United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 79

SEQ ID NO: 3336295 - DNA, 19 bp, Homo sapiens
ctgtccaggcactgctgcc

SEQ ID NO: 3336296 - DNA, 14 bp, Homo sapiens
ctgtccaggccact

SEQ ID NO: 3336297 - DNA, 17 bp, Homo sapiens
ctgtccaggccactgtg

SEQ ID NO: 3336298 - DNA, 22 bp, Homo sapiens
ctgtccaggccactgtggccag

SEQ ID NO: 3336299 - DNA, 18 bp, Homo sapiens
ctgtccatggcctttcta

SEQ ID NO: 3336300 - DNA, 21 bp, Homo sapiens
ctgtccatttatccacaggaa

SEQ ID NO: 3336301 - DNA, 23 bp, Homo sapiens
ctgtcccaatcttaccagatgct

SEQ ID NO: 3336302 - DNA, 22 bp, Homo sapiens
ctgtcccaccgggagcctcccc

SEQ ID NO: 3336303 - DNA, 15 bp, Homo sapiens
ctgtcccacttctca

SEQ ID NO: 3336304 - DNA, 23 bp, Homo sapiens
ctgtccccagccctgtcctggtt

SEQ ID NO: 3336305 - DNA, 18 bp, Homo sapiens
ctgtcccccagctctggt

SEQ ID NO: 3336306 - DNA, 13 bp, Homo sapiens
ctgtccccctacc

SEQ ID NO: 3336307 - DNA, 23 bp, Homo sapiens
ctgtccccctcccctcccagtcc

SEQ ID NO: 3336308 - DNA, 16 bp, Homo sapiens
ctgtcccctcagctcc

SEQ ID NO: 3336309 - DNA, 17 bp, Homo sapiens
ctgtcccctcagctcca

SEQ ID NO: 3336310 - DNA, 14 bp, Homo sapiens
ctgtcccgccttcc

SEQ ID NO: 3336311 - DNA, 18 bp, Homo sapiens
ctgtccctatacactaga

SEQ ID NO: 3336312 - DNA, 12 bp, Homo sapiens
ctgtccctcact

SEQ ID NO: 3336313 - DNA, 13 bp, Homo sapiens
ctgtccctcactg

SEQ ID NO: 3336314 - DNA, 13 bp, Homo sapiens
ctgtccctcccac

SEQ ID NO: 3336315 - DNA, 16 bp, Homo sapiens
ctgtccctcccacctc

SEQ ID NO: 3336316 - DNA, 21 bp, Homo sapiens
ctgtccctcccacctctgtga

SEQ ID NO: 3336317 - DNA, 15 bp, Homo sapiens
ctgtccctccccctt

SEQ ID NO: 3336318 - DNA, 19 bp, Homo sapiens
ctgtccctctagtgccttc

SEQ ID NO: 3336319 - DNA, 13 bp, Homo sapiens
ctgtccctgcagg

SEQ ID NO: 3336320 - DNA, 12 bp, Homo sapiens
ctgtccctgtgg

SEQ ID NO: 3336321 - DNA, 12 bp, Homo sapiens
ctgtcccttcca

SEQ ID NO: 3336322 - DNA, 16 bp, Homo sapiens
ctgtcccttctcttaa

SEQ ID NO: 3336323 - DNA, 13 bp, Homo sapiens
ctgtcccttgcct

SEQ ID NO: 3336324 - DNA, 16 bp, Homo sapiens
ctgtcccttgcctcaa

SEQ ID NO: 3336325 - DNA, 20 bp, Homo sapiens
ctgtcccttgcctcaatgcc

SEQ ID NO: 3336326 - DNA, 15 bp, Homo sapiens
ctgtccggcccagtg

SEQ ID NO: 3336327 - DNA, 22 bp, Homo sapiens
ctgtccggcccagtgccactgc

SEQ ID NO: 3336328 - DNA, 21 bp, Homo sapiens
ctgtccgttcacatgtgtggt

SEQ ID NO: 3336329 - DNA, 19 bp, Homo sapiens
ctgtcctaccagttgccct

SEQ ID NO: 3336330 - DNA, 16 bp, Homo sapiens
ctgtcctcactgctcc

SEQ ID NO: 3336331 - DNA, 19 bp, Homo sapiens
ctgtcctcactgctccctg

SEQ ID NO: 3336332 - DNA, 18 bp, Homo sapiens
ctgtcctcccatcccctg

SEQ ID NO: 3336333 - DNA, 13 bp, Homo sapiens
ctgtcctcctgga

SEQ ID NO: 3336334 - DNA, 17 bp, Homo sapiens
ctgtcctctcgagccca

SEQ ID NO: 3336335 - DNA, 20 bp, Homo sapiens
ctgtcctgatggtcagctcc

SEQ ID NO: 3336336 - DNA, 23 bp, Homo sapiens
ctgtcctgcagcaaacactccac

SEQ ID NO: 3336337 - DNA, 13 bp, Homo sapiens
ctgtcctgcttct

SEQ ID NO: 3336338 - DNA, 15 bp, Homo sapiens
ctgtcctgcttctga

SEQ ID NO: 3336339 - DNA, 13 bp, Homo sapiens
ctgtcctgggagt

SEQ ID NO: 3336340 - DNA, 17 bp, Homo sapiens
ctgtcctggtgtcactt

SEQ ID NO: 3336341 - DNA, 12 bp, Homo sapiens
ctgtcctgtgac

SEQ ID NO: 3336342 - DNA, 17 bp, Homo sapiens
ctgtccttaaagccatt

SEQ ID NO: 3336343 - DNA, 12 bp, Homo sapiens
ctgtccttccct

SEQ ID NO: 3336344 - DNA, 13 bp, Homo sapiens
ctgtcgagacact

SEQ ID NO: 3336345 - DNA, 17 bp, Homo sapiens
ctgtcgcccaggctgga

SEQ ID NO: 3336346 - DNA, 12 bp, Homo sapiens
ctgtcgtgccag

SEQ ID NO: 3336347 - DNA, 17 bp, Homo sapiens
ctgtcgtgccagtcctg

SEQ ID NO: 3336348 - DNA, 19 bp, Homo sapiens
ctgtcgtgccagtcctggg

SEQ ID NO: 3336349 - DNA, 16 bp, Homo sapiens
ctgtctaaaaaccaga

SEQ ID NO: 3336350 - DNA, 13 bp, Homo sapiens
ctgtctaacttta

SEQ ID NO: 3336351 - DNA, 13 bp, Homo sapiens
ctgtctacatttc

SEQ ID NO: 3336352 - DNA, 14 bp, Homo sapiens
ctgtctacctggtc

SEQ ID NO: 3336353 - DNA, 16 bp, Homo sapiens
ctgtctactgtggtga

SEQ ID NO: 3336354 - DNA, 18 bp, Homo sapiens
ctgtctagtctctcctgt

SEQ ID NO: 3336355 - DNA, 17 bp, Homo sapiens
ctgtctatgattgtact

SEQ ID NO: 3336356 - DNA, 19 bp, Homo sapiens
ctgtctatgattgtacttt

SEQ ID NO: 3336357 - DNA, 16 bp, Homo sapiens
ctgtctatgcagcctg

SEQ ID NO: 3336358 - DNA, 17 bp, Homo sapiens
ctgtctatgcagcctgc

SEQ ID NO: 3336359 - DNA, 23 bp, Homo sapiens
ctgtctcaaaaaaacacaaaagt

SEQ ID NO: 3336360 - DNA, 20 bp, Homo sapiens
ctgtctcaagagggcactgg

SEQ ID NO: 3336361 - DNA, 23 bp, Homo sapiens
ctgtctcaagagggcactggtgg

SEQ ID NO: 3336362 - DNA, 20 bp, Homo sapiens
ctgtctcagacttttgtaca

SEQ ID NO: 3336363 - DNA, 12 bp, Homo sapiens
ctgtctcagcct

SEQ ID NO: 3336364 - DNA, 17 bp, Homo sapiens
ctgtctcagtttcactt

SEQ ID NO: 3336365 - DNA, 17 bp, Homo sapiens
ctgtctcatccccaggg

SEQ ID NO: 3336366 - DNA, 17 bp, Homo sapiens
ctgtctcatcctcctgg

SEQ ID NO: 3336367 - DNA, 14 bp, Homo sapiens
ctgtctccactgtg

SEQ ID NO: 3336368 - DNA, 19 bp, Homo sapiens
ctgtctctgaagtactaac

SEQ ID NO: 3336369 - DNA, 13 bp, Homo sapiens
ctgtctctgcctg

SEQ ID NO: 3336370 - DNA, 14 bp, Homo sapiens
ctgtctctgcctgc

SEQ ID NO: 3336371 - DNA, 17 bp, Homo sapiens
ctgtctctgctcgccct

SEQ ID NO: 3336372 - DNA, 21 bp, Homo sapiens
ctgtctcttaaaaaaataaaa

SEQ ID NO: 3336373 - DNA, 19 bp, Homo sapiens
ctgtctctttaagggcatg

SEQ ID NO: 3336374 - DNA, 21 bp, Homo sapiens
ctgtctgaaccacgcgggggc

SEQ ID NO: 3336375 - DNA, 15 bp, Homo sapiens
ctgtctgagactcac

SEQ ID NO: 3336376 - DNA, 14 bp, Homo sapiens
ctgtctgattggct

SEQ ID NO: 3336377 - DNA, 13 bp, Homo sapiens
ctgtctggtggcc

SEQ ID NO: 3336378 - DNA, 16 bp, Homo sapiens
ctgtctggttttaaca

SEQ ID NO: 3336379 - DNA, 18 bp, Homo sapiens
ctgtctggttttaacaat

SEQ ID NO: 3336380 - DNA, 21 bp, Homo sapiens
ctgtctgttctgcacaataaa

SEQ ID NO: 3336381 - DNA, 21 bp, Homo sapiens
ctgtcttcacctgccaccaca

SEQ ID NO: 3336382 - DNA, 14 bp, Homo sapiens
ctgtcttccaagga

SEQ ID NO: 3336383 - DNA, 15 bp, Homo sapiens
ctgtcttccaaggag

SEQ ID NO: 3336384 - DNA, 16 bp, Homo sapiens
ctgtcttctgggcaca

SEQ ID NO: 3336385 - DNA, 15 bp, Homo sapiens
ctgtcttctggtctg

SEQ ID NO: 3336386 - DNA, 18 bp, Homo sapiens
ctgtcttgatgactgctg

SEQ ID NO: 3336387 - DNA, 19 bp, Homo sapiens
ctgtcttgatgactgctga

SEQ ID NO: 3336388 - DNA, 17 bp, Homo sapiens
ctgtctttaaaagagag

SEQ ID NO: 3336389 - DNA, 18 bp, Homo sapiens
ctgtctttatgtttttct

SEQ ID NO: 3336390 - DNA, 18 bp, Homo sapiens
ctgtctttcaaaaggtaa

SEQ ID NO: 3336391 - DNA, 20 bp, Homo sapiens
ctgtctttcagatacatggt

SEQ ID NO: 3336392 - DNA, 18 bp, Homo sapiens
ctgtctttcctgaaccat

SEQ ID NO: 3336393 - DNA, 22 bp, Homo sapiens
ctgtctttggaaaaatgtttgt

SEQ ID NO: 3336394 - DNA, 21 bp, Homo sapiens
ctgtgaaaaaaccgttcaaat

SEQ ID NO: 3336395 - DNA, 23 bp, Homo sapiens
ctgtgaaactggcactgaattaa

SEQ ID NO: 3336396 - DNA, 18 bp, Homo sapiens
ctgtgaaagtacatttgg

SEQ ID NO: 3336397 - DNA, 15 bp, Homo sapiens
ctgtgaacaggctgg

SEQ ID NO: 3336398 - DNA, 21 bp, Homo sapiens
ctgtgaacaggctgggctgct

SEQ ID NO: 3336399 - DNA, 22 bp, Homo sapiens
ctgtgaacgatttagaaagaag

SEQ ID NO: 3336400 - DNA, 17 bp, Homo sapiens
ctgtgaacttgactggg

SEQ ID NO: 3336401 - DNA, 19 bp, Homo sapiens
ctgtgaacttgactgggtg

SEQ ID NO: 3336402 - DNA, 12 bp, Homo sapiens
ctgtgaatacaa

SEQ ID NO: 3336403 - DNA, 13 bp, Homo sapiens
ctgtgaatacaat

SEQ ID NO: 3336404 - DNA, 22 bp, Homo sapiens
ctgtgaatacaattaaaggtcc

SEQ ID NO: 3336405 - DNA, 15 bp, Homo sapiens
ctgtgaatgccactg

SEQ ID NO: 3336406 - DNA, 14 bp, Homo sapiens
ctgtgaatgctaag

SEQ ID NO: 3336407 - DNA, 13 bp, Homo sapiens
ctgtgaatggaag

SEQ ID NO: 3336408 - DNA, 14 bp, Homo sapiens
ctgtgaatggaagc

SEQ ID NO: 3336409 - DNA, 15 bp, Homo sapiens
ctgtgaatggaagca

SEQ ID NO: 3336410 - DNA, 16 bp, Homo sapiens
ctgtgaatggaagcaa

SEQ ID NO: 3336411 - DNA, 14 bp, Homo sapiens
ctgtgaattcagat

SEQ ID NO: 3336412 - DNA, 15 bp, Homo sapiens
ctgtgaattcagatt

SEQ ID NO: 3336413 - DNA, 16 bp, Homo sapiens
ctgtgacaaaggatga

SEQ ID NO: 3336414 - DNA, 23 bp, Homo sapiens
ctgtgacaaaggatgaagaacac

SEQ ID NO: 3336415 - DNA, 17 bp, Homo sapiens
ctgtgacatggtgcctg

SEQ ID NO: 3336416 - DNA, 19 bp, Homo sapiens
ctgtgacatggtgcctgag

SEQ ID NO: 3336417 - DNA, 21 bp, Homo sapiens
ctgtgacatggtgcctgagag

SEQ ID NO: 3336418 - DNA, 23 bp, Homo sapiens
ctgtgacatggtgcctgagaggc

SEQ ID NO: 3336419 - DNA, 22 bp, Homo sapiens
ctgtgaccaccttctgtcccca

SEQ ID NO: 3336420 - DNA, 14 bp, Homo sapiens
ctgtgaccagcact

SEQ ID NO: 3336421 - DNA, 14 bp, Homo sapiens
ctgtgaccatttat

SEQ ID NO: 3336422 - DNA, 19 bp, Homo sapiens
ctgtgaccatttataatgt

SEQ ID NO: 3336423 - DNA, 18 bp, Homo sapiens
ctgtgacccatctgtagt

SEQ ID NO: 3336424 - DNA, 17 bp, Homo sapiens
ctgtgacttcagctctg

SEQ ID NO: 3336425 - DNA, 22 bp, Homo sapiens
ctgtgacttcagctctgtttta

SEQ ID NO: 3336426 - DNA, 16 bp, Homo sapiens
ctgtgagacccccaca

SEQ ID NO: 3336427 - DNA, 20 bp, Homo sapiens
ctgtgagacccccacacctc

SEQ ID NO: 3336428 - DNA, 17 bp, Homo sapiens
ctgtgaggaatgctctg

SEQ ID NO: 3336429 - DNA, 21 bp, Homo sapiens
ctgtgaggaatgctctgtgcc

SEQ ID NO: 3336430 - DNA, 15 bp, Homo sapiens
ctgtgaggcccctgg

SEQ ID NO: 3336431 - DNA, 17 bp, Homo sapiens
ctgtgaggctgtcctgt

SEQ ID NO: 3336432 - DNA, 20 bp, Homo sapiens
ctgtgagtctttggttctaa

SEQ ID NO: 3336433 - DNA, 21 bp, Homo sapiens
ctgtgagtctttggttctaag

SEQ ID NO: 3336434 - DNA, 22 bp, Homo sapiens
ctgtgagtctttggttctaagg

SEQ ID NO: 3336435 - DNA, 23 bp, Homo sapiens
ctgtgagtctttggttctaagga

SEQ ID NO: 3336436 - DNA, 14 bp, Homo sapiens
ctgtgagtgcgtct

SEQ ID NO: 3336437 - DNA, 16 bp, Homo sapiens
ctgtgagtgcgtctga

SEQ ID NO: 3336438 - DNA, 19 bp, Homo sapiens
ctgtgagtgtaagtgtgag

SEQ ID NO: 3336439 - DNA, 18 bp, Homo sapiens
ctgtgataactctgcaaa

SEQ ID NO: 3336440 - DNA, 21 bp, Homo sapiens
ctgtgatcactccagtgcact

SEQ ID NO: 3336441 - DNA, 13 bp, Homo sapiens
ctgtgatcattta

SEQ ID NO: 3336442 - DNA, 19 bp, Homo sapiens
ctgtgatcatttattttaa

SEQ ID NO: 3336443 - DNA, 19 bp, Homo sapiens
ctgtgatccacccaaccct

SEQ ID NO: 3336444 - DNA, 19 bp, Homo sapiens
ctgtgatgacattccctgc

SEQ ID NO: 3336445 - DNA, 15 bp, Homo sapiens
ctgtgatgagctgat

SEQ ID NO: 3336446 - DNA, 14 bp, Homo sapiens
ctgtgatgctgggc

SEQ ID NO: 3336447 - DNA, 21 bp, Homo sapiens
ctgtgcacacacacacacatg

SEQ ID NO: 3336448 - DNA, 15 bp, Homo sapiens
ctgtgcactgccctg

SEQ ID NO: 3336449 - DNA, 16 bp, Homo sapiens
ctgtgcactgccctgt

SEQ ID NO: 3336450 - DNA, 15 bp, Homo sapiens
ctgtgcagcagccca

SEQ ID NO: 3336451 - DNA, 19 bp, Homo sapiens
ctgtgcagcagcccagctt

SEQ ID NO: 3336452 - DNA, 20 bp, Homo sapiens
ctgtgcagcagcccagcttc

SEQ ID NO: 3336453 - DNA, 24 bp, Homo sapiens
ctgtgcagcagcccagcttcctgg

SEQ ID NO: 3336454 - DNA, 15 bp, Homo sapiens
ctgtgcagcgcagct

SEQ ID NO: 3336455 - DNA, 15 bp, Homo sapiens
ctgtgcagggaggag

SEQ ID NO: 3336456 - DNA, 18 bp, Homo sapiens
ctgtgcagtcactggagg

SEQ ID NO: 3336457 - DNA, 20 bp, Homo sapiens
ctgtgcatgggtgaagggag

SEQ ID NO: 3336458 - DNA, 12 bp, Homo sapiens
ctgtgccaacct

SEQ ID NO: 3336459 - DNA, 18 bp, Homo sapiens
ctgtgccacccaccaggg

SEQ ID NO: 3336460 - DNA, 16 bp, Homo sapiens
ctgtgccatgtgccag

SEQ ID NO: 3336461 - DNA, 18 bp, Homo sapiens
ctgtgcccacatcccagg

SEQ ID NO: 3336462 - DNA, 23 bp, Homo sapiens
ctgtgcccacatcccaggcttca

SEQ ID NO: 3336463 - DNA, 17 bp, Homo sapiens
ctgtgccccatgcctgt

SEQ ID NO: 3336464 - DNA, 19 bp, Homo sapiens
ctgtgccctcaccaccaca

SEQ ID NO: 3336465 - DNA, 17 bp, Homo sapiens
ctgtgccctggtggaga

SEQ ID NO: 3336466 - DNA, 16 bp, Homo sapiens
ctgtgcctcctcaccc

SEQ ID NO: 3336467 - DNA, 11 bp, Homo sapiens
ctgtgcctctg

SEQ ID NO: 3336468 - DNA, 14 bp, Homo sapiens
ctgtgcctctgcct

SEQ ID NO: 3336469 - DNA, 17 bp, Homo sapiens
ctgtgcctctgcctgtc

SEQ ID NO: 3336470 - DNA, 14 bp, Homo sapiens
ctgtgcctctggga

SEQ ID NO: 3336471 - DNA, 15 bp, Homo sapiens
ctgtgcctgccatgg

SEQ ID NO: 3336472 - DNA, 17 bp, Homo sapiens
ctgtgcctgccatgggc

SEQ ID NO: 3336473 - DNA, 21 bp, Homo sapiens
ctgtgcctgccatgggccagc

SEQ ID NO: 3336474 - DNA, 22 bp, Homo sapiens
ctgtgcctgccatgggccagcc

SEQ ID NO: 3336475 - DNA, 16 bp, Homo sapiens
ctgtgcctgctagagc

SEQ ID NO: 3336476 - DNA, 21 bp, Homo sapiens
ctgtgcctgctagagcaaccc

SEQ ID NO: 3336477 - DNA, 19 bp, Homo sapiens
ctgtgcgtcccagctgaag

SEQ ID NO: 3336478 - DNA, 18 bp, Homo sapiens
ctgtgctaagtctttccc

SEQ ID NO: 3336479 - DNA, 16 bp, Homo sapiens
ctgtgctatgaatttt

SEQ ID NO: 3336480 - DNA, 13 bp, Homo sapiens
ctgtgctcagaga

SEQ ID NO: 3336481 - DNA, 10 bp, Homo sapiens
ctgtgctccg

SEQ ID NO: 3336482 - DNA, 15 bp, Homo sapiens
ctgtgctctctgtgg

SEQ ID NO: 3336483 - DNA, 21 bp, Homo sapiens
ctgtgctgacatggctctgga

SEQ ID NO: 3336484 - DNA, 20 bp, Homo sapiens
ctgtgctgctgttactgtta

SEQ ID NO: 3336485 - DNA, 23 bp, Homo sapiens
ctgtgctgcttttgagcctcaga

SEQ ID NO: 3336486 - DNA, 16 bp, Homo sapiens
ctgtgctgtgcctgct

SEQ ID NO: 3336487 - DNA, 17 bp, Homo sapiens
ctgtgctgtgcctgcta

SEQ ID NO: 3336488 - DNA, 19 bp, Homo sapiens
ctgtgctgtgcctgctaga

SEQ ID NO: 3336489 - DNA, 21 bp, Homo sapiens
ctgtgctgtgcctgctagagc

SEQ ID NO: 3336490 - DNA, 21 bp, Homo sapiens
ctgtgctgtggagagaagctg

SEQ ID NO: 3336491 - DNA, 15 bp, Homo sapiens
ctgtgctgtggcata

SEQ ID NO: 3336492 - DNA, 11 bp, Homo sapiens
ctgtgctgtgt

SEQ ID NO: 3336493 - DNA, 17 bp, Homo sapiens
ctgtgcttcaattaata

SEQ ID NO: 3336494 - DNA, 22 bp, Homo sapiens
ctgtgcttggatttgcatattt

SEQ ID NO: 3336495 - DNA, 23 bp, Homo sapiens
ctgtggaacccagcagttctgtt

SEQ ID NO: 3336496 - DNA, 22 bp, Homo sapiens
ctgtggaactaataaatacata

SEQ ID NO: 3336497 - DNA, 19 bp, Homo sapiens
ctgtggaccgtggacaggc

SEQ ID NO: 3336498 - DNA, 20 bp, Homo sapiens
ctgtggaccgtggacaggcc

SEQ ID NO: 3336499 - DNA, 24 bp, Homo sapiens
ctgtggaccgtggacaggcccagc

SEQ ID NO: 3336500 - DNA, 23 bp, Homo sapiens
ctgtggagcaaaaggcagctcac

SEQ ID NO: 3336501 - DNA, 11 bp, Homo sapiens
ctgtggagctg

SEQ ID NO: 3336502 - DNA, 17 bp, Homo sapiens
ctgtggagctgccacag

SEQ ID NO: 3336503 - DNA, 20 bp, Homo sapiens
ctgtggagctgccacagaga

SEQ ID NO: 3336504 - DNA, 14 bp, Homo sapiens
ctgtggaggaagga

SEQ ID NO: 3336505 - DNA, 20 bp, Homo sapiens
ctgtggaggaaggattgtaa

SEQ ID NO: 3336506 - DNA, 17 bp, Homo sapiens
ctgtggaggcctgatgc

SEQ ID NO: 3336507 - DNA, 18 bp, Homo sapiens
ctgtggaggcctgatgct

SEQ ID NO: 3336508 - DNA, 15 bp, Homo sapiens
ctgtggatcagagat

SEQ ID NO: 3336509 - DNA, 23 bp, Homo sapiens
ctgtggcacagacttctggaagg

SEQ ID NO: 3336510 - DNA, 15 bp, Homo sapiens
ctgtggcactggcca

SEQ ID NO: 3336511 - DNA, 16 bp, Homo sapiens
ctgtggcagaaaagag

SEQ ID NO: 3336512 - DNA, 22 bp, Homo sapiens
ctgtggcagagttacagttctg

SEQ ID NO: 3336513 - DNA, 14 bp, Homo sapiens
ctgtggcaggcagc

SEQ ID NO: 3336514 - DNA, 17 bp, Homo sapiens
ctgtggcaggcagcgcc

SEQ ID NO: 3336515 - DNA, 16 bp, Homo sapiens
ctgtggccacagcccc

SEQ ID NO: 3336516 - DNA, 17 bp, Homo sapiens
ctgtggccacagccccc

SEQ ID NO: 3336517 - DNA, 19 bp, Homo sapiens
ctgtggccacagccccctt

SEQ ID NO: 3336518 - DNA, 21 bp, Homo sapiens
ctgagaaggaacagggaacat

SEQ ID NO: 3336519 - DNA, 17 bp, Homo sapiens
ctgagaaggcgaggaga

SEQ ID NO: 3336520 - DNA, 18 bp, Homo sapiens
ctgagaaggcgaggagag

SEQ ID NO: 3336521 - DNA, 21 bp, Homo sapiens
ctgagaaggcgaggagagtgg

SEQ ID NO: 3336522 - DNA, 18 bp, Homo sapiens
ctgagaagtcaaacattt

SEQ ID NO: 3336523 - DNA, 14 bp, Homo sapiens
ctgagacagacaca

SEQ ID NO: 3336524 - DNA, 20 bp, Homo sapiens
ctgagacagacacacagcct

SEQ ID NO: 3336525 - DNA, 16 bp, Homo sapiens
ctgagacagtgaattt

SEQ ID NO: 3336526 - DNA, 14 bp, Homo sapiens
ctgagaccagttgg

SEQ ID NO: 3336527 - DNA, 23 bp, Homo sapiens
ctgagaccagttgggagcactgg

SEQ ID NO: 3336528 - DNA, 22 bp, Homo sapiens
ctgagaccatttaacatgcaac

SEQ ID NO: 3336529 - DNA, 19 bp, Homo sapiens
ctgagactcacaggaagga

SEQ ID NO: 3336530 - DNA, 20 bp, Homo sapiens
ctgagactcacaggaaggag

SEQ ID NO: 3336531 - DNA, 12 bp, Homo sapiens
ctgagactccag

SEQ ID NO: 3336532 - DNA, 19 bp, Homo sapiens
ctgagactgtcggagaggc

SEQ ID NO: 3336533 - DNA, 20 bp, Homo sapiens
ctgagactgtcggagaggct

SEQ ID NO: 3336534 - DNA, 20 bp, Homo sapiens
ctgagagaattggctcaata

SEQ ID NO: 3336535 - DNA, 21 bp, Homo sapiens
ctgagagccctgctgtgggag

SEQ ID NO: 3336536 - DNA, 14 bp, Homo sapiens
ctgagaggggaagc

SEQ ID NO: 3336537 - DNA, 14 bp, Homo sapiens
ctgagagtctagat

SEQ ID NO: 3336538 - DNA, 15 bp, Homo sapiens
ctgagagtgaaacca

SEQ ID NO: 3336539 - DNA, 16 bp, Homo sapiens
ctctggaggcctctgg

SEQ ID NO: 3336540 - DNA, 19 bp, Homo sapiens
ctctggaggggtgtggctc

SEQ ID NO: 3336541 - DNA, 20 bp, Homo sapiens
ctctggatatttgcacttat

SEQ ID NO: 3336542 - DNA, 23 bp, Homo sapiens
ctctggcattagaattatttaaa

SEQ ID NO: 3336543 - DNA, 20 bp, Homo sapiens
ctctggccctcggtggctgc

SEQ ID NO: 3336544 - DNA, 11 bp, Homo sapiens
ctctggccctg

SEQ ID NO: 3336545 - DNA, 20 bp, Homo sapiens
ctctggccctggcccttact

SEQ ID NO: 3336546 - DNA, 12 bp, Homo sapiens
ctctggccctgt

SEQ ID NO: 3336547 - DNA, 14 bp, Homo sapiens
ctctggccctgtgt

SEQ ID NO: 3336548 - DNA, 11 bp, Homo sapiens
ctctggccctt

SEQ ID NO: 3336549 - DNA, 13 bp, Homo sapiens
ctctggcccttgg

SEQ ID NO: 3336550 - DNA, 15 bp, Homo sapiens
ctctggcccttggaa

SEQ ID NO: 3336551 - DNA, 19 bp, Homo sapiens
ctctggccgccacccccat

SEQ ID NO: 3336552 - DNA, 13 bp, Homo sapiens
ctctggcctccca

SEQ ID NO: 3336553 - DNA, 22 bp, Homo sapiens
ctctggccttcggcctccatcc

SEQ ID NO: 3336554 - DNA, 15 bp, Homo sapiens
ctctggcggcttcct

SEQ ID NO: 3336555 - DNA, 21 bp, Homo sapiens
ctctggctagaggccagcccc

SEQ ID NO: 3336556 - DNA, 16 bp, Homo sapiens
ctctggctgaaccctg

SEQ ID NO: 3336557 - DNA, 21 bp, Homo sapiens
ctctggctgaaccctgtgctg

SEQ ID NO: 3336558 - DNA, 20 bp, Homo sapiens
ctctggctgtaaggctctag

SEQ ID NO: 3336559 - DNA, 22 bp, Homo sapiens
ctctggctgtaaggctctagat

SEQ ID NO: 3336560 - DNA, 19 bp, Homo sapiens
ctctgggatgcaggcatgc

SEQ ID NO: 3336561 - DNA, 23 bp, Homo sapiens
ctctgggccatgccaggccagag

SEQ ID NO: 3336562 - DNA, 13 bp, Homo sapiens
ctctgggcctggg

SEQ ID NO: 3336563 - DNA, 17 bp, Homo sapiens
ctctgggctcagggctg

SEQ ID NO: 3336564 - DNA, 20 bp, Homo sapiens
ctctgggctcagggctggag

SEQ ID NO: 3336565 - DNA, 19 bp, Homo sapiens
ctctggggaccccaacctc

SEQ ID NO: 3336566 - DNA, 14 bp, Homo sapiens
ctctggggcagatc

SEQ ID NO: 3336567 - DNA, 14 bp, Homo sapiens
ctctggggccctgg

SEQ ID NO: 3336568 - DNA, 15 bp, Homo sapiens
ctctggggccctggg

SEQ ID NO: 3336569 - DNA, 16 bp, Homo sapiens
ctctggggccctgggc

SEQ ID NO: 3336570 - DNA, 18 bp, Homo sapiens
ctctggggccctgggcct

SEQ ID NO: 3336571 - DNA, 14 bp, Homo sapiens
ctctggggctctag

SEQ ID NO: 3336572 - DNA, 16 bp, Homo sapiens
ctctggggctctaggg

SEQ ID NO: 3336573 - DNA, 16 bp, Homo sapiens
ctctggggggcagttg

SEQ ID NO: 3336574 - DNA, 20 bp, Homo sapiens
ctgagggaggaggccacctc

SEQ ID NO: 3336575 - DNA, 22 bp, Homo sapiens
ctgagggaggaggccacctctc

SEQ ID NO: 3336576 - DNA, 18 bp, Homo sapiens
ctgagggattgaggggcc

SEQ ID NO: 3336577 - DNA, 23 bp, Homo sapiens
ctgagggattgaggggccctggc

SEQ ID NO: 3336578 - DNA, 13 bp, Homo sapiens
ctgagggcaaatc

SEQ ID NO: 3336579 - DNA, 19 bp, Homo sapiens
ctgagggcagactggggca

SEQ ID NO: 3336580 - DNA, 13 bp, Homo sapiens
ctgagggccacac

SEQ ID NO: 3336581 - DNA, 15 bp, Homo sapiens
ctgagggccacacta

SEQ ID NO: 3336582 - DNA, 21 bp, Homo sapiens
ctgaggggaggatcactggag

SEQ ID NO: 3336583 - DNA, 23 bp, Homo sapiens
ctgaggggaggatcactggagcc

SEQ ID NO: 3336584 - DNA, 15 bp, Homo sapiens
ctgaggggagggggt

SEQ ID NO: 3336585 - DNA, 18 bp, Homo sapiens
ctgaggggagggggtccg

SEQ ID NO: 3336586 - DNA, 20 bp, Homo sapiens
ctgaggggcatctgcccctc

SEQ ID NO: 3336587 - DNA, 16 bp, Homo sapiens
ctgaggggcttgggaa

SEQ ID NO: 3336588 - DNA, 15 bp, Homo sapiens
ctgagggtccccacc

SEQ ID NO: 3336589 - DNA, 18 bp, Homo sapiens
ctgagggtccccacctgg

SEQ ID NO: 3336590 - DNA, 15 bp, Homo sapiens
ctgagggtggagact

SEQ ID NO: 3336591 - DNA, 17 bp, Homo sapiens
ctgaggtataaagacaa

SEQ ID NO: 3336592 - DNA, 17 bp, Homo sapiens
ctgaggtcagggagtgc

SEQ ID NO: 3336593 - DNA, 13 bp, Homo sapiens
ctgcactaagaga

SEQ ID NO: 3336594 - DNA, 22 bp, Homo sapiens
ctgcactaagagaaaattgcac

SEQ ID NO: 3336595 - DNA, 23 bp, Homo sapiens
ctgcactaagagaaaattgcact

SEQ ID NO: 3336596 - DNA, 16 bp, Homo sapiens
ctgcactactgacatg

SEQ ID NO: 3336597 - DNA, 22 bp, Homo sapiens
ctgcactatagcctaggtgaca

SEQ ID NO: 3336598 - DNA, 15 bp, Homo sapiens
ctgcactccagcctg

SEQ ID NO: 3336599 - DNA, 16 bp, Homo sapiens
ctgcactccagcctgg

SEQ ID NO: 3336600 - DNA, 19 bp, Homo sapiens
ctgcactcccacctgacac

SEQ ID NO: 3336601 - DNA, 22 bp, Homo sapiens
ctgcactctccaccctggctgg

SEQ ID NO: 3336602 - DNA, 11 bp, Homo sapiens
ctgcactgaaa

SEQ ID NO: 3336603 - DNA, 22 bp, Homo sapiens
ctgcactggggagcccgtctca

SEQ ID NO: 3336604 - DNA, 15 bp, Homo sapiens
ctgcacttcagacac

SEQ ID NO: 3336605 - DNA, 16 bp, Homo sapiens
ctgccacactctgacg

SEQ ID NO: 3336606 - DNA, 19 bp, Homo sapiens
ctgccacatacaggtgctc

SEQ ID NO: 3336607 - DNA, 20 bp, Homo sapiens
ctgccacatacaggtgctca

SEQ ID NO: 3336608 - DNA, 16 bp, Homo sapiens
ctgccacatggagccc

SEQ ID NO: 3336609 - DNA, 19 bp, Homo sapiens
ctgccacatggagccccct

SEQ ID NO: 3336610 - DNA, 16 bp, Homo sapiens
ctgccaccacgtctgc

SEQ ID NO: 3336611 - DNA, 15 bp, Homo sapiens
ctgccaccagagacc

SEQ ID NO: 3336612 - DNA, 22 bp, Homo sapiens
ctgccaccagagaccgtcctca

SEQ ID NO: 3336613 - DNA, 18 bp, Homo sapiens
ctgccaccaggccacctc

SEQ ID NO: 3336614 - DNA, 23 bp, Homo sapiens
ctgccaccaggccacctccccag

SEQ ID NO: 3336615 - DNA, 12 bp, Homo sapiens
ctgcccctgcaa

SEQ ID NO: 3336616 - DNA, 20 bp, Homo sapiens
ctgcccctgcaaagacagta

SEQ ID NO: 3336617 - DNA, 13 bp, Homo sapiens
ctgcccctgcgtg

SEQ ID NO: 3336618 - DNA, 21 bp, Homo sapiens
ctgcccctgcgtggcctgagt

SEQ ID NO: 3336619 - DNA, 20 bp, Homo sapiens
ctgcccctgctgtgctgctc

SEQ ID NO: 3336620 - DNA, 18 bp, Homo sapiens
ctgccccttgggcatcca

SEQ ID NO: 3336621 - DNA, 14 bp, Homo sapiens
ctgcccgagctggt

SEQ ID NO: 3336622 - DNA, 16 bp, Homo sapiens
ctgcccgagctggtgc

SEQ ID NO: 3336623 - DNA, 17 bp, Homo sapiens
ctgcccgagctggtgca

SEQ ID NO: 3336624 - DNA, 16 bp, Homo sapiens
ctgcccgcacaccctc

SEQ ID NO: 3336625 - DNA, 16 bp, Homo sapiens
ctgcccgcacagcagc

SEQ ID NO: 3336626 - DNA, 17 bp, Homo sapiens
ctgcccgcacagcagcc

SEQ ID NO: 3336627 - DNA, 19 bp, Homo sapiens
ctgcccgcgggagacagct

SEQ ID NO: 3336628 - DNA, 20 bp, Homo sapiens
ctgcccggtggtttgccatg

SEQ ID NO: 3336629 - DNA, 23 bp, Homo sapiens
ctgcccggtggtttgccatgtcg

SEQ ID NO: 3336630 - DNA, 12 bp, Homo sapiens
ctgccctcatgg

SEQ ID NO: 3336631 - DNA, 21 bp, Homo sapiens
ctgccctcattactgggcctt

SEQ ID NO: 3336632 - DNA, 17 bp, Homo sapiens
ctgccctccccagagca

SEQ ID NO: 3336633 - DNA, 22 bp, Homo sapiens
ctgccctcccctccggactggt

SEQ ID NO: 3336634 - DNA, 17 bp, Homo sapiens
ctgccctccctccttcc

SEQ ID NO: 3336635 - DNA, 16 bp, Homo sapiens
ctgccctcgtggccag

SEQ ID NO: 3336636 - DNA, 19 bp, Homo sapiens
ctgccctcgtggccagccc

SEQ ID NO: 3336637 - DNA, 20 bp, Homo sapiens
ctgccctcgtggccagcccg

SEQ ID NO: 3336638 - DNA, 21 bp, Homo sapiens
ctgccctcgtggccagcccgg

SEQ ID NO: 3336639 - DNA, 22 bp, Homo sapiens
ctgccctcgtggccagcccggc

SEQ ID NO: 3336640 - DNA, 18 bp, Homo sapiens
ctgccctctccttcctta

SEQ ID NO: 3336641 - DNA, 21 bp, Homo sapiens
ctgccctgagaagctgctcca

SEQ ID NO: 3336642 - DNA, 17 bp, Homo sapiens
ctgccctgcctgcccac

SEQ ID NO: 3336643 - DNA, 21 bp, Homo sapiens
ctgccctgctgccgcctccca

SEQ ID NO: 3336644 - DNA, 17 bp, Homo sapiens
ctgccctggcagggtca

SEQ ID NO: 3336645 - DNA, 14 bp, Homo sapiens
ctgccctggccctg

SEQ ID NO: 3336646 - DNA, 15 bp, Homo sapiens
ctgccctggccctga

SEQ ID NO: 3336647 - DNA, 18 bp, Homo sapiens
ctgccctggccctgaggt

SEQ ID NO: 3336648 - DNA, 23 bp, Homo sapiens
ctgccctggccctgaggtgtggg

SEQ ID NO: 3336649 - DNA, 20 bp, Homo sapiens
ctgccctggctgctgccccc

SEQ ID NO: 3336650 - DNA, 14 bp, Homo sapiens
ctgccctggtccag

SEQ ID NO: 3336651 - DNA, 21 bp, Homo sapiens
ctgccctggtccagggaagct

SEQ ID NO: 3336652 - DNA, 17 bp, Homo sapiens
ctgccctggtgctgcca

SEQ ID NO: 3336653 - DNA, 15 bp, Homo sapiens
ctgccctgtccctgt

SEQ ID NO: 3336654 - DNA, 16 bp, Homo sapiens
ctgccctgtccctgtc

SEQ ID NO: 3336655 - DNA, 12 bp, Homo sapiens
ctgccctgtgta

SEQ ID NO: 3336656 - DNA, 21 bp, Homo sapiens
ctgccctgttgtgtatagatg

SEQ ID NO: 3336657 - DNA, 14 bp, Homo sapiens
ctgcccttgctgcc

SEQ ID NO: 3336658 - DNA, 15 bp, Homo sapiens
ctgccctttcctagg

SEQ ID NO: 3336659 - DNA, 16 bp, Homo sapiens
ctgccgacatcagcat

SEQ ID NO: 3336660 - DNA, 16 bp, Homo sapiens
ctgccgaccagagccc

SEQ ID NO: 3336661 - DNA, 15 bp, Homo sapiens
ctgccgacttggaga

SEQ ID NO: 3336662 - DNA, 16 bp, Homo sapiens
ctgccgcagacgggca

SEQ ID NO: 3336663 - DNA, 18 bp, Homo sapiens
ctgccgcagacgggcaca

SEQ ID NO: 3336664 - DNA, 20 bp, Homo sapiens
ctgccgcagacgggcacaga

SEQ ID NO: 3336665 - DNA, 19 bp, Homo sapiens
ctgccgcctcccagcctgg

SEQ ID NO: 3336666 - DNA, 13 bp, Homo sapiens
ctgccgctacctc

SEQ ID NO: 3336667 - DNA, 17 bp, Homo sapiens
ctgccgctacctccctc

SEQ ID NO: 3336668 - DNA, 14 bp, Homo sapiens
ctgccgctgcacca

SEQ ID NO: 3336669 - DNA, 14 bp, Homo sapiens
ctgccgggttctag

SEQ ID NO: 3336670 - DNA, 19 bp, Homo sapiens
ctgccgggttctagtctcc

SEQ ID NO: 3336671 - DNA, 23 bp, Homo sapiens
ctgccgggttctagtctcctttg

SEQ ID NO: 3336672 - DNA, 21 bp, Homo sapiens
ctgccggtcgggcagccagca

SEQ ID NO: 3336673 - DNA, 22 bp, Homo sapiens
ctgccggtcgggcagccagcag

SEQ ID NO: 3336674 - DNA, 14 bp, Homo sapiens
ctgccggtgggacc

SEQ ID NO: 3336675 - DNA, 23 bp, Homo sapiens
ctgccggttcttaaatccatcct

SEQ ID NO: 3336676 - DNA, 22 bp, Homo sapiens
ctgccgtgggcctgtcgtgcca

SEQ ID NO: 3336677 - DNA, 14 bp, Homo sapiens
ctgcctaaccaggc

SEQ ID NO: 3336678 - DNA, 16 bp, Homo sapiens
ctgcctaaccaggccc

SEQ ID NO: 3336679 - DNA, 18 bp, Homo sapiens
ctgcctaaccaggcccag

SEQ ID NO: 3336680 - DNA, 20 bp, Homo sapiens
ctgcctaaccaggcccagcc

SEQ ID NO: 3336681 - DNA, 21 bp, Homo sapiens
ctgcctaaccaggcccagcca

SEQ ID NO: 3336682 - DNA, 20 bp, Homo sapiens
ctgcctagaatctttattca

SEQ ID NO: 3336683 - DNA, 18 bp, Homo sapiens
ctgcctagagtgtagcct

SEQ ID NO: 3336684 - DNA, 17 bp, Homo sapiens
ctgcctagctgcctagc

SEQ ID NO: 3336685 - DNA, 21 bp, Homo sapiens
ctgcctagctgcctagcaagc

SEQ ID NO: 3336686 - DNA, 16 bp, Homo sapiens
ctgcctaggtttttcc

SEQ ID NO: 3336687 - DNA, 23 bp, Homo sapiens
ctgcctaggtttttcctactgtc

SEQ ID NO: 3336688 - DNA, 15 bp, Homo sapiens
ctgcctcaccgcttc

SEQ ID NO: 3336689 - DNA, 12 bp, Homo sapiens
ctgcctcagcct

SEQ ID NO: 3336690 - DNA, 15 bp, Homo sapiens
ctgcctcagcctccc

SEQ ID NO: 3336691 - DNA, 19 bp, Homo sapiens
ctgcctcagcctcccaaag

SEQ ID NO: 3336692 - DNA, 23 bp, Homo sapiens
ctgcctcaggaggcaggaccttc

SEQ ID NO: 3336693 - DNA, 17 bp, Homo sapiens
ctgcctcaggttcctat

SEQ ID NO: 3336694 - DNA, 12 bp, Homo sapiens
ctgcctcagtgg

SEQ ID NO: 3336695 - DNA, 13 bp, Homo sapiens
ctgcctcagtggc

SEQ ID NO: 3336696 - DNA, 16 bp, Homo sapiens
ctgcctcagtggcagc

SEQ ID NO: 3336697 - DNA, 22 bp, Homo sapiens
ctgcctcagtggcagcatcctc

SEQ ID NO: 3336698 - DNA, 22 bp, Homo sapiens
ctgcctccagaatggtctttct

SEQ ID NO: 3336699 - DNA, 18 bp, Homo sapiens
ctgcctccattctgacca

SEQ ID NO: 3336700 - DNA, 14 bp, Homo sapiens
ctgcctcccacttc

SEQ ID NO: 3336701 - DNA, 13 bp, Homo sapiens
ctgcctcccatgc

SEQ ID NO: 3336702 - DNA, 19 bp, Homo sapiens
ctgcctcctcgttcctttc

SEQ ID NO: 3336703 - DNA, 24 bp, Homo sapiens
ctgcctcctcttcaactgaccagc

SEQ ID NO: 3336704 - DNA, 19 bp, Homo sapiens
ctgcctcgaaacacagaaa

SEQ ID NO: 3336705 - DNA, 15 bp, Homo sapiens
ctgcctcgaactggc

SEQ ID NO: 3336706 - DNA, 20 bp, Homo sapiens
ctgcctcgaactggctgcaa

SEQ ID NO: 3336707 - DNA, 21 bp, Homo sapiens
ctgcctctcgctcctcaaccc

SEQ ID NO: 3336708 - DNA, 22 bp, Homo sapiens
ctgcctctgacacacagctctg

SEQ ID NO: 3336709 - DNA, 13 bp, Homo sapiens
ctgcctctgccac

SEQ ID NO: 3336710 - DNA, 12 bp, Homo sapiens
ctgcctctgcct

SEQ ID NO: 3336711 - DNA, 11 bp, Homo sapiens
ctgcctctgct

SEQ ID NO: 3336712 - DNA, 17 bp, Homo sapiens
ctgcctctgctccctct

SEQ ID NO: 3336713 - DNA, 18 bp, Homo sapiens
ctgcctgaaacagccatg

SEQ ID NO: 3336714 - DNA, 19 bp, Homo sapiens
ctgcctgaaacagccatgt

SEQ ID NO: 3336715 - DNA, 12 bp, Homo sapiens
ctgcctgaaagc

SEQ ID NO: 3336716 - DNA, 16 bp, Homo sapiens
ctgcctgaagtcacac

SEQ ID NO: 3336717 - DNA, 18 bp, Homo sapiens
ctgcctgaagtcacacag

SEQ ID NO: 3336718 - DNA, 19 bp, Homo sapiens
ctgcctgaagtcacacagt

SEQ ID NO: 3336719 - DNA, 23 bp, Homo sapiens
ctgcctgaagtcacacagtgagt

SEQ ID NO: 3336720 - DNA, 18 bp, Homo sapiens
ctgcctgacactgagccc

SEQ ID NO: 3336721 - DNA, 20 bp, Homo sapiens
ctgcctgcagtactttacct

SEQ ID NO: 3336722 - DNA, 19 bp, Homo sapiens
ctgcctgcccacttagccg

SEQ ID NO: 3336723 - DNA, 17 bp, Homo sapiens
ctgcctgccccacacgg

SEQ ID NO: 3336724 - DNA, 22 bp, Homo sapiens
ctgcctggagacttagggcacc

SEQ ID NO: 3336725 - DNA, 11 bp, Homo sapiens
ctgcctggccc

SEQ ID NO: 3336726 - DNA, 12 bp, Homo sapiens
ctgcctggcccc

SEQ ID NO: 3336727 - DNA, 15 bp, Homo sapiens
ctgcctggcccccaa

SEQ ID NO: 3336728 - DNA, 22 bp, Homo sapiens
ctgcctggcccccaacctcagg

SEQ ID NO: 3336729 - DNA, 23 bp, Homo sapiens
ctgcctggcccccaacctcaggg

SEQ ID NO: 3336730 - DNA, 11 bp, Homo sapiens
ctgcctggcct

SEQ ID NO: 3336731 - DNA, 12 bp, Homo sapiens
ctgcctggcctg

SEQ ID NO: 3336732 - DNA, 14 bp, Homo sapiens
ctgcctggcctggc

SEQ ID NO: 3336733 - DNA, 19 bp, Homo sapiens
ctgcctgggaacacgtgtg

SEQ ID NO: 3336734 - DNA, 18 bp, Homo sapiens
ctgcctgggcctgtgcag

SEQ ID NO: 3336735 - DNA, 23 bp, Homo sapiens
ctgcctgggcctgtgcagcagcc

SEQ ID NO: 3336736 - DNA, 15 bp, Homo sapiens
ctgcctgggctgttg

SEQ ID NO: 3336737 - DNA, 16 bp, Homo sapiens
ctgcctgggctgttgg

SEQ ID NO: 3336738 - DNA, 18 bp, Homo sapiens
ctgcctgggctgttggca

SEQ ID NO: 3336739 - DNA, 14 bp, Homo sapiens
ctgcctgggtggga

SEQ ID NO: 3336740 - DNA, 19 bp, Homo sapiens
ctgcctgggtgggacagcc

SEQ ID NO: 3336741 - DNA, 22 bp, Homo sapiens
ctgcctgggttccaatcctggc

SEQ ID NO: 3336742 - DNA, 15 bp, Homo sapiens
ctgcctgtagttagg

SEQ ID NO: 3336743 - DNA, 17 bp, Homo sapiens
ctgcctgtagttaggaa

SEQ ID NO: 3336744 - DNA, 13 bp, Homo sapiens
ctgcctgtatact

SEQ ID NO: 3336745 - DNA, 14 bp, Homo sapiens
ctgcctgtgcctgc

SEQ ID NO: 3336746 - DNA, 13 bp, Homo sapiens
ctgcctgtggagt

SEQ ID NO: 3336747 - DNA, 23 bp, Homo sapiens
ctgcctgtggcgccgtctccagg

SEQ ID NO: 3336748 - DNA, 17 bp, Homo sapiens
ctgcctgttataactct

SEQ ID NO: 3336749 - DNA, 22 bp, Homo sapiens
ctgcctgttataactctgcact

SEQ ID NO: 3336750 - DNA, 17 bp, Homo sapiens
ctgcctgttcagctcca

SEQ ID NO: 3336751 - DNA, 16 bp, Homo sapiens
ctgccttactggtttc

SEQ ID NO: 3336752 - DNA, 22 bp, Homo sapiens
ctgccttactggtttccccagg

SEQ ID NO: 3336753 - DNA, 15 bp, Homo sapiens
ctgccttagaggagc

SEQ ID NO: 3336754 - DNA, 23 bp, Homo sapiens
ctgccttagaggagcccacggct

SEQ ID NO: 3336755 - DNA, 20 bp, Homo sapiens
ctgccttagtctcagtttgt

SEQ ID NO: 3336756 - DNA, 18 bp, Homo sapiens
ctgccttcccatgaatct

SEQ ID NO: 3336757 - DNA, 11 bp, Homo sapiens
ctgccttccct

SEQ ID NO: 3336758 - DNA, 13 bp, Homo sapiens
ctgccttcgcttc

SEQ ID NO: 3336759 - DNA, 14 bp, Homo sapiens
ctgccttcgcttct

SEQ ID NO: 3336760 - DNA, 17 bp, Homo sapiens
ctgccttcgcttcttgc

SEQ ID NO: 3336761 - DNA, 20 bp, Homo sapiens
ctgccttcgttaactgtgta

SEQ ID NO: 3336762 - DNA, 18 bp, Homo sapiens
ctgccttctcctctctgg

SEQ ID NO: 3336763 - DNA, 21 bp, Homo sapiens
ctgccttctcctctctgggcc

SEQ ID NO: 3336764 - DNA, 18 bp, Homo sapiens
ctgccttctgacggccct

SEQ ID NO: 3336765 - DNA, 23 bp, Homo sapiens
ctgccttctgacggccctgcaat

SEQ ID NO: 3336766 - DNA, 22 bp, Homo sapiens
ctgccttgaagccactgaagct

SEQ ID NO: 3336767 - DNA, 18 bp, Homo sapiens
ctgccttgctcctagcag

SEQ ID NO: 3336768 - DNA, 23 bp, Homo sapiens
ctgccttggactgtgtttttcct

SEQ ID NO: 3336769 - DNA, 12 bp, Homo sapiens
ctgccttggcct

SEQ ID NO: 3336770 - DNA, 19 bp, Homo sapiens
ctgccttgggccttgctgc

SEQ ID NO: 3336771 - DNA, 15 bp, Homo sapiens
ctgccttgtccctct

SEQ ID NO: 3336772 - DNA, 20 bp, Homo sapiens
ctgcctttaagccaaagaaa

SEQ ID NO: 3336773 - DNA, 20 bp, Homo sapiens
ctgcctttgcagttggactc

SEQ ID NO: 3336774 - DNA, 23 bp, Homo sapiens
ctgcctttgcagttggactctca

SEQ ID NO: 3336775 - DNA, 14 bp, Homo sapiens
ctgcctttttgtcg

SEQ ID NO: 3336776 - DNA, 22 bp, Homo sapiens
ctgcgaagaccctcttgcccat

SEQ ID NO: 3336777 - DNA, 14 bp, Homo sapiens
ctgcgactttctgc

SEQ ID NO: 3336778 - DNA, 18 bp, Homo sapiens
ctgcgactttctgcctgg

SEQ ID NO: 3336779 - DNA, 20 bp, Homo sapiens
ctgcgactttctgcctggag

SEQ ID NO: 3336780 - DNA, 15 bp, Homo sapiens
ctgcgcaccaatgcc

SEQ ID NO: 3336781 - DNA, 20 bp, Homo sapiens
ctgcgcaccaatgcccagca

SEQ ID NO: 3336782 - DNA, 21 bp, Homo sapiens
ctgcgcaccaatgcccagcag

SEQ ID NO: 3336783 - DNA, 23 bp, Homo sapiens
ctgcgcaccaatgcccagcaggg

SEQ ID NO: 3336784 - DNA, 16 bp, Homo sapiens
ctgcgccacttccttt

SEQ ID NO: 3336785 - DNA, 18 bp, Homo sapiens
ctgcgctcggcaggaagg

SEQ ID NO: 3336786 - DNA, 14 bp, Homo sapiens
ctgcggaccccagc

SEQ ID NO: 3336787 - DNA, 15 bp, Homo sapiens
ctgcggaccccagct

SEQ ID NO: 3336788 - DNA, 23 bp, Homo sapiens
ctgcggaccccagctgtgagcct

SEQ ID NO: 3336789 - DNA, 15 bp, Homo sapiens
ctgcggaggagctgc

SEQ ID NO: 3336790 - DNA, 19 bp, Homo sapiens
ctgcggagtgaagaggggc

SEQ ID NO: 3336791 - DNA, 17 bp, Homo sapiens
ctgcgggagctctgtat

SEQ ID NO: 3336792 - DNA, 15 bp, Homo sapiens
ctgcgggaggccctg

SEQ ID NO: 3336793 - DNA, 16 bp, Homo sapiens
ctgcgggaggccctgg

SEQ ID NO: 3336794 - DNA, 18 bp, Homo sapiens
ctgcgggaggccctggcc

SEQ ID NO: 3336795 - DNA, 21 bp, Homo sapiens
ctgcgggaggccctggccctt

SEQ ID NO: 3336796 - DNA, 17 bp, Homo sapiens
ctgcgggatggtcctgg

SEQ ID NO: 3336797 - DNA, 22 bp, Homo sapiens
ctgcgggatggtcctggggctc

SEQ ID NO: 3336798 - DNA, 15 bp, Homo sapiens
ctgcggggagacaga

SEQ ID NO: 3336799 - DNA, 16 bp, Homo sapiens
ctgcggggcagggcct

SEQ ID NO: 3336800 - DNA, 16 bp, Homo sapiens
ctgcggtccacccagg

SEQ ID NO: 3336801 - DNA, 18 bp, Homo sapiens
ctgcggtccacccaggag

SEQ ID NO: 3336802 - DNA, 16 bp, Homo sapiens
ctgcgtccccactccc

SEQ ID NO: 3336803 - DNA, 13 bp, Homo sapiens
ctgcgtcctcctc

SEQ ID NO: 3336804 - DNA, 15 bp, Homo sapiens
ctgcgtcctcctcac

SEQ ID NO: 3336805 - DNA, 19 bp, Homo sapiens
ctgcgtcctcctcacctca

SEQ ID NO: 3336806 - DNA, 19 bp, Homo sapiens
ctgcgtcctgacgccctgc

SEQ ID NO: 3336807 - DNA, 22 bp, Homo sapiens
ctgcgtgccagtcaagaagaaa

SEQ ID NO: 3336808 - DNA, 14 bp, Homo sapiens
ctgcgtggcctgag

SEQ ID NO: 3336809 - DNA, 15 bp, Homo sapiens
ctgcgtggcctgagt

SEQ ID NO: 3336810 - DNA, 21 bp, Homo sapiens
ctgcgttggagccactcctgt

SEQ ID NO: 3336811 - DNA, 23 bp, Homo sapiens
ctgcgttggagccactcctgtcc

SEQ ID NO: 3336812 - DNA, 16 bp, Homo sapiens
ctgcgttggtccagag

SEQ ID NO: 3336813 - DNA, 14 bp, Homo sapiens
ctgctaaatcctca

SEQ ID NO: 3336814 - DNA, 12 bp, Homo sapiens
ctgctaaatctc

SEQ ID NO: 3336815 - DNA, 17 bp, Homo sapiens
ctgctaaattctatgtt

SEQ ID NO: 3336816 - DNA, 14 bp, Homo sapiens
ctgctaacctggaa

SEQ ID NO: 3336817 - DNA, 19 bp, Homo sapiens
ctgctaaggctcctccttg

SEQ ID NO: 3336818 - DNA, 20 bp, Homo sapiens
ctgctaatgcaaattaaaac

SEQ ID NO: 3336819 - DNA, 16 bp, Homo sapiens
ctgctaattccccaga

SEQ ID NO: 3336820 - DNA, 23 bp, Homo sapiens
ctgctacaaatactcttaggaag

SEQ ID NO: 3336821 - DNA, 12 bp, Homo sapiens
ctgctacagcaa

SEQ ID NO: 3336822 - DNA, 12 bp, Homo sapiens
ctgctacaggag

SEQ ID NO: 3336823 - DNA, 13 bp, Homo sapiens
ctgctacaggagg

SEQ ID NO: 3336824 - DNA, 14 bp, Homo sapiens
ctgctaccagcgcc

SEQ ID NO: 3336825 - DNA, 19 bp, Homo sapiens
ctgctaccgccctgggctg

SEQ ID NO: 3336826 - DNA, 21 bp, Homo sapiens
ctgctaccgccctgggctgga

SEQ ID NO: 3336827 - DNA, 16 bp, Homo sapiens
ctgctacctctgagaa

SEQ ID NO: 3336828 - DNA, 14 bp, Homo sapiens
ctgctacctgttct

SEQ ID NO: 3336829 - DNA, 12 bp, Homo sapiens
ctgctagaactt

SEQ ID NO: 3336830 - DNA, 13 bp, Homo sapiens
ctgctagaacttt

SEQ ID NO: 3336831 - DNA, 23 bp, Homo sapiens
ctgctagaacttttttaaataaa

SEQ ID NO: 3336832 - DNA, 16 bp, Homo sapiens
ctgctagagcaacccc

SEQ ID NO: 3336833 - DNA, 19 bp, Homo sapiens
ctgctagagcaacccctgt

SEQ ID NO: 3336834 - DNA, 16 bp, Homo sapiens
ctgctagatttctaca

SEQ ID NO: 3336835 - DNA, 23 bp, Homo sapiens
ctgctagattttaatttatttgt

SEQ ID NO: 3336836 - DNA, 22 bp, Homo sapiens
ctgctatacacaagcaatgcaa

SEQ ID NO: 3336837 - DNA, 23 bp, Homo sapiens
ctgctatccccatctccctgcct

SEQ ID NO: 3336838 - DNA, 21 bp, Homo sapiens
ctgctatgaaaatgagcatca

SEQ ID NO: 3336839 - DNA, 21 bp, Homo sapiens
ctgctatttattttcctaaag

SEQ ID NO: 3336840 - DNA, 15 bp, Homo sapiens
ctgctatttctcttg

SEQ ID NO: 3336841 - DNA, 17 bp, Homo sapiens
ctgctatttctcttgct

SEQ ID NO: 3336842 - DNA, 22 bp, Homo sapiens
ctgctcaactctacccctgctc

SEQ ID NO: 3336843 - DNA, 16 bp, Homo sapiens
ctgctcaaggccacag

SEQ ID NO: 3336844 - DNA, 15 bp, Homo sapiens
ctgctcaccgcccat

SEQ ID NO: 3336845 - DNA, 11 bp, Homo sapiens
ctgctcagcca

SEQ ID NO: 3336846 - DNA, 19 bp, Homo sapiens
ctgctcagtgcttgggctc

SEQ ID NO: 3336847 - DNA, 22 bp, Homo sapiens
ctgctcagtgcttgggctccac

SEQ ID NO: 3336848 - DNA, 15 bp, Homo sapiens
ctgctcatattgtga

SEQ ID NO: 3336849 - DNA, 15 bp, Homo sapiens
ctgctcatccaaagt

SEQ ID NO: 3336850 - DNA, 17 bp, Homo sapiens
ctgctcatccaaagttg

SEQ ID NO: 3336851 - DNA, 11 bp, Homo sapiens
ctgctccacca

SEQ ID NO: 3336852 - DNA, 18 bp, Homo sapiens
ctgctccaccagcagcat

SEQ ID NO: 3336853 - DNA, 12 bp, Homo sapiens
ctgctccaccct

SEQ ID NO: 3336854 - DNA, 13 bp, Homo sapiens
ctgctccaccctc

SEQ ID NO: 3336855 - DNA, 14 bp, Homo sapiens
ctgctccaccctcc

SEQ ID NO: 3336856 - DNA, 19 bp, Homo sapiens
ctgctccaccctcccccag

SEQ ID NO: 3336857 - DNA, 13 bp, Homo sapiens
ctgctccaccctt

SEQ ID NO: 3336858 - DNA, 18 bp, Homo sapiens
ctgctccagaatttggaa

SEQ ID NO: 3336859 - DNA, 20 bp, Homo sapiens
ctgctccagaatttggaaat

SEQ ID NO: 3336860 - DNA, 23 bp, Homo sapiens
ctgctccagaatttggaaatcct

SEQ ID NO: 3336861 - DNA, 15 bp, Homo sapiens
ctgctccaggcctgc

SEQ ID NO: 3336862 - DNA, 19 bp, Homo sapiens
ctgctccaggcctgcagca

SEQ ID NO: 3336863 - DNA, 12 bp, Homo sapiens
ctgctccaggga

SEQ ID NO: 3336864 - DNA, 15 bp, Homo sapiens
ctgctccatgactgg

SEQ ID NO: 3336865 - DNA, 18 bp, Homo sapiens
ctgcttcccatcctaccc

SEQ ID NO: 3336866 - DNA, 19 bp, Homo sapiens
ctgcttcccatcctaccct

SEQ ID NO: 3336867 - DNA, 18 bp, Homo sapiens
ctgcttccccttcctaag

SEQ ID NO: 3336868 - DNA, 20 bp, Homo sapiens
ctgcttcccttactttgctg

SEQ ID NO: 3336869 - DNA, 18 bp, Homo sapiens
ctgcttcctcctggaaat

SEQ ID NO: 3336870 - DNA, 23 bp, Homo sapiens
ctgcttcctgaaataaacactgg

SEQ ID NO: 3336871 - DNA, 17 bp, Homo sapiens
ctgcttcctggtctggc

SEQ ID NO: 3336872 - DNA, 23 bp, Homo sapiens
ctcgtggttattagcaaggctgg

SEQ ID NO: 3336873 - DNA, 22 bp, Homo sapiens
ctcgtgtcagctcaggcagctc

SEQ ID NO: 3336874 - DNA, 15 bp, Homo sapiens
ctcgttcaaaacatt

SEQ ID NO: 3336875 - DNA, 18 bp, Homo sapiens
ctcgttcaaaacattcca

SEQ ID NO: 3336876 - DNA, 14 bp, Homo sapiens
ctctaaaaaagaac

SEQ ID NO: 3336877 - DNA, 16 bp, Homo sapiens
ctctaaaaggttcagg

SEQ ID NO: 3336878 - DNA, 18 bp, Homo sapiens
ctctaaaaggttcaggga

SEQ ID NO: 3336879 - DNA, 15 bp, Homo sapiens
ctctaaagaccaaac

SEQ ID NO: 3336880 - DNA, 19 bp, Homo sapiens
ctctaaagaccaaacttca

SEQ ID NO: 3336881 - DNA, 16 bp, Homo sapiens
ctctaacaggcacttt

SEQ ID NO: 3336882 - DNA, 17 bp, Homo sapiens
ctctaacaggcactttg

SEQ ID NO: 3336883 - DNA, 16 bp, Homo sapiens
ctctaactcctgccat

SEQ ID NO: 3336884 - DNA, 19 bp, Homo sapiens
ctctaagatcttagattct

SEQ ID NO: 3336885 - DNA, 12 bp, Homo sapiens
ctctaagctgtg

SEQ ID NO: 3336886 - DNA, 14 bp, Homo sapiens
ctctaatattgctt

SEQ ID NO: 3336887 - DNA, 17 bp, Homo sapiens
ctctaatcgaaagaaaa

SEQ ID NO: 3336888 - DNA, 17 bp, Homo sapiens
ctctaattcacagtgct

SEQ ID NO: 3336889 - DNA, 20 bp, Homo sapiens
ctctaattcacagtgctctt

SEQ ID NO: 3336890 - DNA, 16 bp, Homo sapiens
ctctacaaactcccac

SEQ ID NO: 3336891 - DNA, 17 bp, Homo sapiens
ctctacaattggaagat

SEQ ID NO: 3336892 - DNA, 19 bp, Homo sapiens
ctctacagaggccatgggc

SEQ ID NO: 3336893 - DNA, 17 bp, Homo sapiens
ctctaccaaataatttc

SEQ ID NO: 3336894 - DNA, 15 bp, Homo sapiens
ctctacccatgagcc

SEQ ID NO: 3336895 - DNA, 17 bp, Homo sapiens
ctctacccatgagcctg

SEQ ID NO: 3336896 - DNA, 13 bp, Homo sapiens
ctctaccctggca

SEQ ID NO: 3336897 - DNA, 22 bp, Homo sapiens
ctctacctccttagctttccct

SEQ ID NO: 3336898 - DNA, 19 bp, Homo sapiens
ctctactaaaaatacagaa

SEQ ID NO: 3336899 - DNA, 19 bp, Homo sapiens
ctctactaccacaaggaaa

SEQ ID NO: 3336900 - DNA, 13 bp, Homo sapiens
ctctactgtgcat

SEQ ID NO: 3336901 - DNA, 17 bp, Homo sapiens
ctctactttccaggcta

SEQ ID NO: 3336902 - DNA, 12 bp, Homo sapiens
ctctagaaattt

SEQ ID NO: 3336903 - DNA, 19 bp, Homo sapiens
ctctagaagccaagggaaa

SEQ ID NO: 3336904 - DNA, 20 bp, Homo sapiens
ctctagaattttaagtgctt

SEQ ID NO: 3336905 - DNA, 13 bp, Homo sapiens
ctctagagcaggg

SEQ ID NO: 3336906 - DNA, 16 bp, Homo sapiens
ctctagagcagggatt

SEQ ID NO: 3336907 - DNA, 20 bp, Homo sapiens
ctctagaggatgaaggctgt

SEQ ID NO: 3336908 - DNA, 16 bp, Homo sapiens
ctctagagtccaaggt

SEQ ID NO: 3336909 - DNA, 14 bp, Homo sapiens
ctctagcaggccta

SEQ ID NO: 3336910 - DNA, 17 bp, Homo sapiens
ctctagctctctaggcc

SEQ ID NO: 3336911 - DNA, 12 bp, Homo sapiens
ctctagctggca

SEQ ID NO: 3336912 - DNA, 13 bp, Homo sapiens
ctctagctggcag

SEQ ID NO: 3336913 - DNA, 18 bp, Homo sapiens
ctctagctggcaggacac

SEQ ID NO: 3336914 - DNA, 21 bp, Homo sapiens
ctctaggagggagccttgtga

SEQ ID NO: 3336915 - DNA, 22 bp, Homo sapiens
ctctaggatgtatattttatat

SEQ ID NO: 3336916 - DNA, 20 bp, Homo sapiens
ctctaggcaagcaggacctg

SEQ ID NO: 3336917 - DNA, 18 bp, Homo sapiens
ctctagggttgctggagc

SEQ ID NO: 3336918 - DNA, 21 bp, Homo sapiens
ctctagggttgctggagcctg

SEQ ID NO: 3336919 - DNA, 19 bp, Homo sapiens
ctctaggtgtgtccacaga

SEQ ID NO: 3336920 - DNA, 14 bp, Homo sapiens
ctctagtgccctcc

SEQ ID NO: 3336921 - DNA, 18 bp, Homo sapiens
ctctagtgccctccacag

SEQ ID NO: 3336922 - DNA, 17 bp, Homo sapiens
ctctagtgcggtttact

SEQ ID NO: 3336923 - DNA, 22 bp, Homo sapiens
ctctagtgtattatcactgtct

SEQ ID NO: 3336924 - DNA, 13 bp, Homo sapiens
ctctagttctttg

SEQ ID NO: 3336925 - DNA, 18 bp, Homo sapiens
ctctatacatctctcccc

SEQ ID NO: 3336926 - DNA, 15 bp, Homo sapiens
ctctatattatgtct

SEQ ID NO: 3336927 - DNA, 21 bp, Homo sapiens
ctctatattatgtcttctttt

SEQ ID NO: 3336928 - DNA, 22 bp, Homo sapiens
ctctatccaaagaacttgattt

SEQ ID NO: 3336929 - DNA, 23 bp, Homo sapiens
ctctatccaaagaacttgatttg

SEQ ID NO: 3336930 - DNA, 19 bp, Homo sapiens
ctctatgccccaaatatag

SEQ ID NO: 3336931 - DNA, 22 bp, Homo sapiens
ctctattgggcacagcctaggg

SEQ ID NO: 3336932 - DNA, 12 bp, Homo sapiens
ctctatttaaat

SEQ ID NO: 3336933 - DNA, 14 bp, Homo sapiens
ctctatttaaattc

SEQ ID NO: 3336934 - DNA, 15 bp, Homo sapiens
ctctatttaatattt

SEQ ID NO: 3336935 - DNA, 19 bp, Homo sapiens
ctctatttattagccaact

SEQ ID NO: 3336936 - DNA, 14 bp, Homo sapiens
ctctatttgagaat

SEQ ID NO: 3336937 - DNA, 15 bp, Homo sapiens
ctctattttgtgatg

SEQ ID NO: 3336938 - DNA, 18 bp, Homo sapiens
ctctattttgtgatgatg

SEQ ID NO: 3336939 - DNA, 23 bp, Homo sapiens
ctctcaaaacttggtatttttca

SEQ ID NO: 3336940 - DNA, 23 bp, Homo sapiens
ctctcaaaagagaaaaacaaaac

SEQ ID NO: 3336941 - DNA, 17 bp, Homo sapiens
ctctcaaaagtctattt

SEQ ID NO: 3336942 - DNA, 23 bp, Homo sapiens
ctctcaaactaaaagacatttgt

SEQ ID NO: 3336943 - DNA, 14 bp, Homo sapiens
ctctcaaagtataa

SEQ ID NO: 3336944 - DNA, 15 bp, Homo sapiens
ctctcaagctagcca

SEQ ID NO: 3336945 - DNA, 12 bp, Homo sapiens
ctctcacacaca

SEQ ID NO: 3336946 - DNA, 14 bp, Homo sapiens
ctctcacccccatc

SEQ ID NO: 3336947 - DNA, 16 bp, Homo sapiens
ctctcactcacatttt

SEQ ID NO: 3336948 - DNA, 13 bp, Homo sapiens
ctctcactcccca

SEQ ID NO: 3336949 - DNA, 14 bp, Homo sapiens
ctctcactccccag

SEQ ID NO: 3336950 - DNA, 14 bp, Homo sapiens
ctctcactccccat

SEQ ID NO: 3336951 - DNA, 14 bp, Homo sapiens
ccagcccctagccc

SEQ ID NO: 3336952 - DNA, 18 bp, Homo sapiens
ccagcccctagcccagga

SEQ ID NO: 3336953 - DNA, 16 bp, Homo sapiens
ccagcccctcccccat

SEQ ID NO: 3336954 - DNA, 18 bp, Homo sapiens
ccagcccctcccccatct

SEQ ID NO: 3336955 - DNA, 20 bp, Homo sapiens
ccagcccctgccccagccca

SEQ ID NO: 3336956 - DNA, 16 bp, Homo sapiens
ccagcccctgcctggg

SEQ ID NO: 3336957 - DNA, 17 bp, Homo sapiens
ccagcccctgcctgggt

SEQ ID NO: 3336958 - DNA, 11 bp, Homo sapiens
ccagcccctgt

SEQ ID NO: 3336959 - DNA, 12 bp, Homo sapiens
ccagccccttcc

SEQ ID NO: 3336960 - DNA, 15 bp, Homo sapiens
ccagccccttctccc

SEQ ID NO: 3336961 - DNA, 21 bp, Homo sapiens
ccagccccttctcccagcaca

SEQ ID NO: 3336962 - DNA, 20 bp, Homo sapiens
ccagcccgcaactctccagc

SEQ ID NO: 3336963 - DNA, 17 bp, Homo sapiens
ccagcccggcctgctcc

SEQ ID NO: 3336964 - DNA, 20 bp, Homo sapiens
ccagcccgggagcctaggac

SEQ ID NO: 3336965 - DNA, 12 bp, Homo sapiens
ccagccctgctg

SEQ ID NO: 3336966 - DNA, 14 bp, Homo sapiens
ccagccctgctggg

SEQ ID NO: 3336967 - DNA, 13 bp, Homo sapiens
ccagccctggctc

SEQ ID NO: 3336968 - DNA, 12 bp, Homo sapiens
ccagccctggga

SEQ ID NO: 3336969 - DNA, 15 bp, Homo sapiens
ccagccctgtcctgg

SEQ ID NO: 3336970 - DNA, 16 bp, Homo sapiens
ccagcccttagcaggg

SEQ ID NO: 3336971 - DNA, 14 bp, Homo sapiens
ccagcccttcctct

SEQ ID NO: 3336972 - DNA, 14 bp, Homo sapiens
ccagcccttctgcc

SEQ ID NO: 3336973 - DNA, 14 bp, Homo sapiens
ccagccgccctggg

SEQ ID NO: 3336974 - DNA, 16 bp, Homo sapiens
ccagccgccctgggct

SEQ ID NO: 3336975 - DNA, 17 bp, Homo sapiens
ccagccgccctgggctg

SEQ ID NO: 3336976 - DNA, 19 bp, Homo sapiens
ccagccgctcggaggcccc

SEQ ID NO: 3336977 - DNA, 15 bp, Homo sapiens
ccagccgctgcaggg

SEQ ID NO: 3336978 - DNA, 23 bp, Homo sapiens
ccagccgctgcagggctcccatg

SEQ ID NO: 3336979 - DNA, 16 bp, Homo sapiens
ccagccggccaatgga

SEQ ID NO: 3336980 - DNA, 13 bp, Homo sapiens
ccagccggcctct

SEQ ID NO: 3336981 - DNA, 16 bp, Homo sapiens
ccagccggtgcctggc

SEQ ID NO: 3336982 - DNA, 21 bp, Homo sapiens
ccagccgtgatgctcaggctt

SEQ ID NO: 3336983 - DNA, 20 bp, Homo sapiens
ccagcctacaagctggcact

SEQ ID NO: 3336984 - DNA, 18 bp, Homo sapiens
ccagcctacccttcctgc

SEQ ID NO: 3336985 - DNA, 17 bp, Homo sapiens
ccagcctagcccttgtc

SEQ ID NO: 3336986 - DNA, 18 bp, Homo sapiens
ccagcctagcccttgtcc

SEQ ID NO: 3336987 - DNA, 19 bp, Homo sapiens
ccagcctatgagcatcctg

SEQ ID NO: 3336988 - DNA, 21 bp, Homo sapiens
ccagcctatgagcatcctgag

SEQ ID NO: 3336989 - DNA, 12 bp, Homo sapiens
ccagcctcagtc

SEQ ID NO: 3336990 - DNA, 21 bp, Homo sapiens
ccagcctcagtcctcccctca

SEQ ID NO: 3336991 - DNA, 22 bp, Homo sapiens
ccagcctcagtcctcccctcac

SEQ ID NO: 3336992 - DNA, 21 bp, Homo sapiens
ccagcctccaagctccatctc

SEQ ID NO: 3336993 - DNA, 12 bp, Homo sapiens
ccagcctcctct

SEQ ID NO: 3336994 - DNA, 15 bp, Homo sapiens
ccagcctcctctgga

SEQ ID NO: 3336995 - DNA, 23 bp, Homo sapiens
ccagcctcctctggacggcaggc

SEQ ID NO: 3336996 - DNA, 22 bp, Homo sapiens
ccagcctcgttggaagaggaac

SEQ ID NO: 3336997 - DNA, 23 bp, Homo sapiens
ccagcctctcccggctgcctgcc

SEQ ID NO: 3336998 - DNA, 15 bp, Homo sapiens
ccagcctctggcatt

SEQ ID NO: 3336999 - DNA, 17 bp, Homo sapiens
ccagcctgaccttcctt

SEQ ID NO: 3337000 - DNA, 13 bp, Homo sapiens
ccagcctgaggca

SEQ ID NO: 3337001 - DNA, 20 bp, Homo sapiens
ccagcctgcccaagcccagg

SEQ ID NO: 3337002 - DNA, 16 bp, Homo sapiens
ccagcctgcctggcag

SEQ ID NO: 3337003 - DNA, 18 bp, Homo sapiens
ccagcctgctgagagccc

SEQ ID NO: 3337004 - DNA, 19 bp, Homo sapiens
ccagcctggacccccagct

SEQ ID NO: 3337005 - DNA, 10 bp, Homo sapiens
ccagcctggc

SEQ ID NO: 3337006 - DNA, 12 bp, Homo sapiens
ccagcctggcca

SEQ ID NO: 3337007 - DNA, 14 bp, Homo sapiens
catggacactccag

SEQ ID NO: 3337008 - DNA, 19 bp, Homo sapiens
catggacactccagtgcca

SEQ ID NO: 3337009 - DNA, 15 bp, Homo sapiens
catggacatttagaa

SEQ ID NO: 3337010 - DNA, 21 bp, Homo sapiens
catggagactcctgccctgtt

SEQ ID NO: 3337011 - DNA, 14 bp, Homo sapiens
catggagccagctc

SEQ ID NO: 3337012 - DNA, 22 bp, Homo sapiens
catggaggagcttgggggatga

SEQ ID NO: 3337013 - DNA, 23 bp, Homo sapiens
catggaggaggagggaggcgctg

SEQ ID NO: 3337014 - DNA, 13 bp, Homo sapiens
catggaggccctc

SEQ ID NO: 3337015 - DNA, 20 bp, Homo sapiens
catggaggccctcctgtgct

SEQ ID NO: 3337016 - DNA, 15 bp, Homo sapiens
catggaggttctaag

SEQ ID NO: 3337017 - DNA, 16 bp, Homo sapiens
catggagtatatgtca

SEQ ID NO: 3337018 - DNA, 14 bp, Homo sapiens
catggagtgtgtat

SEQ ID NO: 3337019 - DNA, 21 bp, Homo sapiens
catggagtgtgtattgttccc

SEQ ID NO: 3337020 - DNA, 15 bp, Homo sapiens
catggatacttcctg

SEQ ID NO: 3337021 - DNA, 19 bp, Homo sapiens
catggatacttcctgggtc

SEQ ID NO: 3337022 - DNA, 13 bp, Homo sapiens
catggatgcattt

SEQ ID NO: 3337023 - DNA, 17 bp, Homo sapiens
catggatgcatttcaaa

SEQ ID NO: 3337024 - DNA, 18 bp, Homo sapiens
catggatgcatttcaaat

SEQ ID NO: 3337025 - DNA, 20 bp, Homo sapiens
catggatgcatttcaaatgt

SEQ ID NO: 3337026 - DNA, 19 bp, Homo sapiens
catggatgcgaggaccact

SEQ ID NO: 3337027 - DNA, 22 bp, Homo sapiens
catggatttttacaagatccat

SEQ ID NO: 3337028 - DNA, 21 bp, Homo sapiens
catggcaattttgtaaattga

SEQ ID NO: 3337029 - DNA, 14 bp, Homo sapiens
catggcaccagccc

SEQ ID NO: 3337030 - DNA, 17 bp, Homo sapiens
catggcaccagccccct

SEQ ID NO: 3337031 - DNA, 17 bp, Homo sapiens
catggcagagtttgtgt

SEQ ID NO: 3337032 - DNA, 19 bp, Homo sapiens
catggcatgcttaaatttt

SEQ ID NO: 3337033 - DNA, 13 bp, Homo sapiens
catggcccccaat

SEQ ID NO: 3337034 - DNA, 14 bp, Homo sapiens
catggcccccaata

SEQ ID NO: 3337035 - DNA, 15 bp, Homo sapiens
catggcccccaataa

SEQ ID NO: 3337036 - DNA, 20 bp, Homo sapiens
catggcccccaataaaggca

SEQ ID NO: 3337037 - DNA, 15 bp, Homo sapiens
catggcccccagggg

SEQ ID NO: 3337038 - DNA, 17 bp, Homo sapiens
ctctgaagcatgtttca

SEQ ID NO: 3337039 - DNA, 20 bp, Homo sapiens
ctctgaagcatgtttcatgt

SEQ ID NO: 3337040 - DNA, 15 bp, Homo sapiens
ctctgaaggacattg

SEQ ID NO: 3337041 - DNA, 22 bp, Homo sapiens
ctctgaaggacattgcggacag

SEQ ID NO: 3337042 - DNA, 16 bp, Homo sapiens
ctctgaatgaagctga

SEQ ID NO: 3337043 - DNA, 17 bp, Homo sapiens
ctctgaatgccccataa

SEQ ID NO: 3337044 - DNA, 19 bp, Homo sapiens
ctctgacaagggctgacct

SEQ ID NO: 3337045 - DNA, 16 bp, Homo sapiens
ctctgacacacagctc

SEQ ID NO: 3337046 - DNA, 19 bp, Homo sapiens
ctctgacatcccttcctgg

SEQ ID NO: 3337047 - DNA, 21 bp, Homo sapiens
ctctgacatcccttcctggaa

SEQ ID NO: 3337048 - DNA, 16 bp, Homo sapiens
ctctgaccaacaggct

SEQ ID NO: 3337049 - DNA, 13 bp, Homo sapiens
ctctgacccctcc

SEQ ID NO: 3337050 - DNA, 14 bp, Homo sapiens
ctctgacccctcct

SEQ ID NO: 3337051 - DNA, 16 bp, Homo sapiens
ctctgacccctcctca

SEQ ID NO: 3337052 - DNA, 21 bp, Homo sapiens
ctctgacccctcctcactggc

SEQ ID NO: 3337053 - DNA, 12 bp, Homo sapiens
ctctgacctgca

SEQ ID NO: 3337054 - DNA, 14 bp, Homo sapiens
ctctgacctgcact

SEQ ID NO: 3337055 - DNA, 16 bp, Homo sapiens
ctctgacctgcaggcc

SEQ ID NO: 3337056 - DNA, 19 bp, Homo sapiens
ctctgactagtagatttct

SEQ ID NO: 3337057 - DNA, 23 bp, Homo sapiens
ctctgacttccccaaacccagaa

SEQ ID NO: 3337058 - DNA, 16 bp, Homo sapiens
ctctgagagtctagat

SEQ ID NO: 3337059 - DNA, 19 bp, Homo sapiens
ctctgagagtctagattct

SEQ ID NO: 3337060 - DNA, 22 bp, Homo sapiens
ctctgagagtctagattctctg

SEQ ID NO: 3337061 - DNA, 16 bp, Homo sapiens
ctctgagcatcaagaa

SEQ ID NO: 3337062 - DNA, 16 bp, Homo sapiens
ctctgagccagattac

SEQ ID NO: 3337063 - DNA, 19 bp, Homo sapiens
ctctgagccagattacagg

SEQ ID NO: 3337064 - DNA, 12 bp, Homo sapiens
ctctgagcccag

SEQ ID NO: 3337065 - DNA, 13 bp, Homo sapiens
ctctgagcccagg

SEQ ID NO: 3337066 - DNA, 15 bp, Homo sapiens
ctctgagcccaggcc

SEQ ID NO: 3337067 - DNA, 13 bp, Homo sapiens
ctctgagcccata

SEQ ID NO: 3337068 - DNA, 19 bp, Homo sapiens
ctctgagcccatacttttg

SEQ ID NO: 3337069 - DNA, 16 bp, Homo sapiens
ctctgagctgctcacc

SEQ ID NO: 3337070 - DNA, 14 bp, Homo sapiens
ctctgaggacacta

SEQ ID NO: 3337071 - DNA, 16 bp, Homo sapiens
ctctgaggacactaac

SEQ ID NO: 3337072 - DNA, 15 bp, Homo sapiens
ctctgaggggagggg

SEQ ID NO: 3337073 - DNA, 16 bp, Homo sapiens
ctctgaggggaggggg

SEQ ID NO: 3337074 - DNA, 21 bp, Homo sapiens
ctctgagtggtggttcctttg

SEQ ID NO: 3337075 - DNA, 16 bp, Homo sapiens
ctctgagtttaccatt

SEQ ID NO: 3337076 - DNA, 13 bp, Homo sapiens
ctctcactcctgc

SEQ ID NO: 3337077 - DNA, 21 bp, Homo sapiens
ctctcactcctgcctccgctg

SEQ ID NO: 3337078 - DNA, 16 bp, Homo sapiens
ctctcagaaggtattc

SEQ ID NO: 3337079 - DNA, 16 bp, Homo sapiens
ctctcagagcatctgg

SEQ ID NO: 3337080 - DNA, 11 bp, Homo sapiens
ctctcagagcc

SEQ ID NO: 3337081 - DNA, 18 bp, Homo sapiens
ctctcagcccagaagaaa

SEQ ID NO: 3337082 - DNA, 19 bp, Homo sapiens
ctctcagccttacatttgt

SEQ ID NO: 3337083 - DNA, 16 bp, Homo sapiens
ctctcagctcagcgcc

SEQ ID NO: 3337084 - DNA, 13 bp, Homo sapiens
ctctcaggatcca

SEQ ID NO: 3337085 - DNA, 12 bp, Homo sapiens
ctctcagggcct

SEQ ID NO: 3337086 - DNA, 13 bp, Homo sapiens
ctctcagggcctg

SEQ ID NO: 3337087 - DNA, 14 bp, Homo sapiens
ctctcagggcctgg

SEQ ID NO: 3337088 - DNA, 17 bp, Homo sapiens
ctctcagggcctggcag

SEQ ID NO: 3337089 - DNA, 22 bp, Homo sapiens
ctctcagggcctggcaggccag

SEQ ID NO: 3337090 - DNA, 12 bp, Homo sapiens
ctctcagtgttt

SEQ ID NO: 3337091 - DNA, 22 bp, Homo sapiens
ctctcagtgttttggactccat

SEQ ID NO: 3337092 - DNA, 18 bp, Homo sapiens
ctctcagttaaaatgtga

SEQ ID NO: 3337093 - DNA, 21 bp, Homo sapiens
ctctcatatgccaccccatgt

SEQ ID NO: 3337094 - DNA, 17 bp, Homo sapiens
ctctcatcaactgaatg

SEQ ID NO: 3337095 - DNA, 14 bp, Homo sapiens
ctctcatcttgttc

SEQ ID NO: 3337096 - DNA, 16 bp, Homo sapiens
ctctccaaaggggctg

SEQ ID NO: 3337097 - DNA, 23 bp, Homo sapiens
ctctccaaaggggctgctggggc

SEQ ID NO: 3337098 - DNA, 14 bp, Homo sapiens
ctctccaagggctt

SEQ ID NO: 3337099 - DNA, 13 bp, Homo sapiens
ctctccacggtag

SEQ ID NO: 3337100 - DNA, 23 bp, Homo sapiens
ctctccacggtagcacttgacct

SEQ ID NO: 3337101 - DNA, 22 bp, Homo sapiens
ctctccagccgaagctgcaggg

SEQ ID NO: 3337102 - DNA, 18 bp, Homo sapiens
ctctccaggcacccttct

SEQ ID NO: 3337103 - DNA, 11 bp, Homo sapiens
ctctccatatc

SEQ ID NO: 3337104 - DNA, 18 bp, Homo sapiens
ctctcccacagagtgctg

SEQ ID NO: 3337105 - DNA, 14 bp, Homo sapiens
ctctcccatcactt

SEQ ID NO: 3337106 - DNA, 13 bp, Homo sapiens
ctctcccatcccc

SEQ ID NO: 3337107 - DNA, 13 bp, Homo sapiens
ctctcccatcctg

SEQ ID NO: 3337108 - DNA, 21 bp, Homo sapiens
ctctcccatcctggggcagca

SEQ ID NO: 3337109 - DNA, 12 bp, Homo sapiens
ctctccccacac

SEQ ID NO: 3337110 - DNA, 21 bp, Homo sapiens
ctctccccacgagggctggct

SEQ ID NO: 3337111 - DNA, 13 bp, Homo sapiens
ctctccccagcaa

SEQ ID NO: 3337112 - DNA, 19 bp, Homo sapiens
ctctccccccgcctgccac

SEQ ID NO: 3337113 - DNA, 18 bp, Homo sapiens
ctctcccctcaaagtctg

SEQ ID NO: 3337114 - DNA, 16 bp, Homo sapiens
ctctcccctcccttgt

SEQ ID NO: 3337115 - DNA, 17 bp, Homo sapiens
ctctcccctgccctgct

SEQ ID NO: 3337116 - DNA, 18 bp, Homo sapiens
ctctcccctgccctgctg

SEQ ID NO: 3337117 - DNA, 16 bp, Homo sapiens
ctctcccggctgcctg

SEQ ID NO: 3337118 - DNA, 15 bp, Homo sapiens
ctctcccgtcagggc

SEQ ID NO: 3337119 - DNA, 17 bp, Homo sapiens
ctctcccgtcagggccc

SEQ ID NO: 3337120 - DNA, 15 bp, Homo sapiens
ctctccctgccaagt

SEQ ID NO: 3337121 - DNA, 24 bp, Homo sapiens
ccctcgtccacaggggcaggcctg

SEQ ID NO: 3337122 - DNA, 16 bp, Homo sapiens
ccctcgtggccagccc

SEQ ID NO: 3337123 - DNA, 23 bp, Homo sapiens
ccctcgtggtccccaacagcgac

SEQ ID NO: 3337124 - DNA, 17 bp, Homo sapiens
ccctctagtgccttctt

SEQ ID NO: 3337125 - DNA, 18 bp, Homo sapiens
ccctctatttattagcca

SEQ ID NO: 3337126 - DNA, 20 bp, Homo sapiens
ccctctatttattagccaac

SEQ ID NO: 3337127 - DNA, 13 bp, Homo sapiens
ccctctcaccaaa

SEQ ID NO: 3337128 - DNA, 21 bp, Homo sapiens
ccctctcactccccagcccca

SEQ ID NO: 3337129 - DNA, 20 bp, Homo sapiens
ccctctcagaggcctgctgc

SEQ ID NO: 3337130 - DNA, 17 bp, Homo sapiens
ccctctcagctccaggt

SEQ ID NO: 3337131 - DNA, 15 bp, Homo sapiens
ccctctcatctcagg

SEQ ID NO: 3337132 - DNA, 13 bp, Homo sapiens
ccctctcctgccc

SEQ ID NO: 3337133 - DNA, 19 bp, Homo sapiens
ccctctcctgcccagatgc

SEQ ID NO: 3337134 - DNA, 12 bp, Homo sapiens
ccctctcctggg

SEQ ID NO: 3337135 - DNA, 14 bp, Homo sapiens
ccctctccttcctt

SEQ ID NO: 3337136 - DNA, 10 bp, Homo sapiens
ccctctctct

SEQ ID NO: 3337137 - DNA, 14 bp, Homo sapiens
ccctctctctgggc

SEQ ID NO: 3337138 - DNA, 13 bp, Homo sapiens
ccctctctgcccc

SEQ ID NO: 3337139 - DNA, 16 bp, Homo sapiens
ccctctctgcccctga

SEQ ID NO: 3337140 - DNA, 20 bp, Homo sapiens
ccctctctgcccctgatcac

SEQ ID NO: 3337141 - DNA, 15 bp, Homo sapiens
ccctctctggtttcc

SEQ ID NO: 3337142 - DNA, 15 bp, Homo sapiens
ccctctgacctgcac

SEQ ID NO: 3337143 - DNA, 16 bp, Homo sapiens
ccctctgacctgcact

SEQ ID NO: 3337144 - DNA, 17 bp, Homo sapiens
ccctctgacctgcactg

SEQ ID NO: 3337145 - DNA, 16 bp, Homo sapiens
ccctctgcagaacagt

SEQ ID NO: 3337146 - DNA, 20 bp, Homo sapiens
cctcagctacccactatcct

SEQ ID NO: 3337147 - DNA, 11 bp, Homo sapiens
cctcagctcca

SEQ ID NO: 3337148 - DNA, 14 bp, Homo sapiens
cctcagctctctgg

SEQ ID NO: 3337149 - DNA, 12 bp, Homo sapiens
cctcagctctgg

SEQ ID NO: 3337150 - DNA, 15 bp, Homo sapiens
cctcagctgcctcac

SEQ ID NO: 3337151 - DNA, 18 bp, Homo sapiens
cctcagctgcctcacttc

SEQ ID NO: 3337152 - DNA, 16 bp, Homo sapiens
cctcagctggctgtat

SEQ ID NO: 3337153 - DNA, 17 bp, Homo sapiens
cctcagctggctgtatg

SEQ ID NO: 3337154 - DNA, 20 bp, Homo sapiens
cctcaggcacacagctactc

SEQ ID NO: 3337155 - DNA, 14 bp, Homo sapiens
cctcaggcagctca

SEQ ID NO: 3337156 - DNA, 22 bp, Homo sapiens
cctcaggcataggcctgggtgc

SEQ ID NO: 3337157 - DNA, 21 bp, Homo sapiens
cctcaggccaggtgcagtggc

SEQ ID NO: 3337158 - DNA, 17 bp, Homo sapiens
cctcagggagcagggaa

SEQ ID NO: 3337159 - DNA, 21 bp, Homo sapiens
cctcagggagcagggaaggcc

SEQ ID NO: 3337160 - DNA, 21 bp, Homo sapiens
cctcagggcacgcaggaccag

SEQ ID NO: 3337161 - DNA, 14 bp, Homo sapiens
cctcagggccagga

SEQ ID NO: 3337162 - DNA, 16 bp, Homo sapiens
cctcagggccaggaag

SEQ ID NO: 3337163 - DNA, 17 bp, Homo sapiens
cctcagggccaggaagg

SEQ ID NO: 3337164 - DNA, 18 bp, Homo sapiens
cctcagggcgctcagacg

SEQ ID NO: 3337165 - DNA, 18 bp, Homo sapiens
cctcaggggaaaactgtt

SEQ ID NO: 3337166 - DNA, 19 bp, Homo sapiens
cccaagggcctcccaccag

SEQ ID NO: 3337167 - DNA, 19 bp, Homo sapiens
cccaagggtgccctttggg

SEQ ID NO: 3337168 - DNA, 14 bp, Homo sapiens
cccaagtagctggg

SEQ ID NO: 3337169 - DNA, 12 bp, Homo sapiens
cccaagtccaaa

SEQ ID NO: 3337170 - DNA, 21 bp, Homo sapiens
cccaagtggtttccacatgct

SEQ ID NO: 3337171 - DNA, 19 bp, Homo sapiens
cccaagttcatgcagctgt

SEQ ID NO: 3337172 - DNA, 20 bp, Homo sapiens
cccaagtttatttctctctt

SEQ ID NO: 3337173 - DNA, 21 bp, Homo sapiens
cccaagtttccatagcaacag

SEQ ID NO: 3337174 - DNA, 14 bp, Homo sapiens
cccaataaaggcag

SEQ ID NO: 3337175 - DNA, 15 bp, Homo sapiens
cccaataaaggcagc

SEQ ID NO: 3337176 - DNA, 19 bp, Homo sapiens
cccaataaaggcagctgcc

SEQ ID NO: 3337177 - DNA, 12 bp, Homo sapiens
cccaatattata

SEQ ID NO: 3337178 - DNA, 15 bp, Homo sapiens
cccaatcaaagaatt

SEQ ID NO: 3337179 - DNA, 20 bp, Homo sapiens
cccaatcaaagaattacagt

SEQ ID NO: 3337180 - DNA, 15 bp, Homo sapiens
cccaatcagcactga

SEQ ID NO: 3337181 - DNA, 13 bp, Homo sapiens
cccaatctttcta

SEQ ID NO: 3337182 - DNA, 14 bp, Homo sapiens
cccaatctttctat

SEQ ID NO: 3337183 - DNA, 22 bp, Homo sapiens
cccaatgagactctagggtcca

SEQ ID NO: 3337184 - DNA, 21 bp, Homo sapiens
cccaattacagggtgactcac

SEQ ID NO: 3337185 - DNA, 22 bp, Homo sapiens
cccaattactattccctttgac

SEQ ID NO: 3337186 - DNA, 14 bp, Homo sapiens
cccaattagcttgg

SEQ ID NO: 3337187 - DNA, 19 bp, Homo sapiens
cccaattaggaagtgtaac

SEQ ID NO: 3337188 - DNA, 14 bp, Homo sapiens
cccaattgctggag

SEQ ID NO: 3337189 - DNA, 22 bp, Homo sapiens
cccaatttcggattttttccaa

SEQ ID NO: 3337190 - DNA, 20 bp, Homo sapiens
cccacaaaaaattgctccta

SEQ ID NO: 3337191 - DNA, 23 bp, Homo sapiens
cccacaaaaaattgctcctaact

SEQ ID NO: 3337192 - DNA, 13 bp, Homo sapiens
cccacaaaaatgt

SEQ ID NO: 3337193 - DNA, 19 bp, Homo sapiens
cccacaaagagagtgcgcc

SEQ ID NO: 3337194 - DNA, 17 bp, Homo sapiens
cccacaagctgtccctg

SEQ ID NO: 3337195 - DNA, 20 bp, Homo sapiens
cccacaagctgtccctgcag

SEQ ID NO: 3337196 - DNA, 20 bp, Homo sapiens
cccacaatcacaagaagatt

SEQ ID NO: 3337197 - DNA, 14 bp, Homo sapiens
cccacaccccagcc

SEQ ID NO: 3337198 - DNA, 15 bp, Homo sapiens
cccacaccccagccc

SEQ ID NO: 3337199 - DNA, 12 bp, Homo sapiens
cccacaccctcg

SEQ ID NO: 3337200 - DNA, 14 bp, Homo sapiens
cccacaccctcggg

SEQ ID NO: 3337201 - DNA, 17 bp, Homo sapiens
cccacaccgtcttcctt

SEQ ID NO: 3337202 - DNA, 22 bp, Homo sapiens
cccacacctcagttcccttggc

SEQ ID NO: 3337203 - DNA, 19 bp, Homo sapiens
cccacacctccacagttca

SEQ ID NO: 3337204 - DNA, 18 bp, Homo sapiens
cccacaccttccagggcc

SEQ ID NO: 3337205 - DNA, 20 bp, Homo sapiens
cccacaccttccagggccct

SEQ ID NO: 3337206 - DNA, 22 bp, Homo sapiens
cccacaccttccagggccctag

SEQ ID NO: 3337207 - DNA, 18 bp, Homo sapiens
cccacacggactcccggg

SEQ ID NO: 3337208 - DNA, 22 bp, Homo sapiens
cccacacggaggcatctgcacc

SEQ ID NO: 3337209 - DNA, 14 bp, Homo sapiens
cccacactatgcac

SEQ ID NO: 3337210 - DNA, 17 bp, Homo sapiens
cccacactgaaaccaaa

SEQ ID NO: 3337211 - DNA, 19 bp, Homo sapiens
cccacacttgagaggatga

SEQ ID NO: 3337212 - DNA, 18 bp, Homo sapiens
cccacagactccggcctg

SEQ ID NO: 3337213 - DNA, 19 bp, Homo sapiens
cccacagagtgctggactg

SEQ ID NO: 3337214 - DNA, 18 bp, Homo sapiens
cctaagtgcccaaagtgg

SEQ ID NO: 3337215 - DNA, 18 bp, Homo sapiens
cctaagtggattggcttt

SEQ ID NO: 3337216 - DNA, 22 bp, Homo sapiens
cctaatcagaaatttttatcag

SEQ ID NO: 3337217 - DNA, 22 bp, Homo sapiens
cctaatccctgggcattgcttt

SEQ ID NO: 3337218 - DNA, 13 bp, Homo sapiens
cctaatgtgttta

SEQ ID NO: 3337219 - DNA, 18 bp, Homo sapiens
cctaattcgatgaaggct

SEQ ID NO: 3337220 - DNA, 24 bp, Homo sapiens
cctaattgtatgttagaataattt

SEQ ID NO: 3337221 - DNA, 23 bp, Homo sapiens
cctaatttctcctcccttccttt

SEQ ID NO: 3337222 - DNA, 23 bp, Homo sapiens
cctaatttgtttcttctgtcttt

SEQ ID NO: 3337223 - DNA, 18 bp, Homo sapiens
cctacaaccatccctgcc

SEQ ID NO: 3337224 - DNA, 17 bp, Homo sapiens
cctacaagagcagcctg

SEQ ID NO: 3337225 - DNA, 18 bp, Homo sapiens
cctacaagagcagcctgt

SEQ ID NO: 3337226 - DNA, 19 bp, Homo sapiens
cctacaagatttagaaaaa

SEQ ID NO: 3337227 - DNA, 20 bp, Homo sapiens
cctacaagatttagaaaaaa

SEQ ID NO: 3337228 - DNA, 15 bp, Homo sapiens
cctacaagctggcac

SEQ ID NO: 3337229 - DNA, 22 bp, Homo sapiens
cctacacactgtcatgcttcat

SEQ ID NO: 3337230 - DNA, 17 bp, Homo sapiens
cctacacccagacccca

SEQ ID NO: 3337231 - DNA, 12 bp, Homo sapiens
cctacagcattg

SEQ ID NO: 3337232 - DNA, 18 bp, Homo sapiens
cctacaggagtgagcact

SEQ ID NO: 3337233 - DNA, 20 bp, Homo sapiens
cctacagttttaactgtgga

SEQ ID NO: 3337234 - DNA, 15 bp, Homo sapiens
cctacattccctctc

SEQ ID NO: 3337235 - DNA, 19 bp, Homo sapiens
cctaccaatctctgctctc

SEQ ID NO: 3337236 - DNA, 16 bp, Homo sapiens
cctaccacagtgtctg

SEQ ID NO: 3337237 - DNA, 19 bp, Homo sapiens
cctaccagttgccctagcc

SEQ ID NO: 3337238 - DNA, 22 bp, Homo sapiens
cctaccatcagggacaggatga

SEQ ID NO: 3337239 - DNA, 15 bp, Homo sapiens
cctaccatgctgctt

SEQ ID NO: 3337240 - DNA, 12 bp, Homo sapiens
cctaccccatag

SEQ ID NO: 3337241 - DNA, 18 bp, Homo sapiens
cctaccctcgggcccacc

SEQ ID NO: 3337242 - DNA, 23 bp, Homo sapiens
cctaccctcgggcccacctggcc

SEQ ID NO: 3337243 - DNA, 14 bp, Homo sapiens
cctacccttcctgc

SEQ ID NO: 3337244 - DNA, 19 bp, Homo sapiens
cctaccgagtctcttctcc

SEQ ID NO: 3337245 - DNA, 20 bp, Homo sapiens
cctaccgagtctcttctcca

SEQ ID NO: 3337246 - DNA, 22 bp, Homo sapiens
cctaccgagtctcttctccact

SEQ ID NO: 3337247 - DNA, 13 bp, Homo sapiens
cctacctcagcct

SEQ ID NO: 3337248 - DNA, 21 bp, Homo sapiens
cctacctcagcctagaccctc

SEQ ID NO: 3337249 - DNA, 13 bp, Homo sapiens
cctacctcaggtt

SEQ ID NO: 3337250 - DNA, 15 bp, Homo sapiens
cctacctgccctgga

SEQ ID NO: 3337251 - DNA, 16 bp, Homo sapiens
cctacgcgccttgtct

SEQ ID NO: 3337252 - DNA, 17 bp, Homo sapiens
cctacggagtcagccag

SEQ ID NO: 3337253 - DNA, 15 bp, Homo sapiens
cctactcccctgggc

SEQ ID NO: 3337254 - DNA, 20 bp, Homo sapiens
cctactccctgcagatgcca

SEQ ID NO: 3337255 - DNA, 13 bp, Homo sapiens
cctactcctgact

SEQ ID NO: 3337256 - DNA, 18 bp, Homo sapiens
cctactcggatggggcac

SEQ ID NO: 3337257 - DNA, 18 bp, Homo sapiens
cctactgagcatttgcac

SEQ ID NO: 3337258 - DNA, 22 bp, Homo sapiens
cctactgagcatttgcacctct

SEQ ID NO: 3337259 - DNA, 14 bp, Homo sapiens
cctactgtcctcag

SEQ ID NO: 3337260 - DNA, 13 bp, Homo sapiens
cctactgtgtctt

SEQ ID NO: 3337261 - DNA, 13 bp, Homo sapiens
cctactgttctaa

SEQ ID NO: 3337262 - DNA, 16 bp, Homo sapiens
cctactgttctaaagc

SEQ ID NO: 3337263 - DNA, 19 bp, Homo sapiens
cctactgttctaaagctct

SEQ ID NO: 3337264 - DNA, 17 bp, Homo sapiens
cctacttctgactttac

SEQ ID NO: 3337265 - DNA, 22 bp, Homo sapiens
cctacttcttttgctcttagct

SEQ ID NO: 3337266 - DNA, 20 bp, Homo sapiens
cctactttgcttccgccact

SEQ ID NO: 3337267 - DNA, 17 bp, Homo sapiens
cctagaaacccaagctc

SEQ ID NO: 3337268 - DNA, 14 bp, Homo sapiens
cctagaatctttat

SEQ ID NO: 3337269 - DNA, 15 bp, Homo sapiens
cctagacccaggtgg

SEQ ID NO: 3337270 - DNA, 19 bp, Homo sapiens
cctagacctaaacggctca

SEQ ID NO: 3337271 - DNA, 21 bp, Homo sapiens
cctagactctgtaacatcact

SEQ ID NO: 3337272 - DNA, 14 bp, Homo sapiens
cctagactgcatcc

SEQ ID NO: 3337273 - DNA, 16 bp, Homo sapiens
cctagagacagaagca

SEQ ID NO: 3337274 - DNA, 21 bp, Homo sapiens
cctagagacagaagcaggctg

SEQ ID NO: 3337275 - DNA, 22 bp, Homo sapiens
cctagaggtgggcagctgggcc

SEQ ID NO: 3337276 - DNA, 15 bp, Homo sapiens
cctagagtgtagcct

SEQ ID NO: 3337277 - DNA, 14 bp, Homo sapiens
cctagcaagctggc

SEQ ID NO: 3337278 - DNA, 15 bp, Homo sapiens
cctagcaagctggcc

SEQ ID NO: 3337279 - DNA, 16 bp, Homo sapiens
cctagcccaccctgct

SEQ ID NO: 3337280 - DNA, 20 bp, Homo sapiens
cctagcccaccctgctgcct

SEQ ID NO: 3337281 - DNA, 15 bp, Homo sapiens
cctagcccagactct

SEQ ID NO: 3337282 - DNA, 17 bp, Homo sapiens
cctagcccagcgctctg

SEQ ID NO: 3337283 - DNA, 20 bp, Homo sapiens
cctagcccagcgctctgcct

SEQ ID NO: 3337284 - DNA, 18 bp, Homo sapiens
cctagcccaggagagaga

SEQ ID NO: 3337285 - DNA, 22 bp, Homo sapiens
cctagccttagaagtcacacag

SEQ ID NO: 3337286 - DNA, 19 bp, Homo sapiens
cctagcgatctctcctggc

SEQ ID NO: 3337287 - DNA, 15 bp, Homo sapiens
cctagcggagcccag

SEQ ID NO: 3337288 - DNA, 16 bp, Homo sapiens
cctagcggagcccagc

SEQ ID NO: 3337289 - DNA, 18 bp, Homo sapiens
cctagcggagcccagcct

SEQ ID NO: 3337290 - DNA, 20 bp, Homo sapiens
cctagcggagcccagcctgg

SEQ ID NO: 3337291 - DNA, 22 bp, Homo sapiens
cctagctcctgccacatggagc

SEQ ID NO: 3337292 - DNA, 13 bp, Homo sapiens
cctagctggctct

SEQ ID NO: 3337293 - DNA, 14 bp, Homo sapiens
cctagctggctctg

SEQ ID NO: 3337294 - DNA, 17 bp, Homo sapiens
cctagcttagtcatggc

SEQ ID NO: 3337295 - DNA, 16 bp, Homo sapiens
cctaggaaactcacac

SEQ ID NO: 3337296 - DNA, 22 bp, Homo sapiens
cctaggaaactcacactcccct

SEQ ID NO: 3337297 - DNA, 16 bp, Homo sapiens
cctaggaattcccagc

SEQ ID NO: 3337298 - DNA, 17 bp, Homo sapiens
cctaggaattcccagcc

SEQ ID NO: 3337299 - DNA, 15 bp, Homo sapiens
cctaggagagccaac

SEQ ID NO: 3337300 - DNA, 21 bp, Homo sapiens
cctaggagtatatttccgcac

SEQ ID NO: 3337301 - DNA, 13 bp, Homo sapiens
cctaggagttgag

SEQ ID NO: 3337302 - DNA, 20 bp, Homo sapiens
cctaggccaaatgcacaagc

SEQ ID NO: 3337303 - DNA, 15 bp, Homo sapiens
cctaggcccaggcct

SEQ ID NO: 3337304 - DNA, 21 bp, Homo sapiens
cctaggcccctcctagaccca

SEQ ID NO: 3337305 - DNA, 13 bp, Homo sapiens
cctaggctgctgc

SEQ ID NO: 3337306 - DNA, 22 bp, Homo sapiens
cctaggggaacagaccagtgac

SEQ ID NO: 3337307 - DNA, 21 bp, Homo sapiens
cctagggtcttgggggtcagg

SEQ ID NO: 3337308 - DNA, 15 bp, Homo sapiens
cctaggtccaagccc

SEQ ID NO: 3337309 - DNA, 14 bp, Homo sapiens
cctaggtctccagt

SEQ ID NO: 3337310 - DNA, 16 bp, Homo sapiens
cctaggtgcagctcct

SEQ ID NO: 3337311 - DNA, 20 bp, Homo sapiens
cctaggtgcagctcctcagc

SEQ ID NO: 3337312 - DNA, 16 bp, Homo sapiens
cctaggttcccggtcc

SEQ ID NO: 3337313 - DNA, 18 bp, Homo sapiens
cctaggttccctgttctt

SEQ ID NO: 3337314 - DNA, 22 bp, Homo sapiens
cctagtaaaaccttgttctatt

SEQ ID NO: 3337315 - DNA, 17 bp, Homo sapiens
cctagtactctctgctc

SEQ ID NO: 3337316 - DNA, 18 bp, Homo sapiens
cctagtactctctgctct

SEQ ID NO: 3337317 - DNA, 20 bp, Homo sapiens
cctagtactctctgctctag

SEQ ID NO: 3337318 - DNA, 20 bp, Homo sapiens
cctagtagctgggatgacag

SEQ ID NO: 3337319 - DNA, 14 bp, Homo sapiens
cctagtcccttccc

SEQ ID NO: 3337320 - DNA, 15 bp, Homo sapiens
cctagtcccttcccc

SEQ ID NO: 3337321 - DNA, 19 bp, Homo sapiens
cctagtgaaccacaggttt

SEQ ID NO: 3337322 - DNA, 15 bp, Homo sapiens
cctagtgcttccact

SEQ ID NO: 3337323 - DNA, 23 bp, Homo sapiens
cctagtgcttccacttctatgca

SEQ ID NO: 3337324 - DNA, 19 bp, Homo sapiens
cctagttaaagaaaggaaa

SEQ ID NO: 3337325 - DNA, 21 bp, Homo sapiens
cctagttcatccaatcctcac

SEQ ID NO: 3337326 - DNA, 17 bp, Homo sapiens
cctagttcctgtggcca

SEQ ID NO: 3337327 - DNA, 17 bp, Homo sapiens
cctagtttgacctcaca

SEQ ID NO: 3337328 - DNA, 12 bp, Homo sapiens
cctagttttcca

SEQ ID NO: 3337329 - DNA, 15 bp, Homo sapiens
cctagttttccatgc

SEQ ID NO: 3337330 - DNA, 15 bp, Homo sapiens
cctagttttctcctc

SEQ ID NO: 3337331 - DNA, 21 bp, Homo sapiens
cctataaaattaaatgccttg

SEQ ID NO: 3337332 - DNA, 15 bp, Homo sapiens
cctataacttcttcc

SEQ ID NO: 3337333 - DNA, 19 bp, Homo sapiens
cctataacttcttcctgct

SEQ ID NO: 3337334 - DNA, 18 bp, Homo sapiens
cctataacttgatgcatg

SEQ ID NO: 3337335 - DNA, 19 bp, Homo sapiens
cctataacttgatgcatgt

SEQ ID NO: 3337336 - DNA, 14 bp, Homo sapiens
cctataagaagcct

SEQ ID NO: 3337337 - DNA, 14 bp, Homo sapiens
cctataagaggaat

SEQ ID NO: 3337338 - DNA, 14 bp, Homo sapiens
cctataatctgtca

SEQ ID NO: 3337339 - DNA, 15 bp, Homo sapiens
cctataatctgtcaa

SEQ ID NO: 3337340 - DNA, 18 bp, Homo sapiens
cctataatcttatacaac

SEQ ID NO: 3337341 - DNA, 15 bp, Homo sapiens
cctataatgtgtgta

SEQ ID NO: 3337342 - DNA, 20 bp, Homo sapiens
cctataccccttacttagca

SEQ ID NO: 3337343 - DNA, 17 bp, Homo sapiens
cccttgccctccgcctg

SEQ ID NO: 3337344 - DNA, 15 bp, Homo sapiens
cccttgccctgacct

SEQ ID NO: 3337345 - DNA, 20 bp, Homo sapiens
cccttgccctgacctcccag

SEQ ID NO: 3337346 - DNA, 16 bp, Homo sapiens
cccttgcccttgccct

SEQ ID NO: 3337347 - DNA, 17 bp, Homo sapiens
cccttgcccttgccctg

SEQ ID NO: 3337348 - DNA, 13 bp, Homo sapiens
cccttgcctcccc

SEQ ID NO: 3337349 - DNA, 18 bp, Homo sapiens
cccttgcctccccatttc

SEQ ID NO: 3337350 - DNA, 20 bp, Homo sapiens
cccttgcctccccatttccc

SEQ ID NO: 3337351 - DNA, 23 bp, Homo sapiens
cccttgcctccccatttcccatc

SEQ ID NO: 3337352 - DNA, 13 bp, Homo sapiens
ccgcccccagcct

SEQ ID NO: 3337353 - DNA, 14 bp, Homo sapiens
ccgcccccagccta

SEQ ID NO: 3337354 - DNA, 19 bp, Homo sapiens
ccgcccccagtccccaccc

SEQ ID NO: 3337355 - DNA, 12 bp, Homo sapiens
ccgccccctcct

SEQ ID NO: 3337356 - DNA, 18 bp, Homo sapiens
ccgcccctctccaaacac

SEQ ID NO: 3337357 - DNA, 13 bp, Homo sapiens
ccgcccctgcagc

SEQ ID NO: 3337358 - DNA, 14 bp, Homo sapiens
ccgcccctgcagca

SEQ ID NO: 3337359 - DNA, 22 bp, Homo sapiens
ccgccctcctcgggccgaggcc

SEQ ID NO: 3337360 - DNA, 13 bp, Homo sapiens
ccgccctgggctg

SEQ ID NO: 3337361 - DNA, 22 bp, Homo sapiens
ccgccctgggctggactggagg

SEQ ID NO: 3337362 - DNA, 18 bp, Homo sapiens
ccgccctgggctgtctgt

SEQ ID NO: 3337363 - DNA, 20 bp, Homo sapiens
ccgccctgggctgtctgtca

SEQ ID NO: 3337364 - DNA, 14 bp, Homo sapiens
ccgccgccaccagc

SEQ ID NO: 3337365 - DNA, 14 bp, Homo sapiens
ccgccgcctcccac

SEQ ID NO: 3337366 - DNA, 13 bp, Homo sapiens
ccgccgcttttct

SEQ ID NO: 3337367 - DNA, 23 bp, Homo sapiens
ccgcctcccaccactccactcct

SEQ ID NO: 3337368 - DNA, 15 bp, Homo sapiens
ccgcctcccacggca

SEQ ID NO: 3337369 - DNA, 23 bp, Homo sapiens
ccgcctccccacggccgctccag

SEQ ID NO: 3337370 - DNA, 14 bp, Homo sapiens
ccgcctccctctca

SEQ ID NO: 3337371 - DNA, 19 bp, Homo sapiens
ccgcctctggccgccaccc

SEQ ID NO: 3337372 - DNA, 16 bp, Homo sapiens
ccgcctgaaagccaca

SEQ ID NO: 3337373 - DNA, 23 bp, Homo sapiens
ccgcctgcagtcttctgggctgc

SEQ ID NO: 3337374 - DNA, 13 bp, Homo sapiens
ccgcctgctcctc

SEQ ID NO: 3337375 - DNA, 16 bp, Homo sapiens
ccgcctgctcctcact

SEQ ID NO: 3337376 - DNA, 22 bp, Homo sapiens
ccgcctgctcctcactggagga

SEQ ID NO: 3337377 - DNA, 13 bp, Homo sapiens
ccgcctggccagg

SEQ ID NO: 3337378 - DNA, 16 bp, Homo sapiens
ccgcctggccagggca

SEQ ID NO: 3337379 - DNA, 17 bp, Homo sapiens
ccgcctggccagggcag

SEQ ID NO: 3337380 - DNA, 16 bp, Homo sapiens
ccgcctgggatctgag

SEQ ID NO: 3337381 - DNA, 20 bp, Homo sapiens
ccgcctgttcccccgccgct

SEQ ID NO: 3337382 - DNA, 23 bp, Homo sapiens
ccgccttccgccccttcccttcc

SEQ ID NO: 3337383 - DNA, 14 bp, Homo sapiens
ccgccttcctcctc

SEQ ID NO: 3337384 - DNA, 23 bp, Homo sapiens
ccgcctttgggttccatcttgct

SEQ ID NO: 3337385 - DNA, 16 bp, Homo sapiens
ccgcgctcgcccagca

SEQ ID NO: 3337386 - DNA, 18 bp, Homo sapiens
ccgcgctcgcccagcagg

SEQ ID NO: 3337387 - DNA, 20 bp, Homo sapiens
ccgcgctcgccccaccggcg

SEQ ID NO: 3337388 - DNA, 13 bp, Homo sapiens
ccgcggctggagc

SEQ ID NO: 3337389 - DNA, 14 bp, Homo sapiens
ccgcggctggagcg

SEQ ID NO: 3337390 - DNA, 20 bp, Homo sapiens
ccgcgggagacagcttctct

SEQ ID NO: 3337391 - DNA, 17 bp, Homo sapiens
ccgcgggttccgcaggc

SEQ ID NO: 3337392 - DNA, 17 bp, Homo sapiens
ccgcggtgctctggcgg

SEQ ID NO: 3337393 - DNA, 19 bp, Homo sapiens
ccgcgtttagaccaaggaa

SEQ ID NO: 3337394 - DNA, 20 bp, Homo sapiens
ccgctagagcagcccaaatt

SEQ ID NO: 3337395 - DNA, 15 bp, Homo sapiens
ccgctcacctagagc

SEQ ID NO: 3337396 - DNA, 16 bp, Homo sapiens
ccgctcacctagagcc

SEQ ID NO: 3337397 - DNA, 20 bp, Homo sapiens
ccgctcacctagagccagac

SEQ ID NO: 3337398 - DNA, 20 bp, Homo sapiens
ccgctcccaacccccctcct

SEQ ID NO: 3337399 - DNA, 22 bp, Homo sapiens
ccgctcccaacccccctcctgc

SEQ ID NO: 3337400 - DNA, 21 bp, Homo sapiens
ccgctcccaccgcccccaccc

SEQ ID NO: 3337401 - DNA, 23 bp, Homo sapiens
ccgctcccaccgcccccacccct

SEQ ID NO: 3337402 - DNA, 15 bp, Homo sapiens
ccgctcctgccgcag

SEQ ID NO: 3337403 - DNA, 22 bp, Homo sapiens
ccgctcctgccgcagacgggca

SEQ ID NO: 3337404 - DNA, 15 bp, Homo sapiens
ccgctcggaggcccc

SEQ ID NO: 3337405 - DNA, 16 bp, Homo sapiens
ccgctcggaggcccca

SEQ ID NO: 3337406 - DNA, 21 bp, Homo sapiens
ccgctcggaggccccaaagga

SEQ ID NO: 3337407 - DNA, 19 bp, Homo sapiens
ccgctctacatcttctgcc

SEQ ID NO: 3337408 - DNA, 21 bp, Homo sapiens
ccgctctcttttctgtacttc

SEQ ID NO: 3337409 - DNA, 19 bp, Homo sapiens
ccgctgcaatgcctagact

SEQ ID NO: 3337410 - DNA, 12 bp, Homo sapiens
ccgctgccacca

SEQ ID NO: 3337411 - DNA, 15 bp, Homo sapiens
ccgctgccagccttg

SEQ ID NO: 3337412 - DNA, 15 bp, Homo sapiens
ccgctgccgctgcac

SEQ ID NO: 3337413 - DNA, 18 bp, Homo sapiens
ccgctgccgctgcaccac

SEQ ID NO: 3337414 - DNA, 14 bp, Homo sapiens
ccgctgctccacgc

SEQ ID NO: 3337415 - DNA, 15 bp, Homo sapiens
ccgctgtcgccccag

SEQ ID NO: 3337416 - DNA, 18 bp, Homo sapiens
ccgctgtgagcccctggt

SEQ ID NO: 3337417 - DNA, 14 bp, Homo sapiens
ccgcttcacccctg

SEQ ID NO: 3337418 - DNA, 17 bp, Homo sapiens
ccgcttgtggggaccca

SEQ ID NO: 3337419 - DNA, 20 bp, Homo sapiens
ccgcttgtggggacccaggc

SEQ ID NO: 3337420 - DNA, 23 bp, Homo sapiens
ccgcttgtggggacccaggctcc

SEQ ID NO: 3337421 - DNA, 19 bp, Homo sapiens
ccgctttctacccagcgag

SEQ ID NO: 3337422 - DNA, 21 bp, Homo sapiens
ccggaaccacagggccagagg

SEQ ID NO: 3337423 - DNA, 18 bp, Homo sapiens
ccggacatactctctgcc

SEQ ID NO: 3337424 - DNA, 13 bp, Homo sapiens
ccggactggtgcc

SEQ ID NO: 3337425 - DNA, 14 bp, Homo sapiens
ccggagatgtagca

SEQ ID NO: 3337426 - DNA, 18 bp, Homo sapiens
ccggagatgtagcaaaac

SEQ ID NO: 3337427 - DNA, 13 bp, Homo sapiens
ccggagcacagcc

SEQ ID NO: 3337428 - DNA, 14 bp, Homo sapiens
ccggagcacagccc

SEQ ID NO: 3337429 - DNA, 16 bp, Homo sapiens
ccggagcacagccctg

SEQ ID NO: 3337430 - DNA, 14 bp, Homo sapiens
ccggaggaaatctg

SEQ ID NO: 3337431 - DNA, 17 bp, Homo sapiens
ccggagtccctgcaggt

SEQ ID NO: 3337432 - DNA, 17 bp, Homo sapiens
ccggatcagagcaggac

SEQ ID NO: 3337433 - DNA, 19 bp, Homo sapiens
ccggatcagagcaggacct

SEQ ID NO: 3337434 - DNA, 22 bp, Homo sapiens
ccggcaaccccagttctgctcc

SEQ ID NO: 3337435 - DNA, 19 bp, Homo sapiens
ccggcaagcagcgggctaa

SEQ ID NO: 3337436 - DNA, 16 bp, Homo sapiens
ccggcaggccctgcag

SEQ ID NO: 3337437 - DNA, 18 bp, Homo sapiens
ccggcaggccctgcagtg

SEQ ID NO: 3337438 - DNA, 11 bp, Homo sapiens
ccggcagggcg

SEQ ID NO: 3337439 - DNA, 23 bp, Homo sapiens
ccggcagggcgggcagagggctg

SEQ ID NO: 3337440 - DNA, 15 bp, Homo sapiens
ccggccagcgggcac

SEQ ID NO: 3337441 - DNA, 20 bp, Homo sapiens
ccggccagcgggcacagggc

SEQ ID NO: 3337442 - DNA, 13 bp, Homo sapiens
ccggcccagtgcc

SEQ ID NO: 3337443 - DNA, 12 bp, Homo sapiens
ccggccccagcc

SEQ ID NO: 3337444 - DNA, 18 bp, Homo sapiens
ccggccccagccagagtt

SEQ ID NO: 3337445 - DNA, 19 bp, Homo sapiens
ccggccccggccccagcca

SEQ ID NO: 3337446 - DNA, 13 bp, Homo sapiens
ccggcccctgctg

SEQ ID NO: 3337447 - DNA, 14 bp, Homo sapiens
ccggcccctgctgg

SEQ ID NO: 3337448 - DNA, 16 bp, Homo sapiens
ccggcccctggcagca

SEQ ID NO: 3337449 - DNA, 17 bp, Homo sapiens
ccggcctcagggcgctc

SEQ ID NO: 3337450 - DNA, 15 bp, Homo sapiens
ccggcctccactccc

SEQ ID NO: 3337451 - DNA, 23 bp, Homo sapiens
ccggcctccactcccccacctga

SEQ ID NO: 3337452 - DNA, 22 bp, Homo sapiens
ccggcctcctcggagagcagca

SEQ ID NO: 3337453 - DNA, 12 bp, Homo sapiens
ccggcctctctg

SEQ ID NO: 3337454 - DNA, 13 bp, Homo sapiens
ccggcctctctgg

SEQ ID NO: 3337455 - DNA, 20 bp, Homo sapiens
ccggcctctctggcctccca

SEQ ID NO: 3337456 - DNA, 13 bp, Homo sapiens
ccggcctcttcca

SEQ ID NO: 3337457 - DNA, 16 bp, Homo sapiens
ccggcctcttccaccc

SEQ ID NO: 3337458 - DNA, 16 bp, Homo sapiens
ccggcctgctcccagc

SEQ ID NO: 3337459 - DNA, 16 bp, Homo sapiens
ccggcggggaccttgg

SEQ ID NO: 3337460 - DNA, 20 bp, Homo sapiens
ccggcggggaccttggtctg

SEQ ID NO: 3337461 - DNA, 18 bp, Homo sapiens
ccggctaatttttgtaat

SEQ ID NO: 3337462 - DNA, 17 bp, Homo sapiens
ccggctatgggggcact

SEQ ID NO: 3337463 - DNA, 12 bp, Homo sapiens
ccggctccaggc

SEQ ID NO: 3337464 - DNA, 14 bp, Homo sapiens
ccggctccaggctc

SEQ ID NO: 3337465 - DNA, 23 bp, Homo sapiens
ccggctcgagcagtcctgcctca

SEQ ID NO: 3337466 - DNA, 14 bp, Homo sapiens
ccggctgcctgccg

SEQ ID NO: 3337467 - DNA, 15 bp, Homo sapiens
ccgggaactcctgcc

SEQ ID NO: 3337468 - DNA, 20 bp, Homo sapiens
ccgggacccacggagccctc

SEQ ID NO: 3337469 - DNA, 22 bp, Homo sapiens
ccgggacccacggagccctccc

SEQ ID NO: 3337470 - DNA, 17 bp, Homo sapiens
ccgggagaaggcatgag

SEQ ID NO: 3337471 - DNA, 18 bp, Homo sapiens
ccgggagcctaggaccac

SEQ ID NO: 3337472 - DNA, 23 bp, Homo sapiens
ccgggagcctaggaccactcagc

SEQ ID NO: 3337473 - DNA, 16 bp, Homo sapiens
ccgggagcctccccct

SEQ ID NO: 3337474 - DNA, 18 bp, Homo sapiens
ccgggagcctccccctca

SEQ ID NO: 3337475 - DNA, 13 bp, Homo sapiens
ccgggatgcaagg

SEQ ID NO: 3337476 - DNA, 15 bp, Homo sapiens
cctaaggacacacta

SEQ ID NO: 3337477 - DNA, 23 bp, Homo sapiens
cctaaggatctctcaggagcaca

SEQ ID NO: 3337478 - DNA, 12 bp, Homo sapiens
cctaagtactgt

SEQ ID NO: 3337479 - DNA, 18 bp, Homo sapiens
cctaagtactgtaataat

SEQ ID NO: 3337480 - DNA, 14 bp, Homo sapiens
cctaagtgcccaaa

SEQ ID NO: 3337481 - DNA, 17 bp, Homo sapiens
cctcccatcccctggac

SEQ ID NO: 3337482 - DNA, 15 bp, Homo sapiens
cctccccacgccctc

SEQ ID NO: 3337483 - DNA, 14 bp, Homo sapiens
cctccccagcccct

SEQ ID NO: 3337484 - DNA, 15 bp, Homo sapiens
cctccccagccccta

SEQ ID NO: 3337485 - DNA, 20 bp, Homo sapiens
cctccccattagagtcagcc

SEQ ID NO: 3337486 - DNA, 22 bp, Homo sapiens
cctcccccaacccccaccccac

SEQ ID NO: 3337487 - DNA, 19 bp, Homo sapiens
cctcccccatctcccaccc

SEQ ID NO: 3337488 - DNA, 17 bp, Homo sapiens
cctcccccgccactcct

SEQ ID NO: 3337489 - DNA, 14 bp, Homo sapiens
cctccccctcaacc

SEQ ID NO: 3337490 - DNA, 11 bp, Homo sapiens
cctccccctgc

SEQ ID NO: 3337491 - DNA, 12 bp, Homo sapiens
cctccccctgca

SEQ ID NO: 3337492 - DNA, 13 bp, Homo sapiens
cctccccctgcaa

SEQ ID NO: 3337493 - DNA, 14 bp, Homo sapiens
cctccccctgccag

SEQ ID NO: 3337494 - DNA, 16 bp, Homo sapiens
cctccccctgccagga

SEQ ID NO: 3337495 - DNA, 15 bp, Homo sapiens
cctccccgcctggcc

SEQ ID NO: 3337496 - DNA, 16 bp, Homo sapiens
cctccccgcctggcca

SEQ ID NO: 3337497 - DNA, 17 bp, Homo sapiens
cctccccgtctcattcc

SEQ ID NO: 3337498 - DNA, 15 bp, Homo sapiens
cctcccctcacagcc

SEQ ID NO: 3337499 - DNA, 16 bp, Homo sapiens
cctcccctcacagcct

SEQ ID NO: 3337500 - DNA, 15 bp, Homo sapiens
cctcccctcccctgc

SEQ ID NO: 3337501 - DNA, 16 bp, Homo sapiens
cctcccctcccctgct

SEQ ID NO: 3337502 - DNA, 21 bp, Homo sapiens
cctcccctccggactggtgcc

SEQ ID NO: 3337503 - DNA, 16 bp, Homo sapiens
cctcccctccttgtct

SEQ ID NO: 3337504 - DNA, 18 bp, Homo sapiens
cctcccctcgtgtcagct

SEQ ID NO: 3337505 - DNA, 23 bp, Homo sapiens
cctcccctctcttgcacccgcct

SEQ ID NO: 3337506 - DNA, 17 bp, Homo sapiens
cctcccctgccaccagg

SEQ ID NO: 3337507 - DNA, 14 bp, Homo sapiens
cctcccctgccatt

SEQ ID NO: 3337508 - DNA, 13 bp, Homo sapiens
cctcccctgccct

SEQ ID NO: 3337509 - DNA, 15 bp, Homo sapiens
cctcccctgccctgg

SEQ ID NO: 3337510 - DNA, 12 bp, Homo sapiens
cctcccctgctg

SEQ ID NO: 3337511 - DNA, 20 bp, Homo sapiens
cctcccgaatagctgggact

SEQ ID NO: 3337512 - DNA, 21 bp, Homo sapiens
cctcccgaatagctgggacta

SEQ ID NO: 3337513 - DNA, 17 bp, Homo sapiens
cctcccgagtagctggg

SEQ ID NO: 3337514 - DNA, 18 bp, Homo sapiens
cctcccgagtagctggga

SEQ ID NO: 3337515 - DNA, 19 bp, Homo sapiens
cctcccgagtagctgggac

SEQ ID NO: 3337516 - DNA, 14 bp, Homo sapiens
cctcccgctgcaag

SEQ ID NO: 3337517 - DNA, 22 bp, Homo sapiens
cctcccgggtctcaggcctcca

SEQ ID NO: 3337518 - DNA, 17 bp, Homo sapiens
cctcccgtagtctcctg

SEQ ID NO: 3337519 - DNA, 20 bp, Homo sapiens
cctcccgtagtctcctgggt

SEQ ID NO: 3337520 - DNA, 15 bp, Homo sapiens
cctccctactcccct

SEQ ID NO: 3337521 - DNA, 14 bp, Homo sapiens
cctccctcccggca

SEQ ID NO: 3337522 - DNA, 19 bp, Homo sapiens
cctccctcccggcatggga

SEQ ID NO: 3337523 - DNA, 23 bp, Homo sapiens
cctccctccggccatactgcctt

SEQ ID NO: 3337524 - DNA, 14 bp, Homo sapiens
cctccctccttcct

SEQ ID NO: 3337525 - DNA, 14 bp, Homo sapiens
cctccctctccata

SEQ ID NO: 3337526 - DNA, 18 bp, Homo sapiens
cctccctctgacctgcag

SEQ ID NO: 3337527 - DNA, 15 bp, Homo sapiens
cctccctctgcccca

SEQ ID NO: 3337528 - DNA, 20 bp, Homo sapiens
cctccctgaaccatccctga

SEQ ID NO: 3337529 - DNA, 12 bp, Homo sapiens
cctccctgcccc

SEQ ID NO: 3337530 - DNA, 13 bp, Homo sapiens
cctccctgcccct

SEQ ID NO: 3337531 - DNA, 22 bp, Homo sapiens
cctccctgcccctcccttcaac

SEQ ID NO: 3337532 - DNA, 17 bp, Homo sapiens
cctccctgctcagtgct

SEQ ID NO: 3337533 - DNA, 23 bp, Homo sapiens
cctccctgctcagtgcttgggct

SEQ ID NO: 3337534 - DNA, 23 bp, Homo sapiens
cctccctgctgtgccatgctggg

SEQ ID NO: 3337535 - DNA, 20 bp, Homo sapiens
cctccctggagcctccactg

SEQ ID NO: 3337536 - DNA, 17 bp, Homo sapiens
cctccctggcagacaca

SEQ ID NO: 3337537 - DNA, 13 bp, Homo sapiens
cctccctggctcc

SEQ ID NO: 3337538 - DNA, 20 bp, Homo sapiens
cctccctggctcccatgacc

SEQ ID NO: 3337539 - DNA, 22 bp, Homo sapiens
cctccctggctgccctggccct

SEQ ID NO: 3337540 - DNA, 22 bp, Homo sapiens
cctccctgttgacgaagtctct

SEQ ID NO: 3337541 - DNA, 14 bp, Homo sapiens
cctccctgtttgaa

SEQ ID NO: 3337542 - DNA, 23 bp, Homo sapiens
cctcccttccgaccctctgggaa

SEQ ID NO: 3337543 - DNA, 22 bp, Homo sapiens
cctcccttccttttccctgctt

SEQ ID NO: 3337544 - DNA, 19 bp, Homo sapiens
cctcccttgggttctgata

SEQ ID NO: 3337545 - DNA, 22 bp, Homo sapiens
cctccgagacagtccagtgtca

SEQ ID NO: 3337546 - DNA, 21 bp, Homo sapiens
cctccgccaatgcacggcctc

SEQ ID NO: 3337547 - DNA, 12 bp, Homo sapiens
cctccgccctgc

SEQ ID NO: 3337548 - DNA, 15 bp, Homo sapiens
cctccgccctgccac

SEQ ID NO: 3337549 - DNA, 14 bp, Homo sapiens
cctccgcctcttgg

SEQ ID NO: 3337550 - DNA, 17 bp, Homo sapiens
cctccgcggctggagcg

SEQ ID NO: 3337551 - DNA, 15 bp, Homo sapiens
cctccggacatccag

SEQ ID NO: 3337552 - DNA, 19 bp, Homo sapiens
cctccgtccacccaggctg

SEQ ID NO: 3337553 - DNA, 17 bp, Homo sapiens
ccctgcctcatccacca

SEQ ID NO: 3337554 - DNA, 19 bp, Homo sapiens
ccctgcctcccatgcctgg

SEQ ID NO: 3337555 - DNA, 13 bp, Homo sapiens
ccctgcctcctgg

SEQ ID NO: 3337556 - DNA, 14 bp, Homo sapiens
ccctgcctcctggg

SEQ ID NO: 3337557 - DNA, 14 bp, Homo sapiens
ccctgcctgcccac

SEQ ID NO: 3337558 - DNA, 14 bp, Homo sapiens
ccctgcctggactt

SEQ ID NO: 3337559 - DNA, 17 bp, Homo sapiens
ccctgcctggcccccaa

SEQ ID NO: 3337560 - DNA, 12 bp, Homo sapiens
ccctgcctgggt

SEQ ID NO: 3337561 - DNA, 14 bp, Homo sapiens
ccctgcggcctcca

SEQ ID NO: 3337562 - DNA, 20 bp, Homo sapiens
ccctgcggcctccacacctg

SEQ ID NO: 3337563 - DNA, 23 bp, Homo sapiens
ccctgcgggcgcgggcagccacc

SEQ ID NO: 3337564 - DNA, 15 bp, Homo sapiens
ccctgcggtcaggct

SEQ ID NO: 3337565 - DNA, 22 bp, Homo sapiens
ccctgcggtcaggctgggcagc

SEQ ID NO: 3337566 - DNA, 16 bp, Homo sapiens
ccctgcgtggcctgag

SEQ ID NO: 3337567 - DNA, 18 bp, Homo sapiens
ccctgcgtggcctgagtc

SEQ ID NO: 3337568 - DNA, 17 bp, Homo sapiens
ccctgcgtgggggccag

SEQ ID NO: 3337569 - DNA, 17 bp, Homo sapiens
ccctgcgttggagccac

SEQ ID NO: 3337570 - DNA, 22 bp, Homo sapiens
ccctgcgttggagccactcctg

SEQ ID NO: 3337571 - DNA, 22 bp, Homo sapiens
ccctgctactcctgtgctctgg

SEQ ID NO: 3337572 - DNA, 22 bp, Homo sapiens
ccctgtccggcccagtgccact

SEQ ID NO: 3337573 - DNA, 13 bp, Homo sapiens
ccctgtcctcact

SEQ ID NO: 3337574 - DNA, 15 bp, Homo sapiens
ccctgtcctcactgc

SEQ ID NO: 3337575 - DNA, 18 bp, Homo sapiens
ccctgtcctcactgctcc

SEQ ID NO: 3337576 - DNA, 16 bp, Homo sapiens
ccctgtcctgtgaatg

SEQ ID NO: 3337577 - DNA, 16 bp, Homo sapiens
ccctgtccttccctgt

SEQ ID NO: 3337578 - DNA, 16 bp, Homo sapiens
ccctgtcgagacactt

SEQ ID NO: 3337579 - DNA, 14 bp, Homo sapiens
ccctgtctaaaaaa

SEQ ID NO: 3337580 - DNA, 14 bp, Homo sapiens
ccctgtctctacta

SEQ ID NO: 3337581 - DNA, 21 bp, Homo sapiens
ccctgtcttctgggcacagtg

SEQ ID NO: 3337582 - DNA, 22 bp, Homo sapiens
ccctgtcttctgggcacagtgg

SEQ ID NO: 3337583 - DNA, 13 bp, Homo sapiens
ccctgtcttgtcc

SEQ ID NO: 3337584 - DNA, 14 bp, Homo sapiens
ccctgtgacaaaat

SEQ ID NO: 3337585 - DNA, 22 bp, Homo sapiens
ccctgtgacatggtgcctgaga

SEQ ID NO: 3337586 - DNA, 16 bp, Homo sapiens
ccctgtgccatcacca

SEQ ID NO: 3337587 - DNA, 20 bp, Homo sapiens
ccctgtgccctgcacgtata

SEQ ID NO: 3337588 - DNA, 21 bp, Homo sapiens
ccctgtgcctaacaccagcgt

SEQ ID NO: 3337589 - DNA, 20 bp, Homo sapiens
ccctgtgctccgtgcctcca

SEQ ID NO: 3337590 - DNA, 21 bp, Homo sapiens
ccctgtgctggtgtcctgacc

SEQ ID NO: 3337591 - DNA, 23 bp, Homo sapiens
ccctgtgctggtgtcctgaccac

SEQ ID NO: 3337592 - DNA, 16 bp, Homo sapiens
ccctgtggagactggg

SEQ ID NO: 3337593 - DNA, 20 bp, Homo sapiens
ccctgtggccaactgcaaaa

SEQ ID NO: 3337594 - DNA, 14 bp, Homo sapiens
ccctgtggccctgg

SEQ ID NO: 3337595 - DNA, 22 bp, Homo sapiens
ccctgtggccgactctgcactc

SEQ ID NO: 3337596 - DNA, 19 bp, Homo sapiens
ccctgtggccgccacctga

SEQ ID NO: 3337597 - DNA, 15 bp, Homo sapiens
ccctgtggggatctc

SEQ ID NO: 3337598 - DNA, 19 bp, Homo sapiens
ccctgtgggggtggccatc

SEQ ID NO: 3337599 - DNA, 24 bp, Homo sapiens
ccctgtgggggtggccatccctgg

SEQ ID NO: 3337600 - DNA, 18 bp, Homo sapiens
ccctgtgtaggggcaggg

SEQ ID NO: 3337601 - DNA, 19 bp, Homo sapiens
ccctgtgtaggggcaggga

SEQ ID NO: 3337602 - DNA, 16 bp, Homo sapiens
ccctgtgttgtctcta

SEQ ID NO: 3337603 - DNA, 17 bp, Homo sapiens
ccctgtgttgtctctag

SEQ ID NO: 3337604 - DNA, 21 bp, Homo sapiens
ccctgtgttgtctctagagca

SEQ ID NO: 3337605 - DNA, 16 bp, Homo sapiens
ccctgttcatgtgcct

SEQ ID NO: 3337606 - DNA, 17 bp, Homo sapiens
ccctgttcatgtgcctc

SEQ ID NO: 3337607 - DNA, 12 bp, Homo sapiens
ccctgttctaag

SEQ ID NO: 3337608 - DNA, 14 bp, Homo sapiens
ccctgttctccctt

SEQ ID NO: 3337609 - DNA, 21 bp, Homo sapiens
ccctgttctccctttctctct

SEQ ID NO: 3337610 - DNA, 22 bp, Homo sapiens
ccctgttctgttggggaggggt

SEQ ID NO: 3337611 - DNA, 14 bp, Homo sapiens
ccctgttcttcctc

SEQ ID NO: 3337612 - DNA, 13 bp, Homo sapiens
ccctgttggcagc

SEQ ID NO: 3337613 - DNA, 14 bp, Homo sapiens
ccctgtttaatatt

SEQ ID NO: 3337614 - DNA, 16 bp, Homo sapiens
ccctgtttaatattta

SEQ ID NO: 3337615 - DNA, 17 bp, Homo sapiens
ccctgtttaatatttaa

SEQ ID NO: 3337616 - DNA, 18 bp, Homo sapiens
ccctgtttaatatttaaa

SEQ ID NO: 3337617 - DNA, 19 bp, Homo sapiens
ccctgtttaatatttaaac

SEQ ID NO: 3337618 - DNA, 21 bp, Homo sapiens
ccctgtttaatatttaaacag

SEQ ID NO: 3337619 - DNA, 17 bp, Homo sapiens
ccctgtttcaatcactg

SEQ ID NO: 3337620 - DNA, 20 bp, Homo sapiens
ccctgtttgaagcctgccct

SEQ ID NO: 3337621 - DNA, 22 bp, Homo sapiens
ccctgttttcccacgaggaatc

SEQ ID NO: 3337622 - DNA, 22 bp, Homo sapiens
ccctgttttctgagcccgggct

SEQ ID NO: 3337623 - DNA, 23 bp, Homo sapiens
ccctgttttctgagcccgggctg

SEQ ID NO: 3337624 - DNA, 14 bp, Homo sapiens
cccttaaaatagaa

SEQ ID NO: 3337625 - DNA, 16 bp, Homo sapiens
cccttaacttttcctt

SEQ ID NO: 3337626 - DNA, 18 bp, Homo sapiens
cccttaacttttccttgt

SEQ ID NO: 3337627 - DNA, 21 bp, Homo sapiens
cccttaaggcacagtgggagc

SEQ ID NO: 3337628 - DNA, 15 bp, Homo sapiens
cccttacacgtacct

SEQ ID NO: 3337629 - DNA, 21 bp, Homo sapiens
cccttaccctttcctccttta

SEQ ID NO: 3337630 - DNA, 17 bp, Homo sapiens
cccttagcctccctgaa

SEQ ID NO: 3337631 - DNA, 13 bp, Homo sapiens
cccttaggccccg

SEQ ID NO: 3337632 - DNA, 20 bp, Homo sapiens
cccttaggccccgtggtgac

SEQ ID NO: 3337633 - DNA, 16 bp, Homo sapiens
cccttcacatttttta

SEQ ID NO: 3337634 - DNA, 15 bp, Homo sapiens
cccttcactgccatg

SEQ ID NO: 3337635 - DNA, 12 bp, Homo sapiens
cccttcagcccc

SEQ ID NO: 3337636 - DNA, 22 bp, Homo sapiens
cccttcagcccccagcccctcc

SEQ ID NO: 3337637 - DNA, 14 bp, Homo sapiens
cccttcagggccag

SEQ ID NO: 3337638 - DNA, 19 bp, Homo sapiens
cccttcagggccagaagga

SEQ ID NO: 3337639 - DNA, 13 bp, Homo sapiens
cccttccacttct

SEQ ID NO: 3337640 - DNA, 20 bp, Homo sapiens
cccttcccaatcagcactga

SEQ ID NO: 3337641 - DNA, 20 bp, Homo sapiens
cccttcccctcccctccttg

SEQ ID NO: 3337642 - DNA, 16 bp, Homo sapiens
cccttcccctccctgg

SEQ ID NO: 3337643 - DNA, 13 bp, Homo sapiens
cccttccccttct

SEQ ID NO: 3337644 - DNA, 13 bp, Homo sapiens
cccttccctgtcc

SEQ ID NO: 3337645 - DNA, 16 bp, Homo sapiens
cccttccctgtccttg

SEQ ID NO: 3337646 - DNA, 17 bp, Homo sapiens
cccttcccttccactgc

SEQ ID NO: 3337647 - DNA, 16 bp, Homo sapiens
cccttccggtgcgtgt

SEQ ID NO: 3337648 - DNA, 18 bp, Homo sapiens
cccttcctaaatatccaa

SEQ ID NO: 3337649 - DNA, 20 bp, Homo sapiens
cccttcctagtgaaccacag

SEQ ID NO: 3337650 - DNA, 14 bp, Homo sapiens
cccttcctccctgt

SEQ ID NO: 3337651 - DNA, 21 bp, Homo sapiens
cccttcctccctgtctctgca

SEQ ID NO: 3337652 - DNA, 14 bp, Homo sapiens
cccttcctctcact

SEQ ID NO: 3337653 - DNA, 17 bp, Homo sapiens
cccttcctctcactcct

SEQ ID NO: 3337654 - DNA, 16 bp, Homo sapiens
cccttcctctccactg

SEQ ID NO: 3337655 - DNA, 21 bp, Homo sapiens
cccttcctctccactgccttc

SEQ ID NO: 3337656 - DNA, 16 bp, Homo sapiens
cccttcctctctcctt

SEQ ID NO: 3337657 - DNA, 13 bp, Homo sapiens
cccttcctggaaa

SEQ ID NO: 3337658 - DNA, 19 bp, Homo sapiens
cccttcctggaaacagcat

SEQ ID NO: 3337659 - DNA, 21 bp, Homo sapiens
cccttcctggcctcactggct

SEQ ID NO: 3337660 - DNA, 22 bp, Homo sapiens
cccttcctggcctcactggctg

SEQ ID NO: 3337661 - DNA, 12 bp, Homo sapiens
cccttcctgggt

SEQ ID NO: 3337662 - DNA, 13 bp, Homo sapiens
cccttcctgggta

SEQ ID NO: 3337663 - DNA, 11 bp, Homo sapiens
cccttccttta

SEQ ID NO: 3337664 - DNA, 21 bp, Homo sapiens
cccttcctttggtgcctcact

SEQ ID NO: 3337665 - DNA, 17 bp, Homo sapiens
cccttccttttccctgc

SEQ ID NO: 3337666 - DNA, 18 bp, Homo sapiens
cccttccttttccctgct

SEQ ID NO: 3337667 - DNA, 14 bp, Homo sapiens
cccttcgctcctgt

SEQ ID NO: 3337668 - DNA, 13 bp, Homo sapiens
cccttctcacagc

SEQ ID NO: 3337669 - DNA, 15 bp, Homo sapiens
cccttctcccagcac

SEQ ID NO: 3337670 - DNA, 15 bp, Homo sapiens
cccttctctgctcca

SEQ ID NO: 3337671 - DNA, 20 bp, Homo sapiens
cccttctgggcatctgttct

SEQ ID NO: 3337672 - DNA, 17 bp, Homo sapiens
cccttctgtgtcacagt

SEQ ID NO: 3337673 - DNA, 14 bp, Homo sapiens
cccttcttgggccc

SEQ ID NO: 3337674 - DNA, 18 bp, Homo sapiens
cccttcttgggccccaga

SEQ ID NO: 3337675 - DNA, 11 bp, Homo sapiens
cccttcttttt

SEQ ID NO: 3337676 - DNA, 16 bp, Homo sapiens
cccttgaaggaagagg

SEQ ID NO: 3337677 - DNA, 15 bp, Homo sapiens
cccttgacaccgggg

SEQ ID NO: 3337678 - DNA, 23 bp, Homo sapiens
cccttgacgtcaagtctccttcc

SEQ ID NO: 3337679 - DNA, 20 bp, Homo sapiens
cccttgcaccgtcctcagca

SEQ ID NO: 3337680 - DNA, 13 bp, Homo sapiens
cccttgcacgtaa

SEQ ID NO: 3337681 - DNA, 19 bp, Homo sapiens
cccttgcagctagttttct

SEQ ID NO: 3337682 - DNA, 19 bp, Homo sapiens
cccttgcagttcagcacca

SEQ ID NO: 3337683 - DNA, 15 bp, Homo sapiens
cccttgcccccatcc

SEQ ID NO: 3337684 - DNA, 18 bp, Homo sapiens
cccttgcccccatccctc

SEQ ID NO: 3337685 - DNA, 13 bp, Homo sapiens
cctcctgtgtgac

SEQ ID NO: 3337686 - DNA, 16 bp, Homo sapiens
cctcctgttctgccca

SEQ ID NO: 3337687 - DNA, 18 bp, Homo sapiens
cctccttagccctgtctg

SEQ ID NO: 3337688 - DNA, 22 bp, Homo sapiens
cctccttagccctgtctgctag

SEQ ID NO: 3337689 - DNA, 22 bp, Homo sapiens
cctccttagctttccctgtgcc

SEQ ID NO: 3337690 - DNA, 13 bp, Homo sapiens
cctccttcagaca

SEQ ID NO: 3337691 - DNA, 16 bp, Homo sapiens
cctccttccacctccc

SEQ ID NO: 3337692 - DNA, 14 bp, Homo sapiens
cctccttcccatgc

SEQ ID NO: 3337693 - DNA, 17 bp, Homo sapiens
cctccttctcccttttt

SEQ ID NO: 3337694 - DNA, 14 bp, Homo sapiens
cctccttgagactg

SEQ ID NO: 3337695 - DNA, 16 bp, Homo sapiens
cctccttgagactgga

SEQ ID NO: 3337696 - DNA, 17 bp, Homo sapiens
cctccttgcccagacta

SEQ ID NO: 3337697 - DNA, 13 bp, Homo sapiens
cctcctttatcac

SEQ ID NO: 3337698 - DNA, 13 bp, Homo sapiens
cctcctttctgtg

SEQ ID NO: 3337699 - DNA, 20 bp, Homo sapiens
cctcgaaacacagaaacctt

SEQ ID NO: 3337700 - DNA, 19 bp, Homo sapiens
cctcgaaccaaggcagcct

SEQ ID NO: 3337701 - DNA, 23 bp, Homo sapiens
cctcgaaccaaggcagcctccag

SEQ ID NO: 3337702 - DNA, 16 bp, Homo sapiens
cctcgaactggctgca

SEQ ID NO: 3337703 - DNA, 22 bp, Homo sapiens
cctcgacagcgcccctgctgtc

SEQ ID NO: 3337704 - DNA, 20 bp, Homo sapiens
cctcgacagggcctggagcc

SEQ ID NO: 3337705 - DNA, 22 bp, Homo sapiens
cctcgagatgggtgctggtcct

SEQ ID NO: 3337706 - DNA, 15 bp, Homo sapiens
cctcgaggcaccggc

SEQ ID NO: 3337707 - DNA, 20 bp, Homo sapiens
cctcgaggcaccggcgctgc

SEQ ID NO: 3337708 - DNA, 21 bp, Homo sapiens
cctcgcctaccaatctctgct

SEQ ID NO: 3337709 - DNA, 23 bp, Homo sapiens
cctcggaaccgctcacctagagc

SEQ ID NO: 3337710 - DNA, 14 bp, Homo sapiens
cctcggagagcagc

SEQ ID NO: 3337711 - DNA, 15 bp, Homo sapiens
cctcggagagcagca

SEQ ID NO: 3337712 - DNA, 21 bp, Homo sapiens
cctcggagagcagcagcacca

SEQ ID NO: 3337713 - DNA, 18 bp, Homo sapiens
cctcggcttgtgggctgg

SEQ ID NO: 3337714 - DNA, 20 bp, Homo sapiens
cctcggcttgtgggctggtg

SEQ ID NO: 3337715 - DNA, 16 bp, Homo sapiens
cctcgggaagcagcca

SEQ ID NO: 3337716 - DNA, 19 bp, Homo sapiens
cctcgggaagcagccagct

SEQ ID NO: 3337717 - DNA, 13 bp, Homo sapiens
cctcgggcccacc

SEQ ID NO: 3337718 - DNA, 15 bp, Homo sapiens
cctcgggcccacctg

SEQ ID NO: 3337719 - DNA, 17 bp, Homo sapiens
cctcgggcccacctggc

SEQ ID NO: 3337720 - DNA, 21 bp, Homo sapiens
cctcgggcccacctggccacc

SEQ ID NO: 3337721 - DNA, 19 bp, Homo sapiens
cctcgggccgaggcccagc

SEQ ID NO: 3337722 - DNA, 16 bp, Homo sapiens
cctcggggctccaggc

SEQ ID NO: 3337723 - DNA, 19 bp, Homo sapiens
cctcggggggtcacaggcc

SEQ ID NO: 3337724 - DNA, 23 bp, Homo sapiens
cctcggggggtcacaggcccaga

SEQ ID NO: 3337725 - DNA, 16 bp, Homo sapiens
cctcggtagcagaggc

SEQ ID NO: 3337726 - DNA, 18 bp, Homo sapiens
cctcggtggctgcacaga

SEQ ID NO: 3337727 - DNA, 23 bp, Homo sapiens
cctcgtccacaggggcaggcctg

SEQ ID NO: 3337728 - DNA, 14 bp, Homo sapiens
cctcgtcctgtccc

SEQ ID NO: 3337729 - DNA, 15 bp, Homo sapiens
cctcgtgaggggcaa

SEQ ID NO: 3337730 - DNA, 17 bp, Homo sapiens
cctcgtgcctgggggag

SEQ ID NO: 3337731 - DNA, 14 bp, Homo sapiens
cctcgtggccagcc

SEQ ID NO: 3337732 - DNA, 15 bp, Homo sapiens
cctcgtggccagccc

SEQ ID NO: 3337733 - DNA, 15 bp, Homo sapiens
cctcgtggtccccaa

SEQ ID NO: 3337734 - DNA, 22 bp, Homo sapiens
cctcgtggttattagcaaggct

SEQ ID NO: 3337735 - DNA, 15 bp, Homo sapiens
cctcgtgtcagctca

SEQ ID NO: 3337736 - DNA, 12 bp, Homo sapiens
cctctaaaccta

SEQ ID NO: 3337737 - DNA, 23 bp, Homo sapiens
cctctaaagcaataatggtccca

SEQ ID NO: 3337738 - DNA, 15 bp, Homo sapiens
cctctaatgagactg

SEQ ID NO: 3337739 - DNA, 16 bp, Homo sapiens
cctctactttccaggc

SEQ ID NO: 3337740 - DNA, 17 bp, Homo sapiens
cctctagaaatttttca

SEQ ID NO: 3337741 - DNA, 19 bp, Homo sapiens
cctctagaaatttttcaga

SEQ ID NO: 3337742 - DNA, 18 bp, Homo sapiens
cctctagaagccaaggga

SEQ ID NO: 3337743 - DNA, 14 bp, Homo sapiens
cctctagcaggcct

SEQ ID NO: 3337744 - DNA, 22 bp, Homo sapiens
cctctagctgtgggggtgaggg

SEQ ID NO: 3337745 - DNA, 17 bp, Homo sapiens
cctctaggcaagcagga

SEQ ID NO: 3337746 - DNA, 20 bp, Homo sapiens
cctctaggcaagcaggacct

SEQ ID NO: 3337747 - DNA, 22 bp, Homo sapiens
cctctaggcaagcaggacctgg

SEQ ID NO: 3337748 - DNA, 13 bp, Homo sapiens
cctctatacatct

SEQ ID NO: 3337749 - DNA, 17 bp, Homo sapiens
cctgaacaagaattgga

SEQ ID NO: 3337750 - DNA, 20 bp, Homo sapiens
cctgaaccccatgggcttgg

SEQ ID NO: 3337751 - DNA, 15 bp, Homo sapiens
cctgaagactgagga

SEQ ID NO: 3337752 - DNA, 18 bp, Homo sapiens
cctgaagaggcgggccag

SEQ ID NO: 3337753 - DNA, 12 bp, Homo sapiens
cctgaagccagc

SEQ ID NO: 3337754 - DNA, 14 bp, Homo sapiens
cctgaagccagcct

SEQ ID NO: 3337755 - DNA, 18 bp, Homo sapiens
cctgaagccagccttctt

SEQ ID NO: 3337756 - DNA, 21 bp, Homo sapiens
cctgaataccacttacctcaa

SEQ ID NO: 3337757 - DNA, 22 bp, Homo sapiens
cctgaatggttccatgcctgag

SEQ ID NO: 3337758 - DNA, 21 bp, Homo sapiens
cctgaattctatttgctgggc

SEQ ID NO: 3337759 - DNA, 18 bp, Homo sapiens
cctgacacaccaggcgct

SEQ ID NO: 3337760 - DNA, 15 bp, Homo sapiens
cctgacactgagccc

SEQ ID NO: 3337761 - DNA, 13 bp, Homo sapiens
cctgacactttaa

SEQ ID NO: 3337762 - DNA, 16 bp, Homo sapiens
cctgacagaaggtgcc

SEQ ID NO: 3337763 - DNA, 13 bp, Homo sapiens
cctgacattgtct

SEQ ID NO: 3337764 - DNA, 15 bp, Homo sapiens
cctgacccaggccgc

SEQ ID NO: 3337765 - DNA, 16 bp, Homo sapiens
cctgacccaggccgca

SEQ ID NO: 3337766 - DNA, 18 bp, Homo sapiens
cctgacccaggccgcagc

SEQ ID NO: 3337767 - DNA, 14 bp, Homo sapiens
cctgaccccttgct

SEQ ID NO: 3337768 - DNA, 15 bp, Homo sapiens
cctgaccccttgctc

SEQ ID NO: 3337769 - DNA, 19 bp, Homo sapiens
cctgaccccttgctccctt

SEQ ID NO: 3337770 - DNA, 13 bp, Homo sapiens
cctgacctcccag

SEQ ID NO: 3337771 - DNA, 17 bp, Homo sapiens
cctgacctcccagccct

SEQ ID NO: 3337772 - DNA, 17 bp, Homo sapiens
cctgacctcttgctgtc

SEQ ID NO: 3337773 - DNA, 19 bp, Homo sapiens
cctgacctcttgctgtctc

SEQ ID NO: 3337774 - DNA, 20 bp, Homo sapiens
cctgacctcttgctgtctct

SEQ ID NO: 3337775 - DNA, 21 bp, Homo sapiens
cctgacctcttgctgtctctg

SEQ ID NO: 3337776 - DNA, 24 bp, Homo sapiens
cctgaccttggctgactggggctg

SEQ ID NO: 3337777 - DNA, 21 bp, Homo sapiens
cctgacgaaactggccccgga

SEQ ID NO: 3337778 - DNA, 14 bp, Homo sapiens
cctgacgccctgcg

SEQ ID NO: 3337779 - DNA, 21 bp, Homo sapiens
cctgacgccctgcgttggagc

SEQ ID NO: 3337780 - DNA, 19 bp, Homo sapiens
cctgacggcgcccccagtg

SEQ ID NO: 3337781 - DNA, 18 bp, Homo sapiens
cctgactctctgtgacct

SEQ ID NO: 3337782 - DNA, 18 bp, Homo sapiens
cctgactctgaaatctga

SEQ ID NO: 3337783 - DNA, 14 bp, Homo sapiens
cctgagaaaggtga

SEQ ID NO: 3337784 - DNA, 15 bp, Homo sapiens
cctgagaagctgctc

SEQ ID NO: 3337785 - DNA, 17 bp, Homo sapiens
cctgagaagctgctcca

SEQ ID NO: 3337786 - DNA, 19 bp, Homo sapiens
cctgagaagctgctccagg

SEQ ID NO: 3337787 - DNA, 19 bp, Homo sapiens
cctgagaaggcgaggagag

SEQ ID NO: 3337788 - DNA, 19 bp, Homo sapiens
cctgagaccctgggagaga

SEQ ID NO: 3337789 - DNA, 23 bp, Homo sapiens
cctgagactccagaatctgctgt

SEQ ID NO: 3337790 - DNA, 22 bp, Homo sapiens
cctgagactgtcggagaggctg

SEQ ID NO: 3337791 - DNA, 18 bp, Homo sapiens
cctgagagaattggctca

SEQ ID NO: 3337792 - DNA, 13 bp, Homo sapiens
cctgagaggcagg

SEQ ID NO: 3337793 - DNA, 20 bp, Homo sapiens
cctgagaggggaagcggccc

SEQ ID NO: 3337794 - DNA, 17 bp, Homo sapiens
cctgagatcccctgagc

SEQ ID NO: 3337795 - DNA, 23 bp, Homo sapiens
cctgagcaacagagtgagaccct

SEQ ID NO: 3337796 - DNA, 21 bp, Homo sapiens
cctgagccccagggtgcccag

SEQ ID NO: 3337797 - DNA, 14 bp, Homo sapiens
cctgcagatgccac

SEQ ID NO: 3337798 - DNA, 16 bp, Homo sapiens
cctgcagcacggacaa

SEQ ID NO: 3337799 - DNA, 16 bp, Homo sapiens
cctgcagcatggtccc

SEQ ID NO: 3337800 - DNA, 17 bp, Homo sapiens
cctgcagcatggtccct

SEQ ID NO: 3337801 - DNA, 22 bp, Homo sapiens
cctgcagcccaaaacccagggc

SEQ ID NO: 3337802 - DNA, 17 bp, Homo sapiens
cctgcagccccagaaga

SEQ ID NO: 3337803 - DNA, 15 bp, Homo sapiens
cctgcagcctcctcc

SEQ ID NO: 3337804 - DNA, 18 bp, Homo sapiens
cctgcaggaacgagcact

SEQ ID NO: 3337805 - DNA, 19 bp, Homo sapiens
cctgcaggaacgagcactg

SEQ ID NO: 3337806 - DNA, 21 bp, Homo sapiens
cctgcaggaacgagcactggc

SEQ ID NO: 3337807 - DNA, 22 bp, Homo sapiens
cctgcaggcaggaacaaacagg

SEQ ID NO: 3337808 - DNA, 22 bp, Homo sapiens
cctgcaggccaagagcagaggc

SEQ ID NO: 3337809 - DNA, 16 bp, Homo sapiens
cctgcaggctgagcca

SEQ ID NO: 3337810 - DNA, 15 bp, Homo sapiens
cctgcagggccatct

SEQ ID NO: 3337811 - DNA, 20 bp, Homo sapiens
cctgcagggcgcccctggga

SEQ ID NO: 3337812 - DNA, 23 bp, Homo sapiens
cctgcaggggagcacggagccgc

SEQ ID NO: 3337813 - DNA, 12 bp, Homo sapiens
cctgcagtgttc

SEQ ID NO: 3337814 - DNA, 21 bp, Homo sapiens
cctgcagtgttcgcttggctc

SEQ ID NO: 3337815 - DNA, 23 bp, Homo sapiens
cctgcatcccaggatgctgggtg

SEQ ID NO: 3337816 - DNA, 19 bp, Homo sapiens
cctgcatgggggcaccggg

SEQ ID NO: 3337817 - DNA, 20 bp, Homo sapiens
cctgcatgggggcaccgggc

SEQ ID NO: 3337818 - DNA, 14 bp, Homo sapiens
cctgcattcatgta

SEQ ID NO: 3337819 - DNA, 20 bp, Homo sapiens
cctgccaagtctcagaagag

SEQ ID NO: 3337820 - DNA, 23 bp, Homo sapiens
cctgccacaacagaataaagcag

SEQ ID NO: 3337821 - DNA, 15 bp, Homo sapiens
cctgccaccacacac

SEQ ID NO: 3337822 - DNA, 12 bp, Homo sapiens
cctgccaccagg

SEQ ID NO: 3337823 - DNA, 15 bp, Homo sapiens
cctgccaccaggcca

SEQ ID NO: 3337824 - DNA, 19 bp, Homo sapiens
cctgccaccaggccacctc

SEQ ID NO: 3337825 - DNA, 22 bp, Homo sapiens
cctgccaccggaggtcactcca

SEQ ID NO: 3337826 - DNA, 18 bp, Homo sapiens
cctgccacctccccccac

SEQ ID NO: 3337827 - DNA, 13 bp, Homo sapiens
cctgccactcact

SEQ ID NO: 3337828 - DNA, 18 bp, Homo sapiens
cctgccactcactaggcc

SEQ ID NO: 3337829 - DNA, 21 bp, Homo sapiens
cctgccactcactaggccccc

SEQ ID NO: 3337830 - DNA, 22 bp, Homo sapiens
cctgccactcactaggccccca

SEQ ID NO: 3337831 - DNA, 18 bp, Homo sapiens
cctgccagagctttgttt

SEQ ID NO: 3337832 - DNA, 18 bp, Homo sapiens
cctgccagaggggaagga

SEQ ID NO: 3337833 - DNA, 18 bp, Homo sapiens
cctgccagcacgcctggc

SEQ ID NO: 3337834 - DNA, 16 bp, Homo sapiens
cctgccagcctggctt

SEQ ID NO: 3337835 - DNA, 17 bp, Homo sapiens
cctgccagcctggcttc

SEQ ID NO: 3337836 - DNA, 21 bp, Homo sapiens
cctgccagcctggcttctgga

SEQ ID NO: 3337837 - DNA, 23 bp, Homo sapiens
cctgccttgaagccactgaagct

SEQ ID NO: 3337838 - DNA, 22 bp, Homo sapiens
cctgccttggggaaggtctccc

SEQ ID NO: 3337839 - DNA, 15 bp, Homo sapiens
cctgcctttaagcca

SEQ ID NO: 3337840 - DNA, 11 bp, Homo sapiens
cctgcctttta

SEQ ID NO: 3337841 - DNA, 20 bp, Homo sapiens
cctgcgaaggggccctggtc

SEQ ID NO: 3337842 - DNA, 20 bp, Homo sapiens
cctgcgagacgcacacagct

SEQ ID NO: 3337843 - DNA, 19 bp, Homo sapiens
cctgcgccccgcccacacc

SEQ ID NO: 3337844 - DNA, 16 bp, Homo sapiens
cctgcgctcggcagga

SEQ ID NO: 3337845 - DNA, 20 bp, Homo sapiens
cctgcgctcggcaggaagga

SEQ ID NO: 3337846 - DNA, 20 bp, Homo sapiens
cctgcgggaccatctggggc

SEQ ID NO: 3337847 - DNA, 17 bp, Homo sapiens
cctgcgggcgcgggcag

SEQ ID NO: 3337848 - DNA, 12 bp, Homo sapiens
cctgcgggctgc

SEQ ID NO: 3337849 - DNA, 20 bp, Homo sapiens
cctgcgggtggggcttgggg

SEQ ID NO: 3337850 - DNA, 17 bp, Homo sapiens
cctgcggtcaggctggg

SEQ ID NO: 3337851 - DNA, 23 bp, Homo sapiens
cctgcggtcaggctgggcagccc

SEQ ID NO: 3337852 - DNA, 13 bp, Homo sapiens
cctgcgtcctcct

SEQ ID NO: 3337853 - DNA, 17 bp, Homo sapiens
cctgcgtcctcctcacc

SEQ ID NO: 3337854 - DNA, 18 bp, Homo sapiens
cctgcgtcctcctcacct

SEQ ID NO: 3337855 - DNA, 20 bp, Homo sapiens
cctgcgtcctgacgccctgc

SEQ ID NO: 3337856 - DNA, 15 bp, Homo sapiens
cctgcgtggcctgag

SEQ ID NO: 3337857 - DNA, 16 bp, Homo sapiens
cctgcgtggcctgagt

SEQ ID NO: 3337858 - DNA, 14 bp, Homo sapiens
cctgcgttggagcc

SEQ ID NO: 3337859 - DNA, 19 bp, Homo sapiens
cctgcgttggagccactcc

SEQ ID NO: 3337860 - DNA, 20 bp, Homo sapiens
cctgcgttggagccactcct

SEQ ID NO: 3337861 - DNA, 23 bp, Homo sapiens
cctgcgttggagccactcctgtc

SEQ ID NO: 3337862 - DNA, 18 bp, Homo sapiens
cctgctaaggctcctcct

SEQ ID NO: 3337863 - DNA, 19 bp, Homo sapiens
cctgctaaggctcctcctt

SEQ ID NO: 3337864 - DNA, 21 bp, Homo sapiens
cctgctaattccccagattgc

SEQ ID NO: 3337865 - DNA, 20 bp, Homo sapiens
cctgctacaacttcagcagt

SEQ ID NO: 3337866 - DNA, 14 bp, Homo sapiens
cctgctacaggagg

SEQ ID NO: 3337867 - DNA, 20 bp, Homo sapiens
cctgctactcctgtgctctg

SEQ ID NO: 3337868 - DNA, 14 bp, Homo sapiens
cctgctagagcaac

SEQ ID NO: 3337869 - DNA, 15 bp, Homo sapiens
cctgctagagcaacc

SEQ ID NO: 3337870 - DNA, 24 bp, Homo sapiens
cctggacttaagcatctggctcta

SEQ ID NO: 3337871 - DNA, 13 bp, Homo sapiens
cctggactttcct

SEQ ID NO: 3337872 - DNA, 15 bp, Homo sapiens
cctggactttcctgc

SEQ ID NO: 3337873 - DNA, 12 bp, Homo sapiens
cctggagaacta

SEQ ID NO: 3337874 - DNA, 16 bp, Homo sapiens
cctggagaactagaga

SEQ ID NO: 3337875 - DNA, 22 bp, Homo sapiens
cctggagacccaccccacctgc

SEQ ID NO: 3337876 - DNA, 22 bp, Homo sapiens
cctggagagcgaggaggcgcgg

SEQ ID NO: 3337877 - DNA, 15 bp, Homo sapiens
cctggagatcctcct

SEQ ID NO: 3337878 - DNA, 21 bp, Homo sapiens
cctggagatcctcctgcagac

SEQ ID NO: 3337879 - DNA, 16 bp, Homo sapiens
cctggagcccacaacc

SEQ ID NO: 3337880 - DNA, 11 bp, Homo sapiens
cctggagcccc

SEQ ID NO: 3337881 - DNA, 22 bp, Homo sapiens
cctggagccccatcggccaaga

SEQ ID NO: 3337882 - DNA, 17 bp, Homo sapiens
cctggagcccctgggtg

SEQ ID NO: 3337883 - DNA, 22 bp, Homo sapiens
cctggaggaattcagctcagct

SEQ ID NO: 3337884 - DNA, 19 bp, Homo sapiens
cctggaggggctggggact

SEQ ID NO: 3337885 - DNA, 18 bp, Homo sapiens
cctggatattattcttgt

SEQ ID NO: 3337886 - DNA, 19 bp, Homo sapiens
cctggatctccccactcta

SEQ ID NO: 3337887 - DNA, 16 bp, Homo sapiens
cctggatgacattaaa

SEQ ID NO: 3337888 - DNA, 22 bp, Homo sapiens
cctggatgatttcatcttctgg

SEQ ID NO: 3337889 - DNA, 17 bp, Homo sapiens
cctggatgtgtggggca

SEQ ID NO: 3337890 - DNA, 18 bp, Homo sapiens
cctggatgtgtggggcat

SEQ ID NO: 3337891 - DNA, 20 bp, Homo sapiens
cctggatgtgtggggcatgg

SEQ ID NO: 3337892 - DNA, 23 bp, Homo sapiens
cctggatttatagtatgtgactt

SEQ ID NO: 3337893 - DNA, 14 bp, Homo sapiens
cctggatttctggt

SEQ ID NO: 3337894 - DNA, 18 bp, Homo sapiens
cctggattttttaaatca

SEQ ID NO: 3337895 - DNA, 20 bp, Homo sapiens
cctggattttttaaatcata

SEQ ID NO: 3337896 - DNA, 14 bp, Homo sapiens
cctgggctggaatc

SEQ ID NO: 3337897 - DNA, 13 bp, Homo sapiens
cctgggctggact

SEQ ID NO: 3337898 - DNA, 15 bp, Homo sapiens
cctgggctggactgg

SEQ ID NO: 3337899 - DNA, 23 bp, Homo sapiens
cctgggctgttggcactcacaga

SEQ ID NO: 3337900 - DNA, 13 bp, Homo sapiens
cctgggcttggcc

SEQ ID NO: 3337901 - DNA, 14 bp, Homo sapiens
cctgggcttggcct

SEQ ID NO: 3337902 - DNA, 20 bp, Homo sapiens
cctgggcttggcctgctgtg

SEQ ID NO: 3337903 - DNA, 13 bp, Homo sapiens
cctggggaaggag

SEQ ID NO: 3337904 - DNA, 15 bp, Homo sapiens
cctggggagaaagta

SEQ ID NO: 3337905 - DNA, 16 bp, Homo sapiens
cctggggcagcactcc

SEQ ID NO: 3337906 - DNA, 21 bp, Homo sapiens
cctggggccggtagaggctcc

SEQ ID NO: 3337907 - DNA, 23 bp, Homo sapiens
cctggggccggtagaggctcccc

SEQ ID NO: 3337908 - DNA, 14 bp, Homo sapiens
cctggggcctgaga

SEQ ID NO: 3337909 - DNA, 17 bp, Homo sapiens
cctggggcctgagagaa

SEQ ID NO: 3337910 - DNA, 13 bp, Homo sapiens
cctggggcctggc

SEQ ID NO: 3337911 - DNA, 16 bp, Homo sapiens
cctggggcctggcagg

SEQ ID NO: 3337912 - DNA, 20 bp, Homo sapiens
cctggggctcctttctccag

SEQ ID NO: 3337913 - DNA, 21 bp, Homo sapiens
cctggggctcctttctccagc

SEQ ID NO: 3337914 - DNA, 12 bp, Homo sapiens
cctggggctggg

SEQ ID NO: 3337915 - DNA, 17 bp, Homo sapiens
cctggggcttctcctga

SEQ ID NO: 3337916 - DNA, 20 bp, Homo sapiens
cctgggggagttttcctcta

SEQ ID NO: 3337917 - DNA, 21 bp, Homo sapiens
cctgggggcagtgactggcag

SEQ ID NO: 3337918 - DNA, 14 bp, Homo sapiens
cctgggggtggcag

SEQ ID NO: 3337919 - DNA, 22 bp, Homo sapiens
cctgggggtggcaggcacacag

SEQ ID NO: 3337920 - DNA, 22 bp, Homo sapiens
cctgggggttctttcttcctct

SEQ ID NO: 3337921 - DNA, 17 bp, Homo sapiens
cctgggggtttcacctg

SEQ ID NO: 3337922 - DNA, 21 bp, Homo sapiens
cctgggggtttcacctgggcc

SEQ ID NO: 3337923 - DNA, 22 bp, Homo sapiens
cctggggtataaaactttcctc

SEQ ID NO: 3337924 - DNA, 22 bp, Homo sapiens
cctggggtgcatcctcctcagc

SEQ ID NO: 3337925 - DNA, 20 bp, Homo sapiens
cctgggtccaaataaaaact

SEQ ID NO: 3337926 - DNA, 20 bp, Homo sapiens
cctgggtcctgttccctacc

SEQ ID NO: 3337927 - DNA, 17 bp, Homo sapiens
cctgggtctgtgtctct

SEQ ID NO: 3337928 - DNA, 21 bp, Homo sapiens
cctgggtctgtgtctcttttc

SEQ ID NO: 3337929 - DNA, 15 bp, Homo sapiens
cctgggtgggctctg

SEQ ID NO: 3337930 - DNA, 16 bp, Homo sapiens
cctgggtgggctctgt

SEQ ID NO: 3337931 - DNA, 19 bp, Homo sapiens
cctgggtgggtggtgggga

SEQ ID NO: 3337932 - DNA, 23 bp, Homo sapiens
cctgggttgggggcactcagcca

SEQ ID NO: 3337933 - DNA, 16 bp, Homo sapiens
cctgggtttcctgcag

SEQ ID NO: 3337934 - DNA, 20 bp, Homo sapiens
cctggtaaccaaatattaaa

SEQ ID NO: 3337935 - DNA, 13 bp, Homo sapiens
cctggtacccagc

SEQ ID NO: 3337936 - DNA, 14 bp, Homo sapiens
cctggtacccagcc

SEQ ID NO: 3337937 - DNA, 18 bp, Homo sapiens
cctggtacccagccatct

SEQ ID NO: 3337938 - DNA, 19 bp, Homo sapiens
cctggtacccagccatctg

SEQ ID NO: 3337939 - DNA, 13 bp, Homo sapiens
cctggtactccct

SEQ ID NO: 3337940 - DNA, 21 bp, Homo sapiens
cctggtcacaggactctgcct

SEQ ID NO: 3337941 - DNA, 21 bp, Homo sapiens
cctggtccagggaagctggcc

SEQ ID NO: 3337942 - DNA, 15 bp, Homo sapiens
cctggtccctcgtcc

SEQ ID NO: 3337943 - DNA, 12 bp, Homo sapiens
cctggtccctct

SEQ ID NO: 3337944 - DNA, 16 bp, Homo sapiens
cctggtccctgggagg

SEQ ID NO: 3337945 - DNA, 19 bp, Homo sapiens
cctggtccttccaggcccc

SEQ ID NO: 3337946 - DNA, 13 bp, Homo sapiens
cctggtgactcct

SEQ ID NO: 3337947 - DNA, 17 bp, Homo sapiens
cctggtgcccctcgcca

SEQ ID NO: 3337948 - DNA, 9 bp, Homo sapiens
cctggtgct

SEQ ID NO: 3337949 - DNA, 17 bp, Homo sapiens
cctggtgctacttgctt

SEQ ID NO: 3337950 - DNA, 21 bp, Homo sapiens
cctggtgctgccacacttcag

SEQ ID NO: 3337951 - DNA, 15 bp, Homo sapiens
cctggtgcttccaaa

SEQ ID NO: 3337952 - DNA, 16 bp, Homo sapiens
cctggtgcttcccacg

SEQ ID NO: 3337953 - DNA, 22 bp, Homo sapiens
cctggtggagaaagcactgacc

SEQ ID NO: 3337954 - DNA, 18 bp, Homo sapiens
cctggtggcaccagatgc

SEQ ID NO: 3337955 - DNA, 15 bp, Homo sapiens
cctggtggcagctgc

SEQ ID NO: 3337956 - DNA, 14 bp, Homo sapiens
cctggtggcagtgg

SEQ ID NO: 3337957 - DNA, 15 bp, Homo sapiens
cctggtggcagtggg

SEQ ID NO: 3337958 - DNA, 18 bp, Homo sapiens
cctggtggcagtgggagc

SEQ ID NO: 3337959 - DNA, 17 bp, Homo sapiens
cctggtggccttctgct

SEQ ID NO: 3337960 - DNA, 16 bp, Homo sapiens
cctggtggtcagatgc

SEQ ID NO: 3337961 - DNA, 16 bp, Homo sapiens
cctggttcatatttat

SEQ ID NO: 3337962 - DNA, 22 bp, Homo sapiens
cctggttccttcctatgcccag

SEQ ID NO: 3337963 - DNA, 21 bp, Homo sapiens
cctggtttcataacttcctgt

SEQ ID NO: 3337964 - DNA, 22 bp, Homo sapiens
cctggtttttaaatagagtttg

SEQ ID NO: 3337965 - DNA, 19 bp, Homo sapiens
cctggtttttggattaaat

SEQ ID NO: 3337966 - DNA, 23 bp, Homo sapiens
cctgtaacatactggcctggact

SEQ ID NO: 3337967 - DNA, 16 bp, Homo sapiens
cctgtaagaaacagag

SEQ ID NO: 3337968 - DNA, 16 bp, Homo sapiens
cctgtaagccaaagaa

SEQ ID NO: 3337969 - DNA, 14 bp, Homo sapiens
cctgtaagcctgca

SEQ ID NO: 3337970 - DNA, 20 bp, Homo sapiens
cctgtaatcagctctcctgg

SEQ ID NO: 3337971 - DNA, 20 bp, Homo sapiens
cctgtaatcatataataaat

SEQ ID NO: 3337972 - DNA, 15 bp, Homo sapiens
cctgtaatcccaact

SEQ ID NO: 3337973 - DNA, 15 bp, Homo sapiens
cctgtaatcccagct

SEQ ID NO: 3337974 - DNA, 20 bp, Homo sapiens
cctgtacagtagattttcca

SEQ ID NO: 3337975 - DNA, 18 bp, Homo sapiens
cctgtaccaaatctgaca

SEQ ID NO: 3337976 - DNA, 13 bp, Homo sapiens
cctgtacccagct

SEQ ID NO: 3337977 - DNA, 14 bp, Homo sapiens
cctgtacccagctc

SEQ ID NO: 3337978 - DNA, 15 bp, Homo sapiens
cctgtacccagctcc

SEQ ID NO: 3337979 - DNA, 14 bp, Homo sapiens
cctgtaccccagca

SEQ ID NO: 3337980 - DNA, 16 bp, Homo sapiens
cctgtacctcagtgga

SEQ ID NO: 3337981 - DNA, 16 bp, Homo sapiens
cctgtacctcatccca

SEQ ID NO: 3337982 - DNA, 23 bp, Homo sapiens
cctgtaccttttgaggagcccca

SEQ ID NO: 3337983 - DNA, 13 bp, Homo sapiens
cctgtactcagga

SEQ ID NO: 3337984 - DNA, 14 bp, Homo sapiens
cctgtactcaggag

SEQ ID NO: 3337985 - DNA, 23 bp, Homo sapiens
cctgtactgtatggaaacactga

SEQ ID NO: 3337986 - DNA, 23 bp, Homo sapiens
cctgtagacctagggaggacctt

SEQ ID NO: 3337987 - DNA, 15 bp, Homo sapiens
cctgtagatgttcta

SEQ ID NO: 3337988 - DNA, 16 bp, Homo sapiens
cctgtagatgttctag

SEQ ID NO: 3337989 - DNA, 18 bp, Homo sapiens
cctgtagatgttctagga

SEQ ID NO: 3337990 - DNA, 19 bp, Homo sapiens
cctgtagatgttctaggat

SEQ ID NO: 3337991 - DNA, 17 bp, Homo sapiens
cctgtagcacttactgg

SEQ ID NO: 3337992 - DNA, 15 bp, Homo sapiens
cctgtagccatctgc

SEQ ID NO: 3337993 - DNA, 13 bp, Homo sapiens
cctgtagctctgc

SEQ ID NO: 3337994 - DNA, 14 bp, Homo sapiens
cctgtagctctgcc

SEQ ID NO: 3337995 - DNA, 15 bp, Homo sapiens
cctgtagctctgcct

SEQ ID NO: 3337996 - DNA, 18 bp, Homo sapiens
cctgtagctttcctggtc

SEQ ID NO: 3337997 - DNA, 22 bp, Homo sapiens
cctgtagctttcctggtccctc

SEQ ID NO: 3337998 - DNA, 14 bp, Homo sapiens
cctgtagttaggaa

SEQ ID NO: 3337999 - DNA, 16 bp, Homo sapiens
cctgtagttaggaaat

SEQ ID NO: 3338000 - DNA, 21 bp, Homo sapiens
cctgtagttaggaaataaaac

SEQ ID NO: 3338001 - DNA, 21 bp, Homo sapiens
cctgtagttgcgtggactctg

SEQ ID NO: 3338002 - DNA, 23 bp, Homo sapiens
cctgtagttgcgtggactctgca

SEQ ID NO: 3338003 - DNA, 13 bp, Homo sapiens
cctgtataagcac

SEQ ID NO: 3338004 - DNA, 16 bp, Homo sapiens
cctgtataagtggagg

SEQ ID NO: 3338005 - DNA, 13 bp, Homo sapiens
cctgtatacttta

SEQ ID NO: 3338006 - DNA, 15 bp, Homo sapiens
ccttcctatgcccag

SEQ ID NO: 3338007 - DNA, 16 bp, Homo sapiens
ccttcctcatccaccc

SEQ ID NO: 3338008 - DNA, 18 bp, Homo sapiens
ccttcctcatccacccca

SEQ ID NO: 3338009 - DNA, 14 bp, Homo sapiens
ccttcctccatcct

SEQ ID NO: 3338010 - DNA, 14 bp, Homo sapiens
ccttcctccctgtc

SEQ ID NO: 3338011 - DNA, 20 bp, Homo sapiens
ccttcctcctccacagtgct

SEQ ID NO: 3338012 - DNA, 23 bp, Homo sapiens
ccttcctcctccacagtgctgct

SEQ ID NO: 3338013 - DNA, 13 bp, Homo sapiens
ccttcctctcact

SEQ ID NO: 3338014 - DNA, 20 bp, Homo sapiens
ccttcctctcactcctgcct

SEQ ID NO: 3338015 - DNA, 21 bp, Homo sapiens
ccttcctctcactcctgcctc

SEQ ID NO: 3338016 - DNA, 15 bp, Homo sapiens
ccttcctctccactg

SEQ ID NO: 3338017 - DNA, 16 bp, Homo sapiens
ccttcctctccactgc

SEQ ID NO: 3338018 - DNA, 14 bp, Homo sapiens
ccttcctctggggc

SEQ ID NO: 3338019 - DNA, 11 bp, Homo sapiens
ccttcctggaa

SEQ ID NO: 3338020 - DNA, 19 bp, Homo sapiens
ccttcctggaaacagcatg

SEQ ID NO: 3338021 - DNA, 11 bp, Homo sapiens
ccttcctggcc

SEQ ID NO: 3338022 - DNA, 13 bp, Homo sapiens
ccttcctggcctc

SEQ ID NO: 3338023 - DNA, 15 bp, Homo sapiens
ccttcctggcctcac

SEQ ID NO: 3338024 - DNA, 20 bp, Homo sapiens
ccttcctggcctcactggct

SEQ ID NO: 3338025 - DNA, 12 bp, Homo sapiens
ccttcctgggag

SEQ ID NO: 3338026 - DNA, 14 bp, Homo sapiens
ccttccttgacctt

SEQ ID NO: 3338027 - DNA, 20 bp, Homo sapiens
ccttccttgctgtcctaggc

SEQ ID NO: 3338028 - DNA, 19 bp, Homo sapiens
ccttcctttaggtctggtt

SEQ ID NO: 3338029 - DNA, 16 bp, Homo sapiens
ccttcctttctccagg

SEQ ID NO: 3338030 - DNA, 17 bp, Homo sapiens
ccttcctttctccagga

SEQ ID NO: 3338031 - DNA, 15 bp, Homo sapiens
ccttcctttggtgcc

SEQ ID NO: 3338032 - DNA, 17 bp, Homo sapiens
ccttcctttggtgcctc

SEQ ID NO: 3338033 - DNA, 18 bp, Homo sapiens
ccttcctttggtgcctca

SEQ ID NO: 3338034 - DNA, 19 bp, Homo sapiens
ccttcctttggtgcctcac

SEQ ID NO: 3338035 - DNA, 13 bp, Homo sapiens
ccttccttttccc

SEQ ID NO: 3338036 - DNA, 21 bp, Homo sapiens
ccttccttttccctgcttcca

SEQ ID NO: 3338037 - DNA, 20 bp, Homo sapiens
ccttcgatacaccgggcctg

SEQ ID NO: 3338038 - DNA, 13 bp, Homo sapiens
ccttcgctcctgt

SEQ ID NO: 3338039 - DNA, 19 bp, Homo sapiens
ccttcgcttcttgcctctg

SEQ ID NO: 3338040 - DNA, 17 bp, Homo sapiens
ccttcggcctccatcct

SEQ ID NO: 3338041 - DNA, 20 bp, Homo sapiens
ccttcggcctccatcctgag

SEQ ID NO: 3338042 - DNA, 15 bp, Homo sapiens
ccttcgggctgtgcc

SEQ ID NO: 3338043 - DNA, 23 bp, Homo sapiens
ccttcggggcgatgctccctcag

SEQ ID NO: 3338044 - DNA, 16 bp, Homo sapiens
ccttcgtctttcccat

SEQ ID NO: 3338045 - DNA, 18 bp, Homo sapiens
ccttcgtgtctctcccac

SEQ ID NO: 3338046 - DNA, 20 bp, Homo sapiens
ccttcgtgtctctcccaccc

SEQ ID NO: 3338047 - DNA, 16 bp, Homo sapiens
ccttctagaacctggg

SEQ ID NO: 3338048 - DNA, 18 bp, Homo sapiens
ccttctagaacctgggct

SEQ ID NO: 3338049 - DNA, 19 bp, Homo sapiens
ccttctagaacctgggctg

SEQ ID NO: 3338050 - DNA, 15 bp, Homo sapiens
ccttctattctagcc

SEQ ID NO: 3338051 - DNA, 15 bp, Homo sapiens
ccttctccaaatgag

SEQ ID NO: 3338052 - DNA, 15 bp, Homo sapiens
ccttctcccagcaca

SEQ ID NO: 3338053 - DNA, 17 bp, Homo sapiens
ccttctccctagctcct

SEQ ID NO: 3338054 - DNA, 16 bp, Homo sapiens
ccttctccttccccag

SEQ ID NO: 3338055 - DNA, 17 bp, Homo sapiens
ccttctccttccccagg

SEQ ID NO: 3338056 - DNA, 16 bp, Homo sapiens
ccttctctatatcatg

SEQ ID NO: 3338057 - DNA, 15 bp, Homo sapiens
ccttctctccctgcc

SEQ ID NO: 3338058 - DNA, 15 bp, Homo sapiens
ccttctctgaacaca

SEQ ID NO: 3338059 - DNA, 22 bp, Homo sapiens
ccttctctgaacacaggcagct

SEQ ID NO: 3338060 - DNA, 13 bp, Homo sapiens
ccttctctgctcc

SEQ ID NO: 3338061 - DNA, 16 bp, Homo sapiens
ccttctctgctccacc

SEQ ID NO: 3338062 - DNA, 21 bp, Homo sapiens
ccttctctgtagggaactctg

SEQ ID NO: 3338063 - DNA, 19 bp, Homo sapiens
ccttctgacggccctgcaa

SEQ ID NO: 3338064 - DNA, 21 bp, Homo sapiens
ccttctgacggccctgcaatg

SEQ ID NO: 3338065 - DNA, 13 bp, Homo sapiens
ccttctgatgtct

SEQ ID NO: 3338066 - DNA, 11 bp, Homo sapiens
ccttctgcagc

SEQ ID NO: 3338067 - DNA, 24 bp, Homo sapiens
ccttctgctgcccaggccacagcc

SEQ ID NO: 3338068 - DNA, 20 bp, Homo sapiens
ccttctgctggataaaatga

SEQ ID NO: 3338069 - DNA, 12 bp, Homo sapiens
ccttctggcctt

SEQ ID NO: 3338070 - DNA, 13 bp, Homo sapiens
ccttctggccttt

SEQ ID NO: 3338071 - DNA, 20 bp, Homo sapiens
ccttctgggcatctgttctg

SEQ ID NO: 3338072 - DNA, 18 bp, Homo sapiens
ccttctgtcctggtgtca

SEQ ID NO: 3338073 - DNA, 21 bp, Homo sapiens
ccttctgtggctcacagaacc

SEQ ID NO: 3338074 - DNA, 22 bp, Homo sapiens
ccttcttctttttgctgttgtt

SEQ ID NO: 3338075 - DNA, 18 bp, Homo sapiens
ccttcttgggccccagac

SEQ ID NO: 3338076 - DNA, 19 bp, Homo sapiens
ccttcttgggccccagacc

SEQ ID NO: 3338077 - DNA, 11 bp, Homo sapiens
ccttcttgtca

SEQ ID NO: 3338078 - DNA, 13 bp, Homo sapiens
ccttctttcctct

SEQ ID NO: 3338079 - DNA, 13 bp, Homo sapiens
ccttctttctgga

SEQ ID NO: 3338080 - DNA, 17 bp, Homo sapiens
ccttctttctggactgg

SEQ ID NO: 3338081 - DNA, 19 bp, Homo sapiens
ccttctttgataatgttaa

SEQ ID NO: 3338082 - DNA, 13 bp, Homo sapiens
ccttctttgtaat

SEQ ID NO: 3338083 - DNA, 14 bp, Homo sapiens
ccttctttttcttc

SEQ ID NO: 3338084 - DNA, 17 bp, Homo sapiens
ccttgaaaaaaaacagt

SEQ ID NO: 3338085 - DNA, 21 bp, Homo sapiens
ccttgaaaataagaatagaaa

SEQ ID NO: 3338086 - DNA, 18 bp, Homo sapiens
ccttgaaactttgggaaa

SEQ ID NO: 3338087 - DNA, 19 bp, Homo sapiens
ccttgaaactttgggaaaa

SEQ ID NO: 3338088 - DNA, 13 bp, Homo sapiens
ccttgaaaggaag

SEQ ID NO: 3338089 - DNA, 17 bp, Homo sapiens
ccttgaagaacctctca

SEQ ID NO: 3338090 - DNA, 14 bp, Homo sapiens
ccttgaagccactg

SEQ ID NO: 3338091 - DNA, 22 bp, Homo sapiens
ccttgaagccactgaagctggg

SEQ ID NO: 3338092 - DNA, 17 bp, Homo sapiens
ccttgaagtgactgttg

SEQ ID NO: 3338093 - DNA, 21 bp, Homo sapiens
ccttgacagggcacaccgggc

SEQ ID NO: 3338094 - DNA, 15 bp, Homo sapiens
ccttgacatcagttc

SEQ ID NO: 3338095 - DNA, 23 bp, Homo sapiens
ccttgacattgtagagcttctgg

SEQ ID NO: 3338096 - DNA, 22 bp, Homo sapiens
ccttgaccttcctctggggctc

SEQ ID NO: 3338097 - DNA, 21 bp, Homo sapiens
ccttgactggacctggtggct

SEQ ID NO: 3338098 - DNA, 19 bp, Homo sapiens
ccttgagaaaccttattgt

SEQ ID NO: 3338099 - DNA, 11 bp, Homo sapiens
ccttgagacca

SEQ ID NO: 3338100 - DNA, 16 bp, Homo sapiens
ccttgagaccacaggg

SEQ ID NO: 3338101 - DNA, 13 bp, Homo sapiens
ccttgagccctgg

SEQ ID NO: 3338102 - DNA, 17 bp, Homo sapiens
ccttgaggattgtggaa

SEQ ID NO: 3338103 - DNA, 23 bp, Homo sapiens
ccttgaggattgtggaaaaccag

SEQ ID NO: 3338104 - DNA, 12 bp, Homo sapiens
ccttgaggtctt

SEQ ID NO: 3338105 - DNA, 15 bp, Homo sapiens
ccttgagtaaaaagg

SEQ ID NO: 3338106 - DNA, 14 bp, Homo sapiens
ccttgagtcagaaa

SEQ ID NO: 3338107 - DNA, 22 bp, Homo sapiens
ccttgagtggggttatctctgt

SEQ ID NO: 3338108 - DNA, 23 bp, Homo sapiens
ccttgagtggggttatctctgtg

SEQ ID NO: 3338109 - DNA, 18 bp, Homo sapiens
ccttgataaatatatatg

SEQ ID NO: 3338110 - DNA, 16 bp, Homo sapiens
ccttgataatatattg

SEQ ID NO: 3338111 - DNA, 23 bp, Homo sapiens
ccttgataatatattgtgttgac

SEQ ID NO: 3338112 - DNA, 11 bp, Homo sapiens
ccttgatcatt

SEQ ID NO: 3338113 - DNA, 14 bp, Homo sapiens
ccttgatcccaatc

SEQ ID NO: 3338114 - DNA, 15 bp, Homo sapiens
ccttgatttgttctt

SEQ ID NO: 3338115 - DNA, 23 bp, Homo sapiens
ccttgcaaagaccataaagtcca

SEQ ID NO: 3338116 - DNA, 14 bp, Homo sapiens
ccttgcacccctca

SEQ ID NO: 3338117 - DNA, 14 bp, Homo sapiens
ccttgcagaactgc

SEQ ID NO: 3338118 - DNA, 17 bp, Homo sapiens
ccttgcagaactgccat

SEQ ID NO: 3338119 - DNA, 22 bp, Homo sapiens
ccttgcagttcagcaccaccct

SEQ ID NO: 3338120 - DNA, 19 bp, Homo sapiens
ccttgccaaagcacttaca

SEQ ID NO: 3338121 - DNA, 17 bp, Homo sapiens
ccttgcccccatccctc

SEQ ID NO: 3338122 - DNA, 19 bp, Homo sapiens
ccttgcccggattctggga

SEQ ID NO: 3338123 - DNA, 14 bp, Homo sapiens
ccttgccctgacct

SEQ ID NO: 3338124 - DNA, 15 bp, Homo sapiens
ccttgcccttgccct

SEQ ID NO: 3338125 - DNA, 17 bp, Homo sapiens
ccttgcccttgccctga

SEQ ID NO: 3338126 - DNA, 14 bp, Homo sapiens
ccttgcctccccat

SEQ ID NO: 3338127 - DNA, 17 bp, Homo sapiens
ccttgccttcccctgtc

SEQ ID NO: 3338128 - DNA, 23 bp, Homo sapiens
ccttgccttcccctgtcttcacc

SEQ ID NO: 3338129 - DNA, 19 bp, Homo sapiens
ccttgcctttgtggccttc

SEQ ID NO: 3338130 - DNA, 14 bp, Homo sapiens
cctttctgtgccct

SEQ ID NO: 3338131 - DNA, 13 bp, Homo sapiens
cctttctgtgtgc

SEQ ID NO: 3338132 - DNA, 13 bp, Homo sapiens
cctttcttggcca

SEQ ID NO: 3338133 - DNA, 12 bp, Homo sapiens
cctttcttttcc

SEQ ID NO: 3338134 - DNA, 17 bp, Homo sapiens
cctttctttttcttctt

SEQ ID NO: 3338135 - DNA, 17 bp, Homo sapiens
cctttgaaacctgctct

SEQ ID NO: 3338136 - DNA, 16 bp, Homo sapiens
cctttgacatttaatt

SEQ ID NO: 3338137 - DNA, 14 bp, Homo sapiens
cctttgacttcagc

SEQ ID NO: 3338138 - DNA, 21 bp, Homo sapiens
cctttgacttcagctgcctga

SEQ ID NO: 3338139 - DNA, 13 bp, Homo sapiens
cctttgagacagt

SEQ ID NO: 3338140 - DNA, 15 bp, Homo sapiens
cctttgagacagttt

SEQ ID NO: 3338141 - DNA, 17 bp, Homo sapiens
cctttgagacagtttct

SEQ ID NO: 3338142 - DNA, 22 bp, Homo sapiens
cctttgagcccacaaagcctta

SEQ ID NO: 3338143 - DNA, 18 bp, Homo sapiens
cctttgcaagatgcttgg

SEQ ID NO: 3338144 - DNA, 18 bp, Homo sapiens
cgagacttggtttcaaaa

SEQ ID NO: 3338145 - DNA, 16 bp, Homo sapiens
cgagagaggagccaga

SEQ ID NO: 3338146 - DNA, 15 bp, Homo sapiens
cgagaggtgggccag

SEQ ID NO: 3338147 - DNA, 22 bp, Homo sapiens
cgagaggtgggccagtctgtgg

SEQ ID NO: 3338148 - DNA, 17 bp, Homo sapiens
cgagatcacgccactgc

SEQ ID NO: 3338149 - DNA, 16 bp, Homo sapiens
cgagatgtgacccacc

SEQ ID NO: 3338150 - DNA, 18 bp, Homo sapiens
cgagattgcaccactgca

SEQ ID NO: 3338151 - DNA, 14 bp, Homo sapiens
cgagcaaagatcaa

SEQ ID NO: 3338152 - DNA, 20 bp, Homo sapiens
cgagcaaagatcaaaataaa

SEQ ID NO: 3338153 - DNA, 20 bp, Homo sapiens
cgagcaatatttatggatgc

SEQ ID NO: 3338154 - DNA, 16 bp, Homo sapiens
cgagcactggccagag

SEQ ID NO: 3338155 - DNA, 17 bp, Homo sapiens
cgagcactggccagaga

SEQ ID NO: 3338156 - DNA, 19 bp, Homo sapiens
cgagcactggccagagagg

SEQ ID NO: 3338157 - DNA, 21 bp, Homo sapiens
cgagcactggccagagagggc

SEQ ID NO: 3338158 - DNA, 21 bp, Homo sapiens
cgagcagtcctgcctcagcct

SEQ ID NO: 3338159 - DNA, 22 bp, Homo sapiens
cgagccaactctaacaggcact

SEQ ID NO: 3338160 - DNA, 15 bp, Homo sapiens
cgagctccagagcaa

SEQ ID NO: 3338161 - DNA, 14 bp, Homo sapiens
cgagctcttggcct

SEQ ID NO: 3338162 - DNA, 17 bp, Homo sapiens
cgagctcttggcctttg

SEQ ID NO: 3338163 - DNA, 13 bp, Homo sapiens
cgagctggtgcat

SEQ ID NO: 3338164 - DNA, 14 bp, Homo sapiens
cgagctggtgcatt

SEQ ID NO: 3338165 - DNA, 15 bp, Homo sapiens
cgagctggtgcatta

SEQ ID NO: 3338166 - DNA, 12 bp, Homo sapiens
cgagctgtcccc

SEQ ID NO: 3338167 - DNA, 21 bp, Homo sapiens
cgagctgtttatgtttttata

SEQ ID NO: 3338168 - DNA, 13 bp, Homo sapiens
cgaggaaaggatt

SEQ ID NO: 3338169 - DNA, 23 bp, Homo sapiens
cgaggaaaggattttaccaaagc

SEQ ID NO: 3338170 - DNA, 14 bp, Homo sapiens
cgaggacagggagg

SEQ ID NO: 3338171 - DNA, 16 bp, Homo sapiens
cgaggacagggaggtg

SEQ ID NO: 3338172 - DNA, 11 bp, Homo sapiens
cgaggagctgg

SEQ ID NO: 3338173 - DNA, 14 bp, Homo sapiens
cgaggagctgggcc

SEQ ID NO: 3338174 - DNA, 16 bp, Homo sapiens
cgaggaggcgcggcct

SEQ ID NO: 3338175 - DNA, 12 bp, Homo sapiens
cgaggaggggcc

SEQ ID NO: 3338176 - DNA, 14 bp, Homo sapiens
cgaggagtaacaat

SEQ ID NO: 3338177 - DNA, 21 bp, Homo sapiens
cgaggagtaacaatacaaatg

SEQ ID NO: 3338178 - DNA, 21 bp, Homo sapiens
cgaggcaccggcgctgcaggt

SEQ ID NO: 3338179 - DNA, 11 bp, Homo sapiens
cgaggcccagc

SEQ ID NO: 3338180 - DNA, 13 bp, Homo sapiens
cgaggcccagcgg

SEQ ID NO: 3338181 - DNA, 18 bp, Homo sapiens
cgaggcccagcgggcaga

SEQ ID NO: 3338182 - DNA, 19 bp, Homo sapiens
cgaggcccagcgggcagat

SEQ ID NO: 3338183 - DNA, 15 bp, Homo sapiens
cgaggcccccgacca

SEQ ID NO: 3338184 - DNA, 23 bp, Homo sapiens
cgaggcctaccccgcagacacct

SEQ ID NO: 3338185 - DNA, 11 bp, Homo sapiens
cgaggctgcta

SEQ ID NO: 3338186 - DNA, 18 bp, Homo sapiens
cgaggctggtgccaggcg

SEQ ID NO: 3338187 - DNA, 21 bp, Homo sapiens
cgagggcagggaccacaccct

SEQ ID NO: 3338188 - DNA, 17 bp, Homo sapiens
cgagggctggctggcct

SEQ ID NO: 3338189 - DNA, 19 bp, Homo sapiens
cgagggctggctggcctca

SEQ ID NO: 3338190 - DNA, 23 bp, Homo sapiens
cgagggctggctggcctcaccca

SEQ ID NO: 3338191 - DNA, 20 bp, Homo sapiens
cgaggggctctcagctcagc

SEQ ID NO: 3338192 - DNA, 15 bp, Homo sapiens
cgagggtcctggctc

SEQ ID NO: 3338193 - DNA, 13 bp, Homo sapiens
cgagtcacctgca

SEQ ID NO: 3338194 - DNA, 15 bp, Homo sapiens
cgagtcacctgcaag

SEQ ID NO: 3338195 - DNA, 18 bp, Homo sapiens
cgagtcaccttccaggac

SEQ ID NO: 3338196 - DNA, 20 bp, Homo sapiens
cgagtctcttctccactgga

SEQ ID NO: 3338197 - DNA, 15 bp, Homo sapiens
cgagtctgggacaca

SEQ ID NO: 3338198 - DNA, 16 bp, Homo sapiens
cgagtctgggacacaa

SEQ ID NO: 3338199 - DNA, 17 bp, Homo sapiens
cgagtgagacaaaattt

SEQ ID NO: 3338200 - DNA, 18 bp, Homo sapiens
cgagtgatttccatctct

SEQ ID NO: 3338201 - DNA, 20 bp, Homo sapiens
cgagtgcggcgtggagactg

SEQ ID NO: 3338202 - DNA, 20 bp, Homo sapiens
cgagttaatgatggcagagg

SEQ ID NO: 3338203 - DNA, 21 bp, Homo sapiens
cgatacaccgggcctggagaa

SEQ ID NO: 3338204 - DNA, 22 bp, Homo sapiens
cgatactgcgactttctgcctg

SEQ ID NO: 3338205 - DNA, 20 bp, Homo sapiens
cgatccacctgtctcagcct

SEQ ID NO: 3338206 - DNA, 14 bp, Homo sapiens
cgatcccacacagg

SEQ ID NO: 3338207 - DNA, 17 bp, Homo sapiens
cgatctcttattttaca

SEQ ID NO: 3338208 - DNA, 14 bp, Homo sapiens
cgatgaaggctgcc

SEQ ID NO: 3338209 - DNA, 21 bp, Homo sapiens
cgatgaggggacattttctgg

SEQ ID NO: 3338210 - DNA, 20 bp, Homo sapiens
cgatgatgcttgtaacaaga

SEQ ID NO: 3338211 - DNA, 10 bp, Homo sapiens
cgatgcattt

SEQ ID NO: 3338212 - DNA, 15 bp, Homo sapiens
cgatgctccctcagc

SEQ ID NO: 3338213 - DNA, 20 bp, Homo sapiens
cgatgctccctcagcctcag

SEQ ID NO: 3338214 - DNA, 22 bp, Homo sapiens
cgatgctccctcagcctcagag

SEQ ID NO: 3338215 - DNA, 23 bp, Homo sapiens
cgatgctccctcagcctcagagg

SEQ ID NO: 3338216 - DNA, 12 bp, Homo sapiens
cgatgctgcttt

SEQ ID NO: 3338217 - DNA, 20 bp, Homo sapiens
cgatgctgctttcccctgtg

SEQ ID NO: 3338218 - DNA, 15 bp, Homo sapiens
cgatggagcccccag

SEQ ID NO: 3338219 - DNA, 12 bp, Homo sapiens
cgattagcttta

SEQ ID NO: 3338220 - DNA, 14 bp, Homo sapiens
cgatttctacctca

SEQ ID NO: 3338221 - DNA, 14 bp, Homo sapiens
cgatttctttcctc

SEQ ID NO: 3338222 - DNA, 20 bp, Homo sapiens
cgcaaaccccctttgtgctg

SEQ ID NO: 3338223 - DNA, 19 bp, Homo sapiens
cgcaaattgtccttcatgg

SEQ ID NO: 3338224 - DNA, 12 bp, Homo sapiens
cgcaactcttgt

SEQ ID NO: 3338225 - DNA, 20 bp, Homo sapiens
cgcaaggccgagcgttccca

SEQ ID NO: 3338226 - DNA, 17 bp, Homo sapiens
cgcaatagttttttact

SEQ ID NO: 3338227 - DNA, 13 bp, Homo sapiens
cgcaatgtggcat

SEQ ID NO: 3338228 - DNA, 23 bp, Homo sapiens
cgcacaaatgaccgcacgttctc

SEQ ID NO: 3338229 - DNA, 16 bp, Homo sapiens
cgcacacagctgagca

SEQ ID NO: 3338230 - DNA, 20 bp, Homo sapiens
cgcacaccctcactctgcca

SEQ ID NO: 3338231 - DNA, 10 bp, Homo sapiens
cgcacagcag

SEQ ID NO: 3338232 - DNA, 12 bp, Homo sapiens
cgcacagccacc

SEQ ID NO: 3338233 - DNA, 16 bp, Homo sapiens
cgcaccaatgcccagc

SEQ ID NO: 3338234 - DNA, 18 bp, Homo sapiens
cgcaccagctgctctgcc

SEQ ID NO: 3338235 - DNA, 21 bp, Homo sapiens
cgcaccattctcctgcctcag

SEQ ID NO: 3338236 - DNA, 15 bp, Homo sapiens
cgcaccattctgact

SEQ ID NO: 3338237 - DNA, 17 bp, Homo sapiens
cgcaccccccaagctgt

SEQ ID NO: 3338238 - DNA, 18 bp, Homo sapiens
cgcacccccctgttctaa

SEQ ID NO: 3338239 - DNA, 16 bp, Homo sapiens
cgcaccccggcctcag

SEQ ID NO: 3338240 - DNA, 17 bp, Homo sapiens
cgcaccccggcctcagg

SEQ ID NO: 3338241 - DNA, 17 bp, Homo sapiens
cgcacctgccccctggt

SEQ ID NO: 3338242 - DNA, 16 bp, Homo sapiens
cgcactccatgagcac

SEQ ID NO: 3338243 - DNA, 14 bp, Homo sapiens
cgcactttccactt

SEQ ID NO: 3338244 - DNA, 15 bp, Homo sapiens
cggaccaagggactc

SEQ ID NO: 3338245 - DNA, 19 bp, Homo sapiens
cggaccactcgaggcctgc

SEQ ID NO: 3338246 - DNA, 14 bp, Homo sapiens
cggaccccagctgt

SEQ ID NO: 3338247 - DNA, 16 bp, Homo sapiens
cggacgtttccatcag

SEQ ID NO: 3338248 - DNA, 22 bp, Homo sapiens
cggactaaactatctgtattta

SEQ ID NO: 3338249 - DNA, 12 bp, Homo sapiens
cggactctggat

SEQ ID NO: 3338250 - DNA, 16 bp, Homo sapiens
cggactggtgccctcc

SEQ ID NO: 3338251 - DNA, 15 bp, Homo sapiens
cggagacggagtccc

SEQ ID NO: 3338252 - DNA, 16 bp, Homo sapiens
cggagagagagagagg

SEQ ID NO: 3338253 - DNA, 16 bp, Homo sapiens
cggagagcagcagcac

SEQ ID NO: 3338254 - DNA, 16 bp, Homo sapiens
cggagaggctgtctgg

SEQ ID NO: 3338255 - DNA, 22 bp, Homo sapiens
cggagatagatgactttgcaga

SEQ ID NO: 3338256 - DNA, 14 bp, Homo sapiens
cggagcacagccct

SEQ ID NO: 3338257 - DNA, 16 bp, Homo sapiens
cggagcatcccggagg

SEQ ID NO: 3338258 - DNA, 14 bp, Homo sapiens
cggagcccagcctg

SEQ ID NO: 3338259 - DNA, 22 bp, Homo sapiens
cggagcccagcctgggagccca

SEQ ID NO: 3338260 - DNA, 12 bp, Homo sapiens
cggagccctccc

SEQ ID NO: 3338261 - DNA, 15 bp, Homo sapiens
cggagcccttggccc

SEQ ID NO: 3338262 - DNA, 15 bp, Homo sapiens
cggagcttgcagtga

SEQ ID NO: 3338263 - DNA, 22 bp, Homo sapiens
cggaggaggagggaggccaggc

SEQ ID NO: 3338264 - DNA, 20 bp, Homo sapiens
cggaggagggatgctgctcc

SEQ ID NO: 3338265 - DNA, 21 bp, Homo sapiens
cggaggagttttggcagccag

SEQ ID NO: 3338266 - DNA, 15 bp, Homo sapiens
cggaggccccaaagg

SEQ ID NO: 3338267 - DNA, 18 bp, Homo sapiens
cggaggccccaaaggaaa

SEQ ID NO: 3338268 - DNA, 16 bp, Homo sapiens
cggaggcctcgagcag

SEQ ID NO: 3338269 - DNA, 18 bp, Homo sapiens
cggaggctgggcccctgg

SEQ ID NO: 3338270 - DNA, 20 bp, Homo sapiens
cggaggctgggcccctggga

SEQ ID NO: 3338271 - DNA, 22 bp, Homo sapiens
cggaggctgggcccctgggatg

SEQ ID NO: 3338272 - DNA, 18 bp, Homo sapiens
cggagggtccagactgtc

SEQ ID NO: 3338273 - DNA, 22 bp, Homo sapiens
cggagtcccaccttggctgcag

SEQ ID NO: 3338274 - DNA, 23 bp, Homo sapiens
cggagtcccaccttggctgcagg

SEQ ID NO: 3338275 - DNA, 19 bp, Homo sapiens
cggagtggggggacagaga

SEQ ID NO: 3338276 - DNA, 18 bp, Homo sapiens
cggatcagagcaggacct

SEQ ID NO: 3338277 - DNA, 22 bp, Homo sapiens
cggatcagagcaggacctccct

SEQ ID NO: 3338278 - DNA, 17 bp, Homo sapiens
cggatcctaagcatcta

SEQ ID NO: 3338279 - DNA, 16 bp, Homo sapiens
cggattccagcccaca

SEQ ID NO: 3338280 - DNA, 15 bp, Homo sapiens
cggattgcgttcctc

SEQ ID NO: 3338281 - DNA, 17 bp, Homo sapiens
cggcaaccccagttctg

SEQ ID NO: 3338282 - DNA, 20 bp, Homo sapiens
cggcaaccccagttctgctc

SEQ ID NO: 3338283 - DNA, 20 bp, Homo sapiens
cggcacccacaagtgccact

SEQ ID NO: 3338284 - DNA, 18 bp, Homo sapiens
cggcagaaaacagagcct

SEQ ID NO: 3338285 - DNA, 22 bp, Homo sapiens
cggcagaaaggaaaacctgaag

SEQ ID NO: 3338286 - DNA, 19 bp, Homo sapiens
cggcaggaaggagcggcgc

SEQ ID NO: 3338287 - DNA, 13 bp, Homo sapiens
cgggaaagaagaa

SEQ ID NO: 3338288 - DNA, 14 bp, Homo sapiens
cgggaaagaagaaa

SEQ ID NO: 3338289 - DNA, 14 bp, Homo sapiens
cgggaaaggaaacg

SEQ ID NO: 3338290 - DNA, 16 bp, Homo sapiens
cgggaaccaagcagga

SEQ ID NO: 3338291 - DNA, 17 bp, Homo sapiens
cgggaataaccttccat

SEQ ID NO: 3338292 - DNA, 22 bp, Homo sapiens
cgggacccacggagccctccct

SEQ ID NO: 3338293 - DNA, 19 bp, Homo sapiens
cgggaccccctggccctgc

SEQ ID NO: 3338294 - DNA, 21 bp, Homo sapiens
cgggacgagaccctacaggag

SEQ ID NO: 3338295 - DNA, 13 bp, Homo sapiens
cgggagcacccag

SEQ ID NO: 3338296 - DNA, 18 bp, Homo sapiens
cgggagcacccagagcac

SEQ ID NO: 3338297 - DNA, 23 bp, Homo sapiens
cgggagcagtgtcttccataatg

SEQ ID NO: 3338298 - DNA, 22 bp, Homo sapiens
cgggagccatgcgccccctccg

SEQ ID NO: 3338299 - DNA, 17 bp, Homo sapiens
cgggagcctaggaccac

SEQ ID NO: 3338300 - DNA, 21 bp, Homo sapiens
cgggaggatgttctgggacac

SEQ ID NO: 3338301 - DNA, 23 bp, Homo sapiens
cgggaggatgttctgggacacag

SEQ ID NO: 3338302 - DNA, 13 bp, Homo sapiens
cgggaggcaccag

SEQ ID NO: 3338303 - DNA, 17 bp, Homo sapiens
cgggaggcaccagctct

SEQ ID NO: 3338304 - DNA, 23 bp, Homo sapiens
cgggaggcaccagctctgtggcc

SEQ ID NO: 3338305 - DNA, 14 bp, Homo sapiens
cgggaggcagagtt

SEQ ID NO: 3338306 - DNA, 13 bp, Homo sapiens
cgggaggccccag

SEQ ID NO: 3338307 - DNA, 15 bp, Homo sapiens
cgggaggccccagct

SEQ ID NO: 3338308 - DNA, 11 bp, Homo sapiens
cgggaggccct

SEQ ID NO: 3338309 - DNA, 12 bp, Homo sapiens
cgggaggccctg

SEQ ID NO: 3338310 - DNA, 15 bp, Homo sapiens
cgggaggccctggcc

SEQ ID NO: 3338311 - DNA, 18 bp, Homo sapiens
cgggaggccctggccctt

SEQ ID NO: 3338312 - DNA, 12 bp, Homo sapiens
cgggaggctggg

SEQ ID NO: 3338313 - DNA, 15 bp, Homo sapiens
cgggaggctgggcac

SEQ ID NO: 3338314 - DNA, 12 bp, Homo sapiens
cgggcaaagggt

SEQ ID NO: 3338315 - DNA, 14 bp, Homo sapiens
cgggcacagacacg

SEQ ID NO: 3338316 - DNA, 16 bp, Homo sapiens
cgggcacagggcacca

SEQ ID NO: 3338317 - DNA, 21 bp, Homo sapiens
cgggcacagggcaccagaggc

SEQ ID NO: 3338318 - DNA, 14 bp, Homo sapiens
cgggcaccagccag

SEQ ID NO: 3338319 - DNA, 19 bp, Homo sapiens
cgggcacctatagtcccag

SEQ ID NO: 3338320 - DNA, 22 bp, Homo sapiens
cgggcactcagaagacactgat

SEQ ID NO: 3338321 - DNA, 12 bp, Homo sapiens
cgggcagatggg

SEQ ID NO: 3338322 - DNA, 13 bp, Homo sapiens
cgggcagatgggc

SEQ ID NO: 3338323 - DNA, 19 bp, Homo sapiens
cgggcagccacccaagcct

SEQ ID NO: 3338324 - DNA, 15 bp, Homo sapiens
cgggcagcgggccag

SEQ ID NO: 3338325 - DNA, 17 bp, Homo sapiens
cgggcatgggcactccc

SEQ ID NO: 3338326 - DNA, 21 bp, Homo sapiens
cgggccaccctctgtttaaaa

SEQ ID NO: 3338327 - DNA, 16 bp, Homo sapiens
cgggccagccaggcgg

SEQ ID NO: 3338328 - DNA, 17 bp, Homo sapiens
cgggccagccaggcggg

SEQ ID NO: 3338329 - DNA, 18 bp, Homo sapiens
cgggccatgagggacagg

SEQ ID NO: 3338330 - DNA, 15 bp, Homo sapiens
cgggcccacctggcc

SEQ ID NO: 3338331 - DNA, 19 bp, Homo sapiens
cgggcccacctggccacct

SEQ ID NO: 3338332 - DNA, 13 bp, Homo sapiens
cgggcccaggcct

SEQ ID NO: 3338333 - DNA, 20 bp, Homo sapiens
cgggccgaggcccagcgggc

SEQ ID NO: 3338334 - DNA, 20 bp, Homo sapiens
cgggcctggagaactagaga

SEQ ID NO: 3338335 - DNA, 21 bp, Homo sapiens
cgggcggtcaggggttcgaga

SEQ ID NO: 3338336 - DNA, 22 bp, Homo sapiens
cgggctaacgggaggctgggca

SEQ ID NO: 3338337 - DNA, 23 bp, Homo sapiens
cgggctaacgggaggctgggcac

SEQ ID NO: 3338338 - DNA, 13 bp, Homo sapiens
cgggctccctggc

SEQ ID NO: 3338339 - DNA, 19 bp, Homo sapiens
cggttcagacccctgcctg

SEQ ID NO: 3338340 - DNA, 11 bp, Homo sapiens
cggttcctggt

SEQ ID NO: 3338341 - DNA, 14 bp, Homo sapiens
cggttcctggtgac

SEQ ID NO: 3338342 - DNA, 21 bp, Homo sapiens
cggttctgcgccacttccttt

SEQ ID NO: 3338343 - DNA, 11 bp, Homo sapiens
cggtttctcca

SEQ ID NO: 3338344 - DNA, 16 bp, Homo sapiens
cggtttctttttaagt

SEQ ID NO: 3338345 - DNA, 20 bp, Homo sapiens
cgtaaagccttgttttctct

SEQ ID NO: 3338346 - DNA, 19 bp, Homo sapiens
cgtaagactttttggtttg

SEQ ID NO: 3338347 - DNA, 16 bp, Homo sapiens
cgtaagtttaaaggat

SEQ ID NO: 3338348 - DNA, 21 bp, Homo sapiens
cgtaatgcttagagaatgttc

SEQ ID NO: 3338349 - DNA, 12 bp, Homo sapiens
cgtaatttaact

SEQ ID NO: 3338350 - DNA, 13 bp, Homo sapiens
cgtaccccaccct

SEQ ID NO: 3338351 - DNA, 15 bp, Homo sapiens
cgtaccccaccctca

SEQ ID NO: 3338352 - DNA, 14 bp, Homo sapiens
cgtaccccactggg

SEQ ID NO: 3338353 - DNA, 17 bp, Homo sapiens
cgtaccgcttccttaga

SEQ ID NO: 3338354 - DNA, 21 bp, Homo sapiens
cgtactaggttggacagcccc

SEQ ID NO: 3338355 - DNA, 14 bp, Homo sapiens
cgtatacacccaga

SEQ ID NO: 3338356 - DNA, 14 bp, Homo sapiens
cgtatatataaaca

SEQ ID NO: 3338357 - DNA, 22 bp, Homo sapiens
cgtatatgtctcaggtccctgc

SEQ ID NO: 3338358 - DNA, 11 bp, Homo sapiens
cgtatgaaaat

SEQ ID NO: 3338359 - DNA, 16 bp, Homo sapiens
cgtatgtctgttacca

SEQ ID NO: 3338360 - DNA, 18 bp, Homo sapiens
cgtcaccacgactggcca

SEQ ID NO: 3338361 - DNA, 21 bp, Homo sapiens
cgtcagacagcaaggaactgt

SEQ ID NO: 3338362 - DNA, 22 bp, Homo sapiens
cgtcagtctttttctgttgtaa

SEQ ID NO: 3338363 - DNA, 20 bp, Homo sapiens
cgtcatggcttaatgtttat

SEQ ID NO: 3338364 - DNA, 15 bp, Homo sapiens
cgtcatgttcctcaa

SEQ ID NO: 3338365 - DNA, 16 bp, Homo sapiens
cgtcattgctgctgct

SEQ ID NO: 3338366 - DNA, 20 bp, Homo sapiens
cgtccacaggggcaggcctg

SEQ ID NO: 3338367 - DNA, 14 bp, Homo sapiens
cgtccacccaggct

SEQ ID NO: 3338368 - DNA, 16 bp, Homo sapiens
cgtccacccaggctgc

SEQ ID NO: 3338369 - DNA, 19 bp, Homo sapiens
cgtccacccaggctgcact

SEQ ID NO: 3338370 - DNA, 20 bp, Homo sapiens
cgtccacccaggctgcactg

SEQ ID NO: 3338371 - DNA, 23 bp, Homo sapiens
cgtccacccaggctgcactgcag

SEQ ID NO: 3338372 - DNA, 15 bp, Homo sapiens
cgtccatggcaccag

SEQ ID NO: 3338373 - DNA, 19 bp, Homo sapiens
cgtccatggcaccagcccc

SEQ ID NO: 3338374 - DNA, 15 bp, Homo sapiens
cgtcccagcatccct

SEQ ID NO: 3338375 - DNA, 13 bp, Homo sapiens
cgtccccctgggg

SEQ ID NO: 3338376 - DNA, 15 bp, Homo sapiens
cgtccctagcagtga

SEQ ID NO: 3338377 - DNA, 14 bp, Homo sapiens
cgtccctgcccatg

SEQ ID NO: 3338378 - DNA, 11 bp, Homo sapiens
cgtccctggcg

SEQ ID NO: 3338379 - DNA, 22 bp, Homo sapiens
cgtccgccctgctcctccctgg

SEQ ID NO: 3338380 - DNA, 21 bp, Homo sapiens
cgtcctatctcccccaaccca

SEQ ID NO: 3338381 - DNA, 20 bp, Homo sapiens
cgtcctcacccctgtcctca

SEQ ID NO: 3338382 - DNA, 22 bp, Homo sapiens
cgtcctcacccctgtcctcact

SEQ ID NO: 3338383 - DNA, 17 bp, Homo sapiens
cgtcctcctcacctcat

SEQ ID NO: 3338384 - DNA, 22 bp, Homo sapiens
cgtcctcgttcaaaacattcca

SEQ ID NO: 3338385 - DNA, 12 bp, Homo sapiens
cgtcctgcagag

SEQ ID NO: 3338386 - DNA, 18 bp, Homo sapiens
cgtcctgctttggcagtg

SEQ ID NO: 3338387 - DNA, 14 bp, Homo sapiens
cgtccttttggttt

SEQ ID NO: 3338388 - DNA, 17 bp, Homo sapiens
cgtcgaggggctctcag

SEQ ID NO: 3338389 - DNA, 19 bp, Homo sapiens
cgtctccaggggctgcttc

SEQ ID NO: 3338390 - DNA, 21 bp, Homo sapiens
cgtctccaggggctgcttcct

SEQ ID NO: 3338391 - DNA, 17 bp, Homo sapiens
cgtctccgcttctctcg

SEQ ID NO: 3338392 - DNA, 12 bp, Homo sapiens
cgtctcctccct

SEQ ID NO: 3338393 - DNA, 13 bp, Homo sapiens
cgtctcctccctc

SEQ ID NO: 3338394 - DNA, 15 bp, Homo sapiens
cgtctcctttgacat

SEQ ID NO: 3338395 - DNA, 18 bp, Homo sapiens
cgtctgacaaatgtgtat

SEQ ID NO: 3338396 - DNA, 19 bp, Homo sapiens
cgtctgacaaatgtgtatg

SEQ ID NO: 3338397 - DNA, 23 bp, Homo sapiens
ctagacttgaaagttttccagta

SEQ ID NO: 3338398 - DNA, 10 bp, Homo sapiens
ctagagaaac

SEQ ID NO: 3338399 - DNA, 16 bp, Homo sapiens
ctagagaacaggtggt

SEQ ID NO: 3338400 - DNA, 16 bp, Homo sapiens
ctagagaagataattg

SEQ ID NO: 3338401 - DNA, 21 bp, Homo sapiens
ctagagaagataattgttgaa

SEQ ID NO: 3338402 - DNA, 15 bp, Homo sapiens
ctagagacaaatctt

SEQ ID NO: 3338403 - DNA, 15 bp, Homo sapiens
ctagagacagaagca

SEQ ID NO: 3338404 - DNA, 20 bp, Homo sapiens
ctagagacagaagcaggctg

SEQ ID NO: 3338405 - DNA, 22 bp, Homo sapiens
ctagagacagaagcaggctgga

SEQ ID NO: 3338406 - DNA, 21 bp, Homo sapiens
ctagagatctggttttgctat

SEQ ID NO: 3338407 - DNA, 21 bp, Homo sapiens
ctagagatgtgcaattgattt

SEQ ID NO: 3338408 - DNA, 14 bp, Homo sapiens
ctagagcagggatt

SEQ ID NO: 3338409 - DNA, 15 bp, Homo sapiens
ctagagcagggatta

SEQ ID NO: 3338410 - DNA, 19 bp, Homo sapiens
ctagaggcagggaggggac

SEQ ID NO: 3338411 - DNA, 23 bp, Homo sapiens
ctagaggccagccccacccagga

SEQ ID NO: 3338412 - DNA, 15 bp, Homo sapiens
ctagaggcctcagtt

SEQ ID NO: 3338413 - DNA, 22 bp, Homo sapiens
ctagaggcttgcataataagct

SEQ ID NO: 3338414 - DNA, 15 bp, Homo sapiens
ctagagggttcctgt

SEQ ID NO: 3338415 - DNA, 19 bp, Homo sapiens
ctagagggttcctgtagac

SEQ ID NO: 3338416 - DNA, 19 bp, Homo sapiens
ctagaggtgggcagctggg

SEQ ID NO: 3338417 - DNA, 23 bp, Homo sapiens
ctagaggtgggcagctgggcccc

SEQ ID NO: 3338418 - DNA, 14 bp, Homo sapiens
ctagagtcatgtga

SEQ ID NO: 3338419 - DNA, 22 bp, Homo sapiens
ctagagtctcagaaactcccct

SEQ ID NO: 3338420 - DNA, 19 bp, Homo sapiens
ctagagtctgaacagctgt

SEQ ID NO: 3338421 - DNA, 13 bp, Homo sapiens
ctagagtgtagcc

SEQ ID NO: 3338422 - DNA, 23 bp, Homo sapiens
ctagagtgtagcctaaagggcag

SEQ ID NO: 3338423 - DNA, 13 bp, Homo sapiens
ctagataaaaaga

SEQ ID NO: 3338424 - DNA, 21 bp, Homo sapiens
ctagatatcgacttgtttttg

SEQ ID NO: 3338425 - DNA, 15 bp, Homo sapiens
ctagatcactgtgct

SEQ ID NO: 3338426 - DNA, 13 bp, Homo sapiens
ctagatccacaca

SEQ ID NO: 3338427 - DNA, 17 bp, Homo sapiens
ctagatccacacacaga

SEQ ID NO: 3338428 - DNA, 19 bp, Homo sapiens
ctagatccacacacagagg

SEQ ID NO: 3338429 - DNA, 21 bp, Homo sapiens
ctagatccacacacagaggaa

SEQ ID NO: 3338430 - DNA, 15 bp, Homo sapiens
ctagatcctaagggt

SEQ ID NO: 3338431 - DNA, 16 bp, Homo sapiens
ctagatcctaagggtc

SEQ ID NO: 3338432 - DNA, 17 bp, Homo sapiens
ctagatgaagttttaca

SEQ ID NO: 3338433 - DNA, 21 bp, Homo sapiens
ctagatgattaaataagattc

SEQ ID NO: 3338434 - DNA, 21 bp, Homo sapiens
ctagatgtttattcttctaga

SEQ ID NO: 3338435 - DNA, 18 bp, Homo sapiens
ctagattatatcaaagta

SEQ ID NO: 3338436 - DNA, 14 bp, Homo sapiens
ctagattcaaaggt

SEQ ID NO: 3338437 - DNA, 16 bp, Homo sapiens
ctagattcaaaggttc

SEQ ID NO: 3338438 - DNA, 12 bp, Homo sapiens
ctagattgacta

SEQ ID NO: 3338439 - DNA, 11 bp, Homo sapiens
ctagatttcta

SEQ ID NO: 3338440 - DNA, 22 bp, Homo sapiens
ctagatttgtccttttatttct

SEQ ID NO: 3338441 - DNA, 19 bp, Homo sapiens
ctagattttaatttatttg

SEQ ID NO: 3338442 - DNA, 21 bp, Homo sapiens
ctagcaagctgccgaaccaaa

SEQ ID NO: 3338443 - DNA, 17 bp, Homo sapiens
ctagcaagctggcctct

SEQ ID NO: 3338444 - DNA, 20 bp, Homo sapiens
ctagcaattgggctcccttt

SEQ ID NO: 3338445 - DNA, 14 bp, Homo sapiens
ctagcaattttctt

SEQ ID NO: 3338446 - DNA, 17 bp, Homo sapiens
ctagcacaatttgcact

SEQ ID NO: 3338447 - DNA, 18 bp, Homo sapiens
ctagcactcattttctat

SEQ ID NO: 3338448 - DNA, 17 bp, Homo sapiens
ctagcagaaatctagaa

SEQ ID NO: 3338449 - DNA, 21 bp, Homo sapiens
ctagcagttgttgaggggagg

SEQ ID NO: 3338450 - DNA, 22 bp, Homo sapiens
ctagcattgtaaaattatttca

SEQ ID NO: 3338451 - DNA, 12 bp, Homo sapiens
ctagccaaggct

SEQ ID NO: 3338452 - DNA, 13 bp, Homo sapiens
ctagccagagaat

SEQ ID NO: 3338453 - DNA, 16 bp, Homo sapiens
ctagccagcattccat

SEQ ID NO: 3338454 - DNA, 18 bp, Homo sapiens
ctagccagcccctcttcc

SEQ ID NO: 3338455 - DNA, 12 bp, Homo sapiens
ctagccaggagt

SEQ ID NO: 3338456 - DNA, 14 bp, Homo sapiens
ctagccaggagtct

SEQ ID NO: 3338457 - DNA, 15 bp, Homo sapiens
ctagccaggagtctg

SEQ ID NO: 3338458 - DNA, 15 bp, Homo sapiens
ctagcccaccctgct

SEQ ID NO: 3338459 - DNA, 20 bp, Homo sapiens
ctagcccaccctgctgcctt

SEQ ID NO: 3338460 - DNA, 13 bp, Homo sapiens
ctagcccagactc

SEQ ID NO: 3338461 - DNA, 15 bp, Homo sapiens
ctagcccagactctg

SEQ ID NO: 3338462 - DNA, 13 bp, Homo sapiens
ctagcccaggaga

SEQ ID NO: 3338463 - DNA, 14 bp, Homo sapiens
ctagcccaggagag

SEQ ID NO: 3338464 - DNA, 15 bp, Homo sapiens
ctagcccaggagaga

SEQ ID NO: 3338465 - DNA, 18 bp, Homo sapiens
ctagcccaggagagagaa

SEQ ID NO: 3338466 - DNA, 23 bp, Homo sapiens
ctagcccaggagagagaaagcca

SEQ ID NO: 3338467 - DNA, 13 bp, Homo sapiens
ctagccccagaga

SEQ ID NO: 3338468 - DNA, 15 bp, Homo sapiens
ctagcccctggggtg

SEQ ID NO: 3338469 - DNA, 13 bp, Homo sapiens
ctagcccctgtgg

SEQ ID NO: 3338470 - DNA, 13 bp, Homo sapiens
ctagccctctcac

SEQ ID NO: 3338471 - DNA, 14 bp, Homo sapiens
ctagcctgaaggat

SEQ ID NO: 3338472 - DNA, 15 bp, Homo sapiens
ctagcctgaaggatt

SEQ ID NO: 3338473 - DNA, 21 bp, Homo sapiens
ctagccttagaagtcacacag

SEQ ID NO: 3338474 - DNA, 23 bp, Homo sapiens
ctagccttagaagtcacacagta

SEQ ID NO: 3338475 - DNA, 19 bp, Homo sapiens
ctagcctttggctctggag

SEQ ID NO: 3338476 - DNA, 20 bp, Homo sapiens
ctagcctttggctctggaga

SEQ ID NO: 3338477 - DNA, 15 bp, Homo sapiens
ctagcggagcccagc

SEQ ID NO: 3338478 - DNA, 16 bp, Homo sapiens
ctagcggagcccagcc

SEQ ID NO: 3338479 - DNA, 22 bp, Homo sapiens
ctagctaatgtaataactgtga

SEQ ID NO: 3338480 - DNA, 21 bp, Homo sapiens
ctagctagaaatatgatttta

SEQ ID NO: 3338481 - DNA, 15 bp, Homo sapiens
ctagctcctcccctt

SEQ ID NO: 3338482 - DNA, 15 bp, Homo sapiens
ctagctctctaggcc

SEQ ID NO: 3338483 - DNA, 16 bp, Homo sapiens
ctagctctctaggcct

SEQ ID NO: 3338484 - DNA, 22 bp, Homo sapiens
ctagctctctaggcctctccag

SEQ ID NO: 3338485 - DNA, 19 bp, Homo sapiens
ctagctgcagatgcctctg

SEQ ID NO: 3338486 - DNA, 17 bp, Homo sapiens
ctagctggtggtttcac

SEQ ID NO: 3338487 - DNA, 16 bp, Homo sapiens
ctagctgtatgatttg

SEQ ID NO: 3338488 - DNA, 14 bp, Homo sapiens
ctagctgtgcaaga

SEQ ID NO: 3338489 - DNA, 16 bp, Homo sapiens
ctagcttctgcttttc

SEQ ID NO: 3338490 - DNA, 18 bp, Homo sapiens
ctagcttctgcttttctg

SEQ ID NO: 3338491 - DNA, 18 bp, Homo sapiens
ctagcttgacacagtcag

SEQ ID NO: 3338492 - DNA, 18 bp, Homo sapiens
ctagctttagaccctggg

SEQ ID NO: 3338493 - DNA, 14 bp, Homo sapiens
ctagcttttaggaa

SEQ ID NO: 3338494 - DNA, 16 bp, Homo sapiens
ctaggaatcccagagg

SEQ ID NO: 3338495 - DNA, 17 bp, Homo sapiens
ctaggaatcccagaggt

SEQ ID NO: 3338496 - DNA, 16 bp, Homo sapiens
ctaggaatgaaatcct

SEQ ID NO: 3338497 - DNA, 15 bp, Homo sapiens
ctaggaattcccagc

SEQ ID NO: 3338498 - DNA, 17 bp, Homo sapiens
ctaggaccactcagccc

SEQ ID NO: 3338499 - DNA, 23 bp, Homo sapiens
ctaggaccatggttaagagtcca

SEQ ID NO: 3338500 - DNA, 22 bp, Homo sapiens
ctaggacccctccatgtgggct

SEQ ID NO: 3338501 - DNA, 22 bp, Homo sapiens
ctaggacgcaataaatttatat

SEQ ID NO: 3338502 - DNA, 14 bp, Homo sapiens
ctaggactctgagg

SEQ ID NO: 3338503 - DNA, 13 bp, Homo sapiens
ctaggactgagga

SEQ ID NO: 3338504 - DNA, 15 bp, Homo sapiens
ctaggactgaggagt

SEQ ID NO: 3338505 - DNA, 20 bp, Homo sapiens
ctaggagaagagttgaggaa

SEQ ID NO: 3338506 - DNA, 17 bp, Homo sapiens
ctaggagagccaacctc

SEQ ID NO: 3338507 - DNA, 18 bp, Homo sapiens
ctaggagggagacactgg

SEQ ID NO: 3338508 - DNA, 23 bp, Homo sapiens
ctaggagttgagtacagtgagga

SEQ ID NO: 3338509 - DNA, 13 bp, Homo sapiens
ctaggatacagaa

SEQ ID NO: 3338510 - DNA, 16 bp, Homo sapiens
ctaggatgctgcagca

SEQ ID NO: 3338511 - DNA, 17 bp, Homo sapiens
ctaggatgctgcagcag

SEQ ID NO: 3338512 - DNA, 20 bp, Homo sapiens
ctaggcactgtagttctaag

SEQ ID NO: 3338513 - DNA, 21 bp, Homo sapiens
ctaggcactgtagttctaaga

SEQ ID NO: 3338514 - DNA, 14 bp, Homo sapiens
ctaggcatcccagg

SEQ ID NO: 3338515 - DNA, 15 bp, Homo sapiens
ctaggcatcccaggg

SEQ ID NO: 3338516 - DNA, 19 bp, Homo sapiens
ctaggcatcccaggggacc

SEQ ID NO: 3338517 - DNA, 17 bp, Homo sapiens
ctaggcatctctgtact

SEQ ID NO: 3338518 - DNA, 13 bp, Homo sapiens
ctaggcccaggcc

SEQ ID NO: 3338519 - DNA, 18 bp, Homo sapiens
ctaggccccagaggccct

SEQ ID NO: 3338520 - DNA, 22 bp, Homo sapiens
ctaggccccagaggccctggag

SEQ ID NO: 3338521 - DNA, 22 bp, Homo sapiens
ctaggcccccacttgcctcttc

SEQ ID NO: 3338522 - DNA, 15 bp, Homo sapiens
ctaggcccctcctag

SEQ ID NO: 3338523 - DNA, 17 bp, Homo sapiens
ctaggcccctcctagac

SEQ ID NO: 3338524 - DNA, 12 bp, Homo sapiens
ctaggccgggcg

SEQ ID NO: 3338525 - DNA, 14 bp, Homo sapiens
ctaggcctggccag

SEQ ID NO: 3338526 - DNA, 22 bp, Homo sapiens
ctaggtaatgttttgtatatac

SEQ ID NO: 3338527 - DNA, 14 bp, Homo sapiens
ctaggtacgatgac

SEQ ID NO: 3338528 - DNA, 11 bp, Homo sapiens
ctaggtatcat

SEQ ID NO: 3338529 - DNA, 22 bp, Homo sapiens
ctaggtatcattcaactctcca

SEQ ID NO: 3338530 - DNA, 17 bp, Homo sapiens
ctaggtctcctcagggt

SEQ ID NO: 3338531 - DNA, 14 bp, Homo sapiens
ctaggtgacagagt

SEQ ID NO: 3338532 - DNA, 15 bp, Homo sapiens
ctaggttatacaata

SEQ ID NO: 3338533 - DNA, 15 bp, Homo sapiens
ctaggttcaattccc

SEQ ID NO: 3338534 - DNA, 16 bp, Homo sapiens
ctaggttccctgttct

SEQ ID NO: 3338535 - DNA, 21 bp, Homo sapiens
ctaggttccctgttcttcctc

SEQ ID NO: 3338536 - DNA, 14 bp, Homo sapiens
ctaggttggacagc

SEQ ID NO: 3338537 - DNA, 22 bp, Homo sapiens
ctaggtttttcctactgtcctc

SEQ ID NO: 3338538 - DNA, 13 bp, Homo sapiens
ctagtaaaacctt

SEQ ID NO: 3338539 - DNA, 20 bp, Homo sapiens
ctagtaaaaccttgttctat

SEQ ID NO: 3338540 - DNA, 22 bp, Homo sapiens
ctagtactctctgctctagcca

SEQ ID NO: 3338541 - DNA, 11 bp, Homo sapiens
ctagtactgta

SEQ ID NO: 3338542 - DNA, 21 bp, Homo sapiens
ctagtatcttcaaactttcac

SEQ ID NO: 3338543 - DNA, 21 bp, Homo sapiens
ctagtatttcatgctgggaat

SEQ ID NO: 3338544 - DNA, 14 bp, Homo sapiens
ctagtcacctgggg

SEQ ID NO: 3338545 - DNA, 22 bp, Homo sapiens
ctagtcacctgggggggttggg

SEQ ID NO: 3338546 - DNA, 14 bp, Homo sapiens
ctagtcattgtcat

SEQ ID NO: 3338547 - DNA, 20 bp, Homo sapiens
ctagtcccttcccctccctg

SEQ ID NO: 3338548 - DNA, 21 bp, Homo sapiens
ctagtccggacccacctcacc

SEQ ID NO: 3338549 - DNA, 23 bp, Homo sapiens
ctagtccggacccacctcacccc

SEQ ID NO: 3338550 - DNA, 15 bp, Homo sapiens
ctagtctcctttgca

SEQ ID NO: 3338551 - DNA, 20 bp, Homo sapiens
ctagtctcctttgcactgag

SEQ ID NO: 3338552 - DNA, 21 bp, Homo sapiens
ctagtctcctttgcactgagg

SEQ ID NO: 3338553 - DNA, 12 bp, Homo sapiens
ctagtctctcct

SEQ ID NO: 3338554 - DNA, 19 bp, Homo sapiens
ctagtgaatttctgaaaga

SEQ ID NO: 3338555 - DNA, 22 bp, Homo sapiens
ctagtgaattttttaaatgaaa

SEQ ID NO: 3338556 - DNA, 20 bp, Homo sapiens
ctagtgacttgtgtcccatg

SEQ ID NO: 3338557 - DNA, 16 bp, Homo sapiens
ctagtgagctgggcat

SEQ ID NO: 3338558 - DNA, 18 bp, Homo sapiens
ctagtgagctgggcatgg

SEQ ID NO: 3338559 - DNA, 19 bp, Homo sapiens
ctagtgcagctgattttaa

SEQ ID NO: 3338560 - DNA, 20 bp, Homo sapiens
ctagtgcagctgattttaac

SEQ ID NO: 3338561 - DNA, 21 bp, Homo sapiens
ctagtgcagctgattttaaca

SEQ ID NO: 3338562 - DNA, 23 bp, Homo sapiens
ctagtgcatttcaaggaatggaa

SEQ ID NO: 3338563 - DNA, 17 bp, Homo sapiens
ctagtgcatttggcact

SEQ ID NO: 3338564 - DNA, 19 bp, Homo sapiens
ctagtgccctccacagccg

SEQ ID NO: 3338565 - DNA, 16 bp, Homo sapiens
ctagtggatgactgtt

SEQ ID NO: 3338566 - DNA, 19 bp, Homo sapiens
ctagtggatgactgttgat

SEQ ID NO: 3338567 - DNA, 18 bp, Homo sapiens
ctagtgggacagcccaga

SEQ ID NO: 3338568 - DNA, 23 bp, Homo sapiens
ctagtgggacagcccagagcctg

SEQ ID NO: 3338569 - DNA, 20 bp, Homo sapiens
ctagtggtctttgtaagagt

SEQ ID NO: 3338570 - DNA, 22 bp, Homo sapiens
ctagtggtctttgtaagagtgt

SEQ ID NO: 3338571 - DNA, 15 bp, Homo sapiens
ctagtgtggtgtgtt

SEQ ID NO: 3338572 - DNA, 22 bp, Homo sapiens
ctagttatttacaggaacttca

SEQ ID NO: 3338573 - DNA, 12 bp, Homo sapiens
ctagttcatcca

SEQ ID NO: 3338574 - DNA, 18 bp, Homo sapiens
ctagttcatccaatcctc

SEQ ID NO: 3338575 - DNA, 21 bp, Homo sapiens
ctagttctttcctccccctgc

SEQ ID NO: 3338576 - DNA, 15 bp, Homo sapiens
ctagttgaggagttt

SEQ ID NO: 3338577 - DNA, 18 bp, Homo sapiens
ctagtttcagtaaataat

SEQ ID NO: 3338578 - DNA, 21 bp, Homo sapiens
ctagtttcagtaaataatgaa

SEQ ID NO: 3338579 - DNA, 16 bp, Homo sapiens
ctagtttcctggttcc

SEQ ID NO: 3338580 - DNA, 15 bp, Homo sapiens
ctagttttcagcctt

SEQ ID NO: 3338581 - DNA, 19 bp, Homo sapiens
ctagttttcagccttggga

SEQ ID NO: 3338582 - DNA, 22 bp, Homo sapiens
ctagttttcagctgctcagaat

SEQ ID NO: 3338583 - DNA, 16 bp, Homo sapiens
ctagttttctcctccc

SEQ ID NO: 3338584 - DNA, 22 bp, Homo sapiens
ctagtttttagtaatctgtaca

SEQ ID NO: 3338585 - DNA, 23 bp, Homo sapiens
ctagtttttagtaatctgtacat

SEQ ID NO: 3338586 - DNA, 14 bp, Homo sapiens
ctagttttttttct

SEQ ID NO: 3338587 - DNA, 15 bp, Homo sapiens
ctataaaactctgca

SEQ ID NO: 3338588 - DNA, 24 bp, Homo sapiens
ctataaaatgcagtaacattctac

SEQ ID NO: 3338589 - DNA, 14 bp, Homo sapiens
ctataaaattaaat

SEQ ID NO: 3338590 - DNA, 21 bp, Homo sapiens
ctataaaattaaatgccttgt

SEQ ID NO: 3338591 - DNA, 20 bp, Homo sapiens
ctataaacattaaaagaaga

SEQ ID NO: 3338592 - DNA, 20 bp, Homo sapiens
ctataaagcgatatacagat

SEQ ID NO: 3338593 - DNA, 16 bp, Homo sapiens
ctataaagtaaagcta

SEQ ID NO: 3338594 - DNA, 15 bp, Homo sapiens
ctataaatcagtatt

SEQ ID NO: 3338595 - DNA, 23 bp, Homo sapiens
ctataaattttttgaaacacaat

SEQ ID NO: 3338596 - DNA, 13 bp, Homo sapiens
ctataacagaaag

SEQ ID NO: 3338597 - DNA, 12 bp, Homo sapiens
ctataacagata

SEQ ID NO: 3338598 - DNA, 21 bp, Homo sapiens
ctataacatatgtacataaat

SEQ ID NO: 3338599 - DNA, 16 bp, Homo sapiens
ctataacttcttcctg

SEQ ID NO: 3338600 - DNA, 16 bp, Homo sapiens
ctataacttgatgcat

SEQ ID NO: 3338601 - DNA, 14 bp, Homo sapiens
ctataatcaaatga

SEQ ID NO: 3338602 - DNA, 19 bp, Homo sapiens
ctataatcaaatgatttca

SEQ ID NO: 3338603 - DNA, 23 bp, Homo sapiens
ctataatcaaatgatttcatatt

SEQ ID NO: 3338604 - DNA, 12 bp, Homo sapiens
ctataatcatta

SEQ ID NO: 3338605 - DNA, 19 bp, Homo sapiens
ctataatcccagcactttg

SEQ ID NO: 3338606 - DNA, 12 bp, Homo sapiens
ctataatctgtc

SEQ ID NO: 3338607 - DNA, 13 bp, Homo sapiens
ctataatctgtca

SEQ ID NO: 3338608 - DNA, 18 bp, Homo sapiens
ctataatctgtcaaaaca

SEQ ID NO: 3338609 - DNA, 19 bp, Homo sapiens
ctataatctgtcaaaacac

SEQ ID NO: 3338610 - DNA, 18 bp, Homo sapiens
ctataatcttatacaaca

SEQ ID NO: 3338611 - DNA, 16 bp, Homo sapiens
ctataatgtaagctct

SEQ ID NO: 3338612 - DNA, 13 bp, Homo sapiens
ctataatgtgtgt

SEQ ID NO: 3338613 - DNA, 22 bp, Homo sapiens
ctataatttacctaagattaca

SEQ ID NO: 3338614 - DNA, 19 bp, Homo sapiens
ctataattttgcctttaac

SEQ ID NO: 3338615 - DNA, 20 bp, Homo sapiens
ctatacacaagcaatgcaag

SEQ ID NO: 3338616 - DNA, 14 bp, Homo sapiens
ctatacacacacac

SEQ ID NO: 3338617 - DNA, 21 bp, Homo sapiens
ctatacacaccctgcccctgc

SEQ ID NO: 3338618 - DNA, 19 bp, Homo sapiens
ctatacactagacaaaact

SEQ ID NO: 3338619 - DNA, 14 bp, Homo sapiens
ctatacatatcttt

SEQ ID NO: 3338620 - DNA, 15 bp, Homo sapiens
ctatacatatcttta

SEQ ID NO: 3338621 - DNA, 17 bp, Homo sapiens
ctatacatatctttatt

SEQ ID NO: 3338622 - DNA, 21 bp, Homo sapiens
ctatactgcatactttttaaa

SEQ ID NO: 3338623 - DNA, 20 bp, Homo sapiens
ctatagactggaaaaaatga

SEQ ID NO: 3338624 - DNA, 15 bp, Homo sapiens
ctatagagaaaaact

SEQ ID NO: 3338625 - DNA, 19 bp, Homo sapiens
ctatagagagggggctctc

SEQ ID NO: 3338626 - DNA, 16 bp, Homo sapiens
ctatagagcctacctg

SEQ ID NO: 3338627 - DNA, 20 bp, Homo sapiens
ctatagcctaggtgacagag

SEQ ID NO: 3338628 - DNA, 21 bp, Homo sapiens
ctatagcttgcagaactgtag

SEQ ID NO: 3338629 - DNA, 16 bp, Homo sapiens
ctatagttatacatca

SEQ ID NO: 3338630 - DNA, 22 bp, Homo sapiens
ctatataaaataactaaaatgt

SEQ ID NO: 3338631 - DNA, 18 bp, Homo sapiens
ctatataaaatgtattca

SEQ ID NO: 3338632 - DNA, 21 bp, Homo sapiens
ctatataaaatgtattcaagc

SEQ ID NO: 3338633 - DNA, 16 bp, Homo sapiens
ctatatacatatatat

SEQ ID NO: 3338634 - DNA, 13 bp, Homo sapiens
ctatatacatgtg

SEQ ID NO: 3338635 - DNA, 19 bp, Homo sapiens
ctatatacatgtgtgtata

SEQ ID NO: 3338636 - DNA, 19 bp, Homo sapiens
ctcactgctcaagaagaca

SEQ ID NO: 3338637 - DNA, 17 bp, Homo sapiens
ctcactgctccctgaag

SEQ ID NO: 3338638 - DNA, 20 bp, Homo sapiens
ctcactgctccctgaagcca

SEQ ID NO: 3338639 - DNA, 23 bp, Homo sapiens
ctcactgctccctgaagccagcc

SEQ ID NO: 3338640 - DNA, 16 bp, Homo sapiens
ctcactgcttgaacta

SEQ ID NO: 3338641 - DNA, 22 bp, Homo sapiens
ctcactggaggagcagcttcct

SEQ ID NO: 3338642 - DNA, 17 bp, Homo sapiens
ctcaggaggcaggacct

SEQ ID NO: 3338643 - DNA, 19 bp, Homo sapiens
ctcaggaggcgcccttggc

SEQ ID NO: 3338644 - DNA, 13 bp, Homo sapiens
ctcaggaggctga

SEQ ID NO: 3338645 - DNA, 20 bp, Homo sapiens
ctcaggatatccttatcaga

SEQ ID NO: 3338646 - DNA, 18 bp, Homo sapiens
ctcaggatccaagctaag

SEQ ID NO: 3338647 - DNA, 13 bp, Homo sapiens
ctcaggcaagccc

SEQ ID NO: 3338648 - DNA, 20 bp, Homo sapiens
ctcaggcaagcccctcagcc

SEQ ID NO: 3338649 - DNA, 16 bp, Homo sapiens
ctcaggcacacagcta

SEQ ID NO: 3338650 - DNA, 14 bp, Homo sapiens
ctcaggcagctcaa

SEQ ID NO: 3338651 - DNA, 17 bp, Homo sapiens
ctcaggcataggcctgg

SEQ ID NO: 3338652 - DNA, 20 bp, Homo sapiens
ctcaggccaagaaacgtctt

SEQ ID NO: 3338653 - DNA, 22 bp, Homo sapiens
ctcatgataccacctttactgt

SEQ ID NO: 3338654 - DNA, 16 bp, Homo sapiens
ctcatgcatttcaagc

SEQ ID NO: 3338655 - DNA, 16 bp, Homo sapiens
ctcatgcccaccccct

SEQ ID NO: 3338656 - DNA, 23 bp, Homo sapiens
ctcatgcccaccccctgccctgc

SEQ ID NO: 3338657 - DNA, 22 bp, Homo sapiens
ctcatgccccctttcagatgtc

SEQ ID NO: 3338658 - DNA, 16 bp, Homo sapiens
ctcatgcctcagcctc

SEQ ID NO: 3338659 - DNA, 13 bp, Homo sapiens
ctcatgcctgctg

SEQ ID NO: 3338660 - DNA, 16 bp, Homo sapiens
ctcatgctgttgctgc

SEQ ID NO: 3338661 - DNA, 18 bp, Homo sapiens
ctcatggcccccaggggc

SEQ ID NO: 3338662 - DNA, 19 bp, Homo sapiens
ctcatggcccccaggggca

SEQ ID NO: 3338663 - DNA, 23 bp, Homo sapiens
ctcatggcccccaggggcaggac

SEQ ID NO: 3338664 - DNA, 15 bp, Homo sapiens
ctcatggcccctctg

SEQ ID NO: 3338665 - DNA, 20 bp, Homo sapiens
ctcatggcgtaatgggcctg

SEQ ID NO: 3338666 - DNA, 23 bp, Homo sapiens
ctcatggcgtaatgggcctgccc

SEQ ID NO: 3338667 - DNA, 15 bp, Homo sapiens
ctcatgggtggcact

SEQ ID NO: 3338668 - DNA, 17 bp, Homo sapiens
ctcatggtgcatataaa

SEQ ID NO: 3338669 - DNA, 12 bp, Homo sapiens
ctcatgtaacat

SEQ ID NO: 3338670 - DNA, 19 bp, Homo sapiens
ctcatgtaacattggtgaa

SEQ ID NO: 3338671 - DNA, 14 bp, Homo sapiens
ctcatgtcctgctg

SEQ ID NO: 3338672 - DNA, 22 bp, Homo sapiens
ctcatgtcctgctggcttccag

SEQ ID NO: 3338673 - DNA, 14 bp, Homo sapiens
ctcatgtggctgga

SEQ ID NO: 3338674 - DNA, 16 bp, Homo sapiens
ctcatgtgtgcaacag

SEQ ID NO: 3338675 - DNA, 14 bp, Homo sapiens
ctcatgttggccaa

SEQ ID NO: 3338676 - DNA, 15 bp, Homo sapiens
ctcatgtttatgaaa

SEQ ID NO: 3338677 - DNA, 18 bp, Homo sapiens
ctcatgtttatgaaaata

SEQ ID NO: 3338678 - DNA, 22 bp, Homo sapiens
ctcattactgcaaattgattgt

SEQ ID NO: 3338679 - DNA, 15 bp, Homo sapiens
ctcattcagtattaa

SEQ ID NO: 3338680 - DNA, 19 bp, Homo sapiens
ctcattcagtattaaaggg

SEQ ID NO: 3338681 - DNA, 21 bp, Homo sapiens
ctcattccaccttcccatgcc

SEQ ID NO: 3338682 - DNA, 17 bp, Homo sapiens
ctcattccactgttggt

SEQ ID NO: 3338683 - DNA, 17 bp, Homo sapiens
ctcattcgcctttgtct

SEQ ID NO: 3338684 - DNA, 14 bp, Homo sapiens
ctcattcttctgta

SEQ ID NO: 3338685 - DNA, 23 bp, Homo sapiens
ctcattcttctgtacgtctgaca

SEQ ID NO: 3338686 - DNA, 14 bp, Homo sapiens
ctcattcttgtttt

SEQ ID NO: 3338687 - DNA, 10 bp, Homo sapiens
ctcattgaaa

SEQ ID NO: 3338688 - DNA, 12 bp, Homo sapiens
ctcattgaaatg

SEQ ID NO: 3338689 - DNA, 13 bp, Homo sapiens
ctcattgaaatgt

SEQ ID NO: 3338690 - DNA, 14 bp, Homo sapiens
ctcattgaaatgtc

SEQ ID NO: 3338691 - DNA, 16 bp, Homo sapiens
ctcattgaaatgtcac

SEQ ID NO: 3338692 - DNA, 17 bp, Homo sapiens
ctcattgacaagaactg

SEQ ID NO: 3338693 - DNA, 14 bp, Homo sapiens
ctcattgactttta

SEQ ID NO: 3338694 - DNA, 22 bp, Homo sapiens
ctcattgacttttataaagcat

SEQ ID NO: 3338695 - DNA, 19 bp, Homo sapiens
ctcattgcagcagataact

SEQ ID NO: 3338696 - DNA, 19 bp, Homo sapiens
ctcattgcccccacctctg

SEQ ID NO: 3338697 - DNA, 21 bp, Homo sapiens
ctcattgcccccacctctggt

SEQ ID NO: 3338698 - DNA, 19 bp, Homo sapiens
ctcattgcctcctgttctg

SEQ ID NO: 3338699 - DNA, 12 bp, Homo sapiens
ctcattggccag

SEQ ID NO: 3338700 - DNA, 13 bp, Homo sapiens
ctcattggccagc

SEQ ID NO: 3338701 - DNA, 23 bp, Homo sapiens
ctcatttaaacccaatcagatgc

SEQ ID NO: 3338702 - DNA, 19 bp, Homo sapiens
ctcatttacgtaaaaagat

SEQ ID NO: 3338703 - DNA, 16 bp, Homo sapiens
ctcatttctaaaagaa

SEQ ID NO: 3338704 - DNA, 20 bp, Homo sapiens
ctcatttgcttttgtcacta

SEQ ID NO: 3338705 - DNA, 20 bp, Homo sapiens
ctcattttctataacagata

SEQ ID NO: 3338706 - DNA, 12 bp, Homo sapiens
ctcatttttcat

SEQ ID NO: 3338707 - DNA, 13 bp, Homo sapiens
ctcatttttcata

SEQ ID NO: 3338708 - DNA, 18 bp, Homo sapiens
ctcatttttttaatttat

SEQ ID NO: 3338709 - DNA, 17 bp, Homo sapiens
ctccaaaacccatgtgg

SEQ ID NO: 3338710 - DNA, 16 bp, Homo sapiens
ctccaaaagcacttac

SEQ ID NO: 3338711 - DNA, 18 bp, Homo sapiens
ctccaaacaccggcagaa

SEQ ID NO: 3338712 - DNA, 15 bp, Homo sapiens
ctccaaacctgtctt

SEQ ID NO: 3338713 - DNA, 22 bp, Homo sapiens
ctccaaactgaagcagcctctc

SEQ ID NO: 3338714 - DNA, 20 bp, Homo sapiens
ctccaaagagccttcagaat

SEQ ID NO: 3338715 - DNA, 18 bp, Homo sapiens
ctccaaaggggctgctgg

SEQ ID NO: 3338716 - DNA, 19 bp, Homo sapiens
ctccaaaggggctgctggg

SEQ ID NO: 3338717 - DNA, 12 bp, Homo sapiens
ctccaaagtcca

SEQ ID NO: 3338718 - DNA, 13 bp, Homo sapiens
ctccaaagtccac

SEQ ID NO: 3338719 - DNA, 23 bp, Homo sapiens
ctccaaatctcaatgaagccagc

SEQ ID NO: 3338720 - DNA, 22 bp, Homo sapiens
ctccaacagaactaaatgttct

SEQ ID NO: 3338721 - DNA, 16 bp, Homo sapiens
ctccaacgcccctgtg

SEQ ID NO: 3338722 - DNA, 17 bp, Homo sapiens
ctccaacgcccctgtgg

SEQ ID NO: 3338723 - DNA, 19 bp, Homo sapiens
ctccaacgcccctgtggcc

SEQ ID NO: 3338724 - DNA, 18 bp, Homo sapiens
ctccaactggattataaa

SEQ ID NO: 3338725 - DNA, 14 bp, Homo sapiens
ctccaagattctag

SEQ ID NO: 3338726 - DNA, 15 bp, Homo sapiens
ctccaagattctaga

SEQ ID NO: 3338727 - DNA, 18 bp, Homo sapiens
ctccaagcctgcctccca

SEQ ID NO: 3338728 - DNA, 19 bp, Homo sapiens
ctccaagctccatctccac

SEQ ID NO: 3338729 - DNA, 20 bp, Homo sapiens
ctccaagggcttctgcaccc

SEQ ID NO: 3338730 - DNA, 22 bp, Homo sapiens
ctccaagggtttcgactggtcc

SEQ ID NO: 3338731 - DNA, 15 bp, Homo sapiens
ctccaagtctctctg

SEQ ID NO: 3338732 - DNA, 16 bp, Homo sapiens
ctccaagtctctctgt

SEQ ID NO: 3338733 - DNA, 20 bp, Homo sapiens
ctccaagtctctctgtgaat

SEQ ID NO: 3338734 - DNA, 16 bp, Homo sapiens
ctccaagtgccagagg

SEQ ID NO: 3338735 - DNA, 20 bp, Homo sapiens
ctccaagtgccagaggtggg

SEQ ID NO: 3338736 - DNA, 21 bp, Homo sapiens
ctccaagtgccagaggtgggc

SEQ ID NO: 3338737 - DNA, 21 bp, Homo sapiens
ctccaataaagtgccttctgg

SEQ ID NO: 3338738 - DNA, 23 bp, Homo sapiens
ctccacagatgtaattatgtttt

SEQ ID NO: 3338739 - DNA, 21 bp, Homo sapiens
ctccacagcgagggcagctgc

SEQ ID NO: 3338740 - DNA, 23 bp, Homo sapiens
ctccacagttcagtggcagggct

SEQ ID NO: 3338741 - DNA, 17 bp, Homo sapiens
ctccacatcccagcagc

SEQ ID NO: 3338742 - DNA, 18 bp, Homo sapiens
ctccacatcccagcagcc

SEQ ID NO: 3338743 - DNA, 21 bp, Homo sapiens
ctccacatcccagcagcccaa

SEQ ID NO: 3338744 - DNA, 14 bp, Homo sapiens
ctccacatcctgtg

SEQ ID NO: 3338745 - DNA, 15 bp, Homo sapiens
ctccacatctgcctt

SEQ ID NO: 3338746 - DNA, 17 bp, Homo sapiens
ctccacatctgccttaa

SEQ ID NO: 3338747 - DNA, 21 bp, Homo sapiens
ctccaccacatctgccagacc

SEQ ID NO: 3338748 - DNA, 19 bp, Homo sapiens
ctccaccaccactggccac

SEQ ID NO: 3338749 - DNA, 13 bp, Homo sapiens
ctccacccagccc

SEQ ID NO: 3338750 - DNA, 15 bp, Homo sapiens
ctccacccagcccct

SEQ ID NO: 3338751 - DNA, 18 bp, Homo sapiens
ctccaccccggcccccga

SEQ ID NO: 3338752 - DNA, 15 bp, Homo sapiens
ctccaccctccacct

SEQ ID NO: 3338753 - DNA, 11 bp, Homo sapiens
ctccaccctgc

SEQ ID NO: 3338754 - DNA, 13 bp, Homo sapiens
ctccaccctgctc

SEQ ID NO: 3338755 - DNA, 15 bp, Homo sapiens
ctccaccctgctctc

SEQ ID NO: 3338756 - DNA, 20 bp, Homo sapiens
ctccaccctgtcccccagct

SEQ ID NO: 3338757 - DNA, 21 bp, Homo sapiens
ctccacccttggcctgtctca

SEQ ID NO: 3338758 - DNA, 15 bp, Homo sapiens
ctccaccgcctatcc

SEQ ID NO: 3338759 - DNA, 21 bp, Homo sapiens
ctccaccgttcaagcgccaga

SEQ ID NO: 3338760 - DNA, 22 bp, Homo sapiens
ctccacctcttcaccccccact

SEQ ID NO: 3338761 - DNA, 13 bp, Homo sapiens
ctccacctgtgag

SEQ ID NO: 3338762 - DNA, 12 bp, Homo sapiens
ctccaccttccc

SEQ ID NO: 3338763 - DNA, 18 bp, Homo sapiens
ctccacgatcctgccacc

SEQ ID NO: 3338764 - DNA, 14 bp, Homo sapiens
ctccacgcctcctg

SEQ ID NO: 3338765 - DNA, 20 bp, Homo sapiens
ctccacgcctcctggccaga

SEQ ID NO: 3338766 - DNA, 21 bp, Homo sapiens
ctccacgcctcctggccagac

SEQ ID NO: 3338767 - DNA, 15 bp, Homo sapiens
ctccacgcgcttcga

SEQ ID NO: 3338768 - DNA, 21 bp, Homo sapiens
ctccactcagctgtcctgcag

SEQ ID NO: 3338769 - DNA, 18 bp, Homo sapiens
ctccactcccccacctga

SEQ ID NO: 3338770 - DNA, 17 bp, Homo sapiens
ctccactcctccagcca

SEQ ID NO: 3338771 - DNA, 13 bp, Homo sapiens
ctccactctcctt

SEQ ID NO: 3338772 - DNA, 22 bp, Homo sapiens
ctccactctccttcgtgtctct

SEQ ID NO: 3338773 - DNA, 14 bp, Homo sapiens
ctccactctgcttc

SEQ ID NO: 3338774 - DNA, 15 bp, Homo sapiens
ctccactctgcttct

SEQ ID NO: 3338775 - DNA, 20 bp, Homo sapiens
ctccactctgcttctctgac

SEQ ID NO: 3338776 - DNA, 12 bp, Homo sapiens
ctccactgccct

SEQ ID NO: 3338777 - DNA, 14 bp, Homo sapiens
ctccactgccctgg

SEQ ID NO: 3338778 - DNA, 17 bp, Homo sapiens
cccctaagtgcccaaag

SEQ ID NO: 3338779 - DNA, 12 bp, Homo sapiens
cccctacccacc

SEQ ID NO: 3338780 - DNA, 12 bp, Homo sapiens
cccctactccct

SEQ ID NO: 3338781 - DNA, 13 bp, Homo sapiens
cccctagaaaccc

SEQ ID NO: 3338782 - DNA, 16 bp, Homo sapiens
cccctagaaacccaag

SEQ ID NO: 3338783 - DNA, 17 bp, Homo sapiens
cccctagaaacccaagc

SEQ ID NO: 3338784 - DNA, 12 bp, Homo sapiens
cccctagcccag

SEQ ID NO: 3338785 - DNA, 18 bp, Homo sapiens
cccctaggatgctgcagc

SEQ ID NO: 3338786 - DNA, 20 bp, Homo sapiens
cccctaggatgctgcagcag

SEQ ID NO: 3338787 - DNA, 22 bp, Homo sapiens
cccctaggatgctgcagcagag

SEQ ID NO: 3338788 - DNA, 14 bp, Homo sapiens
cccctatccttggc

SEQ ID NO: 3338789 - DNA, 21 bp, Homo sapiens
cccctcaaacctcctcttctg

SEQ ID NO: 3338790 - DNA, 11 bp, Homo sapiens
cccctcaaccc

SEQ ID NO: 3338791 - DNA, 19 bp, Homo sapiens
cccctcaacctcctgtgga

SEQ ID NO: 3338792 - DNA, 23 bp, Homo sapiens
cccctcaagccccagcagccctc

SEQ ID NO: 3338793 - DNA, 14 bp, Homo sapiens
cccctcacagcctc

SEQ ID NO: 3338794 - DNA, 17 bp, Homo sapiens
cccctcacagcctctga

SEQ ID NO: 3338795 - DNA, 20 bp, Homo sapiens
cccctcacagcctctgaccc

SEQ ID NO: 3338796 - DNA, 14 bp, Homo sapiens
cccctcactctggc

SEQ ID NO: 3338797 - DNA, 21 bp, Homo sapiens
cccctcagatgatctctccac

SEQ ID NO: 3338798 - DNA, 20 bp, Homo sapiens
cccctccacatcccagcagc

SEQ ID NO: 3338799 - DNA, 11 bp, Homo sapiens
cccctccactg

SEQ ID NO: 3338800 - DNA, 11 bp, Homo sapiens
cccctccagga

SEQ ID NO: 3338801 - DNA, 13 bp, Homo sapiens
cccctccaggaag

SEQ ID NO: 3338802 - DNA, 16 bp, Homo sapiens
cccctccatgggcgtc

SEQ ID NO: 3338803 - DNA, 20 bp, Homo sapiens
cccctccatgggcgtccttt

SEQ ID NO: 3338804 - DNA, 13 bp, Homo sapiens
cccctcccacctc

SEQ ID NO: 3338805 - DNA, 11 bp, Homo sapiens
cccctcccatt

SEQ ID NO: 3338806 - DNA, 13 bp, Homo sapiens
cccctcccattag

SEQ ID NO: 3338807 - DNA, 15 bp, Homo sapiens
cccctcccccaaccc

SEQ ID NO: 3338808 - DNA, 18 bp, Homo sapiens
cccctcccccaaccccca

SEQ ID NO: 3338809 - DNA, 16 bp, Homo sapiens
cccctccccgcctggc

SEQ ID NO: 3338810 - DNA, 13 bp, Homo sapiens
cccctcccctgct

SEQ ID NO: 3338811 - DNA, 13 bp, Homo sapiens
cccctccctctgt

SEQ ID NO: 3338812 - DNA, 14 bp, Homo sapiens
cccctccctggctc

SEQ ID NO: 3338813 - DNA, 16 bp, Homo sapiens
cccctccgccctgcca

SEQ ID NO: 3338814 - DNA, 17 bp, Homo sapiens
cccctccggactggtgc

SEQ ID NO: 3338815 - DNA, 18 bp, Homo sapiens
cccctccggactggtgcc

SEQ ID NO: 3338816 - DNA, 12 bp, Homo sapiens
cccctcctcact

SEQ ID NO: 3338817 - DNA, 13 bp, Homo sapiens
cccctcctcactg

SEQ ID NO: 3338818 - DNA, 17 bp, Homo sapiens
cccctcctccagcccct

SEQ ID NO: 3338819 - DNA, 21 bp, Homo sapiens
cccctcctctagctgtggggg

SEQ ID NO: 3338820 - DNA, 15 bp, Homo sapiens
cccctcctctcccat

SEQ ID NO: 3338821 - DNA, 20 bp, Homo sapiens
cccctcctgaaccgcacagc

SEQ ID NO: 3338822 - DNA, 13 bp, Homo sapiens
cccctcctgctcc

SEQ ID NO: 3338823 - DNA, 20 bp, Homo sapiens
cccctcctgctcctccctgc

SEQ ID NO: 3338824 - DNA, 15 bp, Homo sapiens
cccctccttgggcac

SEQ ID NO: 3338825 - DNA, 21 bp, Homo sapiens
cccctcgccagcttctcctgc

SEQ ID NO: 3338826 - DNA, 17 bp, Homo sapiens
cccctcgtcctgtccca

SEQ ID NO: 3338827 - DNA, 18 bp, Homo sapiens
cccctcgtgcgcatctca

SEQ ID NO: 3338828 - DNA, 15 bp, Homo sapiens
cccctctctgcccct

SEQ ID NO: 3338829 - DNA, 16 bp, Homo sapiens
cccctctgctgctgtc

SEQ ID NO: 3338830 - DNA, 13 bp, Homo sapiens
cccctctggccag

SEQ ID NO: 3338831 - DNA, 23 bp, Homo sapiens
cccctctggtcgctcctgcccac

SEQ ID NO: 3338832 - DNA, 12 bp, Homo sapiens
cccctctgtctt

SEQ ID NO: 3338833 - DNA, 19 bp, Homo sapiens
cccctcttattcctctagg

SEQ ID NO: 3338834 - DNA, 16 bp, Homo sapiens
cccctgcagcacggac

SEQ ID NO: 3338835 - DNA, 13 bp, Homo sapiens
cccctgccccagc

SEQ ID NO: 3338836 - DNA, 16 bp, Homo sapiens
cccctgcccctctgtt

SEQ ID NO: 3338837 - DNA, 14 bp, Homo sapiens
cccctgccctcgtg

SEQ ID NO: 3338838 - DNA, 15 bp, Homo sapiens
cccctgccctcgtgg

SEQ ID NO: 3338839 - DNA, 22 bp, Homo sapiens
cccctgccctcgtggccagccc

SEQ ID NO: 3338840 - DNA, 12 bp, Homo sapiens
cccctgccctgc

SEQ ID NO: 3338841 - DNA, 13 bp, Homo sapiens
cccctgccctgct

SEQ ID NO: 3338842 - DNA, 17 bp, Homo sapiens
cccctgcctcccatgcc

SEQ ID NO: 3338843 - DNA, 21 bp, Homo sapiens
cccctgcctgggaacacgtgt

SEQ ID NO: 3338844 - DNA, 16 bp, Homo sapiens
cccctgcctgggttgg

SEQ ID NO: 3338845 - DNA, 14 bp, Homo sapiens
cccctgcgtggggg

SEQ ID NO: 3338846 - DNA, 15 bp, Homo sapiens
cccctgctccaccag

SEQ ID NO: 3338847 - DNA, 23 bp, Homo sapiens
cccctgctctacccatgagcctg

SEQ ID NO: 3338848 - DNA, 19 bp, Homo sapiens
cccctgctgcaggggctct

SEQ ID NO: 3338849 - DNA, 16 bp, Homo sapiens
cccctgctgtcttccc

SEQ ID NO: 3338850 - DNA, 18 bp, Homo sapiens
cccctgcttctccagcct

SEQ ID NO: 3338851 - DNA, 20 bp, Homo sapiens
cccctggaggcactgaagtg

SEQ ID NO: 3338852 - DNA, 11 bp, Homo sapiens
cccctggccca

SEQ ID NO: 3338853 - DNA, 19 bp, Homo sapiens
cccctggcccatctcagcc

SEQ ID NO: 3338854 - DNA, 14 bp, Homo sapiens
cccctggccctgcc

SEQ ID NO: 3338855 - DNA, 13 bp, Homo sapiens
cccctggcctcag

SEQ ID NO: 3338856 - DNA, 12 bp, Homo sapiens
cccctggcctct

SEQ ID NO: 3338857 - DNA, 20 bp, Homo sapiens
cccctggctgactggccagt

SEQ ID NO: 3338858 - DNA, 20 bp, Homo sapiens
cccctggcttttcactgctg

SEQ ID NO: 3338859 - DNA, 22 bp, Homo sapiens
cccctggcttttcactgctggc

SEQ ID NO: 3338860 - DNA, 22 bp, Homo sapiens
cccctgggcatcttctggcttg

SEQ ID NO: 3338861 - DNA, 23 bp, Homo sapiens
cccctgggctctgccccagctct

SEQ ID NO: 3338862 - DNA, 20 bp, Homo sapiens
cccctgggcttggcctgctg

SEQ ID NO: 3338863 - DNA, 19 bp, Homo sapiens
cccctggggtggccaccag

SEQ ID NO: 3338864 - DNA, 20 bp, Homo sapiens
cccctggggtggccaccagt

SEQ ID NO: 3338865 - DNA, 15 bp, Homo sapiens
cccctggtggacagt

SEQ ID NO: 3338866 - DNA, 21 bp, Homo sapiens
cccctggtggacagtcctggg

SEQ ID NO: 3338867 - DNA, 22 bp, Homo sapiens
cccctggtggacagtcctggga

SEQ ID NO: 3338868 - DNA, 18 bp, Homo sapiens
cccctgtacatttgtgct

SEQ ID NO: 3338869 - DNA, 18 bp, Homo sapiens
cccctgtcccatgcaggc

SEQ ID NO: 3338870 - DNA, 17 bp, Homo sapiens
cccctgtcccctcagct

SEQ ID NO: 3338871 - DNA, 16 bp, Homo sapiens
cccctgtcctcactgc

SEQ ID NO: 3338872 - DNA, 19 bp, Homo sapiens
cccctgtcttcacctgcca

SEQ ID NO: 3338873 - DNA, 19 bp, Homo sapiens
cccctgtggccaactgcaa

SEQ ID NO: 3338874 - DNA, 20 bp, Homo sapiens
cccctgtggccaactgcaaa

SEQ ID NO: 3338875 - DNA, 21 bp, Homo sapiens
cccctgtggggatctcagggg

SEQ ID NO: 3338876 - DNA, 19 bp, Homo sapiens
cccctgtgtattcaccacc

SEQ ID NO: 3338877 - DNA, 23 bp, Homo sapiens
ccccttaagggttgaaggcagtc

SEQ ID NO: 3338878 - DNA, 22 bp, Homo sapiens
ccccttccagatcactgccaca

SEQ ID NO: 3338879 - DNA, 14 bp, Homo sapiens
ccccttccccaggc

SEQ ID NO: 3338880 - DNA, 13 bp, Homo sapiens
ccccttccctgtc

SEQ ID NO: 3338881 - DNA, 13 bp, Homo sapiens
ccccttcctagtg

SEQ ID NO: 3338882 - DNA, 17 bp, Homo sapiens
cccgaatagctgggact

SEQ ID NO: 3338883 - DNA, 15 bp, Homo sapiens
cccgacactgctgca

SEQ ID NO: 3338884 - DNA, 22 bp, Homo sapiens
cccgacactgctgcaccagagt

SEQ ID NO: 3338885 - DNA, 23 bp, Homo sapiens
cccgacactgctgcaccagagtg

SEQ ID NO: 3338886 - DNA, 14 bp, Homo sapiens
cccgacagcctggc

SEQ ID NO: 3338887 - DNA, 18 bp, Homo sapiens
cccgacagcctggcacag

SEQ ID NO: 3338888 - DNA, 14 bp, Homo sapiens
cccgactccaggct

SEQ ID NO: 3338889 - DNA, 18 bp, Homo sapiens
cccgagacacaggcacgg

SEQ ID NO: 3338890 - DNA, 20 bp, Homo sapiens
cccgagctcttggcctttgc

SEQ ID NO: 3338891 - DNA, 14 bp, Homo sapiens
cccgagctggtgca

SEQ ID NO: 3338892 - DNA, 14 bp, Homo sapiens
cccgagctgtttat

SEQ ID NO: 3338893 - DNA, 21 bp, Homo sapiens
cccgaggccttctctgaagga

SEQ ID NO: 3338894 - DNA, 20 bp, Homo sapiens
cccgaggggccggggaagct

SEQ ID NO: 3338895 - DNA, 14 bp, Homo sapiens
cccgagtagctggg

SEQ ID NO: 3338896 - DNA, 17 bp, Homo sapiens
cccgagtagctgggact

SEQ ID NO: 3338897 - DNA, 18 bp, Homo sapiens
cccgagtctgggacacaa

SEQ ID NO: 3338898 - DNA, 19 bp, Homo sapiens
cccgagtgcggcgtggaga

SEQ ID NO: 3338899 - DNA, 16 bp, Homo sapiens
cccgatgctgctttcc

SEQ ID NO: 3338900 - DNA, 20 bp, Homo sapiens
cccgatgtcgacatgttttt

SEQ ID NO: 3338901 - DNA, 20 bp, Homo sapiens
cccgcaaaccccctttgtgc

SEQ ID NO: 3338902 - DNA, 12 bp, Homo sapiens
cccgcacagcag

SEQ ID NO: 3338903 - DNA, 13 bp, Homo sapiens
cccgcacagcagc

SEQ ID NO: 3338904 - DNA, 15 bp, Homo sapiens
cccgcacagcagcct

SEQ ID NO: 3338905 - DNA, 15 bp, Homo sapiens
cccgcactctgcccc

SEQ ID NO: 3338906 - DNA, 12 bp, Homo sapiens
cccgcagacctc

SEQ ID NO: 3338907 - DNA, 21 bp, Homo sapiens
cccgcagacctccccagcccc

SEQ ID NO: 3338908 - DNA, 18 bp, Homo sapiens
cccgcagtgctgggacca

SEQ ID NO: 3338909 - DNA, 20 bp, Homo sapiens
cccgcagtgctgggaccaga

SEQ ID NO: 3338910 - DNA, 23 bp, Homo sapiens
cccgcagtgctgggaccagagcc

SEQ ID NO: 3338911 - DNA, 13 bp, Homo sapiens
cccgccagggctg

SEQ ID NO: 3338912 - DNA, 15 bp, Homo sapiens
cccgccagggctggg

SEQ ID NO: 3338913 - DNA, 11 bp, Homo sapiens
cccgcccacac

SEQ ID NO: 3338914 - DNA, 13 bp, Homo sapiens
cccgcccacaccc

SEQ ID NO: 3338915 - DNA, 14 bp, Homo sapiens
cccgcccacaccct

SEQ ID NO: 3338916 - DNA, 15 bp, Homo sapiens
cccgcccacaccctc

SEQ ID NO: 3338917 - DNA, 15 bp, Homo sapiens
cccgccctcttcctg

SEQ ID NO: 3338918 - DNA, 23 bp, Homo sapiens
cccgcctgagctcctgctgcgga

SEQ ID NO: 3338919 - DNA, 18 bp, Homo sapiens
cccgcctgcagtcttctg

SEQ ID NO: 3338920 - DNA, 14 bp, Homo sapiens
cccgcctgccaccg

SEQ ID NO: 3338921 - DNA, 13 bp, Homo sapiens
cccgcctgccctc

SEQ ID NO: 3338922 - DNA, 17 bp, Homo sapiens
cccgcctgccctcatgg

SEQ ID NO: 3338923 - DNA, 13 bp, Homo sapiens
cccgcctgttccc

SEQ ID NO: 3338924 - DNA, 16 bp, Homo sapiens
cccgccttcctcctcc

SEQ ID NO: 3338925 - DNA, 23 bp, Homo sapiens
cccgccttcctcctccacagtgc

SEQ ID NO: 3338926 - DNA, 19 bp, Homo sapiens
cccgcgctcgcccagcagg

SEQ ID NO: 3338927 - DNA, 19 bp, Homo sapiens
cccgcggtgctctggcggc

SEQ ID NO: 3338928 - DNA, 15 bp, Homo sapiens
cccgctaaggaagat

SEQ ID NO: 3338929 - DNA, 12 bp, Homo sapiens
cccgctcaggcc

SEQ ID NO: 3338930 - DNA, 19 bp, Homo sapiens
cccgctcctgccgcagacg

SEQ ID NO: 3338931 - DNA, 21 bp, Homo sapiens
cccgctctacatcttctgcct

SEQ ID NO: 3338932 - DNA, 20 bp, Homo sapiens
cccgctttcttgctggttgt

SEQ ID NO: 3338933 - DNA, 20 bp, Homo sapiens
cccgcttttgttcttcccca

SEQ ID NO: 3338934 - DNA, 22 bp, Homo sapiens
cccgcttttgttcttccccaca

SEQ ID NO: 3338935 - DNA, 19 bp, Homo sapiens
cccggaattccgtcaccac

SEQ ID NO: 3338936 - DNA, 20 bp, Homo sapiens
cccggagcacagccctggga

SEQ ID NO: 3338937 - DNA, 22 bp, Homo sapiens
cccggagcacagccctgggagg

SEQ ID NO: 3338938 - DNA, 20 bp, Homo sapiens
cccggaggaaatctgcagag

SEQ ID NO: 3338939 - DNA, 22 bp, Homo sapiens
cccggaggaaatctgcagaggg

SEQ ID NO: 3338940 - DNA, 22 bp, Homo sapiens
cccggatcagagcaggacctcc

SEQ ID NO: 3338941 - DNA, 13 bp, Homo sapiens
cccggatgctgct

SEQ ID NO: 3338942 - DNA, 14 bp, Homo sapiens
cccggattctggga

SEQ ID NO: 3338943 - DNA, 18 bp, Homo sapiens
cccggcaggccctgcagt

SEQ ID NO: 3338944 - DNA, 17 bp, Homo sapiens
cccggcatgggaaagcc

SEQ ID NO: 3338945 - DNA, 16 bp, Homo sapiens
cccggccagcgggcac

SEQ ID NO: 3338946 - DNA, 20 bp, Homo sapiens
cccggccagcgggcacaggg

SEQ ID NO: 3338947 - DNA, 21 bp, Homo sapiens
cccggccagcgggcacagggc

SEQ ID NO: 3338948 - DNA, 23 bp, Homo sapiens
cccggccagcgggcacagggcac

SEQ ID NO: 3338949 - DNA, 24 bp, Homo sapiens
cccggccagcgggcacagggcacc

SEQ ID NO: 3338950 - DNA, 13 bp, Homo sapiens
cccggccccagcc

SEQ ID NO: 3338951 - DNA, 21 bp, Homo sapiens
cccggccccccgcgctcgccc

SEQ ID NO: 3338952 - DNA, 16 bp, Homo sapiens
cccggcccctgctggt

SEQ ID NO: 3338953 - DNA, 17 bp, Homo sapiens
cccggcctcagggcgct

SEQ ID NO: 3338954 - DNA, 19 bp, Homo sapiens
cccggcctccactccccca

SEQ ID NO: 3338955 - DNA, 14 bp, Homo sapiens
cccggcctcttcca

SEQ ID NO: 3338956 - DNA, 19 bp, Homo sapiens
cccggcctcttccacccat

SEQ ID NO: 3338957 - DNA, 13 bp, Homo sapiens
cccggctccaggc

SEQ ID NO: 3338958 - DNA, 14 bp, Homo sapiens
cccggctccaggct

SEQ ID NO: 3338959 - DNA, 19 bp, Homo sapiens
cccggctcgtgtatttatt

SEQ ID NO: 3338960 - DNA, 21 bp, Homo sapiens
cccggctgcagaggccagagg

SEQ ID NO: 3338961 - DNA, 23 bp, Homo sapiens
cccggctgggtcggccctgccca

SEQ ID NO: 3338962 - DNA, 17 bp, Homo sapiens
cccggctggttttgtaa

SEQ ID NO: 3338963 - DNA, 12 bp, Homo sapiens
cccgggagccta

SEQ ID NO: 3338964 - DNA, 16 bp, Homo sapiens
cccgggagcctaggac

SEQ ID NO: 3338965 - DNA, 14 bp, Homo sapiens
cccgggagcggagg

SEQ ID NO: 3338966 - DNA, 15 bp, Homo sapiens
cccgggagggcggca

SEQ ID NO: 3338967 - DNA, 17 bp, Homo sapiens
cccgggcaaagggtctt

SEQ ID NO: 3338968 - DNA, 17 bp, Homo sapiens
cccgggccacgccccag

SEQ ID NO: 3338969 - DNA, 18 bp, Homo sapiens
cccgggccacgccccagc

SEQ ID NO: 3338970 - DNA, 16 bp, Homo sapiens
cccgggctctctgctg

SEQ ID NO: 3338971 - DNA, 15 bp, Homo sapiens
cccgggctgcctggg

SEQ ID NO: 3338972 - DNA, 16 bp, Homo sapiens
cccgggctgcctgggc

SEQ ID NO: 3338973 - DNA, 18 bp, Homo sapiens
cccggggaccctgtgaca

SEQ ID NO: 3338974 - DNA, 17 bp, Homo sapiens
cccggggcaaggtctcc

SEQ ID NO: 3338975 - DNA, 18 bp, Homo sapiens
cccggggtcctgtggcag

SEQ ID NO: 3338976 - DNA, 20 bp, Homo sapiens
cccggtcccacccctccctc

SEQ ID NO: 3338977 - DNA, 17 bp, Homo sapiens
cccggtggcggcagggc

SEQ ID NO: 3338978 - DNA, 11 bp, Homo sapiens
ccctagccttg

SEQ ID NO: 3338979 - DNA, 21 bp, Homo sapiens
ccctagctataccagcagaaa

SEQ ID NO: 3338980 - DNA, 17 bp, Homo sapiens
ccctagctttagaccct

SEQ ID NO: 3338981 - DNA, 23 bp, Homo sapiens
ccctaggttccctgttcttcctc

SEQ ID NO: 3338982 - DNA, 20 bp, Homo sapiens
ccctagtcaaaactattttt

SEQ ID NO: 3338983 - DNA, 16 bp, Homo sapiens
ccctagtcccttcccc

SEQ ID NO: 3338984 - DNA, 19 bp, Homo sapiens
ccctatactgtagtattct

SEQ ID NO: 3338985 - DNA, 13 bp, Homo sapiens
ccctatagagagg

SEQ ID NO: 3338986 - DNA, 21 bp, Homo sapiens
ccctatagagagggggctctc

SEQ ID NO: 3338987 - DNA, 19 bp, Homo sapiens
ccctatccttggcaccaaa

SEQ ID NO: 3338988 - DNA, 23 bp, Homo sapiens
ccctatctaaccctcccatggca

SEQ ID NO: 3338989 - DNA, 14 bp, Homo sapiens
ccctatctgtattc

SEQ ID NO: 3338990 - DNA, 20 bp, Homo sapiens
ccctatgaaagattccacag

SEQ ID NO: 3338991 - DNA, 18 bp, Homo sapiens
ccctatggctgagccttg

SEQ ID NO: 3338992 - DNA, 16 bp, Homo sapiens
ccctatggggatggtc

SEQ ID NO: 3338993 - DNA, 12 bp, Homo sapiens
ccctatgtctgc

SEQ ID NO: 3338994 - DNA, 17 bp, Homo sapiens
ccctatttattgacttt

SEQ ID NO: 3338995 - DNA, 16 bp, Homo sapiens
ccctatttccccaccc

SEQ ID NO: 3338996 - DNA, 21 bp, Homo sapiens
ccctcaacaagggagagacct

SEQ ID NO: 3338997 - DNA, 14 bp, Homo sapiens
ccctcaagccccag

SEQ ID NO: 3338998 - DNA, 21 bp, Homo sapiens
ccctcaagccccagcagccct

SEQ ID NO: 3338999 - DNA, 23 bp, Homo sapiens
ccctcaagccccagcagccctca

SEQ ID NO: 3339000 - DNA, 17 bp, Homo sapiens
ccctcacacacacagct

SEQ ID NO: 3339001 - DNA, 18 bp, Homo sapiens
ccctcacacacacagctg

SEQ ID NO: 3339002 - DNA, 22 bp, Homo sapiens
ccctcacacacacagctgggca

SEQ ID NO: 3339003 - DNA, 13 bp, Homo sapiens
ccctcacagcctc

SEQ ID NO: 3339004 - DNA, 17 bp, Homo sapiens
ccctcacagcctctgac

SEQ ID NO: 3339005 - DNA, 13 bp, Homo sapiens
ccctcaccaccac

SEQ ID NO: 3339006 - DNA, 13 bp, Homo sapiens
ccctcaccctgcc

SEQ ID NO: 3339007 - DNA, 16 bp, Homo sapiens
ccctcaccctgcctta

SEQ ID NO: 3339008 - DNA, 14 bp, Homo sapiens
ccctcacctcctct

SEQ ID NO: 3339009 - DNA, 16 bp, Homo sapiens
ccctcactctgccagg

SEQ ID NO: 3339010 - DNA, 18 bp, Homo sapiens
ccctcactctgccagggc

SEQ ID NO: 3339011 - DNA, 14 bp, Homo sapiens
ccctcactctggcc

SEQ ID NO: 3339012 - DNA, 16 bp, Homo sapiens
ccctcactctggcctc

SEQ ID NO: 3339013 - DNA, 14 bp, Homo sapiens
ccctcactggatga

SEQ ID NO: 3339014 - DNA, 19 bp, Homo sapiens
ccctcagcccttgccccca

SEQ ID NO: 3339015 - DNA, 12 bp, Homo sapiens
ccctcagcctca

SEQ ID NO: 3339016 - DNA, 13 bp, Homo sapiens
ccctcagcctcag

SEQ ID NO: 3339017 - DNA, 15 bp, Homo sapiens
ccctcagcctcagag

SEQ ID NO: 3339018 - DNA, 20 bp, Homo sapiens
ccctcagcctcagaggagct

SEQ ID NO: 3339019 - DNA, 18 bp, Homo sapiens
ccctcaggcataggcctg

SEQ ID NO: 3339020 - DNA, 19 bp, Homo sapiens
ccctcaggcataggcctgg

SEQ ID NO: 3339021 - DNA, 22 bp, Homo sapiens
ccctcaggggaaaactgttacc

SEQ ID NO: 3339022 - DNA, 17 bp, Homo sapiens
ccctcataagtttgttt

SEQ ID NO: 3339023 - DNA, 21 bp, Homo sapiens
ccctcatcgcgtcctcctacc

SEQ ID NO: 3339024 - DNA, 18 bp, Homo sapiens
ccctcatcttgaagggcc

SEQ ID NO: 3339025 - DNA, 15 bp, Homo sapiens
ccctcatggccccca

SEQ ID NO: 3339026 - DNA, 21 bp, Homo sapiens
ccctcatggcccctctgacct

SEQ ID NO: 3339027 - DNA, 15 bp, Homo sapiens
ccctcatggctctgg

SEQ ID NO: 3339028 - DNA, 17 bp, Homo sapiens
ccctccacaccagtggc

SEQ ID NO: 3339029 - DNA, 16 bp, Homo sapiens
ccctccacagccgcag

SEQ ID NO: 3339030 - DNA, 15 bp, Homo sapiens
ccctccacatcccag

SEQ ID NO: 3339031 - DNA, 12 bp, Homo sapiens
ccctccaccttc

SEQ ID NO: 3339032 - DNA, 15 bp, Homo sapiens
ccctccaccttccat

SEQ ID NO: 3339033 - DNA, 18 bp, Homo sapiens
ccctccacgcctcctggc

SEQ ID NO: 3339034 - DNA, 21 bp, Homo sapiens
ccctccactcagctgtcctgc

SEQ ID NO: 3339035 - DNA, 23 bp, Homo sapiens
ccctccagcctttggccttggct

SEQ ID NO: 3339036 - DNA, 18 bp, Homo sapiens
ccctccagtgctggattt

SEQ ID NO: 3339037 - DNA, 16 bp, Homo sapiens
ccctccagtgggctga

SEQ ID NO: 3339038 - DNA, 13 bp, Homo sapiens
ccctccatccctg

SEQ ID NO: 3339039 - DNA, 17 bp, Homo sapiens
ccctccatccctggccc

SEQ ID NO: 3339040 - DNA, 18 bp, Homo sapiens
ccctcccaagtagctggg

SEQ ID NO: 3339041 - DNA, 12 bp, Homo sapiens
ccctcccacccc

SEQ ID NO: 3339042 - DNA, 14 bp, Homo sapiens
ccctcccacctctg

SEQ ID NO: 3339043 - DNA, 14 bp, Homo sapiens
ccctcccagtcctc

SEQ ID NO: 3339044 - DNA, 21 bp, Homo sapiens
ccctcccagtcctccagacca

SEQ ID NO: 3339045 - DNA, 15 bp, Homo sapiens
ccctcccattaggac

SEQ ID NO: 3339046 - DNA, 11 bp, Homo sapiens
ccctccccact

SEQ ID NO: 3339047 - DNA, 12 bp, Homo sapiens
ccctccccctca

SEQ ID NO: 3339048 - DNA, 13 bp, Homo sapiens
ccctccccctcaa

SEQ ID NO: 3339049 - DNA, 16 bp, Homo sapiens
ccctccccgcctggcc

SEQ ID NO: 3339050 - DNA, 21 bp, Homo sapiens
ccctccccgcctggccagggc

SEQ ID NO: 3339051 - DNA, 18 bp, Homo sapiens
ccctcccctccatccctg

SEQ ID NO: 3339052 - DNA, 17 bp, Homo sapiens
ccctcccctcccagtcc

SEQ ID NO: 3339053 - DNA, 16 bp, Homo sapiens
ccctcccctcccctgc

SEQ ID NO: 3339054 - DNA, 15 bp, Homo sapiens
ccctcccctctcttg

SEQ ID NO: 3339055 - DNA, 24 bp, Homo sapiens
ccctcccctctcttgcacccgcct

SEQ ID NO: 3339056 - DNA, 13 bp, Homo sapiens
ccctcccctgccc

SEQ ID NO: 3339057 - DNA, 16 bp, Homo sapiens
ccctcccctgctgcag

SEQ ID NO: 3339058 - DNA, 19 bp, Homo sapiens
ccctcccgtagtctcctgg

SEQ ID NO: 3339059 - DNA, 20 bp, Homo sapiens
ccctcccgtagtctcctggg

SEQ ID NO: 3339060 - DNA, 20 bp, Homo sapiens
ccctccctccagtaccataa

SEQ ID NO: 3339061 - DNA, 20 bp, Homo sapiens
ccctccctcctgccgctcct

SEQ ID NO: 3339062 - DNA, 16 bp, Homo sapiens
ccctccctctgcccca

SEQ ID NO: 3339063 - DNA, 21 bp, Homo sapiens
ccctccctgactccctgtggg

SEQ ID NO: 3339064 - DNA, 14 bp, Homo sapiens
ccctccctgcccct

SEQ ID NO: 3339065 - DNA, 14 bp, Homo sapiens
ccctccctggctcc

SEQ ID NO: 3339066 - DNA, 19 bp, Homo sapiens
ccctccctggctcccatga

SEQ ID NO: 3339067 - DNA, 18 bp, Homo sapiens
ccctcccttgtccttgaa

SEQ ID NO: 3339068 - DNA, 15 bp, Homo sapiens
ccctccgccctgcca

SEQ ID NO: 3339069 - DNA, 19 bp, Homo sapiens
ccctccgccctgccactca

SEQ ID NO: 3339070 - DNA, 15 bp, Homo sapiens
ccctccgcctgggat

SEQ ID NO: 3339071 - DNA, 17 bp, Homo sapiens
ccctccgtgatccatcc

SEQ ID NO: 3339072 - DNA, 18 bp, Homo sapiens
ccctcctaaatgtcagct

SEQ ID NO: 3339073 - DNA, 15 bp, Homo sapiens
ccctcctagacccag

SEQ ID NO: 3339074 - DNA, 16 bp, Homo sapiens
ccctcctagacccagg

SEQ ID NO: 3339075 - DNA, 12 bp, Homo sapiens
ccctcctcacct

SEQ ID NO: 3339076 - DNA, 21 bp, Homo sapiens
ccctcctcactcccacctgca

SEQ ID NO: 3339077 - DNA, 14 bp, Homo sapiens
ccctcctcactggc

SEQ ID NO: 3339078 - DNA, 21 bp, Homo sapiens
ccctcctcactggccatccct

SEQ ID NO: 3339079 - DNA, 18 bp, Homo sapiens
ccctcctctagctgtggg

SEQ ID NO: 3339080 - DNA, 13 bp, Homo sapiens
ccctcctctccca

SEQ ID NO: 3339081 - DNA, 22 bp, Homo sapiens
ccctcctgaaccgcacagctca

SEQ ID NO: 3339082 - DNA, 23 bp, Homo sapiens
ccctcctgaaccgcacagctcag

SEQ ID NO: 3339083 - DNA, 20 bp, Homo sapiens
ccctcctgccgctcctctct

SEQ ID NO: 3339084 - DNA, 14 bp, Homo sapiens
ccctcctgctcctc

SEQ ID NO: 3339085 - DNA, 13 bp, Homo sapiens
ccctcctgtaaat

SEQ ID NO: 3339086 - DNA, 20 bp, Homo sapiens
ccctccttccacatgtacat

SEQ ID NO: 3339087 - DNA, 14 bp, Homo sapiens
ccctccttgggcac

SEQ ID NO: 3339088 - DNA, 16 bp, Homo sapiens
ccctccttgggcactt

SEQ ID NO: 3339089 - DNA, 23 bp, Homo sapiens
ccctccttgtctagtttcccaca

SEQ ID NO: 3339090 - DNA, 17 bp, Homo sapiens
ccctcgaaccaaggcag

SEQ ID NO: 3339091 - DNA, 24 bp, Homo sapiens
ccctcgaaccaaggcagcctccag

SEQ ID NO: 3339092 - DNA, 21 bp, Homo sapiens
ccctcgaagcgcgccactcgc

SEQ ID NO: 3339093 - DNA, 22 bp, Homo sapiens
ccctcgacagcgcccctgctgt

SEQ ID NO: 3339094 - DNA, 16 bp, Homo sapiens
ccctcgatatttttaa

SEQ ID NO: 3339095 - DNA, 19 bp, Homo sapiens
ccctcgccagcttctcctg

SEQ ID NO: 3339096 - DNA, 21 bp, Homo sapiens
ccctcgccagcttctcctgcg

SEQ ID NO: 3339097 - DNA, 22 bp, Homo sapiens
ccctcggaagccgtctgactcc

SEQ ID NO: 3339098 - DNA, 18 bp, Homo sapiens
ccctcgggaagcagccag

SEQ ID NO: 3339099 - DNA, 15 bp, Homo sapiens
ccctcgggcccacct

SEQ ID NO: 3339100 - DNA, 16 bp, Homo sapiens
ccctcgggcccacctg

SEQ ID NO: 3339101 - DNA, 18 bp, Homo sapiens
ccctcgggcccacctggc

SEQ ID NO: 3339102 - DNA, 19 bp, Homo sapiens
ccctcgggcccacctggcc

SEQ ID NO: 3339103 - DNA, 22 bp, Homo sapiens
ccctcggggggtcacaggccca

SEQ ID NO: 3339104 - DNA, 18 bp, Homo sapiens
ccctcggtggctgcacag

SEQ ID NO: 3339105 - DNA, 21 bp, Homo sapiens
ccctcggtggctgcacagaag

SEQ ID NO: 3339106 - DNA, 15 bp, Homo sapiens
ccctcgtccacaggg

SEQ ID NO: 3339107 - DNA, 18 bp, Homo sapiens
cccagtccccacccctgc

SEQ ID NO: 3339108 - DNA, 20 bp, Homo sapiens
cccagtccccacccctgccc

SEQ ID NO: 3339109 - DNA, 13 bp, Homo sapiens
cccagtccccgtg

SEQ ID NO: 3339110 - DNA, 23 bp, Homo sapiens
cccagtccccgtgccccgcctcc

SEQ ID NO: 3339111 - DNA, 22 bp, Homo sapiens
cccagtcggccccatctctcat

SEQ ID NO: 3339112 - DNA, 13 bp, Homo sapiens
cccagtctcagac

SEQ ID NO: 3339113 - DNA, 14 bp, Homo sapiens
cccagtctcagaca

SEQ ID NO: 3339114 - DNA, 20 bp, Homo sapiens
cccagtctggaatgcagtgg

SEQ ID NO: 3339115 - DNA, 17 bp, Homo sapiens
cccagtctgttccccat

SEQ ID NO: 3339116 - DNA, 15 bp, Homo sapiens
cccagtcttccttgt

SEQ ID NO: 3339117 - DNA, 19 bp, Homo sapiens
cccagtgagattacagagg

SEQ ID NO: 3339118 - DNA, 15 bp, Homo sapiens
cccagtgccactgcc

SEQ ID NO: 3339119 - DNA, 15 bp, Homo sapiens
cccagtgcccacagg

SEQ ID NO: 3339120 - DNA, 20 bp, Homo sapiens
cccagtgcccacaggatcag

SEQ ID NO: 3339121 - DNA, 14 bp, Homo sapiens
cccagtgggacaga

SEQ ID NO: 3339122 - DNA, 21 bp, Homo sapiens
cccagtgggaggggcaggctg

SEQ ID NO: 3339123 - DNA, 16 bp, Homo sapiens
cccagtgggtctggga

SEQ ID NO: 3339124 - DNA, 21 bp, Homo sapiens
cccagtgtcaagttgtgcttg

SEQ ID NO: 3339125 - DNA, 22 bp, Homo sapiens
cccagtgtcaagttgtgcttgt

SEQ ID NO: 3339126 - DNA, 22 bp, Homo sapiens
cccagttctgaataacttgaag

SEQ ID NO: 3339127 - DNA, 14 bp, Homo sapiens
cccagttctgctcc

SEQ ID NO: 3339128 - DNA, 14 bp, Homo sapiens
cccagttgggtgga

SEQ ID NO: 3339129 - DNA, 14 bp, Homo sapiens
cccagtttcttctt

SEQ ID NO: 3339130 - DNA, 21 bp, Homo sapiens
cccataatagttagccctcag

SEQ ID NO: 3339131 - DNA, 13 bp, Homo sapiens
cccatactcagcc

SEQ ID NO: 3339132 - DNA, 14 bp, Homo sapiens
cccatactcagcct

SEQ ID NO: 3339133 - DNA, 15 bp, Homo sapiens
cccatactcagcctg

SEQ ID NO: 3339134 - DNA, 16 bp, Homo sapiens
cccatactcagcctgc

SEQ ID NO: 3339135 - DNA, 22 bp, Homo sapiens
cccatagatcttctgaaatgaa

SEQ ID NO: 3339136 - DNA, 16 bp, Homo sapiens
cccatagcttccatga

SEQ ID NO: 3339137 - DNA, 18 bp, Homo sapiens
cccatagtttatttttct

SEQ ID NO: 3339138 - DNA, 17 bp, Homo sapiens
cccatatcttgccttca

SEQ ID NO: 3339139 - DNA, 21 bp, Homo sapiens
cccatcacagggttgggccca

SEQ ID NO: 3339140 - DNA, 14 bp, Homo sapiens
cccatcatcccagc

SEQ ID NO: 3339141 - DNA, 13 bp, Homo sapiens
cccatcatccttt

SEQ ID NO: 3339142 - DNA, 12 bp, Homo sapiens
cccatcatgtgg

SEQ ID NO: 3339143 - DNA, 14 bp, Homo sapiens
cccatccaaccact

SEQ ID NO: 3339144 - DNA, 13 bp, Homo sapiens
cccatccaggcag

SEQ ID NO: 3339145 - DNA, 20 bp, Homo sapiens
cccatccagtctcccaactt

SEQ ID NO: 3339146 - DNA, 15 bp, Homo sapiens
cccatccattaggcc

SEQ ID NO: 3339147 - DNA, 12 bp, Homo sapiens
cccatccccacc

SEQ ID NO: 3339148 - DNA, 12 bp, Homo sapiens
cccatccccctg

SEQ ID NO: 3339149 - DNA, 17 bp, Homo sapiens
cccatccctcggaccca

SEQ ID NO: 3339150 - DNA, 12 bp, Homo sapiens
cccatccctgcc

SEQ ID NO: 3339151 - DNA, 17 bp, Homo sapiens
cccatccctgcctggtc

SEQ ID NO: 3339152 - DNA, 14 bp, Homo sapiens
cccatcctaccctc

SEQ ID NO: 3339153 - DNA, 17 bp, Homo sapiens
cccatcctaccctcggg

SEQ ID NO: 3339154 - DNA, 23 bp, Homo sapiens
cccatcctaccctcgggcccacc

SEQ ID NO: 3339155 - DNA, 17 bp, Homo sapiens
cccatcctccagcttct

SEQ ID NO: 3339156 - DNA, 19 bp, Homo sapiens
cccatcctccagcttctgg

SEQ ID NO: 3339157 - DNA, 21 bp, Homo sapiens
cccatcctggggcagcactcc

SEQ ID NO: 3339158 - DNA, 16 bp, Homo sapiens
cccatctcagcctcct

SEQ ID NO: 3339159 - DNA, 19 bp, Homo sapiens
cccatctcaggtgccactc

SEQ ID NO: 3339160 - DNA, 15 bp, Homo sapiens
cccatctcatcctgg

SEQ ID NO: 3339161 - DNA, 15 bp, Homo sapiens
cccatctcccaccct

SEQ ID NO: 3339162 - DNA, 18 bp, Homo sapiens
cccatctccctgcctggc

SEQ ID NO: 3339163 - DNA, 23 bp, Homo sapiens
cccatctctccctcccctgccat

SEQ ID NO: 3339164 - DNA, 13 bp, Homo sapiens
cccatctgcaccc

SEQ ID NO: 3339165 - DNA, 19 bp, Homo sapiens
cccatctgcaccccttctc

SEQ ID NO: 3339166 - DNA, 14 bp, Homo sapiens
cccatcttccacct

SEQ ID NO: 3339167 - DNA, 17 bp, Homo sapiens
cccatcttccacctgtg

SEQ ID NO: 3339168 - DNA, 22 bp, Homo sapiens
cccatcttccacctgtgccctc

SEQ ID NO: 3339169 - DNA, 16 bp, Homo sapiens
cccatcttcctgctgc

SEQ ID NO: 3339170 - DNA, 15 bp, Homo sapiens
cccatgaagatattt

SEQ ID NO: 3339171 - DNA, 19 bp, Homo sapiens
cccatgaccatactgaggg

SEQ ID NO: 3339172 - DNA, 14 bp, Homo sapiens
cccatgacccaccc

SEQ ID NO: 3339173 - DNA, 15 bp, Homo sapiens
cccatgacccacccc

SEQ ID NO: 3339174 - DNA, 13 bp, Homo sapiens
cccatgactgcac

SEQ ID NO: 3339175 - DNA, 21 bp, Homo sapiens
cccatgagaccctggtgcctg

SEQ ID NO: 3339176 - DNA, 20 bp, Homo sapiens
cccatgagcctcagcatcct

SEQ ID NO: 3339177 - DNA, 21 bp, Homo sapiens
cccatgccaaagctagggtgg

SEQ ID NO: 3339178 - DNA, 17 bp, Homo sapiens
cccatgccacgttccac

SEQ ID NO: 3339179 - DNA, 18 bp, Homo sapiens
cccatgccacgttccaca

SEQ ID NO: 3339180 - DNA, 15 bp, Homo sapiens
cccatgcccacctgc

SEQ ID NO: 3339181 - DNA, 23 bp, Homo sapiens
cccatgcctggtcccaagacagt

SEQ ID NO: 3339182 - DNA, 12 bp, Homo sapiens
cccatgcctgtc

SEQ ID NO: 3339183 - DNA, 13 bp, Homo sapiens
cccatgcctgtcc

SEQ ID NO: 3339184 - DNA, 23 bp, Homo sapiens
cccatgcgtgccgcctgctcctc

SEQ ID NO: 3339185 - DNA, 14 bp, Homo sapiens
cccatgctctgccc

SEQ ID NO: 3339186 - DNA, 14 bp, Homo sapiens
cccatgctggtcag

SEQ ID NO: 3339187 - DNA, 20 bp, Homo sapiens
cccatgcttacgtgatcctc

SEQ ID NO: 3339188 - DNA, 17 bp, Homo sapiens
cccatggccccaggccc

SEQ ID NO: 3339189 - DNA, 20 bp, Homo sapiens
cccatggcccccaataaagg

SEQ ID NO: 3339190 - DNA, 23 bp, Homo sapiens
cccatggcccccaataaaggcag

SEQ ID NO: 3339191 - DNA, 15 bp, Homo sapiens
cccatggccctgtgc

SEQ ID NO: 3339192 - DNA, 20 bp, Homo sapiens
cccatgggatatgtggtgta

SEQ ID NO: 3339193 - DNA, 19 bp, Homo sapiens
cccatggggagggattctg

SEQ ID NO: 3339194 - DNA, 21 bp, Homo sapiens
cccatgtaatccttttgttta

SEQ ID NO: 3339195 - DNA, 14 bp, Homo sapiens
cccatgtagccccc

SEQ ID NO: 3339196 - DNA, 23 bp, Homo sapiens
cccatgtagccccctggcctctg

SEQ ID NO: 3339197 - DNA, 22 bp, Homo sapiens
cccatgtcaccggtcagtgcct

SEQ ID NO: 3339198 - DNA, 13 bp, Homo sapiens
cccatgtggctga

SEQ ID NO: 3339199 - DNA, 20 bp, Homo sapiens
cccatgtgtcccctcactct

SEQ ID NO: 3339200 - DNA, 14 bp, Homo sapiens
cccatgttgtaatg

SEQ ID NO: 3339201 - DNA, 20 bp, Homo sapiens
cccatgttgtaatgctgcac

SEQ ID NO: 3339202 - DNA, 21 bp, Homo sapiens
cccattcccccatgtggctga

SEQ ID NO: 3339203 - DNA, 18 bp, Homo sapiens
cccattctacacagagca

SEQ ID NO: 3339204 - DNA, 21 bp, Homo sapiens
cccattctgcctccattctga

SEQ ID NO: 3339205 - DNA, 20 bp, Homo sapiens
cccattctgcctgcccaggc

SEQ ID NO: 3339206 - DNA, 23 bp, Homo sapiens
cccattctgcctgcccaggcccc

SEQ ID NO: 3339207 - DNA, 20 bp, Homo sapiens
cccattcttcctagttttct

SEQ ID NO: 3339208 - DNA, 11 bp, Homo sapiens
cccattctttg

SEQ ID NO: 3339209 - DNA, 17 bp, Homo sapiens
cccattggtgttgtcat

SEQ ID NO: 3339210 - DNA, 19 bp, Homo sapiens
cccattgtggctcctatct

SEQ ID NO: 3339211 - DNA, 16 bp, Homo sapiens
cccatttacacttttg

SEQ ID NO: 3339212 - DNA, 23 bp, Homo sapiens
cccatttcaggaatttaaaatta

SEQ ID NO: 3339213 - DNA, 18 bp, Homo sapiens
cccatttcctcacactaa

SEQ ID NO: 3339214 - DNA, 14 bp, Homo sapiens
cccatttctctaca

SEQ ID NO: 3339215 - DNA, 17 bp, Homo sapiens
cccattttccccttcct

SEQ ID NO: 3339216 - DNA, 15 bp, Homo sapiens
cccattttcctctga

SEQ ID NO: 3339217 - DNA, 20 bp, Homo sapiens
cccatttttatatcgatctc

SEQ ID NO: 3339218 - DNA, 12 bp, Homo sapiens
cccatttttgct

SEQ ID NO: 3339219 - DNA, 18 bp, Homo sapiens
ccccaaacaccttccagc

SEQ ID NO: 3339220 - DNA, 15 bp, Homo sapiens
ccccaaacatagccc

SEQ ID NO: 3339221 - DNA, 16 bp, Homo sapiens
ccccaaacatagcccc

SEQ ID NO: 3339222 - DNA, 14 bp, Homo sapiens
ccccaacactccag

SEQ ID NO: 3339223 - DNA, 16 bp, Homo sapiens
ccccaacactgtgccc

SEQ ID NO: 3339224 - DNA, 20 bp, Homo sapiens
ccccaacactgtgccctggt

SEQ ID NO: 3339225 - DNA, 14 bp, Homo sapiens
ccccaaccacagag

SEQ ID NO: 3339226 - DNA, 21 bp, Homo sapiens
ccccaaccatcttcactggct

SEQ ID NO: 3339227 - DNA, 21 bp, Homo sapiens
ccccaacccaataaaactgat

SEQ ID NO: 3339228 - DNA, 15 bp, Homo sapiens
ccccaacccacctct

SEQ ID NO: 3339229 - DNA, 18 bp, Homo sapiens
ccccaacccacctctggc

SEQ ID NO: 3339230 - DNA, 23 bp, Homo sapiens
ccccaacccacctctggccctgt

SEQ ID NO: 3339231 - DNA, 13 bp, Homo sapiens
ccccaacctcagg

SEQ ID NO: 3339232 - DNA, 14 bp, Homo sapiens
ccccaacctcaggg

SEQ ID NO: 3339233 - DNA, 16 bp, Homo sapiens
ccccaactctgagccc

SEQ ID NO: 3339234 - DNA, 13 bp, Homo sapiens
ccccaagcagcca

SEQ ID NO: 3339235 - DNA, 13 bp, Homo sapiens
ccccatccccacc

SEQ ID NO: 3339236 - DNA, 17 bp, Homo sapiens
ccccatcccctttacta

SEQ ID NO: 3339237 - DNA, 13 bp, Homo sapiens
ccccatccctggg

SEQ ID NO: 3339238 - DNA, 18 bp, Homo sapiens
ccccatcctcatccctga

SEQ ID NO: 3339239 - DNA, 17 bp, Homo sapiens
ccccatcctccagcttc

SEQ ID NO: 3339240 - DNA, 17 bp, Homo sapiens
ccccatctcatcctggc

SEQ ID NO: 3339241 - DNA, 16 bp, Homo sapiens
ccccatctccccaggc

SEQ ID NO: 3339242 - DNA, 22 bp, Homo sapiens
ccattttgttattgactaacag

SEQ ID NO: 3339243 - DNA, 23 bp, Homo sapiens
ccattttgttattgactaacagg

SEQ ID NO: 3339244 - DNA, 17 bp, Homo sapiens
ccattttttaaggaaac

SEQ ID NO: 3339245 - DNA, 20 bp, Homo sapiens
cccaaacaaatatgcaaaag

SEQ ID NO: 3339246 - DNA, 16 bp, Homo sapiens
cccaaacaccttccag

SEQ ID NO: 3339247 - DNA, 21 bp, Homo sapiens
cccaaacaccttccagctcct

SEQ ID NO: 3339248 - DNA, 18 bp, Homo sapiens
cccaaaccatgagaattt

SEQ ID NO: 3339249 - DNA, 19 bp, Homo sapiens
cccaaacccaagtgccttc

SEQ ID NO: 3339250 - DNA, 20 bp, Homo sapiens
cccaaacccttaactgacat

SEQ ID NO: 3339251 - DNA, 22 bp, Homo sapiens
cccaaactgttcaagaaataat

SEQ ID NO: 3339252 - DNA, 18 bp, Homo sapiens
cccaaaggggacaggcct

SEQ ID NO: 3339253 - DNA, 20 bp, Homo sapiens
cccaaaggggacaggcctca

SEQ ID NO: 3339254 - DNA, 15 bp, Homo sapiens
cccaaagtgctgaga

SEQ ID NO: 3339255 - DNA, 20 bp, Homo sapiens
cccaaagtgctgagattaca

SEQ ID NO: 3339256 - DNA, 13 bp, Homo sapiens
cccaaagtgctgg

SEQ ID NO: 3339257 - DNA, 15 bp, Homo sapiens
cccaaagtggggagg

SEQ ID NO: 3339258 - DNA, 19 bp, Homo sapiens
cccaaagtggggagggaca

SEQ ID NO: 3339259 - DNA, 18 bp, Homo sapiens
cccaaataacttcagtcc

SEQ ID NO: 3339260 - DNA, 14 bp, Homo sapiens
cccaaatcaataca

SEQ ID NO: 3339261 - DNA, 10 bp, Homo sapiens
cccaaatgat

SEQ ID NO: 3339262 - DNA, 17 bp, Homo sapiens
cccaaatgatggatcac

SEQ ID NO: 3339263 - DNA, 21 bp, Homo sapiens
cccaaatggctagaacgtgtt

SEQ ID NO: 3339264 - DNA, 23 bp, Homo sapiens
cccaaattagggcaattggaaca

SEQ ID NO: 3339265 - DNA, 15 bp, Homo sapiens
cccaacaacatccat

SEQ ID NO: 3339266 - DNA, 13 bp, Homo sapiens
cccaacactccag

SEQ ID NO: 3339267 - DNA, 12 bp, Homo sapiens
cccaacactgtg

SEQ ID NO: 3339268 - DNA, 15 bp, Homo sapiens
cccaacactgtgccc

SEQ ID NO: 3339269 - DNA, 16 bp, Homo sapiens
cccaacagccttagct

SEQ ID NO: 3339270 - DNA, 21 bp, Homo sapiens
cccaacagccttagctgccag

SEQ ID NO: 3339271 - DNA, 19 bp, Homo sapiens
cccaacagcgacatagccc

SEQ ID NO: 3339272 - DNA, 18 bp, Homo sapiens
cccaaccagtgccaagga

SEQ ID NO: 3339273 - DNA, 17 bp, Homo sapiens
cccaaccatcttcactg

SEQ ID NO: 3339274 - DNA, 16 bp, Homo sapiens
cccaacccaaaccatg

SEQ ID NO: 3339275 - DNA, 17 bp, Homo sapiens
cccaacccaaaccatga

SEQ ID NO: 3339276 - DNA, 13 bp, Homo sapiens
cccaacccacctc

SEQ ID NO: 3339277 - DNA, 14 bp, Homo sapiens
cccaacccacctct

SEQ ID NO: 3339278 - DNA, 13 bp, Homo sapiens
cccaacccccacc

SEQ ID NO: 3339279 - DNA, 14 bp, Homo sapiens
cccaacccccctcc

SEQ ID NO: 3339280 - DNA, 18 bp, Homo sapiens
cccaacccccctcctgct

SEQ ID NO: 3339281 - DNA, 20 bp, Homo sapiens
cccaaccctggcttggggtc

SEQ ID NO: 3339282 - DNA, 12 bp, Homo sapiens
cccaacctcaga

SEQ ID NO: 3339283 - DNA, 13 bp, Homo sapiens
cccaacctcagag

SEQ ID NO: 3339284 - DNA, 13 bp, Homo sapiens
cccaacctcaggg

SEQ ID NO: 3339285 - DNA, 21 bp, Homo sapiens
cccaacctgctctcctcttgc

SEQ ID NO: 3339286 - DNA, 20 bp, Homo sapiens
cccaacggccctgcagccag

SEQ ID NO: 3339287 - DNA, 14 bp, Homo sapiens
cccaacgggaaagg

SEQ ID NO: 3339288 - DNA, 20 bp, Homo sapiens
cccaactccaccagatagca

SEQ ID NO: 3339289 - DNA, 14 bp, Homo sapiens
cccaactctgagcc

SEQ ID NO: 3339290 - DNA, 16 bp, Homo sapiens
cccaactctgagccca

SEQ ID NO: 3339291 - DNA, 19 bp, Homo sapiens
cccaacttcatactggcag

SEQ ID NO: 3339292 - DNA, 20 bp, Homo sapiens
cccaactttgtggatgtctt

SEQ ID NO: 3339293 - DNA, 21 bp, Homo sapiens
cccaagacagatgccccagag

SEQ ID NO: 3339294 - DNA, 14 bp, Homo sapiens
cccaagagaactcg

SEQ ID NO: 3339295 - DNA, 21 bp, Homo sapiens
cccaagagcagagtctgggcc

SEQ ID NO: 3339296 - DNA, 23 bp, Homo sapiens
cccaagagcagagtctgggcctc

SEQ ID NO: 3339297 - DNA, 23 bp, Homo sapiens
cccaagaggtcaaggctgcagtg

SEQ ID NO: 3339298 - DNA, 14 bp, Homo sapiens
cccaagaggtctga

SEQ ID NO: 3339299 - DNA, 16 bp, Homo sapiens
cccaagaggtctgagc

SEQ ID NO: 3339300 - DNA, 23 bp, Homo sapiens
cccaagattcacacctgactctg

SEQ ID NO: 3339301 - DNA, 13 bp, Homo sapiens
cccaagcagccag

SEQ ID NO: 3339302 - DNA, 17 bp, Homo sapiens
cccaagcagccagccag

SEQ ID NO: 3339303 - DNA, 16 bp, Homo sapiens
cccaagccaaaaacct

SEQ ID NO: 3339304 - DNA, 14 bp, Homo sapiens
cccaagccagaggc

SEQ ID NO: 3339305 - DNA, 15 bp, Homo sapiens
cccaagccagaggct

SEQ ID NO: 3339306 - DNA, 16 bp, Homo sapiens
cccaagccagaggctg

SEQ ID NO: 3339307 - DNA, 16 bp, Homo sapiens
cccaagcccaggccac

SEQ ID NO: 3339308 - DNA, 19 bp, Homo sapiens
cccaagccctgaggcctga

SEQ ID NO: 3339309 - DNA, 23 bp, Homo sapiens
cccaagccctgaggcctgaggcc

SEQ ID NO: 3339310 - DNA, 12 bp, Homo sapiens
cccaagcctggg

SEQ ID NO: 3339311 - DNA, 14 bp, Homo sapiens
cccaagctcctcct

SEQ ID NO: 3339312 - DNA, 17 bp, Homo sapiens
cccaaggaaaactgcat

SEQ ID NO: 3339313 - DNA, 20 bp, Homo sapiens
cccaaggacttccacatttt

SEQ ID NO: 3339314 - DNA, 15 bp, Homo sapiens
cccaaggagcacagg

SEQ ID NO: 3339315 - DNA, 22 bp, Homo sapiens
cccaaggagcacaggtcccacc

SEQ ID NO: 3339316 - DNA, 18 bp, Homo sapiens
cccaaggcattgattgca

SEQ ID NO: 3339317 - DNA, 20 bp, Homo sapiens
cccaaggctgcgtctggagg

SEQ ID NO: 3339318 - DNA, 13 bp, Homo sapiens
cccaagggccctg

SEQ ID NO: 3339319 - DNA, 12 bp, Homo sapiens
ccatctgcaccc

SEQ ID NO: 3339320 - DNA, 20 bp, Homo sapiens
ccatctgcaccccttctctc

SEQ ID NO: 3339321 - DNA, 23 bp, Homo sapiens
ccatctgcccaggggtgccccct

SEQ ID NO: 3339322 - DNA, 16 bp, Homo sapiens
ccatctggcctggcct

SEQ ID NO: 3339323 - DNA, 17 bp, Homo sapiens
ccatctggcctggcctg

SEQ ID NO: 3339324 - DNA, 16 bp, Homo sapiens
ccatctgggagtcccc

SEQ ID NO: 3339325 - DNA, 22 bp, Homo sapiens
ccatctgggagtccccttttct

SEQ ID NO: 3339326 - DNA, 18 bp, Homo sapiens
ccatctgggtccttgcac

SEQ ID NO: 3339327 - DNA, 23 bp, Homo sapiens
ccatctgggtccttgcacccctc

SEQ ID NO: 3339328 - DNA, 21 bp, Homo sapiens
ccatctgtagtaatttattgt

SEQ ID NO: 3339329 - DNA, 18 bp, Homo sapiens
ccatcttccacctgtgcc

SEQ ID NO: 3339330 - DNA, 15 bp, Homo sapiens
ccatcttcctgctgc

SEQ ID NO: 3339331 - DNA, 17 bp, Homo sapiens
ccatcttcctgctgctg

SEQ ID NO: 3339332 - DNA, 17 bp, Homo sapiens
ccatcttctccccacag

SEQ ID NO: 3339333 - DNA, 19 bp, Homo sapiens
ccatcttctccccacagcc

SEQ ID NO: 3339334 - DNA, 20 bp, Homo sapiens
ccatcttctccccacagcct

SEQ ID NO: 3339335 - DNA, 21 bp, Homo sapiens
ccatcttctccccacagcctc

SEQ ID NO: 3339336 - DNA, 13 bp, Homo sapiens
ccatcttgctaat

SEQ ID NO: 3339337 - DNA, 21 bp, Homo sapiens
ccatcttgctaataaacactg

SEQ ID NO: 3339338 - DNA, 17 bp, Homo sapiens
ccatctttactcccaag

SEQ ID NO: 3339339 - DNA, 14 bp, Homo sapiens
ccatctttgaactt

SEQ ID NO: 3339340 - DNA, 12 bp, Homo sapiens
ccatctttttct

SEQ ID NO: 3339341 - DNA, 19 bp, Homo sapiens
ccatgaaaacgttttattg

SEQ ID NO: 3339342 - DNA, 20 bp, Homo sapiens
ccatgaaaacgttttattgt

SEQ ID NO: 3339343 - DNA, 16 bp, Homo sapiens
ccatgaacagaaaaca

SEQ ID NO: 3339344 - DNA, 20 bp, Homo sapiens
ccatgaaccaaatggttctt

SEQ ID NO: 3339345 - DNA, 14 bp, Homo sapiens
ccatgaagacagga

SEQ ID NO: 3339346 - DNA, 17 bp, Homo sapiens
ccatgacccacccctgt

SEQ ID NO: 3339347 - DNA, 20 bp, Homo sapiens
ccatgacccacccctgtgct

SEQ ID NO: 3339348 - DNA, 14 bp, Homo sapiens
ccatgactggctgt

SEQ ID NO: 3339349 - DNA, 18 bp, Homo sapiens
ccatgactgtgaccacct

SEQ ID NO: 3339350 - DNA, 21 bp, Homo sapiens
ccatgactgtgaccaccttct

SEQ ID NO: 3339351 - DNA, 20 bp, Homo sapiens
ccatgagaccctggtgcctg

SEQ ID NO: 3339352 - DNA, 21 bp, Homo sapiens
ccatgagcctcagcatcctgg

SEQ ID NO: 3339353 - DNA, 13 bp, Homo sapiens
ccatgagcctgcc

SEQ ID NO: 3339354 - DNA, 15 bp, Homo sapiens
ccatgagggacaggg

SEQ ID NO: 3339355 - DNA, 18 bp, Homo sapiens
ccatgatagctggggctt

SEQ ID NO: 3339356 - DNA, 19 bp, Homo sapiens
ccatgatctgtatttaatg

SEQ ID NO: 3339357 - DNA, 16 bp, Homo sapiens
ccatgattctctgagt

SEQ ID NO: 3339358 - DNA, 20 bp, Homo sapiens
ccatgatttgtcccagcctg

SEQ ID NO: 3339359 - DNA, 12 bp, Homo sapiens
ccatgcaccaaa

SEQ ID NO: 3339360 - DNA, 13 bp, Homo sapiens
ccatgcaccaaac

SEQ ID NO: 3339361 - DNA, 12 bp, Homo sapiens
ccatgcagagcg

SEQ ID NO: 3339362 - DNA, 18 bp, Homo sapiens
ccatgccacgttccacag

SEQ ID NO: 3339363 - DNA, 21 bp, Homo sapiens
ccatgccacgttccacagttg

SEQ ID NO: 3339364 - DNA, 23 bp, Homo sapiens
ccatgccactgccaggcacctgg

SEQ ID NO: 3339365 - DNA, 13 bp, Homo sapiens
ccatgcccacctg

SEQ ID NO: 3339366 - DNA, 16 bp, Homo sapiens
ccatgcccacctgccc

SEQ ID NO: 3339367 - DNA, 23 bp, Homo sapiens
ccatgcctcatgccacaccttct

SEQ ID NO: 3339368 - DNA, 13 bp, Homo sapiens
ccatgcctgaggg

SEQ ID NO: 3339369 - DNA, 14 bp, Homo sapiens
ccatgcctggtccc

SEQ ID NO: 3339370 - DNA, 22 bp, Homo sapiens
ccatgcctgtagctttcctggt

SEQ ID NO: 3339371 - DNA, 13 bp, Homo sapiens
ccatgcctgtcca

SEQ ID NO: 3339372 - DNA, 14 bp, Homo sapiens
ccatgcctgtccag

SEQ ID NO: 3339373 - DNA, 19 bp, Homo sapiens
ccatgcctgtccagcctgg

SEQ ID NO: 3339374 - DNA, 15 bp, Homo sapiens
ccatgcctgtctctg

SEQ ID NO: 3339375 - DNA, 14 bp, Homo sapiens
ccatgcgccccctc

SEQ ID NO: 3339376 - DNA, 20 bp, Homo sapiens
ccatgcgccccctccgccct

SEQ ID NO: 3339377 - DNA, 20 bp, Homo sapiens
ccatgctcatctgctggtcc

SEQ ID NO: 3339378 - DNA, 15 bp, Homo sapiens
ccatgctcctcacct

SEQ ID NO: 3339379 - DNA, 15 bp, Homo sapiens
ccatgctcctcactg

SEQ ID NO: 3339380 - DNA, 13 bp, Homo sapiens
ccatgctctgccc

SEQ ID NO: 3339381 - DNA, 19 bp, Homo sapiens
ccatgctctgccccaagcc

SEQ ID NO: 3339382 - DNA, 23 bp, Homo sapiens
ccatgctctgccccaagccccca

SEQ ID NO: 3339383 - DNA, 15 bp, Homo sapiens
ccatgctgaggcctg

SEQ ID NO: 3339384 - DNA, 14 bp, Homo sapiens
ccatgctgcctcca

SEQ ID NO: 3339385 - DNA, 21 bp, Homo sapiens
ccatgctgctttttggcacag

SEQ ID NO: 3339386 - DNA, 12 bp, Homo sapiens
ccatgctgggcc

SEQ ID NO: 3339387 - DNA, 20 bp, Homo sapiens
ccatgctgggccactgggga

SEQ ID NO: 3339388 - DNA, 13 bp, Homo sapiens
ccatgctggtcag

SEQ ID NO: 3339389 - DNA, 17 bp, Homo sapiens
ccatggacactccagtg

SEQ ID NO: 3339390 - DNA, 19 bp, Homo sapiens
ccatggacactccagtgcc

SEQ ID NO: 3339391 - DNA, 17 bp, Homo sapiens
ccatggagacaagaagg

SEQ ID NO: 3339392 - DNA, 22 bp, Homo sapiens
ccatggagccagctccctctat

SEQ ID NO: 3339393 - DNA, 15 bp, Homo sapiens
ccatggcaccagccc

SEQ ID NO: 3339394 - DNA, 16 bp, Homo sapiens
ccatggcaccagcccc

SEQ ID NO: 3339395 - DNA, 21 bp, Homo sapiens
ccatggcaccagccccctgga

SEQ ID NO: 3339396 - DNA, 23 bp, Homo sapiens
ccatggcccccaataaaggcagc

SEQ ID NO: 3339397 - DNA, 14 bp, Homo sapiens
ccatggccctgtgc

SEQ ID NO: 3339398 - DNA, 17 bp, Homo sapiens
ccatggctcaggcaagc

SEQ ID NO: 3339399 - DNA, 18 bp, Homo sapiens
ccatggctcaggcaagcc

SEQ ID NO: 3339400 - DNA, 13 bp, Homo sapiens
ccatggcttctgg

SEQ ID NO: 3339401 - DNA, 16 bp, Homo sapiens
ccatgggacagggagg

SEQ ID NO: 3339402 - DNA, 17 bp, Homo sapiens
ccatgggagccagctgc

SEQ ID NO: 3339403 - DNA, 22 bp, Homo sapiens
ccatgggagctggttagaaatg

SEQ ID NO: 3339404 - DNA, 23 bp, Homo sapiens
ccatgggatacaacctccctctt

SEQ ID NO: 3339405 - DNA, 15 bp, Homo sapiens
ccatgggccagccta

SEQ ID NO: 3339406 - DNA, 11 bp, Homo sapiens
ccatgggcctg

SEQ ID NO: 3339407 - DNA, 17 bp, Homo sapiens
ccatgggcctgggcctg

SEQ ID NO: 3339408 - DNA, 18 bp, Homo sapiens
ccatgggcctgggcctgc

SEQ ID NO: 3339409 - DNA, 21 bp, Homo sapiens
ccatgggcttcactgtataaa

SEQ ID NO: 3339410 - DNA, 21 bp, Homo sapiens
ccatgggcttggacttcctgg

SEQ ID NO: 3339411 - DNA, 20 bp, Homo sapiens
ccatggtctttccactttca

SEQ ID NO: 3339412 - DNA, 20 bp, Homo sapiens
ccatggttaagagtccaaga

SEQ ID NO: 3339413 - DNA, 14 bp, Homo sapiens
ccatggttgagaaa

SEQ ID NO: 3339414 - DNA, 23 bp, Homo sapiens
ccatgtaaataccagactgcagg

SEQ ID NO: 3339415 - DNA, 18 bp, Homo sapiens
ccatgtactcaagtacca

SEQ ID NO: 3339416 - DNA, 14 bp, Homo sapiens
ccatgtccaaagag

SEQ ID NO: 3339417 - DNA, 18 bp, Homo sapiens
ccatgtccaaagaggctg

SEQ ID NO: 3339418 - DNA, 19 bp, Homo sapiens
ccatgtcctatgtgtgact

SEQ ID NO: 3339419 - DNA, 18 bp, Homo sapiens
ccatgtcgcgctcagcat

SEQ ID NO: 3339420 - DNA, 21 bp, Homo sapiens
ccatgtgattaatgttttcat

SEQ ID NO: 3339421 - DNA, 15 bp, Homo sapiens
ccatgtgcctgcacc

SEQ ID NO: 3339422 - DNA, 17 bp, Homo sapiens
ccatgtgcctgcaccag

SEQ ID NO: 3339423 - DNA, 19 bp, Homo sapiens
ccatgtgcctgcaccagga

SEQ ID NO: 3339424 - DNA, 20 bp, Homo sapiens
ccatgtgcctgcaccaggag

SEQ ID NO: 3339425 - DNA, 16 bp, Homo sapiens
ccatgtgggcacggag

SEQ ID NO: 3339426 - DNA, 16 bp, Homo sapiens
ccatgtgtacattctg

SEQ ID NO: 3339427 - DNA, 22 bp, Homo sapiens
ccatgtgtacattctgcctaga

SEQ ID NO: 3339428 - DNA, 21 bp, Homo sapiens
ccatgttagtaatggcagagc

SEQ ID NO: 3339429 - DNA, 17 bp, Homo sapiens
ccatgttctgcccccag

SEQ ID NO: 3339430 - DNA, 22 bp, Homo sapiens
ccatgttctgcccccagcccaa

SEQ ID NO: 3339431 - DNA, 17 bp, Homo sapiens
ccatgttggccaggctg

SEQ ID NO: 3339432 - DNA, 19 bp, Homo sapiens
ccatgttggccaggctggt

SEQ ID NO: 3339433 - DNA, 21 bp, Homo sapiens
ccatgttggccaggctggtct

SEQ ID NO: 3339434 - DNA, 20 bp, Homo sapiens
ccatgttgtaatgctgcact

SEQ ID NO: 3339435 - DNA, 22 bp, Homo sapiens
ccatgtttagtgaatgactttt

SEQ ID NO: 3339436 - DNA, 13 bp, Homo sapiens
ccatgtttcaaat

SEQ ID NO: 3339437 - DNA, 14 bp, Homo sapiens
ccattaaagtcaga

SEQ ID NO: 3339438 - DNA, 20 bp, Homo sapiens
ccattaaggggaagaatgaa

SEQ ID NO: 3339439 - DNA, 15 bp, Homo sapiens
ccattaagtcatgtg

SEQ ID NO: 3339440 - DNA, 16 bp, Homo sapiens
ccattaagtcatgtgt

SEQ ID NO: 3339441 - DNA, 14 bp, Homo sapiens
ccattaattacata

SEQ ID NO: 3339442 - DNA, 13 bp, Homo sapiens
ccattaggccagc

SEQ ID NO: 3339443 - DNA, 14 bp, Homo sapiens
ccattaggccagca

SEQ ID NO: 3339444 - DNA, 15 bp, Homo sapiens
ccattatactttata

SEQ ID NO: 3339445 - DNA, 16 bp, Homo sapiens
ccattcacaagcctcc

SEQ ID NO: 3339446 - DNA, 18 bp, Homo sapiens
ccattcacaagcctcctg

SEQ ID NO: 3339447 - DNA, 19 bp, Homo sapiens
ccattcacaataaaagctt

SEQ ID NO: 3339448 - DNA, 21 bp, Homo sapiens
ccaggcacctggcctgctggg

SEQ ID NO: 3339449 - DNA, 16 bp, Homo sapiens
ccaggcacggtttgga

SEQ ID NO: 3339450 - DNA, 18 bp, Homo sapiens
ccaggcactgccttctcc

SEQ ID NO: 3339451 - DNA, 18 bp, Homo sapiens
ccaggcactgctgcccag

SEQ ID NO: 3339452 - DNA, 19 bp, Homo sapiens
ccaggcaggtagccagggg

SEQ ID NO: 3339453 - DNA, 14 bp, Homo sapiens
ccaggcaggtcttg

SEQ ID NO: 3339454 - DNA, 19 bp, Homo sapiens
ccaggcaggtgcctggaca

SEQ ID NO: 3339455 - DNA, 17 bp, Homo sapiens
ccaggcagtcgggggct

SEQ ID NO: 3339456 - DNA, 21 bp, Homo sapiens
ccaggcagtcgggggctggcc

SEQ ID NO: 3339457 - DNA, 23 bp, Homo sapiens
ccaggcagtcgggggctggccta

SEQ ID NO: 3339458 - DNA, 18 bp, Homo sapiens
ccaggcatctccttgggc

SEQ ID NO: 3339459 - DNA, 20 bp, Homo sapiens
ccaggcatctccttgggctg

SEQ ID NO: 3339460 - DNA, 15 bp, Homo sapiens
ccaggcattggctca

SEQ ID NO: 3339461 - DNA, 17 bp, Homo sapiens
ccaggccaacagcacct

SEQ ID NO: 3339462 - DNA, 16 bp, Homo sapiens
ccaggccacagccgcc

SEQ ID NO: 3339463 - DNA, 13 bp, Homo sapiens
ccaggccacctcc

SEQ ID NO: 3339464 - DNA, 22 bp, Homo sapiens
ccaggccactgtggccagagct

SEQ ID NO: 3339465 - DNA, 23 bp, Homo sapiens
ccaggccactgtggccagagctg

SEQ ID NO: 3339466 - DNA, 14 bp, Homo sapiens
ccaggccagaggga

SEQ ID NO: 3339467 - DNA, 21 bp, Homo sapiens
ccaggccagagggagtgacag

SEQ ID NO: 3339468 - DNA, 12 bp, Homo sapiens
ccaggccagcct

SEQ ID NO: 3339469 - DNA, 13 bp, Homo sapiens
ccaggccagcctc

SEQ ID NO: 3339470 - DNA, 16 bp, Homo sapiens
ccaggccagcctccga

SEQ ID NO: 3339471 - DNA, 20 bp, Homo sapiens
ccaggccagcctccgagagg

SEQ ID NO: 3339472 - DNA, 17 bp, Homo sapiens
ccaggccaggaccacac

SEQ ID NO: 3339473 - DNA, 15 bp, Homo sapiens
ccaggccattctgcc

SEQ ID NO: 3339474 - DNA, 14 bp, Homo sapiens
ccaggcccaaggct

SEQ ID NO: 3339475 - DNA, 17 bp, Homo sapiens
ccaggcccaaggctccc

SEQ ID NO: 3339476 - DNA, 11 bp, Homo sapiens
ccaggcccagc

SEQ ID NO: 3339477 - DNA, 15 bp, Homo sapiens
ccaggcccaggcaga

SEQ ID NO: 3339478 - DNA, 13 bp, Homo sapiens
ccaggcccatctc

SEQ ID NO: 3339479 - DNA, 23 bp, Homo sapiens
ccaggcccatctcaggtgccact

SEQ ID NO: 3339480 - DNA, 17 bp, Homo sapiens
ccaggccccctgcatct

SEQ ID NO: 3339481 - DNA, 15 bp, Homo sapiens
ccaggcccctgagga

SEQ ID NO: 3339482 - DNA, 18 bp, Homo sapiens
ccaggcccctgaggactg

SEQ ID NO: 3339483 - DNA, 19 bp, Homo sapiens
ccaggcccctgccaccctg

SEQ ID NO: 3339484 - DNA, 23 bp, Homo sapiens
ccaggcccgcaccccggcctcag

SEQ ID NO: 3339485 - DNA, 13 bp, Homo sapiens
ccaggccctccag

SEQ ID NO: 3339486 - DNA, 17 bp, Homo sapiens
ccaggccctccatgggc

SEQ ID NO: 3339487 - DNA, 18 bp, Homo sapiens
ccaggcccttcaggaact

SEQ ID NO: 3339488 - DNA, 16 bp, Homo sapiens
ccaggccgcagctctt

SEQ ID NO: 3339489 - DNA, 17 bp, Homo sapiens
ccaggccgcagctcttg

SEQ ID NO: 3339490 - DNA, 19 bp, Homo sapiens
ccaggccgcagctcttgcc

SEQ ID NO: 3339491 - DNA, 18 bp, Homo sapiens
ccaggccggccagcctca

SEQ ID NO: 3339492 - DNA, 22 bp, Homo sapiens
ccaggccggtgtgggctgtgtc

SEQ ID NO: 3339493 - DNA, 21 bp, Homo sapiens
ccaggccgttccccttggctt

SEQ ID NO: 3339494 - DNA, 22 bp, Homo sapiens
ccaggccgttccccttggcttc

SEQ ID NO: 3339495 - DNA, 16 bp, Homo sapiens
ccaggcctccagcctc

SEQ ID NO: 3339496 - DNA, 15 bp, Homo sapiens
ccaggcctctgtgtc

SEQ ID NO: 3339497 - DNA, 16 bp, Homo sapiens
ccaggcctcttggcag

SEQ ID NO: 3339498 - DNA, 19 bp, Homo sapiens
ccaggcctgaaagaggctg

SEQ ID NO: 3339499 - DNA, 12 bp, Homo sapiens
ccaggcctgcct

SEQ ID NO: 3339500 - DNA, 13 bp, Homo sapiens
ccaggcctgcctc

SEQ ID NO: 3339501 - DNA, 19 bp, Homo sapiens
ccaggcgccccttccccct

SEQ ID NO: 3339502 - DNA, 23 bp, Homo sapiens
ccaggcgcgtgtaaatggttttg

SEQ ID NO: 3339503 - DNA, 16 bp, Homo sapiens
ccaggcgctaattcaa

SEQ ID NO: 3339504 - DNA, 22 bp, Homo sapiens
ccaggcgggagcggtggccctg

SEQ ID NO: 3339505 - DNA, 16 bp, Homo sapiens
ccaggcgggctcaagg

SEQ ID NO: 3339506 - DNA, 22 bp, Homo sapiens
ccaggcgggctcaaggaaaggg

SEQ ID NO: 3339507 - DNA, 19 bp, Homo sapiens
ccaggctagtccggaccca

SEQ ID NO: 3339508 - DNA, 19 bp, Homo sapiens
ccaggctatggttgccacc

SEQ ID NO: 3339509 - DNA, 13 bp, Homo sapiens
ccaggctccgccc

SEQ ID NO: 3339510 - DNA, 18 bp, Homo sapiens
ccaggctccgcccttagt

SEQ ID NO: 3339511 - DNA, 19 bp, Homo sapiens
ccaggctcttcctggacct

SEQ ID NO: 3339512 - DNA, 20 bp, Homo sapiens
ccaggctcttcctggacctg

SEQ ID NO: 3339513 - DNA, 22 bp, Homo sapiens
ccaggctcttcctggacctgag

SEQ ID NO: 3339514 - DNA, 16 bp, Homo sapiens
ccaggctgaattacag

SEQ ID NO: 3339515 - DNA, 10 bp, Homo sapiens
ccaggctgcc

SEQ ID NO: 3339516 - DNA, 19 bp, Homo sapiens
ccaggctgccaaggccaga

SEQ ID NO: 3339517 - DNA, 11 bp, Homo sapiens
ccaggctgccc

SEQ ID NO: 3339518 - DNA, 14 bp, Homo sapiens
ccaggctgccgtgg

SEQ ID NO: 3339519 - DNA, 18 bp, Homo sapiens
ccaggctgccgtggggcc

SEQ ID NO: 3339520 - DNA, 18 bp, Homo sapiens
ccaggctggacatgctga

SEQ ID NO: 3339521 - DNA, 13 bp, Homo sapiens
ccaggctggcgca

SEQ ID NO: 3339522 - DNA, 14 bp, Homo sapiens
ccaggctggcgcag

SEQ ID NO: 3339523 - DNA, 22 bp, Homo sapiens
ccaggctggcgcagccaaggcc

SEQ ID NO: 3339524 - DNA, 16 bp, Homo sapiens
ccaggctggcgtgcag

SEQ ID NO: 3339525 - DNA, 23 bp, Homo sapiens
ccaccaggctggcgcagccaagg

SEQ ID NO: 3339526 - DNA, 12 bp, Homo sapiens
ccaccagttctc

SEQ ID NO: 3339527 - DNA, 19 bp, Homo sapiens
ccaccatatgaattgtaca

SEQ ID NO: 3339528 - DNA, 19 bp, Homo sapiens
ccaccatcatgtctggcta

SEQ ID NO: 3339529 - DNA, 19 bp, Homo sapiens
ccaccattcctgcctttaa

SEQ ID NO: 3339530 - DNA, 15 bp, Homo sapiens
ccacccaagcctgct

SEQ ID NO: 3339531 - DNA, 20 bp, Homo sapiens
ccacccaagcctgctggctg

SEQ ID NO: 3339532 - DNA, 14 bp, Homo sapiens
ccacccacctcagc

SEQ ID NO: 3339533 - DNA, 16 bp, Homo sapiens
ccacccacctcagcct

SEQ ID NO: 3339534 - DNA, 13 bp, Homo sapiens
ccacccactcagg

SEQ ID NO: 3339535 - DNA, 12 bp, Homo sapiens
ccacccaggagc

SEQ ID NO: 3339536 - DNA, 14 bp, Homo sapiens
ccacccaggaggga

SEQ ID NO: 3339537 - DNA, 17 bp, Homo sapiens
ccacccaggagggaggg

SEQ ID NO: 3339538 - DNA, 13 bp, Homo sapiens
ccacccagtgctg

SEQ ID NO: 3339539 - DNA, 19 bp, Homo sapiens
ccacccagtgctgccatgc

SEQ ID NO: 3339540 - DNA, 19 bp, Homo sapiens
ccacccatcttcctgctgc

SEQ ID NO: 3339541 - DNA, 20 bp, Homo sapiens
ccacccatcttcctgctgct

SEQ ID NO: 3339542 - DNA, 19 bp, Homo sapiens
ccaccccaagagaactcgc

SEQ ID NO: 3339543 - DNA, 12 bp, Homo sapiens
ccaccccacact

SEQ ID NO: 3339544 - DNA, 11 bp, Homo sapiens
ccaccccaccc

SEQ ID NO: 3339545 - DNA, 16 bp, Homo sapiens
ccaccccacctgcagg

SEQ ID NO: 3339546 - DNA, 19 bp, Homo sapiens
ccaccccagaaatggtgaa

SEQ ID NO: 3339547 - DNA, 18 bp, Homo sapiens
ccaccccatccagttcat

SEQ ID NO: 3339548 - DNA, 15 bp, Homo sapiens
ccacccccaccccca

SEQ ID NO: 3339549 - DNA, 12 bp, Homo sapiens
ccacccccagcc

SEQ ID NO: 3339550 - DNA, 16 bp, Homo sapiens
ccacccccagctcaat

SEQ ID NO: 3339551 - DNA, 13 bp, Homo sapiens
ccagttaaggacc

SEQ ID NO: 3339552 - DNA, 22 bp, Homo sapiens
ccagttaaggaccgtggccctg

SEQ ID NO: 3339553 - DNA, 18 bp, Homo sapiens
ccagttaatttttccaac

SEQ ID NO: 3339554 - DNA, 17 bp, Homo sapiens
ccagttcaaagtgtata

SEQ ID NO: 3339555 - DNA, 19 bp, Homo sapiens
ccagttcaaagtgtatatt

SEQ ID NO: 3339556 - DNA, 22 bp, Homo sapiens
ccagttctcgttttgggccaga

SEQ ID NO: 3339557 - DNA, 16 bp, Homo sapiens
ccagttctgctcctct

SEQ ID NO: 3339558 - DNA, 17 bp, Homo sapiens
ccagttctgctcctctc

SEQ ID NO: 3339559 - DNA, 21 bp, Homo sapiens
ccagttctgctcctctccagg

SEQ ID NO: 3339560 - DNA, 18 bp, Homo sapiens
ccagttgcactcaggtga

SEQ ID NO: 3339561 - DNA, 17 bp, Homo sapiens
ccagttgcccagagcac

SEQ ID NO: 3339562 - DNA, 18 bp, Homo sapiens
ccagttgcccagagcact

SEQ ID NO: 3339563 - DNA, 14 bp, Homo sapiens
ccagttgcctttta

SEQ ID NO: 3339564 - DNA, 18 bp, Homo sapiens
ccagttgggactcaggat

SEQ ID NO: 3339565 - DNA, 17 bp, Homo sapiens
ccagttgggagcactgg

SEQ ID NO: 3339566 - DNA, 18 bp, Homo sapiens
ccagttgggagcactgga

SEQ ID NO: 3339567 - DNA, 19 bp, Homo sapiens
ccagttgggagcactggag

SEQ ID NO: 3339568 - DNA, 23 bp, Homo sapiens
ccagttgggtggatgcctggtgg

SEQ ID NO: 3339569 - DNA, 21 bp, Homo sapiens
ccagttggtggggccaggcca

SEQ ID NO: 3339570 - DNA, 23 bp, Homo sapiens
ccagtttagatttcaagaaaaaa

SEQ ID NO: 3339571 - DNA, 14 bp, Homo sapiens
ccagtttgactgtg

SEQ ID NO: 3339572 - DNA, 17 bp, Homo sapiens
ccagtttgcacctgtcc

SEQ ID NO: 3339573 - DNA, 20 bp, Homo sapiens
ccagtttgggtaaaatactt

SEQ ID NO: 3339574 - DNA, 12 bp, Homo sapiens
ccagttttcatt

SEQ ID NO: 3339575 - DNA, 16 bp, Homo sapiens
ccataaacggttcctg

SEQ ID NO: 3339576 - DNA, 17 bp, Homo sapiens
ccataaacggttcctgg

SEQ ID NO: 3339577 - DNA, 15 bp, Homo sapiens
ccataacctctgggg

SEQ ID NO: 3339578 - DNA, 12 bp, Homo sapiens
ccataacttgaa

SEQ ID NO: 3339579 - DNA, 17 bp, Homo sapiens
ccataagcctccattta

SEQ ID NO: 3339580 - DNA, 21 bp, Homo sapiens
ccataagcctccatttagttc

SEQ ID NO: 3339581 - DNA, 20 bp, Homo sapiens
ccataatagttagccctcag

SEQ ID NO: 3339582 - DNA, 23 bp, Homo sapiens
ccataatgctaatttaaagagac

SEQ ID NO: 3339583 - DNA, 21 bp, Homo sapiens
ccataatgctactgtctcact

SEQ ID NO: 3339584 - DNA, 13 bp, Homo sapiens
ccataattttgca

SEQ ID NO: 3339585 - DNA, 20 bp, Homo sapiens
ccataattttgcatactgaa

SEQ ID NO: 3339586 - DNA, 21 bp, Homo sapiens
ccatacaatgactagtcacct

SEQ ID NO: 3339587 - DNA, 13 bp, Homo sapiens
ccatacagctcta

SEQ ID NO: 3339588 - DNA, 13 bp, Homo sapiens
ccatactcagcct

SEQ ID NO: 3339589 - DNA, 15 bp, Homo sapiens
ccatactcagcctgc

SEQ ID NO: 3339590 - DNA, 21 bp, Homo sapiens
ccatactcagcctgctgccca

SEQ ID NO: 3339591 - DNA, 17 bp, Homo sapiens
ccatacttttggctcct

SEQ ID NO: 3339592 - DNA, 20 bp, Homo sapiens
ccatagaaacatgacactga

SEQ ID NO: 3339593 - DNA, 14 bp, Homo sapiens
ccatagcaacagga

SEQ ID NO: 3339594 - DNA, 19 bp, Homo sapiens
ccatagcccttacctagag

SEQ ID NO: 3339595 - DNA, 15 bp, Homo sapiens
ccatagcttccatga

SEQ ID NO: 3339596 - DNA, 18 bp, Homo sapiens
ccatagtaactgacatga

SEQ ID NO: 3339597 - DNA, 19 bp, Homo sapiens
ccatagtaccatttataca

SEQ ID NO: 3339598 - DNA, 15 bp, Homo sapiens
ccatagtcacatggc

SEQ ID NO: 3339599 - DNA, 15 bp, Homo sapiens
ccatagtggggcctg

SEQ ID NO: 3339600 - DNA, 20 bp, Homo sapiens
ccatagtggggcctgggagg

SEQ ID NO: 3339601 - DNA, 17 bp, Homo sapiens
ccatagttctgaggtcc

SEQ ID NO: 3339602 - DNA, 17 bp, Homo sapiens
ccatagtttacaatatt

SEQ ID NO: 3339603 - DNA, 19 bp, Homo sapiens
ccatagtttgggtattttt

SEQ ID NO: 3339604 - DNA, 14 bp, Homo sapiens
ccatatctccttcc

SEQ ID NO: 3339605 - DNA, 17 bp, Homo sapiens
ccatatcttgccttcag

SEQ ID NO: 3339606 - DNA, 23 bp, Homo sapiens
ccatatcttgcgaatccaagctc

SEQ ID NO: 3339607 - DNA, 17 bp, Homo sapiens
ccatatgaattgtacag

SEQ ID NO: 3339608 - DNA, 21 bp, Homo sapiens
ccatatgccttggggaggaca

SEQ ID NO: 3339609 - DNA, 22 bp, Homo sapiens
ccatattcagtgctgtggcctg

SEQ ID NO: 3339610 - DNA, 19 bp, Homo sapiens
ccatattctgttggccagt

SEQ ID NO: 3339611 - DNA, 21 bp, Homo sapiens
ccatatttatccatttgtaat

SEQ ID NO: 3339612 - DNA, 22 bp, Homo sapiens
ccatattttattgtattttgat

SEQ ID NO: 3339613 - DNA, 11 bp, Homo sapiens
ccatattttca

SEQ ID NO: 3339614 - DNA, 23 bp, Homo sapiens
ccatattttcacaggtgtggtgt

SEQ ID NO: 3339615 - DNA, 19 bp, Homo sapiens
ccatcaaaatgctttttat

SEQ ID NO: 3339616 - DNA, 16 bp, Homo sapiens
ccatcacaggatgcca

SEQ ID NO: 3339617 - DNA, 20 bp, Homo sapiens
ccaggacgcttctgaatgct

SEQ ID NO: 3339618 - DNA, 20 bp, Homo sapiens
ccaggacgtctggggtgtgg

SEQ ID NO: 3339619 - DNA, 20 bp, Homo sapiens
ccaggactccactggacaga

SEQ ID NO: 3339620 - DNA, 14 bp, Homo sapiens
ccaggactccctcc

SEQ ID NO: 3339621 - DNA, 18 bp, Homo sapiens
ccaggactccctcctcac

SEQ ID NO: 3339622 - DNA, 23 bp, Homo sapiens
ccaggactccctcctcacctctg

SEQ ID NO: 3339623 - DNA, 15 bp, Homo sapiens
ccaggacttggggtc

SEQ ID NO: 3339624 - DNA, 15 bp, Homo sapiens
ccaggagacagacca

SEQ ID NO: 3339625 - DNA, 14 bp, Homo sapiens
ccaggagagagaaa

SEQ ID NO: 3339626 - DNA, 16 bp, Homo sapiens
ccaggagagagaaagc

SEQ ID NO: 3339627 - DNA, 22 bp, Homo sapiens
ccaggagcaggacctactagga

SEQ ID NO: 3339628 - DNA, 15 bp, Homo sapiens
ccaggagccccgagg

SEQ ID NO: 3339629 - DNA, 19 bp, Homo sapiens
ccaggagccccgaggcctt

SEQ ID NO: 3339630 - DNA, 16 bp, Homo sapiens
ccaggagcctgtgcct

SEQ ID NO: 3339631 - DNA, 17 bp, Homo sapiens
ccaggagcctgtgcctc

SEQ ID NO: 3339632 - DNA, 15 bp, Homo sapiens
ccaggaggctgaggt

SEQ ID NO: 3339633 - DNA, 17 bp, Homo sapiens
ccaggagggcatccata

SEQ ID NO: 3339634 - DNA, 18 bp, Homo sapiens
ccaggagggcatccatac

SEQ ID NO: 3339635 - DNA, 13 bp, Homo sapiens
ccaggagtctgtg

SEQ ID NO: 3339636 - DNA, 16 bp, Homo sapiens
ccaggagtctgtgctc

SEQ ID NO: 3339637 - DNA, 17 bp, Homo sapiens
ccaggagtctgtgctct

SEQ ID NO: 3339638 - DNA, 21 bp, Homo sapiens
ccaggagtgtggccacgtggg

SEQ ID NO: 3339639 - DNA, 17 bp, Homo sapiens
ccaggagtttgaggctg

SEQ ID NO: 3339640 - DNA, 15 bp, Homo sapiens
ccaggataaggagac

SEQ ID NO: 3339641 - DNA, 17 bp, Homo sapiens
ccaggataaggagactg

SEQ ID NO: 3339642 - DNA, 20 bp, Homo sapiens
ccaggataaggagactgagg

SEQ ID NO: 3339643 - DNA, 23 bp, Homo sapiens
ccaggataaggagactgaggctt

SEQ ID NO: 3339644 - DNA, 15 bp, Homo sapiens
ccaggatactggcac

SEQ ID NO: 3339645 - DNA, 23 bp, Homo sapiens
ccaggatagtgggcaccccactg

SEQ ID NO: 3339646 - DNA, 18 bp, Homo sapiens
ccaggatatttctgagag

SEQ ID NO: 3339647 - DNA, 14 bp, Homo sapiens
ccaggatcatggtg

SEQ ID NO: 3339648 - DNA, 22 bp, Homo sapiens
ccaggatcccaagcctcctgct

SEQ ID NO: 3339649 - DNA, 16 bp, Homo sapiens
ccaggatcctgcagga

SEQ ID NO: 3339650 - DNA, 18 bp, Homo sapiens
ccaggatcctgcaggaac

SEQ ID NO: 3339651 - DNA, 13 bp, Homo sapiens
ccaggatctttga

SEQ ID NO: 3339652 - DNA, 17 bp, Homo sapiens
ccaggatctttgactga

SEQ ID NO: 3339653 - DNA, 19 bp, Homo sapiens
ccaggatctttgactgaaa

SEQ ID NO: 3339654 - DNA, 22 bp, Homo sapiens
ccaggatgacacctccatttct

SEQ ID NO: 3339655 - DNA, 18 bp, Homo sapiens
ccaggatggactcttctc

SEQ ID NO: 3339656 - DNA, 22 bp, Homo sapiens
ccaggatggaggggtggtcctg

SEQ ID NO: 3339657 - DNA, 23 bp, Homo sapiens
ccaggatggtctcgatctcctga

SEQ ID NO: 3339658 - DNA, 18 bp, Homo sapiens
ccaggattcccccagcca

SEQ ID NO: 3339659 - DNA, 15 bp, Homo sapiens
ccaggcaccatctcc

SEQ ID NO: 3339660 - DNA, 21 bp, Homo sapiens
ccaggcacccttctttcctct

SEQ ID NO: 3339661 - DNA, 23 bp, Homo sapiens
catgtttggtgtttgtctgtgtt

SEQ ID NO: 3339662 - DNA, 14 bp, Homo sapiens
catgttttccgtga

SEQ ID NO: 3339663 - DNA, 10 bp, Homo sapiens
catgttttct

SEQ ID NO: 3339664 - DNA, 21 bp, Homo sapiens
catgttttctttgtttcctgg

SEQ ID NO: 3339665 - DNA, 13 bp, Homo sapiens
catgttttgtata

SEQ ID NO: 3339666 - DNA, 14 bp, Homo sapiens
catgttttgtatac

SEQ ID NO: 3339667 - DNA, 17 bp, Homo sapiens
catgttttgtatacaaa

SEQ ID NO: 3339668 - DNA, 22 bp, Homo sapiens
catgttttgtatacaaatatat

SEQ ID NO: 3339669 - DNA, 14 bp, Homo sapiens
catgttttgtgact

SEQ ID NO: 3339670 - DNA, 17 bp, Homo sapiens
catgttttgtgactata

SEQ ID NO: 3339671 - DNA, 23 bp, Homo sapiens
catgttttgtgactatatagaga

SEQ ID NO: 3339672 - DNA, 21 bp, Homo sapiens
catgttttgtgcatttgtaaa

SEQ ID NO: 3339673 - DNA, 23 bp, Homo sapiens
catgtttttgttttctttgaatg

SEQ ID NO: 3339674 - DNA, 23 bp, Homo sapiens
cattaaaaaaatgtgcctagttt

SEQ ID NO: 3339675 - DNA, 16 bp, Homo sapiens
cattaaaaagaataga

SEQ ID NO: 3339676 - DNA, 15 bp, Homo sapiens
cattaaaaatggaac

SEQ ID NO: 3339677 - DNA, 20 bp, Homo sapiens
cattaaaactaggtaatgtt

SEQ ID NO: 3339678 - DNA, 13 bp, Homo sapiens
cattaaaactgct

SEQ ID NO: 3339679 - DNA, 13 bp, Homo sapiens
cattaaaataaac

SEQ ID NO: 3339680 - DNA, 18 bp, Homo sapiens
cattaaaataaaccaaat

SEQ ID NO: 3339681 - DNA, 13 bp, Homo sapiens
cattaaacttgaa

SEQ ID NO: 3339682 - DNA, 13 bp, Homo sapiens
cattaaagtcaga

SEQ ID NO: 3339683 - DNA, 17 bp, Homo sapiens
cattaaagtcagaagtt

SEQ ID NO: 3339684 - DNA, 19 bp, Homo sapiens
cattaaagttaatagaact

SEQ ID NO: 3339685 - DNA, 20 bp, Homo sapiens
cattaaagttaatagaactt

SEQ ID NO: 3339686 - DNA, 18 bp, Homo sapiens
cattaaatgaatattttg

SEQ ID NO: 3339687 - DNA, 12 bp, Homo sapiens
cattaaatgttt

SEQ ID NO: 3339688 - DNA, 14 bp, Homo sapiens
cattaaattcacaa

SEQ ID NO: 3339689 - DNA, 18 bp, Homo sapiens
cattaaattcacaaactt

SEQ ID NO: 3339690 - DNA, 13 bp, Homo sapiens
cattaaattcact

SEQ ID NO: 3339691 - DNA, 20 bp, Homo sapiens
cattaaattggaattttctt

SEQ ID NO: 3339692 - DNA, 13 bp, Homo sapiens
cattaacacattg

SEQ ID NO: 3339693 - DNA, 15 bp, Homo sapiens
cattaacacattgtt

SEQ ID NO: 3339694 - DNA, 20 bp, Homo sapiens
cattaacagttttccatgaa

SEQ ID NO: 3339695 - DNA, 16 bp, Homo sapiens
cattaactaatctatt

SEQ ID NO: 3339696 - DNA, 21 bp, Homo sapiens
cattaagaatgttggtttact

SEQ ID NO: 3339697 - DNA, 23 bp, Homo sapiens
cattaaggggaagaatgaaagct

SEQ ID NO: 3339698 - DNA, 14 bp, Homo sapiens
cattaagtaatcaa

SEQ ID NO: 3339699 - DNA, 20 bp, Homo sapiens
cattaagtaatcaataaaga

SEQ ID NO: 3339700 - DNA, 15 bp, Homo sapiens
cattaagtcatgtgt

SEQ ID NO: 3339701 - DNA, 17 bp, Homo sapiens
cattaatagcagccttt

SEQ ID NO: 3339702 - DNA, 23 bp, Homo sapiens
cattaatcaatcatctgtgtgaa

SEQ ID NO: 3339703 - DNA, 17 bp, Homo sapiens
cattaatgcctgctttt

SEQ ID NO: 3339704 - DNA, 23 bp, Homo sapiens
cattaatgttaattcagcactga

SEQ ID NO: 3339705 - DNA, 17 bp, Homo sapiens
cattaattaattaaagc

SEQ ID NO: 3339706 - DNA, 19 bp, Homo sapiens
cattaattttgtgcattct

SEQ ID NO: 3339707 - DNA, 13 bp, Homo sapiens
cattacagagagg

SEQ ID NO: 3339708 - DNA, 15 bp, Homo sapiens
cattacagagaggag

SEQ ID NO: 3339709 - DNA, 18 bp, Homo sapiens
cattacagagaggagaaa

SEQ ID NO: 3339710 - DNA, 11 bp, Homo sapiens
cattaccaaaa

SEQ ID NO: 3339711 - DNA, 13 bp, Homo sapiens
cattactgggcct

SEQ ID NO: 3339712 - DNA, 15 bp, Homo sapiens
cattactgttccaga

SEQ ID NO: 3339713 - DNA, 23 bp, Homo sapiens
cattacttgattaagattttaca

SEQ ID NO: 3339714 - DNA, 19 bp, Homo sapiens
cattacttttaaaaatgta

SEQ ID NO: 3339715 - DNA, 18 bp, Homo sapiens
cattagaaattagctgtg

SEQ ID NO: 3339716 - DNA, 19 bp, Homo sapiens
cattagaattatttaaaca

SEQ ID NO: 3339717 - DNA, 19 bp, Homo sapiens
cattagagcccatttcaat

SEQ ID NO: 3339718 - DNA, 16 bp, Homo sapiens
cattagcacagatttt

SEQ ID NO: 3339719 - DNA, 21 bp, Homo sapiens
cattagcacagattttaattg

SEQ ID NO: 3339720 - DNA, 22 bp, Homo sapiens
cattagcacagattttaattgt

SEQ ID NO: 3339721 - DNA, 17 bp, Homo sapiens
cattagcataattttgt

SEQ ID NO: 3339722 - DNA, 19 bp, Homo sapiens
cattagccagatttgtctt

SEQ ID NO: 3339723 - DNA, 21 bp, Homo sapiens
cattaggaattaagttatctt

SEQ ID NO: 3339724 - DNA, 19 bp, Homo sapiens
cattgtctcctatatattt

SEQ ID NO: 3339725 - DNA, 17 bp, Homo sapiens
cattgtctccttccaca

SEQ ID NO: 3339726 - DNA, 13 bp, Homo sapiens
cattgtcttgttc

SEQ ID NO: 3339727 - DNA, 19 bp, Homo sapiens
cattgtcttgttctgtccc

SEQ ID NO: 3339728 - DNA, 21 bp, Homo sapiens
cattgtcttgttctgtccctt

SEQ ID NO: 3339729 - DNA, 16 bp, Homo sapiens
cattgtctttatatga

SEQ ID NO: 3339730 - DNA, 15 bp, Homo sapiens
cattgtgaagcacct

SEQ ID NO: 3339731 - DNA, 23 bp, Homo sapiens
cattgtgatttgttcctgcccca

SEQ ID NO: 3339732 - DNA, 13 bp, Homo sapiens
cattgtggctcct

SEQ ID NO: 3339733 - DNA, 15 bp, Homo sapiens
cattgtgttgacatt

SEQ ID NO: 3339734 - DNA, 16 bp, Homo sapiens
cattgttattgtggaa

SEQ ID NO: 3339735 - DNA, 15 bp, Homo sapiens
cattgttatttatac

SEQ ID NO: 3339736 - DNA, 16 bp, Homo sapiens
cattgttatttataca

SEQ ID NO: 3339737 - DNA, 16 bp, Homo sapiens
cattgttatttctgta

SEQ ID NO: 3339738 - DNA, 20 bp, Homo sapiens
cattgttcttattctggcat

SEQ ID NO: 3339739 - DNA, 18 bp, Homo sapiens
cattgttggccaaagcca

SEQ ID NO: 3339740 - DNA, 17 bp, Homo sapiens
cattgttggctatttga

SEQ ID NO: 3339741 - DNA, 21 bp, Homo sapiens
cattgttggctatttgaaata

SEQ ID NO: 3339742 - DNA, 21 bp, Homo sapiens
cattgtttaggggtgaaggag

SEQ ID NO: 3339743 - DNA, 14 bp, Homo sapiens
cattgtttgcttat

SEQ ID NO: 3339744 - DNA, 13 bp, Homo sapiens
cattgttttgaat

SEQ ID NO: 3339745 - DNA, 23 bp, Homo sapiens
catttaaaaagctcactgctgat

SEQ ID NO: 3339746 - DNA, 12 bp, Homo sapiens
catttaaaagca

SEQ ID NO: 3339747 - DNA, 12 bp, Homo sapiens
catttaaaatga

SEQ ID NO: 3339748 - DNA, 17 bp, Homo sapiens
catttaaaatgattaga

SEQ ID NO: 3339749 - DNA, 14 bp, Homo sapiens
catttaaacccaat

SEQ ID NO: 3339750 - DNA, 12 bp, Homo sapiens
catttaagtttc

SEQ ID NO: 3339751 - DNA, 19 bp, Homo sapiens
catttacagtctctttctt

SEQ ID NO: 3339752 - DNA, 23 bp, Homo sapiens
catttacagtctctttcttcctt

SEQ ID NO: 3339753 - DNA, 17 bp, Homo sapiens
catttacctcgcagtgt

SEQ ID NO: 3339754 - DNA, 19 bp, Homo sapiens
catttacgtaaaaagatat

SEQ ID NO: 3339755 - DNA, 19 bp, Homo sapiens
catttactaaacatatgat

SEQ ID NO: 3339756 - DNA, 20 bp, Homo sapiens
catttactaaacatatgatt

SEQ ID NO: 3339757 - DNA, 12 bp, Homo sapiens
catttactttta

SEQ ID NO: 3339758 - DNA, 12 bp, Homo sapiens
catttagaaaat

SEQ ID NO: 3339759 - DNA, 22 bp, Homo sapiens
catttagaaaatagagctttta

SEQ ID NO: 3339760 - DNA, 19 bp, Homo sapiens
catttagaactttctgctt

SEQ ID NO: 3339761 - DNA, 16 bp, Homo sapiens
catttagaagaaagat

SEQ ID NO: 3339762 - DNA, 17 bp, Homo sapiens
catttagaagaaagatg

SEQ ID NO: 3339763 - DNA, 20 bp, Homo sapiens
catttagaagaaagatgttt

SEQ ID NO: 3339764 - DNA, 22 bp, Homo sapiens
catttagataatttgaaaaagt

SEQ ID NO: 3339765 - DNA, 14 bp, Homo sapiens
catttagttctttg

SEQ ID NO: 3339766 - DNA, 19 bp, Homo sapiens
catttataaccccagcctg

SEQ ID NO: 3339767 - DNA, 18 bp, Homo sapiens
catttatacaaattagaa

SEQ ID NO: 3339768 - DNA, 15 bp, Homo sapiens
catttatcattcttg

SEQ ID NO: 3339769 - DNA, 22 bp, Homo sapiens
catttatccacaggaaagtgtt

SEQ ID NO: 3339770 - DNA, 14 bp, Homo sapiens
catttatctataat

SEQ ID NO: 3339771 - DNA, 22 bp, Homo sapiens
catttatctataatttacctaa

SEQ ID NO: 3339772 - DNA, 17 bp, Homo sapiens
catttatctattaaaat

SEQ ID NO: 3339773 - DNA, 15 bp, Homo sapiens
catttatgatttaat

SEQ ID NO: 3339774 - DNA, 17 bp, Homo sapiens
catttatgatttaataa

SEQ ID NO: 3339775 - DNA, 23 bp, Homo sapiens
catttatgatttaataaaataat

SEQ ID NO: 3339776 - DNA, 18 bp, Homo sapiens
catggtgcctgagaggca

SEQ ID NO: 3339777 - DNA, 19 bp, Homo sapiens
catggtgggttcaggggac

SEQ ID NO: 3339778 - DNA, 13 bp, Homo sapiens
catggtgtaataa

SEQ ID NO: 3339779 - DNA, 22 bp, Homo sapiens
catggtgtaataagacataacg

SEQ ID NO: 3339780 - DNA, 22 bp, Homo sapiens
catggtgtgaaagtcagatgcc

SEQ ID NO: 3339781 - DNA, 20 bp, Homo sapiens
catggttccttccctgggaa

SEQ ID NO: 3339782 - DNA, 16 bp, Homo sapiens
catggttgagaaatga

SEQ ID NO: 3339783 - DNA, 20 bp, Homo sapiens
catggttgtgcacatgcttc

SEQ ID NO: 3339784 - DNA, 18 bp, Homo sapiens
catggtttaaaagaaaaa

SEQ ID NO: 3339785 - DNA, 20 bp, Homo sapiens
catggtttaaaagaaaaaat

SEQ ID NO: 3339786 - DNA, 14 bp, Homo sapiens
catgtaaaagagtc

SEQ ID NO: 3339787 - DNA, 16 bp, Homo sapiens
catgtaaaagcggaaa

SEQ ID NO: 3339788 - DNA, 18 bp, Homo sapiens
catgtaaataccagactg

SEQ ID NO: 3339789 - DNA, 12 bp, Homo sapiens
catgtaacattg

SEQ ID NO: 3339790 - DNA, 13 bp, Homo sapiens
catgtaacattgg

SEQ ID NO: 3339791 - DNA, 22 bp, Homo sapiens
catgtaataaaaagtatatgtt

SEQ ID NO: 3339792 - DNA, 19 bp, Homo sapiens
catgtaattttattttaaa

SEQ ID NO: 3339793 - DNA, 21 bp, Homo sapiens
catgtacaaaatcgattggct

SEQ ID NO: 3339794 - DNA, 19 bp, Homo sapiens
catgtaccatttgcatggc

SEQ ID NO: 3339795 - DNA, 22 bp, Homo sapiens
catgtacctaatccaaatatca

SEQ ID NO: 3339796 - DNA, 22 bp, Homo sapiens
catgtactagttttagttttct

SEQ ID NO: 3339797 - DNA, 19 bp, Homo sapiens
catgtactgagccttgtaa

SEQ ID NO: 3339798 - DNA, 23 bp, Homo sapiens
catgtactgagccttgtaattct

SEQ ID NO: 3339799 - DNA, 22 bp, Homo sapiens
catgtactgtagtttttcttca

SEQ ID NO: 3339800 - DNA, 16 bp, Homo sapiens
catgtagagaaaagca

SEQ ID NO: 3339801 - DNA, 19 bp, Homo sapiens
catgtagagaaaagcacac

SEQ ID NO: 3339802 - DNA, 20 bp, Homo sapiens
catgtagccagcagaactga

SEQ ID NO: 3339803 - DNA, 13 bp, Homo sapiens
catgtagccccct

SEQ ID NO: 3339804 - DNA, 17 bp, Homo sapiens
catgtatattttctcta

SEQ ID NO: 3339805 - DNA, 21 bp, Homo sapiens
catgtatcccaactcctataa

SEQ ID NO: 3339806 - DNA, 17 bp, Homo sapiens
catgtattgcacattgt

SEQ ID NO: 3339807 - DNA, 15 bp, Homo sapiens
catgtatttgagcat

SEQ ID NO: 3339808 - DNA, 13 bp, Homo sapiens
catgtattttgtt

SEQ ID NO: 3339809 - DNA, 21 bp, Homo sapiens
catgtcaggcctgtgtgtgaa

SEQ ID NO: 3339810 - DNA, 13 bp, Homo sapiens
catgtccaaagag

SEQ ID NO: 3339811 - DNA, 18 bp, Homo sapiens
catgtccaaagaggctgc

SEQ ID NO: 3339812 - DNA, 20 bp, Homo sapiens
catgtccaaagaggctgccc

SEQ ID NO: 3339813 - DNA, 12 bp, Homo sapiens
catgtcctgctg

SEQ ID NO: 3339814 - DNA, 14 bp, Homo sapiens
catgtcctgctggc

SEQ ID NO: 3339815 - DNA, 18 bp, Homo sapiens
catgtcctgctggcttcc

SEQ ID NO: 3339816 - DNA, 14 bp, Homo sapiens
catgtcctgtaaag

SEQ ID NO: 3339817 - DNA, 19 bp, Homo sapiens
catgtcctttgcgcctgtg

SEQ ID NO: 3339818 - DNA, 17 bp, Homo sapiens
catgtcgcgctcagcat

SEQ ID NO: 3339819 - DNA, 22 bp, Homo sapiens
catgtcgcgctcagcatgcatc

SEQ ID NO: 3339820 - DNA, 21 bp, Homo sapiens
catgtcgctagccagtgctcc

SEQ ID NO: 3339821 - DNA, 17 bp, Homo sapiens
catgtctgcagtgtgcc

SEQ ID NO: 3339822 - DNA, 23 bp, Homo sapiens
catgtcttgtacatgtgtagcct

SEQ ID NO: 3339823 - DNA, 15 bp, Homo sapiens
catgtcttttaaaat

SEQ ID NO: 3339824 - DNA, 14 bp, Homo sapiens
catgtgaaaccttt

SEQ ID NO: 3339825 - DNA, 24 bp, Homo sapiens
catgtgaaaccttttttaagattt

SEQ ID NO: 3339826 - DNA, 15 bp, Homo sapiens
catgtgaacccggga

SEQ ID NO: 3339827 - DNA, 14 bp, Homo sapiens
catgtgacatttat

SEQ ID NO: 3339828 - DNA, 16 bp, Homo sapiens
catgtgaccactctgt

SEQ ID NO: 3339829 - DNA, 18 bp, Homo sapiens
catgtgaccactctgtct

SEQ ID NO: 3339830 - DNA, 20 bp, Homo sapiens
catgtgagccaccgctgcca

SEQ ID NO: 3339831 - DNA, 22 bp, Homo sapiens
catgtgagccaccgctgccagc

SEQ ID NO: 3339832 - DNA, 13 bp, Homo sapiens
catgtgagcctcg

SEQ ID NO: 3339833 - DNA, 18 bp, Homo sapiens
catgtgagctcttcctat

SEQ ID NO: 3339834 - DNA, 17 bp, Homo sapiens
catgtgaggaggaaaag

SEQ ID NO: 3339835 - DNA, 19 bp, Homo sapiens
catgtgaggaggaaaagga

SEQ ID NO: 3339836 - DNA, 23 bp, Homo sapiens
catgtgaggaggaaaaggaaaaa

SEQ ID NO: 3339837 - DNA, 22 bp, Homo sapiens
catgtgatacattttttaagct

SEQ ID NO: 3339838 - DNA, 20 bp, Homo sapiens
catgtgattaatgttttcat

SEQ ID NO: 3339839 - DNA, 15 bp, Homo sapiens
catgtgcacatgcac

SEQ ID NO: 3339840 - DNA, 14 bp, Homo sapiens
catgtgccatctgt

SEQ ID NO: 3339841 - DNA, 17 bp, Homo sapiens
catgtgccatctgtaca

SEQ ID NO: 3339842 - DNA, 22 bp, Homo sapiens
catgtgcctatagtcccagcta

SEQ ID NO: 3339843 - DNA, 17 bp, Homo sapiens
catgtgcctgcaccagg

SEQ ID NO: 3339844 - DNA, 16 bp, Homo sapiens
cattcccccttcctag

SEQ ID NO: 3339845 - DNA, 16 bp, Homo sapiens
cattcccgaggtcagc

SEQ ID NO: 3339846 - DNA, 13 bp, Homo sapiens
cattccctcccat

SEQ ID NO: 3339847 - DNA, 21 bp, Homo sapiens
cattccctctcatctcaggta

SEQ ID NO: 3339848 - DNA, 20 bp, Homo sapiens
cattccctctcctgcccaga

SEQ ID NO: 3339849 - DNA, 16 bp, Homo sapiens
cattccgttgtctgtg

SEQ ID NO: 3339850 - DNA, 16 bp, Homo sapiens
cattcctaactagaat

SEQ ID NO: 3339851 - DNA, 18 bp, Homo sapiens
cattcctaactagaatta

SEQ ID NO: 3339852 - DNA, 19 bp, Homo sapiens
cattcctaactagaattag

SEQ ID NO: 3339853 - DNA, 14 bp, Homo sapiens
cattcctctgccct

SEQ ID NO: 3339854 - DNA, 19 bp, Homo sapiens
cattcctgaaagaaacagt

SEQ ID NO: 3339855 - DNA, 15 bp, Homo sapiens
cattcctgcctttaa

SEQ ID NO: 3339856 - DNA, 21 bp, Homo sapiens
cattcctgcctttaagccaaa

SEQ ID NO: 3339857 - DNA, 15 bp, Homo sapiens
cattcctggtaccca

SEQ ID NO: 3339858 - DNA, 18 bp, Homo sapiens
cattcctggtacccagcc

SEQ ID NO: 3339859 - DNA, 14 bp, Homo sapiens
cattccttctttga

SEQ ID NO: 3339860 - DNA, 18 bp, Homo sapiens
cattccttctttgataat

SEQ ID NO: 3339861 - DNA, 23 bp, Homo sapiens
cattccttctttgataatgttaa

SEQ ID NO: 3339862 - DNA, 16 bp, Homo sapiens
cattcgcctttgtctt

SEQ ID NO: 3339863 - DNA, 17 bp, Homo sapiens
cattcgcctttgtcttg

SEQ ID NO: 3339864 - DNA, 16 bp, Homo sapiens
cattcgggccacaggg

SEQ ID NO: 3339865 - DNA, 17 bp, Homo sapiens
cattctacacagagcag

SEQ ID NO: 3339866 - DNA, 22 bp, Homo sapiens
cattctacacagagcaggactg

SEQ ID NO: 3339867 - DNA, 21 bp, Homo sapiens
cattctacttgcttattacat

SEQ ID NO: 3339868 - DNA, 15 bp, Homo sapiens
cattctatcaagccc

SEQ ID NO: 3339869 - DNA, 23 bp, Homo sapiens
cattctatcaagcccaggtgcca

SEQ ID NO: 3339870 - DNA, 23 bp, Homo sapiens
cattctatccccaatcagctcct

SEQ ID NO: 3339871 - DNA, 13 bp, Homo sapiens
cattctcattgca

SEQ ID NO: 3339872 - DNA, 15 bp, Homo sapiens
cattctcccaggtac

SEQ ID NO: 3339873 - DNA, 21 bp, Homo sapiens
cattctcccaggtaccagctg

SEQ ID NO: 3339874 - DNA, 15 bp, Homo sapiens
cattctccccagtgt

SEQ ID NO: 3339875 - DNA, 22 bp, Homo sapiens
cattctccccagtgtatgtctt

SEQ ID NO: 3339876 - DNA, 12 bp, Homo sapiens
cattctcctgcc

SEQ ID NO: 3339877 - DNA, 16 bp, Homo sapiens
cattctcctgcctcag

SEQ ID NO: 3339878 - DNA, 15 bp, Homo sapiens
cattctccttgttgt

SEQ ID NO: 3339879 - DNA, 16 bp, Homo sapiens
cattctctcccatcct

SEQ ID NO: 3339880 - DNA, 21 bp, Homo sapiens
cattctctcccatcctggggc

SEQ ID NO: 3339881 - DNA, 14 bp, Homo sapiens
cattctcttttaat

SEQ ID NO: 3339882 - DNA, 15 bp, Homo sapiens
cattctgaattaatt

SEQ ID NO: 3339883 - DNA, 20 bp, Homo sapiens
cattctgaattaattaattt

SEQ ID NO: 3339884 - DNA, 23 bp, Homo sapiens
cattctgaattaattaatttgga

SEQ ID NO: 3339885 - DNA, 17 bp, Homo sapiens
cattctgaccatttcag

SEQ ID NO: 3339886 - DNA, 12 bp, Homo sapiens
cattctgactcg

SEQ ID NO: 3339887 - DNA, 15 bp, Homo sapiens
cattctgatgagcaa

SEQ ID NO: 3339888 - DNA, 11 bp, Homo sapiens
cattctgcaag

SEQ ID NO: 3339889 - DNA, 18 bp, Homo sapiens
cattctgccgccccctcc

SEQ ID NO: 3339890 - DNA, 20 bp, Homo sapiens
cattctgcctgcccaggccc

SEQ ID NO: 3339891 - DNA, 21 bp, Homo sapiens
cattctggtcaagggctgtca

SEQ ID NO: 3339892 - DNA, 16 bp, Homo sapiens
cattcttacaaaacat

SEQ ID NO: 3339893 - DNA, 18 bp, Homo sapiens
cattcttctctagctggt

SEQ ID NO: 3339894 - DNA, 18 bp, Homo sapiens
cattcttctggtgctact

SEQ ID NO: 3339895 - DNA, 23 bp, Homo sapiens
cattcttctgtacgtctgacagg

SEQ ID NO: 3339896 - DNA, 17 bp, Homo sapiens
cattcttgaaagctgtg

SEQ ID NO: 3339897 - DNA, 12 bp, Homo sapiens
cattcttggctt

SEQ ID NO: 3339898 - DNA, 23 bp, Homo sapiens
cattcttgttttctttctttaaa

SEQ ID NO: 3339899 - DNA, 12 bp, Homo sapiens
cattctttggta

SEQ ID NO: 3339900 - DNA, 13 bp, Homo sapiens
cattctttggtaa

SEQ ID NO: 3339901 - DNA, 18 bp, Homo sapiens
cattctttttttcttggc

SEQ ID NO: 3339902 - DNA, 18 bp, Homo sapiens
cattgaaagaagagatga

SEQ ID NO: 3339903 - DNA, 10 bp, Homo sapiens
cattgaaatg

SEQ ID NO: 3339904 - DNA, 21 bp, Homo sapiens
cattgaaatgagcacctccat

SEQ ID NO: 3339905 - DNA, 11 bp, Homo sapiens
cattgaaatgt

SEQ ID NO: 3339906 - DNA, 13 bp, Homo sapiens
cattgaaatgtca

SEQ ID NO: 3339907 - DNA, 15 bp, Homo sapiens
cattgaacacaaact

SEQ ID NO: 3339908 - DNA, 18 bp, Homo sapiens
cattgaagcagatttctg

SEQ ID NO: 3339909 - DNA, 19 bp, Homo sapiens
cattgaagcagatttctgc

SEQ ID NO: 3339910 - DNA, 18 bp, Homo sapiens
cattgaagccgactctgg

SEQ ID NO: 3339911 - DNA, 23 bp, Homo sapiens
cattgaagccgactctggccctg

SEQ ID NO: 3339912 - DNA, 19 bp, Homo sapiens
cattgaagtaatgaatttt

SEQ ID NO: 3339913 - DNA, 20 bp, Homo sapiens
cattgaagtatattcttatt

SEQ ID NO: 3339914 - DNA, 16 bp, Homo sapiens
cattgacaaatctgtg

SEQ ID NO: 3339915 - DNA, 18 bp, Homo sapiens
cattgacaaatctgtgta

SEQ ID NO: 3339916 - DNA, 22 bp, Homo sapiens
cattgaccgcgactaatttcaa

SEQ ID NO: 3339917 - DNA, 18 bp, Homo sapiens
cattgacgattccttctc

SEQ ID NO: 3339918 - DNA, 18 bp, Homo sapiens
cattgacttcattttata

SEQ ID NO: 3339919 - DNA, 22 bp, Homo sapiens
cattgacttcattttatattta

SEQ ID NO: 3339920 - DNA, 16 bp, Homo sapiens
cattgacttttataaa

SEQ ID NO: 3339921 - DNA, 20 bp, Homo sapiens
cattgagctgatataaattc

SEQ ID NO: 3339922 - DNA, 17 bp, Homo sapiens
cattgaggaagagtctt

SEQ ID NO: 3339923 - DNA, 15 bp, Homo sapiens
cattgagtaatatag

SEQ ID NO: 3339924 - DNA, 14 bp, Homo sapiens
cattgagtattgtt

SEQ ID NO: 3339925 - DNA, 16 bp, Homo sapiens
cattgagtattgttta

SEQ ID NO: 3339926 - DNA, 18 bp, Homo sapiens
cattgagtattgtttaaa

SEQ ID NO: 3339927 - DNA, 16 bp, Homo sapiens
cattgagttggttact

SEQ ID NO: 3339928 - DNA, 18 bp, Homo sapiens
cattgagttggttacttc

SEQ ID NO: 3339929 - DNA, 14 bp, Homo sapiens
cattgataatcttc

SEQ ID NO: 3339930 - DNA, 17 bp, Homo sapiens
cattgattgtcagctac

SEQ ID NO: 3339931 - DNA, 19 bp, Homo sapiens
cattgattttataattggt

SEQ ID NO: 3339932 - DNA, 19 bp, Homo sapiens
cattgcacataagcttcca

SEQ ID NO: 3339933 - DNA, 17 bp, Homo sapiens
cattgccaagccccccg

SEQ ID NO: 3339934 - DNA, 15 bp, Homo sapiens
cattgccaccaggag

SEQ ID NO: 3339935 - DNA, 20 bp, Homo sapiens
cattgccaccaggagaacca

SEQ ID NO: 3339936 - DNA, 18 bp, Homo sapiens
cattgccagtgtctttct

SEQ ID NO: 3339937 - DNA, 21 bp, Homo sapiens
cattgccagtgtctttctttg

SEQ ID NO: 3339938 - DNA, 19 bp, Homo sapiens
cattgccattccctgcctg

SEQ ID NO: 3339939 - DNA, 16 bp, Homo sapiens
cattgcccccacctct

SEQ ID NO: 3339940 - DNA, 20 bp, Homo sapiens
cattgcccccacctctggtc

SEQ ID NO: 3339941 - DNA, 13 bp, Homo sapiens
cattgcctcctgt

SEQ ID NO: 3339942 - DNA, 23 bp, Homo sapiens
cattgcctcctgttctgcccacg

SEQ ID NO: 3339943 - DNA, 13 bp, Homo sapiens
cattgcctctttt

SEQ ID NO: 3339944 - DNA, 11 bp, Homo sapiens
cattgcctggc

SEQ ID NO: 3339945 - DNA, 14 bp, Homo sapiens
cattgcggacagcc

SEQ ID NO: 3339946 - DNA, 17 bp, Homo sapiens
cattgcggacagccacg

SEQ ID NO: 3339947 - DNA, 19 bp, Homo sapiens
cattgctccctaagactgt

SEQ ID NO: 3339948 - DNA, 14 bp, Homo sapiens
cattgctgagcctc

SEQ ID NO: 3339949 - DNA, 15 bp, Homo sapiens
cattgctgagcctct

SEQ ID NO: 3339950 - DNA, 18 bp, Homo sapiens
cattgctgagcctctgct

SEQ ID NO: 3339951 - DNA, 17 bp, Homo sapiens
cattgctgctgctacca

SEQ ID NO: 3339952 - DNA, 18 bp, Homo sapiens
cattgctgctgctaccag

SEQ ID NO: 3339953 - DNA, 19 bp, Homo sapiens
cattgctggtagagacccc

SEQ ID NO: 3339954 - DNA, 16 bp, Homo sapiens
cattgctttgaagcag

SEQ ID NO: 3339955 - DNA, 18 bp, Homo sapiens
cattgcttttattttgaa

SEQ ID NO: 3339956 - DNA, 13 bp, Homo sapiens
cattgcttttgaa

SEQ ID NO: 3339957 - DNA, 16 bp, Homo sapiens
cattggaatgttctca

SEQ ID NO: 3339958 - DNA, 12 bp, Homo sapiens
cattggagctga

SEQ ID NO: 3339959 - DNA, 22 bp, Homo sapiens
cattggagctgactgttcttgg

SEQ ID NO: 3339960 - DNA, 11 bp, Homo sapiens
cattggatatt

SEQ ID NO: 3339961 - DNA, 22 bp, Homo sapiens
cattgggctgacacctaccatg

SEQ ID NO: 3339962 - DNA, 19 bp, Homo sapiens
cattgggtgggtaaattca

SEQ ID NO: 3339963 - DNA, 13 bp, Homo sapiens
cattgtaaacaaa

SEQ ID NO: 3339964 - DNA, 15 bp, Homo sapiens
cattgtaaacaaact

SEQ ID NO: 3339965 - DNA, 17 bp, Homo sapiens
cattgtaactattaacc

SEQ ID NO: 3339966 - DNA, 20 bp, Homo sapiens
cattgtaactattaaccttt

SEQ ID NO: 3339967 - DNA, 16 bp, Homo sapiens
cattgtactacctgtg

SEQ ID NO: 3339968 - DNA, 15 bp, Homo sapiens
cattgtagagcttct

SEQ ID NO: 3339969 - DNA, 16 bp, Homo sapiens
cattgtagagcttctg

SEQ ID NO: 3339970 - DNA, 19 bp, Homo sapiens
cattgtagagcttctggca

SEQ ID NO: 3339971 - DNA, 20 bp, Homo sapiens
cattgtatagatataatgaa

SEQ ID NO: 3339972 - DNA, 16 bp, Homo sapiens
cattgtatgatgtgtt

SEQ ID NO: 3339973 - DNA, 18 bp, Homo sapiens
cattgtatgatgtgttgt

SEQ ID NO: 3339974 - DNA, 14 bp, Homo sapiens
catatctacagata

SEQ ID NO: 3339975 - DNA, 15 bp, Homo sapiens
catatctccttcccc

SEQ ID NO: 3339976 - DNA, 20 bp, Homo sapiens
catatcttaaagaaacagct

SEQ ID NO: 3339977 - DNA, 23 bp, Homo sapiens
catatcttaaagaaacagctttc

SEQ ID NO: 3339978 - DNA, 14 bp, Homo sapiens
catatctttattaa

SEQ ID NO: 3339979 - DNA, 17 bp, Homo sapiens
catatctttattaatca

SEQ ID NO: 3339980 - DNA, 18 bp, Homo sapiens
catatgaaaatacaactt

SEQ ID NO: 3339981 - DNA, 13 bp, Homo sapiens
catatgaaatcct

SEQ ID NO: 3339982 - DNA, 15 bp, Homo sapiens
catatgaattgtaca

SEQ ID NO: 3339983 - DNA, 23 bp, Homo sapiens
catatgaccattgagtccctgct

SEQ ID NO: 3339984 - DNA, 20 bp, Homo sapiens
catatgactcacatgatgca

SEQ ID NO: 3339985 - DNA, 14 bp, Homo sapiens
catatgagtgtgga

SEQ ID NO: 3339986 - DNA, 19 bp, Homo sapiens
catatgagtgtggaagccg

SEQ ID NO: 3339987 - DNA, 21 bp, Homo sapiens
catatgatttcactagaaaag

SEQ ID NO: 3339988 - DNA, 16 bp, Homo sapiens
catatgcaccttgtgt

SEQ ID NO: 3339989 - DNA, 17 bp, Homo sapiens
catatgcaccttgtgtc

SEQ ID NO: 3339990 - DNA, 18 bp, Homo sapiens
catatgcaccttgtgtct

SEQ ID NO: 3339991 - DNA, 19 bp, Homo sapiens
catatgcaccttgtgtctg

SEQ ID NO: 3339992 - DNA, 21 bp, Homo sapiens
catatgcaccttgtgtctgta

SEQ ID NO: 3339993 - DNA, 14 bp, Homo sapiens
catatgcagaaata

SEQ ID NO: 3339994 - DNA, 13 bp, Homo sapiens
catatgccacccc

SEQ ID NO: 3339995 - DNA, 21 bp, Homo sapiens
catatgctccaggatctttga

SEQ ID NO: 3339996 - DNA, 23 bp, Homo sapiens
catatgctgtatatcctttctaa

SEQ ID NO: 3339997 - DNA, 17 bp, Homo sapiens
catatggactctgcaca

SEQ ID NO: 3339998 - DNA, 20 bp, Homo sapiens
catatggactctgcacatga

SEQ ID NO: 3339999 - DNA, 18 bp, Homo sapiens
catatggattttctattg

SEQ ID NO: 3340000 - DNA, 20 bp, Homo sapiens
catatggcccagtgtcaagt

SEQ ID NO: 3340001 - DNA, 16 bp, Homo sapiens
catatgtacataaatt

SEQ ID NO: 3340002 - DNA, 19 bp, Homo sapiens
catatgtacataaattgca

SEQ ID NO: 3340003 - DNA, 17 bp, Homo sapiens
catatgtagaaacattt

SEQ ID NO: 3340004 - DNA, 20 bp, Homo sapiens
catatgtagaaacatttaga

SEQ ID NO: 3340005 - DNA, 23 bp, Homo sapiens
catatgtagaaacatttagattt

SEQ ID NO: 3340006 - DNA, 20 bp, Homo sapiens
catatgtagactatatacat

SEQ ID NO: 3340007 - DNA, 16 bp, Homo sapiens
catatgttgctcagtc

SEQ ID NO: 3340008 - DNA, 14 bp, Homo sapiens
catatgtttggtaa

SEQ ID NO: 3340009 - DNA, 22 bp, Homo sapiens
catattaaaattacagatgtga

SEQ ID NO: 3340010 - DNA, 20 bp, Homo sapiens
catattaagcactttaagct

SEQ ID NO: 3340011 - DNA, 16 bp, Homo sapiens
catattactgttgcat

SEQ ID NO: 3340012 - DNA, 18 bp, Homo sapiens
catattactgttgcattt

SEQ ID NO: 3340013 - DNA, 20 bp, Homo sapiens
catattaggaaaatatgggt

SEQ ID NO: 3340014 - DNA, 16 bp, Homo sapiens
catattcagacatcaa

SEQ ID NO: 3340015 - DNA, 16 bp, Homo sapiens
catattccatatttat

SEQ ID NO: 3340016 - DNA, 15 bp, Homo sapiens
catattctgttggaa

SEQ ID NO: 3340017 - DNA, 22 bp, Homo sapiens
catattctgttggccagtgtga

SEQ ID NO: 3340018 - DNA, 20 bp, Homo sapiens
catattcttttctgcaaaat

SEQ ID NO: 3340019 - DNA, 17 bp, Homo sapiens
catattgatctttttat

SEQ ID NO: 3340020 - DNA, 21 bp, Homo sapiens
catattgatctttttatcatg

SEQ ID NO: 3340021 - DNA, 23 bp, Homo sapiens
catattgctgagagaaatatgga

SEQ ID NO: 3340022 - DNA, 16 bp, Homo sapiens
catattggtattcact

SEQ ID NO: 3340023 - DNA, 19 bp, Homo sapiens
catattgtaaaacaggtag

SEQ ID NO: 3340024 - DNA, 18 bp, Homo sapiens
catattgtgattctgcct

SEQ ID NO: 3340025 - DNA, 21 bp, Homo sapiens
catattgtgcttcacagtaga

SEQ ID NO: 3340026 - DNA, 22 bp, Homo sapiens
catattgttagggtcagccatt

SEQ ID NO: 3340027 - DNA, 16 bp, Homo sapiens
catattgttgaaaggt

SEQ ID NO: 3340028 - DNA, 18 bp, Homo sapiens
catattgttggcacagaa

SEQ ID NO: 3340029 - DNA, 20 bp, Homo sapiens
catatttacttcttatacat

SEQ ID NO: 3340030 - DNA, 13 bp, Homo sapiens
catatttatactt

SEQ ID NO: 3340031 - DNA, 14 bp, Homo sapiens
catatttatacttt

SEQ ID NO: 3340032 - DNA, 22 bp, Homo sapiens
catatttatagcaatccatgtt

SEQ ID NO: 3340033 - DNA, 17 bp, Homo sapiens
catatttatccatttgt

SEQ ID NO: 3340034 - DNA, 16 bp, Homo sapiens
catatttattgcattg

SEQ ID NO: 3340035 - DNA, 16 bp, Homo sapiens
catatttgccaataaa

SEQ ID NO: 3340036 - DNA, 16 bp, Homo sapiens
catattttattgtatt

SEQ ID NO: 3340037 - DNA, 13 bp, Homo sapiens
catattttcacag

SEQ ID NO: 3340038 - DNA, 13 bp, Homo sapiens
catcaaaatgctt

SEQ ID NO: 3340039 - DNA, 15 bp, Homo sapiens
catcaaagcctggcc

SEQ ID NO: 3340040 - DNA, 18 bp, Homo sapiens
catcaaataaatttctgg

SEQ ID NO: 3340041 - DNA, 14 bp, Homo sapiens
catcaacatcttgg

SEQ ID NO: 3340042 - DNA, 16 bp, Homo sapiens
catcaaccaccatgga

SEQ ID NO: 3340043 - DNA, 14 bp, Homo sapiens
catcaactgaatga

SEQ ID NO: 3340044 - DNA, 21 bp, Homo sapiens
catcaagaggtgggagggccc

SEQ ID NO: 3340045 - DNA, 18 bp, Homo sapiens
catcaagcaggaattatg

SEQ ID NO: 3340046 - DNA, 21 bp, Homo sapiens
catcaatatccctcttgtaag

SEQ ID NO: 3340047 - DNA, 19 bp, Homo sapiens
catcaatcaaataagtatt

SEQ ID NO: 3340048 - DNA, 16 bp, Homo sapiens
catcaatgttcattgt

SEQ ID NO: 3340049 - DNA, 15 bp, Homo sapiens
catcaatttaaaaag

SEQ ID NO: 3340050 - DNA, 15 bp, Homo sapiens
catcacaatacagat

SEQ ID NO: 3340051 - DNA, 19 bp, Homo sapiens
catcacagcaatatttaac

SEQ ID NO: 3340052 - DNA, 20 bp, Homo sapiens
catcacagcaatatttaaca

SEQ ID NO: 3340053 - DNA, 16 bp, Homo sapiens
catcacagcagcctcc

SEQ ID NO: 3340054 - DNA, 19 bp, Homo sapiens
catcacagcagcctccaac

SEQ ID NO: 3340055 - DNA, 16 bp, Homo sapiens
catcacaggatgccag

SEQ ID NO: 3340056 - DNA, 20 bp, Homo sapiens
catcacaggatgccagcccc

SEQ ID NO: 3340057 - DNA, 21 bp, Homo sapiens
catcacaggatgccagcccct

SEQ ID NO: 3340058 - DNA, 20 bp, Homo sapiens
catcacagggcagagccggg

SEQ ID NO: 3340059 - DNA, 15 bp, Homo sapiens
catcaccaccgcctc

SEQ ID NO: 3340060 - DNA, 16 bp, Homo sapiens
catcaccaccgcctct

SEQ ID NO: 3340061 - DNA, 14 bp, Homo sapiens
catcaccctcttcc

SEQ ID NO: 3340062 - DNA, 16 bp, Homo sapiens
catcaccgctgggtgg

SEQ ID NO: 3340063 - DNA, 15 bp, Homo sapiens
catcacctcaggcca

SEQ ID NO: 3340064 - DNA, 23 bp, Homo sapiens
catcacgtaccccactgggccag

SEQ ID NO: 3340065 - DNA, 19 bp, Homo sapiens
catcacgttagctgtccca

SEQ ID NO: 3340066 - DNA, 17 bp, Homo sapiens
catcactagaagaaaag

SEQ ID NO: 3340067 - DNA, 21 bp, Homo sapiens
catcactatccatgcaccaaa

SEQ ID NO: 3340068 - DNA, 14 bp, Homo sapiens
catcacttccctac

SEQ ID NO: 3340069 - DNA, 14 bp, Homo sapiens
catcacttgtacaa

SEQ ID NO: 3340070 - DNA, 18 bp, Homo sapiens
catggcaccagccccctg

SEQ ID NO: 3340071 - DNA, 22 bp, Homo sapiens
catggcaccagccccctggatg

SEQ ID NO: 3340072 - DNA, 20 bp, Homo sapiens
catggcagcatggagagcct

SEQ ID NO: 3340073 - DNA, 20 bp, Homo sapiens
catggcagcctactctcctt

SEQ ID NO: 3340074 - DNA, 23 bp, Homo sapiens
catggcagctggttgctccattt

SEQ ID NO: 3340075 - DNA, 21 bp, Homo sapiens
catggcatcttcgtcttcact

SEQ ID NO: 3340076 - DNA, 18 bp, Homo sapiens
catggcatgcttaaattt

SEQ ID NO: 3340077 - DNA, 16 bp, Homo sapiens
catggcccccaataaa

SEQ ID NO: 3340078 - DNA, 22 bp, Homo sapiens
catggcccccaggggcaggact

SEQ ID NO: 3340079 - DNA, 13 bp, Homo sapiens
catggcccctctg

SEQ ID NO: 3340080 - DNA, 20 bp, Homo sapiens
catggcctgcagtctggcag

SEQ ID NO: 3340081 - DNA, 12 bp, Homo sapiens
catggcctttct

SEQ ID NO: 3340082 - DNA, 20 bp, Homo sapiens
catggcgtaatgggcctgcc

SEQ ID NO: 3340083 - DNA, 23 bp, Homo sapiens
catggcgtaatgggcctgcccaa

SEQ ID NO: 3340084 - DNA, 22 bp, Homo sapiens
catggctcagatcggccacagg

SEQ ID NO: 3340085 - DNA, 12 bp, Homo sapiens
catggctcaggc

SEQ ID NO: 3340086 - DNA, 17 bp, Homo sapiens
catggctcaggcaagcc

SEQ ID NO: 3340087 - DNA, 18 bp, Homo sapiens
catggctcaggcaagccc

SEQ ID NO: 3340088 - DNA, 15 bp, Homo sapiens
catggctgctgttgc

SEQ ID NO: 3340089 - DNA, 20 bp, Homo sapiens
catggctgtgtttgcagcct

SEQ ID NO: 3340090 - DNA, 23 bp, Homo sapiens
catggctgtgtttgcagcctgct

SEQ ID NO: 3340091 - DNA, 15 bp, Homo sapiens
catggcttaatgttt

SEQ ID NO: 3340092 - DNA, 17 bp, Homo sapiens
catggcttctggtcatg

SEQ ID NO: 3340093 - DNA, 20 bp, Homo sapiens
catgggagccagctgctttt

SEQ ID NO: 3340094 - DNA, 22 bp, Homo sapiens
catgggagccagctgctttttg

SEQ ID NO: 3340095 - DNA, 14 bp, Homo sapiens
catgggagggggct

SEQ ID NO: 3340096 - DNA, 18 bp, Homo sapiens
catgggatacaacctccc

SEQ ID NO: 3340097 - DNA, 17 bp, Homo sapiens
catgggatatgtggtgt

SEQ ID NO: 3340098 - DNA, 13 bp, Homo sapiens
catgggccagcct

SEQ ID NO: 3340099 - DNA, 21 bp, Homo sapiens
catgggccagcctagcccttg

SEQ ID NO: 3340100 - DNA, 15 bp, Homo sapiens
catgggcctcctgtg

SEQ ID NO: 3340101 - DNA, 10 bp, Homo sapiens
catgggcctg

SEQ ID NO: 3340102 - DNA, 11 bp, Homo sapiens
catgggcctgg

SEQ ID NO: 3340103 - DNA, 17 bp, Homo sapiens
catgggcctgggcctgc

SEQ ID NO: 3340104 - DNA, 15 bp, Homo sapiens
catgggcgcaggccc

SEQ ID NO: 3340105 - DNA, 19 bp, Homo sapiens
catgggctagtgtgagtgg

SEQ ID NO: 3340106 - DNA, 13 bp, Homo sapiens
catgggctcttca

SEQ ID NO: 3340107 - DNA, 22 bp, Homo sapiens
catgggctgagtggggagcagt

SEQ ID NO: 3340108 - DNA, 13 bp, Homo sapiens
catgggcttcact

SEQ ID NO: 3340109 - DNA, 20 bp, Homo sapiens
catgggcttggacttcctgg

SEQ ID NO: 3340110 - DNA, 23 bp, Homo sapiens
catggggagggattctggttcca

SEQ ID NO: 3340111 - DNA, 19 bp, Homo sapiens
catggggatcaattttcat

SEQ ID NO: 3340112 - DNA, 16 bp, Homo sapiens
catgggggtgacccca

SEQ ID NO: 3340113 - DNA, 21 bp, Homo sapiens
catggggtggggtagggctga

SEQ ID NO: 3340114 - DNA, 19 bp, Homo sapiens
catgggtgaagggagagcc

SEQ ID NO: 3340115 - DNA, 16 bp, Homo sapiens
catggtaccagccctg

SEQ ID NO: 3340116 - DNA, 17 bp, Homo sapiens
catggtaccagccctgg

SEQ ID NO: 3340117 - DNA, 19 bp, Homo sapiens
catggtacccccttctggg

SEQ ID NO: 3340118 - DNA, 13 bp, Homo sapiens
catggtccctgcc

SEQ ID NO: 3340119 - DNA, 14 bp, Homo sapiens
catggtccctgcct

SEQ ID NO: 3340120 - DNA, 17 bp, Homo sapiens
catggtccctgccttag

SEQ ID NO: 3340121 - DNA, 20 bp, Homo sapiens
catggtcccttaaggcacag

SEQ ID NO: 3340122 - DNA, 16 bp, Homo sapiens
catggtctagaaatgc

SEQ ID NO: 3340123 - DNA, 20 bp, Homo sapiens
catggtctttccactttcat

SEQ ID NO: 3340124 - DNA, 15 bp, Homo sapiens
catggtgcctgagag

SEQ ID NO: 3340125 - DNA, 18 bp, Homo sapiens
catttgtattttgtgtga

SEQ ID NO: 3340126 - DNA, 14 bp, Homo sapiens
catttgtcacagaa

SEQ ID NO: 3340127 - DNA, 16 bp, Homo sapiens
catttgtgaaatgatg

SEQ ID NO: 3340128 - DNA, 12 bp, Homo sapiens
catttgtttgac

SEQ ID NO: 3340129 - DNA, 14 bp, Homo sapiens
catttgttttgctt

SEQ ID NO: 3340130 - DNA, 16 bp, Homo sapiens
catttgttttgctttt

SEQ ID NO: 3340131 - DNA, 18 bp, Homo sapiens
catttgttttgcttttgt

SEQ ID NO: 3340132 - DNA, 16 bp, Homo sapiens
cattttaaaaacttta

SEQ ID NO: 3340133 - DNA, 17 bp, Homo sapiens
cattttaattattattc

SEQ ID NO: 3340134 - DNA, 16 bp, Homo sapiens
cattttaattctctcc

SEQ ID NO: 3340135 - DNA, 13 bp, Homo sapiens
cattttacacagc

SEQ ID NO: 3340136 - DNA, 12 bp, Homo sapiens
cattttacagtg

SEQ ID NO: 3340137 - DNA, 21 bp, Homo sapiens
cattttatatttttgtacata

SEQ ID NO: 3340138 - DNA, 14 bp, Homo sapiens
cattttattaaaca

SEQ ID NO: 3340139 - DNA, 23 bp, Homo sapiens
cattttattaagctttttggaat

SEQ ID NO: 3340140 - DNA, 12 bp, Homo sapiens
cattttatttat

SEQ ID NO: 3340141 - DNA, 15 bp, Homo sapiens
cattttcaactgctt

SEQ ID NO: 3340142 - DNA, 23 bp, Homo sapiens
cattttcccatcatcctttgttc

SEQ ID NO: 3340143 - DNA, 15 bp, Homo sapiens
cattttccccccact

SEQ ID NO: 3340144 - DNA, 22 bp, Homo sapiens
cattttccccccactctcccca

SEQ ID NO: 3340145 - DNA, 18 bp, Homo sapiens
cattttctataacagata

SEQ ID NO: 3340146 - DNA, 21 bp, Homo sapiens
cattttctgacatgcattgtt

SEQ ID NO: 3340147 - DNA, 13 bp, Homo sapiens
cattttcttgtat

SEQ ID NO: 3340148 - DNA, 17 bp, Homo sapiens
cattttgcctgacaatt

SEQ ID NO: 3340149 - DNA, 20 bp, Homo sapiens
cattttggaagttttcagga

SEQ ID NO: 3340150 - DNA, 15 bp, Homo sapiens
cattttggtgagaaa

SEQ ID NO: 3340151 - DNA, 14 bp, Homo sapiens
cattttggtttatt

SEQ ID NO: 3340152 - DNA, 21 bp, Homo sapiens
cattttggtttatttttgtaa

SEQ ID NO: 3340153 - DNA, 23 bp, Homo sapiens
cattttggtttatttttgtaatg

SEQ ID NO: 3340154 - DNA, 12 bp, Homo sapiens
cattttgtaaac

SEQ ID NO: 3340155 - DNA, 13 bp, Homo sapiens
cattttgtgaatg

SEQ ID NO: 3340156 - DNA, 18 bp, Homo sapiens
cattttgtgaatggattg

SEQ ID NO: 3340157 - DNA, 15 bp, Homo sapiens
cattttgttatagaa

SEQ ID NO: 3340158 - DNA, 19 bp, Homo sapiens
cattttgttcttacacata

SEQ ID NO: 3340159 - DNA, 18 bp, Homo sapiens
cattttgttgtaaaaaga

SEQ ID NO: 3340160 - DNA, 13 bp, Homo sapiens
catttttaacagc

SEQ ID NO: 3340161 - DNA, 20 bp, Homo sapiens
catttttaaggctgtgtgaa

SEQ ID NO: 3340162 - DNA, 20 bp, Homo sapiens
catttttactattgttacat

SEQ ID NO: 3340163 - DNA, 22 bp, Homo sapiens
catttttagaaatcacaacaaa

SEQ ID NO: 3340164 - DNA, 18 bp, Homo sapiens
catttttagtagagacag

SEQ ID NO: 3340165 - DNA, 17 bp, Homo sapiens
catttttccaacacaca

SEQ ID NO: 3340166 - DNA, 18 bp, Homo sapiens
catttttcctctgttcac

SEQ ID NO: 3340167 - DNA, 20 bp, Homo sapiens
catttttgcaaatctaaagt

SEQ ID NO: 3340168 - DNA, 12 bp, Homo sapiens
catttttgtaca

SEQ ID NO: 3340169 - DNA, 21 bp, Homo sapiens
cattttttatgggcattgaca

SEQ ID NO: 3340170 - DNA, 19 bp, Homo sapiens
cattttttgctataatcat

SEQ ID NO: 3340171 - DNA, 17 bp, Homo sapiens
catttttttaatttatt

SEQ ID NO: 3340172 - DNA, 21 bp, Homo sapiens
ccaagggaaaggggtgctttt

SEQ ID NO: 3340173 - DNA, 18 bp, Homo sapiens
ccaagggactccaatctg

SEQ ID NO: 3340174 - DNA, 22 bp, Homo sapiens
ccaagggccctggcacccccac

SEQ ID NO: 3340175 - DNA, 14 bp, Homo sapiens
ccaagggcttctgc

SEQ ID NO: 3340176 - DNA, 17 bp, Homo sapiens
ccaagggcttctgcacc

SEQ ID NO: 3340177 - DNA, 22 bp, Homo sapiens
ccaagggcttctgcaccctcca

SEQ ID NO: 3340178 - DNA, 23 bp, Homo sapiens
ccaagggcttctgcaccctccac

SEQ ID NO: 3340179 - DNA, 20 bp, Homo sapiens
ccaagggtttcgactggtcc

SEQ ID NO: 3340180 - DNA, 14 bp, Homo sapiens
ccaaggtcccctcc

SEQ ID NO: 3340181 - DNA, 16 bp, Homo sapiens
ccaaggtcctgctcaa

SEQ ID NO: 3340182 - DNA, 15 bp, Homo sapiens
ccaaggtgatgttgt

SEQ ID NO: 3340183 - DNA, 23 bp, Homo sapiens
ccaaggtgggctgagccctggca

SEQ ID NO: 3340184 - DNA, 22 bp, Homo sapiens
ccaaggtttaaagagtctagat

SEQ ID NO: 3340185 - DNA, 21 bp, Homo sapiens
ccaaggttttataaggctgat

SEQ ID NO: 3340186 - DNA, 18 bp, Homo sapiens
ccaagtaaacagggtacc

SEQ ID NO: 3340187 - DNA, 17 bp, Homo sapiens
ccaagtaccaatgctgt

SEQ ID NO: 3340188 - DNA, 15 bp, Homo sapiens
ccaagtagtctgctc

SEQ ID NO: 3340189 - DNA, 18 bp, Homo sapiens
ccaagtagtctgctcaca

SEQ ID NO: 3340190 - DNA, 12 bp, Homo sapiens
ccaagtccctgt

SEQ ID NO: 3340191 - DNA, 13 bp, Homo sapiens
ccaagtccctgtt

SEQ ID NO: 3340192 - DNA, 16 bp, Homo sapiens
ccaagtcctgaagagg

SEQ ID NO: 3340193 - DNA, 22 bp, Homo sapiens
ccaagtcctggctacatcccag

SEQ ID NO: 3340194 - DNA, 15 bp, Homo sapiens
ccaagtctctctgtg

SEQ ID NO: 3340195 - DNA, 18 bp, Homo sapiens
ccaagtctgtacctcaaa

SEQ ID NO: 3340196 - DNA, 16 bp, Homo sapiens
ccaagtgcactttcta

SEQ ID NO: 3340197 - DNA, 21 bp, Homo sapiens
ccaagtgccagaggtgggcag

SEQ ID NO: 3340198 - DNA, 13 bp, Homo sapiens
ccaagtggctccc

SEQ ID NO: 3340199 - DNA, 23 bp, Homo sapiens
ccaagtggggatggggcctccct

SEQ ID NO: 3340200 - DNA, 18 bp, Homo sapiens
ccaagtggtcaggagttg

SEQ ID NO: 3340201 - DNA, 21 bp, Homo sapiens
ccaagtgtgctctttttttaa

SEQ ID NO: 3340202 - DNA, 22 bp, Homo sapiens
ccaagttataaatcaatgtcac

SEQ ID NO: 3340203 - DNA, 20 bp, Homo sapiens
ccaagttcttcacctctatc

SEQ ID NO: 3340204 - DNA, 16 bp, Homo sapiens
ccaagttgctgtcact

SEQ ID NO: 3340205 - DNA, 18 bp, Homo sapiens
ccaagttgctgtcactgt

SEQ ID NO: 3340206 - DNA, 20 bp, Homo sapiens
ccaagttgtgcttgagccag

SEQ ID NO: 3340207 - DNA, 22 bp, Homo sapiens
ccaagttgtgcttgagccagga

SEQ ID NO: 3340208 - DNA, 21 bp, Homo sapiens
ccaataaaaacattttgaagt

SEQ ID NO: 3340209 - DNA, 23 bp, Homo sapiens
ccaataaaaacattttgaagtgt

SEQ ID NO: 3340210 - DNA, 17 bp, Homo sapiens
ccaataaaactgatgtt

SEQ ID NO: 3340211 - DNA, 22 bp, Homo sapiens
ccaataaaagttttctccaact

SEQ ID NO: 3340212 - DNA, 13 bp, Homo sapiens
ccaataaaccagg

SEQ ID NO: 3340213 - DNA, 14 bp, Homo sapiens
ccaataaaccaggt

SEQ ID NO: 3340214 - DNA, 16 bp, Homo sapiens
ccaataaaggcagctg

SEQ ID NO: 3340215 - DNA, 17 bp, Homo sapiens
ccaataaaggcagctgc

SEQ ID NO: 3340216 - DNA, 20 bp, Homo sapiens
ccaataaaggcagctgcctc

SEQ ID NO: 3340217 - DNA, 21 bp, Homo sapiens
ccaataacaaggagctcaccc

SEQ ID NO: 3340218 - DNA, 23 bp, Homo sapiens
ccaataataaatgccctcttctc

SEQ ID NO: 3340219 - DNA, 14 bp, Homo sapiens
ccaatacagtctag

SEQ ID NO: 3340220 - DNA, 19 bp, Homo sapiens
ccaatagcactttcattgc

SEQ ID NO: 3340221 - DNA, 16 bp, Homo sapiens
ccaataggcaaattaa

SEQ ID NO: 3340222 - DNA, 16 bp, Homo sapiens
ccaatatgtattgtaa

SEQ ID NO: 3340223 - DNA, 18 bp, Homo sapiens
ccaatattaaatctgctg

SEQ ID NO: 3340224 - DNA, 13 bp, Homo sapiens
ccaatattataat

SEQ ID NO: 3340225 - DNA, 20 bp, Homo sapiens
ccaatattttctttaatgct

SEQ ID NO: 3340226 - DNA, 22 bp, Homo sapiens
ccaatattttctttaatgcttt

SEQ ID NO: 3340227 - DNA, 12 bp, Homo sapiens
ccaatcatttta

SEQ ID NO: 3340228 - DNA, 22 bp, Homo sapiens
ccaatcattttaattattattc

SEQ ID NO: 3340229 - DNA, 16 bp, Homo sapiens
ccaatcccctccttgg

SEQ ID NO: 3340230 - DNA, 15 bp, Homo sapiens
ccaatcctcactggg

SEQ ID NO: 3340231 - DNA, 20 bp, Homo sapiens
ccaatctctacccctttctt

SEQ ID NO: 3340232 - DNA, 19 bp, Homo sapiens
ccaatcttaccagatgcta

SEQ ID NO: 3340233 - DNA, 23 bp, Homo sapiens
ccaatgaaatacacaagtaaaca

SEQ ID NO: 3340234 - DNA, 12 bp, Homo sapiens
ccaatgaataat

SEQ ID NO: 3340235 - DNA, 23 bp, Homo sapiens
ccaatgaataatggaaaatgcca

SEQ ID NO: 3340236 - DNA, 21 bp, Homo sapiens
ccaatgagactctagggtcca

SEQ ID NO: 3340237 - DNA, 23 bp, Homo sapiens
ccaatgagactctagggtccagt

SEQ ID NO: 3340238 - DNA, 19 bp, Homo sapiens
ccaatgaggtctgaaatgg

SEQ ID NO: 3340239 - DNA, 17 bp, Homo sapiens
ccaatgattcataacaa

SEQ ID NO: 3340240 - DNA, 22 bp, Homo sapiens
ccaatgcatagagccctggcca

SEQ ID NO: 3340241 - DNA, 24 bp, Homo sapiens
ccaatgcatagagccctggccagc

SEQ ID NO: 3340242 - DNA, 18 bp, Homo sapiens
ccaatgccccactggcag

SEQ ID NO: 3340243 - DNA, 20 bp, Homo sapiens
ccaatgctgctccaccctcc

SEQ ID NO: 3340244 - DNA, 24 bp, Homo sapiens
ccaatgctttgggaggccaaggca

SEQ ID NO: 3340245 - DNA, 21 bp, Homo sapiens
ccaatggagactgtctcaaga

SEQ ID NO: 3340246 - DNA, 22 bp, Homo sapiens
ccaatgggatgaggtcactttt

SEQ ID NO: 3340247 - DNA, 20 bp, Homo sapiens
ccaatgggtttttccctgta

SEQ ID NO: 3340248 - DNA, 16 bp, Homo sapiens
ccaatggtgatcctct

SEQ ID NO: 3340249 - DNA, 20 bp, Homo sapiens
ccaatgtaggagctgccttg

SEQ ID NO: 3340250 - DNA, 13 bp, Homo sapiens
ccaattaaattta

SEQ ID NO: 3340251 - DNA, 20 bp, Homo sapiens
ccaattacagggtgactcac

SEQ ID NO: 3340252 - DNA, 17 bp, Homo sapiens
ccaattactattccctt

SEQ ID NO: 3340253 - DNA, 17 bp, Homo sapiens
ccaattaggaagtgtaa

SEQ ID NO: 3340254 - DNA, 23 bp, Homo sapiens
ccaattaggaagtgtaacagctg

SEQ ID NO: 3340255 - DNA, 15 bp, Homo sapiens
ccaattagtttcctt

SEQ ID NO: 3340256 - DNA, 17 bp, Homo sapiens
ccaattatcatcttttg

SEQ ID NO: 3340257 - DNA, 20 bp, Homo sapiens
ccaattccttgcacatagta

SEQ ID NO: 3340258 - DNA, 15 bp, Homo sapiens
ccaattgatgtatat

SEQ ID NO: 3340259 - DNA, 13 bp, Homo sapiens
ccaattgctaccg

SEQ ID NO: 3340260 - DNA, 20 bp, Homo sapiens
ccaattgttgacagttctga

SEQ ID NO: 3340261 - DNA, 19 bp, Homo sapiens
ccaatttcaagttccaagt

SEQ ID NO: 3340262 - DNA, 21 bp, Homo sapiens
ccaatttcggattttttccaa

SEQ ID NO: 3340263 - DNA, 19 bp, Homo sapiens
ccaccttcaattcctgggc

SEQ ID NO: 3340264 - DNA, 14 bp, Homo sapiens
ccaccttctcacct

SEQ ID NO: 3340265 - DNA, 22 bp, Homo sapiens
ccaccttctgtccccagccctg

SEQ ID NO: 3340266 - DNA, 14 bp, Homo sapiens
ccaccttgatccca

SEQ ID NO: 3340267 - DNA, 19 bp, Homo sapiens
ccaccttggctctgccagt

SEQ ID NO: 3340268 - DNA, 18 bp, Homo sapiens
ccaccttggctgcaggga

SEQ ID NO: 3340269 - DNA, 19 bp, Homo sapiens
ccaccttggctgcagggag

SEQ ID NO: 3340270 - DNA, 16 bp, Homo sapiens
ccacgaacgctcttag

SEQ ID NO: 3340271 - DNA, 19 bp, Homo sapiens
ccacgaatttgctggggaa

SEQ ID NO: 3340272 - DNA, 23 bp, Homo sapiens
ccacgaatttgctggggaatctc

SEQ ID NO: 3340273 - DNA, 16 bp, Homo sapiens
ccacgaccagcccctt

SEQ ID NO: 3340274 - DNA, 15 bp, Homo sapiens
ccacgactggccagg

SEQ ID NO: 3340275 - DNA, 18 bp, Homo sapiens
ccacgactggccagggcc

SEQ ID NO: 3340276 - DNA, 12 bp, Homo sapiens
ccacgagggctg

SEQ ID NO: 3340277 - DNA, 17 bp, Homo sapiens
ccacgagggctggctgg

SEQ ID NO: 3340278 - DNA, 19 bp, Homo sapiens
ccacgagtcacctgcaagc

SEQ ID NO: 3340279 - DNA, 21 bp, Homo sapiens
ccacgagtcacctgcaagccc

SEQ ID NO: 3340280 - DNA, 14 bp, Homo sapiens
ccacgatcccctcc

SEQ ID NO: 3340281 - DNA, 16 bp, Homo sapiens
ccacgatcctgccacc

SEQ ID NO: 3340282 - DNA, 19 bp, Homo sapiens
ccacgatcctgccaccctg

SEQ ID NO: 3340283 - DNA, 14 bp, Homo sapiens
ccacgcactgggcc

SEQ ID NO: 3340284 - DNA, 15 bp, Homo sapiens
ccacgcactgggcca

SEQ ID NO: 3340285 - DNA, 15 bp, Homo sapiens
ccacgcagaggacgc

SEQ ID NO: 3340286 - DNA, 15 bp, Homo sapiens
ccacgcccgtcctgc

SEQ ID NO: 3340287 - DNA, 19 bp, Homo sapiens
ccacgcccgtcctgcctgt

SEQ ID NO: 3340288 - DNA, 21 bp, Homo sapiens
ccacgcccgtcctgcctgtgg

SEQ ID NO: 3340289 - DNA, 22 bp, Homo sapiens
ccacgcccgtcctgcctgtggc

SEQ ID NO: 3340290 - DNA, 23 bp, Homo sapiens
ccacgcccgtcctgcctgtggcg

SEQ ID NO: 3340291 - DNA, 17 bp, Homo sapiens
ccacgccctcccctccc

SEQ ID NO: 3340292 - DNA, 21 bp, Homo sapiens
ccacgccctcccctcccctgc

SEQ ID NO: 3340293 - DNA, 19 bp, Homo sapiens
ccacgccctccctctccca

SEQ ID NO: 3340294 - DNA, 14 bp, Homo sapiens
ccacgcctcctggc

SEQ ID NO: 3340295 - DNA, 15 bp, Homo sapiens
ccacgcctcctggcc

SEQ ID NO: 3340296 - DNA, 15 bp, Homo sapiens
ccacgctcaccccct

SEQ ID NO: 3340297 - DNA, 13 bp, Homo sapiens
ccacgctccagct

SEQ ID NO: 3340298 - DNA, 18 bp, Homo sapiens
ccacgctggaccttgaac

SEQ ID NO: 3340299 - DNA, 14 bp, Homo sapiens
ccacgctgtcctct

SEQ ID NO: 3340300 - DNA, 12 bp, Homo sapiens
ccacggaccccc

SEQ ID NO: 3340301 - DNA, 19 bp, Homo sapiens
ccacggacgtttccatcag

SEQ ID NO: 3340302 - DNA, 20 bp, Homo sapiens
ccacggacgtttccatcagg

SEQ ID NO: 3340303 - DNA, 21 bp, Homo sapiens
ccacggagccctccctatgtc

SEQ ID NO: 3340304 - DNA, 19 bp, Homo sapiens
ccacggaggagggatgctg

SEQ ID NO: 3340305 - DNA, 16 bp, Homo sapiens
ccacggccaggccaga

SEQ ID NO: 3340306 - DNA, 18 bp, Homo sapiens
ccacggccgctccagggg

SEQ ID NO: 3340307 - DNA, 12 bp, Homo sapiens
ccacggcctggc

SEQ ID NO: 3340308 - DNA, 12 bp, Homo sapiens
ccacggccttgt

SEQ ID NO: 3340309 - DNA, 20 bp, Homo sapiens
ccacggcgttgtacctgtag

SEQ ID NO: 3340310 - DNA, 13 bp, Homo sapiens
ccacggctaagag

SEQ ID NO: 3340311 - DNA, 21 bp, Homo sapiens
ccacggctaagaggctgctga

SEQ ID NO: 3340312 - DNA, 23 bp, Homo sapiens
ccacgggcaggggtcagagcact

SEQ ID NO: 3340313 - DNA, 15 bp, Homo sapiens
ccacgggtctgccat

SEQ ID NO: 3340314 - DNA, 21 bp, Homo sapiens
ccacgggtctgccatgctctg

SEQ ID NO: 3340315 - DNA, 16 bp, Homo sapiens
ccacggtgcgtggctg

SEQ ID NO: 3340316 - DNA, 21 bp, Homo sapiens
ccacggtgcgtggctgtggca

SEQ ID NO: 3340317 - DNA, 13 bp, Homo sapiens
ccacgtcccagca

SEQ ID NO: 3340318 - DNA, 18 bp, Homo sapiens
ccacgtcccagcatccct

SEQ ID NO: 3340319 - DNA, 15 bp, Homo sapiens
ccacgtccccctggg

SEQ ID NO: 3340320 - DNA, 14 bp, Homo sapiens
ccacgtctgccagg

SEQ ID NO: 3340321 - DNA, 22 bp, Homo sapiens
ccacgtctgccaggcccatctc

SEQ ID NO: 3340322 - DNA, 13 bp, Homo sapiens
ccacgtctggcca

SEQ ID NO: 3340323 - DNA, 15 bp, Homo sapiens
ccacgtctggccagg

SEQ ID NO: 3340324 - DNA, 17 bp, Homo sapiens
ccacgtctggccaggca

SEQ ID NO: 3340325 - DNA, 18 bp, Homo sapiens
ccacgtctggccaggcac

SEQ ID NO: 3340326 - DNA, 21 bp, Homo sapiens
ccacgtctggccaggcactgc

SEQ ID NO: 3340327 - DNA, 17 bp, Homo sapiens
ccacgtgcgacagagag

SEQ ID NO: 3340328 - DNA, 16 bp, Homo sapiens
ccacgtggggctcact

SEQ ID NO: 3340329 - DNA, 21 bp, Homo sapiens
ccacgtggtcactgtgcactg

SEQ ID NO: 3340330 - DNA, 14 bp, Homo sapiens
ccacgtgtatagta

SEQ ID NO: 3340331 - DNA, 15 bp, Homo sapiens
ccacgtgtcttccac

SEQ ID NO: 3340332 - DNA, 16 bp, Homo sapiens
ccacgttccacagttg

SEQ ID NO: 3340333 - DNA, 20 bp, Homo sapiens
ccacgttccacagttgccac

SEQ ID NO: 3340334 - DNA, 16 bp, Homo sapiens
ccacgttctcacaccc

SEQ ID NO: 3340335 - DNA, 17 bp, Homo sapiens
ccacgttctcacaccca

SEQ ID NO: 3340336 - DNA, 19 bp, Homo sapiens
ccacgttctcacacccacc

SEQ ID NO: 3340337 - DNA, 12 bp, Homo sapiens
ccactaaaaata

SEQ ID NO: 3340338 - DNA, 14 bp, Homo sapiens
ccactaaaaatatt

SEQ ID NO: 3340339 - DNA, 21 bp, Homo sapiens
ccactaagaattcaaactggg

SEQ ID NO: 3340340 - DNA, 14 bp, Homo sapiens
ccactacacctggc

SEQ ID NO: 3340341 - DNA, 22 bp, Homo sapiens
ccactacatgcagcccatgccc

SEQ ID NO: 3340342 - DNA, 22 bp, Homo sapiens
ccactacggaatagttggctag

SEQ ID NO: 3340343 - DNA, 13 bp, Homo sapiens
ccactactgcagc

SEQ ID NO: 3340344 - DNA, 19 bp, Homo sapiens
ccactaggactctgaggct

SEQ ID NO: 3340345 - DNA, 19 bp, Homo sapiens
ccactaggttcttttccat

SEQ ID NO: 3340346 - DNA, 23 bp, Homo sapiens
ccactagtaagtaattatgcact

SEQ ID NO: 3340347 - DNA, 20 bp, Homo sapiens
ccactatcccaatcaaagaa

SEQ ID NO: 3340348 - DNA, 12 bp, Homo sapiens
ccactcaccccc

SEQ ID NO: 3340349 - DNA, 15 bp, Homo sapiens
ccactcacccccttt

SEQ ID NO: 3340350 - DNA, 18 bp, Homo sapiens
ccactcactaggccccca

SEQ ID NO: 3340351 - DNA, 23 bp, Homo sapiens
ccactcagccatttccccctcct

SEQ ID NO: 3340352 - DNA, 13 bp, Homo sapiens
ccactcagcccct

SEQ ID NO: 3340353 - DNA, 16 bp, Homo sapiens
ccactcagcccctagg

SEQ ID NO: 3340354 - DNA, 14 bp, Homo sapiens
ccactcccagtccc

SEQ ID NO: 3340355 - DNA, 14 bp, Homo sapiens
ccactccctgagct

SEQ ID NO: 3340356 - DNA, 15 bp, Homo sapiens
ccactccctgagctt

SEQ ID NO: 3340357 - DNA, 18 bp, Homo sapiens
ccactccctgagctttgg

SEQ ID NO: 3340358 - DNA, 15 bp, Homo sapiens
ccactccctgctcta

SEQ ID NO: 3340359 - DNA, 13 bp, Homo sapiens
ccactcctgtccc

SEQ ID NO: 3340360 - DNA, 14 bp, Homo sapiens
ccactcctgtcccg

SEQ ID NO: 3340361 - DNA, 11 bp, Homo sapiens
ccactccttgt

SEQ ID NO: 3340362 - DNA, 14 bp, Homo sapiens
ccactcgaggcctg

SEQ ID NO: 3340363 - DNA, 15 bp, Homo sapiens
ccactcgaggcctgc

SEQ ID NO: 3340364 - DNA, 18 bp, Homo sapiens
ccactcgcagtcgcagga

SEQ ID NO: 3340365 - DNA, 16 bp, Homo sapiens
ccactcgcttccccca

SEQ ID NO: 3340366 - DNA, 21 bp, Homo sapiens
ccactcgggggtggagtgaga

SEQ ID NO: 3340367 - DNA, 18 bp, Homo sapiens
ccactctaccctcccacc

SEQ ID NO: 3340368 - DNA, 13 bp, Homo sapiens
ccactctacctcc

SEQ ID NO: 3340369 - DNA, 17 bp, Homo sapiens
ccactctccccacacta

SEQ ID NO: 3340370 - DNA, 23 bp, Homo sapiens
ccactctcttccctttccccagc

SEQ ID NO: 3340371 - DNA, 20 bp, Homo sapiens
ccactctgcttctctgactt

SEQ ID NO: 3340372 - DNA, 23 bp, Homo sapiens
ccactcttgaagaggaggccgcc

SEQ ID NO: 3340373 - DNA, 19 bp, Homo sapiens
ccactgacagcctcccacc

SEQ ID NO: 3340374 - DNA, 18 bp, Homo sapiens
ccactgagagcgagatgg

SEQ ID NO: 3340375 - DNA, 13 bp, Homo sapiens
ccactgagcctgg

SEQ ID NO: 3340376 - DNA, 16 bp, Homo sapiens
ccactgcaaataaagc

SEQ ID NO: 3340377 - DNA, 23 bp, Homo sapiens
ccactgcacagagctctccagct

SEQ ID NO: 3340378 - DNA, 19 bp, Homo sapiens
ccactgcaccgggccacag

SEQ ID NO: 3340379 - DNA, 20 bp, Homo sapiens
ccactgcactatagcctagg

SEQ ID NO: 3340380 - DNA, 11 bp, Homo sapiens
ccactgcactc

SEQ ID NO: 3340381 - DNA, 14 bp, Homo sapiens
ccactgcactccag

SEQ ID NO: 3340382 - DNA, 17 bp, Homo sapiens
ccactgcactccagcct

SEQ ID NO: 3340383 - DNA, 16 bp, Homo sapiens
ccactgccaggcacct

SEQ ID NO: 3340384 - DNA, 24 bp, Homo sapiens
ccactgccaggcacctggcctgct

SEQ ID NO: 3340385 - DNA, 16 bp, Homo sapiens
ccactgcccgagctgg

SEQ ID NO: 3340386 - DNA, 17 bp, Homo sapiens
ccactgcccgagctggt

SEQ ID NO: 3340387 - DNA, 20 bp, Homo sapiens
ccactgcccgagctggtgca

SEQ ID NO: 3340388 - DNA, 13 bp, Homo sapiens
ccactgccctgcc

SEQ ID NO: 3340389 - DNA, 16 bp, Homo sapiens
ccactgccctgcctgc

SEQ ID NO: 3340390 - DNA, 19 bp, Homo sapiens
ccactgccctgcctgccca

SEQ ID NO: 3340391 - DNA, 16 bp, Homo sapiens
ccactgccctggcagc

SEQ ID NO: 3340392 - DNA, 19 bp, Homo sapiens
ccactgccctggcagcagc

SEQ ID NO: 3340393 - DNA, 18 bp, Homo sapiens
cagttgaaaatggatttt

SEQ ID NO: 3340394 - DNA, 14 bp, Homo sapiens
cagttgaacagagg

SEQ ID NO: 3340395 - DNA, 13 bp, Homo sapiens
cagttgcaggagc

SEQ ID NO: 3340396 - DNA, 15 bp, Homo sapiens
cagttgccaccacct

SEQ ID NO: 3340397 - DNA, 16 bp, Homo sapiens
cagttgccaccacctc

SEQ ID NO: 3340398 - DNA, 22 bp, Homo sapiens
cagttgccaccacctctgtggc

SEQ ID NO: 3340399 - DNA, 13 bp, Homo sapiens
cagttgcccagag

SEQ ID NO: 3340400 - DNA, 17 bp, Homo sapiens
cagttgcccagagcact

SEQ ID NO: 3340401 - DNA, 20 bp, Homo sapiens
cagttgcccagagcacttta

SEQ ID NO: 3340402 - DNA, 15 bp, Homo sapiens
cagttggactctcag

SEQ ID NO: 3340403 - DNA, 16 bp, Homo sapiens
cagttggactctcagg

SEQ ID NO: 3340404 - DNA, 19 bp, Homo sapiens
cagttggactctcagggat

SEQ ID NO: 3340405 - DNA, 17 bp, Homo sapiens
cagttggatctctggtt

SEQ ID NO: 3340406 - DNA, 13 bp, Homo sapiens
cagttggcagaga

SEQ ID NO: 3340407 - DNA, 21 bp, Homo sapiens
cagttggcagagaaggcctct

SEQ ID NO: 3340408 - DNA, 15 bp, Homo sapiens
cagttgggagcactg

SEQ ID NO: 3340409 - DNA, 20 bp, Homo sapiens
cagttgggagcactggagtg

SEQ ID NO: 3340410 - DNA, 19 bp, Homo sapiens
cagttggggaagccaggtg

SEQ ID NO: 3340411 - DNA, 20 bp, Homo sapiens
cagttgggtagatgggtggg

SEQ ID NO: 3340412 - DNA, 21 bp, Homo sapiens
cagttgggtagatgggtgggg

SEQ ID NO: 3340413 - DNA, 19 bp, Homo sapiens
cagttgggtggatgcctgg

SEQ ID NO: 3340414 - DNA, 17 bp, Homo sapiens
cagttggtggggccagg

SEQ ID NO: 3340415 - DNA, 21 bp, Homo sapiens
cagttggtggggccaggccag

SEQ ID NO: 3340416 - DNA, 16 bp, Homo sapiens
cagttggtgtgttttt

SEQ ID NO: 3340417 - DNA, 17 bp, Homo sapiens
cagttgtcctatggaca

SEQ ID NO: 3340418 - DNA, 21 bp, Homo sapiens
cagttgtctattctgagcctt

SEQ ID NO: 3340419 - DNA, 22 bp, Homo sapiens
cagttgtctattctgagccttg

SEQ ID NO: 3340420 - DNA, 23 bp, Homo sapiens
cagttgtctattctgagccttga

SEQ ID NO: 3340421 - DNA, 13 bp, Homo sapiens
cagttgtgttcat

SEQ ID NO: 3340422 - DNA, 23 bp, Homo sapiens
cagttgtgttcatgctgaatcca

SEQ ID NO: 3340423 - DNA, 15 bp, Homo sapiens
cagttgttcttttta

SEQ ID NO: 3340424 - DNA, 19 bp, Homo sapiens
cagttgttctttttagaaa

SEQ ID NO: 3340425 - DNA, 19 bp, Homo sapiens
cagtttaagacaccaaata

SEQ ID NO: 3340426 - DNA, 20 bp, Homo sapiens
cagtttaagagcagaacaga

SEQ ID NO: 3340427 - DNA, 18 bp, Homo sapiens
cagtttatttttaaagat

SEQ ID NO: 3340428 - DNA, 21 bp, Homo sapiens
cagtttatttttaaagataga

SEQ ID NO: 3340429 - DNA, 23 bp, Homo sapiens
cagtttcactttcacatagatgt

SEQ ID NO: 3340430 - DNA, 15 bp, Homo sapiens
cagtttcaggtgttt

SEQ ID NO: 3340431 - DNA, 18 bp, Homo sapiens
cagtttcttagcttttta

SEQ ID NO: 3340432 - DNA, 22 bp, Homo sapiens
cagtttcttctgcgcctcaggc

SEQ ID NO: 3340433 - DNA, 20 bp, Homo sapiens
cagtttcttcttacacttct

SEQ ID NO: 3340434 - DNA, 18 bp, Homo sapiens
cagtttgaaaatattttg

SEQ ID NO: 3340435 - DNA, 20 bp, Homo sapiens
cagtttgattgaggagctgc

SEQ ID NO: 3340436 - DNA, 19 bp, Homo sapiens
cagtttgctgtactagaga

SEQ ID NO: 3340437 - DNA, 21 bp, Homo sapiens
cagtttgctttgtatgcactt

SEQ ID NO: 3340438 - DNA, 16 bp, Homo sapiens
cagtttgtgtgtctta

SEQ ID NO: 3340439 - DNA, 23 bp, Homo sapiens
cagtttgtgtgtcttaattatta

SEQ ID NO: 3340440 - DNA, 15 bp, Homo sapiens
cagtttgttggaaag

SEQ ID NO: 3340441 - DNA, 16 bp, Homo sapiens
cagttttaactagaat

SEQ ID NO: 3340442 - DNA, 16 bp, Homo sapiens
cagttttaactgtgga

SEQ ID NO: 3340443 - DNA, 22 bp, Homo sapiens
cagttttaactgtggatattgt

SEQ ID NO: 3340444 - DNA, 23 bp, Homo sapiens
cagttttaactgtggatattgtt

SEQ ID NO: 3340445 - DNA, 23 bp, Homo sapiens
cagttttagttggtgctgatgga

SEQ ID NO: 3340446 - DNA, 18 bp, Homo sapiens
cagttttatgctcttttt

SEQ ID NO: 3340447 - DNA, 13 bp, Homo sapiens
cagttttccatga

SEQ ID NO: 3340448 - DNA, 17 bp, Homo sapiens
cagttttccatgaaaac

SEQ ID NO: 3340449 - DNA, 19 bp, Homo sapiens
cagttttccatgaaaacgt

SEQ ID NO: 3340450 - DNA, 16 bp, Homo sapiens
cagttttcccctggcc

SEQ ID NO: 3340451 - DNA, 18 bp, Homo sapiens
cagttttcccctggcctc

SEQ ID NO: 3340452 - DNA, 20 bp, Homo sapiens
cagttttcccctggcctcag

SEQ ID NO: 3340453 - DNA, 15 bp, Homo sapiens
cagtttttcaggagc

SEQ ID NO: 3340454 - DNA, 12 bp, Homo sapiens
cagtttttcatt

SEQ ID NO: 3340455 - DNA, 15 bp, Homo sapiens
cagtttttcatttgt

SEQ ID NO: 3340456 - DNA, 16 bp, Homo sapiens
cagtttttcatttgtt

SEQ ID NO: 3340457 - DNA, 14 bp, Homo sapiens
cagtttttgtatct

SEQ ID NO: 3340458 - DNA, 15 bp, Homo sapiens
cagtttttgtatctt

SEQ ID NO: 3340459 - DNA, 22 bp, Homo sapiens
cataaaaaagaagcactttgat

SEQ ID NO: 3340460 - DNA, 19 bp, Homo sapiens
cataaaaacattttaaaaa

SEQ ID NO: 3340461 - DNA, 18 bp, Homo sapiens
cataaaaagcagaatttt

SEQ ID NO: 3340462 - DNA, 19 bp, Homo sapiens
cataaaaagcagaatttta

SEQ ID NO: 3340463 - DNA, 17 bp, Homo sapiens
cataaaagcattgtctc

SEQ ID NO: 3340464 - DNA, 19 bp, Homo sapiens
cataaaagtgattcttttt

SEQ ID NO: 3340465 - DNA, 20 bp, Homo sapiens
cataaaataaagtatatata

SEQ ID NO: 3340466 - DNA, 21 bp, Homo sapiens
cataaaccatttttgttactc

SEQ ID NO: 3340467 - DNA, 15 bp, Homo sapiens
cataaacggttcctg

SEQ ID NO: 3340468 - DNA, 19 bp, Homo sapiens
cataaacggttcctggtga

SEQ ID NO: 3340469 - DNA, 14 bp, Homo sapiens
cataaactgtcact

SEQ ID NO: 3340470 - DNA, 22 bp, Homo sapiens
cataaagccatgtttcctcttt

SEQ ID NO: 3340471 - DNA, 17 bp, Homo sapiens
cataaagctcaaatgaa

SEQ ID NO: 3340472 - DNA, 21 bp, Homo sapiens
cataaagggtgtaggggccac

SEQ ID NO: 3340473 - DNA, 11 bp, Homo sapiens
cataaagtcag

SEQ ID NO: 3340474 - DNA, 13 bp, Homo sapiens
cataaatatgcag

SEQ ID NO: 3340475 - DNA, 11 bp, Homo sapiens
cataaatcaac

SEQ ID NO: 3340476 - DNA, 16 bp, Homo sapiens
cataaatccagttcta

SEQ ID NO: 3340477 - DNA, 16 bp, Homo sapiens
cataaatgtgttcctg

SEQ ID NO: 3340478 - DNA, 11 bp, Homo sapiens
cataaattatg

SEQ ID NO: 3340479 - DNA, 18 bp, Homo sapiens
cataaattcaactttgta

SEQ ID NO: 3340480 - DNA, 19 bp, Homo sapiens
cataaattcaactttgtaa

SEQ ID NO: 3340481 - DNA, 15 bp, Homo sapiens
cataacaacttcata

SEQ ID NO: 3340482 - DNA, 13 bp, Homo sapiens
cataacagtgcca

SEQ ID NO: 3340483 - DNA, 16 bp, Homo sapiens
cataacagtgccattg

SEQ ID NO: 3340484 - DNA, 18 bp, Homo sapiens
cataacgtttttccttta

SEQ ID NO: 3340485 - DNA, 13 bp, Homo sapiens
cataactaaattt

SEQ ID NO: 3340486 - DNA, 17 bp, Homo sapiens
cataactaaatttgata

SEQ ID NO: 3340487 - DNA, 18 bp, Homo sapiens
cataactaaatttgatac

SEQ ID NO: 3340488 - DNA, 20 bp, Homo sapiens
cataactaaatttgatactt

SEQ ID NO: 3340489 - DNA, 21 bp, Homo sapiens
cataactaaatttgatactta

SEQ ID NO: 3340490 - DNA, 22 bp, Homo sapiens
cataactaaatttgatacttat

SEQ ID NO: 3340491 - DNA, 11 bp, Homo sapiens
cataactgaaa

SEQ ID NO: 3340492 - DNA, 23 bp, Homo sapiens
cataacttcctgtacttgaagtc

SEQ ID NO: 3340493 - DNA, 12 bp, Homo sapiens
cataagaaatgt

SEQ ID NO: 3340494 - DNA, 22 bp, Homo sapiens
cataagaaatgtattcctgaaa

SEQ ID NO: 3340495 - DNA, 15 bp, Homo sapiens
cataagaccgtgtcc

SEQ ID NO: 3340496 - DNA, 17 bp, Homo sapiens
cataagattaaaggaag

SEQ ID NO: 3340497 - DNA, 20 bp, Homo sapiens
cataagattaaaggaaggaa

SEQ ID NO: 3340498 - DNA, 23 bp, Homo sapiens
cataaggacgtgtgtaaatatgt

SEQ ID NO: 3340499 - DNA, 19 bp, Homo sapiens
cataaggcttcaaaatgtt

SEQ ID NO: 3340500 - DNA, 16 bp, Homo sapiens
cataagtatacagttc

SEQ ID NO: 3340501 - DNA, 16 bp, Homo sapiens
cataagtgaatttata

SEQ ID NO: 3340502 - DNA, 14 bp, Homo sapiens
cataataaatcaca

SEQ ID NO: 3340503 - DNA, 16 bp, Homo sapiens
cataataaatcacaca

SEQ ID NO: 3340504 - DNA, 18 bp, Homo sapiens
aataaaaaatctgaagag

SEQ ID NO: 3340505 - DNA, 15 bp, Homo sapiens
aataaaaaccaaatt

SEQ ID NO: 3340506 - DNA, 15 bp, Homo sapiens
aataaaaagttcaga

SEQ ID NO: 3340507 - DNA, 15 bp, Homo sapiens
aataaaaatgtttaa

SEQ ID NO: 3340508 - DNA, 13 bp, Homo sapiens
aataaaaccagct

SEQ ID NO: 3340509 - DNA, 13 bp, Homo sapiens
aataaaacctttc

SEQ ID NO: 3340510 - DNA, 14 bp, Homo sapiens
aataaaacctttca

SEQ ID NO: 3340511 - DNA, 23 bp, Homo sapiens
aataaaacctttcaaatttcaca

SEQ ID NO: 3340512 - DNA, 12 bp, Homo sapiens
aataaaactgtc

SEQ ID NO: 3340513 - DNA, 11 bp, Homo sapiens
aataaaagcac

SEQ ID NO: 3340514 - DNA, 18 bp, Homo sapiens
aataaaagcagcatctgc

SEQ ID NO: 3340515 - DNA, 13 bp, Homo sapiens
aataaaataaaaa

SEQ ID NO: 3340516 - DNA, 16 bp, Homo sapiens
aataaaatcaattttt

SEQ ID NO: 3340517 - DNA, 13 bp, Homo sapiens
aataaaatgaaaa

SEQ ID NO: 3340518 - DNA, 18 bp, Homo sapiens
aataaaatgtgtacagtg

SEQ ID NO: 3340519 - DNA, 21 bp, Homo sapiens
aataaaatgtgtacagtgaat

SEQ ID NO: 3340520 - DNA, 16 bp, Homo sapiens
aataaaattcatttct

SEQ ID NO: 3340521 - DNA, 15 bp, Homo sapiens
aataaaattgcactt

SEQ ID NO: 3340522 - DNA, 13 bp, Homo sapiens
aataaaatttaaa

SEQ ID NO: 3340523 - DNA, 15 bp, Homo sapiens
aataaaatttctaag

SEQ ID NO: 3340524 - DNA, 11 bp, Homo sapiens
aataaacactg

SEQ ID NO: 3340525 - DNA, 12 bp, Homo sapiens
aataaacactgg

SEQ ID NO: 3340526 - DNA, 15 bp, Homo sapiens
aataaacagctattt

SEQ ID NO: 3340527 - DNA, 21 bp, Homo sapiens
aataaacagcttcatgccttt

SEQ ID NO: 3340528 - DNA, 13 bp, Homo sapiens
aataaacattaat

SEQ ID NO: 3340529 - DNA, 21 bp, Homo sapiens
aataaaccaaaggacattatg

SEQ ID NO: 3340530 - DNA, 15 bp, Homo sapiens
aataaaccaaatatg

SEQ ID NO: 3340531 - DNA, 15 bp, Homo sapiens
aataaactattggaa

SEQ ID NO: 3340532 - DNA, 18 bp, Homo sapiens
aataaactcaatgagctc

SEQ ID NO: 3340533 - DNA, 17 bp, Homo sapiens
aataaactgtgtttact

SEQ ID NO: 3340534 - DNA, 21 bp, Homo sapiens
aataaacttggattctctaac

SEQ ID NO: 3340535 - DNA, 13 bp, Homo sapiens
aataaactttttt

SEQ ID NO: 3340536 - DNA, 15 bp, Homo sapiens
aataaactttttttc

SEQ ID NO: 3340537 - DNA, 18 bp, Homo sapiens
aataaactttttttcaat

SEQ ID NO: 3340538 - DNA, 20 bp, Homo sapiens
aataaactttttttcaatgt

SEQ ID NO: 3340539 - DNA, 16 bp, Homo sapiens
aataaagaaaatgaac

SEQ ID NO: 3340540 - DNA, 13 bp, Homo sapiens
aataaagaaattg

SEQ ID NO: 3340541 - DNA, 23 bp, Homo sapiens
aataaagaactccttattttgta

SEQ ID NO: 3340542 - DNA, 13 bp, Homo sapiens
aataaagaattta

SEQ ID NO: 3340543 - DNA, 13 bp, Homo sapiens
aataaagatgagt

SEQ ID NO: 3340544 - DNA, 15 bp, Homo sapiens
aataaagatgagttg

SEQ ID NO: 3340545 - DNA, 14 bp, Homo sapiens
aataaagcaatgtg

SEQ ID NO: 3340546 - DNA, 14 bp, Homo sapiens
aataaagcagcctg

SEQ ID NO: 3340547 - DNA, 16 bp, Homo sapiens
aataaagcagcctgat

SEQ ID NO: 3340548 - DNA, 11 bp, Homo sapiens
aataaagcatt

SEQ ID NO: 3340549 - DNA, 12 bp, Homo sapiens
aataaagcattc

SEQ ID NO: 3340550 - DNA, 18 bp, Homo sapiens
aataaaggataactctgt

SEQ ID NO: 3340551 - DNA, 18 bp, Homo sapiens
aataaaggatgtgattgt

SEQ ID NO: 3340552 - DNA, 10 bp, Homo sapiens
aataaaggca

SEQ ID NO: 3340553 - DNA, 14 bp, Homo sapiens
aataaaggcagctg

SEQ ID NO: 3340554 - DNA, 16 bp, Homo sapiens
aataaaggcagctgcc

SEQ ID NO: 3340555 - DNA, 22 bp, Homo sapiens
aataaaggcagctgcctctgct

SEQ ID NO: 3340556 - DNA, 16 bp, Homo sapiens
aataaaggcagttttc

SEQ ID NO: 3340557 - DNA, 14 bp, Homo sapiens
aataaagtaattat

SEQ ID NO: 3340558 - DNA, 15 bp, Homo sapiens
aataaagtatatata

SEQ ID NO: 3340559 - DNA, 17 bp, Homo sapiens
aataaagtcagatggaa

SEQ ID NO: 3340560 - DNA, 13 bp, Homo sapiens
aataaagtgacaa

SEQ ID NO: 3340561 - DNA, 19 bp, Homo sapiens
aataaagtgacaaaagctc

SEQ ID NO: 3340562 - DNA, 18 bp, Homo sapiens
aataaagtgccttctggg

SEQ ID NO: 3340563 - DNA, 15 bp, Homo sapiens
aataaagtgtaacaa

SEQ ID NO: 3340564 - DNA, 18 bp, Homo sapiens
aataaagtgttttcagag

SEQ ID NO: 3340565 - DNA, 23 bp, Homo sapiens
aataaataaaattcatttctaca

SEQ ID NO: 3340566 - DNA, 13 bp, Homo sapiens
aataaataaataa

SEQ ID NO: 3340567 - DNA, 23 bp, Homo sapiens
aataaatatatctaccccagact

SEQ ID NO: 3340568 - DNA, 15 bp, Homo sapiens
aataaatatctgtac

SEQ ID NO: 3340569 - DNA, 21 bp, Homo sapiens
aataaatccaaaacaaacatg

SEQ ID NO: 3340570 - DNA, 19 bp, Homo sapiens
aataaatctcttctttgct

SEQ ID NO: 3340571 - DNA, 22 bp, Homo sapiens
aataaatctcttctttgctgca

SEQ ID NO: 3340572 - DNA, 11 bp, Homo sapiens
aataaatcttt

SEQ ID NO: 3340573 - DNA, 11 bp, Homo sapiens
cagtgggagct

SEQ ID NO: 3340574 - DNA, 17 bp, Homo sapiens
cagtgggagctgagctg

SEQ ID NO: 3340575 - DNA, 20 bp, Homo sapiens
cagtgggagctgcctgttca

SEQ ID NO: 3340576 - DNA, 14 bp, Homo sapiens
cagtgggaggggca

SEQ ID NO: 3340577 - DNA, 15 bp, Homo sapiens
cagtgggaggggcag

SEQ ID NO: 3340578 - DNA, 17 bp, Homo sapiens
cagtgggaggggcaggc

SEQ ID NO: 3340579 - DNA, 14 bp, Homo sapiens
cagtgggcgggcca

SEQ ID NO: 3340580 - DNA, 22 bp, Homo sapiens
cagtgggcgttgggagcctagc

SEQ ID NO: 3340581 - DNA, 15 bp, Homo sapiens
cagtggggcctgtgg

SEQ ID NO: 3340582 - DNA, 13 bp, Homo sapiens
cagtgggtggcac

SEQ ID NO: 3340583 - DNA, 17 bp, Homo sapiens
cagtgggtggcacctcc

SEQ ID NO: 3340584 - DNA, 21 bp, Homo sapiens
cagtgggtggcacctcctgag

SEQ ID NO: 3340585 - DNA, 23 bp, Homo sapiens
cagtgggtggcacctcctgagaa

SEQ ID NO: 3340586 - DNA, 21 bp, Homo sapiens
cagtggtatgatcacggctca

SEQ ID NO: 3340587 - DNA, 21 bp, Homo sapiens
cagtggtgcgatctgggttca

SEQ ID NO: 3340588 - DNA, 21 bp, Homo sapiens
cagtggttttatactgaagga

SEQ ID NO: 3340589 - DNA, 15 bp, Homo sapiens
cagtgtaatccccca

SEQ ID NO: 3340590 - DNA, 19 bp, Homo sapiens
cagtgtacacgtctggacc

SEQ ID NO: 3340591 - DNA, 23 bp, Homo sapiens
cagtgtacatggaataacatgta

SEQ ID NO: 3340592 - DNA, 19 bp, Homo sapiens
cagtgtagccttgcccgga

SEQ ID NO: 3340593 - DNA, 21 bp, Homo sapiens
cagtgtagttaatttatctaa

SEQ ID NO: 3340594 - DNA, 17 bp, Homo sapiens
cagtgtatggaaataaa

SEQ ID NO: 3340595 - DNA, 19 bp, Homo sapiens
cagtgtatggggcagcttc

SEQ ID NO: 3340596 - DNA, 20 bp, Homo sapiens
cagtgtcaagttgtgcttgt

SEQ ID NO: 3340597 - DNA, 21 bp, Homo sapiens
cagtgtcacctctctcagagc

SEQ ID NO: 3340598 - DNA, 22 bp, Homo sapiens
cagtgtcacctctctcagagca

SEQ ID NO: 3340599 - DNA, 23 bp, Homo sapiens
cagtgtcacctctctcagagcat

SEQ ID NO: 3340600 - DNA, 19 bp, Homo sapiens
cagtgtcctcttgctcaaa

SEQ ID NO: 3340601 - DNA, 16 bp, Homo sapiens
cagtgtccttagaaca

SEQ ID NO: 3340602 - DNA, 16 bp, Homo sapiens
cagtgtctcacactgg

SEQ ID NO: 3340603 - DNA, 14 bp, Homo sapiens
cagtgtctcggagg

SEQ ID NO: 3340604 - DNA, 14 bp, Homo sapiens
cagtgtctggcttt

SEQ ID NO: 3340605 - DNA, 19 bp, Homo sapiens
cagtgtctgtaaaagagcc

SEQ ID NO: 3340606 - DNA, 16 bp, Homo sapiens
cagtgtctgtcccggg

SEQ ID NO: 3340607 - DNA, 15 bp, Homo sapiens
cagtgtctgtgccat

SEQ ID NO: 3340608 - DNA, 16 bp, Homo sapiens
cagtgtctgtgccatg

SEQ ID NO: 3340609 - DNA, 13 bp, Homo sapiens
cagtgtcttccat

SEQ ID NO: 3340610 - DNA, 18 bp, Homo sapiens
cagtgtcttccataatgt

SEQ ID NO: 3340611 - DNA, 20 bp, Homo sapiens
cagtgtcttccataatgtat

SEQ ID NO: 3340612 - DNA, 22 bp, Homo sapiens
cagtgtctttctttggtgcctt

SEQ ID NO: 3340613 - DNA, 18 bp, Homo sapiens
cagtgtgatcccaagtgc

SEQ ID NO: 3340614 - DNA, 15 bp, Homo sapiens
cagtgtggagagggg

SEQ ID NO: 3340615 - DNA, 23 bp, Homo sapiens
cagtgtggagaggggtgcaccca

SEQ ID NO: 3340616 - DNA, 17 bp, Homo sapiens
cagtgtgggcttgacca

SEQ ID NO: 3340617 - DNA, 14 bp, Homo sapiens
cagtgtgtctaaat

SEQ ID NO: 3340618 - DNA, 20 bp, Homo sapiens
cagtgtgtgaactgctttca

SEQ ID NO: 3340619 - DNA, 14 bp, Homo sapiens
cagtgtgtgactta

SEQ ID NO: 3340620 - DNA, 15 bp, Homo sapiens
cagtgttaaatgaaa

SEQ ID NO: 3340621 - DNA, 16 bp, Homo sapiens
cagtgttaaatgaaat

SEQ ID NO: 3340622 - DNA, 18 bp, Homo sapiens
cagtgttaaatgaaattg

SEQ ID NO: 3340623 - DNA, 14 bp, Homo sapiens
cagtgttattttct

SEQ ID NO: 3340624 - DNA, 15 bp, Homo sapiens
cagtgttcgcttggc

SEQ ID NO: 3340625 - DNA, 18 bp, Homo sapiens
cagtgttgagccttttcc

SEQ ID NO: 3340626 - DNA, 21 bp, Homo sapiens
cagtgtttcccataattttct

SEQ ID NO: 3340627 - DNA, 17 bp, Homo sapiens
cagtgtttgggaaatta

SEQ ID NO: 3340628 - DNA, 20 bp, Homo sapiens
cagtgttttaaactctccta

SEQ ID NO: 3340629 - DNA, 14 bp, Homo sapiens
cagtgttttaaatt

SEQ ID NO: 3340630 - DNA, 16 bp, Homo sapiens
cagtgttttaaattct

SEQ ID NO: 3340631 - DNA, 23 bp, Homo sapiens
cagtgttttcagaagaaataaat

SEQ ID NO: 3340632 - DNA, 15 bp, Homo sapiens
cagtgttttctggga

SEQ ID NO: 3340633 - DNA, 20 bp, Homo sapiens
cagtgttttggactccatct

SEQ ID NO: 3340634 - DNA, 21 bp, Homo sapiens
cagtgtttttagacctgtgtt

SEQ ID NO: 3340635 - DNA, 17 bp, Homo sapiens
cagttaaagaagcaatc

SEQ ID NO: 3340636 - DNA, 15 bp, Homo sapiens
cagttaacaggatat

SEQ ID NO: 3340637 - DNA, 20 bp, Homo sapiens
cagttaagaagccctgcaga

SEQ ID NO: 3340638 - DNA, 22 bp, Homo sapiens
cagttaattactcagcagaatg

SEQ ID NO: 3340639 - DNA, 13 bp, Homo sapiens
cagttagactagt

SEQ ID NO: 3340640 - DNA, 23 bp, Homo sapiens
cagttagggttttgcaataactt

SEQ ID NO: 3340641 - DNA, 15 bp, Homo sapiens
cagttataacagatg

SEQ ID NO: 3340642 - DNA, 15 bp, Homo sapiens
cagttataagaagaa

SEQ ID NO: 3340643 - DNA, 12 bp, Homo sapiens
cagttatatttt

SEQ ID NO: 3340644 - DNA, 13 bp, Homo sapiens
cagttatcctttg

SEQ ID NO: 3340645 - DNA, 17 bp, Homo sapiens
cagttatcctttgtgag

SEQ ID NO: 3340646 - DNA, 13 bp, Homo sapiens
cagttatgaatca

SEQ ID NO: 3340647 - DNA, 20 bp, Homo sapiens
cagttatgtgaatgatctct

SEQ ID NO: 3340648 - DNA, 16 bp, Homo sapiens
cagttatgttcagtca

SEQ ID NO: 3340649 - DNA, 18 bp, Homo sapiens
cagttattacatgtaatt

SEQ ID NO: 3340650 - DNA, 14 bp, Homo sapiens
cagttattttggat

SEQ ID NO: 3340651 - DNA, 19 bp, Homo sapiens
cagttattttggatatatt

SEQ ID NO: 3340652 - DNA, 17 bp, Homo sapiens
cagttcaaagtgtatat

SEQ ID NO: 3340653 - DNA, 21 bp, Homo sapiens
cagttcaacctggtggcacca

SEQ ID NO: 3340654 - DNA, 22 bp, Homo sapiens
cagttcaacctggtggcaccag

SEQ ID NO: 3340655 - DNA, 23 bp, Homo sapiens
cagttcaacctggtggcaccaga

SEQ ID NO: 3340656 - DNA, 18 bp, Homo sapiens
cagttcacaccctgcaag

SEQ ID NO: 3340657 - DNA, 16 bp, Homo sapiens
cagttcacctgcactt

SEQ ID NO: 3340658 - DNA, 20 bp, Homo sapiens
cagttcagtggcagggctca

SEQ ID NO: 3340659 - DNA, 23 bp, Homo sapiens
cagttcagtggcagggctcagga

SEQ ID NO: 3340660 - DNA, 15 bp, Homo sapiens
cagttcattattttg

SEQ ID NO: 3340661 - DNA, 15 bp, Homo sapiens
cagttcattgcactt

SEQ ID NO: 3340662 - DNA, 12 bp, Homo sapiens
cagttccaagaa

SEQ ID NO: 3340663 - DNA, 15 bp, Homo sapiens
cagttcccagctccc

SEQ ID NO: 3340664 - DNA, 16 bp, Homo sapiens
cagttcccagctcccc

SEQ ID NO: 3340665 - DNA, 18 bp, Homo sapiens
cagttcccccaacctcag

SEQ ID NO: 3340666 - DNA, 20 bp, Homo sapiens
cagttcccccagtacctcca

SEQ ID NO: 3340667 - DNA, 20 bp, Homo sapiens
cagttcccggagcacagccc

SEQ ID NO: 3340668 - DNA, 22 bp, Homo sapiens
cagttcccggagcacagccctg

SEQ ID NO: 3340669 - DNA, 17 bp, Homo sapiens
cagttcccttggcctca

SEQ ID NO: 3340670 - DNA, 20 bp, Homo sapiens
cagttcccttggcctcagaa

SEQ ID NO: 3340671 - DNA, 14 bp, Homo sapiens
cagttccctttatt

SEQ ID NO: 3340672 - DNA, 14 bp, Homo sapiens
cagttcctggccca

SEQ ID NO: 3340673 - DNA, 21 bp, Homo sapiens
cagttcctggcccatcaactg

SEQ ID NO: 3340674 - DNA, 15 bp, Homo sapiens
cagttcctttagaaa

SEQ ID NO: 3340675 - DNA, 15 bp, Homo sapiens
cagttcctttgtgtg

SEQ ID NO: 3340676 - DNA, 20 bp, Homo sapiens
cagttctcactcctaggaga

SEQ ID NO: 3340677 - DNA, 17 bp, Homo sapiens
cagttctctcccttcct

SEQ ID NO: 3340678 - DNA, 16 bp, Homo sapiens
cagttctgaactggaa

SEQ ID NO: 3340679 - DNA, 14 bp, Homo sapiens
cagttctgaagaat

SEQ ID NO: 3340680 - DNA, 20 bp, Homo sapiens
cagttctgaataacttgaag

SEQ ID NO: 3340681 - DNA, 13 bp, Homo sapiens
cagttctgctcct

SEQ ID NO: 3340682 - DNA, 14 bp, Homo sapiens
cagttctgctcctc

SEQ ID NO: 3340683 - DNA, 15 bp, Homo sapiens
cagttctgctcctct

SEQ ID NO: 3340684 - DNA, 19 bp, Homo sapiens
cagttctgctcctctccag

SEQ ID NO: 3340685 - DNA, 20 bp, Homo sapiens
cagttctgctcctctccagg

SEQ ID NO: 3340686 - DNA, 21 bp, Homo sapiens
cagttctgctcctctccaggc

SEQ ID NO: 3340687 - DNA, 12 bp, Homo sapiens
cagttctgtgta

SEQ ID NO: 3340688 - DNA, 15 bp, Homo sapiens
cagttctgtgtacat

SEQ ID NO: 3340689 - DNA, 19 bp, Homo sapiens
cagttctgtgtacatttta

SEQ ID NO: 3340690 - DNA, 20 bp, Homo sapiens
cagttctgtgtacattttaa

SEQ ID NO: 3340691 - DNA, 21 bp, Homo sapiens
cagttctgttatatcccctgc

SEQ ID NO: 3340692 - DNA, 23 bp, Homo sapiens
cagttcttggtgactgtcccacc

SEQ ID NO: 3340693 - DNA, 18 bp, Homo sapiens
cagttcttggtgctctgt

SEQ ID NO: 3340694 - DNA, 21 bp, Homo sapiens
cagttcttggtgctctgtgtt

SEQ ID NO: 3340695 - DNA, 20 bp, Homo sapiens
cagttctttttgtacactta

SEQ ID NO: 3340696 - DNA, 12 bp, Homo sapiens
acatttggaata

SEQ ID NO: 3340697 - DNA, 17 bp, Homo sapiens
acatttggaatactttt

SEQ ID NO: 3340698 - DNA, 20 bp, Homo sapiens
acatttggattagaaattta

SEQ ID NO: 3340699 - DNA, 19 bp, Homo sapiens
acatttgggagacatgtga

SEQ ID NO: 3340700 - DNA, 17 bp, Homo sapiens
acatttgtagttggagt

SEQ ID NO: 3340701 - DNA, 13 bp, Homo sapiens
acatttgtatatt

SEQ ID NO: 3340702 - DNA, 15 bp, Homo sapiens
acatttgtatattgt

SEQ ID NO: 3340703 - DNA, 15 bp, Homo sapiens
acatttgtcacagaa

SEQ ID NO: 3340704 - DNA, 14 bp, Homo sapiens
acattttaaataaa

SEQ ID NO: 3340705 - DNA, 20 bp, Homo sapiens
acattttaaataaaagaaaa

SEQ ID NO: 3340706 - DNA, 14 bp, Homo sapiens
acattttaatgggt

SEQ ID NO: 3340707 - DNA, 13 bp, Homo sapiens
acattttattaag

SEQ ID NO: 3340708 - DNA, 16 bp, Homo sapiens
acattttcaatactgt

SEQ ID NO: 3340709 - DNA, 12 bp, Homo sapiens
acattttcagtg

SEQ ID NO: 3340710 - DNA, 19 bp, Homo sapiens
acattttccttttcaaata

SEQ ID NO: 3340711 - DNA, 12 bp, Homo sapiens
acattttgaagt

SEQ ID NO: 3340712 - DNA, 13 bp, Homo sapiens
acattttgaagtg

SEQ ID NO: 3340713 - DNA, 17 bp, Homo sapiens
acattttggtgagaaat

SEQ ID NO: 3340714 - DNA, 13 bp, Homo sapiens
acattttgttgta

SEQ ID NO: 3340715 - DNA, 15 bp, Homo sapiens
acattttgttgtaaa

SEQ ID NO: 3340716 - DNA, 17 bp, Homo sapiens
acattttgttgtaaaaa

SEQ ID NO: 3340717 - DNA, 12 bp, Homo sapiens
acatttttacaa

SEQ ID NO: 3340718 - DNA, 15 bp, Homo sapiens
acatttttacaataa

SEQ ID NO: 3340719 - DNA, 19 bp, Homo sapiens
acatttttccgtttgcttt

SEQ ID NO: 3340720 - DNA, 16 bp, Homo sapiens
acattttttaactttc

SEQ ID NO: 3340721 - DNA, 14 bp, Homo sapiens
acattttttaagct

SEQ ID NO: 3340722 - DNA, 17 bp, Homo sapiens
accaaaagaatttgcac

SEQ ID NO: 3340723 - DNA, 15 bp, Homo sapiens
accaaaataataaaa

SEQ ID NO: 3340724 - DNA, 16 bp, Homo sapiens
accaaacaattattta

SEQ ID NO: 3340725 - DNA, 20 bp, Homo sapiens
accaaaccccacttcccctc

SEQ ID NO: 3340726 - DNA, 17 bp, Homo sapiens
accaaactactgaatga

SEQ ID NO: 3340727 - DNA, 17 bp, Homo sapiens
accaaacttcatttttt

SEQ ID NO: 3340728 - DNA, 16 bp, Homo sapiens
accaaacttgttcatt

SEQ ID NO: 3340729 - DNA, 19 bp, Homo sapiens
accaaacttgttcatttag

SEQ ID NO: 3340730 - DNA, 14 bp, Homo sapiens
accaaagttctaat

SEQ ID NO: 3340731 - DNA, 20 bp, Homo sapiens
accaaagttctaataatttc

SEQ ID NO: 3340732 - DNA, 18 bp, Homo sapiens
accaaataaaaatattgt

SEQ ID NO: 3340733 - DNA, 13 bp, Homo sapiens
accaaataagact

SEQ ID NO: 3340734 - DNA, 18 bp, Homo sapiens
accaaatagtgtgaaata

SEQ ID NO: 3340735 - DNA, 16 bp, Homo sapiens
accaaatattaaagat

SEQ ID NO: 3340736 - DNA, 19 bp, Homo sapiens
accaaatcagctgctacta

SEQ ID NO: 3340737 - DNA, 14 bp, Homo sapiens
accaaatctgacat

SEQ ID NO: 3340738 - DNA, 18 bp, Homo sapiens
accaaatctgacatatta

SEQ ID NO: 3340739 - DNA, 19 bp, Homo sapiens
accaaatggttcttacttt

SEQ ID NO: 3340740 - DNA, 15 bp, Homo sapiens
accaaattgcactga

SEQ ID NO: 3340741 - DNA, 22 bp, Homo sapiens
accaacaggctgttctgcactg

SEQ ID NO: 3340742 - DNA, 13 bp, Homo sapiens
accaaccacagca

SEQ ID NO: 3340743 - DNA, 14 bp, Homo sapiens
accaaccagacagc

SEQ ID NO: 3340744 - DNA, 19 bp, Homo sapiens
accaaccctggggaaggag

SEQ ID NO: 3340745 - DNA, 20 bp, Homo sapiens
accaaccttccattcacacc

SEQ ID NO: 3340746 - DNA, 13 bp, Homo sapiens
accaacctttaaa

SEQ ID NO: 3340747 - DNA, 17 bp, Homo sapiens
accaacgttactcaggg

SEQ ID NO: 3340748 - DNA, 15 bp, Homo sapiens
accaactagacattc

SEQ ID NO: 3340749 - DNA, 17 bp, Homo sapiens
accaactagacattctg

SEQ ID NO: 3340750 - DNA, 14 bp, Homo sapiens
accaactgggccca

SEQ ID NO: 3340751 - DNA, 23 bp, Homo sapiens
accaactgtcactcattgctgag

SEQ ID NO: 3340752 - DNA, 10 bp, Homo sapiens
accaactgtg

SEQ ID NO: 3340753 - DNA, 13 bp, Homo sapiens
accaactgtgttg

SEQ ID NO: 3340754 - DNA, 21 bp, Homo sapiens
accaactgtgttgtattaaca

SEQ ID NO: 3340755 - DNA, 14 bp, Homo sapiens
accaagaaagcagg

SEQ ID NO: 3340756 - DNA, 14 bp, Homo sapiens
accaagaactgcat

SEQ ID NO: 3340757 - DNA, 14 bp, Homo sapiens
accaagatctataa

SEQ ID NO: 3340758 - DNA, 16 bp, Homo sapiens
accaagatgccatctg

SEQ ID NO: 3340759 - DNA, 23 bp, Homo sapiens
accaagccaagggaacctgtgtc

SEQ ID NO: 3340760 - DNA, 21 bp, Homo sapiens
accaagcttcaatatttttct

SEQ ID NO: 3340761 - DNA, 13 bp, Homo sapiens
accaaggcagcct

SEQ ID NO: 3340762 - DNA, 21 bp, Homo sapiens
accaaggcagcctccagagcc

SEQ ID NO: 3340763 - DNA, 23 bp, Homo sapiens
accaaggcagcctccagagccag

SEQ ID NO: 3340764 - DNA, 21 bp, Homo sapiens
accaaggctgagacagtgaat

SEQ ID NO: 3340765 - DNA, 23 bp, Homo sapiens
accaaggctgagacagtgaattt

SEQ ID NO: 3340766 - DNA, 15 bp, Homo sapiens
accaagtatttatta

SEQ ID NO: 3340767 - DNA, 23 bp, Homo sapiens
accaagtcctggctacatcccag

SEQ ID NO: 3340768 - DNA, 23 bp, Homo sapiens
accaagttataaatcaatgtcac

SEQ ID NO: 3340769 - DNA, 23 bp, Homo sapiens
accaatagggctgagctctctgt

SEQ ID NO: 3340770 - DNA, 13 bp, Homo sapiens
accaatcatttta

SEQ ID NO: 3340771 - DNA, 19 bp, Homo sapiens
accaatcccagggctggct

SEQ ID NO: 3340772 - DNA, 19 bp, Homo sapiens
accaatctctgctctctat

SEQ ID NO: 3340773 - DNA, 16 bp, Homo sapiens
accaatgccaagataa

SEQ ID NO: 3340774 - DNA, 13 bp, Homo sapiens
accaatgcccagc

SEQ ID NO: 3340775 - DNA, 16 bp, Homo sapiens
accaatgcccagcagg

SEQ ID NO: 3340776 - DNA, 16 bp, Homo sapiens
accaatgctgttgtaa

SEQ ID NO: 3340777 - DNA, 14 bp, Homo sapiens
accaattattgata

SEQ ID NO: 3340778 - DNA, 23 bp, Homo sapiens
accaattattgatatatattata

SEQ ID NO: 3340779 - DNA, 16 bp, Homo sapiens
accaatttcttccttc

SEQ ID NO: 3340780 - DNA, 22 bp, Homo sapiens
accaatttcttccttccacagt

SEQ ID NO: 3340781 - DNA, 22 bp, Homo sapiens
accaatttggtaaaaatgctgc

SEQ ID NO: 3340782 - DNA, 14 bp, Homo sapiens
accacaaaaattga

SEQ ID NO: 3340783 - DNA, 10 bp, Homo sapiens
accacaaagg

SEQ ID NO: 3340784 - DNA, 20 bp, Homo sapiens
accacaaaggccaaactgct

SEQ ID NO: 3340785 - DNA, 21 bp, Homo sapiens
accacaaaggccaaactgctg

SEQ ID NO: 3340786 - DNA, 13 bp, Homo sapiens
accacaactgaca

SEQ ID NO: 3340787 - DNA, 15 bp, Homo sapiens
accacaagcctgaga

SEQ ID NO: 3340788 - DNA, 12 bp, Homo sapiens
accacaagggct

SEQ ID NO: 3340789 - DNA, 13 bp, Homo sapiens
accacacagtccc

SEQ ID NO: 3340790 - DNA, 15 bp, Homo sapiens
accacacatctatga

SEQ ID NO: 3340791 - DNA, 16 bp, Homo sapiens
accacacccagcccac

SEQ ID NO: 3340792 - DNA, 16 bp, Homo sapiens
accacacccagcctca

SEQ ID NO: 3340793 - DNA, 13 bp, Homo sapiens
accacaccctgta

SEQ ID NO: 3340794 - DNA, 16 bp, Homo sapiens
accacacctccctgaa

SEQ ID NO: 3340795 - DNA, 15 bp, Homo sapiens
accacactgagttct

SEQ ID NO: 3340796 - DNA, 23 bp, Homo sapiens
accacagacacaatatgtatgct

SEQ ID NO: 3340797 - DNA, 24 bp, Homo sapiens
accacagacacaatatgtatgctt

SEQ ID NO: 3340798 - DNA, 15 bp, Homo sapiens
accacagacacacac

SEQ ID NO: 3340799 - DNA, 23 bp, Homo sapiens
accacagcatcgggagcacccag

SEQ ID NO: 3340800 - DNA, 15 bp, Homo sapiens
accacagtgggtggc

SEQ ID NO: 3340801 - DNA, 16 bp, Homo sapiens
accacagtgggtggca

SEQ ID NO: 3340802 - DNA, 18 bp, Homo sapiens
accacatctgccagacct

SEQ ID NO: 3340803 - DNA, 15 bp, Homo sapiens
accacatctgctcta

SEQ ID NO: 3340804 - DNA, 17 bp, Homo sapiens
accacatcttgctctgc

SEQ ID NO: 3340805 - DNA, 18 bp, Homo sapiens
accacatgtgcacatgca

SEQ ID NO: 3340806 - DNA, 14 bp, Homo sapiens
accacattaattaa

SEQ ID NO: 3340807 - DNA, 20 bp, Homo sapiens
accacattaattaattaaag

SEQ ID NO: 3340808 - DNA, 15 bp, Homo sapiens
accacattgcttttc

SEQ ID NO: 3340809 - DNA, 13 bp, Homo sapiens
accaccaaaatta

SEQ ID NO: 3340810 - DNA, 21 bp, Homo sapiens
accaccactggccaccaggct

SEQ ID NO: 3340811 - DNA, 21 bp, Homo sapiens
accaccatccaccgctgctcc

SEQ ID NO: 3340812 - DNA, 13 bp, Homo sapiens
accacccacaatc

SEQ ID NO: 3340813 - DNA, 18 bp, Homo sapiens
accaccccaacaaaccat

SEQ ID NO: 3340814 - DNA, 21 bp, Homo sapiens
accacccgaaatgccacgtgg

SEQ ID NO: 3340815 - DNA, 16 bp, Homo sapiens
accacccgaggggggc

SEQ ID NO: 3340816 - DNA, 20 bp, Homo sapiens
accaccctagtcccttcccc

SEQ ID NO: 3340817 - DNA, 13 bp, Homo sapiens
accaccctcccct

SEQ ID NO: 3340818 - DNA, 14 bp, Homo sapiens
accaccctcccctc

SEQ ID NO: 3340819 - DNA, 16 bp, Homo sapiens
accaccctcccctctc

SEQ ID NO: 3340820 - DNA, 17 bp, Homo sapiens
accaccctcccctctct

SEQ ID NO: 3340821 - DNA, 21 bp, Homo sapiens
accaccctgccccccctaaga

SEQ ID NO: 3340822 - DNA, 22 bp, Homo sapiens
accaccgcctctggccgccacc

SEQ ID NO: 3340823 - DNA, 16 bp, Homo sapiens
accacctcactcctgt

SEQ ID NO: 3340824 - DNA, 15 bp, Homo sapiens
accacctcagaaagg

SEQ ID NO: 3340825 - DNA, 12 bp, Homo sapiens
accacctctgtg

SEQ ID NO: 3340826 - DNA, 13 bp, Homo sapiens
accacctctgtgg

SEQ ID NO: 3340827 - DNA, 14 bp, Homo sapiens
gcccagtgaagcct

SEQ ID NO: 3340828 - DNA, 24 bp, Homo sapiens
gcccagtgacaaagactcctctgg

SEQ ID NO: 3340829 - DNA, 22 bp, Homo sapiens
gcccagtgtcaagttgtgcttg

SEQ ID NO: 3340830 - DNA, 23 bp, Homo sapiens
gcccagtgttgtttgtaaataag

SEQ ID NO: 3340831 - DNA, 21 bp, Homo sapiens
gcccagttgggtggatgcctg

SEQ ID NO: 3340832 - DNA, 19 bp, Homo sapiens
gcccataatagttagccct

SEQ ID NO: 3340833 - DNA, 21 bp, Homo sapiens
gcccatactcagcctgctgcc

SEQ ID NO: 3340834 - DNA, 13 bp, Homo sapiens
gcccatcacaggg

SEQ ID NO: 3340835 - DNA, 18 bp, Homo sapiens
gcccatccctgcctggtc

SEQ ID NO: 3340836 - DNA, 15 bp, Homo sapiens
gcccatcctgactga

SEQ ID NO: 3340837 - DNA, 13 bp, Homo sapiens
gcccatccttccc

SEQ ID NO: 3340838 - DNA, 15 bp, Homo sapiens
gcccatctcagcctc

SEQ ID NO: 3340839 - DNA, 23 bp, Homo sapiens
gcccatctcagcctcctgagcct

SEQ ID NO: 3340840 - DNA, 23 bp, Homo sapiens
gcccatctcaggtgccactccct

SEQ ID NO: 3340841 - DNA, 24 bp, Homo sapiens
gcccatctcaggtgccactccctg

SEQ ID NO: 3340842 - DNA, 13 bp, Homo sapiens
gcccatctcggag

SEQ ID NO: 3340843 - DNA, 14 bp, Homo sapiens
gcccatctcggagc

SEQ ID NO: 3340844 - DNA, 14 bp, Homo sapiens
gcccatgcccacct

SEQ ID NO: 3340845 - DNA, 14 bp, Homo sapiens
gcccatggccccca

SEQ ID NO: 3340846 - DNA, 18 bp, Homo sapiens
gcccatggcccccaataa

SEQ ID NO: 3340847 - DNA, 22 bp, Homo sapiens
gcccatggcctctggccaggca

SEQ ID NO: 3340848 - DNA, 15 bp, Homo sapiens
gcccatggcttctgg

SEQ ID NO: 3340849 - DNA, 21 bp, Homo sapiens
gcccatggttgagaaatgaat

SEQ ID NO: 3340850 - DNA, 21 bp, Homo sapiens
gcccatgtcgcgctcagcatg

SEQ ID NO: 3340851 - DNA, 17 bp, Homo sapiens
gcccatgtgttccctct

SEQ ID NO: 3340852 - DNA, 13 bp, Homo sapiens
gcccattcccacc

SEQ ID NO: 3340853 - DNA, 18 bp, Homo sapiens
gccccaaacaaatatgca

SEQ ID NO: 3340854 - DNA, 14 bp, Homo sapiens
gccccaaaggaaaa

SEQ ID NO: 3340855 - DNA, 20 bp, Homo sapiens
gccccaaaggaaaaagcaca

SEQ ID NO: 3340856 - DNA, 22 bp, Homo sapiens
gccccaaataacttcagtcctg

SEQ ID NO: 3340857 - DNA, 21 bp, Homo sapiens
gccccaaatatagcgttccca

SEQ ID NO: 3340858 - DNA, 15 bp, Homo sapiens
gccccaagcagccag

SEQ ID NO: 3340859 - DNA, 21 bp, Homo sapiens
gccccaagcagccagccagtc

SEQ ID NO: 3340860 - DNA, 20 bp, Homo sapiens
gccccaagtcctgaagaggc

SEQ ID NO: 3340861 - DNA, 18 bp, Homo sapiens
gccccaatccctttatta

SEQ ID NO: 3340862 - DNA, 13 bp, Homo sapiens
gccccaattttct

SEQ ID NO: 3340863 - DNA, 16 bp, Homo sapiens
gccccacacagctaca

SEQ ID NO: 3340864 - DNA, 17 bp, Homo sapiens
gccccacagctacctga

SEQ ID NO: 3340865 - DNA, 19 bp, Homo sapiens
gccccacagctacctgaga

SEQ ID NO: 3340866 - DNA, 12 bp, Homo sapiens
gccccacagttg

SEQ ID NO: 3340867 - DNA, 20 bp, Homo sapiens
gccccacagttgtgttcatg

SEQ ID NO: 3340868 - DNA, 16 bp, Homo sapiens
gccccacccccagcca

SEQ ID NO: 3340869 - DNA, 19 bp, Homo sapiens
gccccacccctaagtgccc

SEQ ID NO: 3340870 - DNA, 20 bp, Homo sapiens
gccccacccctaagtgccca

SEQ ID NO: 3340871 - DNA, 23 bp, Homo sapiens
gccccacccctaagtgcccaaag

SEQ ID NO: 3340872 - DNA, 11 bp, Homo sapiens
gccccaccctc

SEQ ID NO: 3340873 - DNA, 19 bp, Homo sapiens
gccccaccctccttgagac

SEQ ID NO: 3340874 - DNA, 14 bp, Homo sapiens
gccccaccctgggc

SEQ ID NO: 3340875 - DNA, 15 bp, Homo sapiens
gccccaccctgggcc

SEQ ID NO: 3340876 - DNA, 19 bp, Homo sapiens
gccccaccctgggccctgg

SEQ ID NO: 3340877 - DNA, 15 bp, Homo sapiens
gccccacctccacct

SEQ ID NO: 3340878 - DNA, 19 bp, Homo sapiens
gccccacctccacctgtga

SEQ ID NO: 3340879 - DNA, 20 bp, Homo sapiens
gccccacctccacctgtgag

SEQ ID NO: 3340880 - DNA, 21 bp, Homo sapiens
gccccacctccacctgtgaga

SEQ ID NO: 3340881 - DNA, 23 bp, Homo sapiens
gccccactcccttgctggcccca

SEQ ID NO: 3340882 - DNA, 23 bp, Homo sapiens
gccccactgatgctgttctcttc

SEQ ID NO: 3340883 - DNA, 17 bp, Homo sapiens
gccccactgccagcagc

SEQ ID NO: 3340884 - DNA, 18 bp, Homo sapiens
gccccagaaggcagggaa

SEQ ID NO: 3340885 - DNA, 18 bp, Homo sapiens
gccccagaccccagggca

SEQ ID NO: 3340886 - DNA, 20 bp, Homo sapiens
gccccagagatgccagccct

SEQ ID NO: 3340887 - DNA, 23 bp, Homo sapiens
gccccagagatgccagcccttca

SEQ ID NO: 3340888 - DNA, 12 bp, Homo sapiens
gccccagagctg

SEQ ID NO: 3340889 - DNA, 22 bp, Homo sapiens
gccccagagctgtttatggcct

SEQ ID NO: 3340890 - DNA, 12 bp, Homo sapiens
gccccagaggcc

SEQ ID NO: 3340891 - DNA, 13 bp, Homo sapiens
gccccagaggccc

SEQ ID NO: 3340892 - DNA, 15 bp, Homo sapiens
gccccagaggccctg

SEQ ID NO: 3340893 - DNA, 17 bp, Homo sapiens
gccccagataccagccc

SEQ ID NO: 3340894 - DNA, 20 bp, Homo sapiens
gccccagataccagcccctg

SEQ ID NO: 3340895 - DNA, 20 bp, Homo sapiens
gccccagatcaccagcccgg

SEQ ID NO: 3340896 - DNA, 17 bp, Homo sapiens
gccccagatctgcctgg

SEQ ID NO: 3340897 - DNA, 22 bp, Homo sapiens
gccccagatctgcctgggcctg

SEQ ID NO: 3340898 - DNA, 13 bp, Homo sapiens
gccccagcacagc

SEQ ID NO: 3340899 - DNA, 20 bp, Homo sapiens
gccccagcagccctcaacag

SEQ ID NO: 3340900 - DNA, 10 bp, Homo sapiens
gccccagcca

SEQ ID NO: 3340901 - DNA, 14 bp, Homo sapiens
gccccagccagagt

SEQ ID NO: 3340902 - DNA, 20 bp, Homo sapiens
gccccagccagagttcctgc

SEQ ID NO: 3340903 - DNA, 14 bp, Homo sapiens
gccccagcccaagt

SEQ ID NO: 3340904 - DNA, 16 bp, Homo sapiens
gccccagccccttctc

SEQ ID NO: 3340905 - DNA, 14 bp, Homo sapiens
gccccagccctgct

SEQ ID NO: 3340906 - DNA, 15 bp, Homo sapiens
gccccagccctgctg

SEQ ID NO: 3340907 - DNA, 20 bp, Homo sapiens
gccccagccctgctggggat

SEQ ID NO: 3340908 - DNA, 14 bp, Homo sapiens
gccccagctctgag

SEQ ID NO: 3340909 - DNA, 22 bp, Homo sapiens
gccccagctctgaggggagggg

SEQ ID NO: 3340910 - DNA, 11 bp, Homo sapiens
gccccaggccc

SEQ ID NO: 3340911 - DNA, 12 bp, Homo sapiens
gccccagggcct

SEQ ID NO: 3340912 - DNA, 18 bp, Homo sapiens
gccccagggctaccctcc

SEQ ID NO: 3340913 - DNA, 18 bp, Homo sapiens
gccccaggggggcctcct

SEQ ID NO: 3340914 - DNA, 16 bp, Homo sapiens
gccccagggtgcccag

SEQ ID NO: 3340915 - DNA, 20 bp, Homo sapiens
gccccagtcggccccatctc

SEQ ID NO: 3340916 - DNA, 13 bp, Homo sapiens
gccccagtgccca

SEQ ID NO: 3340917 - DNA, 14 bp, Homo sapiens
gccccagtgcccac

SEQ ID NO: 3340918 - DNA, 15 bp, Homo sapiens
gccccagtgcccaca

SEQ ID NO: 3340919 - DNA, 21 bp, Homo sapiens
gccccagtgcccacaggatca

SEQ ID NO: 3340920 - DNA, 17 bp, Homo sapiens
gccccatcctcatccct

SEQ ID NO: 3340921 - DNA, 17 bp, Homo sapiens
gccccatctcatcctgg

SEQ ID NO: 3340922 - DNA, 17 bp, Homo sapiens
gccccatgcctgtccag

SEQ ID NO: 3340923 - DNA, 14 bp, Homo sapiens
gccccattctgcct

SEQ ID NO: 3340924 - DNA, 17 bp, Homo sapiens
gccccattctgcctgcc

SEQ ID NO: 3340925 - DNA, 15 bp, Homo sapiens
gcccccaacactcca

SEQ ID NO: 3340926 - DNA, 20 bp, Homo sapiens
gcccccaaccccgcggtgct

SEQ ID NO: 3340927 - DNA, 14 bp, Homo sapiens
gcccccaataaagg

SEQ ID NO: 3340928 - DNA, 16 bp, Homo sapiens
gcccccaataaaggca

SEQ ID NO: 3340929 - DNA, 19 bp, Homo sapiens
gcccccaataaaggcagct

SEQ ID NO: 3340930 - DNA, 22 bp, Homo sapiens
gcccccaataaaggcagctgcc

SEQ ID NO: 3340931 - DNA, 24 bp, Homo sapiens
gcccccaataaaggcagctgcctc

SEQ ID NO: 3340932 - DNA, 13 bp, Homo sapiens
gcccccacctctg

SEQ ID NO: 3340933 - DNA, 15 bp, Homo sapiens
gcccccacctctggt

SEQ ID NO: 3340934 - DNA, 17 bp, Homo sapiens
gcccccagatagagctg

SEQ ID NO: 3340935 - DNA, 18 bp, Homo sapiens
gcccccagatagagctgg

SEQ ID NO: 3340936 - DNA, 14 bp, Homo sapiens
gcccccagcccaaa

SEQ ID NO: 3340937 - DNA, 15 bp, Homo sapiens
gcccccagcccaaag

SEQ ID NO: 3340938 - DNA, 15 bp, Homo sapiens
gcccccagcccctcc

SEQ ID NO: 3340939 - DNA, 19 bp, Homo sapiens
gcccccagcccctccccca

SEQ ID NO: 3340940 - DNA, 20 bp, Homo sapiens
gcccccagcccctcccccat

SEQ ID NO: 3340941 - DNA, 15 bp, Homo sapiens
gcccccagccctggg

SEQ ID NO: 3340942 - DNA, 21 bp, Homo sapiens
gcccccagccctgggaaccac

SEQ ID NO: 3340943 - DNA, 18 bp, Homo sapiens
gcccccaggaagacatta

SEQ ID NO: 3340944 - DNA, 18 bp, Homo sapiens
gcccccaggattccccca

SEQ ID NO: 3340945 - DNA, 19 bp, Homo sapiens
gcccccaggattcccccag

SEQ ID NO: 3340946 - DNA, 12 bp, Homo sapiens
gcccccaggcca

SEQ ID NO: 3340947 - DNA, 14 bp, Homo sapiens
gcccccaggccagg

SEQ ID NO: 3340948 - DNA, 13 bp, Homo sapiens
gcccccaggggca

SEQ ID NO: 3340949 - DNA, 21 bp, Homo sapiens
gcccccagtccccacccctgc

SEQ ID NO: 3340950 - DNA, 14 bp, Homo sapiens
gcccccatccctcg

SEQ ID NO: 3340951 - DNA, 21 bp, Homo sapiens
gcccccatccctcggacccac

SEQ ID NO: 3340952 - DNA, 18 bp, Homo sapiens
gcccccatctccccaggc

SEQ ID NO: 3340953 - DNA, 20 bp, Homo sapiens
gccccccaaatcccagggaa

SEQ ID NO: 3340954 - DNA, 19 bp, Homo sapiens
gcccccccaacactgtgcc

SEQ ID NO: 3340955 - DNA, 17 bp, Homo sapiens
gccccccgaggctgcta

SEQ ID NO: 3340956 - DNA, 14 bp, Homo sapiens
gcccagggctcctg

SEQ ID NO: 3340957 - DNA, 15 bp, Homo sapiens
gcccagggctcctgc

SEQ ID NO: 3340958 - DNA, 20 bp, Homo sapiens
gcccaggggagcgtgttcct

SEQ ID NO: 3340959 - DNA, 12 bp, Homo sapiens
gcccaggggctg

SEQ ID NO: 3340960 - DNA, 15 bp, Homo sapiens
gcccaggggtgcccc

SEQ ID NO: 3340961 - DNA, 19 bp, Homo sapiens
gcccaggggtgccccctcc

SEQ ID NO: 3340962 - DNA, 16 bp, Homo sapiens
gcccaggtaccaccct

SEQ ID NO: 3340963 - DNA, 18 bp, Homo sapiens
gcccaggtaccacccttc

SEQ ID NO: 3340964 - DNA, 21 bp, Homo sapiens
gcccaggtaccacccttcaga

SEQ ID NO: 3340965 - DNA, 15 bp, Homo sapiens
gcccaggtccctccg

SEQ ID NO: 3340966 - DNA, 14 bp, Homo sapiens
gcccagtacattta

SEQ ID NO: 3340967 - DNA, 19 bp, Homo sapiens
gcccagtacatttaaattt

SEQ ID NO: 3340968 - DNA, 22 bp, Homo sapiens
gcccagtacatttaaatttttt

SEQ ID NO: 3340969 - DNA, 17 bp, Homo sapiens
gcccagtagaccttgtt

SEQ ID NO: 3340970 - DNA, 20 bp, Homo sapiens
gcccagtctggaatgcagtg

SEQ ID NO: 3340971 - DNA, 13 bp, Homo sapiens
gccaggtgcagtg

SEQ ID NO: 3340972 - DNA, 14 bp, Homo sapiens
gccaggtgcagtgg

SEQ ID NO: 3340973 - DNA, 22 bp, Homo sapiens
gccaggttagcctttgccctgt

SEQ ID NO: 3340974 - DNA, 23 bp, Homo sapiens
gccaggttagcctttgccctgtc

SEQ ID NO: 3340975 - DNA, 21 bp, Homo sapiens
gccagtaacgcgtcttcctga

SEQ ID NO: 3340976 - DNA, 18 bp, Homo sapiens
gccagtcaagaagaaaaa

SEQ ID NO: 3340977 - DNA, 13 bp, Homo sapiens
gccagtccaggct

SEQ ID NO: 3340978 - DNA, 15 bp, Homo sapiens
gccagtccccgagga

SEQ ID NO: 3340979 - DNA, 22 bp, Homo sapiens
gccagtccccgaggagctgggc

SEQ ID NO: 3340980 - DNA, 23 bp, Homo sapiens
gccagtccccgaggagctgggcc

SEQ ID NO: 3340981 - DNA, 17 bp, Homo sapiens
gccagtcctcctgggag

SEQ ID NO: 3340982 - DNA, 18 bp, Homo sapiens
gccagtcctgcctggcca

SEQ ID NO: 3340983 - DNA, 14 bp, Homo sapiens
gccagtctgggctg

SEQ ID NO: 3340984 - DNA, 17 bp, Homo sapiens
gccagtctgggctgccg

SEQ ID NO: 3340985 - DNA, 12 bp, Homo sapiens
gccagtctgtgg

SEQ ID NO: 3340986 - DNA, 17 bp, Homo sapiens
gccagtcttgcctaggc

SEQ ID NO: 3340987 - DNA, 18 bp, Homo sapiens
gccagtcttgcctaggcc

SEQ ID NO: 3340988 - DNA, 13 bp, Homo sapiens
gccagtcttgtgt

SEQ ID NO: 3340989 - DNA, 17 bp, Homo sapiens
gccagtgaaatgtgaag

SEQ ID NO: 3340990 - DNA, 18 bp, Homo sapiens
gccagtgactttttctga

SEQ ID NO: 3340991 - DNA, 13 bp, Homo sapiens
gccagtgcagcca

SEQ ID NO: 3340992 - DNA, 17 bp, Homo sapiens
gccagtgcagccactgg

SEQ ID NO: 3340993 - DNA, 23 bp, Homo sapiens
gccagtgccattccactccactc

SEQ ID NO: 3340994 - DNA, 16 bp, Homo sapiens
gccagtgctccaggca

SEQ ID NO: 3340995 - DNA, 15 bp, Homo sapiens
gccagtgctggtcac

SEQ ID NO: 3340996 - DNA, 20 bp, Homo sapiens
gccagtggatcccctgcggt

SEQ ID NO: 3340997 - DNA, 16 bp, Homo sapiens
gccagtgggcgggcca

SEQ ID NO: 3340998 - DNA, 19 bp, Homo sapiens
gccagtggggcctgtggaa

SEQ ID NO: 3340999 - DNA, 19 bp, Homo sapiens
gccagtgtaatcccccagg

SEQ ID NO: 3341000 - DNA, 12 bp, Homo sapiens
gccagtgtctgg

SEQ ID NO: 3341001 - DNA, 13 bp, Homo sapiens
gccagtgtctttc

SEQ ID NO: 3341002 - DNA, 14 bp, Homo sapiens
gccagtgtctttct

SEQ ID NO: 3341003 - DNA, 17 bp, Homo sapiens
gccagtgtgatcccaag

SEQ ID NO: 3341004 - DNA, 20 bp, Homo sapiens
gccagtgtgatcccaagtgc

SEQ ID NO: 3341005 - DNA, 17 bp, Homo sapiens
gccagttagactagtcc

SEQ ID NO: 3341006 - DNA, 14 bp, Homo sapiens
gccagttggtgggg

SEQ ID NO: 3341007 - DNA, 15 bp, Homo sapiens
gccagttggtggggc

SEQ ID NO: 3341008 - DNA, 19 bp, Homo sapiens
gccagttggtggggccagg

SEQ ID NO: 3341009 - DNA, 22 bp, Homo sapiens
gccataaaacaggtaatataaa

SEQ ID NO: 3341010 - DNA, 19 bp, Homo sapiens
gccataaacggttcctggt

SEQ ID NO: 3341011 - DNA, 23 bp, Homo sapiens
gccataaacggttcctggtgact

SEQ ID NO: 3341012 - DNA, 16 bp, Homo sapiens
gccataattttgcata

SEQ ID NO: 3341013 - DNA, 16 bp, Homo sapiens
gccatactttgtctga

SEQ ID NO: 3341014 - DNA, 13 bp, Homo sapiens
gccatagccccat

SEQ ID NO: 3341015 - DNA, 19 bp, Homo sapiens
gccataggagaggagggtt

SEQ ID NO: 3341016 - DNA, 19 bp, Homo sapiens
gccatagtttgggtatttt

SEQ ID NO: 3341017 - DNA, 23 bp, Homo sapiens
gccatatataacagatacatttc

SEQ ID NO: 3341018 - DNA, 19 bp, Homo sapiens
gccatattctgttggccag

SEQ ID NO: 3341019 - DNA, 14 bp, Homo sapiens
gccatcaaaatgct

SEQ ID NO: 3341020 - DNA, 22 bp, Homo sapiens
gccatcacaggatgccagcccc

SEQ ID NO: 3341021 - DNA, 22 bp, Homo sapiens
gccatcacatgatctgtttttc

SEQ ID NO: 3341022 - DNA, 19 bp, Homo sapiens
gccatcaccataacctctg

SEQ ID NO: 3341023 - DNA, 18 bp, Homo sapiens
gccatcaccgctgggtgg

SEQ ID NO: 3341024 - DNA, 21 bp, Homo sapiens
gccatccctcgtggtccccaa

SEQ ID NO: 3341025 - DNA, 15 bp, Homo sapiens
gccatccctgtgagg

SEQ ID NO: 3341026 - DNA, 18 bp, Homo sapiens
gccatcgtcctgggactc

SEQ ID NO: 3341027 - DNA, 23 bp, Homo sapiens
gccatctagccagcccctcttcc

SEQ ID NO: 3341028 - DNA, 15 bp, Homo sapiens
gccatctcaggagat

SEQ ID NO: 3341029 - DNA, 17 bp, Homo sapiens
gccatctcaggagatgg

SEQ ID NO: 3341030 - DNA, 14 bp, Homo sapiens
gccatctccctccc

SEQ ID NO: 3341031 - DNA, 19 bp, Homo sapiens
gccatctgactgccaagcc

SEQ ID NO: 3341032 - DNA, 22 bp, Homo sapiens
gccatctgcacacacctccgag

SEQ ID NO: 3341033 - DNA, 15 bp, Homo sapiens
gccatctgcccaggg

SEQ ID NO: 3341034 - DNA, 19 bp, Homo sapiens
gccatctgcccaggggtgc

SEQ ID NO: 3341035 - DNA, 18 bp, Homo sapiens
gccatctgtgtcctggtt

SEQ ID NO: 3341036 - DNA, 14 bp, Homo sapiens
gccatgaagcatta

SEQ ID NO: 3341037 - DNA, 14 bp, Homo sapiens
gccatgagggacag

SEQ ID NO: 3341038 - DNA, 15 bp, Homo sapiens
gccatgagggacagg

SEQ ID NO: 3341039 - DNA, 20 bp, Homo sapiens
gccatgatcgagccactgca

SEQ ID NO: 3341040 - DNA, 22 bp, Homo sapiens
gccatgatctgtatttaatggt

SEQ ID NO: 3341041 - DNA, 22 bp, Homo sapiens
gccatgatggaaatatttattt

SEQ ID NO: 3341042 - DNA, 18 bp, Homo sapiens
gccatgatttgtcccagc

SEQ ID NO: 3341043 - DNA, 12 bp, Homo sapiens
gccatgccactg

SEQ ID NO: 3341044 - DNA, 14 bp, Homo sapiens
gccatgccactgcc

SEQ ID NO: 3341045 - DNA, 23 bp, Homo sapiens
gccatgccactgccaggcacctg

SEQ ID NO: 3341046 - DNA, 16 bp, Homo sapiens
gccatgccaggaacct

SEQ ID NO: 3341047 - DNA, 18 bp, Homo sapiens
gccatgccaggaacctgt

SEQ ID NO: 3341048 - DNA, 14 bp, Homo sapiens
gccatgcccaggac

SEQ ID NO: 3341049 - DNA, 16 bp, Homo sapiens
gccatgcctcatgcca

SEQ ID NO: 3341050 - DNA, 14 bp, Homo sapiens
gccatggctcaggc

SEQ ID NO: 3341051 - DNA, 21 bp, Homo sapiens
gccatggctcaggcaagcccc

SEQ ID NO: 3341052 - DNA, 16 bp, Homo sapiens
gccatgggccagccta

SEQ ID NO: 3341053 - DNA, 19 bp, Homo sapiens
gccatgggccagcctagcc

SEQ ID NO: 3341054 - DNA, 22 bp, Homo sapiens
gccatgggccagcctagccctt

SEQ ID NO: 3341055 - DNA, 21 bp, Homo sapiens
gccatgggcctgggcctgctt

SEQ ID NO: 3341056 - DNA, 14 bp, Homo sapiens
gccatggtaccccc

SEQ ID NO: 3341057 - DNA, 17 bp, Homo sapiens
gccatgtactagtttta

SEQ ID NO: 3341058 - DNA, 14 bp, Homo sapiens
gccatgtccaaaga

SEQ ID NO: 3341059 - DNA, 15 bp, Homo sapiens
gccatgtccaaagag

SEQ ID NO: 3341060 - DNA, 22 bp, Homo sapiens
gccatgtctgcagtgtgccccc

SEQ ID NO: 3341061 - DNA, 14 bp, Homo sapiens
gccatgtgagccac

SEQ ID NO: 3341062 - DNA, 18 bp, Homo sapiens
gccatgtgagccaccgct

SEQ ID NO: 3341063 - DNA, 14 bp, Homo sapiens
gccatgtgccaggt

SEQ ID NO: 3341064 - DNA, 14 bp, Homo sapiens
gccatgttggccag

SEQ ID NO: 3341065 - DNA, 18 bp, Homo sapiens
gccattattttctgtcag

SEQ ID NO: 3341066 - DNA, 20 bp, Homo sapiens
gccattcctggtacccagcc

SEQ ID NO: 3341067 - DNA, 22 bp, Homo sapiens
gccattcctggtacccagccat

SEQ ID NO: 3341068 - DNA, 12 bp, Homo sapiens
gccattgagaat

SEQ ID NO: 3341069 - DNA, 17 bp, Homo sapiens
gccattgcggccccagg

SEQ ID NO: 3341070 - DNA, 20 bp, Homo sapiens
gccattgcggccccaggagg

SEQ ID NO: 3341071 - DNA, 13 bp, Homo sapiens
gccattgtcttta

SEQ ID NO: 3341072 - DNA, 15 bp, Homo sapiens
gccattgtctttata

SEQ ID NO: 3341073 - DNA, 11 bp, Homo sapiens
gccatttaaaa

SEQ ID NO: 3341074 - DNA, 18 bp, Homo sapiens
gccatttcagtggcttcc

SEQ ID NO: 3341075 - DNA, 20 bp, Homo sapiens
gccatttctgaactgttaca

SEQ ID NO: 3341076 - DNA, 13 bp, Homo sapiens
gccatttgatacc

SEQ ID NO: 3341077 - DNA, 20 bp, Homo sapiens
gccatttgcaccctccgcct

SEQ ID NO: 3341078 - DNA, 16 bp, Homo sapiens
gccatttgtaatgaat

SEQ ID NO: 3341079 - DNA, 20 bp, Homo sapiens
gccatttgtaatgaatttgt

SEQ ID NO: 3341080 - DNA, 20 bp, Homo sapiens
gccattttattaaacatttt

SEQ ID NO: 3341081 - DNA, 14 bp, Homo sapiens
gccatttttaatga

SEQ ID NO: 3341082 - DNA, 18 bp, Homo sapiens
gccatttttctataaatc

SEQ ID NO: 3341083 - DNA, 16 bp, Homo sapiens
gcccaaaacccagggc

SEQ ID NO: 3341084 - DNA, 20 bp, Homo sapiens
gcccaaacccttaactgaca

SEQ ID NO: 3341085 - DNA, 22 bp, Homo sapiens
gcccaaagagcacaaacatttt

SEQ ID NO: 3341086 - DNA, 19 bp, Homo sapiens
gcccaaaggggacaggcct

SEQ ID NO: 3341087 - DNA, 13 bp, Homo sapiens
gcccaaagtgggg

SEQ ID NO: 3341088 - DNA, 14 bp, Homo sapiens
gcccaaatgatgga

SEQ ID NO: 3341089 - DNA, 19 bp, Homo sapiens
gcccaaatttaatttgcaa

SEQ ID NO: 3341090 - DNA, 13 bp, Homo sapiens
gcccaacaccagc

SEQ ID NO: 3341091 - DNA, 19 bp, Homo sapiens
gcccaaccatcggtccaca

SEQ ID NO: 3341092 - DNA, 14 bp, Homo sapiens
gcccaacctcctga

SEQ ID NO: 3341093 - DNA, 22 bp, Homo sapiens
gcccaagaatagatgctgactg

SEQ ID NO: 3341094 - DNA, 19 bp, Homo sapiens
gcccaagacagatgcccca

SEQ ID NO: 3341095 - DNA, 21 bp, Homo sapiens
gcccaagagcagagtctgggc

SEQ ID NO: 3341096 - DNA, 23 bp, Homo sapiens
gcccaagagcagagtctgggcct

SEQ ID NO: 3341097 - DNA, 18 bp, Homo sapiens
gcccaagagccctgtggc

SEQ ID NO: 3341098 - DNA, 19 bp, Homo sapiens
gcccaagaggtctgagccc

SEQ ID NO: 3341099 - DNA, 21 bp, Homo sapiens
gcccaagaggtctgagccctg

SEQ ID NO: 3341100 - DNA, 14 bp, Homo sapiens
gccagcaaggcagg

SEQ ID NO: 3341101 - DNA, 13 bp, Homo sapiens
gccagcaatgaca

SEQ ID NO: 3341102 - DNA, 23 bp, Homo sapiens
gccagcaatgacatctcaggggc

SEQ ID NO: 3341103 - DNA, 13 bp, Homo sapiens
gccagcacagagc

SEQ ID NO: 3341104 - DNA, 18 bp, Homo sapiens
gccagcaccacttccttt

SEQ ID NO: 3341105 - DNA, 17 bp, Homo sapiens
gccagcaccctctcctg

SEQ ID NO: 3341106 - DNA, 19 bp, Homo sapiens
gccagcaccctctcctggg

SEQ ID NO: 3341107 - DNA, 14 bp, Homo sapiens
gccagcacctggca

SEQ ID NO: 3341108 - DNA, 13 bp, Homo sapiens
gccagcagcagca

SEQ ID NO: 3341109 - DNA, 14 bp, Homo sapiens
gccagcaggggggc

SEQ ID NO: 3341110 - DNA, 17 bp, Homo sapiens
gccagcattccagactt

SEQ ID NO: 3341111 - DNA, 20 bp, Homo sapiens
gccagcattccagacttcaa

SEQ ID NO: 3341112 - DNA, 22 bp, Homo sapiens
gccagcattccagacttcaaaa

SEQ ID NO: 3341113 - DNA, 11 bp, Homo sapiens
gccagccacag

SEQ ID NO: 3341114 - DNA, 14 bp, Homo sapiens
gccagccacagacc

SEQ ID NO: 3341115 - DNA, 15 bp, Homo sapiens
gccagccacagaccc

SEQ ID NO: 3341116 - DNA, 16 bp, Homo sapiens
gccagccacagacccc

SEQ ID NO: 3341117 - DNA, 11 bp, Homo sapiens
gccagccaggc

SEQ ID NO: 3341118 - DNA, 14 bp, Homo sapiens
gccagccagtgcca

SEQ ID NO: 3341119 - DNA, 15 bp, Homo sapiens
gccagcccagaacac

SEQ ID NO: 3341120 - DNA, 11 bp, Homo sapiens
gccagcccagc

SEQ ID NO: 3341121 - DNA, 13 bp, Homo sapiens
gccagcccagcca

SEQ ID NO: 3341122 - DNA, 19 bp, Homo sapiens
gccagcccatggcccccaa

SEQ ID NO: 3341123 - DNA, 21 bp, Homo sapiens
gccagcccatggcccccaata

SEQ ID NO: 3341124 - DNA, 22 bp, Homo sapiens
gccagccccacacagctacagc

SEQ ID NO: 3341125 - DNA, 13 bp, Homo sapiens
gccagccccaccc

SEQ ID NO: 3341126 - DNA, 15 bp, Homo sapiens
gccagccccacccag

SEQ ID NO: 3341127 - DNA, 17 bp, Homo sapiens
gccagccccacccagga

SEQ ID NO: 3341128 - DNA, 18 bp, Homo sapiens
gccagccccacccaggag

SEQ ID NO: 3341129 - DNA, 11 bp, Homo sapiens
gccagcccctg

SEQ ID NO: 3341130 - DNA, 13 bp, Homo sapiens
gccagcccctgcc

SEQ ID NO: 3341131 - DNA, 14 bp, Homo sapiens
gccagcccctgcct

SEQ ID NO: 3341132 - DNA, 19 bp, Homo sapiens
gccagcccctgcctgggtt

SEQ ID NO: 3341133 - DNA, 15 bp, Homo sapiens
gccagcccggctggt

SEQ ID NO: 3341134 - DNA, 16 bp, Homo sapiens
gccagccctgcagccc

SEQ ID NO: 3341135 - DNA, 17 bp, Homo sapiens
gccagccctgcagccca

SEQ ID NO: 3341136 - DNA, 16 bp, Homo sapiens
gccagccgccctgggc

SEQ ID NO: 3341137 - DNA, 15 bp, Homo sapiens
gccagccggtgcctg

SEQ ID NO: 3341138 - DNA, 13 bp, Homo sapiens
gccagcctagccc

SEQ ID NO: 3341139 - DNA, 12 bp, Homo sapiens
gccagcctcctc

SEQ ID NO: 3341140 - DNA, 13 bp, Homo sapiens
gccagcctcctct

SEQ ID NO: 3341141 - DNA, 14 bp, Homo sapiens
gccagcctcctctg

SEQ ID NO: 3341142 - DNA, 16 bp, Homo sapiens
gccagcctcctctgga

SEQ ID NO: 3341143 - DNA, 17 bp, Homo sapiens
gccagcctcctctggac

SEQ ID NO: 3341144 - DNA, 13 bp, Homo sapiens
gccagcctgaggc

SEQ ID NO: 3341145 - DNA, 18 bp, Homo sapiens
gccagcctggcttctgga

SEQ ID NO: 3341146 - DNA, 22 bp, Homo sapiens
gccagcctggcttctggagccc

SEQ ID NO: 3341147 - DNA, 15 bp, Homo sapiens
gccagcctgggactc

SEQ ID NO: 3341148 - DNA, 16 bp, Homo sapiens
gccagcctggggcctg

SEQ ID NO: 3341149 - DNA, 12 bp, Homo sapiens
gccagccttctt

SEQ ID NO: 3341150 - DNA, 19 bp, Homo sapiens
gccagccttcttccatccc

SEQ ID NO: 3341151 - DNA, 17 bp, Homo sapiens
gccagccttgagccctg

SEQ ID NO: 3341152 - DNA, 13 bp, Homo sapiens
gccagcgggcaca

SEQ ID NO: 3341153 - DNA, 15 bp, Homo sapiens
gccagcgggcacagg

SEQ ID NO: 3341154 - DNA, 16 bp, Homo sapiens
gccagcgggcacaggg

SEQ ID NO: 3341155 - DNA, 18 bp, Homo sapiens
gccagcgggcacagggca

SEQ ID NO: 3341156 - DNA, 19 bp, Homo sapiens
gccagcgggcacagggcac

SEQ ID NO: 3341157 - DNA, 15 bp, Homo sapiens
gccagcgtcccaggg

SEQ ID NO: 3341158 - DNA, 17 bp, Homo sapiens
gccagctcacagtgctg

SEQ ID NO: 3341159 - DNA, 19 bp, Homo sapiens
gccagctcacagtgctgtg

SEQ ID NO: 3341160 - DNA, 13 bp, Homo sapiens
gccagctccctct

SEQ ID NO: 3341161 - DNA, 19 bp, Homo sapiens
gccagctctaggcttcagg

SEQ ID NO: 3341162 - DNA, 20 bp, Homo sapiens
gccagctgcagctgggctgt

SEQ ID NO: 3341163 - DNA, 17 bp, Homo sapiens
gccagctgccccagcca

SEQ ID NO: 3341164 - DNA, 20 bp, Homo sapiens
gccagctgcctgtgcctgcc

SEQ ID NO: 3341165 - DNA, 12 bp, Homo sapiens
gccagctgcctt

SEQ ID NO: 3341166 - DNA, 14 bp, Homo sapiens
gccagctgggagca

SEQ ID NO: 3341167 - DNA, 17 bp, Homo sapiens
gccagctgtgcactttc

SEQ ID NO: 3341168 - DNA, 16 bp, Homo sapiens
gccagcttctcctgcg

SEQ ID NO: 3341169 - DNA, 22 bp, Homo sapiens
gccagcttggggccaccaaagc

SEQ ID NO: 3341170 - DNA, 15 bp, Homo sapiens
gccaggaaggacaga

SEQ ID NO: 3341171 - DNA, 17 bp, Homo sapiens
gccaggaaggacagact

SEQ ID NO: 3341172 - DNA, 21 bp, Homo sapiens
gccaggaaggacagactggcc

SEQ ID NO: 3341173 - DNA, 19 bp, Homo sapiens
gccaggacagtcagctctc

SEQ ID NO: 3341174 - DNA, 22 bp, Homo sapiens
gccaggacatgcaataaaattt

SEQ ID NO: 3341175 - DNA, 16 bp, Homo sapiens
gccaggaccacacagt

SEQ ID NO: 3341176 - DNA, 17 bp, Homo sapiens
gccaggaccacacagtc

SEQ ID NO: 3341177 - DNA, 20 bp, Homo sapiens
gccaggagctcttcaggcct

SEQ ID NO: 3341178 - DNA, 22 bp, Homo sapiens
gccaggagctcttcaggcctcc

SEQ ID NO: 3341179 - DNA, 19 bp, Homo sapiens
gccaggaggttggtgactg

SEQ ID NO: 3341180 - DNA, 23 bp, Homo sapiens
gccaggaggttggtgactgaaac

SEQ ID NO: 3341181 - DNA, 15 bp, Homo sapiens
gccaggagtctgtgc

SEQ ID NO: 3341182 - DNA, 16 bp, Homo sapiens
gccaggagtctgtgct

SEQ ID NO: 3341183 - DNA, 22 bp, Homo sapiens
gccaggatcatggtgtaataag

SEQ ID NO: 3341184 - DNA, 23 bp, Homo sapiens
gccaggatggtctcgatctcctg

SEQ ID NO: 3341185 - DNA, 22 bp, Homo sapiens
gccaggcaacttcagtcctggg

SEQ ID NO: 3341186 - DNA, 17 bp, Homo sapiens
gccaggcacagggcccg

SEQ ID NO: 3341187 - DNA, 16 bp, Homo sapiens
gccaggcacctggcct

SEQ ID NO: 3341188 - DNA, 18 bp, Homo sapiens
gccaggcacctggcctgc

SEQ ID NO: 3341189 - DNA, 15 bp, Homo sapiens
gccaggcaggggtgg

SEQ ID NO: 3341190 - DNA, 16 bp, Homo sapiens
gccaggcaggggtggg

SEQ ID NO: 3341191 - DNA, 17 bp, Homo sapiens
gccaggcaggtccacag

SEQ ID NO: 3341192 - DNA, 15 bp, Homo sapiens
gccaggccagaggga

SEQ ID NO: 3341193 - DNA, 14 bp, Homo sapiens
gccaggccaggacc

SEQ ID NO: 3341194 - DNA, 15 bp, Homo sapiens
gccaggccaggacca

SEQ ID NO: 3341195 - DNA, 16 bp, Homo sapiens
gccaggccaggaccac

SEQ ID NO: 3341196 - DNA, 22 bp, Homo sapiens
gccaggccaggaccacacagtc

SEQ ID NO: 3341197 - DNA, 16 bp, Homo sapiens
gccaggcccaggcaga

SEQ ID NO: 3341198 - DNA, 23 bp, Homo sapiens
gccaggcccatctcaggtgccac

SEQ ID NO: 3341199 - DNA, 22 bp, Homo sapiens
gccaggcccgcaccccggcctc

SEQ ID NO: 3341200 - DNA, 21 bp, Homo sapiens
gccaggcctctctcacctctc

SEQ ID NO: 3341201 - DNA, 18 bp, Homo sapiens
gccaggcgttggtgccac

SEQ ID NO: 3341202 - DNA, 21 bp, Homo sapiens
gccaggctatggttgccaccc

SEQ ID NO: 3341203 - DNA, 22 bp, Homo sapiens
gccaggctatggttgccacccc

SEQ ID NO: 3341204 - DNA, 17 bp, Homo sapiens
gccaggctcaggccatg

SEQ ID NO: 3341205 - DNA, 20 bp, Homo sapiens
gccaggctccctttctcttc

SEQ ID NO: 3341206 - DNA, 14 bp, Homo sapiens
gccaggctgccaag

SEQ ID NO: 3341207 - DNA, 15 bp, Homo sapiens
gccaggctggtctca

SEQ ID NO: 3341208 - DNA, 15 bp, Homo sapiens
gccagggcagggcca

SEQ ID NO: 3341209 - DNA, 15 bp, Homo sapiens
gccagggcagtgcta

SEQ ID NO: 3341210 - DNA, 19 bp, Homo sapiens
gccagggccacgctccagc

SEQ ID NO: 3341211 - DNA, 22 bp, Homo sapiens
gccagggcccctcaccctgcct

SEQ ID NO: 3341212 - DNA, 19 bp, Homo sapiens
gccagggccctgcagaggg

SEQ ID NO: 3341213 - DNA, 10 bp, Homo sapiens
gccagggctg

SEQ ID NO: 3341214 - DNA, 17 bp, Homo sapiens
gccagggctgccctgag

SEQ ID NO: 3341215 - DNA, 19 bp, Homo sapiens
gccagggctgccctgagaa

SEQ ID NO: 3341216 - DNA, 13 bp, Homo sapiens
gccagggctgggg

SEQ ID NO: 3341217 - DNA, 15 bp, Homo sapiens
gccagggctggggac

SEQ ID NO: 3341218 - DNA, 16 bp, Homo sapiens
gccagggcttcctctt

SEQ ID NO: 3341219 - DNA, 23 bp, Homo sapiens
gccagggcttcctcttccgggca

SEQ ID NO: 3341220 - DNA, 23 bp, Homo sapiens
gccaggggattgtctcagggccg

SEQ ID NO: 3341221 - DNA, 20 bp, Homo sapiens
gccagggggactagcccctg

SEQ ID NO: 3341222 - DNA, 18 bp, Homo sapiens
gccagggtctgtgtgaat

SEQ ID NO: 3341223 - DNA, 20 bp, Homo sapiens
gccagggtctgtgtgaatgt

SEQ ID NO: 3341224 - DNA, 19 bp, Homo sapiens
gccagggtttacccagtgg

SEQ ID NO: 3341225 - DNA, 15 bp, Homo sapiens
gcatttaataaagat

SEQ ID NO: 3341226 - DNA, 23 bp, Homo sapiens
gcatttaatggcagctagtgcct

SEQ ID NO: 3341227 - DNA, 15 bp, Homo sapiens
gcatttactttgtgt

SEQ ID NO: 3341228 - DNA, 14 bp, Homo sapiens
gcatttcaaatgtt

SEQ ID NO: 3341229 - DNA, 23 bp, Homo sapiens
gcatttcacctgtgacaaaggat

SEQ ID NO: 3341230 - DNA, 11 bp, Homo sapiens
gcatttcattc

SEQ ID NO: 3341231 - DNA, 20 bp, Homo sapiens
gcatttcattcttctctagc

SEQ ID NO: 3341232 - DNA, 22 bp, Homo sapiens
gcatttccaacaccacagacac

SEQ ID NO: 3341233 - DNA, 18 bp, Homo sapiens
gcatttcctgctggtcaa

SEQ ID NO: 3341234 - DNA, 23 bp, Homo sapiens
gcatttctcttctcagctcttcc

SEQ ID NO: 3341235 - DNA, 19 bp, Homo sapiens
gcatttctgaatagaaatg

SEQ ID NO: 3341236 - DNA, 21 bp, Homo sapiens
gcatttcttgatgttgcttag

SEQ ID NO: 3341237 - DNA, 23 bp, Homo sapiens
gcatttgctctttcatctctgct

SEQ ID NO: 3341238 - DNA, 15 bp, Homo sapiens
gcatttggcactgag

SEQ ID NO: 3341239 - DNA, 19 bp, Homo sapiens
gcatttgtattttgtgtga

SEQ ID NO: 3341240 - DNA, 21 bp, Homo sapiens
gcatttgtattttgtgtgacc

SEQ ID NO: 3341241 - DNA, 16 bp, Homo sapiens
gcatttgtgttattat

SEQ ID NO: 3341242 - DNA, 16 bp, Homo sapiens
gcatttttaagggagt

SEQ ID NO: 3341243 - DNA, 21 bp, Homo sapiens
gcatttttgatttatgcatgg

SEQ ID NO: 3341244 - DNA, 15 bp, Homo sapiens
gccaaaaaaaaaaga

SEQ ID NO: 3341245 - DNA, 21 bp, Homo sapiens
gccaaaatcctgaactttctc

SEQ ID NO: 3341246 - DNA, 17 bp, Homo sapiens
gccaaaattcatttcta

SEQ ID NO: 3341247 - DNA, 18 bp, Homo sapiens
gccaaacccttgtcagtg

SEQ ID NO: 3341248 - DNA, 17 bp, Homo sapiens
gccaaagaaacaagctg

SEQ ID NO: 3341249 - DNA, 20 bp, Homo sapiens
gccaaagaaacaagctgtgc

SEQ ID NO: 3341250 - DNA, 21 bp, Homo sapiens
gccaaagaaacaagctgtgca

SEQ ID NO: 3341251 - DNA, 16 bp, Homo sapiens
gccaaagctaggcctg

SEQ ID NO: 3341252 - DNA, 20 bp, Homo sapiens
gccaaaggctggtggcaagt

SEQ ID NO: 3341253 - DNA, 17 bp, Homo sapiens
gccaaataaacagctat

SEQ ID NO: 3341254 - DNA, 21 bp, Homo sapiens
gccaaatgcagggaggggagg

SEQ ID NO: 3341255 - DNA, 18 bp, Homo sapiens
gccaaatgtaattgaata

SEQ ID NO: 3341256 - DNA, 14 bp, Homo sapiens
gccaaattttatct

SEQ ID NO: 3341257 - DNA, 20 bp, Homo sapiens
gccaacaccacagaaatggg

SEQ ID NO: 3341258 - DNA, 19 bp, Homo sapiens
gccaacagaagcttccatt

SEQ ID NO: 3341259 - DNA, 15 bp, Homo sapiens
gccaacagcacctcc

SEQ ID NO: 3341260 - DNA, 20 bp, Homo sapiens
gccaacatcgtgaaaccctg

SEQ ID NO: 3341261 - DNA, 17 bp, Homo sapiens
gccaaccagcccgacag

SEQ ID NO: 3341262 - DNA, 22 bp, Homo sapiens
gccaacctgttcttagagtgta

SEQ ID NO: 3341263 - DNA, 19 bp, Homo sapiens
gccaaccttcaaagaaact

SEQ ID NO: 3341264 - DNA, 16 bp, Homo sapiens
gccaactaagccctcg

SEQ ID NO: 3341265 - DNA, 23 bp, Homo sapiens
gccaactaagccctcgaaccaag

SEQ ID NO: 3341266 - DNA, 15 bp, Homo sapiens
gccaactagcccctg

SEQ ID NO: 3341267 - DNA, 17 bp, Homo sapiens
gccaactagcccctggg

SEQ ID NO: 3341268 - DNA, 20 bp, Homo sapiens
gccaactagcccctggggtg

SEQ ID NO: 3341269 - DNA, 14 bp, Homo sapiens
gccaactcctcaca

SEQ ID NO: 3341270 - DNA, 23 bp, Homo sapiens
gccaactctaacaggcactttga

SEQ ID NO: 3341271 - DNA, 19 bp, Homo sapiens
gccaactgctgctttttga

SEQ ID NO: 3341272 - DNA, 17 bp, Homo sapiens
gccaactggtgtttgaa

SEQ ID NO: 3341273 - DNA, 17 bp, Homo sapiens
gccaactgtttccctgc

SEQ ID NO: 3341274 - DNA, 20 bp, Homo sapiens
gccaactgtttccctgctga

SEQ ID NO: 3341275 - DNA, 22 bp, Homo sapiens
gccaactgtttccctgctgaat

SEQ ID NO: 3341276 - DNA, 20 bp, Homo sapiens
gccaacttgagggcccagag

SEQ ID NO: 3341277 - DNA, 21 bp, Homo sapiens
gccaagaaacgtcttctaaac

SEQ ID NO: 3341278 - DNA, 15 bp, Homo sapiens
gccaagacaaatcaa

SEQ ID NO: 3341279 - DNA, 14 bp, Homo sapiens
gccaagactcctca

SEQ ID NO: 3341280 - DNA, 15 bp, Homo sapiens
gccaagactcctcag

SEQ ID NO: 3341281 - DNA, 22 bp, Homo sapiens
gccaagagaaaggcctgcacac

SEQ ID NO: 3341282 - DNA, 20 bp, Homo sapiens
gccaagagcatcgtgaccct

SEQ ID NO: 3341283 - DNA, 15 bp, Homo sapiens
gccaagattttcctc

SEQ ID NO: 3341284 - DNA, 11 bp, Homo sapiens
gccaagccaga

SEQ ID NO: 3341285 - DNA, 15 bp, Homo sapiens
gccaagccagattct

SEQ ID NO: 3341286 - DNA, 20 bp, Homo sapiens
gccaagccagattctcttga

SEQ ID NO: 3341287 - DNA, 18 bp, Homo sapiens
gccaagctccctggagcc

SEQ ID NO: 3341288 - DNA, 20 bp, Homo sapiens
gccaagctccctggagccct

SEQ ID NO: 3341289 - DNA, 15 bp, Homo sapiens
gccaagctttaaatt

SEQ ID NO: 3341290 - DNA, 16 bp, Homo sapiens
gccaagctttaaatta

SEQ ID NO: 3341291 - DNA, 18 bp, Homo sapiens
gccaaggactgactgaga

SEQ ID NO: 3341292 - DNA, 15 bp, Homo sapiens
gccaaggaggcctgg

SEQ ID NO: 3341293 - DNA, 19 bp, Homo sapiens
gccaaggaggcctggggag

SEQ ID NO: 3341294 - DNA, 22 bp, Homo sapiens
gccaagggaaaggggtgctttt

SEQ ID NO: 3341295 - DNA, 20 bp, Homo sapiens
gccaagggtcctcacccctc

SEQ ID NO: 3341296 - DNA, 16 bp, Homo sapiens
gccaagtaaacagggt

SEQ ID NO: 3341297 - DNA, 19 bp, Homo sapiens
gccaagtaaacagggtacc

SEQ ID NO: 3341298 - DNA, 16 bp, Homo sapiens
gccaagtaagaaagtg

SEQ ID NO: 3341299 - DNA, 17 bp, Homo sapiens
gccaagtctcagaagag

SEQ ID NO: 3341300 - DNA, 18 bp, Homo sapiens
gccaagtgcgtgccgtgt

SEQ ID NO: 3341301 - DNA, 19 bp, Homo sapiens
gccaagtgcgtgccgtgtg

SEQ ID NO: 3341302 - DNA, 18 bp, Homo sapiens
gccaagtggggtgctggg

SEQ ID NO: 3341303 - DNA, 20 bp, Homo sapiens
gccaagtggggtgctgggag

SEQ ID NO: 3341304 - DNA, 20 bp, Homo sapiens
gccaagttgctgtcactgtt

SEQ ID NO: 3341305 - DNA, 13 bp, Homo sapiens
gccaataaaaagt

SEQ ID NO: 3341306 - DNA, 16 bp, Homo sapiens
gccaataaacctgtaa

SEQ ID NO: 3341307 - DNA, 17 bp, Homo sapiens
gccaatatgtattgtaa

SEQ ID NO: 3341308 - DNA, 18 bp, Homo sapiens
gccaatattaaatctgct

SEQ ID NO: 3341309 - DNA, 12 bp, Homo sapiens
gccaatgaggtc

SEQ ID NO: 3341310 - DNA, 22 bp, Homo sapiens
gccaatgaggtctgaaatggag

SEQ ID NO: 3341311 - DNA, 18 bp, Homo sapiens
gccaatgccccactggca

SEQ ID NO: 3341312 - DNA, 13 bp, Homo sapiens
gccaatggaaacc

SEQ ID NO: 3341313 - DNA, 16 bp, Homo sapiens
gccaatggagactgtc

SEQ ID NO: 3341314 - DNA, 18 bp, Homo sapiens
gccaatgtcgaaacctac

SEQ ID NO: 3341315 - DNA, 16 bp, Homo sapiens
gccaatgtctcctccc

SEQ ID NO: 3341316 - DNA, 20 bp, Homo sapiens
gccaattgctaccgagaagg

SEQ ID NO: 3341317 - DNA, 20 bp, Homo sapiens
gccacaaagctaggatggtt

SEQ ID NO: 3341318 - DNA, 23 bp, Homo sapiens
gccacaacagaataaagcagcct

SEQ ID NO: 3341319 - DNA, 16 bp, Homo sapiens
gccacaaggctggcca

SEQ ID NO: 3341320 - DNA, 16 bp, Homo sapiens
gccacaagtcttccag

SEQ ID NO: 3341321 - DNA, 15 bp, Homo sapiens
gccacacagaccacc

SEQ ID NO: 3341322 - DNA, 20 bp, Homo sapiens
gccacacagaccaccatcca

SEQ ID NO: 3341323 - DNA, 12 bp, Homo sapiens
gccacacccagc

SEQ ID NO: 3341324 - DNA, 16 bp, Homo sapiens
gccacaccctcccccg

SEQ ID NO: 3341325 - DNA, 22 bp, Homo sapiens
gccacaccctcccccgccactc

SEQ ID NO: 3341326 - DNA, 12 bp, Homo sapiens
gccacacctggc

SEQ ID NO: 3341327 - DNA, 20 bp, Homo sapiens
gccacacctggccttaaaga

SEQ ID NO: 3341328 - DNA, 18 bp, Homo sapiens
gccacactattaccatga

SEQ ID NO: 3341329 - DNA, 17 bp, Homo sapiens
gccacagacccctggga

SEQ ID NO: 3341330 - DNA, 18 bp, Homo sapiens
gccacagacccctgggag

SEQ ID NO: 3341331 - DNA, 23 bp, Homo sapiens
gccacagagaagtttgtagccag

SEQ ID NO: 3341332 - DNA, 18 bp, Homo sapiens
gccacagcccccttgccc

SEQ ID NO: 3341333 - DNA, 16 bp, Homo sapiens
gccacagccgcctttg

SEQ ID NO: 3341334 - DNA, 17 bp, Homo sapiens
gccacaggcctccctgt

SEQ ID NO: 3341335 - DNA, 17 bp, Homo sapiens
gccacaggctagatccc

SEQ ID NO: 3341336 - DNA, 20 bp, Homo sapiens
gccacagggcggtgctagct

SEQ ID NO: 3341337 - DNA, 16 bp, Homo sapiens
gccacatcaaaccttt

SEQ ID NO: 3341338 - DNA, 16 bp, Homo sapiens
gccacatggagccccc

SEQ ID NO: 3341339 - DNA, 11 bp, Homo sapiens
gccacatttct

SEQ ID NO: 3341340 - DNA, 20 bp, Homo sapiens
gccacatttctgatcagagg

SEQ ID NO: 3341341 - DNA, 16 bp, Homo sapiens
gccacatttggttcta

SEQ ID NO: 3341342 - DNA, 14 bp, Homo sapiens
gccaccaaagctgc

SEQ ID NO: 3341343 - DNA, 16 bp, Homo sapiens
gccaccaaagctgccc

SEQ ID NO: 3341344 - DNA, 17 bp, Homo sapiens
gccaccaaagctgccca

SEQ ID NO: 3341345 - DNA, 13 bp, Homo sapiens
gccaccacacaca

SEQ ID NO: 3341346 - DNA, 16 bp, Homo sapiens
gccaccacgtccagct

SEQ ID NO: 3341347 - DNA, 18 bp, Homo sapiens
gccaccaggccacctccc

SEQ ID NO: 3341348 - DNA, 12 bp, Homo sapiens
gccaccaggctg

SEQ ID NO: 3341349 - DNA, 13 bp, Homo sapiens
gccaccaggctgg

SEQ ID NO: 3341350 - DNA, 17 bp, Homo sapiens
gccaccaggctggcgca

SEQ ID NO: 3341351 - DNA, 18 bp, Homo sapiens
gccaccaggctggcgcag

SEQ ID NO: 3341352 - DNA, 19 bp, Homo sapiens
gccaccaggctggcgcagc

SEQ ID NO: 3341353 - DNA, 17 bp, Homo sapiens
gccaccatggccagcca

SEQ ID NO: 3341354 - DNA, 18 bp, Homo sapiens
gccaccatggccagccaa

SEQ ID NO: 3341355 - DNA, 14 bp, Homo sapiens
gccaccattcctgg

SEQ ID NO: 3341356 - DNA, 22 bp, Homo sapiens
gccaccattcctggaaaccaca

SEQ ID NO: 3341357 - DNA, 17 bp, Homo sapiens
gccacccaagcctgctg

SEQ ID NO: 3341358 - DNA, 18 bp, Homo sapiens
gccacccaagcctgctgg

SEQ ID NO: 3341359 - DNA, 22 bp, Homo sapiens
gccacccaagcctgctggctgc

SEQ ID NO: 3341360 - DNA, 12 bp, Homo sapiens
gccacccactca

SEQ ID NO: 3341361 - DNA, 13 bp, Homo sapiens
gccacccactcag

SEQ ID NO: 3341362 - DNA, 18 bp, Homo sapiens
gccacccactcaggattg

SEQ ID NO: 3341363 - DNA, 16 bp, Homo sapiens
gccaccccatgtgcct

SEQ ID NO: 3341364 - DNA, 18 bp, Homo sapiens
gccaccccgggctctctg

SEQ ID NO: 3341365 - DNA, 22 bp, Homo sapiens
gccacccgtggggtgctgccct

SEQ ID NO: 3341366 - DNA, 21 bp, Homo sapiens
gccacccgttctgctggcctg

SEQ ID NO: 3341367 - DNA, 12 bp, Homo sapiens
gccaccctagcc

SEQ ID NO: 3341368 - DNA, 13 bp, Homo sapiens
gccaccctgggga

SEQ ID NO: 3341369 - DNA, 15 bp, Homo sapiens
gccaccgctgccagc

SEQ ID NO: 3341370 - DNA, 15 bp, Homo sapiens
gccacctatctcgtg

SEQ ID NO: 3341371 - DNA, 22 bp, Homo sapiens
gccacctatctcgtgggagagc

SEQ ID NO: 3341372 - DNA, 13 bp, Homo sapiens
gccacctcagggc

SEQ ID NO: 3341373 - DNA, 14 bp, Homo sapiens
gccacctcagggca

SEQ ID NO: 3341374 - DNA, 13 bp, Homo sapiens
gccacctcctccc

SEQ ID NO: 3341375 - DNA, 12 bp, Homo sapiens
gccacctctcca

SEQ ID NO: 3341376 - DNA, 14 bp, Homo sapiens
gccacctctccaag

SEQ ID NO: 3341377 - DNA, 23 bp, Homo sapiens
gccacctctccaagggcttctgc

SEQ ID NO: 3341378 - DNA, 15 bp, Homo sapiens
gccacctctccctca

SEQ ID NO: 3341379 - DNA, 16 bp, Homo sapiens
gccacctctgtcattt

SEQ ID NO: 3341380 - DNA, 22 bp, Homo sapiens
gccacctgaggtgggcccagga

SEQ ID NO: 3341381 - DNA, 15 bp, Homo sapiens
gccacgaccagcccc

SEQ ID NO: 3341382 - DNA, 16 bp, Homo sapiens
gccacgcactgggcca

SEQ ID NO: 3341383 - DNA, 20 bp, Homo sapiens
gccacgcactgggccacgga

SEQ ID NO: 3341384 - DNA, 22 bp, Homo sapiens
gccacgcactgggccacggagg

SEQ ID NO: 3341385 - DNA, 14 bp, Homo sapiens
gccacgccccagcc

SEQ ID NO: 3341386 - DNA, 17 bp, Homo sapiens
gccacgccccagcccga

SEQ ID NO: 3341387 - DNA, 17 bp, Homo sapiens
gccacgctccagctgcc

SEQ ID NO: 3341388 - DNA, 13 bp, Homo sapiens
gccacgctgtcct

SEQ ID NO: 3341389 - DNA, 22 bp, Homo sapiens
gccacgctgtcctctcgagccc

SEQ ID NO: 3341390 - DNA, 17 bp, Homo sapiens
gccacggccaggccaga

SEQ ID NO: 3341391 - DNA, 18 bp, Homo sapiens
gccacggccaggccagag

SEQ ID NO: 3341392 - DNA, 15 bp, Homo sapiens
gccacggcctggctg

SEQ ID NO: 3341393 - DNA, 16 bp, Homo sapiens
gccacgtcccagcatc

SEQ ID NO: 3341394 - DNA, 20 bp, Homo sapiens
gccacgtggtcactgtgcac

SEQ ID NO: 3341395 - DNA, 22 bp, Homo sapiens
gccacgttggagaagcccgtgt

SEQ ID NO: 3341396 - DNA, 22 bp, Homo sapiens
gccactacactccagcctgagc

SEQ ID NO: 3341397 - DNA, 23 bp, Homo sapiens
gccactacactccagcctgagca

SEQ ID NO: 3341398 - DNA, 16 bp, Homo sapiens
gccactagtaagtaat

SEQ ID NO: 3341399 - DNA, 18 bp, Homo sapiens
gccactcactaggccccc

SEQ ID NO: 3341400 - DNA, 19 bp, Homo sapiens
gccactcactaggccccca

SEQ ID NO: 3341401 - DNA, 22 bp, Homo sapiens
gccactcagccatttccccctc

SEQ ID NO: 3341402 - DNA, 18 bp, Homo sapiens
gccactccagacccctgg

SEQ ID NO: 3341403 - DNA, 14 bp, Homo sapiens
gccactccctgagc

SEQ ID NO: 3341404 - DNA, 15 bp, Homo sapiens
gccactccctgagct

SEQ ID NO: 3341405 - DNA, 20 bp, Homo sapiens
gccactccctgagctttggg

SEQ ID NO: 3341406 - DNA, 21 bp, Homo sapiens
gccactccgagaggtgggcca

SEQ ID NO: 3341407 - DNA, 16 bp, Homo sapiens
gccactcctccctccg

SEQ ID NO: 3341408 - DNA, 13 bp, Homo sapiens
gccactcctgtcc

SEQ ID NO: 3341409 - DNA, 22 bp, Homo sapiens
gccactcctgtcccgccttcct

SEQ ID NO: 3341410 - DNA, 12 bp, Homo sapiens
gccactccttgt

SEQ ID NO: 3341411 - DNA, 21 bp, Homo sapiens
gccactctatgagttggactt

SEQ ID NO: 3341412 - DNA, 18 bp, Homo sapiens
gccactctcttccctttc

SEQ ID NO: 3341413 - DNA, 17 bp, Homo sapiens
gccactgaagctgggat

SEQ ID NO: 3341414 - DNA, 17 bp, Homo sapiens
gccactgagcctggccc

SEQ ID NO: 3341415 - DNA, 20 bp, Homo sapiens
gccactgcaccgggccacag

SEQ ID NO: 3341416 - DNA, 14 bp, Homo sapiens
gccactgccaggca

SEQ ID NO: 3341417 - DNA, 22 bp, Homo sapiens
gccactgccaggcacctggcct

SEQ ID NO: 3341418 - DNA, 24 bp, Homo sapiens
gccactgccaggcacctggcctgc

SEQ ID NO: 3341419 - DNA, 15 bp, Homo sapiens
gccactgccccccga

SEQ ID NO: 3341420 - DNA, 22 bp, Homo sapiens
gccactgccccccgaggctgct

SEQ ID NO: 3341421 - DNA, 16 bp, Homo sapiens
gccactgcccgagctg

SEQ ID NO: 3341422 - DNA, 17 bp, Homo sapiens
gccactgcccgagctgg

SEQ ID NO: 3341423 - DNA, 18 bp, Homo sapiens
gccactgcccgagctggt

SEQ ID NO: 3341424 - DNA, 21 bp, Homo sapiens
gccactgcgggagctctgtat

SEQ ID NO: 3341425 - DNA, 20 bp, Homo sapiens
gccactgctttccagcctgg

SEQ ID NO: 3341426 - DNA, 18 bp, Homo sapiens
gccactggggactttatt

SEQ ID NO: 3341427 - DNA, 16 bp, Homo sapiens
gccactgtggccagag

SEQ ID NO: 3341428 - DNA, 19 bp, Homo sapiens
gccactgtggccagagctg

SEQ ID NO: 3341429 - DNA, 18 bp, Homo sapiens
gccacttaatgtatgtta

SEQ ID NO: 3341430 - DNA, 15 bp, Homo sapiens
gccacttcctttgtg

SEQ ID NO: 3341431 - DNA, 15 bp, Homo sapiens
gccacttctccccag

SEQ ID NO: 3341432 - DNA, 19 bp, Homo sapiens
gccacttcttaaaggcctg

SEQ ID NO: 3341433 - DNA, 19 bp, Homo sapiens
gccactttacccacctaga

SEQ ID NO: 3341434 - DNA, 19 bp, Homo sapiens
gccactttcagagccccca

SEQ ID NO: 3341435 - DNA, 20 bp, Homo sapiens
gccactttgactcagaggct

SEQ ID NO: 3341436 - DNA, 22 bp, Homo sapiens
gccactttggtacatggccagt

SEQ ID NO: 3341437 - DNA, 23 bp, Homo sapiens
gccacttttgactagggattcag

SEQ ID NO: 3341438 - DNA, 21 bp, Homo sapiens
gccagaaggagggcagagcca

SEQ ID NO: 3341439 - DNA, 18 bp, Homo sapiens
gccagacgctgccgctgc

SEQ ID NO: 3341440 - DNA, 17 bp, Homo sapiens
gccagactctaggttat

SEQ ID NO: 3341441 - DNA, 12 bp, Homo sapiens
gccagagaggag

SEQ ID NO: 3341442 - DNA, 15 bp, Homo sapiens
gccagagaggagcac

SEQ ID NO: 3341443 - DNA, 14 bp, Homo sapiens
gccagagagggccc

SEQ ID NO: 3341444 - DNA, 15 bp, Homo sapiens
gccagagatgcaata

SEQ ID NO: 3341445 - DNA, 12 bp, Homo sapiens
gccagagccaaa

SEQ ID NO: 3341446 - DNA, 22 bp, Homo sapiens
gccagagcccttcactgccatg

SEQ ID NO: 3341447 - DNA, 13 bp, Homo sapiens
gccagagcctggg

SEQ ID NO: 3341448 - DNA, 16 bp, Homo sapiens
gccagagctggaaggc

SEQ ID NO: 3341449 - DNA, 22 bp, Homo sapiens
gccagagctggaaggcagggca

SEQ ID NO: 3341450 - DNA, 23 bp, Homo sapiens
gccagagctggaaggcagggcag

SEQ ID NO: 3341451 - DNA, 15 bp, Homo sapiens
gccagagctgggagg

SEQ ID NO: 3341452 - DNA, 21 bp, Homo sapiens
gccagagctgggtggggacag

SEQ ID NO: 3341453 - DNA, 15 bp, Homo sapiens
gccagaggcccccag

SEQ ID NO: 3341454 - DNA, 20 bp, Homo sapiens
gccagaggcccccagcccag

SEQ ID NO: 3341455 - DNA, 24 bp, Homo sapiens
gccagaggcccccagcccagggct

SEQ ID NO: 3341456 - DNA, 12 bp, Homo sapiens
gccagaggctgg

SEQ ID NO: 3341457 - DNA, 20 bp, Homo sapiens
gccagagggagtgacagagg

SEQ ID NO: 3341458 - DNA, 19 bp, Homo sapiens
gccagagggcttgtgaaca

SEQ ID NO: 3341459 - DNA, 13 bp, Homo sapiens
gccagaggtgctt

SEQ ID NO: 3341460 - DNA, 16 bp, Homo sapiens
gccagaggtgcttcac

SEQ ID NO: 3341461 - DNA, 12 bp, Homo sapiens
gccagaggtggg

SEQ ID NO: 3341462 - DNA, 19 bp, Homo sapiens
gccagaggtgggcaggtgg

SEQ ID NO: 3341463 - DNA, 20 bp, Homo sapiens
gccagaggtgggcaggtggt

SEQ ID NO: 3341464 - DNA, 22 bp, Homo sapiens
gccagaggtgggcaggtggtgg

SEQ ID NO: 3341465 - DNA, 13 bp, Homo sapiens
gccagagtggcct

SEQ ID NO: 3341466 - DNA, 15 bp, Homo sapiens
gccagataaaatgtt

SEQ ID NO: 3341467 - DNA, 21 bp, Homo sapiens
gccagatgcacatccctggaa

SEQ ID NO: 3341468 - DNA, 20 bp, Homo sapiens
gccagatgcaggacaggagg

SEQ ID NO: 3341469 - DNA, 21 bp, Homo sapiens
gccagatgcaggacaggaggc

SEQ ID NO: 3341470 - DNA, 22 bp, Homo sapiens
gccagatggactccagcctgcc

SEQ ID NO: 3341471 - DNA, 15 bp, Homo sapiens
gccagattgccatcc

SEQ ID NO: 3341472 - DNA, 16 bp, Homo sapiens
gccagatttgtctttt

SEQ ID NO: 3341473 - DNA, 14 bp, Homo sapiens
gccagcaacgcttg

SEQ ID NO: 3341474 - DNA, 19 bp, Homo sapiens
gccagcaagagttaggggc

SEQ ID NO: 3341475 - DNA, 15 bp, Homo sapiens
gcagcaccctccccc

SEQ ID NO: 3341476 - DNA, 20 bp, Homo sapiens
gcagcaccctcccccgcagc

SEQ ID NO: 3341477 - DNA, 14 bp, Homo sapiens
gcagcacctccagg

SEQ ID NO: 3341478 - DNA, 19 bp, Homo sapiens
gcagcacggacaataaacc

SEQ ID NO: 3341479 - DNA, 12 bp, Homo sapiens
gcagcactcccc

SEQ ID NO: 3341480 - DNA, 13 bp, Homo sapiens
gcagcactcccca

SEQ ID NO: 3341481 - DNA, 16 bp, Homo sapiens
gcagcactccccagag

SEQ ID NO: 3341482 - DNA, 20 bp, Homo sapiens
gcagcactccccagagctgt

SEQ ID NO: 3341483 - DNA, 23 bp, Homo sapiens
gcagcagaggacagtctggagaa

SEQ ID NO: 3341484 - DNA, 18 bp, Homo sapiens
gcagcagataactttttt

SEQ ID NO: 3341485 - DNA, 13 bp, Homo sapiens
gcagcagcccagc

SEQ ID NO: 3341486 - DNA, 14 bp, Homo sapiens
gcagcagcccagct

SEQ ID NO: 3341487 - DNA, 15 bp, Homo sapiens
gcagcagcccagctt

SEQ ID NO: 3341488 - DNA, 17 bp, Homo sapiens
gcagcagctaggactga

SEQ ID NO: 3341489 - DNA, 23 bp, Homo sapiens
gcagcagctaggactgaggagtg

SEQ ID NO: 3341490 - DNA, 15 bp, Homo sapiens
gcagcagctctgagc

SEQ ID NO: 3341491 - DNA, 19 bp, Homo sapiens
gcagcaggaactctggacc

SEQ ID NO: 3341492 - DNA, 21 bp, Homo sapiens
gcagcagtgagtctcttcaga

SEQ ID NO: 3341493 - DNA, 20 bp, Homo sapiens
gcagcagttggatcttttga

SEQ ID NO: 3341494 - DNA, 15 bp, Homo sapiens
gcagcatcctccaaa

SEQ ID NO: 3341495 - DNA, 15 bp, Homo sapiens
gcagcatctgctaat

SEQ ID NO: 3341496 - DNA, 14 bp, Homo sapiens
gcagcatcttctgg

SEQ ID NO: 3341497 - DNA, 12 bp, Homo sapiens
gcagcatggaaa

SEQ ID NO: 3341498 - DNA, 16 bp, Homo sapiens
gcagcatggagagagg

SEQ ID NO: 3341499 - DNA, 15 bp, Homo sapiens
gcagcatggtccctg

SEQ ID NO: 3341500 - DNA, 23 bp, Homo sapiens
gcagccagccagtcttgcctagg

SEQ ID NO: 3341501 - DNA, 19 bp, Homo sapiens
gcagccagccggtgcctgg

SEQ ID NO: 3341502 - DNA, 19 bp, Homo sapiens
gcagccagctccccacacc

SEQ ID NO: 3341503 - DNA, 14 bp, Homo sapiens
gcactggtggcccg

SEQ ID NO: 3341504 - DNA, 19 bp, Homo sapiens
gcactgtagttctaagact

SEQ ID NO: 3341505 - DNA, 15 bp, Homo sapiens
gcactgtatgctgga

SEQ ID NO: 3341506 - DNA, 21 bp, Homo sapiens
gcactgtcactttgctctggg

SEQ ID NO: 3341507 - DNA, 17 bp, Homo sapiens
gcactgtcccttgcctc

SEQ ID NO: 3341508 - DNA, 20 bp, Homo sapiens
gcactgtctcagtttcactt

SEQ ID NO: 3341509 - DNA, 11 bp, Homo sapiens
gcactgtgcta

SEQ ID NO: 3341510 - DNA, 19 bp, Homo sapiens
gcacttaaggcactctgtt

SEQ ID NO: 3341511 - DNA, 21 bp, Homo sapiens
gcacttaatttgtaaacttct

SEQ ID NO: 3341512 - DNA, 23 bp, Homo sapiens
gcacttaatttgtaaacttctga

SEQ ID NO: 3341513 - DNA, 23 bp, Homo sapiens
gcacttacaccagtttgactgtg

SEQ ID NO: 3341514 - DNA, 15 bp, Homo sapiens
gcacttagcaggcac

SEQ ID NO: 3341515 - DNA, 19 bp, Homo sapiens
gcacttagctatcagaaga

SEQ ID NO: 3341516 - DNA, 16 bp, Homo sapiens
gcacttatatagcacc

SEQ ID NO: 3341517 - DNA, 14 bp, Homo sapiens
gcacttatggtaat

SEQ ID NO: 3341518 - DNA, 17 bp, Homo sapiens
gcacttcagaattccat

SEQ ID NO: 3341519 - DNA, 24 bp, Homo sapiens
gcacttgacaccaaccagacagca

SEQ ID NO: 3341520 - DNA, 21 bp, Homo sapiens
gcacttgagaaccagtctcct

SEQ ID NO: 3341521 - DNA, 20 bp, Homo sapiens
gcacttgattaagcttttgt

SEQ ID NO: 3341522 - DNA, 16 bp, Homo sapiens
gcacttgcgtcctgca

SEQ ID NO: 3341523 - DNA, 14 bp, Homo sapiens
gcacttggcctcag

SEQ ID NO: 3341524 - DNA, 21 bp, Homo sapiens
gcacttggcctcagctggctg

SEQ ID NO: 3341525 - DNA, 23 bp, Homo sapiens
gcacttggcctcagctggctgta

SEQ ID NO: 3341526 - DNA, 19 bp, Homo sapiens
gcacttgtaactcaccgtg

SEQ ID NO: 3341527 - DNA, 12 bp, Homo sapiens
gcacttgtatat

SEQ ID NO: 3341528 - DNA, 15 bp, Homo sapiens
gcacttgtatatacg

SEQ ID NO: 3341529 - DNA, 17 bp, Homo sapiens
gcacttgtatttaattc

SEQ ID NO: 3341530 - DNA, 17 bp, Homo sapiens
gcactttagcagatgtg

SEQ ID NO: 3341531 - DNA, 21 bp, Homo sapiens
gcactttcattgccagtgtct

SEQ ID NO: 3341532 - DNA, 20 bp, Homo sapiens
gcactttccacttcttcctt

SEQ ID NO: 3341533 - DNA, 23 bp, Homo sapiens
gcactttccacttcttcctttct

SEQ ID NO: 3341534 - DNA, 19 bp, Homo sapiens
gcactttgaaatacctcat

SEQ ID NO: 3341535 - DNA, 18 bp, Homo sapiens
gcacctggcctgctggga

SEQ ID NO: 3341536 - DNA, 19 bp, Homo sapiens
gcacctgtactcaggaggc

SEQ ID NO: 3341537 - DNA, 18 bp, Homo sapiens
gcacctgtagtcccagct

SEQ ID NO: 3341538 - DNA, 11 bp, Homo sapiens
gcacctgtccc

SEQ ID NO: 3341539 - DNA, 20 bp, Homo sapiens
gcacctgtccccaccctcca

SEQ ID NO: 3341540 - DNA, 21 bp, Homo sapiens
gcacctgtccccaccctccac

SEQ ID NO: 3341541 - DNA, 18 bp, Homo sapiens
gcaccttaccaactttct

SEQ ID NO: 3341542 - DNA, 20 bp, Homo sapiens
gcaccttcactctccagggt

SEQ ID NO: 3341543 - DNA, 15 bp, Homo sapiens
gcaccttcctcactt

SEQ ID NO: 3341544 - DNA, 21 bp, Homo sapiens
gcaccttctttctggactggc

SEQ ID NO: 3341545 - DNA, 20 bp, Homo sapiens
gcaccttgtgtctgtacacg

SEQ ID NO: 3341546 - DNA, 16 bp, Homo sapiens
gcacctttgcacagga

SEQ ID NO: 3341547 - DNA, 15 bp, Homo sapiens
gcacgaaatgttatt

SEQ ID NO: 3341548 - DNA, 15 bp, Homo sapiens
gcacgagctggaacc

SEQ ID NO: 3341549 - DNA, 23 bp, Homo sapiens
gcacgagctggaacccacgagga

SEQ ID NO: 3341550 - DNA, 10 bp, Homo sapiens
gcacgcacac

SEQ ID NO: 3341551 - DNA, 12 bp, Homo sapiens
gcacgcacacac

SEQ ID NO: 3341552 - DNA, 16 bp, Homo sapiens
gcacgcacacacacaa

SEQ ID NO: 3341553 - DNA, 14 bp, Homo sapiens
gcacgcaggaccag

SEQ ID NO: 3341554 - DNA, 13 bp, Homo sapiens
gcacgccctactc

SEQ ID NO: 3341555 - DNA, 23 bp, Homo sapiens
gcacgccctactccactgccctg

SEQ ID NO: 3341556 - DNA, 15 bp, Homo sapiens
gcacggacaataaac

SEQ ID NO: 3341557 - DNA, 16 bp, Homo sapiens
gcacggacaataaacc

SEQ ID NO: 3341558 - DNA, 18 bp, Homo sapiens
gcacggagccgcgggaca

SEQ ID NO: 3341559 - DNA, 23 bp, Homo sapiens
gcacggcgtggtgtgtccctgga

SEQ ID NO: 3341560 - DNA, 13 bp, Homo sapiens
gcacgtcatggga

SEQ ID NO: 3341561 - DNA, 20 bp, Homo sapiens
gcacgtcgcccgctgagctg

SEQ ID NO: 3341562 - DNA, 23 bp, Homo sapiens
gcacgtggcatgtggcctgtggc

SEQ ID NO: 3341563 - DNA, 14 bp, Homo sapiens
gcacgtgtgtgcac

SEQ ID NO: 3341564 - DNA, 19 bp, Homo sapiens
gcacgtttaaagttctgtg

SEQ ID NO: 3341565 - DNA, 20 bp, Homo sapiens
gcactaaaaagttgaaccat

SEQ ID NO: 3341566 - DNA, 18 bp, Homo sapiens
gcactaaagccagcctga

SEQ ID NO: 3341567 - DNA, 21 bp, Homo sapiens
gcactaaagccagcctgacct

SEQ ID NO: 3341568 - DNA, 15 bp, Homo sapiens
gcactaaatatgaac

SEQ ID NO: 3341569 - DNA, 15 bp, Homo sapiens
gcactacataaactg

SEQ ID NO: 3341570 - DNA, 17 bp, Homo sapiens
gcactactcctctgcag

SEQ ID NO: 3341571 - DNA, 16 bp, Homo sapiens
gcactagcctttggct

SEQ ID NO: 3341572 - DNA, 22 bp, Homo sapiens
gcactagcctttggctctggag

SEQ ID NO: 3341573 - DNA, 23 bp, Homo sapiens
gcactagtttgattattatgttt

SEQ ID NO: 3341574 - DNA, 22 bp, Homo sapiens
gcactataatgtaagctctact

SEQ ID NO: 3341575 - DNA, 18 bp, Homo sapiens
gcactatatgtttacaca

SEQ ID NO: 3341576 - DNA, 22 bp, Homo sapiens
gcactatgaggaataattattt

SEQ ID NO: 3341577 - DNA, 12 bp, Homo sapiens
gcactattttat

SEQ ID NO: 3341578 - DNA, 13 bp, Homo sapiens
gcactattttata

SEQ ID NO: 3341579 - DNA, 18 bp, Homo sapiens
gcactattttatatttaa

SEQ ID NO: 3341580 - DNA, 23 bp, Homo sapiens
gcactcaaaagctgggaaccagc

SEQ ID NO: 3341581 - DNA, 19 bp, Homo sapiens
gcactcaaccttaagacct

SEQ ID NO: 3341582 - DNA, 21 bp, Homo sapiens
gcactcaactctgagcccata

SEQ ID NO: 3341583 - DNA, 16 bp, Homo sapiens
gcactcacagacctgg

SEQ ID NO: 3341584 - DNA, 17 bp, Homo sapiens
gcactcacagacctgga

SEQ ID NO: 3341585 - DNA, 19 bp, Homo sapiens
gcactcacagacctggagc

SEQ ID NO: 3341586 - DNA, 17 bp, Homo sapiens
gcactcagccacgacca

SEQ ID NO: 3341587 - DNA, 22 bp, Homo sapiens
gcactcagccacgaccagcccc

SEQ ID NO: 3341588 - DNA, 14 bp, Homo sapiens
gcactccaaacctg

SEQ ID NO: 3341589 - DNA, 15 bp, Homo sapiens
gcactccagcctggg

SEQ ID NO: 3341590 - DNA, 19 bp, Homo sapiens
gcactccccagagctgtgc

SEQ ID NO: 3341591 - DNA, 20 bp, Homo sapiens
gcactccccagagctgtgcc

SEQ ID NO: 3341592 - DNA, 17 bp, Homo sapiens
gcactctaaaaggttca

SEQ ID NO: 3341593 - DNA, 11 bp, Homo sapiens
gcactctagat

SEQ ID NO: 3341594 - DNA, 19 bp, Homo sapiens
gcactctccaccctggctg

SEQ ID NO: 3341595 - DNA, 21 bp, Homo sapiens
gcactctccaccctggctggg

SEQ ID NO: 3341596 - DNA, 14 bp, Homo sapiens
gcactctgttattt

SEQ ID NO: 3341597 - DNA, 15 bp, Homo sapiens
gcactcttaaagcaa

SEQ ID NO: 3341598 - DNA, 20 bp, Homo sapiens
gcactgaaaataccatcagg

SEQ ID NO: 3341599 - DNA, 19 bp, Homo sapiens
gcactgaagtttttgaaat

SEQ ID NO: 3341600 - DNA, 20 bp, Homo sapiens
gcactgaagtttttgaaata

SEQ ID NO: 3341601 - DNA, 12 bp, Homo sapiens
gcactgacattg

SEQ ID NO: 3341602 - DNA, 20 bp, Homo sapiens
gcactgacccttccagacat

SEQ ID NO: 3341603 - DNA, 17 bp, Homo sapiens
gcactgactgggcatag

SEQ ID NO: 3341604 - DNA, 12 bp, Homo sapiens
gcactgagcccc

SEQ ID NO: 3341605 - DNA, 12 bp, Homo sapiens
gcactgagggcc

SEQ ID NO: 3341606 - DNA, 13 bp, Homo sapiens
gcactgagggcca

SEQ ID NO: 3341607 - DNA, 15 bp, Homo sapiens
gcactgagggccaca

SEQ ID NO: 3341608 - DNA, 24 bp, Homo sapiens
gcactgagggccacactattacca

SEQ ID NO: 3341609 - DNA, 12 bp, Homo sapiens
gcactgatttca

SEQ ID NO: 3341610 - DNA, 15 bp, Homo sapiens
gcactgatttcacaa

SEQ ID NO: 3341611 - DNA, 19 bp, Homo sapiens
gcactgatttcacaacaga

SEQ ID NO: 3341612 - DNA, 20 bp, Homo sapiens
gcactgatttcacaacagat

SEQ ID NO: 3341613 - DNA, 14 bp, Homo sapiens
gcactgcagtgatg

SEQ ID NO: 3341614 - DNA, 23 bp, Homo sapiens
gcactgcatgcaaacaagaaacg

SEQ ID NO: 3341615 - DNA, 14 bp, Homo sapiens
gcactgccactggg

SEQ ID NO: 3341616 - DNA, 13 bp, Homo sapiens
gcactgccctgtt

SEQ ID NO: 3341617 - DNA, 20 bp, Homo sapiens
gcactggcattgtccctgtg

SEQ ID NO: 3341618 - DNA, 20 bp, Homo sapiens
gcactggccacccctcccca

SEQ ID NO: 3341619 - DNA, 12 bp, Homo sapiens
gcactggccaga

SEQ ID NO: 3341620 - DNA, 18 bp, Homo sapiens
gcactggccagagagggc

SEQ ID NO: 3341621 - DNA, 21 bp, Homo sapiens
gcactggccagagagggccca

SEQ ID NO: 3341622 - DNA, 23 bp, Homo sapiens
gcactggccagagagggcccagc

SEQ ID NO: 3341623 - DNA, 15 bp, Homo sapiens
gcactggctctctcc

SEQ ID NO: 3341624 - DNA, 19 bp, Homo sapiens
gcactggctctctccagga

SEQ ID NO: 3341625 - DNA, 23 bp, Homo sapiens
gcactgggatgagccgctgtgag

SEQ ID NO: 3341626 - DNA, 15 bp, Homo sapiens
gcactggggagcccg

SEQ ID NO: 3341627 - DNA, 19 bp, Homo sapiens
gcactggggagcccgtctc

SEQ ID NO: 3341628 - DNA, 14 bp, Homo sapiens
gcacagcccagggc

SEQ ID NO: 3341629 - DNA, 12 bp, Homo sapiens
gcacagccctcc

SEQ ID NO: 3341630 - DNA, 12 bp, Homo sapiens
gcacagccctgg

SEQ ID NO: 3341631 - DNA, 23 bp, Homo sapiens
gcacagctgtagtggggttctag

SEQ ID NO: 3341632 - DNA, 20 bp, Homo sapiens
gcacagcttgacctgaggct

SEQ ID NO: 3341633 - DNA, 21 bp, Homo sapiens
gcacaggactgattctgggat

SEQ ID NO: 3341634 - DNA, 17 bp, Homo sapiens
gcacaggatgctggcct

SEQ ID NO: 3341635 - DNA, 12 bp, Homo sapiens
gcacagggagaa

SEQ ID NO: 3341636 - DNA, 16 bp, Homo sapiens
gcacagggcaccagag

SEQ ID NO: 3341637 - DNA, 16 bp, Homo sapiens
gcacagggcagtggga

SEQ ID NO: 3341638 - DNA, 23 bp, Homo sapiens
gcacagggtctgctctttctctg

SEQ ID NO: 3341639 - DNA, 14 bp, Homo sapiens
gcacaggtcccacc

SEQ ID NO: 3341640 - DNA, 19 bp, Homo sapiens
gcacaggtcccacctccag

SEQ ID NO: 3341641 - DNA, 22 bp, Homo sapiens
gcacaggtcccacctccagccc

SEQ ID NO: 3341642 - DNA, 20 bp, Homo sapiens
gcacaggtcgggcgcaggat

SEQ ID NO: 3341643 - DNA, 16 bp, Homo sapiens
gcacagtgaagtgctg

SEQ ID NO: 3341644 - DNA, 15 bp, Homo sapiens
gcacagtgcatctca

SEQ ID NO: 3341645 - DNA, 18 bp, Homo sapiens
gcacagtgcatctcagcc

SEQ ID NO: 3341646 - DNA, 19 bp, Homo sapiens
gcacagtgcatctcagccc

SEQ ID NO: 3341647 - DNA, 18 bp, Homo sapiens
gcacagtgggagctgagc

SEQ ID NO: 3341648 - DNA, 17 bp, Homo sapiens
gcacagtgtgtgactta

SEQ ID NO: 3341649 - DNA, 22 bp, Homo sapiens
gcacagttagttgtgaaagaaa

SEQ ID NO: 3341650 - DNA, 21 bp, Homo sapiens
gcacagttgaagggaggggct

SEQ ID NO: 3341651 - DNA, 12 bp, Homo sapiens
gcacagtttgaa

SEQ ID NO: 3341652 - DNA, 11 bp, Homo sapiens
gcacatacatt

SEQ ID NO: 3341653 - DNA, 15 bp, Homo sapiens
gcacatacattaaaa

SEQ ID NO: 3341654 - DNA, 14 bp, Homo sapiens
gcacatagagaggg

SEQ ID NO: 3341655 - DNA, 13 bp, Homo sapiens
gcacatccctgga

SEQ ID NO: 3341656 - DNA, 13 bp, Homo sapiens
gcacatctgcatt

SEQ ID NO: 3341657 - DNA, 19 bp, Homo sapiens
gcacatgcctgtagtccca

SEQ ID NO: 3341658 - DNA, 14 bp, Homo sapiens
gcacatgcgcactc

SEQ ID NO: 3341659 - DNA, 20 bp, Homo sapiens
gcacatgctgagtctcccaa

SEQ ID NO: 3341660 - DNA, 23 bp, Homo sapiens
gcacatgctgagtctcccaaggc

SEQ ID NO: 3341661 - DNA, 21 bp, Homo sapiens
gcacatgctggccagcctggg

SEQ ID NO: 3341662 - DNA, 22 bp, Homo sapiens
gcacatggaggagcttggggga

SEQ ID NO: 3341663 - DNA, 13 bp, Homo sapiens
gcacatgtcttgt

SEQ ID NO: 3341664 - DNA, 20 bp, Homo sapiens
gcacatgtcttgtacatgtg

SEQ ID NO: 3341665 - DNA, 18 bp, Homo sapiens
gcacatgtgccacacagt

SEQ ID NO: 3341666 - DNA, 12 bp, Homo sapiens
gcacatgttcat

SEQ ID NO: 3341667 - DNA, 12 bp, Homo sapiens
gcacatgtttcc

SEQ ID NO: 3341668 - DNA, 16 bp, Homo sapiens
gcacatttcagggaga

SEQ ID NO: 3341669 - DNA, 14 bp, Homo sapiens
gcacatttctggat

SEQ ID NO: 3341670 - DNA, 13 bp, Homo sapiens
gcaccaaccacag

SEQ ID NO: 3341671 - DNA, 14 bp, Homo sapiens
gcaccaatgcccag

SEQ ID NO: 3341672 - DNA, 18 bp, Homo sapiens
gcaccaccaagccaaggg

SEQ ID NO: 3341673 - DNA, 11 bp, Homo sapiens
gcaccacccta

SEQ ID NO: 3341674 - DNA, 14 bp, Homo sapiens
gcaccactctcctt

SEQ ID NO: 3341675 - DNA, 20 bp, Homo sapiens
gcaccactgcactccagcct

SEQ ID NO: 3341676 - DNA, 23 bp, Homo sapiens
gcaccagagtgaaagggctatgg

SEQ ID NO: 3341677 - DNA, 15 bp, Homo sapiens
gcaccagcatccacc

SEQ ID NO: 3341678 - DNA, 17 bp, Homo sapiens
gcaccagcatccacctt

SEQ ID NO: 3341679 - DNA, 11 bp, Homo sapiens
gcaccagccag

SEQ ID NO: 3341680 - DNA, 19 bp, Homo sapiens
gcaccagccagcgtagcag

SEQ ID NO: 3341681 - DNA, 15 bp, Homo sapiens
gcaccagccccctgg

SEQ ID NO: 3341682 - DNA, 15 bp, Homo sapiens
gcaccagctctgtgg

SEQ ID NO: 3341683 - DNA, 17 bp, Homo sapiens
gcaccagctctgtggcc

SEQ ID NO: 3341684 - DNA, 19 bp, Homo sapiens
gcaccagctctgtggcctg

SEQ ID NO: 3341685 - DNA, 11 bp, Homo sapiens
gcaccagctgc

SEQ ID NO: 3341686 - DNA, 16 bp, Homo sapiens
gcaccagctgctctgc

SEQ ID NO: 3341687 - DNA, 19 bp, Homo sapiens
gcaccagctgctctgcccc

SEQ ID NO: 3341688 - DNA, 20 bp, Homo sapiens
gcaccatcacaatacagata

SEQ ID NO: 3341689 - DNA, 14 bp, Homo sapiens
gcaccatctgcttg

SEQ ID NO: 3341690 - DNA, 15 bp, Homo sapiens
gcaccattctcctgc

SEQ ID NO: 3341691 - DNA, 20 bp, Homo sapiens
gcaccattctcctgcctcag

SEQ ID NO: 3341692 - DNA, 23 bp, Homo sapiens
gcaccattctgactcggtttctc

SEQ ID NO: 3341693 - DNA, 16 bp, Homo sapiens
gcacccaactactgag

SEQ ID NO: 3341694 - DNA, 19 bp, Homo sapiens
gcacccacaagtgccactg

SEQ ID NO: 3341695 - DNA, 15 bp, Homo sapiens
gcacccactcaccag

SEQ ID NO: 3341696 - DNA, 13 bp, Homo sapiens
gcaccccaaggct

SEQ ID NO: 3341697 - DNA, 12 bp, Homo sapiens
gcacccccacaa

SEQ ID NO: 3341698 - DNA, 14 bp, Homo sapiens
gcaccccccaagct

SEQ ID NO: 3341699 - DNA, 21 bp, Homo sapiens
gcacccccctgttctaagggg

SEQ ID NO: 3341700 - DNA, 13 bp, Homo sapiens
gcacccccgcacc

SEQ ID NO: 3341701 - DNA, 21 bp, Homo sapiens
gcaccccctgctccaccagca

SEQ ID NO: 3341702 - DNA, 23 bp, Homo sapiens
gcaccccgatgtggacctctact

SEQ ID NO: 3341703 - DNA, 15 bp, Homo sapiens
gcaccccggcctcag

SEQ ID NO: 3341704 - DNA, 13 bp, Homo sapiens
gcaccccttctct

SEQ ID NO: 3341705 - DNA, 17 bp, Homo sapiens
gcaccccttctctcctc

SEQ ID NO: 3341706 - DNA, 15 bp, Homo sapiens
gcacccgcctctccc

SEQ ID NO: 3341707 - DNA, 19 bp, Homo sapiens
gcacccggcccctgctggt

SEQ ID NO: 3341708 - DNA, 20 bp, Homo sapiens
gcacccggggccagagacat

SEQ ID NO: 3341709 - DNA, 15 bp, Homo sapiens
gcaccctccaccctg

SEQ ID NO: 3341710 - DNA, 19 bp, Homo sapiens
gcaccctccaccctgtccc

SEQ ID NO: 3341711 - DNA, 19 bp, Homo sapiens
gcaccctcgatgaagccca

SEQ ID NO: 3341712 - DNA, 17 bp, Homo sapiens
gcaccctctcctggggg

SEQ ID NO: 3341713 - DNA, 18 bp, Homo sapiens
gcaccctctcctgggggt

SEQ ID NO: 3341714 - DNA, 12 bp, Homo sapiens
gcaccctctggc

SEQ ID NO: 3341715 - DNA, 18 bp, Homo sapiens
gcaccctgcacctgctgc

SEQ ID NO: 3341716 - DNA, 22 bp, Homo sapiens
gcaccctggaaaggggagttga

SEQ ID NO: 3341717 - DNA, 12 bp, Homo sapiens
gatctttcagga

SEQ ID NO: 3341718 - DNA, 20 bp, Homo sapiens
gatctttctttccaaaacat

SEQ ID NO: 3341719 - DNA, 17 bp, Homo sapiens
gatctttgcagacaggc

SEQ ID NO: 3341720 - DNA, 13 bp, Homo sapiens
gatgaaaagattt

SEQ ID NO: 3341721 - DNA, 14 bp, Homo sapiens
gatgaaataatttt

SEQ ID NO: 3341722 - DNA, 21 bp, Homo sapiens
gatgaaatgaggtcagagcct

SEQ ID NO: 3341723 - DNA, 22 bp, Homo sapiens
gatgaactcttagaaatgaagg

SEQ ID NO: 3341724 - DNA, 14 bp, Homo sapiens
gatgaagaaattta

SEQ ID NO: 3341725 - DNA, 20 bp, Homo sapiens
gatgaagaacacagcatgtg

SEQ ID NO: 3341726 - DNA, 14 bp, Homo sapiens
gatgaagagtgaga

SEQ ID NO: 3341727 - DNA, 18 bp, Homo sapiens
gatgaagggcgagtgaat

SEQ ID NO: 3341728 - DNA, 22 bp, Homo sapiens
gatgaagttttacattgttgag

SEQ ID NO: 3341729 - DNA, 14 bp, Homo sapiens
gatgaatacatttt

SEQ ID NO: 3341730 - DNA, 15 bp, Homo sapiens
gatgaatagatgtga

SEQ ID NO: 3341731 - DNA, 16 bp, Homo sapiens
gatgaatcaatgaaaa

SEQ ID NO: 3341732 - DNA, 13 bp, Homo sapiens
gatgaatgagaat

SEQ ID NO: 3341733 - DNA, 14 bp, Homo sapiens
gatgaatgtatgtg

SEQ ID NO: 3341734 - DNA, 14 bp, Homo sapiens
gatgaatgtattta

SEQ ID NO: 3341735 - DNA, 17 bp, Homo sapiens
gatgacaacttcccagt

SEQ ID NO: 3341736 - DNA, 17 bp, Homo sapiens
gatgacattccctgcta

SEQ ID NO: 3341737 - DNA, 18 bp, Homo sapiens
gatgaccaatgggatgag

SEQ ID NO: 3341738 - DNA, 14 bp, Homo sapiens
gatgaccagggatg

SEQ ID NO: 3341739 - DNA, 18 bp, Homo sapiens
gatgaccagggatgctgg

SEQ ID NO: 3341740 - DNA, 22 bp, Homo sapiens
gatgaccagggatgctgggctg

SEQ ID NO: 3341741 - DNA, 15 bp, Homo sapiens
gatgacctggataac

SEQ ID NO: 3341742 - DNA, 12 bp, Homo sapiens
gatgactaaaat

SEQ ID NO: 3341743 - DNA, 12 bp, Homo sapiens
gatgactgagtc

SEQ ID NO: 3341744 - DNA, 12 bp, Homo sapiens
gatgactgctga

SEQ ID NO: 3341745 - DNA, 14 bp, Homo sapiens
gatgactgctgatt

SEQ ID NO: 3341746 - DNA, 20 bp, Homo sapiens
gatgactttgcagatggaaa

SEQ ID NO: 3341747 - DNA, 17 bp, Homo sapiens
gatgagaaacagctcag

SEQ ID NO: 3341748 - DNA, 21 bp, Homo sapiens
gatgagaatttctaaaaagat

SEQ ID NO: 3341749 - DNA, 17 bp, Homo sapiens
gatgagagcccagaggt

SEQ ID NO: 3341750 - DNA, 18 bp, Homo sapiens
gatgagatattaaattct

SEQ ID NO: 3341751 - DNA, 21 bp, Homo sapiens
gatgagatttgccagcacagg

SEQ ID NO: 3341752 - DNA, 21 bp, Homo sapiens
gatgagcccagccctgttctg

SEQ ID NO: 3341753 - DNA, 14 bp, Homo sapiens
gatgagggtgactg

SEQ ID NO: 3341754 - DNA, 20 bp, Homo sapiens
gatgataagttcctttcctt

SEQ ID NO: 3341755 - DNA, 13 bp, Homo sapiens
gatgatcaattat

SEQ ID NO: 3341756 - DNA, 23 bp, Homo sapiens
gatgatccatgagtttgccctgg

SEQ ID NO: 3341757 - DNA, 21 bp, Homo sapiens
gatgatgaaatgaggtcagag

SEQ ID NO: 3341758 - DNA, 23 bp, Homo sapiens
gatgatgacgacgacaacgatga

SEQ ID NO: 3341759 - DNA, 19 bp, Homo sapiens
gatgatgagaatttctaaa

SEQ ID NO: 3341760 - DNA, 23 bp, Homo sapiens
gatgatgataatgatgatgacga

SEQ ID NO: 3341761 - DNA, 14 bp, Homo sapiens
gatgatgatgaaaa

SEQ ID NO: 3341762 - DNA, 17 bp, Homo sapiens
gatgatgatgatgatga

SEQ ID NO: 3341763 - DNA, 12 bp, Homo sapiens
gatgatgctgtg

SEQ ID NO: 3341764 - DNA, 22 bp, Homo sapiens
gatgatgcttgtaacaagaaaa

SEQ ID NO: 3341765 - DNA, 16 bp, Homo sapiens
gatgatgtctcttgta

SEQ ID NO: 3341766 - DNA, 15 bp, Homo sapiens
gatgattcagaaatt

SEQ ID NO: 3341767 - DNA, 14 bp, Homo sapiens
gatgcaaagaaaat

SEQ ID NO: 3341768 - DNA, 21 bp, Homo sapiens
gatgcaaagtacaatgtgttt

SEQ ID NO: 3341769 - DNA, 20 bp, Homo sapiens
gatgcaacacgcatggtcaa

SEQ ID NO: 3341770 - DNA, 19 bp, Homo sapiens
gatgcaaggaccaggactc

SEQ ID NO: 3341771 - DNA, 21 bp, Homo sapiens
gatgcaaggattacagaaact

SEQ ID NO: 3341772 - DNA, 15 bp, Homo sapiens
gatgcacatccctgg

SEQ ID NO: 3341773 - DNA, 15 bp, Homo sapiens
gatgcacatttctgg

SEQ ID NO: 3341774 - DNA, 17 bp, Homo sapiens
gatgcacatttctggat

SEQ ID NO: 3341775 - DNA, 20 bp, Homo sapiens
gatgcacatttctggattgt

SEQ ID NO: 3341776 - DNA, 21 bp, Homo sapiens
gatgcactgaaaacttagcca

SEQ ID NO: 3341777 - DNA, 20 bp, Homo sapiens
gatgcagccgccttccttga

SEQ ID NO: 3341778 - DNA, 22 bp, Homo sapiens
gatgcagccgccttccttgacc

SEQ ID NO: 3341779 - DNA, 13 bp, Homo sapiens
gatgcaggacagg

SEQ ID NO: 3341780 - DNA, 17 bp, Homo sapiens
gatgcaggacaggaggc

SEQ ID NO: 3341781 - DNA, 21 bp, Homo sapiens
gatgcaggttggaaggggcct

SEQ ID NO: 3341782 - DNA, 16 bp, Homo sapiens
gatgcatgtcttttaa

SEQ ID NO: 3341783 - DNA, 22 bp, Homo sapiens
gatgcatgtggtttggttcctc

SEQ ID NO: 3341784 - DNA, 16 bp, Homo sapiens
gatgcatttaataaag

SEQ ID NO: 3341785 - DNA, 22 bp, Homo sapiens
gatgcatttaataaagatgagt

SEQ ID NO: 3341786 - DNA, 15 bp, Homo sapiens
gatgccaacctctgg

SEQ ID NO: 3341787 - DNA, 22 bp, Homo sapiens
gatgccaatactagtcacccca

SEQ ID NO: 3341788 - DNA, 19 bp, Homo sapiens
gatgccaatattaaatctg

SEQ ID NO: 3341789 - DNA, 15 bp, Homo sapiens
gatgccagcccctgc

SEQ ID NO: 3341790 - DNA, 18 bp, Homo sapiens
gatgccagcccctgcctg

SEQ ID NO: 3341791 - DNA, 20 bp, Homo sapiens
gatgccattcttccttgcaa

SEQ ID NO: 3341792 - DNA, 20 bp, Homo sapiens
gatgcccagagggcccaggc

SEQ ID NO: 3341793 - DNA, 19 bp, Homo sapiens
gatgccccctccaggagag

SEQ ID NO: 3341794 - DNA, 14 bp, Homo sapiens
gatgccctgggggc

SEQ ID NO: 3341795 - DNA, 20 bp, Homo sapiens
gatgcctacaaccatccctg

SEQ ID NO: 3341796 - DNA, 14 bp, Homo sapiens
gatgcctggtggca

SEQ ID NO: 3341797 - DNA, 16 bp, Homo sapiens
gatgcctggtggcagc

SEQ ID NO: 3341798 - DNA, 18 bp, Homo sapiens
gatgcctggtggcagctg

SEQ ID NO: 3341799 - DNA, 20 bp, Homo sapiens
gatgcctggtggcagctgcg

SEQ ID NO: 3341800 - DNA, 13 bp, Homo sapiens
gatgcgaggacca

SEQ ID NO: 3341801 - DNA, 13 bp, Homo sapiens
gatgcgccttgct

SEQ ID NO: 3341802 - DNA, 16 bp, Homo sapiens
gatgctagaactccct

SEQ ID NO: 3341803 - DNA, 18 bp, Homo sapiens
gatgctagaactcccttt

SEQ ID NO: 3341804 - DNA, 16 bp, Homo sapiens
gatgctagccccagag

SEQ ID NO: 3341805 - DNA, 18 bp, Homo sapiens
gatgctatggtcaggtta

SEQ ID NO: 3341806 - DNA, 21 bp, Homo sapiens
gatgctccctcagcctcagag

SEQ ID NO: 3341807 - DNA, 15 bp, Homo sapiens
gatgctccctcccct

SEQ ID NO: 3341808 - DNA, 17 bp, Homo sapiens
gatgctgactgtactcc

SEQ ID NO: 3341809 - DNA, 20 bp, Homo sapiens
gatgctgactgtactcctcc

SEQ ID NO: 3341810 - DNA, 14 bp, Homo sapiens
gatgctgatggagc

SEQ ID NO: 3341811 - DNA, 14 bp, Homo sapiens
gatgctgcctgagt

SEQ ID NO: 3341812 - DNA, 16 bp, Homo sapiens
gatgctgcctgagtca

SEQ ID NO: 3341813 - DNA, 14 bp, Homo sapiens
gatgctgctccgcc

SEQ ID NO: 3341814 - DNA, 19 bp, Homo sapiens
gatgctggagaagagagga

SEQ ID NO: 3341815 - DNA, 21 bp, Homo sapiens
gatgctggagaagagaggaga

SEQ ID NO: 3341816 - DNA, 14 bp, Homo sapiens
gatgctggagaggt

SEQ ID NO: 3341817 - DNA, 12 bp, Homo sapiens
gatgctgggctg

SEQ ID NO: 3341818 - DNA, 20 bp, Homo sapiens
gatgctgggctgggccctct

SEQ ID NO: 3341819 - DNA, 23 bp, Homo sapiens
gatgctgggttggtgcacagtga

SEQ ID NO: 3341820 - DNA, 19 bp, Homo sapiens
gatgctgtaacttaaaata

SEQ ID NO: 3341821 - DNA, 22 bp, Homo sapiens
gatgctgtgacaataagtttga

SEQ ID NO: 3341822 - DNA, 13 bp, Homo sapiens
gatgctgtttgac

SEQ ID NO: 3341823 - DNA, 18 bp, Homo sapiens
gatggaaaaactgaggct

SEQ ID NO: 3341824 - DNA, 16 bp, Homo sapiens
gatggaaaaataacaa

SEQ ID NO: 3341825 - DNA, 17 bp, Homo sapiens
gatggaaaaggaagact

SEQ ID NO: 3341826 - DNA, 15 bp, Homo sapiens
gatggaaaataaaca

SEQ ID NO: 3341827 - DNA, 22 bp, Homo sapiens
gatggaaagaggtgaaaatgaa

SEQ ID NO: 3341828 - DNA, 21 bp, Homo sapiens
gatggaagttgcagtgagctg

SEQ ID NO: 3341829 - DNA, 16 bp, Homo sapiens
gatggaattattgtac

SEQ ID NO: 3341830 - DNA, 22 bp, Homo sapiens
gatggacagttcacaccctgca

SEQ ID NO: 3341831 - DNA, 19 bp, Homo sapiens
gatggaccgggtgggcctg

SEQ ID NO: 3341832 - DNA, 16 bp, Homo sapiens
gatggagaaagaagtg

SEQ ID NO: 3341833 - DNA, 23 bp, Homo sapiens
gatggagactggtcctgtgtgca

SEQ ID NO: 3341834 - DNA, 19 bp, Homo sapiens
gatggagcccaggcgggag

SEQ ID NO: 3341835 - DNA, 14 bp, Homo sapiens
gatggagcccccag

SEQ ID NO: 3341836 - DNA, 16 bp, Homo sapiens
gatggagcgcacctgc

SEQ ID NO: 3341837 - DNA, 21 bp, Homo sapiens
gatggagggagggggaagtcg

SEQ ID NO: 3341838 - DNA, 19 bp, Homo sapiens
gatggagttcttgtgccat

SEQ ID NO: 3341839 - DNA, 15 bp, Homo sapiens
gatggagtttctaag

SEQ ID NO: 3341840 - DNA, 18 bp, Homo sapiens
gatggataacctatatga

SEQ ID NO: 3341841 - DNA, 16 bp, Homo sapiens
gatggatcaccattat

SEQ ID NO: 3341842 - DNA, 19 bp, Homo sapiens
gatggattctcagatattt

SEQ ID NO: 3341843 - DNA, 22 bp, Homo sapiens
gatggattctcagatatttata

SEQ ID NO: 3341844 - DNA, 19 bp, Homo sapiens
gatggatttgcctgtgcca

SEQ ID NO: 3341845 - DNA, 23 bp, Homo sapiens
gatggcacaatgaatgtatattt

SEQ ID NO: 3341846 - DNA, 21 bp, Homo sapiens
gataatattagtgattctgat

SEQ ID NO: 3341847 - DNA, 22 bp, Homo sapiens
gataatattgtttggtaaatgt

SEQ ID NO: 3341848 - DNA, 16 bp, Homo sapiens
gataatctcagtgctt

SEQ ID NO: 3341849 - DNA, 21 bp, Homo sapiens
gataatcttcaggtgaacact

SEQ ID NO: 3341850 - DNA, 20 bp, Homo sapiens
gataatgaaataatcagtga

SEQ ID NO: 3341851 - DNA, 18 bp, Homo sapiens
gataatggtgaacatttt

SEQ ID NO: 3341852 - DNA, 13 bp, Homo sapiens
gataatgttaaat

SEQ ID NO: 3341853 - DNA, 19 bp, Homo sapiens
gataatgttaaatttgtaa

SEQ ID NO: 3341854 - DNA, 19 bp, Homo sapiens
gataattagatgattatat

SEQ ID NO: 3341855 - DNA, 21 bp, Homo sapiens
gataattagatgattatatat

SEQ ID NO: 3341856 - DNA, 14 bp, Homo sapiens
gataattcatttgt

SEQ ID NO: 3341857 - DNA, 16 bp, Homo sapiens
gataattcatttgtat

SEQ ID NO: 3341858 - DNA, 11 bp, Homo sapiens
gataattgcta

SEQ ID NO: 3341859 - DNA, 13 bp, Homo sapiens
gataatttgaaaa

SEQ ID NO: 3341860 - DNA, 21 bp, Homo sapiens
gataattttatttataaacta

SEQ ID NO: 3341861 - DNA, 13 bp, Homo sapiens
gatacacacacac

SEQ ID NO: 3341862 - DNA, 19 bp, Homo sapiens
gatacaggaaaagctgctg

SEQ ID NO: 3341863 - DNA, 21 bp, Homo sapiens
gatacaggaaaagctgctgac

SEQ ID NO: 3341864 - DNA, 23 bp, Homo sapiens
gatacaggaaaagctgctgacag

SEQ ID NO: 3341865 - DNA, 19 bp, Homo sapiens
gatacagtccctaaagaaa

SEQ ID NO: 3341866 - DNA, 20 bp, Homo sapiens
gatacataactaaatttgat

SEQ ID NO: 3341867 - DNA, 13 bp, Homo sapiens
gatacatcactgc

SEQ ID NO: 3341868 - DNA, 21 bp, Homo sapiens
gatacatcactgcttgatgaa

SEQ ID NO: 3341869 - DNA, 17 bp, Homo sapiens
gataccacctttactgt

SEQ ID NO: 3341870 - DNA, 13 bp, Homo sapiens
gatacccccctct

SEQ ID NO: 3341871 - DNA, 18 bp, Homo sapiens
gataccttcttatttaat

SEQ ID NO: 3341872 - DNA, 20 bp, Homo sapiens
gatactaaaagttcttctcc

SEQ ID NO: 3341873 - DNA, 13 bp, Homo sapiens
gatactaaggacg

SEQ ID NO: 3341874 - DNA, 15 bp, Homo sapiens
gatactctcagattt

SEQ ID NO: 3341875 - DNA, 13 bp, Homo sapiens
gatactctgtcag

SEQ ID NO: 3341876 - DNA, 15 bp, Homo sapiens
gatactgaatgcata

SEQ ID NO: 3341877 - DNA, 18 bp, Homo sapiens
gatactgaatgcataaat

SEQ ID NO: 3341878 - DNA, 18 bp, Homo sapiens
gatactgcagggccagga

SEQ ID NO: 3341879 - DNA, 21 bp, Homo sapiens
gatactgcgactttctgcctg

SEQ ID NO: 3341880 - DNA, 23 bp, Homo sapiens
gatactgctactgtaattttata

SEQ ID NO: 3341881 - DNA, 16 bp, Homo sapiens
gatactggaagttttg

SEQ ID NO: 3341882 - DNA, 13 bp, Homo sapiens
gatactggcacag

SEQ ID NO: 3341883 - DNA, 21 bp, Homo sapiens
gatacttagtggtatgtctct

SEQ ID NO: 3341884 - DNA, 14 bp, Homo sapiens
gatacttcctgggt

SEQ ID NO: 3341885 - DNA, 15 bp, Homo sapiens
gatacttcctgggtc

SEQ ID NO: 3341886 - DNA, 20 bp, Homo sapiens
gatacttggatttagtttca

SEQ ID NO: 3341887 - DNA, 18 bp, Homo sapiens
gatactttgatattttca

SEQ ID NO: 3341888 - DNA, 15 bp, Homo sapiens
gatagaggaaaggga

SEQ ID NO: 3341889 - DNA, 14 bp, Homo sapiens
gatagcactttcta

SEQ ID NO: 3341890 - DNA, 22 bp, Homo sapiens
gatagcattgttttcttttaca

SEQ ID NO: 3341891 - DNA, 16 bp, Homo sapiens
gatagctaacatttta

SEQ ID NO: 3341892 - DNA, 19 bp, Homo sapiens
gatagctaactgtaaatca

SEQ ID NO: 3341893 - DNA, 17 bp, Homo sapiens
gataggaactgtctcaa

SEQ ID NO: 3341894 - DNA, 14 bp, Homo sapiens
gataggagctgcag

SEQ ID NO: 3341895 - DNA, 20 bp, Homo sapiens
gataggcacatagagaggga

SEQ ID NO: 3341896 - DNA, 22 bp, Homo sapiens
gataggcccaaggtcccctcca

SEQ ID NO: 3341897 - DNA, 12 bp, Homo sapiens
gataggctctgc

SEQ ID NO: 3341898 - DNA, 13 bp, Homo sapiens
gatagtaagcata

SEQ ID NO: 3341899 - DNA, 14 bp, Homo sapiens
gatagtaagcatag

SEQ ID NO: 3341900 - DNA, 15 bp, Homo sapiens
gatagttgatgcatg

SEQ ID NO: 3341901 - DNA, 16 bp, Homo sapiens
gatagttgatgcatgt

SEQ ID NO: 3341902 - DNA, 16 bp, Homo sapiens
gatataaatggctggt

SEQ ID NO: 3341903 - DNA, 13 bp, Homo sapiens
gatataaattctg

SEQ ID NO: 3341904 - DNA, 13 bp, Homo sapiens
gatataatgtatt

SEQ ID NO: 3341905 - DNA, 15 bp, Homo sapiens
gatataatgtatttt

SEQ ID NO: 3341906 - DNA, 14 bp, Homo sapiens
gatatacagatgaa

SEQ ID NO: 3341907 - DNA, 16 bp, Homo sapiens
gatatacagatgaaaa

SEQ ID NO: 3341908 - DNA, 21 bp, Homo sapiens
gatatacagatgaaaatttga

SEQ ID NO: 3341909 - DNA, 17 bp, Homo sapiens
gatatacatgaaaattt

SEQ ID NO: 3341910 - DNA, 13 bp, Homo sapiens
gatatacattgtg

SEQ ID NO: 3341911 - DNA, 15 bp, Homo sapiens
gatatacattgtgtg

SEQ ID NO: 3341912 - DNA, 13 bp, Homo sapiens
gatataccaaatt

SEQ ID NO: 3341913 - DNA, 16 bp, Homo sapiens
gatatactttgtggac

SEQ ID NO: 3341914 - DNA, 22 bp, Homo sapiens
gatatactttgtggaccaatta

SEQ ID NO: 3341915 - DNA, 20 bp, Homo sapiens
gatatagacagtccttaaaa

SEQ ID NO: 3341916 - DNA, 19 bp, Homo sapiens
gatatagttttacttttaa

SEQ ID NO: 3341917 - DNA, 12 bp, Homo sapiens
gatatcaaaatt

SEQ ID NO: 3341918 - DNA, 22 bp, Homo sapiens
gatatcatgcttggttttcttt

SEQ ID NO: 3341919 - DNA, 13 bp, Homo sapiens
gatatcattttaa

SEQ ID NO: 3341920 - DNA, 18 bp, Homo sapiens
gatatccttatcagagct

SEQ ID NO: 3341921 - DNA, 23 bp, Homo sapiens
gatatcgacttgtttttgcacat

SEQ ID NO: 3341922 - DNA, 21 bp, Homo sapiens
gatatgaaactctacatttaa

SEQ ID NO: 3341923 - DNA, 20 bp, Homo sapiens
gatatgctgaacgcagaaga

SEQ ID NO: 3341924 - DNA, 19 bp, Homo sapiens
gatatggagaattgctgaa

SEQ ID NO: 3341925 - DNA, 14 bp, Homo sapiens
gatatggcagaaga

SEQ ID NO: 3341926 - DNA, 15 bp, Homo sapiens
gatatggcattgcac

SEQ ID NO: 3341927 - DNA, 15 bp, Homo sapiens
gatatggctgcccag

SEQ ID NO: 3341928 - DNA, 16 bp, Homo sapiens
gatatggctgcccagg

SEQ ID NO: 3341929 - DNA, 19 bp, Homo sapiens
gatatggctgcccaggaga

SEQ ID NO: 3341930 - DNA, 20 bp, Homo sapiens
gatatggctgcccaggagac

SEQ ID NO: 3341931 - DNA, 13 bp, Homo sapiens
gatatgggactga

SEQ ID NO: 3341932 - DNA, 18 bp, Homo sapiens
gatatgtatgggtagggt

SEQ ID NO: 3341933 - DNA, 14 bp, Homo sapiens
gatattaatcaaaa

SEQ ID NO: 3341934 - DNA, 13 bp, Homo sapiens
gatattactttat

SEQ ID NO: 3341935 - DNA, 20 bp, Homo sapiens
gatattagttaatgagccat

SEQ ID NO: 3341936 - DNA, 18 bp, Homo sapiens
gatattataagggagagc

SEQ ID NO: 3341937 - DNA, 12 bp, Homo sapiens
gatattatctac

SEQ ID NO: 3341938 - DNA, 23 bp, Homo sapiens
gatattattagaaattagaaaaa

SEQ ID NO: 3341939 - DNA, 15 bp, Homo sapiens
gatattattcttgta

SEQ ID NO: 3341940 - DNA, 19 bp, Homo sapiens
gatattcttctcttgcttt

SEQ ID NO: 3341941 - DNA, 16 bp, Homo sapiens
gatattgaatgttaaa

SEQ ID NO: 3341942 - DNA, 24 bp, Homo sapiens
gatattgatgataacacttaaaat

SEQ ID NO: 3341943 - DNA, 21 bp, Homo sapiens
gatattgctactataatcaaa

SEQ ID NO: 3341944 - DNA, 22 bp, Homo sapiens
gatattgtcagagttctgctct

SEQ ID NO: 3341945 - DNA, 16 bp, Homo sapiens
gatattgtgaagtaca

SEQ ID NO: 3341946 - DNA, 17 bp, Homo sapiens
gatattgtgaagtacat

SEQ ID NO: 3341947 - DNA, 13 bp, Homo sapiens
gatattgtttaaa

SEQ ID NO: 3341948 - DNA, 13 bp, Homo sapiens
gatatttaagaaa

SEQ ID NO: 3341949 - DNA, 15 bp, Homo sapiens
gatatttaagaaaat

SEQ ID NO: 3341950 - DNA, 23 bp, Homo sapiens
gatatttaagaaaatacaataaa

SEQ ID NO: 3341951 - DNA, 22 bp, Homo sapiens
gatatttaggagtgtgtgacat

SEQ ID NO: 3341952 - DNA, 13 bp, Homo sapiens
gatatttctcagc

SEQ ID NO: 3341953 - DNA, 14 bp, Homo sapiens
gatatttcttgctt

SEQ ID NO: 3341954 - DNA, 13 bp, Homo sapiens
gatatttgcacta

SEQ ID NO: 3341955 - DNA, 15 bp, Homo sapiens
gatatttgcacttat

SEQ ID NO: 3341956 - DNA, 20 bp, Homo sapiens
gatatttgcagtttttcatt

SEQ ID NO: 3341957 - DNA, 18 bp, Homo sapiens
gatattttcaaattgtat

SEQ ID NO: 3341958 - DNA, 19 bp, Homo sapiens
gatattttcaacgcagccc

SEQ ID NO: 3341959 - DNA, 22 bp, Homo sapiens
gatattttcaacgcagccctgc

SEQ ID NO: 3341960 - DNA, 17 bp, Homo sapiens
gatatttttatctttat

SEQ ID NO: 3341961 - DNA, 15 bp, Homo sapiens
gatatttttccattt

SEQ ID NO: 3341962 - DNA, 14 bp, Homo sapiens
gatatttttgtact

SEQ ID NO: 3341963 - DNA, 15 bp, Homo sapiens
gatatttttgtactt

SEQ ID NO: 3341964 - DNA, 18 bp, Homo sapiens
gatcaaagatgaaaagta

SEQ ID NO: 3341965 - DNA, 23 bp, Homo sapiens
gatcaaataacttagggccaagt

SEQ ID NO: 3341966 - DNA, 23 bp, Homo sapiens
gatcaaattcatttttttcactg

SEQ ID NO: 3341967 - DNA, 22 bp, Homo sapiens
gatcaaattttgagcaaagaaa

SEQ ID NO: 3341968 - DNA, 13 bp, Homo sapiens
gatcaactgttca

SEQ ID NO: 3341969 - DNA, 18 bp, Homo sapiens
gatcaataaaatgtgatt

SEQ ID NO: 3341970 - DNA, 19 bp, Homo sapiens
gatcaatatttttatatca

SEQ ID NO: 3341971 - DNA, 16 bp, Homo sapiens
gatcaattaaatgtag

SEQ ID NO: 3341972 - DNA, 16 bp, Homo sapiens
gatcaattatagtttc

SEQ ID NO: 3341973 - DNA, 11 bp, Homo sapiens
gatcacagcct

SEQ ID NO: 3341974 - DNA, 13 bp, Homo sapiens
gatcacagcctcc

SEQ ID NO: 3341975 - DNA, 17 bp, Homo sapiens
gatcacagcctccaggg

SEQ ID NO: 3341976 - DNA, 19 bp, Homo sapiens
gatcacagcctccagggcc

SEQ ID NO: 3341977 - DNA, 20 bp, Homo sapiens
gatcaccagcccggcctgct

SEQ ID NO: 3341978 - DNA, 22 bp, Homo sapiens
gatcaccagcccggcctgctcc

SEQ ID NO: 3341979 - DNA, 16 bp, Homo sapiens
gatcacgccactgcac

SEQ ID NO: 3341980 - DNA, 18 bp, Homo sapiens
gatcacgccactgcacta

SEQ ID NO: 3341981 - DNA, 23 bp, Homo sapiens
gatcacgccactgcactccagcc

SEQ ID NO: 3341982 - DNA, 24 bp, Homo sapiens
gatcacgccactgcactccagcct

SEQ ID NO: 3341983 - DNA, 14 bp, Homo sapiens
gatcacgctccccg

SEQ ID NO: 3341984 - DNA, 15 bp, Homo sapiens
gatcacggctcactg

SEQ ID NO: 3341985 - DNA, 18 bp, Homo sapiens
gatcacggctcactgcag

SEQ ID NO: 3341986 - DNA, 15 bp, Homo sapiens
gatcactcccagcac

SEQ ID NO: 3341987 - DNA, 15 bp, Homo sapiens
gatcactgccacact

SEQ ID NO: 3341988 - DNA, 12 bp, Homo sapiens
gatcactggagc

SEQ ID NO: 3341989 - DNA, 19 bp, Homo sapiens
gatcacttgagttcaggag

SEQ ID NO: 3341990 - DNA, 21 bp, Homo sapiens
gatcagaacattcagctctgg

SEQ ID NO: 3341991 - DNA, 12 bp, Homo sapiens
gatcagagcagg

SEQ ID NO: 3341992 - DNA, 21 bp, Homo sapiens
gatcagatgctccaagattct

SEQ ID NO: 3341993 - DNA, 22 bp, Homo sapiens
gatcagatgctccaagattcta

SEQ ID NO: 3341994 - DNA, 17 bp, Homo sapiens
gatcagccccgctcctc

SEQ ID NO: 3341995 - DNA, 16 bp, Homo sapiens
gatcagctgtttgtca

SEQ ID NO: 3341996 - DNA, 17 bp, Homo sapiens
gatcagctgtttgtcat

SEQ ID NO: 3341997 - DNA, 16 bp, Homo sapiens
gatcaggcagtgttta

SEQ ID NO: 3341998 - DNA, 19 bp, Homo sapiens
gatcagggaatccagctcc

SEQ ID NO: 3341999 - DNA, 20 bp, Homo sapiens
gatcagtataattttttaaa

SEQ ID NO: 3342000 - DNA, 14 bp, Homo sapiens
gatcagtatttcac

SEQ ID NO: 3342001 - DNA, 11 bp, Homo sapiens
gatcagtgttg

SEQ ID NO: 3342002 - DNA, 22 bp, Homo sapiens
gatcataaaagtgattcttttt

SEQ ID NO: 3342003 - DNA, 16 bp, Homo sapiens
gatcatccactgtgcc

SEQ ID NO: 3342004 - DNA, 14 bp, Homo sapiens
gatcatcgccagag

SEQ ID NO: 3342005 - DNA, 19 bp, Homo sapiens
gatcatcgccagaggtgct

SEQ ID NO: 3342006 - DNA, 13 bp, Homo sapiens
gatcatgcattgt

SEQ ID NO: 3342007 - DNA, 14 bp, Homo sapiens
gatcatggtgtaat

SEQ ID NO: 3342008 - DNA, 18 bp, Homo sapiens
gatcatggtgtaataaga

SEQ ID NO: 3342009 - DNA, 15 bp, Homo sapiens
gatcatgtacttttt

SEQ ID NO: 3342010 - DNA, 19 bp, Homo sapiens
gatcatgttgttaaaatta

SEQ ID NO: 3342011 - DNA, 18 bp, Homo sapiens
gatcattttccccccact

SEQ ID NO: 3342012 - DNA, 21 bp, Homo sapiens
gatcatttttaactgattctt

SEQ ID NO: 3342013 - DNA, 19 bp, Homo sapiens
gatccaaattgtgcttctc

SEQ ID NO: 3342014 - DNA, 20 bp, Homo sapiens
gatccaactaatgccttact

SEQ ID NO: 3342015 - DNA, 15 bp, Homo sapiens
gatccaagctaagca

SEQ ID NO: 3342016 - DNA, 17 bp, Homo sapiens
gatccaagctaagcact

SEQ ID NO: 3342017 - DNA, 20 bp, Homo sapiens
gatccacccacctcagcctc

SEQ ID NO: 3342018 - DNA, 16 bp, Homo sapiens
gatccaccccctgccc

SEQ ID NO: 3342019 - DNA, 14 bp, Homo sapiens
gatccacctgtctc

SEQ ID NO: 3342020 - DNA, 18 bp, Homo sapiens
gatccacctgtctcagcc

SEQ ID NO: 3342021 - DNA, 17 bp, Homo sapiens
gatccagtataagacta

SEQ ID NO: 3342022 - DNA, 23 bp, Homo sapiens
gatccatttccattgcttattat

SEQ ID NO: 3342023 - DNA, 18 bp, Homo sapiens
gatccatttgcctttctg

SEQ ID NO: 3342024 - DNA, 23 bp, Homo sapiens
gatccatttgcctttctgggagc

SEQ ID NO: 3342025 - DNA, 20 bp, Homo sapiens
gatcccaccctggggacccc

SEQ ID NO: 3342026 - DNA, 13 bp, Homo sapiens
gatcccagaaagt

SEQ ID NO: 3342027 - DNA, 12 bp, Homo sapiens
gatcccatctct

SEQ ID NO: 3342028 - DNA, 18 bp, Homo sapiens
gatccccaagtgtgaaca

SEQ ID NO: 3342029 - DNA, 16 bp, Homo sapiens
gatccccgcctggcca

SEQ ID NO: 3342030 - DNA, 21 bp, Homo sapiens
gatccccgcctggccaggagc

SEQ ID NO: 3342031 - DNA, 13 bp, Homo sapiens
gatcccctccccc

SEQ ID NO: 3342032 - DNA, 16 bp, Homo sapiens
gatcccctctcctgcc

SEQ ID NO: 3342033 - DNA, 21 bp, Homo sapiens
gatcccctctgtctacaaata

SEQ ID NO: 3342034 - DNA, 20 bp, Homo sapiens
gatccctgtgttgtctctag

SEQ ID NO: 3342035 - DNA, 14 bp, Homo sapiens
gatccgactgcttt

SEQ ID NO: 3342036 - DNA, 17 bp, Homo sapiens
gatccgactgctttgga

SEQ ID NO: 3342037 - DNA, 14 bp, Homo sapiens
gatccggaaagaag

SEQ ID NO: 3342038 - DNA, 20 bp, Homo sapiens
gatcctaactgaagagacag

SEQ ID NO: 3342039 - DNA, 19 bp, Homo sapiens
gatcctacaatattttatt

SEQ ID NO: 3342040 - DNA, 16 bp, Homo sapiens
gatcctccctcatggc

SEQ ID NO: 3342041 - DNA, 15 bp, Homo sapiens
gatcctctactgtgc

SEQ ID NO: 3342042 - DNA, 22 bp, Homo sapiens
gatcctctactgtgcatctcct

SEQ ID NO: 3342043 - DNA, 14 bp, Homo sapiens
gatcctctattttg

SEQ ID NO: 3342044 - DNA, 15 bp, Homo sapiens
gatcctctattttgt

SEQ ID NO: 3342045 - DNA, 19 bp, Homo sapiens
gatcctctattttgtgatg

SEQ ID NO: 3342046 - DNA, 20 bp, Homo sapiens
gatcctctattttgtgatga

SEQ ID NO: 3342047 - DNA, 11 bp, Homo sapiens
gatcctgcagg

SEQ ID NO: 3342048 - DNA, 22 bp, Homo sapiens
gatcctgcaggaacgagcactg

SEQ ID NO: 3342049 - DNA, 14 bp, Homo sapiens
gatcctgccaccct

SEQ ID NO: 3342050 - DNA, 18 bp, Homo sapiens
gatcctgccaccctgtag

SEQ ID NO: 3342051 - DNA, 11 bp, Homo sapiens
gatcctgctgg

SEQ ID NO: 3342052 - DNA, 12 bp, Homo sapiens
gatcctgctggg

SEQ ID NO: 3342053 - DNA, 19 bp, Homo sapiens
gatcctgctggggccgcca

SEQ ID NO: 3342054 - DNA, 17 bp, Homo sapiens
gatcctggattcactca

SEQ ID NO: 3342055 - DNA, 19 bp, Homo sapiens
gatcctggggccctcagct

SEQ ID NO: 3342056 - DNA, 22 bp, Homo sapiens
gatcctgggtcaaaaaaaagaa

SEQ ID NO: 3342057 - DNA, 22 bp, Homo sapiens
gatccttcacaggcagtgcatg

SEQ ID NO: 3342058 - DNA, 21 bp, Homo sapiens
gatcctttttccatcatttta

SEQ ID NO: 3342059 - DNA, 15 bp, Homo sapiens
gatccttttttgtca

SEQ ID NO: 3342060 - DNA, 17 bp, Homo sapiens
gatccttttttgtcatt

SEQ ID NO: 3342061 - DNA, 21 bp, Homo sapiens
gatccttttttgtcattttat

SEQ ID NO: 3342062 - DNA, 17 bp, Homo sapiens
gatcgagaccatcctgg

SEQ ID NO: 3342063 - DNA, 19 bp, Homo sapiens
gatcgagaccatcctggct

SEQ ID NO: 3342064 - DNA, 15 bp, Homo sapiens
gatcgcatcattgca

SEQ ID NO: 3342065 - DNA, 23 bp, Homo sapiens
gatcgcgccactacactccagcc

SEQ ID NO: 3342066 - DNA, 16 bp, Homo sapiens
gatcgcttgagcccag

SEQ ID NO: 3342067 - DNA, 17 bp, Homo sapiens
gatcgcttgagcccagg

SEQ ID NO: 3342068 - DNA, 20 bp, Homo sapiens
gatcggagcctcctctctca

SEQ ID NO: 3342069 - DNA, 15 bp, Homo sapiens
gatcgtgctaaattt

SEQ ID NO: 3342070 - DNA, 18 bp, Homo sapiens
gatctaagcctttccata

SEQ ID NO: 3342071 - DNA, 22 bp, Homo sapiens
gatctacaggacaaagggaggg

SEQ ID NO: 3342072 - DNA, 20 bp, Homo sapiens
gatctacttctgtaattgtg

SEQ ID NO: 3342073 - DNA, 21 bp, Homo sapiens
gatctatgtttgtgtgatttc

SEQ ID NO: 3342074 - DNA, 13 bp, Homo sapiens
gatctatttcatg

SEQ ID NO: 3342075 - DNA, 16 bp, Homo sapiens
gatctatttcatgttt

SEQ ID NO: 3342076 - DNA, 14 bp, Homo sapiens
gatctcagctttga

SEQ ID NO: 3342077 - DNA, 17 bp, Homo sapiens
gatctcaggggctgttt

SEQ ID NO: 3342078 - DNA, 19 bp, Homo sapiens
gatctcaggggctgtttga

SEQ ID NO: 3342079 - DNA, 16 bp, Homo sapiens
gatctcataatgcttt

SEQ ID NO: 3342080 - DNA, 22 bp, Homo sapiens
gatctccactgataagactgtt

SEQ ID NO: 3342081 - DNA, 12 bp, Homo sapiens
gatctcccctca

SEQ ID NO: 3342082 - DNA, 12 bp, Homo sapiens
gatctctcagga

SEQ ID NO: 3342083 - DNA, 19 bp, Homo sapiens
gatctctcaggagcacagg

SEQ ID NO: 3342084 - DNA, 16 bp, Homo sapiens
gatctctcctggccta

SEQ ID NO: 3342085 - DNA, 18 bp, Homo sapiens
gatctgatggtgagctgg

SEQ ID NO: 3342086 - DNA, 17 bp, Homo sapiens
gatctgcatctgataga

SEQ ID NO: 3342087 - DNA, 16 bp, Homo sapiens
gatctgcctgggcctg

SEQ ID NO: 3342088 - DNA, 21 bp, Homo sapiens
gatctgcctgggcctgtgcag

SEQ ID NO: 3342089 - DNA, 23 bp, Homo sapiens
gatctgcctgggcctgtgcagca

SEQ ID NO: 3342090 - DNA, 18 bp, Homo sapiens
gatctgcggatctcagct

SEQ ID NO: 3342091 - DNA, 19 bp, Homo sapiens
gatctgcggatctcagctt

SEQ ID NO: 3342092 - DNA, 13 bp, Homo sapiens
gatctggctgcag

SEQ ID NO: 3342093 - DNA, 18 bp, Homo sapiens
gatctgggttcactgcaa

SEQ ID NO: 3342094 - DNA, 18 bp, Homo sapiens
gatctgtgccccatgcct

SEQ ID NO: 3342095 - DNA, 13 bp, Homo sapiens
gatctgttttgaa

SEQ ID NO: 3342096 - DNA, 18 bp, Homo sapiens
gatctgttttgaaggcaa

SEQ ID NO: 3342097 - DNA, 13 bp, Homo sapiens
gatcttagattct

SEQ ID NO: 3342098 - DNA, 17 bp, Homo sapiens
gatcttccgtggtcaga

SEQ ID NO: 3342099 - DNA, 12 bp, Homo sapiens
gatcttctgaaa

SEQ ID NO: 3342100 - DNA, 14 bp, Homo sapiens
gatcttctgaaatg

SEQ ID NO: 3342101 - DNA, 16 bp, Homo sapiens
gatcttctgaaatgaa

SEQ ID NO: 3342102 - DNA, 18 bp, Homo sapiens
gatcttctgaaatgaaac

SEQ ID NO: 3342103 - DNA, 16 bp, Homo sapiens
gatcttgccacatttc

SEQ ID NO: 3342104 - DNA, 14 bp, Homo sapiens
gatcttgtgctcag

SEQ ID NO: 3342105 - DNA, 14 bp, Homo sapiens
gagtgaaagggcta

SEQ ID NO: 3342106 - DNA, 19 bp, Homo sapiens
gagtgaaagggctatggca

SEQ ID NO: 3342107 - DNA, 24 bp, Homo sapiens
gagtgaaataattaaaaaccactg

SEQ ID NO: 3342108 - DNA, 15 bp, Homo sapiens
gagtgaagaggggca

SEQ ID NO: 3342109 - DNA, 18 bp, Homo sapiens
gagtgacagaggcagccc

SEQ ID NO: 3342110 - DNA, 20 bp, Homo sapiens
gagtgacagaggcagcccca

SEQ ID NO: 3342111 - DNA, 16 bp, Homo sapiens
gagtgactacacacag

SEQ ID NO: 3342112 - DNA, 14 bp, Homo sapiens
gagtgactagacgt

SEQ ID NO: 3342113 - DNA, 15 bp, Homo sapiens
gagtgactcaagaag

SEQ ID NO: 3342114 - DNA, 17 bp, Homo sapiens
gagtgactccaagaaca

SEQ ID NO: 3342115 - DNA, 13 bp, Homo sapiens
gagtgagccagtg

SEQ ID NO: 3342116 - DNA, 13 bp, Homo sapiens
gagtgagcctggc

SEQ ID NO: 3342117 - DNA, 22 bp, Homo sapiens
gagtgagctacagagccgagca

SEQ ID NO: 3342118 - DNA, 18 bp, Homo sapiens
gagtgaggacgcaccgcc

SEQ ID NO: 3342119 - DNA, 18 bp, Homo sapiens
gagtgaggcttccaggct

SEQ ID NO: 3342120 - DNA, 19 bp, Homo sapiens
gagtgatagtcttttgctt

SEQ ID NO: 3342121 - DNA, 19 bp, Homo sapiens
gagtgatgatttgggggag

SEQ ID NO: 3342122 - DNA, 17 bp, Homo sapiens
gagtgatttccatctct

SEQ ID NO: 3342123 - DNA, 13 bp, Homo sapiens
gagtgcacagctg

SEQ ID NO: 3342124 - DNA, 14 bp, Homo sapiens
gagtgcacagctgt

SEQ ID NO: 3342125 - DNA, 15 bp, Homo sapiens
gagtgcacagctgtc

SEQ ID NO: 3342126 - DNA, 12 bp, Homo sapiens
gagtgcagtgag

SEQ ID NO: 3342127 - DNA, 18 bp, Homo sapiens
gagtgcgccctgcactcc

SEQ ID NO: 3342128 - DNA, 16 bp, Homo sapiens
gagtgcggcgtggaga

SEQ ID NO: 3342129 - DNA, 18 bp, Homo sapiens
gagtgcggcgtggagact

SEQ ID NO: 3342130 - DNA, 13 bp, Homo sapiens
gagtgcgtctgag

SEQ ID NO: 3342131 - DNA, 14 bp, Homo sapiens
gagtgcgtctgagg

SEQ ID NO: 3342132 - DNA, 16 bp, Homo sapiens
gagtgcgtctgagggg

SEQ ID NO: 3342133 - DNA, 21 bp, Homo sapiens
gagtgctggactgttccaggc

SEQ ID NO: 3342134 - DNA, 11 bp, Homo sapiens
gagtggaagga

SEQ ID NO: 3342135 - DNA, 19 bp, Homo sapiens
gagtggaaggactgtggct

SEQ ID NO: 3342136 - DNA, 17 bp, Homo sapiens
gagtggaatgcagggaa

SEQ ID NO: 3342137 - DNA, 21 bp, Homo sapiens
gagtggaatgcagggaagagg

SEQ ID NO: 3342138 - DNA, 12 bp, Homo sapiens
gagtggagtctg

SEQ ID NO: 3342139 - DNA, 15 bp, Homo sapiens
gagtggagtctgagt

SEQ ID NO: 3342140 - DNA, 23 bp, Homo sapiens
gagtggagtctgagtctgagtcc

SEQ ID NO: 3342141 - DNA, 15 bp, Homo sapiens
gagtggcagccatgc

SEQ ID NO: 3342142 - DNA, 13 bp, Homo sapiens
gagtggctcctcc

SEQ ID NO: 3342143 - DNA, 15 bp, Homo sapiens
gagtggctcctcccg

SEQ ID NO: 3342144 - DNA, 19 bp, Homo sapiens
gagtgggagaaggcagtga

SEQ ID NO: 3342145 - DNA, 16 bp, Homo sapiens
gagtgggcacctcaga

SEQ ID NO: 3342146 - DNA, 20 bp, Homo sapiens
gagtgggcagaggtggcgcc

SEQ ID NO: 3342147 - DNA, 21 bp, Homo sapiens
gagtggggttatctctgtgtt

SEQ ID NO: 3342148 - DNA, 21 bp, Homo sapiens
gagtggtctttctggagaggt

SEQ ID NO: 3342149 - DNA, 14 bp, Homo sapiens
gagtggtggttcct

SEQ ID NO: 3342150 - DNA, 19 bp, Homo sapiens
gagtgtaaataattttaaa

SEQ ID NO: 3342151 - DNA, 13 bp, Homo sapiens
gagtgtagaagca

SEQ ID NO: 3342152 - DNA, 15 bp, Homo sapiens
gagtgtagaagcatt

SEQ ID NO: 3342153 - DNA, 20 bp, Homo sapiens
gagtgtagaagcattccttc

SEQ ID NO: 3342154 - DNA, 17 bp, Homo sapiens
gagtgtagactgtggct

SEQ ID NO: 3342155 - DNA, 18 bp, Homo sapiens
gagtgtagcctaaagggc

SEQ ID NO: 3342156 - DNA, 23 bp, Homo sapiens
gagtgtagcctaaagggcagggc

SEQ ID NO: 3342157 - DNA, 20 bp, Homo sapiens
gagtgtagctgtaagggcag

SEQ ID NO: 3342158 - DNA, 23 bp, Homo sapiens
gagtgtagctgtaagggcagtgc

SEQ ID NO: 3342159 - DNA, 13 bp, Homo sapiens
gagtgtatgagta

SEQ ID NO: 3342160 - DNA, 19 bp, Homo sapiens
gagtgtcctgcccatgccc

SEQ ID NO: 3342161 - DNA, 17 bp, Homo sapiens
gagtgtttgggggacgt

SEQ ID NO: 3342162 - DNA, 22 bp, Homo sapiens
gagttaaatagagtatatgcac

SEQ ID NO: 3342163 - DNA, 16 bp, Homo sapiens
gagttaagaagctgtt

SEQ ID NO: 3342164 - DNA, 13 bp, Homo sapiens
gagttacagttct

SEQ ID NO: 3342165 - DNA, 17 bp, Homo sapiens
gagttacattaatgtta

SEQ ID NO: 3342166 - DNA, 21 bp, Homo sapiens
gagttacttgtctgaggcctc

SEQ ID NO: 3342167 - DNA, 16 bp, Homo sapiens
gagttatctaaaagaa

SEQ ID NO: 3342168 - DNA, 22 bp, Homo sapiens
gagttattcataaagagaaaat

SEQ ID NO: 3342169 - DNA, 15 bp, Homo sapiens
gagttcaactacatg

SEQ ID NO: 3342170 - DNA, 22 bp, Homo sapiens
gagttcacaggaggccagtggg

SEQ ID NO: 3342171 - DNA, 23 bp, Homo sapiens
gagttcacaggaggccagtgggc

SEQ ID NO: 3342172 - DNA, 21 bp, Homo sapiens
gagttcagagtccttaaaatg

SEQ ID NO: 3342173 - DNA, 16 bp, Homo sapiens
gagttcagtatttaat

SEQ ID NO: 3342174 - DNA, 20 bp, Homo sapiens
gagttccaagttgaagggaa

SEQ ID NO: 3342175 - DNA, 17 bp, Homo sapiens
gagttcgagaccagcct

SEQ ID NO: 3342176 - DNA, 18 bp, Homo sapiens
gagttcggctctgggtgg

SEQ ID NO: 3342177 - DNA, 11 bp, Homo sapiens
gagttctacat

SEQ ID NO: 3342178 - DNA, 16 bp, Homo sapiens
gagttctcagggctcc

SEQ ID NO: 3342179 - DNA, 16 bp, Homo sapiens
gagttctccctgtaca

SEQ ID NO: 3342180 - DNA, 22 bp, Homo sapiens
gagttctccctgtacagtgtta

SEQ ID NO: 3342181 - DNA, 15 bp, Homo sapiens
gagttgaggaactgt

SEQ ID NO: 3342182 - DNA, 19 bp, Homo sapiens
gagttgaggaactgtacag

SEQ ID NO: 3342183 - DNA, 17 bp, Homo sapiens
gagttgccaagacaaat

SEQ ID NO: 3342184 - DNA, 22 bp, Homo sapiens
gagttggagtactatatttaca

SEQ ID NO: 3342185 - DNA, 16 bp, Homo sapiens
gagttgtggaaagcct

SEQ ID NO: 3342186 - DNA, 16 bp, Homo sapiens
gagttgttgtgtacag

SEQ ID NO: 3342187 - DNA, 17 bp, Homo sapiens
gagtttaagaccagcct

SEQ ID NO: 3342188 - DNA, 14 bp, Homo sapiens
gagtttaccatttg

SEQ ID NO: 3342189 - DNA, 17 bp, Homo sapiens
gagtttaccatttgtaa

SEQ ID NO: 3342190 - DNA, 22 bp, Homo sapiens
gagtttaccatttgtaataaag

SEQ ID NO: 3342191 - DNA, 14 bp, Homo sapiens
gagtttatattctg

SEQ ID NO: 3342192 - DNA, 22 bp, Homo sapiens
gagtttccccactaataaagtg

SEQ ID NO: 3342193 - DNA, 17 bp, Homo sapiens
gagtttcctatgggaac

SEQ ID NO: 3342194 - DNA, 17 bp, Homo sapiens
gagtttgagacaagccc

SEQ ID NO: 3342195 - DNA, 22 bp, Homo sapiens
gagtttgagacaagccctggca

SEQ ID NO: 3342196 - DNA, 18 bp, Homo sapiens
gagtttgctattagagca

SEQ ID NO: 3342197 - DNA, 11 bp, Homo sapiens
gagtttgtagg

SEQ ID NO: 3342198 - DNA, 18 bp, Homo sapiens
gagtttgtcgctcatgtg

SEQ ID NO: 3342199 - DNA, 18 bp, Homo sapiens
gagtttgtgtgttgtctt

SEQ ID NO: 3342200 - DNA, 22 bp, Homo sapiens
gagtttgttctgttctggggga

SEQ ID NO: 3342201 - DNA, 16 bp, Homo sapiens
gagttttaacaatcca

SEQ ID NO: 3342202 - DNA, 14 bp, Homo sapiens
gagttttctttagt

SEQ ID NO: 3342203 - DNA, 15 bp, Homo sapiens
gagttttctttagta

SEQ ID NO: 3342204 - DNA, 16 bp, Homo sapiens
gagttttggcagccag

SEQ ID NO: 3342205 - DNA, 16 bp, Homo sapiens
gagtttttatgccttt

SEQ ID NO: 3342206 - DNA, 22 bp, Homo sapiens
gataaaaacctgaactttcatt

SEQ ID NO: 3342207 - DNA, 14 bp, Homo sapiens
gataaactgagcct

SEQ ID NO: 3342208 - DNA, 11 bp, Homo sapiens
gataaagatga

SEQ ID NO: 3342209 - DNA, 13 bp, Homo sapiens
gataaagatgatc

SEQ ID NO: 3342210 - DNA, 14 bp, Homo sapiens
gataaagcacagct

SEQ ID NO: 3342211 - DNA, 14 bp, Homo sapiens
gataaatatttgac

SEQ ID NO: 3342212 - DNA, 17 bp, Homo sapiens
gataaatcataaagtca

SEQ ID NO: 3342213 - DNA, 16 bp, Homo sapiens
gataaatcatttcagt

SEQ ID NO: 3342214 - DNA, 16 bp, Homo sapiens
gataaattccactgga

SEQ ID NO: 3342215 - DNA, 15 bp, Homo sapiens
gataacacttaaaat

SEQ ID NO: 3342216 - DNA, 17 bp, Homo sapiens
gataacccttattccat

SEQ ID NO: 3342217 - DNA, 17 bp, Homo sapiens
gataacctatatgattt

SEQ ID NO: 3342218 - DNA, 23 bp, Homo sapiens
gataacctatatgatttatagtt

SEQ ID NO: 3342219 - DNA, 16 bp, Homo sapiens
gataaccttgaaaaaa

SEQ ID NO: 3342220 - DNA, 11 bp, Homo sapiens
gataactctcc

SEQ ID NO: 3342221 - DNA, 22 bp, Homo sapiens
gataactgatttctatggcttt

SEQ ID NO: 3342222 - DNA, 18 bp, Homo sapiens
gataactgcaattttaat

SEQ ID NO: 3342223 - DNA, 17 bp, Homo sapiens
gataagaatgctggttt

SEQ ID NO: 3342224 - DNA, 23 bp, Homo sapiens
gataagccactctgtcccttcct

SEQ ID NO: 3342225 - DNA, 13 bp, Homo sapiens
gataagcctgagc

SEQ ID NO: 3342226 - DNA, 15 bp, Homo sapiens
gataagcctgagcct

SEQ ID NO: 3342227 - DNA, 16 bp, Homo sapiens
gataagcctgagcctt

SEQ ID NO: 3342228 - DNA, 17 bp, Homo sapiens
gataagcctgagcctta

SEQ ID NO: 3342229 - DNA, 18 bp, Homo sapiens
gataagcctgagccttag

SEQ ID NO: 3342230 - DNA, 22 bp, Homo sapiens
gataataaattgaaattgtgaa

SEQ ID NO: 3342231 - DNA, 19 bp, Homo sapiens
gataataatattgtttttc

SEQ ID NO: 3342232 - DNA, 14 bp, Homo sapiens
gataataatcttgg

SEQ ID NO: 3342233 - DNA, 17 bp, Homo sapiens
gataatatatttgcaga

SEQ ID NO: 3342234 - DNA, 23 bp, Homo sapiens
gataatatctttgtgataattta

SEQ ID NO: 3342235 - DNA, 18 bp, Homo sapiens
gaggcctggggaggccct

SEQ ID NO: 3342236 - DNA, 13 bp, Homo sapiens
gaggcctggggcc

SEQ ID NO: 3342237 - DNA, 17 bp, Homo sapiens
gaggcggcccggccagc

SEQ ID NO: 3342238 - DNA, 18 bp, Homo sapiens
gaggcggcccggccagcg

SEQ ID NO: 3342239 - DNA, 13 bp, Homo sapiens
gaggcgggccagc

SEQ ID NO: 3342240 - DNA, 20 bp, Homo sapiens
gaggctattattttcactgt

SEQ ID NO: 3342241 - DNA, 15 bp, Homo sapiens
gaggctccacttggt

SEQ ID NO: 3342242 - DNA, 17 bp, Homo sapiens
gaggctccacttggtct

SEQ ID NO: 3342243 - DNA, 19 bp, Homo sapiens
gaggctccacttggtctgt

SEQ ID NO: 3342244 - DNA, 12 bp, Homo sapiens
gaggctccagga

SEQ ID NO: 3342245 - DNA, 13 bp, Homo sapiens
gaggctccaggac

SEQ ID NO: 3342246 - DNA, 20 bp, Homo sapiens
gaggctccaggactccactg

SEQ ID NO: 3342247 - DNA, 13 bp, Homo sapiens
gaggctccccagg

SEQ ID NO: 3342248 - DNA, 14 bp, Homo sapiens
gaggctccccaggg

SEQ ID NO: 3342249 - DNA, 19 bp, Homo sapiens
gaggctgacgtgtgaggga

SEQ ID NO: 3342250 - DNA, 16 bp, Homo sapiens
gaggctgaggcctgga

SEQ ID NO: 3342251 - DNA, 16 bp, Homo sapiens
gaggctgcagagctga

SEQ ID NO: 3342252 - DNA, 14 bp, Homo sapiens
gaggctgcctctcc

SEQ ID NO: 3342253 - DNA, 11 bp, Homo sapiens
gaggctgctag

SEQ ID NO: 3342254 - DNA, 15 bp, Homo sapiens
gaggctgggcacaga

SEQ ID NO: 3342255 - DNA, 18 bp, Homo sapiens
gaggctgggcacagaggt

SEQ ID NO: 3342256 - DNA, 13 bp, Homo sapiens
gaggctgtctggg

SEQ ID NO: 3342257 - DNA, 21 bp, Homo sapiens
gaggctgtgtgcctgggggag

SEQ ID NO: 3342258 - DNA, 13 bp, Homo sapiens
gaggcttccaggc

SEQ ID NO: 3342259 - DNA, 13 bp, Homo sapiens
gaggcttcctgcg

SEQ ID NO: 3342260 - DNA, 18 bp, Homo sapiens
gaggcttctccgccagcc

SEQ ID NO: 3342261 - DNA, 20 bp, Homo sapiens
gaggcttctccgccagcctc

SEQ ID NO: 3342262 - DNA, 21 bp, Homo sapiens
gaggcttctccgccagcctcc

SEQ ID NO: 3342263 - DNA, 23 bp, Homo sapiens
gaggcttgtttacctttctctct

SEQ ID NO: 3342264 - DNA, 21 bp, Homo sapiens
gagggaatccccgaaggtgct

SEQ ID NO: 3342265 - DNA, 13 bp, Homo sapiens
gagggacaggctg

SEQ ID NO: 3342266 - DNA, 16 bp, Homo sapiens
gagggacaggctgaag

SEQ ID NO: 3342267 - DNA, 18 bp, Homo sapiens
gagggacaggctgaagag

SEQ ID NO: 3342268 - DNA, 21 bp, Homo sapiens
gagggacaggctgaagagagg

SEQ ID NO: 3342269 - DNA, 19 bp, Homo sapiens
gagggaccaactgggccca

SEQ ID NO: 3342270 - DNA, 18 bp, Homo sapiens
gagggactgcctctgcca

SEQ ID NO: 3342271 - DNA, 14 bp, Homo sapiens
gagggagaagcatg

SEQ ID NO: 3342272 - DNA, 16 bp, Homo sapiens
gagggagagagagaga

SEQ ID NO: 3342273 - DNA, 21 bp, Homo sapiens
gagggagatctttcccaggcc

SEQ ID NO: 3342274 - DNA, 12 bp, Homo sapiens
gagggagcagac

SEQ ID NO: 3342275 - DNA, 20 bp, Homo sapiens
gagggagcagacaggaggaa

SEQ ID NO: 3342276 - DNA, 13 bp, Homo sapiens
gagggaggaggcc

SEQ ID NO: 3342277 - DNA, 18 bp, Homo sapiens
gagggagggcggtggaca

SEQ ID NO: 3342278 - DNA, 18 bp, Homo sapiens
gagggaggtgtttaaaga

SEQ ID NO: 3342279 - DNA, 14 bp, Homo sapiens
gagggagtgacaga

SEQ ID NO: 3342280 - DNA, 18 bp, Homo sapiens
gagggagtgacagaggca

SEQ ID NO: 3342281 - DNA, 15 bp, Homo sapiens
gagggatcacagggc

SEQ ID NO: 3342282 - DNA, 23 bp, Homo sapiens
gagggatcacagggccccagaag

SEQ ID NO: 3342283 - DNA, 23 bp, Homo sapiens
gagggatgaagggcgagtgaatc

SEQ ID NO: 3342284 - DNA, 15 bp, Homo sapiens
gagggatggagaaag

SEQ ID NO: 3342285 - DNA, 13 bp, Homo sapiens
gagggatggagag

SEQ ID NO: 3342286 - DNA, 18 bp, Homo sapiens
gagggattctggttccag

SEQ ID NO: 3342287 - DNA, 20 bp, Homo sapiens
gagggcaagtggatgggaat

SEQ ID NO: 3342288 - DNA, 17 bp, Homo sapiens
gagggcacagccctccg

SEQ ID NO: 3342289 - DNA, 18 bp, Homo sapiens
gagggcactggtggcccg

SEQ ID NO: 3342290 - DNA, 18 bp, Homo sapiens
gagggcagactggggcat

SEQ ID NO: 3342291 - DNA, 11 bp, Homo sapiens
gagggcagagc

SEQ ID NO: 3342292 - DNA, 20 bp, Homo sapiens
gagggcagagccatgggcct

SEQ ID NO: 3342293 - DNA, 13 bp, Homo sapiens
gagggcagctgct

SEQ ID NO: 3342294 - DNA, 15 bp, Homo sapiens
gagggcagtacctgg

SEQ ID NO: 3342295 - DNA, 16 bp, Homo sapiens
gagggcagtacctggg

SEQ ID NO: 3342296 - DNA, 18 bp, Homo sapiens
gagggccaagacttggca

SEQ ID NO: 3342297 - DNA, 14 bp, Homo sapiens
gagggcccagagca

SEQ ID NO: 3342298 - DNA, 18 bp, Homo sapiens
gagggcccagagcaggaa

SEQ ID NO: 3342299 - DNA, 12 bp, Homo sapiens
gagggcccagcc

SEQ ID NO: 3342300 - DNA, 13 bp, Homo sapiens
gagggcccagccc

SEQ ID NO: 3342301 - DNA, 15 bp, Homo sapiens
gagggcccagcccag

SEQ ID NO: 3342302 - DNA, 20 bp, Homo sapiens
gagggcccagcccagagcca

SEQ ID NO: 3342303 - DNA, 13 bp, Homo sapiens
gagggcccagctg

SEQ ID NO: 3342304 - DNA, 20 bp, Homo sapiens
gagggcccagctgtagccat

SEQ ID NO: 3342305 - DNA, 23 bp, Homo sapiens
gagggcccagctgtagccatggc

SEQ ID NO: 3342306 - DNA, 13 bp, Homo sapiens
gagggcccctgcg

SEQ ID NO: 3342307 - DNA, 15 bp, Homo sapiens
gagggccctacctga

SEQ ID NO: 3342308 - DNA, 21 bp, Homo sapiens
gagggccgtaccccaccctca

SEQ ID NO: 3342309 - DNA, 19 bp, Homo sapiens
gagggcggcaggggcctgg

SEQ ID NO: 3342310 - DNA, 23 bp, Homo sapiens
gagggcggcaggggcctggagat

SEQ ID NO: 3342311 - DNA, 21 bp, Homo sapiens
gagggctcgaggggtgggctg

SEQ ID NO: 3342312 - DNA, 21 bp, Homo sapiens
gagggcttcctctagaagcca

SEQ ID NO: 3342313 - DNA, 12 bp, Homo sapiens
gaggggaacaga

SEQ ID NO: 3342314 - DNA, 16 bp, Homo sapiens
gaggggaagctgcagc

SEQ ID NO: 3342315 - DNA, 19 bp, Homo sapiens
gaggggaagctgcagcttg

SEQ ID NO: 3342316 - DNA, 14 bp, Homo sapiens
gaggggaagtccct

SEQ ID NO: 3342317 - DNA, 11 bp, Homo sapiens
gaggggagggg

SEQ ID NO: 3342318 - DNA, 17 bp, Homo sapiens
gaggggatccagccact

SEQ ID NO: 3342319 - DNA, 13 bp, Homo sapiens
gaggggcagccgc

SEQ ID NO: 3342320 - DNA, 14 bp, Homo sapiens
gaggggcaggctga

SEQ ID NO: 3342321 - DNA, 14 bp, Homo sapiens
gaggggccaggccc

SEQ ID NO: 3342322 - DNA, 17 bp, Homo sapiens
gaggggccaggcccagg

SEQ ID NO: 3342323 - DNA, 18 bp, Homo sapiens
gaggggccaggcccaggc

SEQ ID NO: 3342324 - DNA, 14 bp, Homo sapiens
gaggggcccctgct

SEQ ID NO: 3342325 - DNA, 18 bp, Homo sapiens
gaggggcccggtggcggc

SEQ ID NO: 3342326 - DNA, 13 bp, Homo sapiens
gaggggccctccg

SEQ ID NO: 3342327 - DNA, 20 bp, Homo sapiens
gaggggccctccgagggtgc

SEQ ID NO: 3342328 - DNA, 14 bp, Homo sapiens
gaggggcctggcag

SEQ ID NO: 3342329 - DNA, 18 bp, Homo sapiens
gaggggcctggcagccgt

SEQ ID NO: 3342330 - DNA, 16 bp, Homo sapiens
gaggggcgcgggaggg

SEQ ID NO: 3342331 - DNA, 17 bp, Homo sapiens
gaggggcgctggcccag

SEQ ID NO: 3342332 - DNA, 12 bp, Homo sapiens
gaggggctcctg

SEQ ID NO: 3342333 - DNA, 14 bp, Homo sapiens
gaggggctggggca

SEQ ID NO: 3342334 - DNA, 18 bp, Homo sapiens
gagggggaagtcgaagga

SEQ ID NO: 3342335 - DNA, 14 bp, Homo sapiens
gagggggagtagcc

SEQ ID NO: 3342336 - DNA, 15 bp, Homo sapiens
gagggggagtagcca

SEQ ID NO: 3342337 - DNA, 20 bp, Homo sapiens
gagggggcgctcaggaccca

SEQ ID NO: 3342338 - DNA, 17 bp, Homo sapiens
gagggggcttgaagcca

SEQ ID NO: 3342339 - DNA, 21 bp, Homo sapiens
gagggggcttgaagccaaaga

SEQ ID NO: 3342340 - DNA, 19 bp, Homo sapiens
gaggggggggtgggtgaga

SEQ ID NO: 3342341 - DNA, 17 bp, Homo sapiens
gaggggggtgctggccc

SEQ ID NO: 3342342 - DNA, 14 bp, Homo sapiens
gagggggtggaggg

SEQ ID NO: 3342343 - DNA, 19 bp, Homo sapiens
gagggggttacaaactgca

SEQ ID NO: 3342344 - DNA, 20 bp, Homo sapiens
gagggggttacaaactgcaa

SEQ ID NO: 3342345 - DNA, 17 bp, Homo sapiens
gaggggtgtggcagtgg

SEQ ID NO: 3342346 - DNA, 18 bp, Homo sapiens
gaggggtgtggcagtggt

SEQ ID NO: 3342347 - DNA, 17 bp, Homo sapiens
gaggggttgccacaggc

SEQ ID NO: 3342348 - DNA, 15 bp, Homo sapiens
gagggtacagctggg

SEQ ID NO: 3342349 - DNA, 19 bp, Homo sapiens
gagggtatggtgctgctct

SEQ ID NO: 3342350 - DNA, 14 bp, Homo sapiens
gagggtctgaggaa

SEQ ID NO: 3342351 - DNA, 14 bp, Homo sapiens
gagggtggaggaag

SEQ ID NO: 3342352 - DNA, 21 bp, Homo sapiens
gagggtggtgacctctgcctg

SEQ ID NO: 3342353 - DNA, 16 bp, Homo sapiens
gagggtgtttcctcta

SEQ ID NO: 3342354 - DNA, 17 bp, Homo sapiens
gagggttcccctggcct

SEQ ID NO: 3342355 - DNA, 14 bp, Homo sapiens
gagggttgggctgg

SEQ ID NO: 3342356 - DNA, 14 bp, Homo sapiens
gagggttggggagg

SEQ ID NO: 3342357 - DNA, 17 bp, Homo sapiens
gagggttggggaggggc

SEQ ID NO: 3342358 - DNA, 21 bp, Homo sapiens
gaggtaacagaacagcttcag

SEQ ID NO: 3342359 - DNA, 21 bp, Homo sapiens
gaggtagaccaggatttctaa

SEQ ID NO: 3342360 - DNA, 14 bp, Homo sapiens
gaggtatattggaa

SEQ ID NO: 3342361 - DNA, 15 bp, Homo sapiens
gaggtcaccagggga

SEQ ID NO: 3342362 - DNA, 21 bp, Homo sapiens
gaggtcaccaggggaggagcc

SEQ ID NO: 3342363 - DNA, 21 bp, Homo sapiens
gaggtcactccaccatcccca

SEQ ID NO: 3342364 - DNA, 15 bp, Homo sapiens
gaggtcactggaaag

SEQ ID NO: 3342365 - DNA, 20 bp, Homo sapiens
gaggtcactggaaaggggag

SEQ ID NO: 3342366 - DNA, 22 bp, Homo sapiens
gaggtcaggaagcaggggtggg

SEQ ID NO: 3342367 - DNA, 14 bp, Homo sapiens
gaggtcaggcccca

SEQ ID NO: 3342368 - DNA, 15 bp, Homo sapiens
gaggtcaggccctgg

SEQ ID NO: 3342369 - DNA, 23 bp, Homo sapiens
gaggtccaccggcccctggcagc

SEQ ID NO: 3342370 - DNA, 13 bp, Homo sapiens
gaggtccagccca

SEQ ID NO: 3342371 - DNA, 22 bp, Homo sapiens
gaggtccctgtgtgtaggctgg

SEQ ID NO: 3342372 - DNA, 20 bp, Homo sapiens
gaggtcctctggagccctaa

SEQ ID NO: 3342373 - DNA, 16 bp, Homo sapiens
gaggtcctttggacag

SEQ ID NO: 3342374 - DNA, 12 bp, Homo sapiens
gaggtctccagg

SEQ ID NO: 3342375 - DNA, 17 bp, Homo sapiens
gaggtctccccatcccc

SEQ ID NO: 3342376 - DNA, 21 bp, Homo sapiens
gaggtctgtacgttacctctt

SEQ ID NO: 3342377 - DNA, 14 bp, Homo sapiens
gaggtgaaaatgaa

SEQ ID NO: 3342378 - DNA, 18 bp, Homo sapiens
gaggtgaaaatgaagaag

SEQ ID NO: 3342379 - DNA, 15 bp, Homo sapiens
gaggtgaaagggagc

SEQ ID NO: 3342380 - DNA, 19 bp, Homo sapiens
gaggtgagctactttgtga

SEQ ID NO: 3342381 - DNA, 21 bp, Homo sapiens
gaggtgaggggggctggcggg

SEQ ID NO: 3342382 - DNA, 15 bp, Homo sapiens
gaggtggcagccctg

SEQ ID NO: 3342383 - DNA, 20 bp, Homo sapiens
gaggtggcttttgcggccag

SEQ ID NO: 3342384 - DNA, 17 bp, Homo sapiens
gaggtgggagcaggaga

SEQ ID NO: 3342385 - DNA, 23 bp, Homo sapiens
gaggtgggagcaggagattgaga

SEQ ID NO: 3342386 - DNA, 11 bp, Homo sapiens
gaggtgggcag

SEQ ID NO: 3342387 - DNA, 15 bp, Homo sapiens
gaggtgggcagctgg

SEQ ID NO: 3342388 - DNA, 16 bp, Homo sapiens
gaggtgggcagctggg

SEQ ID NO: 3342389 - DNA, 18 bp, Homo sapiens
gaggtgggcagctgggcc

SEQ ID NO: 3342390 - DNA, 20 bp, Homo sapiens
gaggtgggcatgccaccctc

SEQ ID NO: 3342391 - DNA, 14 bp, Homo sapiens
gaggtgggcccagg

SEQ ID NO: 3342392 - DNA, 16 bp, Homo sapiens
gaggtgggctggggct

SEQ ID NO: 3342393 - DNA, 21 bp, Homo sapiens
gaggtgggctggggctgctcc

SEQ ID NO: 3342394 - DNA, 17 bp, Homo sapiens
gaggtgggtgtgggtgg

SEQ ID NO: 3342395 - DNA, 13 bp, Homo sapiens
gaggtggtctgaa

SEQ ID NO: 3342396 - DNA, 20 bp, Homo sapiens
gaggtggtctgaatgttctg

SEQ ID NO: 3342397 - DNA, 12 bp, Homo sapiens
gaggtggtttta

SEQ ID NO: 3342398 - DNA, 19 bp, Homo sapiens
gaggtgtttaaagagaggt

SEQ ID NO: 3342399 - DNA, 21 bp, Homo sapiens
gaggtgtttaaagagaggtta

SEQ ID NO: 3342400 - DNA, 22 bp, Homo sapiens
gaggttaggagttcgagaccag

SEQ ID NO: 3342401 - DNA, 13 bp, Homo sapiens
gaggttatctgcc

SEQ ID NO: 3342402 - DNA, 18 bp, Homo sapiens
gaggttatctgcctggcc

SEQ ID NO: 3342403 - DNA, 21 bp, Homo sapiens
gaggttatctgcctggcctgg

SEQ ID NO: 3342404 - DNA, 16 bp, Homo sapiens
gaggttcctctgcctg

SEQ ID NO: 3342405 - DNA, 19 bp, Homo sapiens
gaggttctcagagccaagt

SEQ ID NO: 3342406 - DNA, 16 bp, Homo sapiens
gaggttctgagaccag

SEQ ID NO: 3342407 - DNA, 13 bp, Homo sapiens
gaggttgaagcca

SEQ ID NO: 3342408 - DNA, 13 bp, Homo sapiens
gaggttgcagtgt

SEQ ID NO: 3342409 - DNA, 12 bp, Homo sapiens
gaggttggattt

SEQ ID NO: 3342410 - DNA, 16 bp, Homo sapiens
gaggtttggaagagtg

SEQ ID NO: 3342411 - DNA, 16 bp, Homo sapiens
gagtaaatacaggtag

SEQ ID NO: 3342412 - DNA, 19 bp, Homo sapiens
gagtaacaatacaaatgga

SEQ ID NO: 3342413 - DNA, 20 bp, Homo sapiens
gagtaacaatacaaatggat

SEQ ID NO: 3342414 - DNA, 13 bp, Homo sapiens
gagtaacatttgc

SEQ ID NO: 3342415 - DNA, 15 bp, Homo sapiens
gagtaacatttgctg

SEQ ID NO: 3342416 - DNA, 21 bp, Homo sapiens
gagtaactattattataggta

SEQ ID NO: 3342417 - DNA, 12 bp, Homo sapiens
gagtaagagctg

SEQ ID NO: 3342418 - DNA, 23 bp, Homo sapiens
gagtaatgcatacagaaatataa

SEQ ID NO: 3342419 - DNA, 17 bp, Homo sapiens
gagtaatggtgtagaac

SEQ ID NO: 3342420 - DNA, 16 bp, Homo sapiens
gagtacctgctgcccc

SEQ ID NO: 3342421 - DNA, 18 bp, Homo sapiens
gagtacctgctgccccag

SEQ ID NO: 3342422 - DNA, 13 bp, Homo sapiens
gagtagagaggcc

SEQ ID NO: 3342423 - DNA, 21 bp, Homo sapiens
gagtagagaggcccgcccgcc

SEQ ID NO: 3342424 - DNA, 18 bp, Homo sapiens
gagtagatggtgaaattt

SEQ ID NO: 3342425 - DNA, 21 bp, Homo sapiens
gagtaggcggcgatttttgta

SEQ ID NO: 3342426 - DNA, 19 bp, Homo sapiens
gagtatacaatatataaaa

SEQ ID NO: 3342427 - DNA, 19 bp, Homo sapiens
gagtatacctcctatatgt

SEQ ID NO: 3342428 - DNA, 22 bp, Homo sapiens
gagtatgttaagctctttatga

SEQ ID NO: 3342429 - DNA, 17 bp, Homo sapiens
gagtattaagaatgcag

SEQ ID NO: 3342430 - DNA, 21 bp, Homo sapiens
gagtattctcataggagactg

SEQ ID NO: 3342431 - DNA, 20 bp, Homo sapiens
gagtatttaggcagattgaa

SEQ ID NO: 3342432 - DNA, 13 bp, Homo sapiens
gagtatttggtaa

SEQ ID NO: 3342433 - DNA, 20 bp, Homo sapiens
gagtcaaaggcatctccctt

SEQ ID NO: 3342434 - DNA, 15 bp, Homo sapiens
gagtcaatgtgcagt

SEQ ID NO: 3342435 - DNA, 14 bp, Homo sapiens
gagtcaccaagccc

SEQ ID NO: 3342436 - DNA, 12 bp, Homo sapiens
gagtcacctgca

SEQ ID NO: 3342437 - DNA, 16 bp, Homo sapiens
gagtcacctgcaagcc

SEQ ID NO: 3342438 - DNA, 12 bp, Homo sapiens
gagtcagagccc

SEQ ID NO: 3342439 - DNA, 13 bp, Homo sapiens
gagtcagagccct

SEQ ID NO: 3342440 - DNA, 14 bp, Homo sapiens
gagtcagagccctg

SEQ ID NO: 3342441 - DNA, 22 bp, Homo sapiens
gagtcagagccctggctgggtt

SEQ ID NO: 3342442 - DNA, 14 bp, Homo sapiens
gagtcagaggagaa

SEQ ID NO: 3342443 - DNA, 14 bp, Homo sapiens
gagtcagccaggag

SEQ ID NO: 3342444 - DNA, 16 bp, Homo sapiens
gagtcagggcccagag

SEQ ID NO: 3342445 - DNA, 19 bp, Homo sapiens
gagtcagtgtctggctttt

SEQ ID NO: 3342446 - DNA, 16 bp, Homo sapiens
gagtcattgacttcat

SEQ ID NO: 3342447 - DNA, 15 bp, Homo sapiens
gagtccacacttgaa

SEQ ID NO: 3342448 - DNA, 15 bp, Homo sapiens
gagtccattctccca

SEQ ID NO: 3342449 - DNA, 13 bp, Homo sapiens
gagtcccaccttg

SEQ ID NO: 3342450 - DNA, 21 bp, Homo sapiens
gagtcccaccttggctgcagg

SEQ ID NO: 3342451 - DNA, 14 bp, Homo sapiens
gagtcccactgcct

SEQ ID NO: 3342452 - DNA, 17 bp, Homo sapiens
gagtcccactgcctcag

SEQ ID NO: 3342453 - DNA, 22 bp, Homo sapiens
gagtcccactgcctcaggttcc

SEQ ID NO: 3342454 - DNA, 23 bp, Homo sapiens
gagtcccactgcctcaggttcct

SEQ ID NO: 3342455 - DNA, 16 bp, Homo sapiens
gagtcccccagagatg

SEQ ID NO: 3342456 - DNA, 18 bp, Homo sapiens
gagtcccctactccctct

SEQ ID NO: 3342457 - DNA, 17 bp, Homo sapiens
gagtcccctcacctcct

SEQ ID NO: 3342458 - DNA, 19 bp, Homo sapiens
gagtcccctcacctcctct

SEQ ID NO: 3342459 - DNA, 16 bp, Homo sapiens
gagtcccctccaggaa

SEQ ID NO: 3342460 - DNA, 11 bp, Homo sapiens
gagtccctgct

SEQ ID NO: 3342461 - DNA, 19 bp, Homo sapiens
gagtccgaaagggacttgg

SEQ ID NO: 3342462 - DNA, 16 bp, Homo sapiens
gagtcctcactcccag

SEQ ID NO: 3342463 - DNA, 17 bp, Homo sapiens
gagtcctctagcaggcc

SEQ ID NO: 3342464 - DNA, 19 bp, Homo sapiens
gagtcctctagcaggccta

SEQ ID NO: 3342465 - DNA, 17 bp, Homo sapiens
gagtcctggtccctctg

SEQ ID NO: 3342466 - DNA, 20 bp, Homo sapiens
gagtcctggtccctctgagg

SEQ ID NO: 3342467 - DNA, 13 bp, Homo sapiens
gagtcctgtctct

SEQ ID NO: 3342468 - DNA, 14 bp, Homo sapiens
gagtcctgtctctg

SEQ ID NO: 3342469 - DNA, 20 bp, Homo sapiens
gagtcctgtctctgcctgcg

SEQ ID NO: 3342470 - DNA, 22 bp, Homo sapiens
gagtcgtacagaaagctgcctg

SEQ ID NO: 3342471 - DNA, 19 bp, Homo sapiens
gagtcgttggagactgaag

SEQ ID NO: 3342472 - DNA, 11 bp, Homo sapiens
gagtctaaaga

SEQ ID NO: 3342473 - DNA, 13 bp, Homo sapiens
gagtctagattca

SEQ ID NO: 3342474 - DNA, 21 bp, Homo sapiens
gagtctagattcaaaggttct

SEQ ID NO: 3342475 - DNA, 22 bp, Homo sapiens
gagtctagattcaaaggttcta

SEQ ID NO: 3342476 - DNA, 20 bp, Homo sapiens
gagtctagcactcattttct

SEQ ID NO: 3342477 - DNA, 22 bp, Homo sapiens
gagtctagcactcattttctat

SEQ ID NO: 3342478 - DNA, 20 bp, Homo sapiens
gagtctcactgttgcccagg

SEQ ID NO: 3342479 - DNA, 14 bp, Homo sapiens
gagtctcccaaggc

SEQ ID NO: 3342480 - DNA, 12 bp, Homo sapiens
gagtctcctgtg

SEQ ID NO: 3342481 - DNA, 14 bp, Homo sapiens
gagtctctgccacc

SEQ ID NO: 3342482 - DNA, 20 bp, Homo sapiens
gagtctctgccacccactca

SEQ ID NO: 3342483 - DNA, 12 bp, Homo sapiens
gagtctcttctc

SEQ ID NO: 3342484 - DNA, 14 bp, Homo sapiens
gagtctcttctcca

SEQ ID NO: 3342485 - DNA, 13 bp, Homo sapiens
gagtctgagtcct

SEQ ID NO: 3342486 - DNA, 11 bp, Homo sapiens
gagtctgggac

SEQ ID NO: 3342487 - DNA, 13 bp, Homo sapiens
gagtctgggcctc

SEQ ID NO: 3342488 - DNA, 14 bp, Homo sapiens
gagtctgggcctct

SEQ ID NO: 3342489 - DNA, 16 bp, Homo sapiens
gagtctgggcctctga

SEQ ID NO: 3342490 - DNA, 20 bp, Homo sapiens
gagtcttactctgccgccca

SEQ ID NO: 3342491 - DNA, 21 bp, Homo sapiens
gagtcttggcggcagcagcca

SEQ ID NO: 3342492 - DNA, 17 bp, Homo sapiens
gagtcttgggcctggcc

SEQ ID NO: 3342493 - DNA, 22 bp, Homo sapiens
gagtcttggtttctctctacag

SEQ ID NO: 3342494 - DNA, 16 bp, Homo sapiens
gagtctttggttctaa

SEQ ID NO: 3342495 - DNA, 21 bp, Homo sapiens
gagtgaaacctttagggcagc

SEQ ID NO: 3342496 - DNA, 20 bp, Homo sapiens
gaggacgctctctggccttc

SEQ ID NO: 3342497 - DNA, 21 bp, Homo sapiens
gaggacgctctctggccttcg

SEQ ID NO: 3342498 - DNA, 23 bp, Homo sapiens
gaggacgtcatcggaggctgggc

SEQ ID NO: 3342499 - DNA, 20 bp, Homo sapiens
gaggactcccaaccctggct

SEQ ID NO: 3342500 - DNA, 19 bp, Homo sapiens
gaggactcgcttgtaaata

SEQ ID NO: 3342501 - DNA, 11 bp, Homo sapiens
gaggactgaga

SEQ ID NO: 3342502 - DNA, 13 bp, Homo sapiens
gaggactgagact

SEQ ID NO: 3342503 - DNA, 14 bp, Homo sapiens
gaggacttgtgtct

SEQ ID NO: 3342504 - DNA, 16 bp, Homo sapiens
gaggacttgtgtctct

SEQ ID NO: 3342505 - DNA, 12 bp, Homo sapiens
gaggagaccctg

SEQ ID NO: 3342506 - DNA, 13 bp, Homo sapiens
gaggagaccctgg

SEQ ID NO: 3342507 - DNA, 13 bp, Homo sapiens
gaggagagagacc

SEQ ID NO: 3342508 - DNA, 17 bp, Homo sapiens
gaggagagagaccccgc

SEQ ID NO: 3342509 - DNA, 11 bp, Homo sapiens
gaggagagagg

SEQ ID NO: 3342510 - DNA, 14 bp, Homo sapiens
gaggagagaggcag

SEQ ID NO: 3342511 - DNA, 17 bp, Homo sapiens
gaggagaggagagaggc

SEQ ID NO: 3342512 - DNA, 20 bp, Homo sapiens
gaggagaggggaagggccag

SEQ ID NO: 3342513 - DNA, 13 bp, Homo sapiens
gaggagcacctga

SEQ ID NO: 3342514 - DNA, 19 bp, Homo sapiens
gaggagcagcttccttctg

SEQ ID NO: 3342515 - DNA, 20 bp, Homo sapiens
gaggagcagcttccttctgg

SEQ ID NO: 3342516 - DNA, 14 bp, Homo sapiens
gaggagccagacag

SEQ ID NO: 3342517 - DNA, 13 bp, Homo sapiens
gaggagccaggca

SEQ ID NO: 3342518 - DNA, 14 bp, Homo sapiens
gaggagccccagct

SEQ ID NO: 3342519 - DNA, 23 bp, Homo sapiens
gaggagccggccaccagatgctg

SEQ ID NO: 3342520 - DNA, 21 bp, Homo sapiens
gaggagcctgtgcgtcccagc

SEQ ID NO: 3342521 - DNA, 23 bp, Homo sapiens
gaggagcctgtgcgtcccagctg

SEQ ID NO: 3342522 - DNA, 16 bp, Homo sapiens
gaggagctctaccctg

SEQ ID NO: 3342523 - DNA, 20 bp, Homo sapiens
gaggagctctaccctgctcc

SEQ ID NO: 3342524 - DNA, 21 bp, Homo sapiens
gaggagctctaccctgctccc

SEQ ID NO: 3342525 - DNA, 22 bp, Homo sapiens
gaggagctctaccctgctccct

SEQ ID NO: 3342526 - DNA, 11 bp, Homo sapiens
gaggagctgct

SEQ ID NO: 3342527 - DNA, 13 bp, Homo sapiens
gaggaggaaggca

SEQ ID NO: 3342528 - DNA, 16 bp, Homo sapiens
gaggaggaaggcaaga

SEQ ID NO: 3342529 - DNA, 13 bp, Homo sapiens
gaggaggagatgg

SEQ ID NO: 3342530 - DNA, 19 bp, Homo sapiens
gaggaggatgtccctgggc

SEQ ID NO: 3342531 - DNA, 21 bp, Homo sapiens
gaggaggatgtccctgggcca

SEQ ID NO: 3342532 - DNA, 23 bp, Homo sapiens
gaggaggatgtccctgggccagg

SEQ ID NO: 3342533 - DNA, 15 bp, Homo sapiens
gaggaggcgcggcct

SEQ ID NO: 3342534 - DNA, 13 bp, Homo sapiens
gaggagggagaag

SEQ ID NO: 3342535 - DNA, 14 bp, Homo sapiens
gaggagggagaaga

SEQ ID NO: 3342536 - DNA, 17 bp, Homo sapiens
gaggagggagagggagg

SEQ ID NO: 3342537 - DNA, 16 bp, Homo sapiens
gaggagggaggccagg

SEQ ID NO: 3342538 - DNA, 14 bp, Homo sapiens
gaggagggaggccg

SEQ ID NO: 3342539 - DNA, 15 bp, Homo sapiens
gaggagggatgctgc

SEQ ID NO: 3342540 - DNA, 19 bp, Homo sapiens
gaggagggatgctgcctga

SEQ ID NO: 3342541 - DNA, 21 bp, Homo sapiens
gaggagggtttgggcagagcg

SEQ ID NO: 3342542 - DNA, 18 bp, Homo sapiens
gaggaggtggcagccctg

SEQ ID NO: 3342543 - DNA, 22 bp, Homo sapiens
gaggaggtggcagccctgtagg

SEQ ID NO: 3342544 - DNA, 18 bp, Homo sapiens
gaggaggttcactgagct

SEQ ID NO: 3342545 - DNA, 20 bp, Homo sapiens
gaggagtttcctaaaagttc

SEQ ID NO: 3342546 - DNA, 17 bp, Homo sapiens
gaggatcactggagccc

SEQ ID NO: 3342547 - DNA, 18 bp, Homo sapiens
gaggatgaatagatgtga

SEQ ID NO: 3342548 - DNA, 17 bp, Homo sapiens
gaggatgagagcccaga

SEQ ID NO: 3342549 - DNA, 18 bp, Homo sapiens
gaggatgagagcccagag

SEQ ID NO: 3342550 - DNA, 17 bp, Homo sapiens
gaggatgagcagaccag

SEQ ID NO: 3342551 - DNA, 12 bp, Homo sapiens
gaggatggagag

SEQ ID NO: 3342552 - DNA, 14 bp, Homo sapiens
gaggatggagagag

SEQ ID NO: 3342553 - DNA, 15 bp, Homo sapiens
gaggatggccagtgt

SEQ ID NO: 3342554 - DNA, 20 bp, Homo sapiens
gaggatggccagtgtctgtc

SEQ ID NO: 3342555 - DNA, 20 bp, Homo sapiens
gaggatgtccctgggccagg

SEQ ID NO: 3342556 - DNA, 19 bp, Homo sapiens
gaggatgtggaaagcactt

SEQ ID NO: 3342557 - DNA, 20 bp, Homo sapiens
gaggatttaagggatggaaa

SEQ ID NO: 3342558 - DNA, 22 bp, Homo sapiens
gaggattttccagttctgacac

SEQ ID NO: 3342559 - DNA, 17 bp, Homo sapiens
gaggatttttttctgag

SEQ ID NO: 3342560 - DNA, 14 bp, Homo sapiens
gaggcaagaaaagg

SEQ ID NO: 3342561 - DNA, 14 bp, Homo sapiens
gaggcaagagactg

SEQ ID NO: 3342562 - DNA, 17 bp, Homo sapiens
gaggcaagctgaaattt

SEQ ID NO: 3342563 - DNA, 17 bp, Homo sapiens
gaggcaccggcgctgca

SEQ ID NO: 3342564 - DNA, 18 bp, Homo sapiens
gaggcaccggcgctgcag

SEQ ID NO: 3342565 - DNA, 20 bp, Homo sapiens
gaggcaccggcgctgcaggt

SEQ ID NO: 3342566 - DNA, 22 bp, Homo sapiens
gaggcagagagcggtctcaggc

SEQ ID NO: 3342567 - DNA, 18 bp, Homo sapiens
gaggcagccccattctgc

SEQ ID NO: 3342568 - DNA, 19 bp, Homo sapiens
gaggcagccccattctgcc

SEQ ID NO: 3342569 - DNA, 23 bp, Homo sapiens
gaggcagccccattctgcctgcc

SEQ ID NO: 3342570 - DNA, 15 bp, Homo sapiens
gaggcagccccctcc

SEQ ID NO: 3342571 - DNA, 12 bp, Homo sapiens
gaggcagcccgc

SEQ ID NO: 3342572 - DNA, 20 bp, Homo sapiens
gaggcagcttcaagtgcctt

SEQ ID NO: 3342573 - DNA, 21 bp, Homo sapiens
gaggcagcttcaagtgccttt

SEQ ID NO: 3342574 - DNA, 14 bp, Homo sapiens
gaggcaggctccag

SEQ ID NO: 3342575 - DNA, 15 bp, Homo sapiens
gaggcagggagggga

SEQ ID NO: 3342576 - DNA, 14 bp, Homo sapiens
gaggcagggtctca

SEQ ID NO: 3342577 - DNA, 19 bp, Homo sapiens
gaggcagggtctcactctg

SEQ ID NO: 3342578 - DNA, 18 bp, Homo sapiens
gaggcatcctgcctgggt

SEQ ID NO: 3342579 - DNA, 21 bp, Homo sapiens
gaggcatcctgcctgggtggg

SEQ ID NO: 3342580 - DNA, 17 bp, Homo sapiens
gaggcatggccctgggg

SEQ ID NO: 3342581 - DNA, 15 bp, Homo sapiens
gagctttcaaagaag

SEQ ID NO: 3342582 - DNA, 18 bp, Homo sapiens
gagctttcaaagaaggaa

SEQ ID NO: 3342583 - DNA, 23 bp, Homo sapiens
gagctttggggacagttggcaga

SEQ ID NO: 3342584 - DNA, 15 bp, Homo sapiens
gagctttttttaaat

SEQ ID NO: 3342585 - DNA, 12 bp, Homo sapiens
gaggaaaaaaga

SEQ ID NO: 3342586 - DNA, 16 bp, Homo sapiens
gaggaaaaaagaacca

SEQ ID NO: 3342587 - DNA, 23 bp, Homo sapiens
gaggaaaaaagaaccaaaacttc

SEQ ID NO: 3342588 - DNA, 20 bp, Homo sapiens
gaggaaaaccaagccgtggc

SEQ ID NO: 3342589 - DNA, 14 bp, Homo sapiens
gaggaaagagagca

SEQ ID NO: 3342590 - DNA, 16 bp, Homo sapiens
gaggaaagagtcttca

SEQ ID NO: 3342591 - DNA, 20 bp, Homo sapiens
gaggaaagagtcttcaacat

SEQ ID NO: 3342592 - DNA, 23 bp, Homo sapiens
gaggaacagtgtggtttgggaaa

SEQ ID NO: 3342593 - DNA, 15 bp, Homo sapiens
gaggaactgtacaga

SEQ ID NO: 3342594 - DNA, 13 bp, Homo sapiens
gaggaagagcagg

SEQ ID NO: 3342595 - DNA, 19 bp, Homo sapiens
gaggaagagcaggcacatg

SEQ ID NO: 3342596 - DNA, 21 bp, Homo sapiens
gaggaagatgggggcaagaag

SEQ ID NO: 3342597 - DNA, 19 bp, Homo sapiens
gaggaaggaacagcaatgg

SEQ ID NO: 3342598 - DNA, 15 bp, Homo sapiens
gaggaaggattgtaa

SEQ ID NO: 3342599 - DNA, 16 bp, Homo sapiens
gaggaaggattgtaaa

SEQ ID NO: 3342600 - DNA, 12 bp, Homo sapiens
gaggaaggctga

SEQ ID NO: 3342601 - DNA, 14 bp, Homo sapiens
gaggaaggctgaac

SEQ ID NO: 3342602 - DNA, 18 bp, Homo sapiens
gaggaagggatgggcccc

SEQ ID NO: 3342603 - DNA, 17 bp, Homo sapiens
gaggaataaatgccttt

SEQ ID NO: 3342604 - DNA, 19 bp, Homo sapiens
gaggaataaatgcctttat

SEQ ID NO: 3342605 - DNA, 17 bp, Homo sapiens
gaggaataattatttat

SEQ ID NO: 3342606 - DNA, 23 bp, Homo sapiens
gaggaatatgacggaagaacata

SEQ ID NO: 3342607 - DNA, 19 bp, Homo sapiens
gaggaatcctggcagccca

SEQ ID NO: 3342608 - DNA, 22 bp, Homo sapiens
gaggaatctgtgggtctgggag

SEQ ID NO: 3342609 - DNA, 15 bp, Homo sapiens
gaggaatgctctgtg

SEQ ID NO: 3342610 - DNA, 14 bp, Homo sapiens
gaggacaaaacttc

SEQ ID NO: 3342611 - DNA, 15 bp, Homo sapiens
gaggacaaccattcc

SEQ ID NO: 3342612 - DNA, 13 bp, Homo sapiens
gaggacagggagg

SEQ ID NO: 3342613 - DNA, 21 bp, Homo sapiens
gaggacatgtttttgttttct

SEQ ID NO: 3342614 - DNA, 13 bp, Homo sapiens
gaggaccactcct

SEQ ID NO: 3342615 - DNA, 22 bp, Homo sapiens
gaggaccactcctgtacactga

SEQ ID NO: 3342616 - DNA, 21 bp, Homo sapiens
gaggacgcacgctcgctgcca

SEQ ID NO: 3342617 - DNA, 22 bp, Homo sapiens
gaggacgcacgctcgctgccat

SEQ ID NO: 3342618 - DNA, 23 bp, Homo sapiens
gaggacgcacgctcgctgccatc

SEQ ID NO: 3342619 - DNA, 15 bp, Homo sapiens
gaggacgctctctgg

SEQ ID NO: 3342620 - DNA, 17 bp, Homo sapiens
gagcaggaaggcctggg

SEQ ID NO: 3342621 - DNA, 18 bp, Homo sapiens
gagcaggaaggcctgggt

SEQ ID NO: 3342622 - DNA, 12 bp, Homo sapiens
gagcaggacctc

SEQ ID NO: 3342623 - DNA, 19 bp, Homo sapiens
gagcaggactccaggccca

SEQ ID NO: 3342624 - DNA, 19 bp, Homo sapiens
gagcaggactctattttaa

SEQ ID NO: 3342625 - DNA, 18 bp, Homo sapiens
gagcaggagattgagaag

SEQ ID NO: 3342626 - DNA, 22 bp, Homo sapiens
gagcaggccggaaccacagggc

SEQ ID NO: 3342627 - DNA, 18 bp, Homo sapiens
gagcaggcggtggggaga

SEQ ID NO: 3342628 - DNA, 19 bp, Homo sapiens
gagcaggctggcagctctc

SEQ ID NO: 3342629 - DNA, 20 bp, Homo sapiens
gagcaggctggcagctctcc

SEQ ID NO: 3342630 - DNA, 16 bp, Homo sapiens
gagcagggaaggcctg

SEQ ID NO: 3342631 - DNA, 18 bp, Homo sapiens
gagcagggaaggcctgac

SEQ ID NO: 3342632 - DNA, 20 bp, Homo sapiens
gagcagggattaacctctgc

SEQ ID NO: 3342633 - DNA, 21 bp, Homo sapiens
gagcagggattaacctctgca

SEQ ID NO: 3342634 - DNA, 14 bp, Homo sapiens
gagcagggctcagc

SEQ ID NO: 3342635 - DNA, 21 bp, Homo sapiens
gagcagggctcagcggggaca

SEQ ID NO: 3342636 - DNA, 20 bp, Homo sapiens
gagcaggttccccaagggcc

SEQ ID NO: 3342637 - DNA, 20 bp, Homo sapiens
gagcagtcctgcctcagcct

SEQ ID NO: 3342638 - DNA, 17 bp, Homo sapiens
gagcagtgtcttccata

SEQ ID NO: 3342639 - DNA, 17 bp, Homo sapiens
gagcagttttcccctgg

SEQ ID NO: 3342640 - DNA, 19 bp, Homo sapiens
gagcagttttcccctggcc

SEQ ID NO: 3342641 - DNA, 19 bp, Homo sapiens
gagcatagcagaggggcca

SEQ ID NO: 3342642 - DNA, 23 bp, Homo sapiens
gagcatagcagaggggccaggcc

SEQ ID NO: 3342643 - DNA, 22 bp, Homo sapiens
gagcatcagccagtgaatctgt

SEQ ID NO: 3342644 - DNA, 19 bp, Homo sapiens
gagcatcccggaggaaatc

SEQ ID NO: 3342645 - DNA, 16 bp, Homo sapiens
gagcatcctgagcccc

SEQ ID NO: 3342646 - DNA, 18 bp, Homo sapiens
gagcatcctgagccccgc

SEQ ID NO: 3342647 - DNA, 21 bp, Homo sapiens
gagcatcgtgacccttcaggg

SEQ ID NO: 3342648 - DNA, 22 bp, Homo sapiens
gagcatctggctgtttagcaga

SEQ ID NO: 3342649 - DNA, 12 bp, Homo sapiens
gagcatggatgc

SEQ ID NO: 3342650 - DNA, 18 bp, Homo sapiens
gagcatggatgcatttca

SEQ ID NO: 3342651 - DNA, 20 bp, Homo sapiens
gagcatgttttgtatacaaa

SEQ ID NO: 3342652 - DNA, 14 bp, Homo sapiens
gagcattagctggc

SEQ ID NO: 3342653 - DNA, 23 bp, Homo sapiens
gagcatttccaacaccacagaca

SEQ ID NO: 3342654 - DNA, 18 bp, Homo sapiens
gagcatttgcacctctgt

SEQ ID NO: 3342655 - DNA, 15 bp, Homo sapiens
gagcatttttaaggg

SEQ ID NO: 3342656 - DNA, 16 bp, Homo sapiens
gagccaacctcggctt

SEQ ID NO: 3342657 - DNA, 12 bp, Homo sapiens
gagccaaggagg

SEQ ID NO: 3342658 - DNA, 16 bp, Homo sapiens
gagccaaggaggcctg

SEQ ID NO: 3342659 - DNA, 16 bp, Homo sapiens
gagccaagtcctccct

SEQ ID NO: 3342660 - DNA, 14 bp, Homo sapiens
gagccaccgctgcc

SEQ ID NO: 3342661 - DNA, 12 bp, Homo sapiens
gagccactcctg

SEQ ID NO: 3342662 - DNA, 15 bp, Homo sapiens
gagccactcctgtcc

SEQ ID NO: 3342663 - DNA, 14 bp, Homo sapiens
gagccagacagacc

SEQ ID NO: 3342664 - DNA, 14 bp, Homo sapiens
gagccagcctggga

SEQ ID NO: 3342665 - DNA, 12 bp, Homo sapiens
gagccaggttca

SEQ ID NO: 3342666 - DNA, 23 bp, Homo sapiens
gagccagtgagggcagtcctgca

SEQ ID NO: 3342667 - DNA, 19 bp, Homo sapiens
gagccagttgtcctatgga

SEQ ID NO: 3342668 - DNA, 23 bp, Homo sapiens
gagccatataagtttgaaggaaa

SEQ ID NO: 3342669 - DNA, 18 bp, Homo sapiens
gagccatcactagaagaa

SEQ ID NO: 3342670 - DNA, 16 bp, Homo sapiens
gagccatgaagcatta

SEQ ID NO: 3342671 - DNA, 22 bp, Homo sapiens
gagccatgatcgagccactgca

SEQ ID NO: 3342672 - DNA, 22 bp, Homo sapiens
gagccatggaccacgcaggaag

SEQ ID NO: 3342673 - DNA, 17 bp, Homo sapiens
gagccatgggcctgggc

SEQ ID NO: 3342674 - DNA, 21 bp, Homo sapiens
gagccattttgtgaatggatt

SEQ ID NO: 3342675 - DNA, 22 bp, Homo sapiens
gagcccaagttatctttccctc

SEQ ID NO: 3342676 - DNA, 13 bp, Homo sapiens
gagcccaccttgg

SEQ ID NO: 3342677 - DNA, 23 bp, Homo sapiens
gagcccagaggtaacagaacagc

SEQ ID NO: 3342678 - DNA, 18 bp, Homo sapiens
gagcccagccctccccat

SEQ ID NO: 3342679 - DNA, 13 bp, Homo sapiens
gagcccagctgcc

SEQ ID NO: 3342680 - DNA, 14 bp, Homo sapiens
gagcccagctgcct

SEQ ID NO: 3342681 - DNA, 19 bp, Homo sapiens
gagcccagctgcctggaga

SEQ ID NO: 3342682 - DNA, 11 bp, Homo sapiens
gagcccaggcc

SEQ ID NO: 3342683 - DNA, 19 bp, Homo sapiens
gagcccagtgaagcctctg

SEQ ID NO: 3342684 - DNA, 20 bp, Homo sapiens
gagcccagtgaagcctctga

SEQ ID NO: 3342685 - DNA, 17 bp, Homo sapiens
gagcccatactcagcct

SEQ ID NO: 3342686 - DNA, 18 bp, Homo sapiens
gagcccatactcagcctg

SEQ ID NO: 3342687 - DNA, 20 bp, Homo sapiens
gagcccatactcagcctgct

SEQ ID NO: 3342688 - DNA, 22 bp, Homo sapiens
gagcccatgttctgcccccagc

SEQ ID NO: 3342689 - DNA, 23 bp, Homo sapiens
gagcccatgttctgcccccagcc

SEQ ID NO: 3342690 - DNA, 13 bp, Homo sapiens
gagcccattccca

SEQ ID NO: 3342691 - DNA, 13 bp, Homo sapiens
gagccccaagtcc

SEQ ID NO: 3342692 - DNA, 15 bp, Homo sapiens
gagccccaagtcctg

SEQ ID NO: 3342693 - DNA, 16 bp, Homo sapiens
gagccccagctaccct

SEQ ID NO: 3342694 - DNA, 20 bp, Homo sapiens
gagccccaggggggcctcct

SEQ ID NO: 3342695 - DNA, 20 bp, Homo sapiens
gagcccccaccttgatccca

SEQ ID NO: 3342696 - DNA, 12 bp, Homo sapiens
gagcccccagat

SEQ ID NO: 3342697 - DNA, 17 bp, Homo sapiens
gagcccccagccctggg

SEQ ID NO: 3342698 - DNA, 18 bp, Homo sapiens
gagcccccagccctggga

SEQ ID NO: 3342699 - DNA, 13 bp, Homo sapiens
gagcccccccaac

SEQ ID NO: 3342700 - DNA, 18 bp, Homo sapiens
gagccccgcagacctccc

SEQ ID NO: 3342701 - DNA, 23 bp, Homo sapiens
gagccccgcagacctccccagcc

SEQ ID NO: 3342702 - DNA, 13 bp, Homo sapiens
gagccccgccctc

SEQ ID NO: 3342703 - DNA, 16 bp, Homo sapiens
gagccccgccctcttc

SEQ ID NO: 3342704 - DNA, 19 bp, Homo sapiens
gagccccgccctcttcctg

SEQ ID NO: 3342705 - DNA, 20 bp, Homo sapiens
gagccccgccctcttcctga

SEQ ID NO: 3342706 - DNA, 15 bp, Homo sapiens
gagcccctcctccag

SEQ ID NO: 3342707 - DNA, 12 bp, Homo sapiens
gagcccctgggt

SEQ ID NO: 3342708 - DNA, 20 bp, Homo sapiens
gagcccctggtcctgagggt

SEQ ID NO: 3342709 - DNA, 19 bp, Homo sapiens
gagcccgcttttgttcttc

SEQ ID NO: 3342710 - DNA, 19 bp, Homo sapiens
gagcccgggctgcctgggc

SEQ ID NO: 3342711 - DNA, 21 bp, Homo sapiens
gagcccgtgcagtacaggcaa

SEQ ID NO: 3342712 - DNA, 16 bp, Homo sapiens
gagccctaaccccttc

SEQ ID NO: 3342713 - DNA, 18 bp, Homo sapiens
gagccctaaccccttcca

SEQ ID NO: 3342714 - DNA, 20 bp, Homo sapiens
gagccctaaccccttccaga

SEQ ID NO: 3342715 - DNA, 18 bp, Homo sapiens
gagccctactccctgcag

SEQ ID NO: 3342716 - DNA, 19 bp, Homo sapiens
gagccctcaactattctgt

SEQ ID NO: 3342717 - DNA, 15 bp, Homo sapiens
gagccctgctgtggg

SEQ ID NO: 3342718 - DNA, 21 bp, Homo sapiens
gagccctggacacccctgctc

SEQ ID NO: 3342719 - DNA, 13 bp, Homo sapiens
gagccctggcagg

SEQ ID NO: 3342720 - DNA, 23 bp, Homo sapiens
gagccctggcaggatgaccctgc

SEQ ID NO: 3342721 - DNA, 14 bp, Homo sapiens
gagccctggccagc

SEQ ID NO: 3342722 - DNA, 16 bp, Homo sapiens
gagccctggccagccc

SEQ ID NO: 3342723 - DNA, 13 bp, Homo sapiens
gagccctggctgg

SEQ ID NO: 3342724 - DNA, 18 bp, Homo sapiens
gagccctggctgggttca

SEQ ID NO: 3342725 - DNA, 13 bp, Homo sapiens
gagccctggggac

SEQ ID NO: 3342726 - DNA, 13 bp, Homo sapiens
gagccctggtggc

SEQ ID NO: 3342727 - DNA, 20 bp, Homo sapiens
gagccctgtggccgccacct

SEQ ID NO: 3342728 - DNA, 21 bp, Homo sapiens
gagccctgtggccgccacctg

SEQ ID NO: 3342729 - DNA, 19 bp, Homo sapiens
gagccctgttggcagctct

SEQ ID NO: 3342730 - DNA, 15 bp, Homo sapiens
gagcccttcactgcc

SEQ ID NO: 3342731 - DNA, 15 bp, Homo sapiens
gagcccttgcctccc

SEQ ID NO: 3342732 - DNA, 21 bp, Homo sapiens
gagccgagatcacgccactgc

SEQ ID NO: 3342733 - DNA, 22 bp, Homo sapiens
gagccgagattgcgccactgca

SEQ ID NO: 3342734 - DNA, 16 bp, Homo sapiens
gagccgggcccctggg

SEQ ID NO: 3342735 - DNA, 14 bp, Homo sapiens
gagccgggcctggg

SEQ ID NO: 3342736 - DNA, 16 bp, Homo sapiens
gagccggtggtgcccg

SEQ ID NO: 3342737 - DNA, 15 bp, Homo sapiens
gagcctagaagctgg

SEQ ID NO: 3342738 - DNA, 21 bp, Homo sapiens
gagcctagcggagcccagcct

SEQ ID NO: 3342739 - DNA, 21 bp, Homo sapiens
gagcctagtttttaatagcta

SEQ ID NO: 3342740 - DNA, 21 bp, Homo sapiens
gagcctcagaccccaggtcag

SEQ ID NO: 3342741 - DNA, 22 bp, Homo sapiens
gagcctcagaccccaggtcagc

SEQ ID NO: 3342742 - DNA, 15 bp, Homo sapiens
gagcctcagcatcct

SEQ ID NO: 3342743 - DNA, 15 bp, Homo sapiens
gagcctccccctcag

SEQ ID NO: 3342744 - DNA, 14 bp, Homo sapiens
gagcctcctgccca

SEQ ID NO: 3342745 - DNA, 15 bp, Homo sapiens
gagcctcctgcccag

SEQ ID NO: 3342746 - DNA, 19 bp, Homo sapiens
gagcctcctgcccagtccc

SEQ ID NO: 3342747 - DNA, 12 bp, Homo sapiens
gagcctcttagt

SEQ ID NO: 3342748 - DNA, 22 bp, Homo sapiens
gagcctgagtcagggcccagag

SEQ ID NO: 3342749 - DNA, 12 bp, Homo sapiens
gactctgcacat

SEQ ID NO: 3342750 - DNA, 14 bp, Homo sapiens
gactctgcacatga

SEQ ID NO: 3342751 - DNA, 15 bp, Homo sapiens
gactctgcacatgtc

SEQ ID NO: 3342752 - DNA, 20 bp, Homo sapiens
gactctgcacatgtcttgta

SEQ ID NO: 3342753 - DNA, 16 bp, Homo sapiens
gactctgcctcctctt

SEQ ID NO: 3342754 - DNA, 13 bp, Homo sapiens
gactctggccctg

SEQ ID NO: 3342755 - DNA, 16 bp, Homo sapiens
gactctggccctggcc

SEQ ID NO: 3342756 - DNA, 18 bp, Homo sapiens
gactctggtgcctccaga

SEQ ID NO: 3342757 - DNA, 18 bp, Homo sapiens
gactctgtggggccttgg

SEQ ID NO: 3342758 - DNA, 17 bp, Homo sapiens
gactcttctcggctcag

SEQ ID NO: 3342759 - DNA, 17 bp, Homo sapiens
gacttcccaacagcctt

SEQ ID NO: 3342760 - DNA, 19 bp, Homo sapiens
gacttcccaacagccttag

SEQ ID NO: 3342761 - DNA, 13 bp, Homo sapiens
gacttcccagcta

SEQ ID NO: 3342762 - DNA, 13 bp, Homo sapiens
gacttcctggggc

SEQ ID NO: 3342763 - DNA, 18 bp, Homo sapiens
gacttcctggggccccgc

SEQ ID NO: 3342764 - DNA, 14 bp, Homo sapiens
gacttccttgctct

SEQ ID NO: 3342765 - DNA, 17 bp, Homo sapiens
gacttccttgctctccc

SEQ ID NO: 3342766 - DNA, 16 bp, Homo sapiens
gacttcgactcaggat

SEQ ID NO: 3342767 - DNA, 13 bp, Homo sapiens
gacttctgcagct

SEQ ID NO: 3342768 - DNA, 14 bp, Homo sapiens
gacttctgcctgga

SEQ ID NO: 3342769 - DNA, 21 bp, Homo sapiens
gacttctggaaggctggctga

SEQ ID NO: 3342770 - DNA, 12 bp, Homo sapiens
gacttctggagg

SEQ ID NO: 3342771 - DNA, 20 bp, Homo sapiens
gacttctggttgtatttcta

SEQ ID NO: 3342772 - DNA, 21 bp, Homo sapiens
gacttctggttgtatttctat

SEQ ID NO: 3342773 - DNA, 23 bp, Homo sapiens
gacttctgtgggcccctcaacag

SEQ ID NO: 3342774 - DNA, 11 bp, Homo sapiens
gacttcttacc

SEQ ID NO: 3342775 - DNA, 18 bp, Homo sapiens
gacttcttacccaaagca

SEQ ID NO: 3342776 - DNA, 16 bp, Homo sapiens
gacttcttcctctaga

SEQ ID NO: 3342777 - DNA, 14 bp, Homo sapiens
gacttgaaagcatc

SEQ ID NO: 3342778 - DNA, 15 bp, Homo sapiens
gacttgaaagttttc

SEQ ID NO: 3342779 - DNA, 23 bp, Homo sapiens
gacttgagtgttcctttttaaat

SEQ ID NO: 3342780 - DNA, 23 bp, Homo sapiens
gacttgccgtcccctaaggaaat

SEQ ID NO: 3342781 - DNA, 14 bp, Homo sapiens
gacttgctaaagca

SEQ ID NO: 3342782 - DNA, 20 bp, Homo sapiens
gacttggagactcctggtct

SEQ ID NO: 3342783 - DNA, 21 bp, Homo sapiens
gacttggagactcctggtctg

SEQ ID NO: 3342784 - DNA, 17 bp, Homo sapiens
gacttggcaacagaagc

SEQ ID NO: 3342785 - DNA, 13 bp, Homo sapiens
gacttgggagctg

SEQ ID NO: 3342786 - DNA, 22 bp, Homo sapiens
gacttgggggaacgatgtgtct

SEQ ID NO: 3342787 - DNA, 22 bp, Homo sapiens
gacttggtacagttgcaggagc

SEQ ID NO: 3342788 - DNA, 14 bp, Homo sapiens
gacttggtctgatt

SEQ ID NO: 3342789 - DNA, 20 bp, Homo sapiens
gacttggttggtagggtggg

SEQ ID NO: 3342790 - DNA, 13 bp, Homo sapiens
gacttgtgtctct

SEQ ID NO: 3342791 - DNA, 18 bp, Homo sapiens
gacttgtttgtcttccat

SEQ ID NO: 3342792 - DNA, 22 bp, Homo sapiens
gacttgtttgtcttccattcca

SEQ ID NO: 3342793 - DNA, 22 bp, Homo sapiens
gacttgtttgtgcatcctgtga

SEQ ID NO: 3342794 - DNA, 18 bp, Homo sapiens
gacttgttttatgctcag

SEQ ID NO: 3342795 - DNA, 15 bp, Homo sapiens
gacttgtttttgcac

SEQ ID NO: 3342796 - DNA, 14 bp, Homo sapiens
gactttaaaaggat

SEQ ID NO: 3342797 - DNA, 17 bp, Homo sapiens
gactttaaaaggattaa

SEQ ID NO: 3342798 - DNA, 20 bp, Homo sapiens
gactttagtgccctgccccc

SEQ ID NO: 3342799 - DNA, 11 bp, Homo sapiens
gactttataaa

SEQ ID NO: 3342800 - DNA, 21 bp, Homo sapiens
gactttatctaatacctctgt

SEQ ID NO: 3342801 - DNA, 16 bp, Homo sapiens
gactttatttatttct

SEQ ID NO: 3342802 - DNA, 17 bp, Homo sapiens
gactttatttatttcta

SEQ ID NO: 3342803 - DNA, 19 bp, Homo sapiens
gactttattttctggtaga

SEQ ID NO: 3342804 - DNA, 12 bp, Homo sapiens
gactttcctgca

SEQ ID NO: 3342805 - DNA, 11 bp, Homo sapiens
gactttctgtt

SEQ ID NO: 3342806 - DNA, 11 bp, Homo sapiens
gactttgacaa

SEQ ID NO: 3342807 - DNA, 18 bp, Homo sapiens
gactttgacaattactca

SEQ ID NO: 3342808 - DNA, 17 bp, Homo sapiens
gactttgcagatggaaa

SEQ ID NO: 3342809 - DNA, 21 bp, Homo sapiens
gactttgcagccggcacaggg

SEQ ID NO: 3342810 - DNA, 20 bp, Homo sapiens
gacttttattaataaaacaa

SEQ ID NO: 3342811 - DNA, 19 bp, Homo sapiens
gacttttcgttaacattga

SEQ ID NO: 3342812 - DNA, 22 bp, Homo sapiens
gacttttcttaacaacctggcc

SEQ ID NO: 3342813 - DNA, 20 bp, Homo sapiens
gacttttgtacatctggctt

SEQ ID NO: 3342814 - DNA, 13 bp, Homo sapiens
gactttttataaa

SEQ ID NO: 3342815 - DNA, 13 bp, Homo sapiens
gagaaaaaaaacc

SEQ ID NO: 3342816 - DNA, 14 bp, Homo sapiens
gagaaaaaaaacct

SEQ ID NO: 3342817 - DNA, 22 bp, Homo sapiens
gagaaaaaaaaccttgtaaaaa

SEQ ID NO: 3342818 - DNA, 11 bp, Homo sapiens
gagaaaaacaa

SEQ ID NO: 3342819 - DNA, 12 bp, Homo sapiens
gagaaaaaccaa

SEQ ID NO: 3342820 - DNA, 19 bp, Homo sapiens
gagaaaaagctcctgtcct

SEQ ID NO: 3342821 - DNA, 17 bp, Homo sapiens
gagaaaaaggaaaaaaa

SEQ ID NO: 3342822 - DNA, 18 bp, Homo sapiens
gagaaaaatgctccccac

SEQ ID NO: 3342823 - DNA, 14 bp, Homo sapiens
gagaaaagagagaa

SEQ ID NO: 3342824 - DNA, 17 bp, Homo sapiens
gagaaaatccaggtcat

SEQ ID NO: 3342825 - DNA, 18 bp, Homo sapiens
gagaaaattgcactaaat

SEQ ID NO: 3342826 - DNA, 14 bp, Homo sapiens
gagaaacagagaca

SEQ ID NO: 3342827 - DNA, 19 bp, Homo sapiens
gagaaacagagacaggccc

SEQ ID NO: 3342828 - DNA, 21 bp, Homo sapiens
gagaaacagttggtaactttt

SEQ ID NO: 3342829 - DNA, 21 bp, Homo sapiens
gagaaaccttattgtacctct

SEQ ID NO: 3342830 - DNA, 17 bp, Homo sapiens
gagaaagagagaagcca

SEQ ID NO: 3342831 - DNA, 19 bp, Homo sapiens
gagaaagagagaagccagc

SEQ ID NO: 3342832 - DNA, 20 bp, Homo sapiens
gagaaagccaggcaggtagc

SEQ ID NO: 3342833 - DNA, 18 bp, Homo sapiens
gagaaaggcctgcacaca

SEQ ID NO: 3342834 - DNA, 23 bp, Homo sapiens
gagaaagtacttctccaccctgc

SEQ ID NO: 3342835 - DNA, 23 bp, Homo sapiens
gagaaatcatcctgttttctctg

SEQ ID NO: 3342836 - DNA, 23 bp, Homo sapiens
gagaaatgtgtagctgcaaaaat

SEQ ID NO: 3342837 - DNA, 17 bp, Homo sapiens
gagaaattcgtgtgttt

SEQ ID NO: 3342838 - DNA, 14 bp, Homo sapiens
gagaaattctgtta

SEQ ID NO: 3342839 - DNA, 23 bp, Homo sapiens
gagaaatttctgtgaaacctgtg

SEQ ID NO: 3342840 - DNA, 19 bp, Homo sapiens
gagaaatttttatttttga

SEQ ID NO: 3342841 - DNA, 22 bp, Homo sapiens
gagaacaaagctgttaaactgt

SEQ ID NO: 3342842 - DNA, 16 bp, Homo sapiens
gagaacaagtcacagc

SEQ ID NO: 3342843 - DNA, 12 bp, Homo sapiens
gagaacagtggt

SEQ ID NO: 3342844 - DNA, 17 bp, Homo sapiens
gagaacagtggttgcct

SEQ ID NO: 3342845 - DNA, 19 bp, Homo sapiens
gagaacagtggttgcctgg

SEQ ID NO: 3342846 - DNA, 13 bp, Homo sapiens
gagaaccaaatct

SEQ ID NO: 3342847 - DNA, 19 bp, Homo sapiens
gagaaccagtctcctcact

SEQ ID NO: 3342848 - DNA, 22 bp, Homo sapiens
gagaaccagtctcctcactctg

SEQ ID NO: 3342849 - DNA, 11 bp, Homo sapiens
gagaactgact

SEQ ID NO: 3342850 - DNA, 23 bp, Homo sapiens
gagaagaatagaggtcctcatgg

SEQ ID NO: 3342851 - DNA, 12 bp, Homo sapiens
gagaagacactg

SEQ ID NO: 3342852 - DNA, 15 bp, Homo sapiens
gagaagacactgcag

SEQ ID NO: 3342853 - DNA, 12 bp, Homo sapiens
gagaagagagga

SEQ ID NO: 3342854 - DNA, 13 bp, Homo sapiens
gagaagagccctg

SEQ ID NO: 3342855 - DNA, 20 bp, Homo sapiens
gagaagaggcatcctgcctg

SEQ ID NO: 3342856 - DNA, 22 bp, Homo sapiens
gagaagaggcatcctgcctggg

SEQ ID NO: 3342857 - DNA, 16 bp, Homo sapiens
gagaagagggcctgtg

SEQ ID NO: 3342858 - DNA, 14 bp, Homo sapiens
gagaagcacttgag

SEQ ID NO: 3342859 - DNA, 18 bp, Homo sapiens
gagaagcatatagaggca

SEQ ID NO: 3342860 - DNA, 13 bp, Homo sapiens
gagaagcatgaaa

SEQ ID NO: 3342861 - DNA, 13 bp, Homo sapiens
gagaagccagcca

SEQ ID NO: 3342862 - DNA, 15 bp, Homo sapiens
gagaagccagccaca

SEQ ID NO: 3342863 - DNA, 16 bp, Homo sapiens
gagaagccagccacag

SEQ ID NO: 3342864 - DNA, 19 bp, Homo sapiens
gagaagccagccacagacc

SEQ ID NO: 3342865 - DNA, 15 bp, Homo sapiens
gagaagcccgtgtga

SEQ ID NO: 3342866 - DNA, 16 bp, Homo sapiens
gagaagcccgtgtgag

SEQ ID NO: 3342867 - DNA, 18 bp, Homo sapiens
gagaagccttcagctcca

SEQ ID NO: 3342868 - DNA, 16 bp, Homo sapiens
gagaagcggtcatgag

SEQ ID NO: 3342869 - DNA, 13 bp, Homo sapiens
gagaagctctgaa

SEQ ID NO: 3342870 - DNA, 17 bp, Homo sapiens
gagaagctggacttctg

SEQ ID NO: 3342871 - DNA, 17 bp, Homo sapiens
cttttggtttgggggcg

SEQ ID NO: 3342872 - DNA, 12 bp, Homo sapiens
cttttgtaaaga

SEQ ID NO: 3342873 - DNA, 23 bp, Homo sapiens
cttttgtaaagaaatttactata

SEQ ID NO: 3342874 - DNA, 13 bp, Homo sapiens
cttttgtaagaca

SEQ ID NO: 3342875 - DNA, 20 bp, Homo sapiens
cttttgtaagacaaaggttt

SEQ ID NO: 3342876 - DNA, 20 bp, Homo sapiens
cttttgtaattgtgtaaaaa

SEQ ID NO: 3342877 - DNA, 12 bp, Homo sapiens
cttttgtataca

SEQ ID NO: 3342878 - DNA, 16 bp, Homo sapiens
cttttgtatcttcctt

SEQ ID NO: 3342879 - DNA, 16 bp, Homo sapiens
cttttgtccccagggc

SEQ ID NO: 3342880 - DNA, 18 bp, Homo sapiens
cttttgtccccagggccc

SEQ ID NO: 3342881 - DNA, 18 bp, Homo sapiens
cttttgtctatgggactc

SEQ ID NO: 3342882 - DNA, 15 bp, Homo sapiens
cttttgtggtgtctt

SEQ ID NO: 3342883 - DNA, 19 bp, Homo sapiens
cttttgtgtgaattgacta

SEQ ID NO: 3342884 - DNA, 20 bp, Homo sapiens
cttttgttaaacccttctgt

SEQ ID NO: 3342885 - DNA, 11 bp, Homo sapiens
cttttgttact

SEQ ID NO: 3342886 - DNA, 20 bp, Homo sapiens
cttttgttactgttcttgct

SEQ ID NO: 3342887 - DNA, 21 bp, Homo sapiens
cttttgttactgttcttgctg

SEQ ID NO: 3342888 - DNA, 22 bp, Homo sapiens
cttttgttactgttcttgctgc

SEQ ID NO: 3342889 - DNA, 14 bp, Homo sapiens
cttttgttattcca

SEQ ID NO: 3342890 - DNA, 18 bp, Homo sapiens
cttttgttattccatcaa

SEQ ID NO: 3342891 - DNA, 13 bp, Homo sapiens
cttttgttgtatg

SEQ ID NO: 3342892 - DNA, 17 bp, Homo sapiens
cttttgttgtgactttt

SEQ ID NO: 3342893 - DNA, 13 bp, Homo sapiens
cttttgttttttt

SEQ ID NO: 3342894 - DNA, 20 bp, Homo sapiens
ctttttaaaaactcttcagt

SEQ ID NO: 3342895 - DNA, 22 bp, Homo sapiens
ctttttaaaaggtattttgaat

SEQ ID NO: 3342896 - DNA, 22 bp, Homo sapiens
ctttttaaaatggtgcttaagt

SEQ ID NO: 3342897 - DNA, 23 bp, Homo sapiens
ctttttaacaaaaaacagattct

SEQ ID NO: 3342898 - DNA, 15 bp, Homo sapiens
ctttttaagtaatgt

SEQ ID NO: 3342899 - DNA, 14 bp, Homo sapiens
ctttttaatatgct

SEQ ID NO: 3342900 - DNA, 17 bp, Homo sapiens
ctttttaattcaccaaa

SEQ ID NO: 3342901 - DNA, 17 bp, Homo sapiens
ctttttacagcattgtc

SEQ ID NO: 3342902 - DNA, 16 bp, Homo sapiens
ctttttacctttcata

SEQ ID NO: 3342903 - DNA, 22 bp, Homo sapiens
gaaaaccagcttgcgaataaca

SEQ ID NO: 3342904 - DNA, 22 bp, Homo sapiens
gaaaaccatattttattgtatt

SEQ ID NO: 3342905 - DNA, 19 bp, Homo sapiens
gaaaaccatctggcctggc

SEQ ID NO: 3342906 - DNA, 20 bp, Homo sapiens
gaaaaccatctggcctggcc

SEQ ID NO: 3342907 - DNA, 19 bp, Homo sapiens
gaaaacgttttattgtgtt

SEQ ID NO: 3342908 - DNA, 20 bp, Homo sapiens
gaaaacgttttattgtgttt

SEQ ID NO: 3342909 - DNA, 18 bp, Homo sapiens
gaaaactaaggatttttc

SEQ ID NO: 3342910 - DNA, 17 bp, Homo sapiens
gaaaactcattactttt

SEQ ID NO: 3342911 - DNA, 16 bp, Homo sapiens
gaaaactctttgctgc

SEQ ID NO: 3342912 - DNA, 16 bp, Homo sapiens
gaaaactgaaaatcta

SEQ ID NO: 3342913 - DNA, 21 bp, Homo sapiens
gaaaactgctgataaaatatg

SEQ ID NO: 3342914 - DNA, 14 bp, Homo sapiens
gaaaactgggtatg

SEQ ID NO: 3342915 - DNA, 19 bp, Homo sapiens
gaaaactgtgttgccacag

SEQ ID NO: 3342916 - DNA, 22 bp, Homo sapiens
gaaaactgttctctttaaaata

SEQ ID NO: 3342917 - DNA, 13 bp, Homo sapiens
gaaaacttagcca

SEQ ID NO: 3342918 - DNA, 17 bp, Homo sapiens
gaaaacttagccagagt

SEQ ID NO: 3342919 - DNA, 14 bp, Homo sapiens
gaaaacttcaaagc

SEQ ID NO: 3342920 - DNA, 12 bp, Homo sapiens
gaaaactttaaa

SEQ ID NO: 3342921 - DNA, 20 bp, Homo sapiens
gaaaactttaaaaaatattt

SEQ ID NO: 3342922 - DNA, 16 bp, Homo sapiens
gaaaagaaaacaaaaa

SEQ ID NO: 3342923 - DNA, 23 bp, Homo sapiens
gaaaagaaacctggggtgaatac

SEQ ID NO: 3342924 - DNA, 19 bp, Homo sapiens
gaaaagaatacagaaagat

SEQ ID NO: 3342925 - DNA, 16 bp, Homo sapiens
gaaaagaccctgagac

SEQ ID NO: 3342926 - DNA, 13 bp, Homo sapiens
gaaaagagagaaa

SEQ ID NO: 3342927 - DNA, 15 bp, Homo sapiens
gaaaagagtatgtag

SEQ ID NO: 3342928 - DNA, 19 bp, Homo sapiens
gaaaagataaagaccagaa

SEQ ID NO: 3342929 - DNA, 23 bp, Homo sapiens
gaaaagattttaatcaagttgaa

SEQ ID NO: 3342930 - DNA, 18 bp, Homo sapiens
gaaaagcaattgccctgt

SEQ ID NO: 3342931 - DNA, 19 bp, Homo sapiens
gaaaagcaattgccctgta

SEQ ID NO: 3342932 - DNA, 20 bp, Homo sapiens
gacgcacgctcgctgccatc

SEQ ID NO: 3342933 - DNA, 21 bp, Homo sapiens
gacgcacgctcgctgccatca

SEQ ID NO: 3342934 - DNA, 16 bp, Homo sapiens
gacgcaggaatggaaa

SEQ ID NO: 3342935 - DNA, 14 bp, Homo sapiens
gacgccaccattcc

SEQ ID NO: 3342936 - DNA, 21 bp, Homo sapiens
gacgccccggggcgcctagag

SEQ ID NO: 3342937 - DNA, 20 bp, Homo sapiens
gacgcctgccctccccagag

SEQ ID NO: 3342938 - DNA, 22 bp, Homo sapiens
gacgcctgccctccccagagca

SEQ ID NO: 3342939 - DNA, 18 bp, Homo sapiens
ctttattttttaagtatt

SEQ ID NO: 3342940 - DNA, 14 bp, Homo sapiens
ctttcaacttgcat

SEQ ID NO: 3342941 - DNA, 23 bp, Homo sapiens
ctttcaagcagtcgtgcctgtgt

SEQ ID NO: 3342942 - DNA, 18 bp, Homo sapiens
ctttcacaaggtataata

SEQ ID NO: 3342943 - DNA, 18 bp, Homo sapiens
ctttcaccctcatgaaaa

SEQ ID NO: 3342944 - DNA, 16 bp, Homo sapiens
ctttcacctttgtgta

SEQ ID NO: 3342945 - DNA, 12 bp, Homo sapiens
ctttcactttga

SEQ ID NO: 3342946 - DNA, 15 bp, Homo sapiens
ctttcagaaatataa

SEQ ID NO: 3342947 - DNA, 22 bp, Homo sapiens
ctttcagaaatataacacattt

SEQ ID NO: 3342948 - DNA, 15 bp, Homo sapiens
ctttcagatgtcttc

SEQ ID NO: 3342949 - DNA, 22 bp, Homo sapiens
ctttcagatgtcttctgcctgt

SEQ ID NO: 3342950 - DNA, 21 bp, Homo sapiens
ctttcagcattaggcttttaa

SEQ ID NO: 3342951 - DNA, 16 bp, Homo sapiens
ctttcagggccatggt

SEQ ID NO: 3342952 - DNA, 15 bp, Homo sapiens
ctttcagtacttttt

SEQ ID NO: 3342953 - DNA, 23 bp, Homo sapiens
ctttcagtggaaaccctgagagt

SEQ ID NO: 3342954 - DNA, 13 bp, Homo sapiens
ctttcagtggaat

SEQ ID NO: 3342955 - DNA, 14 bp, Homo sapiens
ctttcagttagcct

SEQ ID NO: 3342956 - DNA, 19 bp, Homo sapiens
ctttcatcacactgggtgg

SEQ ID NO: 3342957 - DNA, 18 bp, Homo sapiens
ctttcatctggggtgggg

SEQ ID NO: 3342958 - DNA, 20 bp, Homo sapiens
ctttcattggatttttgtta

SEQ ID NO: 3342959 - DNA, 17 bp, Homo sapiens
ctttccaaaacatttct

SEQ ID NO: 3342960 - DNA, 20 bp, Homo sapiens
ctttccaaattatttcttaa

SEQ ID NO: 3342961 - DNA, 21 bp, Homo sapiens
ctttccaccacagccagcacc

SEQ ID NO: 3342962 - DNA, 14 bp, Homo sapiens
ctttccacttcttc

SEQ ID NO: 3342963 - DNA, 18 bp, Homo sapiens
ctttccagcctcctgctg

SEQ ID NO: 3342964 - DNA, 16 bp, Homo sapiens
ctttccagcctgggca

SEQ ID NO: 3342965 - DNA, 13 bp, Homo sapiens
ctttccagttaag

SEQ ID NO: 3342966 - DNA, 18 bp, Homo sapiens
ctttccatatttaaccta

SEQ ID NO: 3342967 - DNA, 23 bp, Homo sapiens
ctttccatgggagccagctgctt

SEQ ID NO: 3342968 - DNA, 16 bp, Homo sapiens
ctttccatttggtatt

SEQ ID NO: 3342969 - DNA, 16 bp, Homo sapiens
ctttcccatcttccaa

SEQ ID NO: 3342970 - DNA, 17 bp, Homo sapiens
ctttcccccttctctta

SEQ ID NO: 3342971 - DNA, 16 bp, Homo sapiens
ctttcccctctctgcc

SEQ ID NO: 3342972 - DNA, 21 bp, Homo sapiens
ctttcccctctctgcccctga

SEQ ID NO: 3342973 - DNA, 15 bp, Homo sapiens
ctttcccctgtgggg

SEQ ID NO: 3342974 - DNA, 17 bp, Homo sapiens
ctttcccctgtggggat

SEQ ID NO: 3342975 - DNA, 13 bp, Homo sapiens
ctttccctgtgcc

SEQ ID NO: 3342976 - DNA, 15 bp, Homo sapiens
ctttcccttccagtt

SEQ ID NO: 3342977 - DNA, 18 bp, Homo sapiens
ctttcccttgtgtcaaga

SEQ ID NO: 3342978 - DNA, 14 bp, Homo sapiens
ctttcccttttctg

SEQ ID NO: 3342979 - DNA, 15 bp, Homo sapiens
ctttccgctgtcgcc

SEQ ID NO: 3342980 - DNA, 19 bp, Homo sapiens
ctttccggcacactgccaa

SEQ ID NO: 3342981 - DNA, 14 bp, Homo sapiens
ctttcctaaagcca

SEQ ID NO: 3342982 - DNA, 22 bp, Homo sapiens
ctttcctaaagccatcatgcct

SEQ ID NO: 3342983 - DNA, 19 bp, Homo sapiens
ctttcctaggcccaggcct

SEQ ID NO: 3342984 - DNA, 20 bp, Homo sapiens
ctttcctcaagtatcttcta

SEQ ID NO: 3342985 - DNA, 22 bp, Homo sapiens
ctttcctcaagtatcttctatt

SEQ ID NO: 3342986 - DNA, 17 bp, Homo sapiens
ctttcctccccctgcaa

SEQ ID NO: 3342987 - DNA, 13 bp, Homo sapiens
ctttcctcttccc

SEQ ID NO: 3342988 - DNA, 14 bp, Homo sapiens
ctttcctcttcccc

SEQ ID NO: 3342989 - DNA, 22 bp, Homo sapiens
ctttcctgaatccaaactaatc

SEQ ID NO: 3342990 - DNA, 21 bp, Homo sapiens
ctttcctgcaactcaaggact

SEQ ID NO: 3342991 - DNA, 23 bp, Homo sapiens
ctttcctgccataaaagctatga

SEQ ID NO: 3342992 - DNA, 13 bp, Homo sapiens
ctttcctgcccca

SEQ ID NO: 3342993 - DNA, 19 bp, Homo sapiens
ctttcctgccccaggcctg

SEQ ID NO: 3342994 - DNA, 11 bp, Homo sapiens
ctttcctgcct

SEQ ID NO: 3342995 - DNA, 20 bp, Homo sapiens
ctttcctggacactcagacc

SEQ ID NO: 3342996 - DNA, 13 bp, Homo sapiens
ctttcctgttcag

SEQ ID NO: 3342997 - DNA, 14 bp, Homo sapiens
ctttcctgttcagc

SEQ ID NO: 3342998 - DNA, 21 bp, Homo sapiens
ctttcctttccccagcccagg

SEQ ID NO: 3342999 - DNA, 15 bp, Homo sapiens
ctttccttttcttta

SEQ ID NO: 3343000 - DNA, 18 bp, Homo sapiens
ctttcgaaatttcatttt

SEQ ID NO: 3343001 - DNA, 14 bp, Homo sapiens
ctttcggagctcct

SEQ ID NO: 3343002 - DNA, 19 bp, Homo sapiens
ctttctaactttctttact

SEQ ID NO: 3343003 - DNA, 17 bp, Homo sapiens
ctttctaatgtgtgaat

SEQ ID NO: 3343004 - DNA, 23 bp, Homo sapiens
ctttctagaagtttcccttcctc

SEQ ID NO: 3343005 - DNA, 23 bp, Homo sapiens
ctttctagctgttgagctgtttt

SEQ ID NO: 3343006 - DNA, 20 bp, Homo sapiens
ctttctagtcctattctatt

SEQ ID NO: 3343007 - DNA, 19 bp, Homo sapiens
ctttctagtggtctttgta

SEQ ID NO: 3343008 - DNA, 12 bp, Homo sapiens
ctttctatcatt

SEQ ID NO: 3343009 - DNA, 14 bp, Homo sapiens
ctttctatcatttt

SEQ ID NO: 3343010 - DNA, 20 bp, Homo sapiens
ctttctcagttttcataagt

SEQ ID NO: 3343011 - DNA, 20 bp, Homo sapiens
ctttctccagccagcaatga

SEQ ID NO: 3343012 - DNA, 22 bp, Homo sapiens
ctttctcccccgacactgctgc

SEQ ID NO: 3343013 - DNA, 15 bp, Homo sapiens
ctttctcctgtgaat

SEQ ID NO: 3343014 - DNA, 22 bp, Homo sapiens
ctttctcctgtgaatggaggca

SEQ ID NO: 3343015 - DNA, 20 bp, Homo sapiens
ctttctccttagtcttctca

SEQ ID NO: 3343016 - DNA, 19 bp, Homo sapiens
ctttctcgattttatcttt

SEQ ID NO: 3343017 - DNA, 18 bp, Homo sapiens
ctttctctcagaaatgct

SEQ ID NO: 3343018 - DNA, 20 bp, Homo sapiens
ctttctctcagccttacatt

SEQ ID NO: 3343019 - DNA, 15 bp, Homo sapiens
ctttctctcctttct

SEQ ID NO: 3343020 - DNA, 17 bp, Homo sapiens
ctttctctcctttcttt

SEQ ID NO: 3343021 - DNA, 22 bp, Homo sapiens
ctttctctctttatacagctgt

SEQ ID NO: 3343022 - DNA, 13 bp, Homo sapiens
ctttctctgccag

SEQ ID NO: 3343023 - DNA, 16 bp, Homo sapiens
ctttctctgccagtga

SEQ ID NO: 3343024 - DNA, 18 bp, Homo sapiens
ctttctctgccagtgaca

SEQ ID NO: 3343025 - DNA, 17 bp, Homo sapiens
ctttctctttctctctt

SEQ ID NO: 3343026 - DNA, 14 bp, Homo sapiens
ctttctgaaggaag

SEQ ID NO: 3343027 - DNA, 21 bp, Homo sapiens
ctttctgaaggaagagaagac

SEQ ID NO: 3343028 - DNA, 17 bp, Homo sapiens
ctttctgattactgtcc

SEQ ID NO: 3343029 - DNA, 20 bp, Homo sapiens
ctttctgcagtttttcagga

SEQ ID NO: 3343030 - DNA, 21 bp, Homo sapiens
ctttctgcagtttttcaggag

SEQ ID NO: 3343031 - DNA, 11 bp, Homo sapiens
ctttctgcctg

SEQ ID NO: 3343032 - DNA, 16 bp, Homo sapiens
ctttctgcttgtgtta

SEQ ID NO: 3343033 - DNA, 14 bp, Homo sapiens
ctttctgggagcag

SEQ ID NO: 3343034 - DNA, 13 bp, Homo sapiens
ctttctgtatata

SEQ ID NO: 3343035 - DNA, 19 bp, Homo sapiens
ctttctgtatatacttttt

SEQ ID NO: 3343036 - DNA, 19 bp, Homo sapiens
ctttctgtccttttggcac

SEQ ID NO: 3343037 - DNA, 13 bp, Homo sapiens
ctttctgtgccct

SEQ ID NO: 3343038 - DNA, 14 bp, Homo sapiens
ctttctgtgcccta

SEQ ID NO: 3343039 - DNA, 13 bp, Homo sapiens
ctttcttaatttt

SEQ ID NO: 3343040 - DNA, 12 bp, Homo sapiens
ctttcttccttt

SEQ ID NO: 3343041 - DNA, 14 bp, Homo sapiens
ctttcttctgccct

SEQ ID NO: 3343042 - DNA, 16 bp, Homo sapiens
ctttcttgctggttgt

SEQ ID NO: 3343043 - DNA, 13 bp, Homo sapiens
ctttcttggccag

SEQ ID NO: 3343044 - DNA, 14 bp, Homo sapiens
ctttcttggccagt

SEQ ID NO: 3343045 - DNA, 13 bp, Homo sapiens
ctttcttgtcttt

SEQ ID NO: 3343046 - DNA, 16 bp, Homo sapiens
ctttctttaaatgttt

SEQ ID NO: 3343047 - DNA, 15 bp, Homo sapiens
ctttctttacctgag

SEQ ID NO: 3343048 - DNA, 17 bp, Homo sapiens
ctttctttgattctcct

SEQ ID NO: 3343049 - DNA, 17 bp, Homo sapiens
ctttctttgcaccaaag

SEQ ID NO: 3343050 - DNA, 13 bp, Homo sapiens
ctttctttggtgc

SEQ ID NO: 3343051 - DNA, 15 bp, Homo sapiens
ctttctttggtgcct

SEQ ID NO: 3343052 - DNA, 21 bp, Homo sapiens
ctttctttggtgcctttcctg

SEQ ID NO: 3343053 - DNA, 20 bp, Homo sapiens
ctttgaaagaagcaagacac

SEQ ID NO: 3343054 - DNA, 20 bp, Homo sapiens
ctttgaaatacctcatgttt

SEQ ID NO: 3343055 - DNA, 22 bp, Homo sapiens
ctttgaaatacctcatgtttat

SEQ ID NO: 3343056 - DNA, 21 bp, Homo sapiens
ctttgaaatagtctgtgtgaa

SEQ ID NO: 3343057 - DNA, 19 bp, Homo sapiens
ctttgaagcagttgtgtca

SEQ ID NO: 3343058 - DNA, 13 bp, Homo sapiens
ctttgaagtagct

SEQ ID NO: 3343059 - DNA, 17 bp, Homo sapiens
ctttgaataaaaatgca

SEQ ID NO: 3343060 - DNA, 13 bp, Homo sapiens
ctttgaatgcttt

SEQ ID NO: 3343061 - DNA, 16 bp, Homo sapiens
ctttgaatgctttttg

SEQ ID NO: 3343062 - DNA, 15 bp, Homo sapiens
ctttgacaactaaaa

SEQ ID NO: 3343063 - DNA, 16 bp, Homo sapiens
ctttgacaattactca

SEQ ID NO: 3343064 - DNA, 21 bp, Homo sapiens
ctttgacaattactcaggttt

SEQ ID NO: 3343065 - DNA, 21 bp, Homo sapiens
ctttgacaattcctagataaa

SEQ ID NO: 3343066 - DNA, 14 bp, Homo sapiens
ctttgacatttaat

SEQ ID NO: 3343067 - DNA, 17 bp, Homo sapiens
ctttgacatttaattta

SEQ ID NO: 3343068 - DNA, 22 bp, Homo sapiens
ctttgactcagaggctgggagc

SEQ ID NO: 3343069 - DNA, 19 bp, Homo sapiens
ctttgactctataagcaaa

SEQ ID NO: 3343070 - DNA, 20 bp, Homo sapiens
ctttgactctataagcaaat

SEQ ID NO: 3343071 - DNA, 14 bp, Homo sapiens
ctttgacttcagct

SEQ ID NO: 3343072 - DNA, 18 bp, Homo sapiens
ctttgacttcttgcttca

SEQ ID NO: 3343073 - DNA, 15 bp, Homo sapiens
ctttgagaagccttc

SEQ ID NO: 3343074 - DNA, 16 bp, Homo sapiens
ctttgagatgtgttcc

SEQ ID NO: 3343075 - DNA, 22 bp, Homo sapiens
ctttgagatgtgttcctcctgc

SEQ ID NO: 3343076 - DNA, 21 bp, Homo sapiens
ctttgagcccacaaagcctta

SEQ ID NO: 3343077 - DNA, 13 bp, Homo sapiens
ctttgagggactg

SEQ ID NO: 3343078 - DNA, 21 bp, Homo sapiens
ctttgagtagatccatttcca

SEQ ID NO: 3343079 - DNA, 23 bp, Homo sapiens
ctttgagtagatccatttccatt

SEQ ID NO: 3343080 - DNA, 21 bp, Homo sapiens
ctttgataatgttaaatttgt

SEQ ID NO: 3343081 - DNA, 22 bp, Homo sapiens
ctttgataatgttaaatttgta

SEQ ID NO: 3343082 - DNA, 19 bp, Homo sapiens
ctttgatcccagaaagtat

SEQ ID NO: 3343083 - DNA, 17 bp, Homo sapiens
ctttgatgagcatttgt

SEQ ID NO: 3343084 - DNA, 12 bp, Homo sapiens
ctttgattcata

SEQ ID NO: 3343085 - DNA, 23 bp, Homo sapiens
ctttgattctccttttatgtgta

SEQ ID NO: 3343086 - DNA, 18 bp, Homo sapiens
ctttgatttacagcaagt

SEQ ID NO: 3343087 - DNA, 19 bp, Homo sapiens
ctttgatttagattgagta

SEQ ID NO: 3343088 - DNA, 20 bp, Homo sapiens
ctttgatttccaagtaatat

SEQ ID NO: 3343089 - DNA, 15 bp, Homo sapiens
ctttgcaagatgctt

SEQ ID NO: 3343090 - DNA, 13 bp, Homo sapiens
ctttgcaatagca

SEQ ID NO: 3343091 - DNA, 15 bp, Homo sapiens
ctttgcacattttga

SEQ ID NO: 3343092 - DNA, 14 bp, Homo sapiens
ctttgcactgaggg

SEQ ID NO: 3343093 - DNA, 15 bp, Homo sapiens
ctttgcacttaaaaa

SEQ ID NO: 3343094 - DNA, 15 bp, Homo sapiens
ctttgcagacaggca

SEQ ID NO: 3343095 - DNA, 20 bp, Homo sapiens
ctttgcaggctctgggctca

SEQ ID NO: 3343096 - DNA, 23 bp, Homo sapiens
ctttgcaggctctgggctcaggg

SEQ ID NO: 3343097 - DNA, 18 bp, Homo sapiens
ctttgcagggcagcccca

SEQ ID NO: 3343098 - DNA, 18 bp, Homo sapiens
ctttgcatatgagccgtg

SEQ ID NO: 3343099 - DNA, 15 bp, Homo sapiens
ctttgccaaaatacc

SEQ ID NO: 3343100 - DNA, 11 bp, Homo sapiens
ctttgccacaa

SEQ ID NO: 3343101 - DNA, 19 bp, Homo sapiens
ctttgccagtcattcagca

SEQ ID NO: 3343102 - DNA, 14 bp, Homo sapiens
ctttgcctcctgtg

SEQ ID NO: 3343103 - DNA, 11 bp, Homo sapiens
ctttgcctggt

SEQ ID NO: 3343104 - DNA, 16 bp, Homo sapiens
ctttgccttgggctgc

SEQ ID NO: 3343105 - DNA, 20 bp, Homo sapiens
ctttgcctttcttctgccct

SEQ ID NO: 3343106 - DNA, 21 bp, Homo sapiens
ctttgcctttcttctgccctt

SEQ ID NO: 3343107 - DNA, 15 bp, Homo sapiens
ctttgcggacgggct

SEQ ID NO: 3343108 - DNA, 16 bp, Homo sapiens
ctttgctacaaattta

SEQ ID NO: 3343109 - DNA, 23 bp, Homo sapiens
ctttgctacaaatttatgcattt

SEQ ID NO: 3343110 - DNA, 13 bp, Homo sapiens
ctttgctatgtaa

SEQ ID NO: 3343111 - DNA, 13 bp, Homo sapiens
ctttgctccgctc

SEQ ID NO: 3343112 - DNA, 15 bp, Homo sapiens
ctttgctccgctccc

SEQ ID NO: 3343113 - DNA, 17 bp, Homo sapiens
ctttgctccgctcccac

SEQ ID NO: 3343114 - DNA, 20 bp, Homo sapiens
ctttgctccgctcccaccgc

SEQ ID NO: 3343115 - DNA, 22 bp, Homo sapiens
ctttgctctcaattaaagtcta

SEQ ID NO: 3343116 - DNA, 13 bp, Homo sapiens
ctttgctcttgcc

SEQ ID NO: 3343117 - DNA, 19 bp, Homo sapiens
ctttgctgatttcccctct

SEQ ID NO: 3343118 - DNA, 19 bp, Homo sapiens
ctttgctgctgatgggcat

SEQ ID NO: 3343119 - DNA, 16 bp, Homo sapiens
ctttgctggaagaaac

SEQ ID NO: 3343120 - DNA, 21 bp, Homo sapiens
ctttgctggaagaaactaaaa

SEQ ID NO: 3343121 - DNA, 23 bp, Homo sapiens
ctttgctgtgaggaatgctctgt

SEQ ID NO: 3343122 - DNA, 15 bp, Homo sapiens
ctttgcttcccattg

SEQ ID NO: 3343123 - DNA, 18 bp, Homo sapiens
ctttgcttccgccactca

SEQ ID NO: 3343124 - DNA, 16 bp, Homo sapiens
ctttgcttgaacacag

SEQ ID NO: 3343125 - DNA, 17 bp, Homo sapiens
ctttgcttgaacacagt

SEQ ID NO: 3343126 - DNA, 20 bp, Homo sapiens
ctttgcttgaacacagtatt

SEQ ID NO: 3343127 - DNA, 22 bp, Homo sapiens
ctttggaaaaatgggtctttta

SEQ ID NO: 3343128 - DNA, 17 bp, Homo sapiens
ctttggaaaaatgtttg

SEQ ID NO: 3343129 - DNA, 23 bp, Homo sapiens
ctttggaaagtacactctgctgt

SEQ ID NO: 3343130 - DNA, 13 bp, Homo sapiens
ctttggacagctg

SEQ ID NO: 3343131 - DNA, 23 bp, Homo sapiens
ctttggacagctgactgaatgca

SEQ ID NO: 3343132 - DNA, 20 bp, Homo sapiens
ctttggacccaaggaaaact

SEQ ID NO: 3343133 - DNA, 16 bp, Homo sapiens
ctttggacctaatcca

SEQ ID NO: 3343134 - DNA, 11 bp, Homo sapiens
ctttggagact

SEQ ID NO: 3343135 - DNA, 13 bp, Homo sapiens
ctttggagctttt

SEQ ID NO: 3343136 - DNA, 15 bp, Homo sapiens
ctttggcagtgtttt

SEQ ID NO: 3343137 - DNA, 17 bp, Homo sapiens
ctttggcagtgttttgg

SEQ ID NO: 3343138 - DNA, 17 bp, Homo sapiens
ctttggccattccaaca

SEQ ID NO: 3343139 - DNA, 14 bp, Homo sapiens
ctttggctctggag

SEQ ID NO: 3343140 - DNA, 14 bp, Homo sapiens
ctttgggaaaacat

SEQ ID NO: 3343141 - DNA, 14 bp, Homo sapiens
ctttgggaaagccc

SEQ ID NO: 3343142 - DNA, 15 bp, Homo sapiens
ctttgggaaagccca

SEQ ID NO: 3343143 - DNA, 16 bp, Homo sapiens
ctttgggaaagctctt

SEQ ID NO: 3343144 - DNA, 18 bp, Homo sapiens
ctttgggagcaaaataag

SEQ ID NO: 3343145 - DNA, 15 bp, Homo sapiens
ctttgggaggccaag

SEQ ID NO: 3343146 - DNA, 17 bp, Homo sapiens
ctttgggaggccaaggc

SEQ ID NO: 3343147 - DNA, 18 bp, Homo sapiens
ctttgggaggccaaggca

SEQ ID NO: 3343148 - DNA, 23 bp, Homo sapiens
ctttgggaggccaaggcaggtag

SEQ ID NO: 3343149 - DNA, 18 bp, Homo sapiens
ctttgggaggctgaggcg

SEQ ID NO: 3343150 - DNA, 17 bp, Homo sapiens
ctttgggatcccaccct

SEQ ID NO: 3343151 - DNA, 18 bp, Homo sapiens
ctttgggcctctgcttct

SEQ ID NO: 3343152 - DNA, 14 bp, Homo sapiens
ctttgggctgccct

SEQ ID NO: 3343153 - DNA, 15 bp, Homo sapiens
ctttgggctgccctg

SEQ ID NO: 3343154 - DNA, 19 bp, Homo sapiens
ctttgggctttgcaggctc

SEQ ID NO: 3343155 - DNA, 21 bp, Homo sapiens
ctttgggctttgcaggctctg

SEQ ID NO: 3343156 - DNA, 23 bp, Homo sapiens
ctttgggctttgcaggctctggg

SEQ ID NO: 3343157 - DNA, 20 bp, Homo sapiens
ctttggggagcaggaggcca

SEQ ID NO: 3343158 - DNA, 23 bp, Homo sapiens
ctttgggtctacaagtatatgtg

SEQ ID NO: 3343159 - DNA, 18 bp, Homo sapiens
ctttggtactgctgtctt

SEQ ID NO: 3343160 - DNA, 14 bp, Homo sapiens
ctttggtagaaaag

SEQ ID NO: 3343161 - DNA, 23 bp, Homo sapiens
ctttggtgccaactggtgtttga

SEQ ID NO: 3343162 - DNA, 14 bp, Homo sapiens
ctttggtgcctttc

SEQ ID NO: 3343163 - DNA, 18 bp, Homo sapiens
ctttggtgcctttcctgt

SEQ ID NO: 3343164 - DNA, 15 bp, Homo sapiens
ctttggttaaaaatg

SEQ ID NO: 3343165 - DNA, 16 bp, Homo sapiens
ctttggttaaaaatgg

SEQ ID NO: 3343166 - DNA, 14 bp, Homo sapiens
ctttggttcagcta

SEQ ID NO: 3343167 - DNA, 19 bp, Homo sapiens
ctttggttctggccagaat

SEQ ID NO: 3343168 - DNA, 16 bp, Homo sapiens
ctttggtttctgtctg

SEQ ID NO: 3343169 - DNA, 11 bp, Homo sapiens
ctttggttttt

SEQ ID NO: 3343170 - DNA, 19 bp, Homo sapiens
ctttggtttttttcttctg

SEQ ID NO: 3343171 - DNA, 19 bp, Homo sapiens
ctttgtaagacatttgtat

SEQ ID NO: 3343172 - DNA, 19 bp, Homo sapiens
ctttgtaagagtgtagaag

SEQ ID NO: 3343173 - DNA, 22 bp, Homo sapiens
ctttgtaagagtgtagaagcat

SEQ ID NO: 3343174 - DNA, 20 bp, Homo sapiens
ctttgtaagatccaccccct

SEQ ID NO: 3343175 - DNA, 18 bp, Homo sapiens
ctttgtaatcactcccat

SEQ ID NO: 3343176 - DNA, 13 bp, Homo sapiens
ctttgtaatggga

SEQ ID NO: 3343177 - DNA, 18 bp, Homo sapiens
ctttgtaatttttgggga

SEQ ID NO: 3343178 - DNA, 15 bp, Homo sapiens
ctttgtaccaaaatt

SEQ ID NO: 3343179 - DNA, 12 bp, Homo sapiens
ctttgtaccccc

SEQ ID NO: 3343180 - DNA, 21 bp, Homo sapiens
ctttgtacttgtgtttgctta

SEQ ID NO: 3343181 - DNA, 16 bp, Homo sapiens
ctttgtagttactcaa

SEQ ID NO: 3343182 - DNA, 19 bp, Homo sapiens
ctttgtagttactcaagca

SEQ ID NO: 3343183 - DNA, 12 bp, Homo sapiens
ctttgtataaat

SEQ ID NO: 3343184 - DNA, 15 bp, Homo sapiens
ctttgtatagagaat

SEQ ID NO: 3343185 - DNA, 23 bp, Homo sapiens
ctttgtatcttccatatttggaa

SEQ ID NO: 3343186 - DNA, 20 bp, Homo sapiens
ctttgtcctaagagatttat

SEQ ID NO: 3343187 - DNA, 18 bp, Homo sapiens
ctttgtctgccttcccaa

SEQ ID NO: 3343188 - DNA, 19 bp, Homo sapiens
ctttgtcttgtacttctgt

SEQ ID NO: 3343189 - DNA, 20 bp, Homo sapiens
ctttgtcttgtacttctgtg

SEQ ID NO: 3343190 - DNA, 14 bp, Homo sapiens
ctttgtgacaggaa

SEQ ID NO: 3343191 - DNA, 13 bp, Homo sapiens
ctttgtgataatt

SEQ ID NO: 3343192 - DNA, 17 bp, Homo sapiens
ctttgtgattatttcac

SEQ ID NO: 3343193 - DNA, 22 bp, Homo sapiens
ctttgtgattcaatctgtaaac

SEQ ID NO: 3343194 - DNA, 23 bp, Homo sapiens
ctttgtgcacatttatttcctcc

SEQ ID NO: 3343195 - DNA, 20 bp, Homo sapiens
ctttgtggatgtcttccttg

SEQ ID NO: 3343196 - DNA, 14 bp, Homo sapiens
ctttgtggccttcc

SEQ ID NO: 3343197 - DNA, 13 bp, Homo sapiens
ctttgtggcttcc

SEQ ID NO: 3343198 - DNA, 16 bp, Homo sapiens
ctttgtggggcttggc

SEQ ID NO: 3343199 - DNA, 18 bp, Homo sapiens
ctttgtgtgtactcactg

SEQ ID NO: 3343200 - DNA, 18 bp, Homo sapiens
ctttgttcatagcccagt

SEQ ID NO: 3343201 - DNA, 14 bp, Homo sapiens
ctttgttctgagca

SEQ ID NO: 3343202 - DNA, 20 bp, Homo sapiens
ctttgttctttaggagattt

SEQ ID NO: 3343203 - DNA, 11 bp, Homo sapiens
ctttgttgaag

SEQ ID NO: 3343204 - DNA, 15 bp, Homo sapiens
ctttgttgaagtttg

SEQ ID NO: 3343205 - DNA, 14 bp, Homo sapiens
ctttgttgtttgga

SEQ ID NO: 3343206 - DNA, 18 bp, Homo sapiens
ctttgtttccttattcag

SEQ ID NO: 3343207 - DNA, 13 bp, Homo sapiens
ctttgtttctttt

SEQ ID NO: 3343208 - DNA, 14 bp, Homo sapiens
ctttgttttaataa

SEQ ID NO: 3343209 - DNA, 19 bp, Homo sapiens
ctttgttttgatgtttgtg

SEQ ID NO: 3343210 - DNA, 18 bp, Homo sapiens
ctttgttttttgttggag

SEQ ID NO: 3343211 - DNA, 12 bp, Homo sapiens
cttttaaagacc

SEQ ID NO: 3343212 - DNA, 18 bp, Homo sapiens
cttttaaagaccctccta

SEQ ID NO: 3343213 - DNA, 22 bp, Homo sapiens
cttttaaaggggcagaaaaact

SEQ ID NO: 3343214 - DNA, 23 bp, Homo sapiens
cttttaaaggggcagaaaaactc

SEQ ID NO: 3343215 - DNA, 12 bp, Homo sapiens
cttttaaatcat

SEQ ID NO: 3343216 - DNA, 14 bp, Homo sapiens
cttttaacattttg

SEQ ID NO: 3343217 - DNA, 13 bp, Homo sapiens
cttttaagaaaca

SEQ ID NO: 3343218 - DNA, 22 bp, Homo sapiens
cttttaagacattttcatgctt

SEQ ID NO: 3343219 - DNA, 12 bp, Homo sapiens
cttttaagcagt

SEQ ID NO: 3343220 - DNA, 18 bp, Homo sapiens
cttttaaggataaatcat

SEQ ID NO: 3343221 - DNA, 23 bp, Homo sapiens
cttttaaggataaatcataaagt

SEQ ID NO: 3343222 - DNA, 22 bp, Homo sapiens
cttttaattaaataaaagctgg

SEQ ID NO: 3343223 - DNA, 17 bp, Homo sapiens
cttttaattactgtttt

SEQ ID NO: 3343224 - DNA, 20 bp, Homo sapiens
cttttaattactgttttctt

SEQ ID NO: 3343225 - DNA, 12 bp, Homo sapiens
cttttaattcat

SEQ ID NO: 3343226 - DNA, 22 bp, Homo sapiens
cttttaccgttggggcccttaa

SEQ ID NO: 3343227 - DNA, 17 bp, Homo sapiens
cttttacgtagtaaaag

SEQ ID NO: 3343228 - DNA, 20 bp, Homo sapiens
cttttacgtagtaaaagtca

SEQ ID NO: 3343229 - DNA, 14 bp, Homo sapiens
cttttactttttta

SEQ ID NO: 3343230 - DNA, 15 bp, Homo sapiens
cttttagaaatactg

SEQ ID NO: 3343231 - DNA, 19 bp, Homo sapiens
cttttagaaatactgcaag

SEQ ID NO: 3343232 - DNA, 18 bp, Homo sapiens
cttttagccagagatgca

SEQ ID NO: 3343233 - DNA, 20 bp, Homo sapiens
cttttagccagagatgcaat

SEQ ID NO: 3343234 - DNA, 13 bp, Homo sapiens
cttttagcctagt

SEQ ID NO: 3343235 - DNA, 21 bp, Homo sapiens
cttttaggaaaatcactttgt

SEQ ID NO: 3343236 - DNA, 16 bp, Homo sapiens
cttttagggagagtca

SEQ ID NO: 3343237 - DNA, 21 bp, Homo sapiens
cttttagggagagtcatattt

SEQ ID NO: 3343238 - DNA, 22 bp, Homo sapiens
cttttagtcacgtgtattttca

SEQ ID NO: 3343239 - DNA, 13 bp, Homo sapiens
cttttataataat

SEQ ID NO: 3343240 - DNA, 12 bp, Homo sapiens
cttttatactct

SEQ ID NO: 3343241 - DNA, 20 bp, Homo sapiens
cttttataggtgagaaaaaa

SEQ ID NO: 3343242 - DNA, 20 bp, Homo sapiens
cttttatatggcccagcctt

SEQ ID NO: 3343243 - DNA, 13 bp, Homo sapiens
cttttatatttgt

SEQ ID NO: 3343244 - DNA, 15 bp, Homo sapiens
cttttatatttgtat

SEQ ID NO: 3343245 - DNA, 17 bp, Homo sapiens
cttttatatttgtatcg

SEQ ID NO: 3343246 - DNA, 19 bp, Homo sapiens
cttttatgattttgtttat

SEQ ID NO: 3343247 - DNA, 18 bp, Homo sapiens
cttttatggatgattaaa

SEQ ID NO: 3343248 - DNA, 19 bp, Homo sapiens
cttttatggatgattaaat

SEQ ID NO: 3343249 - DNA, 17 bp, Homo sapiens
cttttattgacacagaa

SEQ ID NO: 3343250 - DNA, 21 bp, Homo sapiens
cttttatttgcaacatttaca

SEQ ID NO: 3343251 - DNA, 12 bp, Homo sapiens
cttttattttga

SEQ ID NO: 3343252 - DNA, 14 bp, Homo sapiens
cttttattttgaaa

SEQ ID NO: 3343253 - DNA, 13 bp, Homo sapiens
cttttattttttc

SEQ ID NO: 3343254 - DNA, 23 bp, Homo sapiens
cttttattttttcttttgtaatt

SEQ ID NO: 3343255 - DNA, 20 bp, Homo sapiens
cttttcactgctggctgcct

SEQ ID NO: 3343256 - DNA, 20 bp, Homo sapiens
cttttcagctgagccctggg

SEQ ID NO: 3343257 - DNA, 22 bp, Homo sapiens
cttttcagctgagccctgggga

SEQ ID NO: 3343258 - DNA, 14 bp, Homo sapiens
cttttcaggaaaat

SEQ ID NO: 3343259 - DNA, 22 bp, Homo sapiens
cttttcataaagggttgaaaat

SEQ ID NO: 3343260 - DNA, 13 bp, Homo sapiens
cttttcatgtaga

SEQ ID NO: 3343261 - DNA, 19 bp, Homo sapiens
cttttcatgtagaactcag

SEQ ID NO: 3343262 - DNA, 16 bp, Homo sapiens
cttttccaggatcctg

SEQ ID NO: 3343263 - DNA, 18 bp, Homo sapiens
cttttcccactgtttaag

SEQ ID NO: 3343264 - DNA, 15 bp, Homo sapiens
cttttcccctgttaa

SEQ ID NO: 3343265 - DNA, 21 bp, Homo sapiens
cttttcccctgttaaacagta

SEQ ID NO: 3343266 - DNA, 14 bp, Homo sapiens
cttttccctgcttc

SEQ ID NO: 3343267 - DNA, 18 bp, Homo sapiens
cttttccctgcttccagg

SEQ ID NO: 3343268 - DNA, 17 bp, Homo sapiens
cttttcccttaaataca

SEQ ID NO: 3343269 - DNA, 16 bp, Homo sapiens
cttttcctatttgttt

SEQ ID NO: 3343270 - DNA, 22 bp, Homo sapiens
cttttcctcaagcaataattgt

SEQ ID NO: 3343271 - DNA, 13 bp, Homo sapiens
cttttcctccctt

SEQ ID NO: 3343272 - DNA, 16 bp, Homo sapiens
cttttcctctctcccg

SEQ ID NO: 3343273 - DNA, 23 bp, Homo sapiens
cttttcctgtcagtgtttttgaa

SEQ ID NO: 3343274 - DNA, 13 bp, Homo sapiens
cttttccttacca

SEQ ID NO: 3343275 - DNA, 22 bp, Homo sapiens
cttttccttcccttttctgttc

SEQ ID NO: 3343276 - DNA, 16 bp, Homo sapiens
cttttcctttgtggtt

SEQ ID NO: 3343277 - DNA, 17 bp, Homo sapiens
cttttctaccctagcca

SEQ ID NO: 3343278 - DNA, 18 bp, Homo sapiens
cttttctaccctagccat

SEQ ID NO: 3343279 - DNA, 22 bp, Homo sapiens
cttttctaccctagccattcct

SEQ ID NO: 3343280 - DNA, 13 bp, Homo sapiens
cttttctattaat

SEQ ID NO: 3343281 - DNA, 16 bp, Homo sapiens
cttttctattaatcat

SEQ ID NO: 3343282 - DNA, 13 bp, Homo sapiens
cttttctattttg

SEQ ID NO: 3343283 - DNA, 14 bp, Homo sapiens
cttttctctttctc

SEQ ID NO: 3343284 - DNA, 12 bp, Homo sapiens
cttttctgcaga

SEQ ID NO: 3343285 - DNA, 15 bp, Homo sapiens
cttttctgcagaggg

SEQ ID NO: 3343286 - DNA, 11 bp, Homo sapiens
cttttctgctg

SEQ ID NO: 3343287 - DNA, 13 bp, Homo sapiens
cttttctgctgag

SEQ ID NO: 3343288 - DNA, 14 bp, Homo sapiens
cttttctgctgagg

SEQ ID NO: 3343289 - DNA, 19 bp, Homo sapiens
cttttctggaatgtaatca

SEQ ID NO: 3343290 - DNA, 17 bp, Homo sapiens
cttttctggggcccagg

SEQ ID NO: 3343291 - DNA, 18 bp, Homo sapiens
cttttctggggcccagga

SEQ ID NO: 3343292 - DNA, 17 bp, Homo sapiens
cttttctgggtatgtgc

SEQ ID NO: 3343293 - DNA, 14 bp, Homo sapiens
cttttctgttgtac

SEQ ID NO: 3343294 - DNA, 16 bp, Homo sapiens
cttttcttaaaccttc

SEQ ID NO: 3343295 - DNA, 19 bp, Homo sapiens
cttttcttaacaacctggc

SEQ ID NO: 3343296 - DNA, 13 bp, Homo sapiens
cttttcttcattt

SEQ ID NO: 3343297 - DNA, 15 bp, Homo sapiens
cttttcttcctggct

SEQ ID NO: 3343298 - DNA, 17 bp, Homo sapiens
cttttctttaaagaagt

SEQ ID NO: 3343299 - DNA, 15 bp, Homo sapiens
cttttctttgttata

SEQ ID NO: 3343300 - DNA, 17 bp, Homo sapiens
cttttcttttctaccct

SEQ ID NO: 3343301 - DNA, 15 bp, Homo sapiens
cttttcttttgttac

SEQ ID NO: 3343302 - DNA, 16 bp, Homo sapiens
cttttcttttgttact

SEQ ID NO: 3343303 - DNA, 17 bp, Homo sapiens
cttttcttttgttactg

SEQ ID NO: 3343304 - DNA, 20 bp, Homo sapiens
cttttgaagtagtttgtata

SEQ ID NO: 3343305 - DNA, 12 bp, Homo sapiens
cttttgacactg

SEQ ID NO: 3343306 - DNA, 18 bp, Homo sapiens
cttttgacttaaagcaga

SEQ ID NO: 3343307 - DNA, 15 bp, Homo sapiens
cttttgagacttttt

SEQ ID NO: 3343308 - DNA, 18 bp, Homo sapiens
cttttgagactttttggt

SEQ ID NO: 3343309 - DNA, 20 bp, Homo sapiens
cttttgagactttttggtgg

SEQ ID NO: 3343310 - DNA, 14 bp, Homo sapiens
cttttgagaggggt

SEQ ID NO: 3343311 - DNA, 13 bp, Homo sapiens
cttttgagcctca

SEQ ID NO: 3343312 - DNA, 16 bp, Homo sapiens
cttttgagcctcagac

SEQ ID NO: 3343313 - DNA, 23 bp, Homo sapiens
cttttgagcctcagaccccaggt

SEQ ID NO: 3343314 - DNA, 14 bp, Homo sapiens
cttttgcacccctc

SEQ ID NO: 3343315 - DNA, 16 bp, Homo sapiens
cttttgcacccctccc

SEQ ID NO: 3343316 - DNA, 17 bp, Homo sapiens
cttttgcacccctccca

SEQ ID NO: 3343317 - DNA, 18 bp, Homo sapiens
cttttgcacccctcccat

SEQ ID NO: 3343318 - DNA, 19 bp, Homo sapiens
cttttgcacccctcccatt

SEQ ID NO: 3343319 - DNA, 19 bp, Homo sapiens
cttttgccagtattatgca

SEQ ID NO: 3343320 - DNA, 23 bp, Homo sapiens
cttttgctactaagttcacatta

SEQ ID NO: 3343321 - DNA, 23 bp, Homo sapiens
cttttgctatagttatacatcaa

SEQ ID NO: 3343322 - DNA, 22 bp, Homo sapiens
cttttgctcttagctgtctgct

SEQ ID NO: 3343323 - DNA, 20 bp, Homo sapiens
cttttgctttctgtttctta

SEQ ID NO: 3343324 - DNA, 15 bp, Homo sapiens
cttttggcactgaga

SEQ ID NO: 3343325 - DNA, 16 bp, Homo sapiens
cttttggtctgtgtga

SEQ ID NO: 3343326 - DNA, 18 bp, Homo sapiens
cttttggtgtgttggaca

SEQ ID NO: 3343327 - DNA, 19 bp, Homo sapiens
cttttggtgtgttggacag

SEQ ID NO: 3343328 - DNA, 15 bp, Homo sapiens
cttggacatcctcct

SEQ ID NO: 3343329 - DNA, 16 bp, Homo sapiens
cttggacatcctcctc

SEQ ID NO: 3343330 - DNA, 17 bp, Homo sapiens
cttggacatcctcctcc

SEQ ID NO: 3343331 - DNA, 19 bp, Homo sapiens
cttggacatcctcctccca

SEQ ID NO: 3343332 - DNA, 20 bp, Homo sapiens
cttggacatcctcctcccac

SEQ ID NO: 3343333 - DNA, 15 bp, Homo sapiens
cttggactcttgctc

SEQ ID NO: 3343334 - DNA, 15 bp, Homo sapiens
cttggagaccctgca

SEQ ID NO: 3343335 - DNA, 19 bp, Homo sapiens
cttggagactcctggtctg

SEQ ID NO: 3343336 - DNA, 20 bp, Homo sapiens
cttggagactcctggtctgt

SEQ ID NO: 3343337 - DNA, 13 bp, Homo sapiens
cttggagcaggca

SEQ ID NO: 3343338 - DNA, 17 bp, Homo sapiens
cttggaggaaacttaag

SEQ ID NO: 3343339 - DNA, 18 bp, Homo sapiens
cttggaggagagagaccc

SEQ ID NO: 3343340 - DNA, 19 bp, Homo sapiens
cttggaggagagagacccc

SEQ ID NO: 3343341 - DNA, 20 bp, Homo sapiens
cttggagggcccacttgtat

SEQ ID NO: 3343342 - DNA, 18 bp, Homo sapiens
cttggattccctctgcct

SEQ ID NO: 3343343 - DNA, 14 bp, Homo sapiens
cttggattctctaa

SEQ ID NO: 3343344 - DNA, 16 bp, Homo sapiens
cttggcaaaagccttg

SEQ ID NO: 3343345 - DNA, 17 bp, Homo sapiens
cttggcaaaagccttgt

SEQ ID NO: 3343346 - DNA, 20 bp, Homo sapiens
cttggcaaaagccttgtgta

SEQ ID NO: 3343347 - DNA, 23 bp, Homo sapiens
cttggcaaaagccttgtgtatat

SEQ ID NO: 3343348 - DNA, 12 bp, Homo sapiens
cttggcaccaaa

SEQ ID NO: 3343349 - DNA, 13 bp, Homo sapiens
cttggcaccaaag

SEQ ID NO: 3343350 - DNA, 12 bp, Homo sapiens
cttggcactttt

SEQ ID NO: 3343351 - DNA, 15 bp, Homo sapiens
cttggcagctgaact

SEQ ID NO: 3343352 - DNA, 19 bp, Homo sapiens
cttggcatcacagggcaga

SEQ ID NO: 3343353 - DNA, 22 bp, Homo sapiens
cttggcatgggcgcaggcccag

SEQ ID NO: 3343354 - DNA, 19 bp, Homo sapiens
cttggcatttctatacttt

SEQ ID NO: 3343355 - DNA, 20 bp, Homo sapiens
cttggccctttccttccaga

SEQ ID NO: 3343356 - DNA, 19 bp, Homo sapiens
cttggcctaaacctcagtt

SEQ ID NO: 3343357 - DNA, 19 bp, Homo sapiens
cttggcctcagctggctgt

SEQ ID NO: 3343358 - DNA, 12 bp, Homo sapiens
cttggcctgctg

SEQ ID NO: 3343359 - DNA, 15 bp, Homo sapiens
cttggcctgctgtga

SEQ ID NO: 3343360 - DNA, 23 bp, Homo sapiens
cttggcctgtctcatccccaggg

SEQ ID NO: 3343361 - DNA, 14 bp, Homo sapiens
cttggcctttgcat

SEQ ID NO: 3343362 - DNA, 17 bp, Homo sapiens
cttggcggcagcagcca

SEQ ID NO: 3343363 - DNA, 15 bp, Homo sapiens
cttggcgtggagcag

SEQ ID NO: 3343364 - DNA, 18 bp, Homo sapiens
cttggcgtggagcaggcg

SEQ ID NO: 3343365 - DNA, 17 bp, Homo sapiens
cttggcgtggagccagg

SEQ ID NO: 3343366 - DNA, 23 bp, Homo sapiens
cttggctcaagtcctcttttctg

SEQ ID NO: 3343367 - DNA, 21 bp, Homo sapiens
cttggctcgaatctctgtgcc

SEQ ID NO: 3343368 - DNA, 18 bp, Homo sapiens
cttggctctgccagtgga

SEQ ID NO: 3343369 - DNA, 13 bp, Homo sapiens
cttggctgcaggg

SEQ ID NO: 3343370 - DNA, 14 bp, Homo sapiens
cttggctgcaggga

SEQ ID NO: 3343371 - DNA, 17 bp, Homo sapiens
cttggctgcagggagtc

SEQ ID NO: 3343372 - DNA, 12 bp, Homo sapiens
cttggctgtgag

SEQ ID NO: 3343373 - DNA, 21 bp, Homo sapiens
cttggctgtgaggcccctgga

SEQ ID NO: 3343374 - DNA, 19 bp, Homo sapiens
cttggcttaatcattttca

SEQ ID NO: 3343375 - DNA, 14 bp, Homo sapiens
cttggcttacctga

SEQ ID NO: 3343376 - DNA, 23 bp, Homo sapiens
cttggcttcctccgtccacccag

SEQ ID NO: 3343377 - DNA, 17 bp, Homo sapiens
cttggcttctgtgatga

SEQ ID NO: 3343378 - DNA, 18 bp, Homo sapiens
cttggctttcctgtttct

SEQ ID NO: 3343379 - DNA, 20 bp, Homo sapiens
cttgggaaaaaaacttggca

SEQ ID NO: 3343380 - DNA, 11 bp, Homo sapiens
cttgggacagc

SEQ ID NO: 3343381 - DNA, 22 bp, Homo sapiens
cttgggagagcccctggggcct

SEQ ID NO: 3343382 - DNA, 17 bp, Homo sapiens
cttgggaggctgaggca

SEQ ID NO: 3343383 - DNA, 23 bp, Homo sapiens
cttgggaggctgaggcaggagaa

SEQ ID NO: 3343384 - DNA, 23 bp, Homo sapiens
cttgggcagagctggctctgagc

SEQ ID NO: 3343385 - DNA, 23 bp, Homo sapiens
cttgggcagttctcactcctagg

SEQ ID NO: 3343386 - DNA, 23 bp, Homo sapiens
cttgggccccagaccccagggca

SEQ ID NO: 3343387 - DNA, 18 bp, Homo sapiens
cttgggcctcaggctctg

SEQ ID NO: 3343388 - DNA, 12 bp, Homo sapiens
cttgggcctggc

SEQ ID NO: 3343389 - DNA, 16 bp, Homo sapiens
cttgggccttgctgct

SEQ ID NO: 3343390 - DNA, 22 bp, Homo sapiens
cttgggccttgctgctgctgca

SEQ ID NO: 3343391 - DNA, 18 bp, Homo sapiens
cttgggctactggcagct

SEQ ID NO: 3343392 - DNA, 17 bp, Homo sapiens
cttgggctcctggctgc

SEQ ID NO: 3343393 - DNA, 14 bp, Homo sapiens
cttgggctgaccca

SEQ ID NO: 3343394 - DNA, 14 bp, Homo sapiens
cttgggctgctcct

SEQ ID NO: 3343395 - DNA, 12 bp, Homo sapiens
cttgggctggga

SEQ ID NO: 3343396 - DNA, 17 bp, Homo sapiens
cttggggaacccatgag

SEQ ID NO: 3343397 - DNA, 17 bp, Homo sapiens
cttggggaatttcctct

SEQ ID NO: 3343398 - DNA, 12 bp, Homo sapiens
cttggggagagg

SEQ ID NO: 3343399 - DNA, 11 bp, Homo sapiens
cttggggaggc

SEQ ID NO: 3343400 - DNA, 23 bp, Homo sapiens
cttggggccaccaaagctgccca

SEQ ID NO: 3343401 - DNA, 15 bp, Homo sapiens
cttggggcctggctt

SEQ ID NO: 3343402 - DNA, 23 bp, Homo sapiens
cttggggcctggcttgctccagg

SEQ ID NO: 3343403 - DNA, 18 bp, Homo sapiens
cttggggctggggggcac

SEQ ID NO: 3343404 - DNA, 18 bp, Homo sapiens
cttccactgcctctgcct

SEQ ID NO: 3343405 - DNA, 21 bp, Homo sapiens
cttccagcttcaggcaccagc

SEQ ID NO: 3343406 - DNA, 18 bp, Homo sapiens
cttccaggaaactccaca

SEQ ID NO: 3343407 - DNA, 21 bp, Homo sapiens
cttccaggaaactccacatct

SEQ ID NO: 3343408 - DNA, 17 bp, Homo sapiens
cttccaggacccctggg

SEQ ID NO: 3343409 - DNA, 22 bp, Homo sapiens
cttccaggataaggagactgag

SEQ ID NO: 3343410 - DNA, 10 bp, Homo sapiens
cttccaggct

SEQ ID NO: 3343411 - DNA, 15 bp, Homo sapiens
cttccaggctcttcc

SEQ ID NO: 3343412 - DNA, 13 bp, Homo sapiens
cttccagggccct

SEQ ID NO: 3343413 - DNA, 22 bp, Homo sapiens
cttccataatgctactgtctca

SEQ ID NO: 3343414 - DNA, 11 bp, Homo sapiens
cttccataatt

SEQ ID NO: 3343415 - DNA, 18 bp, Homo sapiens
cttccataggacatactg

SEQ ID NO: 3343416 - DNA, 16 bp, Homo sapiens
cttccatatttggaag

SEQ ID NO: 3343417 - DNA, 17 bp, Homo sapiens
cttccatcccaaccagt

SEQ ID NO: 3343418 - DNA, 22 bp, Homo sapiens
cttccatcccaaccagtgccaa

SEQ ID NO: 3343419 - DNA, 17 bp, Homo sapiens
cttccatcccaggacac

SEQ ID NO: 3343420 - DNA, 17 bp, Homo sapiens
cttccatctagtcacaa

SEQ ID NO: 3343421 - DNA, 17 bp, Homo sapiens
cttccatgagaacagca

SEQ ID NO: 3343422 - DNA, 11 bp, Homo sapiens
cttccatgcct

SEQ ID NO: 3343423 - DNA, 21 bp, Homo sapiens
cttccatgcctgtagctttcc

SEQ ID NO: 3343424 - DNA, 15 bp, Homo sapiens
cttccatgtcgcctc

SEQ ID NO: 3343425 - DNA, 20 bp, Homo sapiens
cttccatgtcgcctctgcat

SEQ ID NO: 3343426 - DNA, 12 bp, Homo sapiens
cttccatgtgga

SEQ ID NO: 3343427 - DNA, 15 bp, Homo sapiens
cttccatgtggagaa

SEQ ID NO: 3343428 - DNA, 15 bp, Homo sapiens
cttccattaacaaat

SEQ ID NO: 3343429 - DNA, 12 bp, Homo sapiens
cttccatttata

SEQ ID NO: 3343430 - DNA, 15 bp, Homo sapiens
cttcccaatcagcac

SEQ ID NO: 3343431 - DNA, 17 bp, Homo sapiens
cttcccaatcagcactg

SEQ ID NO: 3343432 - DNA, 18 bp, Homo sapiens
cttcccaatcagcactga

SEQ ID NO: 3343433 - DNA, 19 bp, Homo sapiens
cttcccaatcagcactgaa

SEQ ID NO: 3343434 - DNA, 21 bp, Homo sapiens
cttcccaatcagcactgaaaa

SEQ ID NO: 3343435 - DNA, 15 bp, Homo sapiens
cttcccacctccctg

SEQ ID NO: 3343436 - DNA, 21 bp, Homo sapiens
cttcccacctccctgcccagg

SEQ ID NO: 3343437 - DNA, 17 bp, Homo sapiens
cttcccagaaaaccagt

SEQ ID NO: 3343438 - DNA, 16 bp, Homo sapiens
cttcccagaggcagag

SEQ ID NO: 3343439 - DNA, 15 bp, Homo sapiens
cttcccagagggagc

SEQ ID NO: 3343440 - DNA, 20 bp, Homo sapiens
cttcccagagggagcaggcc

SEQ ID NO: 3343441 - DNA, 13 bp, Homo sapiens
cttcccagccatg

SEQ ID NO: 3343442 - DNA, 16 bp, Homo sapiens
cttcccagccatgccc

SEQ ID NO: 3343443 - DNA, 12 bp, Homo sapiens
cttcccatccta

SEQ ID NO: 3343444 - DNA, 18 bp, Homo sapiens
cttcccatgactgcaccc

SEQ ID NO: 3343445 - DNA, 18 bp, Homo sapiens
cttcccatgcattctggt

SEQ ID NO: 3343446 - DNA, 15 bp, Homo sapiens
cttcccatgcctgtc

SEQ ID NO: 3343447 - DNA, 15 bp, Homo sapiens
cttcccattgtggct

SEQ ID NO: 3343448 - DNA, 19 bp, Homo sapiens
cttccccaacttccctagt

SEQ ID NO: 3343449 - DNA, 20 bp, Homo sapiens
cttccccaacttccctagtc

SEQ ID NO: 3343450 - DNA, 10 bp, Homo sapiens
cttccccagg

SEQ ID NO: 3343451 - DNA, 23 bp, Homo sapiens
cttccccaggatggactcttctc

SEQ ID NO: 3343452 - DNA, 16 bp, Homo sapiens
cttccccaggcccacc

SEQ ID NO: 3343453 - DNA, 18 bp, Homo sapiens
cttccccaggcccaccat

SEQ ID NO: 3343454 - DNA, 14 bp, Homo sapiens
cttcccccagccca

SEQ ID NO: 3343455 - DNA, 16 bp, Homo sapiens
cttcccccagcccatc

SEQ ID NO: 3343456 - DNA, 14 bp, Homo sapiens
cttcccccatagcc

SEQ ID NO: 3343457 - DNA, 15 bp, Homo sapiens
cttcccccatagcca

SEQ ID NO: 3343458 - DNA, 15 bp, Homo sapiens
cttccccctccaatc

SEQ ID NO: 3343459 - DNA, 20 bp, Homo sapiens
cttccccctcttcttctgaa

SEQ ID NO: 3343460 - DNA, 18 bp, Homo sapiens
cttccccctgtagactag

SEQ ID NO: 3343461 - DNA, 18 bp, Homo sapiens
cttcccctcccctccttg

SEQ ID NO: 3343462 - DNA, 16 bp, Homo sapiens
cttcccctccctggct

SEQ ID NO: 3343463 - DNA, 20 bp, Homo sapiens
cttcccctccctggctccca

SEQ ID NO: 3343464 - DNA, 13 bp, Homo sapiens
cttcccctgtctt

SEQ ID NO: 3343465 - DNA, 12 bp, Homo sapiens
cttccccttcct

SEQ ID NO: 3343466 - DNA, 14 bp, Homo sapiens
cttccccttcctaa

SEQ ID NO: 3343467 - DNA, 13 bp, Homo sapiens
cttccccttgccc

SEQ ID NO: 3343468 - DNA, 17 bp, Homo sapiens
cttccccttgcccttgc

SEQ ID NO: 3343469 - DNA, 22 bp, Homo sapiens
cttccccttgcccttgccctga

SEQ ID NO: 3343470 - DNA, 13 bp, Homo sapiens
cttcccctttccc

SEQ ID NO: 3343471 - DNA, 17 bp, Homo sapiens
cttcccgctcagccctc

SEQ ID NO: 3343472 - DNA, 23 bp, Homo sapiens
cttcccgctcagccctccctgcc

SEQ ID NO: 3343473 - DNA, 12 bp, Homo sapiens
cttccctaatct

SEQ ID NO: 3343474 - DNA, 15 bp, Homo sapiens
cttccctacctcagg

SEQ ID NO: 3343475 - DNA, 11 bp, Homo sapiens
cttccctccaa

SEQ ID NO: 3343476 - DNA, 16 bp, Homo sapiens
cttccctgttctccct

SEQ ID NO: 3343477 - DNA, 16 bp, Homo sapiens
cttcccttccactgcc

SEQ ID NO: 3343478 - DNA, 20 bp, Homo sapiens
cttcccttccactgcctctg

SEQ ID NO: 3343479 - DNA, 22 bp, Homo sapiens
cttcccttccactgcctctgcc

SEQ ID NO: 3343480 - DNA, 16 bp, Homo sapiens
cttcccttttctgttc

SEQ ID NO: 3343481 - DNA, 19 bp, Homo sapiens
cttccgaccctctgggaac

SEQ ID NO: 3343482 - DNA, 17 bp, Homo sapiens
cttgtatattttaagaa

SEQ ID NO: 3343483 - DNA, 13 bp, Homo sapiens
cttgtatttaatt

SEQ ID NO: 3343484 - DNA, 15 bp, Homo sapiens
cttgtatttaattct

SEQ ID NO: 3343485 - DNA, 20 bp, Homo sapiens
cttgtattttgttaaagctg

SEQ ID NO: 3343486 - DNA, 16 bp, Homo sapiens
cttgtcacaataaatg

SEQ ID NO: 3343487 - DNA, 23 bp, Homo sapiens
cttgtcactgacacaaaggaagt

SEQ ID NO: 3343488 - DNA, 22 bp, Homo sapiens
cttgtcactggtagaccaaaat

SEQ ID NO: 3343489 - DNA, 19 bp, Homo sapiens
cttgtcagacataaagcca

SEQ ID NO: 3343490 - DNA, 13 bp, Homo sapiens
cttgtcattgact

SEQ ID NO: 3343491 - DNA, 21 bp, Homo sapiens
cttgtcccacgtgtcttccac

SEQ ID NO: 3343492 - DNA, 22 bp, Homo sapiens
cttgtcccacgtgtcttccact

SEQ ID NO: 3343493 - DNA, 14 bp, Homo sapiens
cttgtccctctcac

SEQ ID NO: 3343494 - DNA, 14 bp, Homo sapiens
cttgtccctttccc

SEQ ID NO: 3343495 - DNA, 18 bp, Homo sapiens
cttgtccctttccctacc

SEQ ID NO: 3343496 - DNA, 15 bp, Homo sapiens
cttgtcctgccagct

SEQ ID NO: 3343497 - DNA, 16 bp, Homo sapiens
cttgtcctgccagctg

SEQ ID NO: 3343498 - DNA, 17 bp, Homo sapiens
cttgtcctgccagctgc

SEQ ID NO: 3343499 - DNA, 22 bp, Homo sapiens
cttgtcctgccagctgccttcc

SEQ ID NO: 3343500 - DNA, 17 bp, Homo sapiens
cttgtctatttttgtct

SEQ ID NO: 3343501 - DNA, 18 bp, Homo sapiens
cttgtctcctactcctga

SEQ ID NO: 3343502 - DNA, 17 bp, Homo sapiens
cttgtctgaatgtattt

SEQ ID NO: 3343503 - DNA, 12 bp, Homo sapiens
cttgtctgagat

SEQ ID NO: 3343504 - DNA, 17 bp, Homo sapiens
cttgtctgaggcctcat

SEQ ID NO: 3343505 - DNA, 14 bp, Homo sapiens
cttgtctgatttct

SEQ ID NO: 3343506 - DNA, 18 bp, Homo sapiens
cttgtcttctggtacttt

SEQ ID NO: 3343507 - DNA, 19 bp, Homo sapiens
cttgtgaaaaaataaagaa

SEQ ID NO: 3343508 - DNA, 16 bp, Homo sapiens
cttgtgaaacacagct

SEQ ID NO: 3343509 - DNA, 14 bp, Homo sapiens
cttgtgaactgctg

SEQ ID NO: 3343510 - DNA, 16 bp, Homo sapiens
cttgtgaatgcttctc

SEQ ID NO: 3343511 - DNA, 14 bp, Homo sapiens
cttgtgactgaagg

SEQ ID NO: 3343512 - DNA, 18 bp, Homo sapiens
cttgtgattgctgccata

SEQ ID NO: 3343513 - DNA, 16 bp, Homo sapiens
cttgtgccctgccccc

SEQ ID NO: 3343514 - DNA, 21 bp, Homo sapiens
cttgtgccctgcccccatctc

SEQ ID NO: 3343515 - DNA, 23 bp, Homo sapiens
cttgtgctggatggagcccaggc

SEQ ID NO: 3343516 - DNA, 23 bp, Homo sapiens
cttgtgcttggtggggctcgtgg

SEQ ID NO: 3343517 - DNA, 18 bp, Homo sapiens
cttgtggaattgggagct

SEQ ID NO: 3343518 - DNA, 13 bp, Homo sapiens
cttgtggacacag

SEQ ID NO: 3343519 - DNA, 16 bp, Homo sapiens
cttgtggacacagctc

SEQ ID NO: 3343520 - DNA, 18 bp, Homo sapiens
cttgtggacacagctctt

SEQ ID NO: 3343521 - DNA, 22 bp, Homo sapiens
cttgtggaggatgaatagatgt

SEQ ID NO: 3343522 - DNA, 13 bp, Homo sapiens
cttgtggcagagg

SEQ ID NO: 3343523 - DNA, 17 bp, Homo sapiens
cttgtggcagaggatgt

SEQ ID NO: 3343524 - DNA, 16 bp, Homo sapiens
cttgtggggacccagg

SEQ ID NO: 3343525 - DNA, 21 bp, Homo sapiens
cttgtggggacccaggctccg

SEQ ID NO: 3343526 - DNA, 12 bp, Homo sapiens
cttgtggtgtaa

SEQ ID NO: 3343527 - DNA, 14 bp, Homo sapiens
cttgtggtgtaaag

SEQ ID NO: 3343528 - DNA, 20 bp, Homo sapiens
cttgtggtgtaaagctggcc

SEQ ID NO: 3343529 - DNA, 14 bp, Homo sapiens
cttgtggtgtgacc

SEQ ID NO: 3343530 - DNA, 16 bp, Homo sapiens
cttgtggtgtgaccat

SEQ ID NO: 3343531 - DNA, 19 bp, Homo sapiens
cttgtgtcaagacatttct

SEQ ID NO: 3343532 - DNA, 15 bp, Homo sapiens
cttgtgtctctgtgc

SEQ ID NO: 3343533 - DNA, 21 bp, Homo sapiens
cttgtgtctctgtgcttttaa

SEQ ID NO: 3343534 - DNA, 13 bp, Homo sapiens
cttgtgtctgcgt

SEQ ID NO: 3343535 - DNA, 15 bp, Homo sapiens
cttgtgtctgtacac

SEQ ID NO: 3343536 - DNA, 11 bp, Homo sapiens
cttgtgtgttt

SEQ ID NO: 3343537 - DNA, 13 bp, Homo sapiens
cttgtgtgtttca

SEQ ID NO: 3343538 - DNA, 15 bp, Homo sapiens
cttgtgttctgagta

SEQ ID NO: 3343539 - DNA, 13 bp, Homo sapiens
cttgtgtttgctt

SEQ ID NO: 3343540 - DNA, 17 bp, Homo sapiens
cttgtgtttgcttaaac

SEQ ID NO: 3343541 - DNA, 21 bp, Homo sapiens
cttgtgtttgcttaaacaaag

SEQ ID NO: 3343542 - DNA, 19 bp, Homo sapiens
cttgtgttttactgtcaga

SEQ ID NO: 3343543 - DNA, 22 bp, Homo sapiens
cttgtgttttactgtcagatta

SEQ ID NO: 3343544 - DNA, 16 bp, Homo sapiens
cttgttacttgcagca

SEQ ID NO: 3343545 - DNA, 13 bp, Homo sapiens
cttgttagaaaac

SEQ ID NO: 3343546 - DNA, 16 bp, Homo sapiens
cttgttagaaaacaaa

SEQ ID NO: 3343547 - DNA, 14 bp, Homo sapiens
cttgttagagagaa

SEQ ID NO: 3343548 - DNA, 16 bp, Homo sapiens
cttgttattgtgaatg

SEQ ID NO: 3343549 - DNA, 14 bp, Homo sapiens
cttgttcaggaaaa

SEQ ID NO: 3343550 - DNA, 23 bp, Homo sapiens
cttgttccactgcaaataaagcc

SEQ ID NO: 3343551 - DNA, 13 bp, Homo sapiens
cttgttccagctc

SEQ ID NO: 3343552 - DNA, 16 bp, Homo sapiens
cttgttccagctcttt

SEQ ID NO: 3343553 - DNA, 13 bp, Homo sapiens
cttgttctatttt

SEQ ID NO: 3343554 - DNA, 16 bp, Homo sapiens
cttgttctgtcccttc

SEQ ID NO: 3343555 - DNA, 18 bp, Homo sapiens
cttgttgaaaatatttct

SEQ ID NO: 3343556 - DNA, 20 bp, Homo sapiens
cttgttgctcaaaaaatgag

SEQ ID NO: 3343557 - DNA, 21 bp, Homo sapiens
cttgttgggattcctgaccca

SEQ ID NO: 3343558 - DNA, 12 bp, Homo sapiens
cttgttggtgga

SEQ ID NO: 3343559 - DNA, 15 bp, Homo sapiens
cttgttggtggagag

SEQ ID NO: 3343560 - DNA, 14 bp, Homo sapiens
cttgttgtggctct

SEQ ID NO: 3343561 - DNA, 20 bp, Homo sapiens
cttgttgtggctcttatttc

SEQ ID NO: 3343562 - DNA, 22 bp, Homo sapiens
cttgttgtggctcttatttctg

SEQ ID NO: 3343563 - DNA, 15 bp, Homo sapiens
cttgtttacctttct

SEQ ID NO: 3343564 - DNA, 22 bp, Homo sapiens
cttgtttatcagatacatcact

SEQ ID NO: 3343565 - DNA, 13 bp, Homo sapiens
cttgtttatgata

SEQ ID NO: 3343566 - DNA, 19 bp, Homo sapiens
cttgtttatgatatttctt

SEQ ID NO: 3343567 - DNA, 22 bp, Homo sapiens
cttgtttcaattccacctgcaa

SEQ ID NO: 3343568 - DNA, 13 bp, Homo sapiens
cttgtttcagctt

SEQ ID NO: 3343569 - DNA, 20 bp, Homo sapiens
cttgtttgtgcatcctgtga

SEQ ID NO: 3343570 - DNA, 17 bp, Homo sapiens
cttgttttctctgtgtg

SEQ ID NO: 3343571 - DNA, 21 bp, Homo sapiens
cttgttttctttctttaaatg

SEQ ID NO: 3343572 - DNA, 17 bp, Homo sapiens
cttgttttggatggctt

SEQ ID NO: 3343573 - DNA, 13 bp, Homo sapiens
cttgttttgtttg

SEQ ID NO: 3343574 - DNA, 18 bp, Homo sapiens
cttgtttttattaattta

SEQ ID NO: 3343575 - DNA, 12 bp, Homo sapiens
cttgtttttgca

SEQ ID NO: 3343576 - DNA, 20 bp, Homo sapiens
cttgttttttttttccactt

SEQ ID NO: 3343577 - DNA, 20 bp, Homo sapiens
ctttaaaaaaaaaagttaca

SEQ ID NO: 3343578 - DNA, 19 bp, Homo sapiens
ctttaaaaaaatttaagtg

SEQ ID NO: 3343579 - DNA, 16 bp, Homo sapiens
ctttaaaaaagactga

SEQ ID NO: 3343580 - DNA, 19 bp, Homo sapiens
ctttaaaaaatatttatta

SEQ ID NO: 3343581 - DNA, 12 bp, Homo sapiens
ctttaaaaagga

SEQ ID NO: 3343582 - DNA, 11 bp, Homo sapiens
ctttaaaagaa

SEQ ID NO: 3343583 - DNA, 15 bp, Homo sapiens
ctttaaaagagagag

SEQ ID NO: 3343584 - DNA, 19 bp, Homo sapiens
ctttaaaaggattaatctg

SEQ ID NO: 3343585 - DNA, 22 bp, Homo sapiens
ctttaaaatatttgtctttaaa

SEQ ID NO: 3343586 - DNA, 13 bp, Homo sapiens
ctttaaaattgtc

SEQ ID NO: 3343587 - DNA, 22 bp, Homo sapiens
ctttaaacctgtagaatcaatt

SEQ ID NO: 3343588 - DNA, 22 bp, Homo sapiens
ctttaaactcagggacagagcc

SEQ ID NO: 3343589 - DNA, 19 bp, Homo sapiens
ctttaaaggcccagcccct

SEQ ID NO: 3343590 - DNA, 18 bp, Homo sapiens
ctttaaagggcctgcctg

SEQ ID NO: 3343591 - DNA, 17 bp, Homo sapiens
ctttaaagtgtaataat

SEQ ID NO: 3343592 - DNA, 21 bp, Homo sapiens
ctttaaagtgtaataatatga

SEQ ID NO: 3343593 - DNA, 15 bp, Homo sapiens
ctttaaatgttttat

SEQ ID NO: 3343594 - DNA, 23 bp, Homo sapiens
ctttaactgccgtaatttaactt

SEQ ID NO: 3343595 - DNA, 18 bp, Homo sapiens
ctttaagaaccttaatga

SEQ ID NO: 3343596 - DNA, 19 bp, Homo sapiens
ctttaagaaccttaatgac

SEQ ID NO: 3343597 - DNA, 23 bp, Homo sapiens
ctttaagaaccttaatgacaaca

SEQ ID NO: 3343598 - DNA, 12 bp, Homo sapiens
ctttaagagact

SEQ ID NO: 3343599 - DNA, 17 bp, Homo sapiens
ctttaagatatccatct

SEQ ID NO: 3343600 - DNA, 20 bp, Homo sapiens
ctttaagatatccatctttt

SEQ ID NO: 3343601 - DNA, 17 bp, Homo sapiens
ctttaagccaaagaaac

SEQ ID NO: 3343602 - DNA, 21 bp, Homo sapiens
ctttaagccaaagaaacaagc

SEQ ID NO: 3343603 - DNA, 19 bp, Homo sapiens
ctttaagggcatgccttgt

SEQ ID NO: 3343604 - DNA, 17 bp, Homo sapiens
ctttaagtttcaggata

SEQ ID NO: 3343605 - DNA, 21 bp, Homo sapiens
ctttaataaattgcttactga

SEQ ID NO: 3343606 - DNA, 14 bp, Homo sapiens
ctttaatcttcagt

SEQ ID NO: 3343607 - DNA, 13 bp, Homo sapiens
ctttaatgcatct

SEQ ID NO: 3343608 - DNA, 22 bp, Homo sapiens
cttaggatggggctcccagctc

SEQ ID NO: 3343609 - DNA, 23 bp, Homo sapiens
cttaggccttcctctctccagat

SEQ ID NO: 3343610 - DNA, 12 bp, Homo sapiens
cttagggaaaga

SEQ ID NO: 3343611 - DNA, 21 bp, Homo sapiens
cttagggtggctttaattgta

SEQ ID NO: 3343612 - DNA, 19 bp, Homo sapiens
cttaggttattttgctttg

SEQ ID NO: 3343613 - DNA, 20 bp, Homo sapiens
cttagtaaaatttatttcat

SEQ ID NO: 3343614 - DNA, 19 bp, Homo sapiens
cttagtaactttttatgta

SEQ ID NO: 3343615 - DNA, 23 bp, Homo sapiens
cttagtcgaatgttagattcctc

SEQ ID NO: 3343616 - DNA, 16 bp, Homo sapiens
cttagtcttctcatag

SEQ ID NO: 3343617 - DNA, 20 bp, Homo sapiens
cttagtgatcatttaaaaag

SEQ ID NO: 3343618 - DNA, 16 bp, Homo sapiens
cttagtgccacccacc

SEQ ID NO: 3343619 - DNA, 23 bp, Homo sapiens
cttagtgcccgcctaggagttga

SEQ ID NO: 3343620 - DNA, 20 bp, Homo sapiens
cttagtgcggacaagtttta

SEQ ID NO: 3343621 - DNA, 23 bp, Homo sapiens
cttagtgcttcagagtttgtgtg

SEQ ID NO: 3343622 - DNA, 14 bp, Homo sapiens
cttagtgggccagg

SEQ ID NO: 3343623 - DNA, 17 bp, Homo sapiens
cttagtgggccagggct

SEQ ID NO: 3343624 - DNA, 16 bp, Homo sapiens
cttagttctcactgtt

SEQ ID NO: 3343625 - DNA, 17 bp, Homo sapiens
cttagtttcagagacct

SEQ ID NO: 3343626 - DNA, 20 bp, Homo sapiens
cttagtttcagagaccttaa

SEQ ID NO: 3343627 - DNA, 19 bp, Homo sapiens
cttagtttggattcttatg

SEQ ID NO: 3343628 - DNA, 22 bp, Homo sapiens
cttagtttgtgtgttgtctctt

SEQ ID NO: 3343629 - DNA, 17 bp, Homo sapiens
cttataaacacattgaa

SEQ ID NO: 3343630 - DNA, 16 bp, Homo sapiens
cttataaaccaatctt

SEQ ID NO: 3343631 - DNA, 13 bp, Homo sapiens
cttataaatcata

SEQ ID NO: 3343632 - DNA, 19 bp, Homo sapiens
cttataacctagttaaaga

SEQ ID NO: 3343633 - DNA, 20 bp, Homo sapiens
cttataagtgaagtgatact

SEQ ID NO: 3343634 - DNA, 14 bp, Homo sapiens
cttatagaataaaa

SEQ ID NO: 3343635 - DNA, 15 bp, Homo sapiens
cttatagaatattta

SEQ ID NO: 3343636 - DNA, 20 bp, Homo sapiens
cttatagaatatttattacc

SEQ ID NO: 3343637 - DNA, 15 bp, Homo sapiens
cttatagcactttga

SEQ ID NO: 3343638 - DNA, 17 bp, Homo sapiens
cttatagcactttgaaa

SEQ ID NO: 3343639 - DNA, 16 bp, Homo sapiens
cttatagtctaagact

SEQ ID NO: 3343640 - DNA, 21 bp, Homo sapiens
cttatagtctaagactatata

SEQ ID NO: 3343641 - DNA, 19 bp, Homo sapiens
cttatagttaatattttgt

SEQ ID NO: 3343642 - DNA, 18 bp, Homo sapiens
cttatagttactgtgtaa

SEQ ID NO: 3343643 - DNA, 18 bp, Homo sapiens
cttatatagcacctttca

SEQ ID NO: 3343644 - DNA, 21 bp, Homo sapiens
cttatatagcagcaaaaatat

SEQ ID NO: 3343645 - DNA, 17 bp, Homo sapiens
cttatatatgcacttaa

SEQ ID NO: 3343646 - DNA, 14 bp, Homo sapiens
cttatatgtccttg

SEQ ID NO: 3343647 - DNA, 14 bp, Homo sapiens
cttatatttcccta

SEQ ID NO: 3343648 - DNA, 15 bp, Homo sapiens
cttatattttcgtat

SEQ ID NO: 3343649 - DNA, 20 bp, Homo sapiens
cttatattttcgtatgaaaa

SEQ ID NO: 3343650 - DNA, 22 bp, Homo sapiens
cttatattttcgtatgaaaatg

SEQ ID NO: 3343651 - DNA, 19 bp, Homo sapiens
cttatatttttaataaaag

SEQ ID NO: 3343652 - DNA, 11 bp, Homo sapiens
cttatcaagtg

SEQ ID NO: 3343653 - DNA, 19 bp, Homo sapiens
cttatcaagtgtcttccat

SEQ ID NO: 3343654 - DNA, 12 bp, Homo sapiens
cttatcagagct

SEQ ID NO: 3343655 - DNA, 22 bp, Homo sapiens
cttatcagctacttaagagaaa

SEQ ID NO: 3343656 - DNA, 18 bp, Homo sapiens
cttatcccccccagcctg

SEQ ID NO: 3343657 - DNA, 21 bp, Homo sapiens
cttatcctaaaacaaatagtt

SEQ ID NO: 3343658 - DNA, 21 bp, Homo sapiens
cttatctcagtcatgcataaa

SEQ ID NO: 3343659 - DNA, 23 bp, Homo sapiens
cttatctcagtcatgcataaata

SEQ ID NO: 3343660 - DNA, 12 bp, Homo sapiens
cttatctctttt

SEQ ID NO: 3343661 - DNA, 18 bp, Homo sapiens
cttatctgccatgtccat

SEQ ID NO: 3343662 - DNA, 20 bp, Homo sapiens
cttatcttacaatattgatt

SEQ ID NO: 3343663 - DNA, 14 bp, Homo sapiens
cttatcttatgcca

SEQ ID NO: 3343664 - DNA, 13 bp, Homo sapiens
cttatcttctgga

SEQ ID NO: 3343665 - DNA, 15 bp, Homo sapiens
cttatcttctggatt

SEQ ID NO: 3343666 - DNA, 21 bp, Homo sapiens
cttatgacatcacttgtacaa

SEQ ID NO: 3343667 - DNA, 17 bp, Homo sapiens
cttatgatgttttccct

SEQ ID NO: 3343668 - DNA, 20 bp, Homo sapiens
cttatgattaaacttccttc

SEQ ID NO: 3343669 - DNA, 15 bp, Homo sapiens
cttatgattgcagat

SEQ ID NO: 3343670 - DNA, 16 bp, Homo sapiens
cttatgcggttaattt

SEQ ID NO: 3343671 - DNA, 15 bp, Homo sapiens
cttatggccacagcc

SEQ ID NO: 3343672 - DNA, 21 bp, Homo sapiens
cttatggtatgtagccagctg

SEQ ID NO: 3343673 - DNA, 12 bp, Homo sapiens
cttatgtacttg

SEQ ID NO: 3343674 - DNA, 22 bp, Homo sapiens
cttatgtacttgatactgaatg

SEQ ID NO: 3343675 - DNA, 23 bp, Homo sapiens
cttatgtagagtttttatgcctt

SEQ ID NO: 3343676 - DNA, 18 bp, Homo sapiens
cttatgtagatatttggc

SEQ ID NO: 3343677 - DNA, 20 bp, Homo sapiens
cttatgtgggttgcctggtg

SEQ ID NO: 3343678 - DNA, 14 bp, Homo sapiens
cttatgttgaaaaa

SEQ ID NO: 3343679 - DNA, 15 bp, Homo sapiens
cttattacatttaaa

SEQ ID NO: 3343680 - DNA, 15 bp, Homo sapiens
cttattactattatt

SEQ ID NO: 3343681 - DNA, 14 bp, Homo sapiens
cttattataaaatg

SEQ ID NO: 3343682 - DNA, 12 bp, Homo sapiens
cttattccacag

SEQ ID NO: 3343683 - DNA, 21 bp, Homo sapiens
cttattcccaaactacagaat

SEQ ID NO: 3343684 - DNA, 18 bp, Homo sapiens
cttattccctcatccttt

SEQ ID NO: 3343685 - DNA, 19 bp, Homo sapiens
cttattccctcatcctttc

SEQ ID NO: 3343686 - DNA, 20 bp, Homo sapiens
cttattccgagcattccagt

SEQ ID NO: 3343687 - DNA, 16 bp, Homo sapiens
cttattcctctaggca

SEQ ID NO: 3343688 - DNA, 15 bp, Homo sapiens
cttattctcaaagca

SEQ ID NO: 3343689 - DNA, 19 bp, Homo sapiens
cttattcttttataataat

SEQ ID NO: 3343690 - DNA, 20 bp, Homo sapiens
cttcaagtgttgctcttgga

SEQ ID NO: 3343691 - DNA, 16 bp, Homo sapiens
cttcaagttagctcag

SEQ ID NO: 3343692 - DNA, 18 bp, Homo sapiens
cttcaagttagctcagga

SEQ ID NO: 3343693 - DNA, 13 bp, Homo sapiens
cttcaagttgtaa

SEQ ID NO: 3343694 - DNA, 22 bp, Homo sapiens
cttcaagttgtaaaaatgaaag

SEQ ID NO: 3343695 - DNA, 16 bp, Homo sapiens
cttcaatactgaaaat

SEQ ID NO: 3343696 - DNA, 15 bp, Homo sapiens
cttcaatagaactgt

SEQ ID NO: 3343697 - DNA, 16 bp, Homo sapiens
cttcaatgctagaaaa

SEQ ID NO: 3343698 - DNA, 20 bp, Homo sapiens
cttcaatgtgtcatttccgg

SEQ ID NO: 3343699 - DNA, 15 bp, Homo sapiens
cttcaattcctgggc

SEQ ID NO: 3343700 - DNA, 16 bp, Homo sapiens
cttcacaccccaggcc

SEQ ID NO: 3343701 - DNA, 20 bp, Homo sapiens
cttcacaggcagtgcatgtg

SEQ ID NO: 3343702 - DNA, 21 bp, Homo sapiens
cttcacagtagagccagcttg

SEQ ID NO: 3343703 - DNA, 14 bp, Homo sapiens
cttcacattaaaaa

SEQ ID NO: 3343704 - DNA, 20 bp, Homo sapiens
cttcaccagtctgtctactg

SEQ ID NO: 3343705 - DNA, 22 bp, Homo sapiens
cttcaccagtctgtctactgtg

SEQ ID NO: 3343706 - DNA, 24 bp, Homo sapiens
cttcacccagctaatctgtagggc

SEQ ID NO: 3343707 - DNA, 14 bp, Homo sapiens
cttcaccccggcag

SEQ ID NO: 3343708 - DNA, 19 bp, Homo sapiens
cttcaccccggcaggccct

SEQ ID NO: 3343709 - DNA, 21 bp, Homo sapiens
cttcaccccggcaggccctgc

SEQ ID NO: 3343710 - DNA, 15 bp, Homo sapiens
cttcaccctggagcc

SEQ ID NO: 3343711 - DNA, 13 bp, Homo sapiens
cttcaccctgtca

SEQ ID NO: 3343712 - DNA, 13 bp, Homo sapiens
cttcacctctatc

SEQ ID NO: 3343713 - DNA, 15 bp, Homo sapiens
cttcacctctatcca

SEQ ID NO: 3343714 - DNA, 13 bp, Homo sapiens
cttcacctgccac

SEQ ID NO: 3343715 - DNA, 14 bp, Homo sapiens
cttcacctgccacc

SEQ ID NO: 3343716 - DNA, 15 bp, Homo sapiens
cttcacctgttatgt

SEQ ID NO: 3343717 - DNA, 19 bp, Homo sapiens
cttcacctgttatgtatga

SEQ ID NO: 3343718 - DNA, 17 bp, Homo sapiens
cttcacgcccttggcca

SEQ ID NO: 3343719 - DNA, 18 bp, Homo sapiens
cttcactactttaataaa

SEQ ID NO: 3343720 - DNA, 14 bp, Homo sapiens
cttcactccggtgt

SEQ ID NO: 3343721 - DNA, 22 bp, Homo sapiens
cttcactccggtgtgcctgcag

SEQ ID NO: 3343722 - DNA, 18 bp, Homo sapiens
cttcactctccagggtac

SEQ ID NO: 3343723 - DNA, 15 bp, Homo sapiens
cttcactctctgaag

SEQ ID NO: 3343724 - DNA, 13 bp, Homo sapiens
cttcactgtataa

SEQ ID NO: 3343725 - DNA, 18 bp, Homo sapiens
cttcactgtcatcttcaa

SEQ ID NO: 3343726 - DNA, 19 bp, Homo sapiens
cttcactgtggccacagcc

SEQ ID NO: 3343727 - DNA, 12 bp, Homo sapiens
cttcactgttcc

SEQ ID NO: 3343728 - DNA, 13 bp, Homo sapiens
cttcactgttccc

SEQ ID NO: 3343729 - DNA, 18 bp, Homo sapiens
cttcactgttccctctgg

SEQ ID NO: 3343730 - DNA, 22 bp, Homo sapiens
cttcactgttccctctggcttc

SEQ ID NO: 3343731 - DNA, 16 bp, Homo sapiens
cttcactgttgaaaat

SEQ ID NO: 3343732 - DNA, 12 bp, Homo sapiens
cttcagaaagac

SEQ ID NO: 3343733 - DNA, 20 bp, Homo sapiens
cttcagaacacacagacttt

SEQ ID NO: 3343734 - DNA, 16 bp, Homo sapiens
cttcagaagctatttt

SEQ ID NO: 3343735 - DNA, 15 bp, Homo sapiens
cttcagaattagatg

SEQ ID NO: 3343736 - DNA, 20 bp, Homo sapiens
cttcagaattccatatcttg

SEQ ID NO: 3343737 - DNA, 19 bp, Homo sapiens
cttcagacacaaaagtcca

SEQ ID NO: 3343738 - DNA, 19 bp, Homo sapiens
cttcagacagagaggactg

SEQ ID NO: 3343739 - DNA, 20 bp, Homo sapiens
cttcagacagagaggactgt

SEQ ID NO: 3343740 - DNA, 11 bp, Homo sapiens
cttcagagctc

SEQ ID NO: 3343741 - DNA, 13 bp, Homo sapiens
cttcagaggctga

SEQ ID NO: 3343742 - DNA, 16 bp, Homo sapiens
cttcagaggctgaggt

SEQ ID NO: 3343743 - DNA, 23 bp, Homo sapiens
cttcagagtcctcattataaaat

SEQ ID NO: 3343744 - DNA, 19 bp, Homo sapiens
cttcagatattattgcttt

SEQ ID NO: 3343745 - DNA, 13 bp, Homo sapiens
cttcagatctgag

SEQ ID NO: 3343746 - DNA, 23 bp, Homo sapiens
cttcagatgggaggaaagagagc

SEQ ID NO: 3343747 - DNA, 20 bp, Homo sapiens
cttcagcaagttagaactag

SEQ ID NO: 3343748 - DNA, 14 bp, Homo sapiens
cttcagcacggcgt

SEQ ID NO: 3343749 - DNA, 21 bp, Homo sapiens
cttcagcagtacctataaagt

SEQ ID NO: 3343750 - DNA, 12 bp, Homo sapiens
cttcagcccctt

SEQ ID NO: 3343751 - DNA, 16 bp, Homo sapiens
cttcagccccttctcc

SEQ ID NO: 3343752 - DNA, 21 bp, Homo sapiens
cttcagccccttctcccctcc

SEQ ID NO: 3343753 - DNA, 14 bp, Homo sapiens
cttcagcctcccga

SEQ ID NO: 3343754 - DNA, 16 bp, Homo sapiens
cttcagcctcccgagt

SEQ ID NO: 3343755 - DNA, 20 bp, Homo sapiens
cttcagcctcccgagtagct

SEQ ID NO: 3343756 - DNA, 14 bp, Homo sapiens
cttcagcctgaggc

SEQ ID NO: 3343757 - DNA, 15 bp, Homo sapiens
cttcagcctgaggct

SEQ ID NO: 3343758 - DNA, 23 bp, Homo sapiens
cttcagctccagggaatccaagc

SEQ ID NO: 3343759 - DNA, 15 bp, Homo sapiens
cttcagctctttttg

SEQ ID NO: 3343760 - DNA, 13 bp, Homo sapiens
cttcagctgcctg

SEQ ID NO: 3343761 - DNA, 23 bp, Homo sapiens
cttcagctgcctgaaacagccat

SEQ ID NO: 3343762 - DNA, 16 bp, Homo sapiens
cttcaggcaccagcat

SEQ ID NO: 3343763 - DNA, 19 bp, Homo sapiens
cttcaggcaccagcatcca

SEQ ID NO: 3343764 - DNA, 17 bp, Homo sapiens
cttcaggccgagccagg

SEQ ID NO: 3343765 - DNA, 15 bp, Homo sapiens
cttcaggcctccctc

SEQ ID NO: 3343766 - DNA, 15 bp, Homo sapiens
cttcaggctcttctc

SEQ ID NO: 3343767 - DNA, 19 bp, Homo sapiens
cttcaggctcttctccttt

SEQ ID NO: 3343768 - DNA, 21 bp, Homo sapiens
cttcagggaggtagtttcaaa

SEQ ID NO: 3343769 - DNA, 18 bp, Homo sapiens
cttcagggcagggctctg

SEQ ID NO: 3343770 - DNA, 14 bp, Homo sapiens
ctgttgcccaggct

SEQ ID NO: 3343771 - DNA, 15 bp, Homo sapiens
ctgttgcccaggctg

SEQ ID NO: 3343772 - DNA, 18 bp, Homo sapiens
ctgttgcccaggctggcg

SEQ ID NO: 3343773 - DNA, 18 bp, Homo sapiens
ctgttgccctttctgtac

SEQ ID NO: 3343774 - DNA, 18 bp, Homo sapiens
ctgttgcctaattggaaa

SEQ ID NO: 3343775 - DNA, 13 bp, Homo sapiens
ctgttgcctttta

SEQ ID NO: 3343776 - DNA, 21 bp, Homo sapiens
ctgttgctcaaatctattcag

SEQ ID NO: 3343777 - DNA, 21 bp, Homo sapiens
ctgttgctgtgtttaatttga

SEQ ID NO: 3343778 - DNA, 18 bp, Homo sapiens
ctgttggagcaaaccatt

SEQ ID NO: 3343779 - DNA, 18 bp, Homo sapiens
ctgttggcactcacagac

SEQ ID NO: 3343780 - DNA, 22 bp, Homo sapiens
ctgttggcactcacagacctgg

SEQ ID NO: 3343781 - DNA, 16 bp, Homo sapiens
ctgttggcaggctggc

SEQ ID NO: 3343782 - DNA, 14 bp, Homo sapiens
ctgttggcagtgag

SEQ ID NO: 3343783 - DNA, 21 bp, Homo sapiens
ctgttggcagtgagtgagcct

SEQ ID NO: 3343784 - DNA, 12 bp, Homo sapiens
ctgttggccagt

SEQ ID NO: 3343785 - DNA, 22 bp, Homo sapiens
ctgttggctgggggcctcagtg

SEQ ID NO: 3343786 - DNA, 12 bp, Homo sapiens
ctgttgtaactt

SEQ ID NO: 3343787 - DNA, 15 bp, Homo sapiens
ctgttgtaacttatg

SEQ ID NO: 3343788 - DNA, 18 bp, Homo sapiens
ctgttgtaacttatgtag

SEQ ID NO: 3343789 - DNA, 20 bp, Homo sapiens
ctgttgtaacttatgtagat

SEQ ID NO: 3343790 - DNA, 21 bp, Homo sapiens
ctgttgtaacttatgtagata

SEQ ID NO: 3343791 - DNA, 12 bp, Homo sapiens
ctgttgtacatt

SEQ ID NO: 3343792 - DNA, 17 bp, Homo sapiens
ctgttgtacatttatga

SEQ ID NO: 3343793 - DNA, 19 bp, Homo sapiens
ctgttgtacatttatgatt

SEQ ID NO: 3343794 - DNA, 22 bp, Homo sapiens
ctgttgtacatttatgatttaa

SEQ ID NO: 3343795 - DNA, 16 bp, Homo sapiens
ctgttgttccatttta

SEQ ID NO: 3343796 - DNA, 17 bp, Homo sapiens
ctgttgttgttaatgaa

SEQ ID NO: 3343797 - DNA, 22 bp, Homo sapiens
ctgttgttgttaatgaaaatgt

SEQ ID NO: 3343798 - DNA, 16 bp, Homo sapiens
ctgttgttttgtttta

SEQ ID NO: 3343799 - DNA, 16 bp, Homo sapiens
ctgtttaatatttaaa

SEQ ID NO: 3343800 - DNA, 21 bp, Homo sapiens
ctgtttagagtaaataaactg

SEQ ID NO: 3343801 - DNA, 16 bp, Homo sapiens
ctgtttaggaagaagt

SEQ ID NO: 3343802 - DNA, 18 bp, Homo sapiens
ctgtttataatctgaaga

SEQ ID NO: 3343803 - DNA, 20 bp, Homo sapiens
ctgtttataatctgaagata

SEQ ID NO: 3343804 - DNA, 15 bp, Homo sapiens
ctgtttatggcctca

SEQ ID NO: 3343805 - DNA, 17 bp, Homo sapiens
ctgtttatggcctcagc

SEQ ID NO: 3343806 - DNA, 18 bp, Homo sapiens
ctgtttatggcctcagct

SEQ ID NO: 3343807 - DNA, 21 bp, Homo sapiens
ctgtttatggcctcagctgcc

SEQ ID NO: 3343808 - DNA, 15 bp, Homo sapiens
ctgtttattcccatc

SEQ ID NO: 3343809 - DNA, 16 bp, Homo sapiens
ctgtttattttatatt

SEQ ID NO: 3343810 - DNA, 17 bp, Homo sapiens
ctgtttcaacacagacc

SEQ ID NO: 3343811 - DNA, 22 bp, Homo sapiens
ctgtttcaaggcactctagatt

SEQ ID NO: 3343812 - DNA, 20 bp, Homo sapiens
ctgtttcactgaaatgtttg

SEQ ID NO: 3343813 - DNA, 22 bp, Homo sapiens
ctgtttcactgaaatgtttgga

SEQ ID NO: 3343814 - DNA, 13 bp, Homo sapiens
ctgtttccagggt

SEQ ID NO: 3343815 - DNA, 14 bp, Homo sapiens
ctgtttccctgctg

SEQ ID NO: 3343816 - DNA, 17 bp, Homo sapiens
ctgtttccctgctgaat

SEQ ID NO: 3343817 - DNA, 21 bp, Homo sapiens
ctgtttctctgccgctacctc

SEQ ID NO: 3343818 - DNA, 22 bp, Homo sapiens
ctgtttctctttgtctgccttc

SEQ ID NO: 3343819 - DNA, 16 bp, Homo sapiens
ctgtttctgtcaggag

SEQ ID NO: 3343820 - DNA, 17 bp, Homo sapiens
ctgtttcttaagggcac

SEQ ID NO: 3343821 - DNA, 19 bp, Homo sapiens
ctgtttgacacctcttttt

SEQ ID NO: 3343822 - DNA, 23 bp, Homo sapiens
ctgtttgacacctcttttttcgt

SEQ ID NO: 3343823 - DNA, 11 bp, Homo sapiens
ctgtttgatgt

SEQ ID NO: 3343824 - DNA, 15 bp, Homo sapiens
ctgtttgatgtatgt

SEQ ID NO: 3343825 - DNA, 17 bp, Homo sapiens
ctgtttgatgtatgtgt

SEQ ID NO: 3343826 - DNA, 17 bp, Homo sapiens
ctgtttggaaaagacag

SEQ ID NO: 3343827 - DNA, 12 bp, Homo sapiens
ctgtttggactg

SEQ ID NO: 3343828 - DNA, 14 bp, Homo sapiens
ctgtttggcacttg

SEQ ID NO: 3343829 - DNA, 15 bp, Homo sapiens
ctgtttggcacttgt

SEQ ID NO: 3343830 - DNA, 17 bp, Homo sapiens
ctgtttggcacttgtat

SEQ ID NO: 3343831 - DNA, 19 bp, Homo sapiens
ctgtttggcacttgtattt

SEQ ID NO: 3343832 - DNA, 15 bp, Homo sapiens
ctgtttggcttataa

SEQ ID NO: 3343833 - DNA, 18 bp, Homo sapiens
ctgtttggcttataaaca

SEQ ID NO: 3343834 - DNA, 16 bp, Homo sapiens
ctgtttgtcctgagat

SEQ ID NO: 3343835 - DNA, 22 bp, Homo sapiens
ctgttttaaatttatttcaaaa

SEQ ID NO: 3343836 - DNA, 13 bp, Homo sapiens
ctgttttaattgt

SEQ ID NO: 3343837 - DNA, 16 bp, Homo sapiens
ctgttttatatattat

SEQ ID NO: 3343838 - DNA, 22 bp, Homo sapiens
ctgttttatatattatgtgaag

SEQ ID NO: 3343839 - DNA, 13 bp, Homo sapiens
ctgttttccctga

SEQ ID NO: 3343840 - DNA, 20 bp, Homo sapiens
ctgttttctgagcccgggct

SEQ ID NO: 3343841 - DNA, 20 bp, Homo sapiens
ctgttttgtggtcagctgta

SEQ ID NO: 3343842 - DNA, 18 bp, Homo sapiens
ctgttttgttaatgctct

SEQ ID NO: 3343843 - DNA, 19 bp, Homo sapiens
ctgtttttaagctgtttcc

SEQ ID NO: 3343844 - DNA, 23 bp, Homo sapiens
ctgtttttaagctgtttccatag

SEQ ID NO: 3343845 - DNA, 23 bp, Homo sapiens
ctgtttttctctaatgcttgatt

SEQ ID NO: 3343846 - DNA, 16 bp, Homo sapiens
ctgtttttgtatcttt

SEQ ID NO: 3343847 - DNA, 16 bp, Homo sapiens
ctgtttttttttcatt

SEQ ID NO: 3343848 - DNA, 12 bp, Homo sapiens
cttaaaaaactt

SEQ ID NO: 3343849 - DNA, 18 bp, Homo sapiens
cttaaaaaacttgtaaat

SEQ ID NO: 3343850 - DNA, 14 bp, Homo sapiens
cttaaaaaatgtcc

SEQ ID NO: 3343851 - DNA, 13 bp, Homo sapiens
cttaaaaaggaac

SEQ ID NO: 3343852 - DNA, 20 bp, Homo sapiens
cttaaaaatcattgattgtc

SEQ ID NO: 3343853 - DNA, 13 bp, Homo sapiens
cttaaaacagctg

SEQ ID NO: 3343854 - DNA, 16 bp, Homo sapiens
cttaaaagtactttaa

SEQ ID NO: 3343855 - DNA, 14 bp, Homo sapiens
cttaaaataagcag

SEQ ID NO: 3343856 - DNA, 16 bp, Homo sapiens
cttaaaataattaaat

SEQ ID NO: 3343857 - DNA, 13 bp, Homo sapiens
cttaaaatatttt

SEQ ID NO: 3343858 - DNA, 14 bp, Homo sapiens
cttaaaatatttta

SEQ ID NO: 3343859 - DNA, 14 bp, Homo sapiens
ctgtgcatgggtga

SEQ ID NO: 3343860 - DNA, 17 bp, Homo sapiens
ctgtgcatgggtgaagg

SEQ ID NO: 3343861 - DNA, 15 bp, Homo sapiens
ctgtgcattagatat

SEQ ID NO: 3343862 - DNA, 23 bp, Homo sapiens
ctgtgccagaaacagtgggagcc

SEQ ID NO: 3343863 - DNA, 11 bp, Homo sapiens
ctgtgccagca

SEQ ID NO: 3343864 - DNA, 13 bp, Homo sapiens
ctgtgccagcagg

SEQ ID NO: 3343865 - DNA, 14 bp, Homo sapiens
ctgtgccaggctga

SEQ ID NO: 3343866 - DNA, 14 bp, Homo sapiens
ctgtgccatgctgg

SEQ ID NO: 3343867 - DNA, 14 bp, Homo sapiens
ctgtgccatgtgcc

SEQ ID NO: 3343868 - DNA, 15 bp, Homo sapiens
ctgtgccatgtgcca

SEQ ID NO: 3343869 - DNA, 18 bp, Homo sapiens
ctgtgccatgtgccaggt

SEQ ID NO: 3343870 - DNA, 22 bp, Homo sapiens
ctgtgcccacatcccaggcttc

SEQ ID NO: 3343871 - DNA, 19 bp, Homo sapiens
ctgtgcccatggcttctgg

SEQ ID NO: 3343872 - DNA, 14 bp, Homo sapiens
ctgtgccctcacca

SEQ ID NO: 3343873 - DNA, 18 bp, Homo sapiens
ctgtgccctcaccaccac

SEQ ID NO: 3343874 - DNA, 16 bp, Homo sapiens
ctgtgccctccaaaga

SEQ ID NO: 3343875 - DNA, 12 bp, Homo sapiens
ctgtgccctggt

SEQ ID NO: 3343876 - DNA, 13 bp, Homo sapiens
ctgtgccctggtg

SEQ ID NO: 3343877 - DNA, 13 bp, Homo sapiens
ctgtgcctcctca

SEQ ID NO: 3343878 - DNA, 12 bp, Homo sapiens
ctgtgcctctgc

SEQ ID NO: 3343879 - DNA, 16 bp, Homo sapiens
ctgtgcctctgcctgt

SEQ ID NO: 3343880 - DNA, 16 bp, Homo sapiens
ctgtgcctctgggact

SEQ ID NO: 3343881 - DNA, 17 bp, Homo sapiens
ctgtgcctctgggactg

SEQ ID NO: 3343882 - DNA, 15 bp, Homo sapiens
ctgtgcctgaatatt

SEQ ID NO: 3343883 - DNA, 14 bp, Homo sapiens
ctgtgcctgctaga

SEQ ID NO: 3343884 - DNA, 17 bp, Homo sapiens
ctgtgcctgctagagca

SEQ ID NO: 3343885 - DNA, 20 bp, Homo sapiens
ctgtgcctgtcaggctctgg

SEQ ID NO: 3343886 - DNA, 19 bp, Homo sapiens
ctgtgccttcttttgatta

SEQ ID NO: 3343887 - DNA, 19 bp, Homo sapiens
ctgtgcctttgcaaatcag

SEQ ID NO: 3343888 - DNA, 13 bp, Homo sapiens
ctgtgctatgaat

SEQ ID NO: 3343889 - DNA, 15 bp, Homo sapiens
ctgtgctccgtgcct

SEQ ID NO: 3343890 - DNA, 17 bp, Homo sapiens
ctgtgctccgtgcctcc

SEQ ID NO: 3343891 - DNA, 18 bp, Homo sapiens
ctgtgctccgtgcctcca

SEQ ID NO: 3343892 - DNA, 20 bp, Homo sapiens
ctgtgctccgtgcctccacc

SEQ ID NO: 3343893 - DNA, 21 bp, Homo sapiens
ctgtgctccgtgcctccacca

SEQ ID NO: 3343894 - DNA, 22 bp, Homo sapiens
ctgtgctccgtgcctccaccac

SEQ ID NO: 3343895 - DNA, 15 bp, Homo sapiens
ctgtgctctggacag

SEQ ID NO: 3343896 - DNA, 18 bp, Homo sapiens
ctgtgctctggacaggca

SEQ ID NO: 3343897 - DNA, 16 bp, Homo sapiens
ctgtgctcttttggtg

SEQ ID NO: 3343898 - DNA, 20 bp, Homo sapiens
ctgtgctggtgtcctgacca

SEQ ID NO: 3343899 - DNA, 23 bp, Homo sapiens
ctgtgctggtgtcctgaccaccc

SEQ ID NO: 3343900 - DNA, 15 bp, Homo sapiens
ctgtgctgtgcctgc

SEQ ID NO: 3343901 - DNA, 13 bp, Homo sapiens
ctgtgctgtgtgt

SEQ ID NO: 3343902 - DNA, 14 bp, Homo sapiens
ctgtgcttcgagcc

SEQ ID NO: 3343903 - DNA, 18 bp, Homo sapiens
ctgtggaactaataaata

SEQ ID NO: 3343904 - DNA, 19 bp, Homo sapiens
ctgtggaatgagtgtgcat

SEQ ID NO: 3343905 - DNA, 21 bp, Homo sapiens
ctgtggaatgagtgtgcatgg

SEQ ID NO: 3343906 - DNA, 22 bp, Homo sapiens
ctgtggaccgtggacaggccca

SEQ ID NO: 3343907 - DNA, 22 bp, Homo sapiens
ctgtggagcaaaaggcagctca

SEQ ID NO: 3343908 - DNA, 17 bp, Homo sapiens
ctgtggagctcagcccc

SEQ ID NO: 3343909 - DNA, 16 bp, Homo sapiens
ctgtggagctgccaca

SEQ ID NO: 3343910 - DNA, 18 bp, Homo sapiens
ctgtggagctgccacaga

SEQ ID NO: 3343911 - DNA, 23 bp, Homo sapiens
ctgtggaggaaggattgtaaaaa

SEQ ID NO: 3343912 - DNA, 12 bp, Homo sapiens
ctgtggaggcct

SEQ ID NO: 3343913 - DNA, 15 bp, Homo sapiens
ctgtggcacagactt

SEQ ID NO: 3343914 - DNA, 13 bp, Homo sapiens
ctgtggcactggc

SEQ ID NO: 3343915 - DNA, 21 bp, Homo sapiens
ctgtggcagaaaagaggagac

SEQ ID NO: 3343916 - DNA, 19 bp, Homo sapiens
ctgtggcagagttacagtt

SEQ ID NO: 3343917 - DNA, 18 bp, Homo sapiens
ctgtggcaggcagcgcca

SEQ ID NO: 3343918 - DNA, 23 bp, Homo sapiens
ctgtggcaggcagcgccaagcaa

SEQ ID NO: 3343919 - DNA, 15 bp, Homo sapiens
ctgtggcataaattg

SEQ ID NO: 3343920 - DNA, 18 bp, Homo sapiens
ctgtggcataaattgcat

SEQ ID NO: 3343921 - DNA, 17 bp, Homo sapiens
ctgtggcatctttgcct

SEQ ID NO: 3343922 - DNA, 15 bp, Homo sapiens
ctgtggccacagccc

SEQ ID NO: 3343923 - DNA, 15 bp, Homo sapiens
ctgtggccagagctg

SEQ ID NO: 3343924 - DNA, 23 bp, Homo sapiens
ctgtggccagagctggaaggcag

SEQ ID NO: 3343925 - DNA, 22 bp, Homo sapiens
ctgtggccccatccaaccactg

SEQ ID NO: 3343926 - DNA, 13 bp, Homo sapiens
ctgtggccctggc

SEQ ID NO: 3343927 - DNA, 16 bp, Homo sapiens
ctgtggccctggctct

SEQ ID NO: 3343928 - DNA, 19 bp, Homo sapiens
ctgtggccgactctgcact

SEQ ID NO: 3343929 - DNA, 17 bp, Homo sapiens
ctgtggccgtctcctcc

SEQ ID NO: 3343930 - DNA, 19 bp, Homo sapiens
ctgtggccgttatctggaa

SEQ ID NO: 3343931 - DNA, 21 bp, Homo sapiens
ctgtggccgttatctggaagt

SEQ ID NO: 3343932 - DNA, 13 bp, Homo sapiens
ctgtggcctgggc

SEQ ID NO: 3343933 - DNA, 14 bp, Homo sapiens
ctgtggcctgggca

SEQ ID NO: 3343934 - DNA, 17 bp, Homo sapiens
ctgtggcctgtgtccag

SEQ ID NO: 3343935 - DNA, 23 bp, Homo sapiens
ctgtggcctgtgtcccatgaccc

SEQ ID NO: 3343936 - DNA, 19 bp, Homo sapiens
ctgtggcgccgtctccagg

SEQ ID NO: 3343937 - DNA, 14 bp, Homo sapiens
ctgtgggagcctgc

SEQ ID NO: 3343938 - DNA, 12 bp, Homo sapiens
ctgtgggcagca

SEQ ID NO: 3343939 - DNA, 14 bp, Homo sapiens
ctgtgggcagcacc

SEQ ID NO: 3343940 - DNA, 16 bp, Homo sapiens
ctgtgggcagcaccct

SEQ ID NO: 3343941 - DNA, 17 bp, Homo sapiens
ctgtgggcagcaccctc

SEQ ID NO: 3343942 - DNA, 19 bp, Homo sapiens
ctgtgggcagcaccctccc

SEQ ID NO: 3343943 - DNA, 21 bp, Homo sapiens
ctgtgggcagcaccctccccc

SEQ ID NO: 3343944 - DNA, 23 bp, Homo sapiens
ctgtgggcagcaccctcccccgc

SEQ ID NO: 3343945 - DNA, 17 bp, Homo sapiens
ctgtgggcccctcaaca

SEQ ID NO: 3343946 - DNA, 19 bp, Homo sapiens
ctgtgggcccctcaacagc

SEQ ID NO: 3343947 - DNA, 24 bp, Homo sapiens
ctgtgggcccctcaacagccaagt

SEQ ID NO: 3343948 - DNA, 15 bp, Homo sapiens
ctgtgggctggcagt

SEQ ID NO: 3343949 - DNA, 20 bp, Homo sapiens
ctgtggggatctcaggggct

SEQ ID NO: 3343950 - DNA, 19 bp, Homo sapiens
ctgtggggccttggttccc

SEQ ID NO: 3343951 - DNA, 22 bp, Homo sapiens
ctgtggggctggtagctcaggt

SEQ ID NO: 3343952 - DNA, 20 bp, Homo sapiens
ctgtgggggtgtgccccctt

SEQ ID NO: 3343953 - DNA, 20 bp, Homo sapiens
ctgtggtctggtgttccagc

SEQ ID NO: 3343954 - DNA, 14 bp, Homo sapiens
ctgtggttacagtg

SEQ ID NO: 3343955 - DNA, 17 bp, Homo sapiens
ctgtggttacagtgcag

SEQ ID NO: 3343956 - DNA, 22 bp, Homo sapiens
ctgtggttacagtgcagacagg

SEQ ID NO: 3343957 - DNA, 15 bp, Homo sapiens
ctgtggttcctctgc

SEQ ID NO: 3343958 - DNA, 15 bp, Homo sapiens
ctgtggtttcatgtt

SEQ ID NO: 3343959 - DNA, 17 bp, Homo sapiens
ctgtggtttcatgttag

SEQ ID NO: 3343960 - DNA, 18 bp, Homo sapiens
ctgtgtaattagtgccac

SEQ ID NO: 3343961 - DNA, 17 bp, Homo sapiens
ctgtgtacataactgaa

SEQ ID NO: 3343962 - DNA, 22 bp, Homo sapiens
ctgtgtacataactgaaaatgt

SEQ ID NO: 3343963 - DNA, 17 bp, Homo sapiens
ctgtgtatatctcttgg

SEQ ID NO: 3343964 - DNA, 15 bp, Homo sapiens
ctgtgtatattattt

SEQ ID NO: 3343965 - DNA, 15 bp, Homo sapiens
ctgtgtatgtacata

SEQ ID NO: 3343966 - DNA, 15 bp, Homo sapiens
ctgtgtatttgcttt

SEQ ID NO: 3343967 - DNA, 19 bp, Homo sapiens
ctgtgtcacccagactgga

SEQ ID NO: 3343968 - DNA, 17 bp, Homo sapiens
ctgtgtcagaaaccctg

SEQ ID NO: 3343969 - DNA, 19 bp, Homo sapiens
ctgtgtcaggtggggcagc

SEQ ID NO: 3343970 - DNA, 14 bp, Homo sapiens
ctgtgtccagcagc

SEQ ID NO: 3343971 - DNA, 16 bp, Homo sapiens
ctgtgtccagcagctg

SEQ ID NO: 3343972 - DNA, 17 bp, Homo sapiens
ctgtgtccagcagctgc

SEQ ID NO: 3343973 - DNA, 21 bp, Homo sapiens
ctgtgtccatgcgctcagggc

SEQ ID NO: 3343974 - DNA, 21 bp, Homo sapiens
ctgtgtcccccccagtgcagg

SEQ ID NO: 3343975 - DNA, 23 bp, Homo sapiens
ctgtgtcccccccagtgcaggga

SEQ ID NO: 3343976 - DNA, 18 bp, Homo sapiens
ctgtgtctaagattctag

SEQ ID NO: 3343977 - DNA, 20 bp, Homo sapiens
ctgtgtctaagattctagat

SEQ ID NO: 3343978 - DNA, 21 bp, Homo sapiens
ctgtgtctaagattctagatc

SEQ ID NO: 3343979 - DNA, 17 bp, Homo sapiens
ctgtgtctcttttctct

SEQ ID NO: 3343980 - DNA, 22 bp, Homo sapiens
ctgtgtctgcccaatgaataat

SEQ ID NO: 3343981 - DNA, 14 bp, Homo sapiens
ctgtgtctgctctc

SEQ ID NO: 3343982 - DNA, 16 bp, Homo sapiens
ctgtgtctgctctcat

SEQ ID NO: 3343983 - DNA, 19 bp, Homo sapiens
ctgtgtcttgcaatggcag

SEQ ID NO: 3343984 - DNA, 23 bp, Homo sapiens
ctgtgtcttgcaatggcagcctt

SEQ ID NO: 3343985 - DNA, 20 bp, Homo sapiens
ctgtgtctttcacagctcct

SEQ ID NO: 3343986 - DNA, 15 bp, Homo sapiens
ctgtgtctttctctc

SEQ ID NO: 3343987 - DNA, 13 bp, Homo sapiens
ctgtgtgaaaatg

SEQ ID NO: 3343988 - DNA, 14 bp, Homo sapiens
ctgtcctgcttctg

SEQ ID NO: 3343989 - DNA, 20 bp, Homo sapiens
ctgtcctgggagtgagctgg

SEQ ID NO: 3343990 - DNA, 22 bp, Homo sapiens
ctgtcctgtacattgtgggatg

SEQ ID NO: 3343991 - DNA, 13 bp, Homo sapiens
ctgtcctgtgaat

SEQ ID NO: 3343992 - DNA, 14 bp, Homo sapiens
ctgtccttccctgt

SEQ ID NO: 3343993 - DNA, 22 bp, Homo sapiens
ctgtccttccctgttctccctt

SEQ ID NO: 3343994 - DNA, 13 bp, Homo sapiens
ctgtccttgccct

SEQ ID NO: 3343995 - DNA, 21 bp, Homo sapiens
ctgtccttttcccctacagaa

SEQ ID NO: 3343996 - DNA, 16 bp, Homo sapiens
ctgtcgcccagtctgg

SEQ ID NO: 3343997 - DNA, 13 bp, Homo sapiens
ctgtcgccccagg

SEQ ID NO: 3343998 - DNA, 15 bp, Homo sapiens
ctgtcgccccaggcc

SEQ ID NO: 3343999 - DNA, 17 bp, Homo sapiens
ctgtcgccccaggccct

SEQ ID NO: 3344000 - DNA, 18 bp, Homo sapiens
ctgtcgccccaggccctc

SEQ ID NO: 3344001 - DNA, 20 bp, Homo sapiens
ctgtcgccccaggccctccc

SEQ ID NO: 3344002 - DNA, 17 bp, Homo sapiens
ctgtcgccttagcatgt

SEQ ID NO: 3344003 - DNA, 18 bp, Homo sapiens
ctgtcgccttagcatgtt

SEQ ID NO: 3344004 - DNA, 19 bp, Homo sapiens
ctgtcgccttagcatgttt

SEQ ID NO: 3344005 - DNA, 16 bp, Homo sapiens
ctgtcgctctcagttc

SEQ ID NO: 3344006 - DNA, 14 bp, Homo sapiens
ctgtcggagaggct

SEQ ID NO: 3344007 - DNA, 15 bp, Homo sapiens
ctgtcggagaggctg

SEQ ID NO: 3344008 - DNA, 21 bp, Homo sapiens
ctgtcgtgatggggcaagggc

SEQ ID NO: 3344009 - DNA, 15 bp, Homo sapiens
ctgtcgtgccagtcc

SEQ ID NO: 3344010 - DNA, 13 bp, Homo sapiens
ctgtctaaaaaac

SEQ ID NO: 3344011 - DNA, 13 bp, Homo sapiens
ctgtctacaaata

SEQ ID NO: 3344012 - DNA, 13 bp, Homo sapiens
ctgtctactgtgg

SEQ ID NO: 3344013 - DNA, 14 bp, Homo sapiens
ctgtctactgtggt

SEQ ID NO: 3344014 - DNA, 15 bp, Homo sapiens
ctgtctactgtggtg

SEQ ID NO: 3344015 - DNA, 17 bp, Homo sapiens
ctgtctaggtctcctca

SEQ ID NO: 3344016 - DNA, 21 bp, Homo sapiens
ctgtctaggtctcctcagggt

SEQ ID NO: 3344017 - DNA, 19 bp, Homo sapiens
ctgtctagtctctcctgta

SEQ ID NO: 3344018 - DNA, 13 bp, Homo sapiens
ctgtctcaaaaaa

SEQ ID NO: 3344019 - DNA, 18 bp, Homo sapiens
ctgtctcaagagggcact

SEQ ID NO: 3344020 - DNA, 19 bp, Homo sapiens
ctgtctcaagagggcactg

SEQ ID NO: 3344021 - DNA, 22 bp, Homo sapiens
ctgtctcaagagggcactggtg

SEQ ID NO: 3344022 - DNA, 17 bp, Homo sapiens
ctgtctcacctggactt

SEQ ID NO: 3344023 - DNA, 21 bp, Homo sapiens
ctgtctcagacttttgtacat

SEQ ID NO: 3344024 - DNA, 16 bp, Homo sapiens
ctgtctcagcctccca

SEQ ID NO: 3344025 - DNA, 14 bp, Homo sapiens
ctgtctcatcctcc

SEQ ID NO: 3344026 - DNA, 13 bp, Homo sapiens
ctgtctctgcatc

SEQ ID NO: 3344027 - DNA, 12 bp, Homo sapiens
ctgtctctgcct

SEQ ID NO: 3344028 - DNA, 15 bp, Homo sapiens
ctgtctcttccatgc

SEQ ID NO: 3344029 - DNA, 18 bp, Homo sapiens
ctgtctcttgaaaaatgc

SEQ ID NO: 3344030 - DNA, 15 bp, Homo sapiens
ctgtctcttttctct

SEQ ID NO: 3344031 - DNA, 14 bp, Homo sapiens
ctgtctgaagccat

SEQ ID NO: 3344032 - DNA, 20 bp, Homo sapiens
ctgtctgacaacctcttggt

SEQ ID NO: 3344033 - DNA, 22 bp, Homo sapiens
ctgtctgagactcacaggaagg

SEQ ID NO: 3344034 - DNA, 12 bp, Homo sapiens
ctgtctgccctc

SEQ ID NO: 3344035 - DNA, 17 bp, Homo sapiens
ctgtctgccctctgggt

SEQ ID NO: 3344036 - DNA, 15 bp, Homo sapiens
ctgtctgctcagaca

SEQ ID NO: 3344037 - DNA, 12 bp, Homo sapiens
ctgtctggggcc

SEQ ID NO: 3344038 - DNA, 15 bp, Homo sapiens
ctgtctggtggcccc

SEQ ID NO: 3344039 - DNA, 16 bp, Homo sapiens
ctgtctgtcaccagct

SEQ ID NO: 3344040 - DNA, 19 bp, Homo sapiens
ctgtcttaaactaaatgtg

SEQ ID NO: 3344041 - DNA, 21 bp, Homo sapiens
ctgtcttaaactaaatgtgca

SEQ ID NO: 3344042 - DNA, 14 bp, Homo sapiens
ctgtcttcacctgc

SEQ ID NO: 3344043 - DNA, 15 bp, Homo sapiens
ctgtcttcacctgcc

SEQ ID NO: 3344044 - DNA, 14 bp, Homo sapiens
ctgtcttctgggca

SEQ ID NO: 3344045 - DNA, 17 bp, Homo sapiens
ctgtcttctggtctgtg

SEQ ID NO: 3344046 - DNA, 17 bp, Homo sapiens
ctgtctttattcttatt

SEQ ID NO: 3344047 - DNA, 15 bp, Homo sapiens
ctgtctttcagatac

SEQ ID NO: 3344048 - DNA, 16 bp, Homo sapiens
ctgtctttcagataca

SEQ ID NO: 3344049 - DNA, 23 bp, Homo sapiens
ctgtctttctgagcacactttag

SEQ ID NO: 3344050 - DNA, 21 bp, Homo sapiens
ctgtcttttcaggtttgtcat

SEQ ID NO: 3344051 - DNA, 21 bp, Homo sapiens
ctgtgaaaaataacggtgctt

SEQ ID NO: 3344052 - DNA, 13 bp, Homo sapiens
ctgtgaaacctgt

SEQ ID NO: 3344053 - DNA, 20 bp, Homo sapiens
ctgtgaaataccacaagcct

SEQ ID NO: 3344054 - DNA, 19 bp, Homo sapiens
ctgtgaacagagagaccct

SEQ ID NO: 3344055 - DNA, 23 bp, Homo sapiens
ctgtgaagagccggtggtgcccg

SEQ ID NO: 3344056 - DNA, 18 bp, Homo sapiens
ctgtgaagtttacattgt

SEQ ID NO: 3344057 - DNA, 14 bp, Homo sapiens
ctgtgaatacaatt

SEQ ID NO: 3344058 - DNA, 17 bp, Homo sapiens
ctgtgaatacaattaaa

SEQ ID NO: 3344059 - DNA, 18 bp, Homo sapiens
ctgtgaatacaattaaag

SEQ ID NO: 3344060 - DNA, 21 bp, Homo sapiens
ctgtgaatacaattaaaggtc

SEQ ID NO: 3344061 - DNA, 15 bp, Homo sapiens
ctgtgaatacttgaa

SEQ ID NO: 3344062 - DNA, 16 bp, Homo sapiens
ctgtgaatgccactgc

SEQ ID NO: 3344063 - DNA, 20 bp, Homo sapiens
ctgtgaatgccactgccttc

SEQ ID NO: 3344064 - DNA, 17 bp, Homo sapiens
ctgtgaatggaagcaaa

SEQ ID NO: 3344065 - DNA, 12 bp, Homo sapiens
ctgtgaatggag

SEQ ID NO: 3344066 - DNA, 16 bp, Homo sapiens
ctgtgaatggaggcag

SEQ ID NO: 3344067 - DNA, 22 bp, Homo sapiens
ctgtgaatggaggcagagacct

SEQ ID NO: 3344068 - DNA, 22 bp, Homo sapiens
ctgtgacaagccaatgtgaatt

SEQ ID NO: 3344069 - DNA, 16 bp, Homo sapiens
ctgtgacaataagttt

SEQ ID NO: 3344070 - DNA, 16 bp, Homo sapiens
ctgtgacatggtgcct

SEQ ID NO: 3344071 - DNA, 20 bp, Homo sapiens
ctgtgacatggtgcctgaga

SEQ ID NO: 3344072 - DNA, 17 bp, Homo sapiens
ctgtgaccaccttctgt

SEQ ID NO: 3344073 - DNA, 13 bp, Homo sapiens
ctgtgacccatct

SEQ ID NO: 3344074 - DNA, 17 bp, Homo sapiens
ctgtgacctcaggcact

SEQ ID NO: 3344075 - DNA, 22 bp, Homo sapiens
ctgtgacctcaggcactagcct

SEQ ID NO: 3344076 - DNA, 22 bp, Homo sapiens
ctgtgacctgccccgcccagct

SEQ ID NO: 3344077 - DNA, 18 bp, Homo sapiens
ctgtgacgcagacagagg

SEQ ID NO: 3344078 - DNA, 21 bp, Homo sapiens
ctgtgacgcagacagagggga

SEQ ID NO: 3344079 - DNA, 16 bp, Homo sapiens
ctgtgacttctccagg

SEQ ID NO: 3344080 - DNA, 23 bp, Homo sapiens
ctgtgagaacccagtttcccgtc

SEQ ID NO: 3344081 - DNA, 17 bp, Homo sapiens
ctgtgagacccccacac

SEQ ID NO: 3344082 - DNA, 18 bp, Homo sapiens
ctgtgagacccccacacc

SEQ ID NO: 3344083 - DNA, 16 bp, Homo sapiens
ctgtgagatccgtgaa

SEQ ID NO: 3344084 - DNA, 21 bp, Homo sapiens
ctgtgagatgctagaactccc

SEQ ID NO: 3344085 - DNA, 23 bp, Homo sapiens
ctgtgagcaaggagcacaagcca

SEQ ID NO: 3344086 - DNA, 21 bp, Homo sapiens
ctgtgagcccctggtcctgag

SEQ ID NO: 3344087 - DNA, 15 bp, Homo sapiens
ctgtgagccttggct

SEQ ID NO: 3344088 - DNA, 17 bp, Homo sapiens
ctgtgagccttggctgt

SEQ ID NO: 3344089 - DNA, 20 bp, Homo sapiens
ctgtgaggaaagcacacagt

SEQ ID NO: 3344090 - DNA, 19 bp, Homo sapiens
ctgtgaggaatgctctgtg

SEQ ID NO: 3344091 - DNA, 19 bp, Homo sapiens
ctggtgggaaggccggcag

SEQ ID NO: 3344092 - DNA, 23 bp, Homo sapiens
ctggtgggaggggcgcccacctc

SEQ ID NO: 3344093 - DNA, 20 bp, Homo sapiens
ctggtgggccttaacatccc

SEQ ID NO: 3344094 - DNA, 15 bp, Homo sapiens
ctggtggtcagatgc

SEQ ID NO: 3344095 - DNA, 18 bp, Homo sapiens
ctggtggtttcacggtgc

SEQ ID NO: 3344096 - DNA, 20 bp, Homo sapiens
ctggtggtttcacggtgcca

SEQ ID NO: 3344097 - DNA, 17 bp, Homo sapiens
ctggtggtttttgctct

SEQ ID NO: 3344098 - DNA, 16 bp, Homo sapiens
ctggtgtccagctgag

SEQ ID NO: 3344099 - DNA, 14 bp, Homo sapiens
ctggtgtcctgacc

SEQ ID NO: 3344100 - DNA, 17 bp, Homo sapiens
ctggtgtcctgaccacc

SEQ ID NO: 3344101 - DNA, 21 bp, Homo sapiens
ctggtgtcctgaccaccctcc

SEQ ID NO: 3344102 - DNA, 23 bp, Homo sapiens
ctggttagaaatgcagaatccta

SEQ ID NO: 3344103 - DNA, 16 bp, Homo sapiens
ctggttccagggtccc

SEQ ID NO: 3344104 - DNA, 16 bp, Homo sapiens
ctggttcccactgagg

SEQ ID NO: 3344105 - DNA, 18 bp, Homo sapiens
ctggttcccgtttctcca

SEQ ID NO: 3344106 - DNA, 18 bp, Homo sapiens
ctggttcctgactggcaa

SEQ ID NO: 3344107 - DNA, 18 bp, Homo sapiens
ctggttctatttaatgga

SEQ ID NO: 3344108 - DNA, 18 bp, Homo sapiens
ctggttggattaatcttt

SEQ ID NO: 3344109 - DNA, 17 bp, Homo sapiens
ctggttgggcagccaga

SEQ ID NO: 3344110 - DNA, 15 bp, Homo sapiens
ctggttgtcattttt

SEQ ID NO: 3344111 - DNA, 20 bp, Homo sapiens
ctggttgtctagtcattgtc

SEQ ID NO: 3344112 - DNA, 16 bp, Homo sapiens
ctggttgtttctgttc

SEQ ID NO: 3344113 - DNA, 18 bp, Homo sapiens
ctggtttacaggccctgc

SEQ ID NO: 3344114 - DNA, 21 bp, Homo sapiens
ctggtttacaggccctgctcc

SEQ ID NO: 3344115 - DNA, 22 bp, Homo sapiens
ctggtttacaggccctgctcct

SEQ ID NO: 3344116 - DNA, 18 bp, Homo sapiens
ctggtttcactggcccaa

SEQ ID NO: 3344117 - DNA, 20 bp, Homo sapiens
ctggtttccccagggaagga

SEQ ID NO: 3344118 - DNA, 15 bp, Homo sapiens
ctggtttctcattct

SEQ ID NO: 3344119 - DNA, 12 bp, Homo sapiens
ctggtttctgag

SEQ ID NO: 3344120 - DNA, 21 bp, Homo sapiens
ctggtttgaaagatgcagtgg

SEQ ID NO: 3344121 - DNA, 16 bp, Homo sapiens
ctggtttgaaagatta

SEQ ID NO: 3344122 - DNA, 14 bp, Homo sapiens
ctggttttgctatt

SEQ ID NO: 3344123 - DNA, 18 bp, Homo sapiens
ctggttttgtacactgct

SEQ ID NO: 3344124 - DNA, 20 bp, Homo sapiens
ctggtttttggattaaatta

SEQ ID NO: 3344125 - DNA, 12 bp, Homo sapiens
ctgtaaaacgct

SEQ ID NO: 3344126 - DNA, 21 bp, Homo sapiens
ctgtaaaattataaactttta

SEQ ID NO: 3344127 - DNA, 14 bp, Homo sapiens
ctgtaaactgtgta

SEQ ID NO: 3344128 - DNA, 20 bp, Homo sapiens
ctgtaaactgtgtattccaa

SEQ ID NO: 3344129 - DNA, 16 bp, Homo sapiens
ctgtaaagatgtttat

SEQ ID NO: 3344130 - DNA, 22 bp, Homo sapiens
ctgtaaagatgtttatttcagg

SEQ ID NO: 3344131 - DNA, 16 bp, Homo sapiens
ctgtaaagatttgttg

SEQ ID NO: 3344132 - DNA, 21 bp, Homo sapiens
ctgtaaataaaatgtgtacag

SEQ ID NO: 3344133 - DNA, 15 bp, Homo sapiens
ctgtaaataccattg

SEQ ID NO: 3344134 - DNA, 16 bp, Homo sapiens
ctgtaaataccattga

SEQ ID NO: 3344135 - DNA, 14 bp, Homo sapiens
ctgtaaatcctaga

SEQ ID NO: 3344136 - DNA, 21 bp, Homo sapiens
ctgtaaatcctagacttgaaa

SEQ ID NO: 3344137 - DNA, 18 bp, Homo sapiens
ctgtaaatggtgtacata

SEQ ID NO: 3344138 - DNA, 14 bp, Homo sapiens
ctgtaaattgaact

SEQ ID NO: 3344139 - DNA, 15 bp, Homo sapiens
ctgtaaattgaactt

SEQ ID NO: 3344140 - DNA, 21 bp, Homo sapiens
ctgtaacacagctgagagact

SEQ ID NO: 3344141 - DNA, 15 bp, Homo sapiens
ctgtaacattcagga

SEQ ID NO: 3344142 - DNA, 19 bp, Homo sapiens
ctgtaactgctgagccact

SEQ ID NO: 3344143 - DNA, 15 bp, Homo sapiens
ctgtaactgtcagtg

SEQ ID NO: 3344144 - DNA, 15 bp, Homo sapiens
ctgtaacttaaaata

SEQ ID NO: 3344145 - DNA, 15 bp, Homo sapiens
ctgtaagaaaatgct

SEQ ID NO: 3344146 - DNA, 23 bp, Homo sapiens
ctgtaagaagagactgggaagat

SEQ ID NO: 3344147 - DNA, 16 bp, Homo sapiens
ctgtaagaagagccat

SEQ ID NO: 3344148 - DNA, 13 bp, Homo sapiens
ctgtaagatgttg

SEQ ID NO: 3344149 - DNA, 16 bp, Homo sapiens
ctgtaaggctctagat

SEQ ID NO: 3344150 - DNA, 14 bp, Homo sapiens
ctgtaagggcagtg

SEQ ID NO: 3344151 - DNA, 14 bp, Homo sapiens
ctgtaataatacct

SEQ ID NO: 3344152 - DNA, 22 bp, Homo sapiens
ctgtaatagttcagtagaatta

SEQ ID NO: 3344153 - DNA, 20 bp, Homo sapiens
ctgtaatatttaaatattac

SEQ ID NO: 3344154 - DNA, 20 bp, Homo sapiens
ctgtaatcatttgtttacat

SEQ ID NO: 3344155 - DNA, 14 bp, Homo sapiens
ctgtaatcccagca

SEQ ID NO: 3344156 - DNA, 17 bp, Homo sapiens
ctgtaatcccagcactt

SEQ ID NO: 3344157 - DNA, 16 bp, Homo sapiens
ctgtaatgatactgat

SEQ ID NO: 3344158 - DNA, 19 bp, Homo sapiens
ctgtaattaagtaaaccaa

SEQ ID NO: 3344159 - DNA, 13 bp, Homo sapiens
ctgtaatttagtt

SEQ ID NO: 3344160 - DNA, 16 bp, Homo sapiens
ctgtaatttagttatt

SEQ ID NO: 3344161 - DNA, 17 bp, Homo sapiens
ctgtacaccatagttta

SEQ ID NO: 3344162 - DNA, 16 bp, Homo sapiens
ctgtacacgtgtcctg

SEQ ID NO: 3344163 - DNA, 19 bp, Homo sapiens
ctgtacatagcctatattt

SEQ ID NO: 3344164 - DNA, 16 bp, Homo sapiens
ctgtacatttaaaatt

SEQ ID NO: 3344165 - DNA, 16 bp, Homo sapiens
ctgtacatttgtgctc

SEQ ID NO: 3344166 - DNA, 19 bp, Homo sapiens
ctgtacattttgttgtaaa

SEQ ID NO: 3344167 - DNA, 14 bp, Homo sapiens
ctgtaccaaatctg

SEQ ID NO: 3344168 - DNA, 17 bp, Homo sapiens
ctgtaccaaatctgaca

SEQ ID NO: 3344169 - DNA, 20 bp, Homo sapiens
ctgtaccaaatctgacatat

SEQ ID NO: 3344170 - DNA, 21 bp, Homo sapiens
ctgtaccaaatctgacatatt

SEQ ID NO: 3344171 - DNA, 23 bp, Homo sapiens
ctgtaccacagacacaatatgta

SEQ ID NO: 3344172 - DNA, 16 bp, Homo sapiens
ctgtaccagttaattt

SEQ ID NO: 3344173 - DNA, 17 bp, Homo sapiens
ctgtacccagatgccta

SEQ ID NO: 3344174 - DNA, 20 bp, Homo sapiens
ctgtacccagatgcctacaa

SEQ ID NO: 3344175 - DNA, 23 bp, Homo sapiens
ctgtacccagctccttttgtccc

SEQ ID NO: 3344176 - DNA, 23 bp, Homo sapiens
ctgtaccctcgcatgactgttac

SEQ ID NO: 3344177 - DNA, 13 bp, Homo sapiens
ctgtacccttcca

SEQ ID NO: 3344178 - DNA, 16 bp, Homo sapiens
ctgtacccttccacct

SEQ ID NO: 3344179 - DNA, 17 bp, Homo sapiens
ctgtacccttccacctc

SEQ ID NO: 3344180 - DNA, 21 bp, Homo sapiens
ctgtacccttccacctcctag

SEQ ID NO: 3344181 - DNA, 17 bp, Homo sapiens
ctgtacctcaaatgaat

SEQ ID NO: 3344182 - DNA, 23 bp, Homo sapiens
ctgtacctcagtggatcttcaga

SEQ ID NO: 3344183 - DNA, 13 bp, Homo sapiens
ctgtacctcatcc

SEQ ID NO: 3344184 - DNA, 15 bp, Homo sapiens
ctgtacctcatccca

SEQ ID NO: 3344185 - DNA, 18 bp, Homo sapiens
ctgtacctcatcccatga

SEQ ID NO: 3344186 - DNA, 19 bp, Homo sapiens
ctgtacgtctgacaggcaa

SEQ ID NO: 3344187 - DNA, 20 bp, Homo sapiens
ctgtacgtctgacaggcaat

SEQ ID NO: 3344188 - DNA, 17 bp, Homo sapiens
ctgtactaattcttaca

SEQ ID NO: 3344189 - DNA, 21 bp, Homo sapiens
ctgtactagagatctggtttt

SEQ ID NO: 3344190 - DNA, 22 bp, Homo sapiens
ctgtactagtctgtgtgggact

SEQ ID NO: 3344191 - DNA, 21 bp, Homo sapiens
ctgtactataagtagttggtt

SEQ ID NO: 3344192 - DNA, 15 bp, Homo sapiens
ctgtactcctcccag

SEQ ID NO: 3344193 - DNA, 17 bp, Homo sapiens
ctgtactgttctgtgtc

SEQ ID NO: 3344194 - DNA, 18 bp, Homo sapiens
ctgtacttaataaattca

SEQ ID NO: 3344195 - DNA, 17 bp, Homo sapiens
ctgtacttcttgaatat

SEQ ID NO: 3344196 - DNA, 22 bp, Homo sapiens
ctgtacttgaagtctaaaagca

SEQ ID NO: 3344197 - DNA, 17 bp, Homo sapiens
ctgtagagttgctgaga

SEQ ID NO: 3344198 - DNA, 23 bp, Homo sapiens
ctgtagagttgctgagagggctc

SEQ ID NO: 3344199 - DNA, 19 bp, Homo sapiens
ctggggctccctctctggt

SEQ ID NO: 3344200 - DNA, 20 bp, Homo sapiens
ctggggctcctttctccagc

SEQ ID NO: 3344201 - DNA, 17 bp, Homo sapiens
ctggggctctctgagac

SEQ ID NO: 3344202 - DNA, 19 bp, Homo sapiens
ctggggctctgtgcaggga

SEQ ID NO: 3344203 - DNA, 16 bp, Homo sapiens
ctggggctgctcccct

SEQ ID NO: 3344204 - DNA, 13 bp, Homo sapiens
ctggggctgggcc

SEQ ID NO: 3344205 - DNA, 14 bp, Homo sapiens
ctggggctgggccc

SEQ ID NO: 3344206 - DNA, 19 bp, Homo sapiens
ctggggctgttgaagtcac

SEQ ID NO: 3344207 - DNA, 20 bp, Homo sapiens
ctggggcttcaccagtctgt

SEQ ID NO: 3344208 - DNA, 22 bp, Homo sapiens
ctggggcttcaccagtctgtct

SEQ ID NO: 3344209 - DNA, 17 bp, Homo sapiens
ctgctccgctgctcctt

SEQ ID NO: 3344210 - DNA, 13 bp, Homo sapiens
ctgctcctcactg

SEQ ID NO: 3344211 - DNA, 13 bp, Homo sapiens
ctgctcctccctg

SEQ ID NO: 3344212 - DNA, 20 bp, Homo sapiens
ctgctcctccctgcccccca

SEQ ID NO: 3344213 - DNA, 14 bp, Homo sapiens
ctgctcctccctgg

SEQ ID NO: 3344214 - DNA, 15 bp, Homo sapiens
ctgctcctccctggc

SEQ ID NO: 3344215 - DNA, 18 bp, Homo sapiens
ctgctcctccctggctgc

SEQ ID NO: 3344216 - DNA, 21 bp, Homo sapiens
ctgctcctccctggctgccct

SEQ ID NO: 3344217 - DNA, 22 bp, Homo sapiens
ctgctcctccctggctgccctg

SEQ ID NO: 3344218 - DNA, 15 bp, Homo sapiens
ctgctcctcctgccc

SEQ ID NO: 3344219 - DNA, 16 bp, Homo sapiens
ctgctcctctccccag

SEQ ID NO: 3344220 - DNA, 18 bp, Homo sapiens
ctgctccttcactgttcc

SEQ ID NO: 3344221 - DNA, 12 bp, Homo sapiens
ctgctctaacag

SEQ ID NO: 3344222 - DNA, 21 bp, Homo sapiens
ctgctctacccatgagcctgc

SEQ ID NO: 3344223 - DNA, 13 bp, Homo sapiens
ctgctctagccag

SEQ ID NO: 3344224 - DNA, 17 bp, Homo sapiens
ctgctctagccaggagt

SEQ ID NO: 3344225 - DNA, 14 bp, Homo sapiens
ctgctctagctggc

SEQ ID NO: 3344226 - DNA, 15 bp, Homo sapiens
ctgctctagctggca

SEQ ID NO: 3344227 - DNA, 16 bp, Homo sapiens
ctgctctagctggcag

SEQ ID NO: 3344228 - DNA, 16 bp, Homo sapiens
ctgctctagggaatct

SEQ ID NO: 3344229 - DNA, 16 bp, Homo sapiens
ctgctctagtgggaca

SEQ ID NO: 3344230 - DNA, 21 bp, Homo sapiens
ctgctctagtgggacagccca

SEQ ID NO: 3344231 - DNA, 15 bp, Homo sapiens
ctgctctattgtagc

SEQ ID NO: 3344232 - DNA, 19 bp, Homo sapiens
ctgctctcatccattcctc

SEQ ID NO: 3344233 - DNA, 19 bp, Homo sapiens
ctgctctccgcgcctaccc

SEQ ID NO: 3344234 - DNA, 11 bp, Homo sapiens
ctgctctgccc

SEQ ID NO: 3344235 - DNA, 12 bp, Homo sapiens
ctgctctgcccc

SEQ ID NO: 3344236 - DNA, 23 bp, Homo sapiens
ctgctctgccccttgggcatcca

SEQ ID NO: 3344237 - DNA, 22 bp, Homo sapiens
ctgctctggaataaagttgcag

SEQ ID NO: 3344238 - DNA, 12 bp, Homo sapiens
ctgctctggtta

SEQ ID NO: 3344239 - DNA, 19 bp, Homo sapiens
ctgctcttagtgcccgcct

SEQ ID NO: 3344240 - DNA, 21 bp, Homo sapiens
ctgctcttatgccatttgttt

SEQ ID NO: 3344241 - DNA, 21 bp, Homo sapiens
ctgctctttctacatgactgg

SEQ ID NO: 3344242 - DNA, 14 bp, Homo sapiens
ctgctctttctctg

SEQ ID NO: 3344243 - DNA, 20 bp, Homo sapiens
ctgctctttctctgccagtg

SEQ ID NO: 3344244 - DNA, 21 bp, Homo sapiens
ctgctctttctctgccagtga

SEQ ID NO: 3344245 - DNA, 21 bp, Homo sapiens
ctgctgaaaaccatctggcct

SEQ ID NO: 3344246 - DNA, 22 bp, Homo sapiens
ctgctgaatgcctcgctccctt

SEQ ID NO: 3344247 - DNA, 13 bp, Homo sapiens
ctgctgagagccc

SEQ ID NO: 3344248 - DNA, 17 bp, Homo sapiens
ctgctgagccactcgca

SEQ ID NO: 3344249 - DNA, 16 bp, Homo sapiens
ctgctgagctgggccc

SEQ ID NO: 3344250 - DNA, 17 bp, Homo sapiens
ctgctgagctgggccca

SEQ ID NO: 3344251 - DNA, 19 bp, Homo sapiens
ctgctgagctgggcccagc

SEQ ID NO: 3344252 - DNA, 14 bp, Homo sapiens
ctgctgcaccagag

SEQ ID NO: 3344253 - DNA, 21 bp, Homo sapiens
ctgctgcaccagagtgaaagg

SEQ ID NO: 3344254 - DNA, 20 bp, Homo sapiens
ctgctgcacccaactactga

SEQ ID NO: 3344255 - DNA, 16 bp, Homo sapiens
ctgctgcaggggctct

SEQ ID NO: 3344256 - DNA, 18 bp, Homo sapiens
ctgctgcaggggctctgg

SEQ ID NO: 3344257 - DNA, 20 bp, Homo sapiens
ctgctgcaggggctctggag

SEQ ID NO: 3344258 - DNA, 21 bp, Homo sapiens
ctgctgcaggggctctggaga

SEQ ID NO: 3344259 - DNA, 15 bp, Homo sapiens
ctgctgcccagcctc

SEQ ID NO: 3344260 - DNA, 22 bp, Homo sapiens
ctgctgcccagcctccaagctc

SEQ ID NO: 3344261 - DNA, 12 bp, Homo sapiens
ctgctgcccagg

SEQ ID NO: 3344262 - DNA, 14 bp, Homo sapiens
ctgctgcccaggcc

SEQ ID NO: 3344263 - DNA, 17 bp, Homo sapiens
ctgctgcccaggccaca

SEQ ID NO: 3344264 - DNA, 19 bp, Homo sapiens
ctgctgcccaggctgtgca

SEQ ID NO: 3344265 - DNA, 21 bp, Homo sapiens
ctgctgcccccaccccgggga

SEQ ID NO: 3344266 - DNA, 13 bp, Homo sapiens
ctgctgcctcttt

SEQ ID NO: 3344267 - DNA, 18 bp, Homo sapiens
ctgctgcggaggagctgc

SEQ ID NO: 3344268 - DNA, 10 bp, Homo sapiens
ctgctgctgt

SEQ ID NO: 3344269 - DNA, 20 bp, Homo sapiens
ctgctgctgtaactgctgag

SEQ ID NO: 3344270 - DNA, 21 bp, Homo sapiens
ctgctgctgtaactgctgagc

SEQ ID NO: 3344271 - DNA, 14 bp, Homo sapiens
ctgctgctgtccct

SEQ ID NO: 3344272 - DNA, 20 bp, Homo sapiens
ctgctgctttttgaggtggc

SEQ ID NO: 3344273 - DNA, 20 bp, Homo sapiens
ctgctggacagagactcagc

SEQ ID NO: 3344274 - DNA, 13 bp, Homo sapiens
ctgctggacagcc

SEQ ID NO: 3344275 - DNA, 17 bp, Homo sapiens
ctgctggagtctggctt

SEQ ID NO: 3344276 - DNA, 20 bp, Homo sapiens
ctgctggagtttcatgtaca

SEQ ID NO: 3344277 - DNA, 13 bp, Homo sapiens
ctgctggatattt

SEQ ID NO: 3344278 - DNA, 15 bp, Homo sapiens
ctgctggcccagcca

SEQ ID NO: 3344279 - DNA, 22 bp, Homo sapiens
ctgctggcccagccaaaccctg

SEQ ID NO: 3344280 - DNA, 14 bp, Homo sapiens
ctgctggcctggat

SEQ ID NO: 3344281 - DNA, 15 bp, Homo sapiens
ctgctggcctggatc

SEQ ID NO: 3344282 - DNA, 14 bp, Homo sapiens
ctgctggctgcggc

SEQ ID NO: 3344283 - DNA, 15 bp, Homo sapiens
ctgctggcttccagc

SEQ ID NO: 3344284 - DNA, 18 bp, Homo sapiens
ctgctggcttccagcttc

SEQ ID NO: 3344285 - DNA, 21 bp, Homo sapiens
ctgctggcttccagcttcagg

SEQ ID NO: 3344286 - DNA, 18 bp, Homo sapiens
ctgctgggaaccccgcag

SEQ ID NO: 3344287 - DNA, 13 bp, Homo sapiens
ctgctggggatcc

SEQ ID NO: 3344288 - DNA, 17 bp, Homo sapiens
ctgctggggcatgtgtg

SEQ ID NO: 3344289 - DNA, 20 bp, Homo sapiens
ctgctggggcatgtgtgcct

SEQ ID NO: 3344290 - DNA, 19 bp, Homo sapiens
ctgctggggccgccacggc

SEQ ID NO: 3344291 - DNA, 19 bp, Homo sapiens
ctgctggtacctgccctct

SEQ ID NO: 3344292 - DNA, 13 bp, Homo sapiens
ctgctgtaaaatt

SEQ ID NO: 3344293 - DNA, 16 bp, Homo sapiens
ctgctgtaaaattata

SEQ ID NO: 3344294 - DNA, 20 bp, Homo sapiens
ctgctgtaaaattataaact

SEQ ID NO: 3344295 - DNA, 22 bp, Homo sapiens
ctgctgtaaaattataaacttt

SEQ ID NO: 3344296 - DNA, 16 bp, Homo sapiens
ctgctgtaactgctga

SEQ ID NO: 3344297 - DNA, 20 bp, Homo sapiens
ctgctgtacccagatgccta

SEQ ID NO: 3344298 - DNA, 23 bp, Homo sapiens
ctgctgtacccagatgcctacaa

SEQ ID NO: 3344299 - DNA, 22 bp, Homo sapiens
ctgctgtagtcctttctgcctt

SEQ ID NO: 3344300 - DNA, 18 bp, Homo sapiens
ctgctgtccccttggcag

SEQ ID NO: 3344301 - DNA, 17 bp, Homo sapiens
ctgctgtccctccccct

SEQ ID NO: 3344302 - DNA, 20 bp, Homo sapiens
ctgctgtccctcccccttgt

SEQ ID NO: 3344303 - DNA, 23 bp, Homo sapiens
ctgctgtgccatgctgggccact

SEQ ID NO: 3344304 - DNA, 15 bp, Homo sapiens
ctgctgtgctgctca

SEQ ID NO: 3344305 - DNA, 18 bp, Homo sapiens
ctgctgttgccatagccc

SEQ ID NO: 3344306 - DNA, 20 bp, Homo sapiens
ctgctgttgccatagcccca

SEQ ID NO: 3344307 - DNA, 22 bp, Homo sapiens
ctgcttaaagttggtattaata

SEQ ID NO: 3344308 - DNA, 23 bp, Homo sapiens
ctgcttaatcttcaaagccttct

SEQ ID NO: 3344309 - DNA, 17 bp, Homo sapiens
ctgcttagctgccttga

SEQ ID NO: 3344310 - DNA, 21 bp, Homo sapiens
ctgcttagctgccttgagcta

SEQ ID NO: 3344311 - DNA, 15 bp, Homo sapiens
ctgcttaggagagac

SEQ ID NO: 3344312 - DNA, 19 bp, Homo sapiens
ctgcttcaaggcttccact

SEQ ID NO: 3344313 - DNA, 14 bp, Homo sapiens
ctgcttcagcctcc

SEQ ID NO: 3344314 - DNA, 13 bp, Homo sapiens
ctgcttcatgtga

SEQ ID NO: 3344315 - DNA, 21 bp, Homo sapiens
ctgcttcccacctccctgccc

SEQ ID NO: 3344316 - DNA, 22 bp, Homo sapiens
ctgcttcccacctccctgccca

SEQ ID NO: 3344317 - DNA, 11 bp, Homo sapiens
ctgcttcccat

SEQ ID NO: 3344318 - DNA, 15 bp, Homo sapiens
ctgcttcccatccta

SEQ ID NO: 3344319 - DNA, 14 bp, Homo sapiens
ctgccccctcccac

SEQ ID NO: 3344320 - DNA, 18 bp, Homo sapiens
ctgccccctcccactctt

SEQ ID NO: 3344321 - DNA, 14 bp, Homo sapiens
ctgccccctggtgg

SEQ ID NO: 3344322 - DNA, 15 bp, Homo sapiens
ctgccccgcccagct

SEQ ID NO: 3344323 - DNA, 16 bp, Homo sapiens
ctgccccgcccagctg

SEQ ID NO: 3344324 - DNA, 16 bp, Homo sapiens
ctgccccgcccccagt

SEQ ID NO: 3344325 - DNA, 23 bp, Homo sapiens
ctgccccgcccccagtccccacc

SEQ ID NO: 3344326 - DNA, 22 bp, Homo sapiens
ctgccccggcccctccccctga

SEQ ID NO: 3344327 - DNA, 14 bp, Homo sapiens
ctgccccggcctcc

SEQ ID NO: 3344328 - DNA, 17 bp, Homo sapiens
ctgccccggcctcctcg

SEQ ID NO: 3344329 - DNA, 18 bp, Homo sapiens
ctgccccgttccctgtca

SEQ ID NO: 3344330 - DNA, 21 bp, Homo sapiens
ctgccccgttccctgtcagag

SEQ ID NO: 3344331 - DNA, 22 bp, Homo sapiens
ctgccccgttccctgtcagagg

SEQ ID NO: 3344332 - DNA, 17 bp, Homo sapiens
ctgcccctaccctggac

SEQ ID NO: 3344333 - DNA, 17 bp, Homo sapiens
ctgcccctaggatgctg

SEQ ID NO: 3344334 - DNA, 21 bp, Homo sapiens
ctgcccctaggatgctgcagc

SEQ ID NO: 3344335 - DNA, 13 bp, Homo sapiens
ctgcccctccccc

SEQ ID NO: 3344336 - DNA, 22 bp, Homo sapiens
ctgcccctcccccaacccccac

SEQ ID NO: 3344337 - DNA, 13 bp, Homo sapiens
ctgcccctctcac

SEQ ID NO: 3344338 - DNA, 17 bp, Homo sapiens
ctgcccctctcaccaaa

SEQ ID NO: 3344339 - DNA, 19 bp, Homo sapiens
ctgcccctgatcactccca

SEQ ID NO: 3344340 - DNA, 22 bp, Homo sapiens
ctgcccctgatcactcccagca

SEQ ID NO: 3344341 - DNA, 21 bp, Homo sapiens
ctgcccctggtgccctgagac

SEQ ID NO: 3344342 - DNA, 14 bp, Homo sapiens
ctgccccttgggca

SEQ ID NO: 3344343 - DNA, 21 bp, Homo sapiens
ctgcccgagctggtgcattac

SEQ ID NO: 3344344 - DNA, 18 bp, Homo sapiens
ctgcccgcacagcagcct

SEQ ID NO: 3344345 - DNA, 20 bp, Homo sapiens
ctgcccgcacagcagcctgc

SEQ ID NO: 3344346 - DNA, 21 bp, Homo sapiens
ctgcccgcacagcagcctgct

SEQ ID NO: 3344347 - DNA, 21 bp, Homo sapiens
ctgcccgctgcaatgcctaga

SEQ ID NO: 3344348 - DNA, 15 bp, Homo sapiens
ctgcccggctgcgga

SEQ ID NO: 3344349 - DNA, 16 bp, Homo sapiens
ctgccctactcactct

SEQ ID NO: 3344350 - DNA, 17 bp, Homo sapiens
ctgccctccttaatttg

SEQ ID NO: 3344351 - DNA, 18 bp, Homo sapiens
ctgccctcgtggccagcc

SEQ ID NO: 3344352 - DNA, 23 bp, Homo sapiens
ctgccctcgtggccagcccggct

SEQ ID NO: 3344353 - DNA, 20 bp, Homo sapiens
ctgccctctatttattagcc

SEQ ID NO: 3344354 - DNA, 17 bp, Homo sapiens
ctgccctctccttcctt

SEQ ID NO: 3344355 - DNA, 15 bp, Homo sapiens
ctgccctctgggtcc

SEQ ID NO: 3344356 - DNA, 11 bp, Homo sapiens
ctgccctgaga

SEQ ID NO: 3344357 - DNA, 16 bp, Homo sapiens
ctgccctgccactttg

SEQ ID NO: 3344358 - DNA, 12 bp, Homo sapiens
ctgccctgcctg

SEQ ID NO: 3344359 - DNA, 14 bp, Homo sapiens
ctgccctgcctgcc

SEQ ID NO: 3344360 - DNA, 16 bp, Homo sapiens
ctgccctgcctgccca

SEQ ID NO: 3344361 - DNA, 18 bp, Homo sapiens
ctgccctgcctgcccact

SEQ ID NO: 3344362 - DNA, 22 bp, Homo sapiens
ctgccctggaacatcctttgca

SEQ ID NO: 3344363 - DNA, 23 bp, Homo sapiens
ctgccctggaacatcctttgcag

SEQ ID NO: 3344364 - DNA, 14 bp, Homo sapiens
ctgccctggctgct

SEQ ID NO: 3344365 - DNA, 16 bp, Homo sapiens
ctgccctggctgctgc

SEQ ID NO: 3344366 - DNA, 18 bp, Homo sapiens
ctgccctggctgctgccc

SEQ ID NO: 3344367 - DNA, 15 bp, Homo sapiens
ctgccctggtccagg

SEQ ID NO: 3344368 - DNA, 23 bp, Homo sapiens
ctgccctggtccagggaagctgg

SEQ ID NO: 3344369 - DNA, 15 bp, Homo sapiens
ctgccctggtgctgc

SEQ ID NO: 3344370 - DNA, 20 bp, Homo sapiens
ctgccctggtgctgccacac

SEQ ID NO: 3344371 - DNA, 23 bp, Homo sapiens
ctgccctggtgctgccacacttc

SEQ ID NO: 3344372 - DNA, 16 bp, Homo sapiens
ctgccctgttcatgtg

SEQ ID NO: 3344373 - DNA, 22 bp, Homo sapiens
ctgccctgttcatgtgcctctg

SEQ ID NO: 3344374 - DNA, 15 bp, Homo sapiens
ctgcccttcctgcag

SEQ ID NO: 3344375 - DNA, 16 bp, Homo sapiens
ctgcccttgtctgaga

SEQ ID NO: 3344376 - DNA, 17 bp, Homo sapiens
ctgccctttcctaggcc

SEQ ID NO: 3344377 - DNA, 17 bp, Homo sapiens
ctgccgcaacagttttt

SEQ ID NO: 3344378 - DNA, 18 bp, Homo sapiens
ctgccgccccctcctgaa

SEQ ID NO: 3344379 - DNA, 14 bp, Homo sapiens
ctgccgcctcccag

SEQ ID NO: 3344380 - DNA, 15 bp, Homo sapiens
ctgccgcctcccagc

SEQ ID NO: 3344381 - DNA, 16 bp, Homo sapiens
ctgccgcctcccagcc

SEQ ID NO: 3344382 - DNA, 13 bp, Homo sapiens
ctgccgctgcacc

SEQ ID NO: 3344383 - DNA, 20 bp, Homo sapiens
ctgccgctgccgctgcacca

SEQ ID NO: 3344384 - DNA, 21 bp, Homo sapiens
ctgccggcaggatgcagcgcc

SEQ ID NO: 3344385 - DNA, 23 bp, Homo sapiens
ctgccggtcgggcagccagcaga

SEQ ID NO: 3344386 - DNA, 15 bp, Homo sapiens
ctgccggtgggaccc

SEQ ID NO: 3344387 - DNA, 20 bp, Homo sapiens
ctgccggtttgaaaatatgc

SEQ ID NO: 3344388 - DNA, 13 bp, Homo sapiens
ctgccgtggggcc

SEQ ID NO: 3344389 - DNA, 20 bp, Homo sapiens
ctgccgtggggccgccgcct

SEQ ID NO: 3344390 - DNA, 15 bp, Homo sapiens
ctgcctaaccaggcc

SEQ ID NO: 3344391 - DNA, 23 bp, Homo sapiens
ctgcctaaccaggcccagccagt

SEQ ID NO: 3344392 - DNA, 23 bp, Homo sapiens
ctgcctacagaacttcagaaaga

SEQ ID NO: 3344393 - DNA, 18 bp, Homo sapiens
ctgcctagaatctttatt

SEQ ID NO: 3344394 - DNA, 21 bp, Homo sapiens
ctgcctagagtgtagcctaaa

SEQ ID NO: 3344395 - DNA, 22 bp, Homo sapiens
ctgcctagagtgtagcctaaag

SEQ ID NO: 3344396 - DNA, 18 bp, Homo sapiens
ctgcctagcaagctggcc

SEQ ID NO: 3344397 - DNA, 20 bp, Homo sapiens
ctgcctagcaagctggcctc

SEQ ID NO: 3344398 - DNA, 17 bp, Homo sapiens
ctgcctaggtttttcct

SEQ ID NO: 3344399 - DNA, 20 bp, Homo sapiens
ctgcctataatcttatacaa

SEQ ID NO: 3344400 - DNA, 23 bp, Homo sapiens
ctgcctattatctgtcagctgca

SEQ ID NO: 3344401 - DNA, 23 bp, Homo sapiens
ctgcctcacttcctacaagagca

SEQ ID NO: 3344402 - DNA, 13 bp, Homo sapiens
ctgcctcagcctc

SEQ ID NO: 3344403 - DNA, 18 bp, Homo sapiens
ctgcctcagcctcccaag

SEQ ID NO: 3344404 - DNA, 13 bp, Homo sapiens
ctgcctcaggttc

SEQ ID NO: 3344405 - DNA, 14 bp, Homo sapiens
ctgcctcagtggca

SEQ ID NO: 3344406 - DNA, 21 bp, Homo sapiens
ctgcctcccaaggtcctctca

SEQ ID NO: 3344407 - DNA, 15 bp, Homo sapiens
ctgcctcccacttca

SEQ ID NO: 3344408 - DNA, 12 bp, Homo sapiens
ctgcctccgctg

SEQ ID NO: 3344409 - DNA, 17 bp, Homo sapiens
ctgcctcctcgttcctt

SEQ ID NO: 3344410 - DNA, 13 bp, Homo sapiens
ctgcctcctcttc

SEQ ID NO: 3344411 - DNA, 14 bp, Homo sapiens
ctgcctcctcttca

SEQ ID NO: 3344412 - DNA, 12 bp, Homo sapiens
ctgcctcctggg

SEQ ID NO: 3344413 - DNA, 18 bp, Homo sapiens
ctgcctcgaactggctgc

SEQ ID NO: 3344414 - DNA, 19 bp, Homo sapiens
ctgcctcgaactggctgca

SEQ ID NO: 3344415 - DNA, 22 bp, Homo sapiens
ctgcctctcatcaactgaatga

SEQ ID NO: 3344416 - DNA, 22 bp, Homo sapiens
ctgcctctcccatcacttccct

SEQ ID NO: 3344417 - DNA, 15 bp, Homo sapiens
ctgcctctgacacac

SEQ ID NO: 3344418 - DNA, 18 bp, Homo sapiens
ctgcctctgacacacagc

SEQ ID NO: 3344419 - DNA, 21 bp, Homo sapiens
ctgcctctgacacacagctct

SEQ ID NO: 3344420 - DNA, 16 bp, Homo sapiens
ctgcctctgccacact

SEQ ID NO: 3344421 - DNA, 13 bp, Homo sapiens
ctgcctctgcctc

SEQ ID NO: 3344422 - DNA, 14 bp, Homo sapiens
ctgcctctgcctta

SEQ ID NO: 3344423 - DNA, 12 bp, Homo sapiens
ctgcctctgctc

SEQ ID NO: 3344424 - DNA, 14 bp, Homo sapiens
ctgcctctgctccc

SEQ ID NO: 3344425 - DNA, 15 bp, Homo sapiens
ctgcctctgctccct

SEQ ID NO: 3344426 - DNA, 14 bp, Homo sapiens
ctgcctctgggcca

SEQ ID NO: 3344427 - DNA, 16 bp, Homo sapiens
ctgcctgaaacagcca

SEQ ID NO: 3344428 - DNA, 19 bp, Homo sapiens
ctgcctgacactgagcccc

SEQ ID NO: 3344429 - DNA, 17 bp, Homo sapiens
ctgcctgcaatatttga

SEQ ID NO: 3344430 - DNA, 18 bp, Homo sapiens
ctgcctgcaatatttgaa

SEQ ID NO: 3344431 - DNA, 19 bp, Homo sapiens
ctgcctgcaatatttgaat

SEQ ID NO: 3344432 - DNA, 21 bp, Homo sapiens
ctgcctgcagtactttacctc

SEQ ID NO: 3344433 - DNA, 13 bp, Homo sapiens
ctgcctgcccact

SEQ ID NO: 3344434 - DNA, 17 bp, Homo sapiens
ctgcctgcccaggcccc

SEQ ID NO: 3344435 - DNA, 22 bp, Homo sapiens
ctgcctgcccaggcccctgcca

SEQ ID NO: 3344436 - DNA, 20 bp, Homo sapiens
ctgcctgccccacacggact

SEQ ID NO: 3344437 - DNA, 21 bp, Homo sapiens
ctgcctgccccacccacccca

SEQ ID NO: 3344438 - DNA, 15 bp, Homo sapiens
ctgcctgcggcccag

SEQ ID NO: 3344439 - DNA, 13 bp, Homo sapiens
ctgcctgctttgg

SEQ ID NO: 3344440 - DNA, 14 bp, Homo sapiens
ctgcctggagaggg

SEQ ID NO: 3344441 - DNA, 15 bp, Homo sapiens
ctgcctggagagggt

SEQ ID NO: 3344442 - DNA, 16 bp, Homo sapiens
ctgcctggagagggtc

SEQ ID NO: 3344443 - DNA, 17 bp, Homo sapiens
ctgcctggagagggtct

SEQ ID NO: 3344444 - DNA, 23 bp, Homo sapiens
ctgcctggagagggtctcgctgt

SEQ ID NO: 3344445 - DNA, 18 bp, Homo sapiens
ctgcctggatgagaaaca

SEQ ID NO: 3344446 - DNA, 19 bp, Homo sapiens
ctgcctggatgagaaacag

SEQ ID NO: 3344447 - DNA, 12 bp, Homo sapiens
ctgcctggcagg

SEQ ID NO: 3344448 - DNA, 14 bp, Homo sapiens
ctgagctggaaggg

SEQ ID NO: 3344449 - DNA, 19 bp, Homo sapiens
ctgagctgggcccagcccc

SEQ ID NO: 3344450 - DNA, 20 bp, Homo sapiens
ctgagctgggcccagcccct

SEQ ID NO: 3344451 - DNA, 12 bp, Homo sapiens
ctgagctggggc

SEQ ID NO: 3344452 - DNA, 24 bp, Homo sapiens
ctgagcttagccttgtgccctgcc

SEQ ID NO: 3344453 - DNA, 15 bp, Homo sapiens
ctgagcttctctgtg

SEQ ID NO: 3344454 - DNA, 20 bp, Homo sapiens
ctgaggaatccagacccggc

SEQ ID NO: 3344455 - DNA, 23 bp, Homo sapiens
ctgaggaatccagacccggctgc

SEQ ID NO: 3344456 - DNA, 20 bp, Homo sapiens
ctgaggacactaaccacgct

SEQ ID NO: 3344457 - DNA, 18 bp, Homo sapiens
ctgaggattcaggggctg

SEQ ID NO: 3344458 - DNA, 14 bp, Homo sapiens
ctgaggatttcaag

SEQ ID NO: 3344459 - DNA, 16 bp, Homo sapiens
ctgaggcaagagaatt

SEQ ID NO: 3344460 - DNA, 21 bp, Homo sapiens
ctgaggcctaaaagtaaacat

SEQ ID NO: 3344461 - DNA, 23 bp, Homo sapiens
ctgaggcctaaaagtaaacatta

SEQ ID NO: 3344462 - DNA, 17 bp, Homo sapiens
ctgaggcctagactctg

SEQ ID NO: 3344463 - DNA, 15 bp, Homo sapiens
ctgaggcctcatccc

SEQ ID NO: 3344464 - DNA, 16 bp, Homo sapiens
ctgaggcctgaggcct

SEQ ID NO: 3344465 - DNA, 17 bp, Homo sapiens
ctgaggcctgaggcctg

SEQ ID NO: 3344466 - DNA, 17 bp, Homo sapiens
ctgaggcctgtgcctgt

SEQ ID NO: 3344467 - DNA, 18 bp, Homo sapiens
ctgaggcgggtggatcac

SEQ ID NO: 3344468 - DNA, 15 bp, Homo sapiens
ctgaggctccacttg

SEQ ID NO: 3344469 - DNA, 17 bp, Homo sapiens
ctgaggctgtggtcaca

SEQ ID NO: 3344470 - DNA, 23 bp, Homo sapiens
ctgaggcttagagagaggaggca

SEQ ID NO: 3344471 - DNA, 14 bp, Homo sapiens
ctgaggctttggat

SEQ ID NO: 3344472 - DNA, 15 bp, Homo sapiens
ctgaggctttggatt

SEQ ID NO: 3344473 - DNA, 17 bp, Homo sapiens
ctgagggaggaggccac

SEQ ID NO: 3344474 - DNA, 21 bp, Homo sapiens
ctgagggaggaggccacctct

SEQ ID NO: 3344475 - DNA, 19 bp, Homo sapiens
ctgagggcaaatccagtcc

SEQ ID NO: 3344476 - DNA, 20 bp, Homo sapiens
ctgagggcagactggggcat

SEQ ID NO: 3344477 - DNA, 16 bp, Homo sapiens
ctgagggccacactat

SEQ ID NO: 3344478 - DNA, 22 bp, Homo sapiens
ctgaggggaggatcactggagc

SEQ ID NO: 3344479 - DNA, 19 bp, Homo sapiens
ctgaggggcaacgaagaaa

SEQ ID NO: 3344480 - DNA, 15 bp, Homo sapiens
ctgaggggcttggga

SEQ ID NO: 3344481 - DNA, 20 bp, Homo sapiens
ctgagggtccccacctggga

SEQ ID NO: 3344482 - DNA, 21 bp, Homo sapiens
ctgagggtccccacctgggac

SEQ ID NO: 3344483 - DNA, 18 bp, Homo sapiens
ctgagggtctgggcggcg

SEQ ID NO: 3344484 - DNA, 20 bp, Homo sapiens
ctgagggtggagactaagcc

SEQ ID NO: 3344485 - DNA, 15 bp, Homo sapiens
ctgaggtcagggagt

SEQ ID NO: 3344486 - DNA, 21 bp, Homo sapiens
ctgaggtctcttgagggagct

SEQ ID NO: 3344487 - DNA, 19 bp, Homo sapiens
ctgaggtgaaagggagcta

SEQ ID NO: 3344488 - DNA, 17 bp, Homo sapiens
ctgaggtgcctgtccca

SEQ ID NO: 3344489 - DNA, 22 bp, Homo sapiens
ctgaggtgcctgtcccaccccc

SEQ ID NO: 3344490 - DNA, 20 bp, Homo sapiens
ctgaggtgggcagatcacga

SEQ ID NO: 3344491 - DNA, 15 bp, Homo sapiens
ctgaggtgggctggg

SEQ ID NO: 3344492 - DNA, 18 bp, Homo sapiens
ctgaggtgggctggggct

SEQ ID NO: 3344493 - DNA, 22 bp, Homo sapiens
ctgaggtgggctggggctgctc

SEQ ID NO: 3344494 - DNA, 21 bp, Homo sapiens
ctgaggttcctctgcctgccc

SEQ ID NO: 3344495 - DNA, 21 bp, Homo sapiens
ctgaggtttcacccttaaccc

SEQ ID NO: 3344496 - DNA, 22 bp, Homo sapiens
ctgagtcaccctacctgtgcct

SEQ ID NO: 3344497 - DNA, 13 bp, Homo sapiens
ctgagtcacgctg

SEQ ID NO: 3344498 - DNA, 15 bp, Homo sapiens
ctgagtcacgctggg

SEQ ID NO: 3344499 - DNA, 20 bp, Homo sapiens
ctgagtcagggcccagaggc

SEQ ID NO: 3344500 - DNA, 23 bp, Homo sapiens
ctgagtcagggcccagaggctga

SEQ ID NO: 3344501 - DNA, 17 bp, Homo sapiens
ctgagtccactgctcca

SEQ ID NO: 3344502 - DNA, 16 bp, Homo sapiens
ctgagtcctggtccct

SEQ ID NO: 3344503 - DNA, 18 bp, Homo sapiens
ctgagtcctggtccctct

SEQ ID NO: 3344504 - DNA, 21 bp, Homo sapiens
ctgagtcctggtccctctgag

SEQ ID NO: 3344505 - DNA, 15 bp, Homo sapiens
ctgagtcctttgcta

SEQ ID NO: 3344506 - DNA, 18 bp, Homo sapiens
ctgagtcgtacagaaagc

SEQ ID NO: 3344507 - DNA, 14 bp, Homo sapiens
ctgagtctcctgtg

SEQ ID NO: 3344508 - DNA, 14 bp, Homo sapiens
ctgagtctctgaat

SEQ ID NO: 3344509 - DNA, 20 bp, Homo sapiens
ctgagtggaatgcagggaag

SEQ ID NO: 3344510 - DNA, 16 bp, Homo sapiens
ctgagtggcaggggac

SEQ ID NO: 3344511 - DNA, 13 bp, Homo sapiens
ctgagtggccagc

SEQ ID NO: 3344512 - DNA, 19 bp, Homo sapiens
ctgagtggccagccagtgc

SEQ ID NO: 3344513 - DNA, 16 bp, Homo sapiens
ctgagtggggagcagt

SEQ ID NO: 3344514 - DNA, 21 bp, Homo sapiens
ctgagttctgtgtattttcag

SEQ ID NO: 3344515 - DNA, 11 bp, Homo sapiens
ctgagttgttc

SEQ ID NO: 3344516 - DNA, 15 bp, Homo sapiens
ctgagttgttctaac

SEQ ID NO: 3344517 - DNA, 16 bp, Homo sapiens
ctgagttgttctaaca

SEQ ID NO: 3344518 - DNA, 18 bp, Homo sapiens
ctgagtttaccatttgta

SEQ ID NO: 3344519 - DNA, 22 bp, Homo sapiens
ctgagtttatattctgaaagga

SEQ ID NO: 3344520 - DNA, 23 bp, Homo sapiens
ctgagtttatattctgaaaggaa

SEQ ID NO: 3344521 - DNA, 19 bp, Homo sapiens
ctgagtttcattctcctgc

SEQ ID NO: 3344522 - DNA, 21 bp, Homo sapiens
ctgagtttcattctcctgcct

SEQ ID NO: 3344523 - DNA, 22 bp, Homo sapiens
ctgagtttttaaaaatggacaa

SEQ ID NO: 3344524 - DNA, 20 bp, Homo sapiens
ctgataaaaataatattaat

SEQ ID NO: 3344525 - DNA, 12 bp, Homo sapiens
ctgataaaatac

SEQ ID NO: 3344526 - DNA, 14 bp, Homo sapiens
ctgataaagaaaga

SEQ ID NO: 3344527 - DNA, 18 bp, Homo sapiens
ctgataaagcacagctgt

SEQ ID NO: 3344528 - DNA, 21 bp, Homo sapiens
ctgataagactgtttttaagt

SEQ ID NO: 3344529 - DNA, 18 bp, Homo sapiens
ctgatacataactaaatt

SEQ ID NO: 3344530 - DNA, 18 bp, Homo sapiens
ctgatataaattctgtgg

SEQ ID NO: 3344531 - DNA, 16 bp, Homo sapiens
ctgatatattttacaa

SEQ ID NO: 3344532 - DNA, 19 bp, Homo sapiens
ctgatattccatgaatgta

SEQ ID NO: 3344533 - DNA, 23 bp, Homo sapiens
ctgatattttacctcttattgca

SEQ ID NO: 3344534 - DNA, 12 bp, Homo sapiens
ctgatcactccc

SEQ ID NO: 3344535 - DNA, 16 bp, Homo sapiens
ctgatcactcccagca

SEQ ID NO: 3344536 - DNA, 20 bp, Homo sapiens
ctgatcactcccagcactcc

SEQ ID NO: 3344537 - DNA, 12 bp, Homo sapiens
ctgatcagaggt

SEQ ID NO: 3344538 - DNA, 19 bp, Homo sapiens
ctgatcagaggtgtacact

SEQ ID NO: 3344539 - DNA, 21 bp, Homo sapiens
ctgatcagaggtgtacactaa

SEQ ID NO: 3344540 - DNA, 22 bp, Homo sapiens
ctgatcagaggtgtacactaac

SEQ ID NO: 3344541 - DNA, 23 bp, Homo sapiens
ctgatcagaggtgtacactaaca

SEQ ID NO: 3344542 - DNA, 18 bp, Homo sapiens
ctgatcatcgccagaggt

SEQ ID NO: 3344543 - DNA, 19 bp, Homo sapiens
ctgatcatcgccagaggtg

SEQ ID NO: 3344544 - DNA, 14 bp, Homo sapiens
ctgatcatgcattg

SEQ ID NO: 3344545 - DNA, 16 bp, Homo sapiens
ctgatcgtagaaaatt

SEQ ID NO: 3344546 - DNA, 21 bp, Homo sapiens
ctgatctctactaccacaagg

SEQ ID NO: 3344547 - DNA, 13 bp, Homo sapiens
ctgatctcttcct

SEQ ID NO: 3344548 - DNA, 20 bp, Homo sapiens
ctgatctgcggatctcagct

SEQ ID NO: 3344549 - DNA, 15 bp, Homo sapiens
ctgatcttacagaaa

SEQ ID NO: 3344550 - DNA, 20 bp, Homo sapiens
ctgatgaacttattctgtag

SEQ ID NO: 3344551 - DNA, 18 bp, Homo sapiens
ctgatgaatcactgtttt

SEQ ID NO: 3344552 - DNA, 22 bp, Homo sapiens
ctgatgacacccaccctgtgcc

SEQ ID NO: 3344553 - DNA, 23 bp, Homo sapiens
ctgatgacacccaccctgtgcca

SEQ ID NO: 3344554 - DNA, 11 bp, Homo sapiens
ctgatgagcaa

SEQ ID NO: 3344555 - DNA, 22 bp, Homo sapiens
ctgatgatgtctcttgtagaag

SEQ ID NO: 3344556 - DNA, 14 bp, Homo sapiens
ctgatgcaaggatt

SEQ ID NO: 3344557 - DNA, 20 bp, Homo sapiens
ctgatgccgtgatcctgagc

SEQ ID NO: 3344558 - DNA, 15 bp, Homo sapiens
ctgatgctccctccc

SEQ ID NO: 3344559 - DNA, 17 bp, Homo sapiens
ctgatgctccctcccct

SEQ ID NO: 3344560 - DNA, 23 bp, Homo sapiens
ctgatgctccctcccctgccctg

SEQ ID NO: 3344561 - DNA, 24 bp, Homo sapiens
ctgatgctccctcccctgccctgg

SEQ ID NO: 3344562 - DNA, 11 bp, Homo sapiens
ctgatgctgcc

SEQ ID NO: 3344563 - DNA, 14 bp, Homo sapiens
ctgatgctgccccg

SEQ ID NO: 3344564 - DNA, 16 bp, Homo sapiens
ctgatgctgttctctt

SEQ ID NO: 3344565 - DNA, 15 bp, Homo sapiens
ctgatggagccttcc

SEQ ID NO: 3344566 - DNA, 14 bp, Homo sapiens
ctgatggaggaaaa

SEQ ID NO: 3344567 - DNA, 16 bp, Homo sapiens
ctgatggaggaaaaag

SEQ ID NO: 3344568 - DNA, 23 bp, Homo sapiens
ctgatggagggagggggaagtcg

SEQ ID NO: 3344569 - DNA, 22 bp, Homo sapiens
ctgatggatcccgaagaatgga

SEQ ID NO: 3344570 - DNA, 22 bp, Homo sapiens
ctgatggcacttagctatcaga

SEQ ID NO: 3344571 - DNA, 21 bp, Homo sapiens
ctgatggccaagggggtggac

SEQ ID NO: 3344572 - DNA, 15 bp, Homo sapiens
ctgatggctgcccct

SEQ ID NO: 3344573 - DNA, 22 bp, Homo sapiens
ctgatggcttgacatgtgcaat

SEQ ID NO: 3344574 - DNA, 21 bp, Homo sapiens
ctgatgggcaacccccagcct

SEQ ID NO: 3344575 - DNA, 20 bp, Homo sapiens
ctgatgggtcccaaaagctt

SEQ ID NO: 3344576 - DNA, 16 bp, Homo sapiens
ctgatggtacaggaaa

SEQ ID NO: 3344577 - DNA, 19 bp, Homo sapiens
ctgatggtcagctcccttc

SEQ ID NO: 3344578 - DNA, 14 bp, Homo sapiens
ctgatggtgagctg

SEQ ID NO: 3344579 - DNA, 16 bp, Homo sapiens
ctgatggtgagctggg

SEQ ID NO: 3344580 - DNA, 17 bp, Homo sapiens
ctgatggtgagctggga

SEQ ID NO: 3344581 - DNA, 18 bp, Homo sapiens
ctgatggtgagctgggaa

SEQ ID NO: 3344582 - DNA, 18 bp, Homo sapiens
ctgatgtcaatttctgtg

SEQ ID NO: 3344583 - DNA, 19 bp, Homo sapiens
ctgatgtcaatttctgtgt

SEQ ID NO: 3344584 - DNA, 22 bp, Homo sapiens
ctgatgtgacattccatgacga

SEQ ID NO: 3344585 - DNA, 15 bp, Homo sapiens
ctgatgtttgaagag

SEQ ID NO: 3344586 - DNA, 17 bp, Homo sapiens
ctgatgttttagcattt

SEQ ID NO: 3344587 - DNA, 13 bp, Homo sapiens
ctgattactgtca

SEQ ID NO: 3344588 - DNA, 19 bp, Homo sapiens
ctgattactgtcaataaac

SEQ ID NO: 3344589 - DNA, 13 bp, Homo sapiens
ctgattaggtaac

SEQ ID NO: 3344590 - DNA, 23 bp, Homo sapiens
ctgattatgtcttttatatttgt

SEQ ID NO: 3344591 - DNA, 11 bp, Homo sapiens
ctgattattta

SEQ ID NO: 3344592 - DNA, 17 bp, Homo sapiens
ctgattattttcttcat

SEQ ID NO: 3344593 - DNA, 18 bp, Homo sapiens
ctgattcactgcatggct

SEQ ID NO: 3344594 - DNA, 20 bp, Homo sapiens
ctgattcactgcatggctcc

SEQ ID NO: 3344595 - DNA, 17 bp, Homo sapiens
ctgattcccaagctctg

SEQ ID NO: 3344596 - DNA, 19 bp, Homo sapiens
ctgattctggctttaagcc

SEQ ID NO: 3344597 - DNA, 15 bp, Homo sapiens
ctgattgacctgctc

SEQ ID NO: 3344598 - DNA, 19 bp, Homo sapiens
ctgattgcagaaaggagag

SEQ ID NO: 3344599 - DNA, 14 bp, Homo sapiens
ctgattgtttacag

SEQ ID NO: 3344600 - DNA, 15 bp, Homo sapiens
ctgatttacatgtat

SEQ ID NO: 3344601 - DNA, 18 bp, Homo sapiens
ctgatttacatgtatggt

SEQ ID NO: 3344602 - DNA, 18 bp, Homo sapiens
ctgatttatggttttttt

SEQ ID NO: 3344603 - DNA, 21 bp, Homo sapiens
ctgatttatggtttttttaag

SEQ ID NO: 3344604 - DNA, 22 bp, Homo sapiens
ctgatttatttctactatatac

SEQ ID NO: 3344605 - DNA, 18 bp, Homo sapiens
ctgatttcagaagagact

SEQ ID NO: 3344606 - DNA, 21 bp, Homo sapiens
ctgatttcagtttttcatttg

SEQ ID NO: 3344607 - DNA, 16 bp, Homo sapiens
ctgatttccaggcccc

SEQ ID NO: 3344608 - DNA, 19 bp, Homo sapiens
ctgatttccaggcccctga

SEQ ID NO: 3344609 - DNA, 21 bp, Homo sapiens
ctgatttctatggctttcaaa

SEQ ID NO: 3344610 - DNA, 14 bp, Homo sapiens
ctgatttcttgctt

SEQ ID NO: 3344611 - DNA, 14 bp, Homo sapiens
ctgatttggaaaaa

SEQ ID NO: 3344612 - DNA, 23 bp, Homo sapiens
ctgatttgttttcattatagaca

SEQ ID NO: 3344613 - DNA, 12 bp, Homo sapiens
ctgattttaaca

SEQ ID NO: 3344614 - DNA, 22 bp, Homo sapiens
ctgatttttaaagtactttctt

SEQ ID NO: 3344615 - DNA, 15 bp, Homo sapiens
ctgattttttttcct

SEQ ID NO: 3344616 - DNA, 19 bp, Homo sapiens
ctgattttttttcctttta

SEQ ID NO: 3344617 - DNA, 21 bp, Homo sapiens
ctgccacactctccatcaccc

SEQ ID NO: 3344618 - DNA, 13 bp, Homo sapiens
ctgccacactctg

SEQ ID NO: 3344619 - DNA, 13 bp, Homo sapiens
ctgccacacttca

SEQ ID NO: 3344620 - DNA, 22 bp, Homo sapiens
ctgccacacttcaggctcttct

SEQ ID NO: 3344621 - DNA, 23 bp, Homo sapiens
ctgccacagagaagtttgtagcc

SEQ ID NO: 3344622 - DNA, 14 bp, Homo sapiens
ctgccacatacagg

SEQ ID NO: 3344623 - DNA, 18 bp, Homo sapiens
ctgccacatacaggtgct

SEQ ID NO: 3344624 - DNA, 14 bp, Homo sapiens
ctgccacatggagc

SEQ ID NO: 3344625 - DNA, 17 bp, Homo sapiens
ctgccaccacgtctgcc

SEQ ID NO: 3344626 - DNA, 21 bp, Homo sapiens
ctgccaccacgtctgccaggc

SEQ ID NO: 3344627 - DNA, 22 bp, Homo sapiens
ctgccaccacgtctgccaggcc

SEQ ID NO: 3344628 - DNA, 14 bp, Homo sapiens
ctgccaccagagac

SEQ ID NO: 3344629 - DNA, 21 bp, Homo sapiens
ctgccaccagagaccgtcctc

SEQ ID NO: 3344630 - DNA, 13 bp, Homo sapiens
ctgccaccaggcc

SEQ ID NO: 3344631 - DNA, 14 bp, Homo sapiens
ctgccaccaggcca

SEQ ID NO: 3344632 - DNA, 17 bp, Homo sapiens
ctgccaccaggccacct

SEQ ID NO: 3344633 - DNA, 12 bp, Homo sapiens
ctgccacccact

SEQ ID NO: 3344634 - DNA, 13 bp, Homo sapiens
ctgccacccactc

SEQ ID NO: 3344635 - DNA, 15 bp, Homo sapiens
ctgccacccactcag

SEQ ID NO: 3344636 - DNA, 17 bp, Homo sapiens
ctgccacctccccccac

SEQ ID NO: 3344637 - DNA, 21 bp, Homo sapiens
ctgccacctccccccacaagt

SEQ ID NO: 3344638 - DNA, 14 bp, Homo sapiens
ctgccactttgcac

SEQ ID NO: 3344639 - DNA, 22 bp, Homo sapiens
ctgccagaccttaataaaggcc

SEQ ID NO: 3344640 - DNA, 11 bp, Homo sapiens
ctgccagcagc

SEQ ID NO: 3344641 - DNA, 12 bp, Homo sapiens
ctgccagcagca

SEQ ID NO: 3344642 - DNA, 13 bp, Homo sapiens
ctgccagcagcag

SEQ ID NO: 3344643 - DNA, 12 bp, Homo sapiens
ctgccagcccag

SEQ ID NO: 3344644 - DNA, 14 bp, Homo sapiens
ctgccagcccagaa

SEQ ID NO: 3344645 - DNA, 21 bp, Homo sapiens
ctgccagcccagaacacccct

SEQ ID NO: 3344646 - DNA, 15 bp, Homo sapiens
ctgccagcctggctt

SEQ ID NO: 3344647 - DNA, 13 bp, Homo sapiens
ctgccagccttga

SEQ ID NO: 3344648 - DNA, 15 bp, Homo sapiens
ctgccagccttgagc

SEQ ID NO: 3344649 - DNA, 21 bp, Homo sapiens
ctgccagccttgagccctggc

SEQ ID NO: 3344650 - DNA, 12 bp, Homo sapiens
ctgccagctgcc

SEQ ID NO: 3344651 - DNA, 14 bp, Homo sapiens
ctgccagctgcctt

SEQ ID NO: 3344652 - DNA, 15 bp, Homo sapiens
ctgccagctgccttc

SEQ ID NO: 3344653 - DNA, 23 bp, Homo sapiens
ctgccagctgccttcctcatccc

SEQ ID NO: 3344654 - DNA, 21 bp, Homo sapiens
ctgccaggcaacttttaaagc

SEQ ID NO: 3344655 - DNA, 14 bp, Homo sapiens
ctgccaggcacctg

SEQ ID NO: 3344656 - DNA, 16 bp, Homo sapiens
ctgccaggcacctggc

SEQ ID NO: 3344657 - DNA, 18 bp, Homo sapiens
ctgccaggcacctggcct

SEQ ID NO: 3344658 - DNA, 21 bp, Homo sapiens
ctgccaggcacctggcctgct

SEQ ID NO: 3344659 - DNA, 23 bp, Homo sapiens
ctgccaggcacctggcctgctgg

SEQ ID NO: 3344660 - DNA, 17 bp, Homo sapiens
ctgccaggcaggggtgg

SEQ ID NO: 3344661 - DNA, 20 bp, Homo sapiens
ctgccaggcaggggtggggg

SEQ ID NO: 3344662 - DNA, 16 bp, Homo sapiens
ctgccaggccagcctc

SEQ ID NO: 3344663 - DNA, 20 bp, Homo sapiens
ctgccaggccagcctccgag

SEQ ID NO: 3344664 - DNA, 22 bp, Homo sapiens
ctgccaggccagcctccgagag

SEQ ID NO: 3344665 - DNA, 16 bp, Homo sapiens
ctgccaggcccatctc

SEQ ID NO: 3344666 - DNA, 18 bp, Homo sapiens
ctgccaggcccatctcag

SEQ ID NO: 3344667 - DNA, 22 bp, Homo sapiens
ctgccaggcccatctcaggtgc

SEQ ID NO: 3344668 - DNA, 21 bp, Homo sapiens
ctgccaggcgttggtgccact

SEQ ID NO: 3344669 - DNA, 12 bp, Homo sapiens
ctgccagggagc

SEQ ID NO: 3344670 - DNA, 12 bp, Homo sapiens
ctgccagggcag

SEQ ID NO: 3344671 - DNA, 13 bp, Homo sapiens
ctgccagggcttc

SEQ ID NO: 3344672 - DNA, 17 bp, Homo sapiens
ctgccagtccccctgcc

SEQ ID NO: 3344673 - DNA, 20 bp, Homo sapiens
ctgccagtccccctgcccca

SEQ ID NO: 3344674 - DNA, 21 bp, Homo sapiens
ctgccagtccccctgccccag

SEQ ID NO: 3344675 - DNA, 21 bp, Homo sapiens
ctgccagtgacagacaggctc

SEQ ID NO: 3344676 - DNA, 19 bp, Homo sapiens
ctgccagtgcagccactgg

SEQ ID NO: 3344677 - DNA, 13 bp, Homo sapiens
ctgccagtggatc

SEQ ID NO: 3344678 - DNA, 17 bp, Homo sapiens
ctgccatcaccgctggg

SEQ ID NO: 3344679 - DNA, 12 bp, Homo sapiens
ctgccatccagg

SEQ ID NO: 3344680 - DNA, 19 bp, Homo sapiens
ctgccatccaggttcagct

SEQ ID NO: 3344681 - DNA, 22 bp, Homo sapiens
ctgccatcttagtttggattct

SEQ ID NO: 3344682 - DNA, 21 bp, Homo sapiens
ctgccatgatagctggggctt

SEQ ID NO: 3344683 - DNA, 13 bp, Homo sapiens
ctgccatgccact

SEQ ID NO: 3344684 - DNA, 15 bp, Homo sapiens
ctgccatgccactgc

SEQ ID NO: 3344685 - DNA, 17 bp, Homo sapiens
ctgccatgccactgcca

SEQ ID NO: 3344686 - DNA, 17 bp, Homo sapiens
ctgccatgccaggaacc

SEQ ID NO: 3344687 - DNA, 18 bp, Homo sapiens
ctgccatgccaggaacct

SEQ ID NO: 3344688 - DNA, 23 bp, Homo sapiens
ctgccatgccaggaacctgtcct

SEQ ID NO: 3344689 - DNA, 22 bp, Homo sapiens
ctgccatggcgtgtccctctcg

SEQ ID NO: 3344690 - DNA, 20 bp, Homo sapiens
ctgccatgggccagcctagc

SEQ ID NO: 3344691 - DNA, 21 bp, Homo sapiens
ctgccatgggccagcctagcc

SEQ ID NO: 3344692 - DNA, 22 bp, Homo sapiens
ctgccatgtttagtgaatgact

SEQ ID NO: 3344693 - DNA, 15 bp, Homo sapiens
ctgccattattttct

SEQ ID NO: 3344694 - DNA, 21 bp, Homo sapiens
ctgccattattttctgtcaga

SEQ ID NO: 3344695 - DNA, 15 bp, Homo sapiens
ctgccattcttctgg

SEQ ID NO: 3344696 - DNA, 16 bp, Homo sapiens
ctgccattcttctggt

SEQ ID NO: 3344697 - DNA, 23 bp, Homo sapiens
ctgccatttcccttctggacact

SEQ ID NO: 3344698 - DNA, 14 bp, Homo sapiens
ctgcccaaaccctt

SEQ ID NO: 3344699 - DNA, 20 bp, Homo sapiens
ctgcccaaacccttaactga

SEQ ID NO: 3344700 - DNA, 18 bp, Homo sapiens
ctgcccaagcccaggcca

SEQ ID NO: 3344701 - DNA, 21 bp, Homo sapiens
ctgcccaagggcctcccacca

SEQ ID NO: 3344702 - DNA, 20 bp, Homo sapiens
ctgcccacaactcccttgca

SEQ ID NO: 3344703 - DNA, 17 bp, Homo sapiens
ctgcccacattggaccc

SEQ ID NO: 3344704 - DNA, 13 bp, Homo sapiens
ctgcccaccccct

SEQ ID NO: 3344705 - DNA, 21 bp, Homo sapiens
ctgcccacctcagcctcccaa

SEQ ID NO: 3344706 - DNA, 24 bp, Homo sapiens
ctgcccacttagccgtccatggca

SEQ ID NO: 3344707 - DNA, 18 bp, Homo sapiens
ctgcccagatgccctttg

SEQ ID NO: 3344708 - DNA, 19 bp, Homo sapiens
ctgcccagccccgctcagg

SEQ ID NO: 3344709 - DNA, 20 bp, Homo sapiens
ctgcccagccccgctcaggc

SEQ ID NO: 3344710 - DNA, 18 bp, Homo sapiens
ctgcccaggccacagccg

SEQ ID NO: 3344711 - DNA, 16 bp, Homo sapiens
ctgcccaggcccctgc

SEQ ID NO: 3344712 - DNA, 18 bp, Homo sapiens
ctgcccaggccggccagc

SEQ ID NO: 3344713 - DNA, 22 bp, Homo sapiens
ctgcccaggccggccagcctca

SEQ ID NO: 3344714 - DNA, 13 bp, Homo sapiens
ctgcccaggggtg

SEQ ID NO: 3344715 - DNA, 15 bp, Homo sapiens
ctgcccaggggtgcc

SEQ ID NO: 3344716 - DNA, 17 bp, Homo sapiens
ctgcccaggggtgcccc

SEQ ID NO: 3344717 - DNA, 21 bp, Homo sapiens
ctgcccaggggtgccccctcc

SEQ ID NO: 3344718 - DNA, 14 bp, Homo sapiens
ctgcccagtccccc

SEQ ID NO: 3344719 - DNA, 21 bp, Homo sapiens
ctgcccagtgttgtttgtaaa

SEQ ID NO: 3344720 - DNA, 23 bp, Homo sapiens
ctgcccagtgttgtttgtaaata

SEQ ID NO: 3344721 - DNA, 18 bp, Homo sapiens
ctgcccatcacagggttg

SEQ ID NO: 3344722 - DNA, 21 bp, Homo sapiens
ctgcccatgtcgcgctcagca

SEQ ID NO: 3344723 - DNA, 15 bp, Homo sapiens
ctgccccaaacaaat

SEQ ID NO: 3344724 - DNA, 21 bp, Homo sapiens
ctgccccaaacaaatatgcaa

SEQ ID NO: 3344725 - DNA, 17 bp, Homo sapiens
ctgccccaagcagccag

SEQ ID NO: 3344726 - DNA, 22 bp, Homo sapiens
ctgccccaagcagccagccagt

SEQ ID NO: 3344727 - DNA, 14 bp, Homo sapiens
ctgccccaagcccc

SEQ ID NO: 3344728 - DNA, 23 bp, Homo sapiens
ctgccccaagcccccaaccccgc

SEQ ID NO: 3344729 - DNA, 11 bp, Homo sapiens
ctgccccaccc

SEQ ID NO: 3344730 - DNA, 13 bp, Homo sapiens
ctgccccagccag

SEQ ID NO: 3344731 - DNA, 19 bp, Homo sapiens
ctgccccagctctggcttc

SEQ ID NO: 3344732 - DNA, 21 bp, Homo sapiens
ctgccccagctgactgtggcc

SEQ ID NO: 3344733 - DNA, 21 bp, Homo sapiens
ctgccccagggcctgcttccc

SEQ ID NO: 3344734 - DNA, 23 bp, Homo sapiens
ctgccccagtcgttagaatatag

SEQ ID NO: 3344735 - DNA, 14 bp, Homo sapiens
ctgcccccaacact

SEQ ID NO: 3344736 - DNA, 17 bp, Homo sapiens
ctgcccccaacactcca

SEQ ID NO: 3344737 - DNA, 18 bp, Homo sapiens
ctgcccccaacactccag

SEQ ID NO: 3344738 - DNA, 15 bp, Homo sapiens
ctgcccccaccccgg

SEQ ID NO: 3344739 - DNA, 12 bp, Homo sapiens
ctgcccccactg

SEQ ID NO: 3344740 - DNA, 13 bp, Homo sapiens
ctgcccccactgt

SEQ ID NO: 3344741 - DNA, 15 bp, Homo sapiens
ctgcccccagcccaa

SEQ ID NO: 3344742 - DNA, 16 bp, Homo sapiens
ctgcccccagccccgg

SEQ ID NO: 3344743 - DNA, 11 bp, Homo sapiens
ctgccccccgc

SEQ ID NO: 3344744 - DNA, 22 bp, Homo sapiens
ctgcccccgctcccgctcccag

SEQ ID NO: 3344745 - DNA, 23 bp, Homo sapiens
ctgcccccgctcccgctcccagg

SEQ ID NO: 3344746 - DNA, 18 bp, Homo sapiens
ctgacctgtcatgccccc

SEQ ID NO: 3344747 - DNA, 19 bp, Homo sapiens
ctgacctgtcatgcccccc

SEQ ID NO: 3344748 - DNA, 19 bp, Homo sapiens
ctgaccttggagagacaca

SEQ ID NO: 3344749 - DNA, 17 bp, Homo sapiens
ctgacgaaactggcccc

SEQ ID NO: 3344750 - DNA, 20 bp, Homo sapiens
ctgacgaaactggccccgga

SEQ ID NO: 3344751 - DNA, 21 bp, Homo sapiens
ctgacgaaactggccccggat

SEQ ID NO: 3344752 - DNA, 14 bp, Homo sapiens
ctgacggccctgca

SEQ ID NO: 3344753 - DNA, 22 bp, Homo sapiens
ctgacggcgcccccagtgtgca

SEQ ID NO: 3344754 - DNA, 15 bp, Homo sapiens
ctgacgggaggcccc

SEQ ID NO: 3344755 - DNA, 18 bp, Homo sapiens
ctgacgggaggccccagc

SEQ ID NO: 3344756 - DNA, 19 bp, Homo sapiens
ctgacgggaggccccagct

SEQ ID NO: 3344757 - DNA, 21 bp, Homo sapiens
ctgacgggaggccccagctct

SEQ ID NO: 3344758 - DNA, 23 bp, Homo sapiens
ctgacgggaggccccagctctga

SEQ ID NO: 3344759 - DNA, 13 bp, Homo sapiens
ctgacgtccacct

SEQ ID NO: 3344760 - DNA, 21 bp, Homo sapiens
ctgacgtctgaagcttgactc

SEQ ID NO: 3344761 - DNA, 22 bp, Homo sapiens
ctgacgtctgaagcttgactcc

SEQ ID NO: 3344762 - DNA, 14 bp, Homo sapiens
ctgactaaactttt

SEQ ID NO: 3344763 - DNA, 15 bp, Homo sapiens
ctgactactttgcct

SEQ ID NO: 3344764 - DNA, 18 bp, Homo sapiens
ctgactcaacatgttact

SEQ ID NO: 3344765 - DNA, 14 bp, Homo sapiens
ctgactcaggcgcc

SEQ ID NO: 3344766 - DNA, 20 bp, Homo sapiens
ctgactcaggcgcctggcac

SEQ ID NO: 3344767 - DNA, 14 bp, Homo sapiens
ctgactccctgtgg

SEQ ID NO: 3344768 - DNA, 17 bp, Homo sapiens
ctgactccctgtggggg

SEQ ID NO: 3344769 - DNA, 18 bp, Homo sapiens
ctgactcctacctgccct

SEQ ID NO: 3344770 - DNA, 20 bp, Homo sapiens
ctgactcctacctgccctgg

SEQ ID NO: 3344771 - DNA, 18 bp, Homo sapiens
ctgactcggtttctccaa

SEQ ID NO: 3344772 - DNA, 14 bp, Homo sapiens
ctgactctctgtga

SEQ ID NO: 3344773 - DNA, 22 bp, Homo sapiens
ctgactctcttttgaggtccct

SEQ ID NO: 3344774 - DNA, 14 bp, Homo sapiens
ctgactctgaaatc

SEQ ID NO: 3344775 - DNA, 22 bp, Homo sapiens
ctgactgaaggaaaagcaagaa

SEQ ID NO: 3344776 - DNA, 22 bp, Homo sapiens
ctgactgagacacgatgccgag

SEQ ID NO: 3344777 - DNA, 14 bp, Homo sapiens
ctgactgccaagcc

SEQ ID NO: 3344778 - DNA, 16 bp, Homo sapiens
ctgactgccaagccag

SEQ ID NO: 3344779 - DNA, 16 bp, Homo sapiens
ctgactggccaaaccc

SEQ ID NO: 3344780 - DNA, 20 bp, Homo sapiens
ctgactggttaacagcagtc

SEQ ID NO: 3344781 - DNA, 13 bp, Homo sapiens
ctgactgtcctct

SEQ ID NO: 3344782 - DNA, 12 bp, Homo sapiens
ctgactgtggcc

SEQ ID NO: 3344783 - DNA, 16 bp, Homo sapiens
ctgactgtggccccct

SEQ ID NO: 3344784 - DNA, 22 bp, Homo sapiens
ctgactgttcttggtaactgat

SEQ ID NO: 3344785 - DNA, 19 bp, Homo sapiens
ctgacttaagcaaaagaaa

SEQ ID NO: 3344786 - DNA, 13 bp, Homo sapiens
ctgacttcatctg

SEQ ID NO: 3344787 - DNA, 20 bp, Homo sapiens
ctgacttcatggaatggaca

SEQ ID NO: 3344788 - DNA, 19 bp, Homo sapiens
ctgacttctgcctggagac

SEQ ID NO: 3344789 - DNA, 15 bp, Homo sapiens
ctgacttgagtgttc

SEQ ID NO: 3344790 - DNA, 21 bp, Homo sapiens
ctgacttgagtgttccttttt

SEQ ID NO: 3344791 - DNA, 17 bp, Homo sapiens
ctgacttggcacttaag

SEQ ID NO: 3344792 - DNA, 12 bp, Homo sapiens
ctgactttactt

SEQ ID NO: 3344793 - DNA, 14 bp, Homo sapiens
ctgactttacttgt

SEQ ID NO: 3344794 - DNA, 15 bp, Homo sapiens
ctgactttacttgtg

SEQ ID NO: 3344795 - DNA, 21 bp, Homo sapiens
ctgactttctgattactgtcc

SEQ ID NO: 3344796 - DNA, 16 bp, Homo sapiens
ctgactttgcttgctt

SEQ ID NO: 3344797 - DNA, 17 bp, Homo sapiens
ctgactttgcttgcttt

SEQ ID NO: 3344798 - DNA, 16 bp, Homo sapiens
ctgactttttcccccc

SEQ ID NO: 3344799 - DNA, 13 bp, Homo sapiens
ctgagaaaagaac

SEQ ID NO: 3344800 - DNA, 14 bp, Homo sapiens
ctgagaactcctga

SEQ ID NO: 3344801 - DNA, 15 bp, Homo sapiens
ctgagaactcctgac

SEQ ID NO: 3344802 - DNA, 18 bp, Homo sapiens
ctgagaagaggagccctc

SEQ ID NO: 3344803 - DNA, 22 bp, Homo sapiens
ctgagaagaggagccctcatct

SEQ ID NO: 3344804 - DNA, 15 bp, Homo sapiens
ctgagaataagaaag

SEQ ID NO: 3344805 - DNA, 22 bp, Homo sapiens
ctgagaatcacggtggtaaaga

SEQ ID NO: 3344806 - DNA, 16 bp, Homo sapiens
ctgagaccacagaggc

SEQ ID NO: 3344807 - DNA, 13 bp, Homo sapiens
ctgagaccactga

SEQ ID NO: 3344808 - DNA, 15 bp, Homo sapiens
ctgagaccactgagt

SEQ ID NO: 3344809 - DNA, 17 bp, Homo sapiens
ctgagaccactgagtac

SEQ ID NO: 3344810 - DNA, 13 bp, Homo sapiens
ctgagaccagtgt

SEQ ID NO: 3344811 - DNA, 24 bp, Homo sapiens
ctgagaccagtgtatcaggtcagg

SEQ ID NO: 3344812 - DNA, 20 bp, Homo sapiens
ctgagaccctgggagagaag

SEQ ID NO: 3344813 - DNA, 12 bp, Homo sapiens
ctgagactcaca

SEQ ID NO: 3344814 - DNA, 22 bp, Homo sapiens
ctgagactccagaatctgctgt

SEQ ID NO: 3344815 - DNA, 18 bp, Homo sapiens
ctgagactctttagagca

SEQ ID NO: 3344816 - DNA, 19 bp, Homo sapiens
ctgagactctttagagcag

SEQ ID NO: 3344817 - DNA, 20 bp, Homo sapiens
ctgagactggcacttagccc

SEQ ID NO: 3344818 - DNA, 13 bp, Homo sapiens
ctgagagactttt

SEQ ID NO: 3344819 - DNA, 18 bp, Homo sapiens
ctgagagacttttaatca

SEQ ID NO: 3344820 - DNA, 13 bp, Homo sapiens
ctgagagccccca

SEQ ID NO: 3344821 - DNA, 14 bp, Homo sapiens
ctgagagccctgct

SEQ ID NO: 3344822 - DNA, 17 bp, Homo sapiens
ctgagagcgagatggga

SEQ ID NO: 3344823 - DNA, 12 bp, Homo sapiens
ctgagaggcagg

SEQ ID NO: 3344824 - DNA, 14 bp, Homo sapiens
ctgagaggcaggca

SEQ ID NO: 3344825 - DNA, 15 bp, Homo sapiens
ctgagaggcaggcat

SEQ ID NO: 3344826 - DNA, 17 bp, Homo sapiens
ctgagaggcaggcatag

SEQ ID NO: 3344827 - DNA, 16 bp, Homo sapiens
ctgagaggcctggagc

SEQ ID NO: 3344828 - DNA, 17 bp, Homo sapiens
ctgagagggctcgaggg

SEQ ID NO: 3344829 - DNA, 17 bp, Homo sapiens
ctgagagtctagattct

SEQ ID NO: 3344830 - DNA, 22 bp, Homo sapiens
ctgagagtctagattctctggc

SEQ ID NO: 3344831 - DNA, 22 bp, Homo sapiens
ctgagagtgaaaccatgactgt

SEQ ID NO: 3344832 - DNA, 21 bp, Homo sapiens
ctgagataagtaggctggttt

SEQ ID NO: 3344833 - DNA, 21 bp, Homo sapiens
ctgagatatgaacatattgtt

SEQ ID NO: 3344834 - DNA, 15 bp, Homo sapiens
ctgagatcctggagt

SEQ ID NO: 3344835 - DNA, 13 bp, Homo sapiens
ctgagattcttca

SEQ ID NO: 3344836 - DNA, 22 bp, Homo sapiens
ctgagatttttttgtgtatgtt

SEQ ID NO: 3344837 - DNA, 21 bp, Homo sapiens
ctgagcaaatgtggctcctgg

SEQ ID NO: 3344838 - DNA, 20 bp, Homo sapiens
ctgagcaactcttgattatc

SEQ ID NO: 3344839 - DNA, 20 bp, Homo sapiens
ctgagcaagaccctgtctct

SEQ ID NO: 3344840 - DNA, 20 bp, Homo sapiens
ctgagcagccgccagctggg

SEQ ID NO: 3344841 - DNA, 17 bp, Homo sapiens
ctgagccaaggaggcct

SEQ ID NO: 3344842 - DNA, 19 bp, Homo sapiens
ctgagccaaggaggcctgg

SEQ ID NO: 3344843 - DNA, 15 bp, Homo sapiens
ctgagccactctctt

SEQ ID NO: 3344844 - DNA, 21 bp, Homo sapiens
ctgagcccaagctaagccatc

SEQ ID NO: 3344845 - DNA, 18 bp, Homo sapiens
ctgagcccagctgcctgg

SEQ ID NO: 3344846 - DNA, 11 bp, Homo sapiens
ctgagcccagg

SEQ ID NO: 3344847 - DNA, 13 bp, Homo sapiens
ctgagcccaggcc

SEQ ID NO: 3344848 - DNA, 19 bp, Homo sapiens
ctgagcccaggccgttccc

SEQ ID NO: 3344849 - DNA, 11 bp, Homo sapiens
ctgagcccata

SEQ ID NO: 3344850 - DNA, 23 bp, Homo sapiens
ctgagcccatacttttggctcct

SEQ ID NO: 3344851 - DNA, 16 bp, Homo sapiens
ctgagcccatgttctg

SEQ ID NO: 3344852 - DNA, 19 bp, Homo sapiens
ctgagcccatgttctgccc

SEQ ID NO: 3344853 - DNA, 20 bp, Homo sapiens
ctgagccccagggtgcccag

SEQ ID NO: 3344854 - DNA, 18 bp, Homo sapiens
ctgagccccgcagacctc

SEQ ID NO: 3344855 - DNA, 21 bp, Homo sapiens
ctgagccccgcagacctcccc

SEQ ID NO: 3344856 - DNA, 22 bp, Homo sapiens
ctgagccccgccctcttcctga

SEQ ID NO: 3344857 - DNA, 20 bp, Homo sapiens
ctgagcccgggctgcctggg

SEQ ID NO: 3344858 - DNA, 22 bp, Homo sapiens
ctgagcccgggctgcctgggct

SEQ ID NO: 3344859 - DNA, 23 bp, Homo sapiens
ctgagccctactccctgcagatg

SEQ ID NO: 3344860 - DNA, 14 bp, Homo sapiens
ctgagccctggcag

SEQ ID NO: 3344861 - DNA, 21 bp, Homo sapiens
ctgagccctggggactgttcc

SEQ ID NO: 3344862 - DNA, 18 bp, Homo sapiens
ctgagccctggtgtgttt

SEQ ID NO: 3344863 - DNA, 18 bp, Homo sapiens
ctgagcctacagatgaac

SEQ ID NO: 3344864 - DNA, 12 bp, Homo sapiens
ctgagcctctgc

SEQ ID NO: 3344865 - DNA, 18 bp, Homo sapiens
ctgagcctctgctcccca

SEQ ID NO: 3344866 - DNA, 11 bp, Homo sapiens
ctgagcctgtg

SEQ ID NO: 3344867 - DNA, 18 bp, Homo sapiens
ctgagccttagctcccag

SEQ ID NO: 3344868 - DNA, 19 bp, Homo sapiens
ctgagccttagctcccagc

SEQ ID NO: 3344869 - DNA, 23 bp, Homo sapiens
ctgagcgtgctttccaaaaccca

SEQ ID NO: 3344870 - DNA, 21 bp, Homo sapiens
ctgagctatttcatctatttt

SEQ ID NO: 3344871 - DNA, 21 bp, Homo sapiens
ctgagctccccagatctccca

SEQ ID NO: 3344872 - DNA, 13 bp, Homo sapiens
ctgagctcctgct

SEQ ID NO: 3344873 - DNA, 22 bp, Homo sapiens
ctgagctcctgctgcggaggag

SEQ ID NO: 3344874 - DNA, 16 bp, Homo sapiens
ctgagctgagtggcca

SEQ ID NO: 3344875 - DNA, 21 bp, Homo sapiens
ctctgttgtcgtaaagatttg

SEQ ID NO: 3344876 - DNA, 18 bp, Homo sapiens
ctctgtttgatgctattt

SEQ ID NO: 3344877 - DNA, 17 bp, Homo sapiens
ctcttaaacttgtgaat

SEQ ID NO: 3344878 - DNA, 20 bp, Homo sapiens
ctcttaaagctgcctgtagt

SEQ ID NO: 3344879 - DNA, 12 bp, Homo sapiens
ctcttaaagttg

SEQ ID NO: 3344880 - DNA, 12 bp, Homo sapiens
ctcttaagaaac

SEQ ID NO: 3344881 - DNA, 15 bp, Homo sapiens
ctcttaagcagcatg

SEQ ID NO: 3344882 - DNA, 21 bp, Homo sapiens
ctcttaataatctcatgctgt

SEQ ID NO: 3344883 - DNA, 13 bp, Homo sapiens
ctcttaatctgtg

SEQ ID NO: 3344884 - DNA, 15 bp, Homo sapiens
ctcttaatctgtgtg

SEQ ID NO: 3344885 - DNA, 19 bp, Homo sapiens
ctcttacagtgtttggaca

SEQ ID NO: 3344886 - DNA, 14 bp, Homo sapiens
ctcttacttgccaa

SEQ ID NO: 3344887 - DNA, 15 bp, Homo sapiens
ctcttagaacattgt

SEQ ID NO: 3344888 - DNA, 19 bp, Homo sapiens
ctcttagcagcttccagat

SEQ ID NO: 3344889 - DNA, 21 bp, Homo sapiens
ctcttagctactgtatgcaaa

SEQ ID NO: 3344890 - DNA, 17 bp, Homo sapiens
ctcttaggcactttggg

SEQ ID NO: 3344891 - DNA, 22 bp, Homo sapiens
ctcttaggcatgtaggaccctg

SEQ ID NO: 3344892 - DNA, 21 bp, Homo sapiens
ctcttagtgcccgcctaggag

SEQ ID NO: 3344893 - DNA, 16 bp, Homo sapiens
ctcttatagaatattt

SEQ ID NO: 3344894 - DNA, 17 bp, Homo sapiens
ctcttatagaatattta

SEQ ID NO: 3344895 - DNA, 11 bp, Homo sapiens
ctcttatctca

SEQ ID NO: 3344896 - DNA, 23 bp, Homo sapiens
ctcttatctcagtcatgcataaa

SEQ ID NO: 3344897 - DNA, 17 bp, Homo sapiens
ctcttatgcacacctcc

SEQ ID NO: 3344898 - DNA, 13 bp, Homo sapiens
ctcttatgccatt

SEQ ID NO: 3344899 - DNA, 16 bp, Homo sapiens
ctcttattcctctagg

SEQ ID NO: 3344900 - DNA, 12 bp, Homo sapiens
ctcttattctaa

SEQ ID NO: 3344901 - DNA, 14 bp, Homo sapiens
ctcttattgcccac

SEQ ID NO: 3344902 - DNA, 15 bp, Homo sapiens
ctcttattgcccacg

SEQ ID NO: 3344903 - DNA, 13 bp, Homo sapiens
ctcttatttctga

SEQ ID NO: 3344904 - DNA, 14 bp, Homo sapiens
ctcttatttctgaa

SEQ ID NO: 3344905 - DNA, 23 bp, Homo sapiens
ctcttatttctgaattcaaagct

SEQ ID NO: 3344906 - DNA, 18 bp, Homo sapiens
ctcttcaaaaagcagagt

SEQ ID NO: 3344907 - DNA, 20 bp, Homo sapiens
ctcttcaactgaccagcctc

SEQ ID NO: 3344908 - DNA, 22 bp, Homo sapiens
ctcttcaccccggcaggccctg

SEQ ID NO: 3344909 - DNA, 20 bp, Homo sapiens
ctcttcactgtggccacagc

SEQ ID NO: 3344910 - DNA, 11 bp, Homo sapiens
ctcttcagaaa

SEQ ID NO: 3344911 - DNA, 15 bp, Homo sapiens
ctcttcagactctca

SEQ ID NO: 3344912 - DNA, 16 bp, Homo sapiens
ctcttcagccccttct

SEQ ID NO: 3344913 - DNA, 16 bp, Homo sapiens
ctcttcaggcctccct

SEQ ID NO: 3344914 - DNA, 19 bp, Homo sapiens
ctcttcaggcctccctctc

SEQ ID NO: 3344915 - DNA, 12 bp, Homo sapiens
ctcttcaggttc

SEQ ID NO: 3344916 - DNA, 18 bp, Homo sapiens
ctcttcagtgactcctgc

SEQ ID NO: 3344917 - DNA, 14 bp, Homo sapiens
ctcttcattgtcta

SEQ ID NO: 3344918 - DNA, 13 bp, Homo sapiens
ctcttcatttttt

SEQ ID NO: 3344919 - DNA, 16 bp, Homo sapiens
ctcttcccatgactgc

SEQ ID NO: 3344920 - DNA, 16 bp, Homo sapiens
ctcttccccttgccct

SEQ ID NO: 3344921 - DNA, 23 bp, Homo sapiens
ctcttccccttgcccttgccctg

SEQ ID NO: 3344922 - DNA, 22 bp, Homo sapiens
ctcttccctgcgcctgtgatgc

SEQ ID NO: 3344923 - DNA, 21 bp, Homo sapiens
ctcttccctttccccagcatc

SEQ ID NO: 3344924 - DNA, 19 bp, Homo sapiens
ctcttccggagatgtagca

SEQ ID NO: 3344925 - DNA, 22 bp, Homo sapiens
ctcttccggagatgtagcaaaa

SEQ ID NO: 3344926 - DNA, 15 bp, Homo sapiens
ctcttcctacccaac

SEQ ID NO: 3344927 - DNA, 16 bp, Homo sapiens
ctcttcctatttttgt

SEQ ID NO: 3344928 - DNA, 17 bp, Homo sapiens
ctcttcctgtgatccac

SEQ ID NO: 3344929 - DNA, 23 bp, Homo sapiens
ctcttccttgaagaactgcaggc

SEQ ID NO: 3344930 - DNA, 19 bp, Homo sapiens
ctcttcgatgtgcccaggg

SEQ ID NO: 3344931 - DNA, 21 bp, Homo sapiens
ctcttcgcgcccgcccctgca

SEQ ID NO: 3344932 - DNA, 15 bp, Homo sapiens
ctcttcggtgttctt

SEQ ID NO: 3344933 - DNA, 14 bp, Homo sapiens
ctcttctcaagtgc

SEQ ID NO: 3344934 - DNA, 12 bp, Homo sapiens
ctcttctccact

SEQ ID NO: 3344935 - DNA, 15 bp, Homo sapiens
ctcttctccactgga

SEQ ID NO: 3344936 - DNA, 17 bp, Homo sapiens
ctcttctccactggatg

SEQ ID NO: 3344937 - DNA, 19 bp, Homo sapiens
ctcttctccactggatgga

SEQ ID NO: 3344938 - DNA, 15 bp, Homo sapiens
ctcttctccaggctg

SEQ ID NO: 3344939 - DNA, 12 bp, Homo sapiens
ctcttctcccag

SEQ ID NO: 3344940 - DNA, 14 bp, Homo sapiens
ctcttctcccagaa

SEQ ID NO: 3344941 - DNA, 13 bp, Homo sapiens
ctcttctcggctc

SEQ ID NO: 3344942 - DNA, 16 bp, Homo sapiens
ctcttctcggctcagg

SEQ ID NO: 3344943 - DNA, 15 bp, Homo sapiens
ctcttctctccagct

SEQ ID NO: 3344944 - DNA, 14 bp, Homo sapiens
ctcttctctgcaat

SEQ ID NO: 3344945 - DNA, 17 bp, Homo sapiens
ctcttctgacgtgcctt

SEQ ID NO: 3344946 - DNA, 12 bp, Homo sapiens
ctcttctgagct

SEQ ID NO: 3344947 - DNA, 15 bp, Homo sapiens
ctcttctgagctatt

SEQ ID NO: 3344948 - DNA, 18 bp, Homo sapiens
ctcttctgagctatttca

SEQ ID NO: 3344949 - DNA, 21 bp, Homo sapiens
ctcttctgagctatttcatct

SEQ ID NO: 3344950 - DNA, 22 bp, Homo sapiens
ctcttctgagctatttcatcta

SEQ ID NO: 3344951 - DNA, 13 bp, Homo sapiens
ctcttctgctcca

SEQ ID NO: 3344952 - DNA, 14 bp, Homo sapiens
ctcttctggctcaa

SEQ ID NO: 3344953 - DNA, 15 bp, Homo sapiens
ctcttctgggcctga

SEQ ID NO: 3344954 - DNA, 19 bp, Homo sapiens
ctcttctggggcaggctgg

SEQ ID NO: 3344955 - DNA, 21 bp, Homo sapiens
ctcttctggggcaggctgggc

SEQ ID NO: 3344956 - DNA, 23 bp, Homo sapiens
ctcttctggggcaggctgggcca

SEQ ID NO: 3344957 - DNA, 15 bp, Homo sapiens
ctcttcttctgaaga

SEQ ID NO: 3344958 - DNA, 16 bp, Homo sapiens
ctcttcttctgaagat

SEQ ID NO: 3344959 - DNA, 17 bp, Homo sapiens
ctcttcttcttcagaag

SEQ ID NO: 3344960 - DNA, 15 bp, Homo sapiens
ctcttcttgaaattt

SEQ ID NO: 3344961 - DNA, 20 bp, Homo sapiens
ctcttcttgaaattttaacc

SEQ ID NO: 3344962 - DNA, 17 bp, Homo sapiens
ctcttctttagaacagg

SEQ ID NO: 3344963 - DNA, 22 bp, Homo sapiens
ctcttctttatactgtaattta

SEQ ID NO: 3344964 - DNA, 19 bp, Homo sapiens
ctcttcttttggcttccat

SEQ ID NO: 3344965 - DNA, 13 bp, Homo sapiens
ctcttgaagagga

SEQ ID NO: 3344966 - DNA, 15 bp, Homo sapiens
ctcttgagcagtggc

SEQ ID NO: 3344967 - DNA, 13 bp, Homo sapiens
ctcttgagctggc

SEQ ID NO: 3344968 - DNA, 16 bp, Homo sapiens
ctcttgagctggcctc

SEQ ID NO: 3344969 - DNA, 21 bp, Homo sapiens
ctcttgatacccccctctgtc

SEQ ID NO: 3344970 - DNA, 14 bp, Homo sapiens
ctcttgcccatcct

SEQ ID NO: 3344971 - DNA, 16 bp, Homo sapiens
ctcttgcccatcctga

SEQ ID NO: 3344972 - DNA, 16 bp, Homo sapiens
ctcttgcccttccctg

SEQ ID NO: 3344973 - DNA, 19 bp, Homo sapiens
ctcttgcccttccctgtcc

SEQ ID NO: 3344974 - DNA, 21 bp, Homo sapiens
ctcttgcccttccctgtccct

SEQ ID NO: 3344975 - DNA, 15 bp, Homo sapiens
ctcttgcctctctca

SEQ ID NO: 3344976 - DNA, 15 bp, Homo sapiens
ctcttgctgtctctg

SEQ ID NO: 3344977 - DNA, 18 bp, Homo sapiens
ctcttgctgtctctgctc

SEQ ID NO: 3344978 - DNA, 18 bp, Homo sapiens
ctcttggaaaataagaca

SEQ ID NO: 3344979 - DNA, 19 bp, Homo sapiens
ctcttgggttcaagcgatt

SEQ ID NO: 3344980 - DNA, 22 bp, Homo sapiens
ctcttggtgtgattgcacagaa

SEQ ID NO: 3344981 - DNA, 14 bp, Homo sapiens
ctcttgtcccacgt

SEQ ID NO: 3344982 - DNA, 20 bp, Homo sapiens
ctcttgtccctttccctacc

SEQ ID NO: 3344983 - DNA, 12 bp, Homo sapiens
ctcttgtgattt

SEQ ID NO: 3344984 - DNA, 23 bp, Homo sapiens
ctcttgtgctggatggagcccag

SEQ ID NO: 3344985 - DNA, 17 bp, Homo sapiens
ctcttgttgagttctgt

SEQ ID NO: 3344986 - DNA, 20 bp, Homo sapiens
ctcttgttttgtttgtctct

SEQ ID NO: 3344987 - DNA, 21 bp, Homo sapiens
ctcttgtttttattaatttat

SEQ ID NO: 3344988 - DNA, 16 bp, Homo sapiens
ctctttaagttttgat

SEQ ID NO: 3344989 - DNA, 17 bp, Homo sapiens
ctctttaagttttgatt

SEQ ID NO: 3344990 - DNA, 14 bp, Homo sapiens
ctctttaataaatt

SEQ ID NO: 3344991 - DNA, 16 bp, Homo sapiens
ctctttactcccttcc

SEQ ID NO: 3344992 - DNA, 20 bp, Homo sapiens
ctctttagagcagctttggg

SEQ ID NO: 3344993 - DNA, 15 bp, Homo sapiens
ctctttagtataatt

SEQ ID NO: 3344994 - DNA, 11 bp, Homo sapiens
ctctttcaaag

SEQ ID NO: 3344995 - DNA, 15 bp, Homo sapiens
ctctttcacattgtt

SEQ ID NO: 3344996 - DNA, 12 bp, Homo sapiens
ctctttcagaga

SEQ ID NO: 3344997 - DNA, 22 bp, Homo sapiens
ctctttcagagaggtctcaggt

SEQ ID NO: 3344998 - DNA, 13 bp, Homo sapiens
ctctttccctgcg

SEQ ID NO: 3344999 - DNA, 22 bp, Homo sapiens
ctctttcctgttgttgttaatg

SEQ ID NO: 3345000 - DNA, 13 bp, Homo sapiens
ctctttccttgct

SEQ ID NO: 3345001 - DNA, 15 bp, Homo sapiens
ctctttcgtcaccct

SEQ ID NO: 3345002 - DNA, 18 bp, Homo sapiens
ctctttcgtcacccttgg

SEQ ID NO: 3345003 - DNA, 19 bp, Homo sapiens
ctctttcgtcacccttgga

SEQ ID NO: 3345004 - DNA, 20 bp, Homo sapiens
ctctttctaactttctttac

SEQ ID NO: 3345005 - DNA, 21 bp, Homo sapiens
ctctttctacatgactgggcc

SEQ ID NO: 3345006 - DNA, 15 bp, Homo sapiens
ctctttctctccttt

SEQ ID NO: 3345007 - DNA, 19 bp, Homo sapiens
ctctttctctcctttcttt

SEQ ID NO: 3345008 - DNA, 13 bp, Homo sapiens
ctctttctctctt

SEQ ID NO: 3345009 - DNA, 17 bp, Homo sapiens
ctctttctctcttccct

SEQ ID NO: 3345010 - DNA, 15 bp, Homo sapiens
ctctttctctgccag

SEQ ID NO: 3345011 - DNA, 18 bp, Homo sapiens
ctctttctctgccagtga

SEQ ID NO: 3345012 - DNA, 20 bp, Homo sapiens
ctctttctgaaggaagagaa

SEQ ID NO: 3345013 - DNA, 12 bp, Homo sapiens
ctctttctgggc

SEQ ID NO: 3345014 - DNA, 13 bp, Homo sapiens
ctctttctgtata

SEQ ID NO: 3345015 - DNA, 12 bp, Homo sapiens
ctctttcttcct

SEQ ID NO: 3345016 - DNA, 22 bp, Homo sapiens
ctctttgaaatagtctgtgtga

SEQ ID NO: 3345017 - DNA, 19 bp, Homo sapiens
ctctttgacaactaaaatt

SEQ ID NO: 3345018 - DNA, 21 bp, Homo sapiens
ctctttggcgacctcctttca

SEQ ID NO: 3345019 - DNA, 18 bp, Homo sapiens
ctctttggctcccctgta

SEQ ID NO: 3345020 - DNA, 18 bp, Homo sapiens
ctctttgtggggcttggc

SEQ ID NO: 3345021 - DNA, 20 bp, Homo sapiens
ctctttgtggggcttggcgt

SEQ ID NO: 3345022 - DNA, 15 bp, Homo sapiens
ctcttttatatttgt

SEQ ID NO: 3345023 - DNA, 23 bp, Homo sapiens
ctcttttatatttgtaggagaaa

SEQ ID NO: 3345024 - DNA, 16 bp, Homo sapiens
ctcttttcattgtgta

SEQ ID NO: 3345025 - DNA, 18 bp, Homo sapiens
ctcttttccccgcctgca

SEQ ID NO: 3345026 - DNA, 15 bp, Homo sapiens
ctcttttccctctct

SEQ ID NO: 3345027 - DNA, 20 bp, Homo sapiens
ctcttttctattttgttttt

SEQ ID NO: 3345028 - DNA, 14 bp, Homo sapiens
ctcttttctctgtg

SEQ ID NO: 3345029 - DNA, 15 bp, Homo sapiens
ctcttttctgtactt

SEQ ID NO: 3345030 - DNA, 21 bp, Homo sapiens
ctcttttgctttattccagaa

SEQ ID NO: 3345031 - DNA, 18 bp, Homo sapiens
ctcttttgttaaataata

SEQ ID NO: 3345032 - DNA, 20 bp, Homo sapiens
ctctttttagggccaggcag

SEQ ID NO: 3345033 - DNA, 22 bp, Homo sapiens
ctctttttcgtataatcttgta

SEQ ID NO: 3345034 - DNA, 22 bp, Homo sapiens
ctcttttttactcattgaaatg

SEQ ID NO: 3345035 - DNA, 17 bp, Homo sapiens
ctcttttttcgtttgtt

SEQ ID NO: 3345036 - DNA, 22 bp, Homo sapiens
ctctttttttttttttttttgg

SEQ ID NO: 3345037 - DNA, 18 bp, Homo sapiens
ctgaaaaaaaaaaagaag

SEQ ID NO: 3345038 - DNA, 19 bp, Homo sapiens
ctgaaaaaaaaaaagaaga

SEQ ID NO: 3345039 - DNA, 19 bp, Homo sapiens
ctgaaaaatctaagtgata

SEQ ID NO: 3345040 - DNA, 22 bp, Homo sapiens
ctgaaaaatctaagtgatataa

SEQ ID NO: 3345041 - DNA, 13 bp, Homo sapiens
ctgaaaaatggga

SEQ ID NO: 3345042 - DNA, 21 bp, Homo sapiens
ctgaaaaatggtaattgttgc

SEQ ID NO: 3345043 - DNA, 21 bp, Homo sapiens
ctgaaaaccatctggcctggc

SEQ ID NO: 3345044 - DNA, 18 bp, Homo sapiens
ctgaaaacctaccagcca

SEQ ID NO: 3345045 - DNA, 20 bp, Homo sapiens
ctgaaaagcaattgccctgt

SEQ ID NO: 3345046 - DNA, 14 bp, Homo sapiens
ctgaaaagctgcat

SEQ ID NO: 3345047 - DNA, 13 bp, Homo sapiens
ctgaaaatccaat

SEQ ID NO: 3345048 - DNA, 13 bp, Homo sapiens
ctgaaaatgtaaa

SEQ ID NO: 3345049 - DNA, 15 bp, Homo sapiens
ctgaaaatgtaaatt

SEQ ID NO: 3345050 - DNA, 12 bp, Homo sapiens
ctgaaaatgtgc

SEQ ID NO: 3345051 - DNA, 13 bp, Homo sapiens
ctgaaacagattt

SEQ ID NO: 3345052 - DNA, 17 bp, Homo sapiens
ctgaaacagatttcata

SEQ ID NO: 3345053 - DNA, 21 bp, Homo sapiens
ctgaaacattcacacagggct

SEQ ID NO: 3345054 - DNA, 22 bp, Homo sapiens
ctgaaacattccgaagagggaa

SEQ ID NO: 3345055 - DNA, 16 bp, Homo sapiens
ctgaaaccaaaacata

SEQ ID NO: 3345056 - DNA, 12 bp, Homo sapiens
ctgaaaccattt

SEQ ID NO: 3345057 - DNA, 23 bp, Homo sapiens
ctgaaacccaaagccctggtaaa

SEQ ID NO: 3345058 - DNA, 22 bp, Homo sapiens
ctgaaacccacagatgtctctg

SEQ ID NO: 3345059 - DNA, 20 bp, Homo sapiens
ctgaaacctagtactgcccc

SEQ ID NO: 3345060 - DNA, 22 bp, Homo sapiens
ctgaaactggttttaagtgctt

SEQ ID NO: 3345061 - DNA, 14 bp, Homo sapiens
ctgaaagaaacagt

SEQ ID NO: 3345062 - DNA, 16 bp, Homo sapiens
ctctatgccccaaata

SEQ ID NO: 3345063 - DNA, 20 bp, Homo sapiens
ctctattaagatttccaagt

SEQ ID NO: 3345064 - DNA, 23 bp, Homo sapiens
ctctattagactttagaaataaa

SEQ ID NO: 3345065 - DNA, 24 bp, Homo sapiens
ctctattagactttagaaataaat

SEQ ID NO: 3345066 - DNA, 21 bp, Homo sapiens
ctctattctcaaagtttccta

SEQ ID NO: 3345067 - DNA, 19 bp, Homo sapiens
ctctattgggcacagccta

SEQ ID NO: 3345068 - DNA, 21 bp, Homo sapiens
ctctattgtagcatttcttga

SEQ ID NO: 3345069 - DNA, 15 bp, Homo sapiens
ctctatttaaattct

SEQ ID NO: 3345070 - DNA, 14 bp, Homo sapiens
ctctatttaatatt

SEQ ID NO: 3345071 - DNA, 16 bp, Homo sapiens
ctctatttaatattta

SEQ ID NO: 3345072 - DNA, 17 bp, Homo sapiens
ctctatttaatatttat

SEQ ID NO: 3345073 - DNA, 15 bp, Homo sapiens
ctctatttcattttt

SEQ ID NO: 3345074 - DNA, 14 bp, Homo sapiens
ctctattttaaagt

SEQ ID NO: 3345075 - DNA, 18 bp, Homo sapiens
ctctcaaaagtctatttt

SEQ ID NO: 3345076 - DNA, 20 bp, Homo sapiens
ctctcaagctagccagaggg

SEQ ID NO: 3345077 - DNA, 14 bp, Homo sapiens
ctctcaagtaatat

SEQ ID NO: 3345078 - DNA, 13 bp, Homo sapiens
ctctcaattaaag

SEQ ID NO: 3345079 - DNA, 13 bp, Homo sapiens
ctctcacctcagc

SEQ ID NO: 3345080 - DNA, 15 bp, Homo sapiens
ctctcacctctccct

SEQ ID NO: 3345081 - DNA, 16 bp, Homo sapiens
ctctcactcctgcctc

SEQ ID NO: 3345082 - DNA, 18 bp, Homo sapiens
ctctcactcctgcctccg

SEQ ID NO: 3345083 - DNA, 13 bp, Homo sapiens
ctctcagagccct

SEQ ID NO: 3345084 - DNA, 15 bp, Homo sapiens
ctctcagagccctca

SEQ ID NO: 3345085 - DNA, 15 bp, Homo sapiens
ctctcagcctcccac

SEQ ID NO: 3345086 - DNA, 15 bp, Homo sapiens
ctctcaggagcacag

SEQ ID NO: 3345087 - DNA, 17 bp, Homo sapiens
ctctcaggagcacaggc

SEQ ID NO: 3345088 - DNA, 21 bp, Homo sapiens
ctctcaggagcacaggcagct

SEQ ID NO: 3345089 - DNA, 16 bp, Homo sapiens
ctctcaggagtatctt

SEQ ID NO: 3345090 - DNA, 14 bp, Homo sapiens
ctctcaggatcaag

SEQ ID NO: 3345091 - DNA, 24 bp, Homo sapiens
ctctcagggcctggcaggccagtg

SEQ ID NO: 3345092 - DNA, 18 bp, Homo sapiens
ctctcagtgttttggact

SEQ ID NO: 3345093 - DNA, 16 bp, Homo sapiens
ctctcagttctctccc

SEQ ID NO: 3345094 - DNA, 16 bp, Homo sapiens
ctctcatatatatttt

SEQ ID NO: 3345095 - DNA, 16 bp, Homo sapiens
ctctcatcaactgaat

SEQ ID NO: 3345096 - DNA, 19 bp, Homo sapiens
ctctcatcctccagtacct

SEQ ID NO: 3345097 - DNA, 20 bp, Homo sapiens
ctctccaaaggggctgctgg

SEQ ID NO: 3345098 - DNA, 21 bp, Homo sapiens
ctctccaaaggggctgctggg

SEQ ID NO: 3345099 - DNA, 12 bp, Homo sapiens
ctctccaagggc

SEQ ID NO: 3345100 - DNA, 23 bp, Homo sapiens
ctctccaagggcttctgcaccct

SEQ ID NO: 3345101 - DNA, 13 bp, Homo sapiens
ctctccaagtctc

SEQ ID NO: 3345102 - DNA, 17 bp, Homo sapiens
ctctccaagtctctctg

SEQ ID NO: 3345103 - DNA, 21 bp, Homo sapiens
ctctccaagtctctctgtgaa

SEQ ID NO: 3345104 - DNA, 14 bp, Homo sapiens
ctctccaagtgcca

SEQ ID NO: 3345105 - DNA, 16 bp, Homo sapiens
ctctccaagtgccaga

SEQ ID NO: 3345106 - DNA, 17 bp, Homo sapiens
ctctccaatgttctatt

SEQ ID NO: 3345107 - DNA, 20 bp, Homo sapiens
ctctccaccctggctgggat

SEQ ID NO: 3345108 - DNA, 11 bp, Homo sapiens
ctctccactgc

SEQ ID NO: 3345109 - DNA, 12 bp, Homo sapiens
ctctccactgcc

SEQ ID NO: 3345110 - DNA, 16 bp, Homo sapiens
ctctccactgccttcg

SEQ ID NO: 3345111 - DNA, 21 bp, Homo sapiens
ctctccagccgaagctgcagg

SEQ ID NO: 3345112 - DNA, 19 bp, Homo sapiens
ctctccagcggtccaaagt

SEQ ID NO: 3345113 - DNA, 13 bp, Homo sapiens
ctctccagctcca

SEQ ID NO: 3345114 - DNA, 16 bp, Homo sapiens
ctctccagctccaaga

SEQ ID NO: 3345115 - DNA, 15 bp, Homo sapiens
ctctccagctgacta

SEQ ID NO: 3345116 - DNA, 18 bp, Homo sapiens
ctctccagctgactaaac

SEQ ID NO: 3345117 - DNA, 19 bp, Homo sapiens
ctctccagtttgcacctgt

SEQ ID NO: 3345118 - DNA, 23 bp, Homo sapiens
ctctccagtttgcacctgtcccc

SEQ ID NO: 3345119 - DNA, 15 bp, Homo sapiens
ctctccatatctcct

SEQ ID NO: 3345120 - DNA, 15 bp, Homo sapiens
ctctcccaccccggc

SEQ ID NO: 3345121 - DNA, 20 bp, Homo sapiens
ctctcccatcacttccctac

SEQ ID NO: 3345122 - DNA, 20 bp, Homo sapiens
ctctcccatccccctgccct

SEQ ID NO: 3345123 - DNA, 14 bp, Homo sapiens
ctctcccatcctgg

SEQ ID NO: 3345124 - DNA, 16 bp, Homo sapiens
ctctcccatcctgggg

SEQ ID NO: 3345125 - DNA, 14 bp, Homo sapiens
ctctcccatttcct

SEQ ID NO: 3345126 - DNA, 16 bp, Homo sapiens
ctctccccaggtccag

SEQ ID NO: 3345127 - DNA, 20 bp, Homo sapiens
ctctccccctatttattgac

SEQ ID NO: 3345128 - DNA, 12 bp, Homo sapiens
ctctcccctcaa

SEQ ID NO: 3345129 - DNA, 21 bp, Homo sapiens
ctctcccctcaaagtctgcaa

SEQ ID NO: 3345130 - DNA, 13 bp, Homo sapiens
ctctcccctccag

SEQ ID NO: 3345131 - DNA, 14 bp, Homo sapiens
ctctcccctccagc

SEQ ID NO: 3345132 - DNA, 15 bp, Homo sapiens
ctctcccggctgcct

SEQ ID NO: 3345133 - DNA, 18 bp, Homo sapiens
ctctcccggctgcctgcc

SEQ ID NO: 3345134 - DNA, 19 bp, Homo sapiens
ctctcccggctgcctgccg

SEQ ID NO: 3345135 - DNA, 13 bp, Homo sapiens
ctctccctcccct

SEQ ID NO: 3345136 - DNA, 22 bp, Homo sapiens
ctctgcacaccctccagagaca

SEQ ID NO: 3345137 - DNA, 22 bp, Homo sapiens
ctctgcacagacaagcagccct

SEQ ID NO: 3345138 - DNA, 14 bp, Homo sapiens
ctctgcacagatgg

SEQ ID NO: 3345139 - DNA, 15 bp, Homo sapiens
ctctgcacagatgga

SEQ ID NO: 3345140 - DNA, 14 bp, Homo sapiens
ctctgcacatgtct

SEQ ID NO: 3345141 - DNA, 15 bp, Homo sapiens
ctctgcacatgtctt

SEQ ID NO: 3345142 - DNA, 16 bp, Homo sapiens
ctctgcacatgtcttg

SEQ ID NO: 3345143 - DNA, 13 bp, Homo sapiens
ctctgcacccctc

SEQ ID NO: 3345144 - DNA, 15 bp, Homo sapiens
ctctgcactaagaga

SEQ ID NO: 3345145 - DNA, 15 bp, Homo sapiens
ctctgcactactcct

SEQ ID NO: 3345146 - DNA, 20 bp, Homo sapiens
ctctgcactactcctctgca

SEQ ID NO: 3345147 - DNA, 18 bp, Homo sapiens
ctctgcactactgacatg

SEQ ID NO: 3345148 - DNA, 13 bp, Homo sapiens
ctctgcactctcc

SEQ ID NO: 3345149 - DNA, 15 bp, Homo sapiens
ctctgcactctccac

SEQ ID NO: 3345150 - DNA, 23 bp, Homo sapiens
ctctgcactctccaccctggctg

SEQ ID NO: 3345151 - DNA, 16 bp, Homo sapiens
ctctgcagaacagtga

SEQ ID NO: 3345152 - DNA, 16 bp, Homo sapiens
ctctgcagtgccttgg

SEQ ID NO: 3345153 - DNA, 14 bp, Homo sapiens
ctctgcatcccagc

SEQ ID NO: 3345154 - DNA, 15 bp, Homo sapiens
ctctgcatcccagca

SEQ ID NO: 3345155 - DNA, 18 bp, Homo sapiens
ctctgcatcccagcacct

SEQ ID NO: 3345156 - DNA, 12 bp, Homo sapiens
ctctgcatctga

SEQ ID NO: 3345157 - DNA, 19 bp, Homo sapiens
ctctgccaaaggatgtgat

SEQ ID NO: 3345158 - DNA, 14 bp, Homo sapiens
ctctgccaccagag

SEQ ID NO: 3345159 - DNA, 17 bp, Homo sapiens
ctctgccaccagagacc

SEQ ID NO: 3345160 - DNA, 14 bp, Homo sapiens
ctctgccacccact

SEQ ID NO: 3345161 - DNA, 17 bp, Homo sapiens
ctctgccacccactcag

SEQ ID NO: 3345162 - DNA, 18 bp, Homo sapiens
ctctgccacccactcagg

SEQ ID NO: 3345163 - DNA, 18 bp, Homo sapiens
ctctgccagggcagtgct

SEQ ID NO: 3345164 - DNA, 19 bp, Homo sapiens
ctctgccagggcagtgcta

SEQ ID NO: 3345165 - DNA, 20 bp, Homo sapiens
ctctgccagtgacagacagg

SEQ ID NO: 3345166 - DNA, 13 bp, Homo sapiens
ctctgccagtgga

SEQ ID NO: 3345167 - DNA, 11 bp, Homo sapiens
ctctgcccact

SEQ ID NO: 3345168 - DNA, 14 bp, Homo sapiens
ctctgccccaagca

SEQ ID NO: 3345169 - DNA, 15 bp, Homo sapiens
ctctgccccaagcag

SEQ ID NO: 3345170 - DNA, 17 bp, Homo sapiens
ctctgccccaagcagcc

SEQ ID NO: 3345171 - DNA, 19 bp, Homo sapiens
ctctgccccaagcagccag

SEQ ID NO: 3345172 - DNA, 20 bp, Homo sapiens
ctctgccccaagcagccagc

SEQ ID NO: 3345173 - DNA, 20 bp, Homo sapiens
ctctgccccacgctgtggcc

SEQ ID NO: 3345174 - DNA, 16 bp, Homo sapiens
ctctgccccagctctg

SEQ ID NO: 3345175 - DNA, 18 bp, Homo sapiens
ctctgccccagctctggc

SEQ ID NO: 3345176 - DNA, 12 bp, Homo sapiens
ctctgccccagt

SEQ ID NO: 3345177 - DNA, 17 bp, Homo sapiens
ctctgccccagtcgtta

SEQ ID NO: 3345178 - DNA, 22 bp, Homo sapiens
ctctgcccctcccaacccagcc

SEQ ID NO: 3345179 - DNA, 22 bp, Homo sapiens
ctctgccggtcgggcagccagc

SEQ ID NO: 3345180 - DNA, 24 bp, Homo sapiens
ctctgccggtcgggcagccagcag

SEQ ID NO: 3345181 - DNA, 19 bp, Homo sapiens
ctctgcctcaccgcttccc

SEQ ID NO: 3345182 - DNA, 16 bp, Homo sapiens
ctctgcctcccaggtt

SEQ ID NO: 3345183 - DNA, 16 bp, Homo sapiens
ctctgcctctgacaca

SEQ ID NO: 3345184 - DNA, 21 bp, Homo sapiens
ctctgcctgaagtcacacagt

SEQ ID NO: 3345185 - DNA, 22 bp, Homo sapiens
ctctgcctgaagtcacacagtg

SEQ ID NO: 3345186 - DNA, 20 bp, Homo sapiens
ctctgcctggtggtcagatg

SEQ ID NO: 3345187 - DNA, 15 bp, Homo sapiens
ctctgcctttgacat

SEQ ID NO: 3345188 - DNA, 19 bp, Homo sapiens
ctctgcctttgacatttaa

SEQ ID NO: 3345189 - DNA, 16 bp, Homo sapiens
ctctgcggaccccagc

SEQ ID NO: 3345190 - DNA, 17 bp, Homo sapiens
ctctgcggaccccagct

SEQ ID NO: 3345191 - DNA, 20 bp, Homo sapiens
ctctgcggggcagggccttc

SEQ ID NO: 3345192 - DNA, 24 bp, Homo sapiens
ctctgcggggcagggccttcctgg

SEQ ID NO: 3345193 - DNA, 15 bp, Homo sapiens
ctctgctatgagtgt

SEQ ID NO: 3345194 - DNA, 15 bp, Homo sapiens
ctctgctatttctct

SEQ ID NO: 3345195 - DNA, 15 bp, Homo sapiens
tttgattgatttgaa

SEQ ID NO: 3345196 - DNA, 17 bp, Homo sapiens
tttgatttacagcaagt

SEQ ID NO: 3345197 - DNA, 17 bp, Homo sapiens
tttgatttagattgagt

SEQ ID NO: 3345198 - DNA, 14 bp, Homo sapiens
tttgatttcattaa

SEQ ID NO: 3345199 - DNA, 18 bp, Homo sapiens
tttgatttccaagtaata

SEQ ID NO: 3345200 - DNA, 21 bp, Homo sapiens
tttgatttccatcttaatgtt

SEQ ID NO: 3345201 - DNA, 14 bp, Homo sapiens
tttgattttgctga

SEQ ID NO: 3345202 - DNA, 23 bp, Homo sapiens
tttgattttgctgactttaaaag

SEQ ID NO: 3345203 - DNA, 17 bp, Homo sapiens
tttgcaaatataaacat

SEQ ID NO: 3345204 - DNA, 23 bp, Homo sapiens
tttgcaacaggggaggaaaaaag

SEQ ID NO: 3345205 - DNA, 17 bp, Homo sapiens
tttgcaataacttctat

SEQ ID NO: 3345206 - DNA, 19 bp, Homo sapiens
tttgcaataacttctatat

SEQ ID NO: 3345207 - DNA, 18 bp, Homo sapiens
ttttccactccattgtcg

SEQ ID NO: 3345208 - DNA, 13 bp, Homo sapiens
ttttccagcaagt

SEQ ID NO: 3345209 - DNA, 20 bp, Homo sapiens
ttttccatcattttacagtg

SEQ ID NO: 3345210 - DNA, 11 bp, Homo sapiens
ttttccatgaa

SEQ ID NO: 3345211 - DNA, 13 bp, Homo sapiens
tttttccatcatt

SEQ ID NO: 3345212 - DNA, 12 bp, Homo sapiens
tttttccccctt

SEQ ID NO: 3345213 - DNA, 18 bp, Homo sapiens
tttttcctagccctctca

SEQ ID NO: 3345214 - DNA, 19 bp, Homo sapiens
tttttcctctgagcccagc

SEQ ID NO: 3345215 - DNA, 11 bp, Homo sapiens
tttttccttta

SEQ ID NO: 3345216 - DNA, 21 bp, Homo sapiens
tttttctaaaacattcccctc

SEQ ID NO: 3345217 - DNA, 16 bp, Homo sapiens
tttttctaagagaagt

SEQ ID NO: 3345218 - DNA, 21 bp, Homo sapiens
tttttctagtttcagtaaata

SEQ ID NO: 3345219 - DNA, 19 bp, Homo sapiens
tttttctataaatcagtat

SEQ ID NO: 3345220 - DNA, 16 bp, Homo sapiens
tttttctcaaagtttt

SEQ ID NO: 3345221 - DNA, 15 bp, Homo sapiens
tttttctccagtgct

SEQ ID NO: 3345222 - DNA, 17 bp, Homo sapiens
tttttctgataaaagat

SEQ ID NO: 3345223 - DNA, 22 bp, Homo sapiens
tttttctgtgataactctgcaa

SEQ ID NO: 3345224 - DNA, 16 bp, Homo sapiens
tttttcttaaaagtac

SEQ ID NO: 3345225 - DNA, 13 bp, Homo sapiens
tttttcttccctt

SEQ ID NO: 3345226 - DNA, 16 bp, Homo sapiens
tttttctttataaact

SEQ ID NO: 3345227 - DNA, 17 bp, Homo sapiens
tttttctttataaactt

SEQ ID NO: 3345228 - DNA, 12 bp, Homo sapiens
tttttctttcac

SEQ ID NO: 3345229 - DNA, 21 bp, Homo sapiens
tttttcttttcggaaatctta

SEQ ID NO: 3345230 - DNA, 23 bp, Homo sapiens
tttttctttttaaccctaatctt

SEQ ID NO: 3345231 - DNA, 19 bp, Homo sapiens
tttttgaaacccacagttt

SEQ ID NO: 3345232 - DNA, 17 bp, Homo sapiens
tttttgaaatgaaattt

SEQ ID NO: 3345233 - DNA, 23 bp, Homo sapiens
tttttgaactaagaaacttttgt

SEQ ID NO: 3345234 - DNA, 16 bp, Homo sapiens
tttttgagtcaaagac

SEQ ID NO: 3345235 - DNA, 14 bp, Homo sapiens
tttttgcagtaact

SEQ ID NO: 3345236 - DNA, 21 bp, Homo sapiens
tttttgcatgatatcttcaag

SEQ ID NO: 3345237 - DNA, 19 bp, Homo sapiens
tttttgcatgcatgcaaat

SEQ ID NO: 3345238 - DNA, 17 bp, Homo sapiens
tttttgccagactctag

SEQ ID NO: 3345239 - DNA, 11 bp, Homo sapiens
tttttgctata

SEQ ID NO: 3345240 - DNA, 12 bp, Homo sapiens
tttttgcttttg

SEQ ID NO: 3345241 - DNA, 15 bp, Homo sapiens
tttttggaggtgctt

SEQ ID NO: 3345242 - DNA, 23 bp, Homo sapiens
tttttggcctgtttgatgtatgt

SEQ ID NO: 3345243 - DNA, 20 bp, Homo sapiens
tttttggtataatgtttaaa

SEQ ID NO: 3345244 - DNA, 17 bp, Homo sapiens
tttttggtggatgtaaa

SEQ ID NO: 3345245 - DNA, 18 bp, Homo sapiens
tttttggtggatgtaaat

SEQ ID NO: 3345246 - DNA, 22 bp, Homo sapiens
tttttggtgtatagaagtttgt

SEQ ID NO: 3345247 - DNA, 14 bp, Homo sapiens
tttttggttgggaa

SEQ ID NO: 3345248 - DNA, 15 bp, Homo sapiens
tttttgtaaactgga

SEQ ID NO: 3345249 - DNA, 12 bp, Homo sapiens
tttttgtaaata

SEQ ID NO: 3345250 - DNA, 12 bp, Homo sapiens
tttttgtaacta

SEQ ID NO: 3345251 - DNA, 13 bp, Homo sapiens
tttttgtacttga

SEQ ID NO: 3345252 - DNA, 12 bp, Homo sapiens
tttttgtacttt

SEQ ID NO: 3345253 - DNA, 19 bp, Homo sapiens
tttttgtagagccagggtc

SEQ ID NO: 3345254 - DNA, 20 bp, Homo sapiens
tttttgtagagccagggtct

SEQ ID NO: 3345255 - DNA, 20 bp, Homo sapiens
tttttgtagtgacctgttta

SEQ ID NO: 3345256 - DNA, 22 bp, Homo sapiens
tttttgtgttttgttctttaaa

SEQ ID NO: 3345257 - DNA, 22 bp, Homo sapiens
tttttgttccacaagttaaata

SEQ ID NO: 3345258 - DNA, 15 bp, Homo sapiens
tttttgtttgtttgt

SEQ ID NO: 3345259 - DNA, 13 bp, Homo sapiens
ttttttaaagcaa

SEQ ID NO: 3345260 - DNA, 22 bp, Homo sapiens
ttttttactcattgaaatgtca

SEQ ID NO: 3345261 - DNA, 13 bp, Homo sapiens
ttttttatgctaa

SEQ ID NO: 3345262 - DNA, 12 bp, Homo sapiens
ttttttcaatat

SEQ ID NO: 3345263 - DNA, 13 bp, Homo sapiens
ttttttccaaaac

SEQ ID NO: 3345264 - DNA, 12 bp, Homo sapiens
ttttttccaaag

SEQ ID NO: 3345265 - DNA, 22 bp, Homo sapiens
ttttttccatctttacaaaact

SEQ ID NO: 3345266 - DNA, 12 bp, Homo sapiens
ttttttcctaag

SEQ ID NO: 3345267 - DNA, 13 bp, Homo sapiens
ttttttcgtttgt

SEQ ID NO: 3345268 - DNA, 12 bp, Homo sapiens
ttttttctaaga

SEQ ID NO: 3345269 - DNA, 9 bp, Homo sapiens
ttttttgaa

SEQ ID NO: 3345270 - DNA, 12 bp, Homo sapiens
ttttttgaaaac

SEQ ID NO: 3345271 - DNA, 13 bp, Homo sapiens
ttttttgaaacag

SEQ ID NO: 3345272 - DNA, 17 bp, Homo sapiens
ttttttgagagagagtc

SEQ ID NO: 3345273 - DNA, 13 bp, Homo sapiens
ttttttgtaacta

SEQ ID NO: 3345274 - DNA, 17 bp, Homo sapiens
ttttttgtcttattgaa

SEQ ID NO: 3345275 - DNA, 13 bp, Homo sapiens
tttttttaaaatc

SEQ ID NO: 3345276 - DNA, 12 bp, Homo sapiens
tttttttcagtt

SEQ ID NO: 3345277 - DNA, 12 bp, Homo sapiens
tttttttcttta

SEQ ID NO: 3345278 - DNA, 13 bp, Homo sapiens
ttttttttccaaa

SEQ ID NO: 3345279 - DNA, 13 bp, Homo sapiens
ttttttttttcct

SEQ ID NO: 3345280 - DNA, 13 bp, Homo sapiens
ttttttttttggt

SEQ ID NO: 3345281 - DNA, 21 bp, Homo sapiens
tttcattacaatggaaacaat

SEQ ID NO: 3345282 - DNA, 20 bp, Homo sapiens
tttcattacttttaaaaatg

SEQ ID NO: 3345283 - DNA, 15 bp, Homo sapiens
tttcattatcatcaa

SEQ ID NO: 3345284 - DNA, 15 bp, Homo sapiens
tttcattcatcccat

SEQ ID NO: 3345285 - DNA, 21 bp, Homo sapiens
tttcattccttcagatttggc

SEQ ID NO: 3345286 - DNA, 13 bp, Homo sapiens
tttcattgccagt

SEQ ID NO: 3345287 - DNA, 18 bp, Homo sapiens
tttcattgccagtgtctt

SEQ ID NO: 3345288 - DNA, 21 bp, Homo sapiens
tttcattggatttttgttaat

SEQ ID NO: 3345289 - DNA, 20 bp, Homo sapiens
tttcattgtatgatgtgttg

SEQ ID NO: 3345290 - DNA, 19 bp, Homo sapiens
tttcatttagtcatgtgac

SEQ ID NO: 3345291 - DNA, 14 bp, Homo sapiens
tttcatttatctat

SEQ ID NO: 3345292 - DNA, 22 bp, Homo sapiens
tttcatttcttacgttctttca

SEQ ID NO: 3345293 - DNA, 17 bp, Homo sapiens
tttcatttgtacaaggt

SEQ ID NO: 3345294 - DNA, 19 bp, Homo sapiens
tttcatttgtacaaggtaa

SEQ ID NO: 3345295 - DNA, 20 bp, Homo sapiens
tttcatttgtacaaggtaat

SEQ ID NO: 3345296 - DNA, 14 bp, Homo sapiens
tttcattttaaaaa

SEQ ID NO: 3345297 - DNA, 17 bp, Homo sapiens
tttcattttaaaaagtc

SEQ ID NO: 3345298 - DNA, 20 bp, Homo sapiens
tttcattttttgcatcagta

SEQ ID NO: 3345299 - DNA, 21 bp, Homo sapiens
tttccaaaacaatttcttttt

SEQ ID NO: 3345300 - DNA, 21 bp, Homo sapiens
tttccaaaacatttctggaca

SEQ ID NO: 3345301 - DNA, 16 bp, Homo sapiens
tttccaaactgactca

SEQ ID NO: 3345302 - DNA, 22 bp, Homo sapiens
tttccaacacacacaacgtaaa

SEQ ID NO: 3345303 - DNA, 15 bp, Homo sapiens
tttccaacaccacag

SEQ ID NO: 3345304 - DNA, 18 bp, Homo sapiens
tttccaactactaataga

SEQ ID NO: 3345305 - DNA, 19 bp, Homo sapiens
tttccaactactaatagaa

SEQ ID NO: 3345306 - DNA, 17 bp, Homo sapiens
tttccaactggcactct

SEQ ID NO: 3345307 - DNA, 15 bp, Homo sapiens
tttccaacttgtctg

SEQ ID NO: 3345308 - DNA, 18 bp, Homo sapiens
tttccaacttgtctggga

SEQ ID NO: 3345309 - DNA, 14 bp, Homo sapiens
tttccaagctcctt

SEQ ID NO: 3345310 - DNA, 18 bp, Homo sapiens
tttccaagtaatataatg

SEQ ID NO: 3345311 - DNA, 14 bp, Homo sapiens
tttccaatgtgttc

SEQ ID NO: 3345312 - DNA, 19 bp, Homo sapiens
tttccacaaaatctgtcca

SEQ ID NO: 3345313 - DNA, 19 bp, Homo sapiens
tttccaccacagccagcac

SEQ ID NO: 3345314 - DNA, 23 bp, Homo sapiens
tttccactttcatctggggtggg

SEQ ID NO: 3345315 - DNA, 21 bp, Homo sapiens
tttccagaaccacacttgaaa

SEQ ID NO: 3345316 - DNA, 11 bp, Homo sapiens
tttccagcctc

SEQ ID NO: 3345317 - DNA, 12 bp, Homo sapiens
tttccagtgcaa

SEQ ID NO: 3345318 - DNA, 17 bp, Homo sapiens
tttccagttcctctttt

SEQ ID NO: 3345319 - DNA, 16 bp, Homo sapiens
tttccatcatttctgt

SEQ ID NO: 3345320 - DNA, 14 bp, Homo sapiens
tttccattccagaa

SEQ ID NO: 3345321 - DNA, 13 bp, Homo sapiens
tttccatttctga

SEQ ID NO: 3345322 - DNA, 18 bp, Homo sapiens
tttccatttctgatgtct

SEQ ID NO: 3345323 - DNA, 23 bp, Homo sapiens
tttcccaatctctacccctttct

SEQ ID NO: 3345324 - DNA, 14 bp, Homo sapiens
tttcccacatcttt

SEQ ID NO: 3345325 - DNA, 21 bp, Homo sapiens
tttcccactgtttaaggagtt

SEQ ID NO: 3345326 - DNA, 16 bp, Homo sapiens
tttcccaggttctgtt

SEQ ID NO: 3345327 - DNA, 17 bp, Homo sapiens
tttcccatcatcctttg

SEQ ID NO: 3345328 - DNA, 16 bp, Homo sapiens
tttcccatggggaggg

SEQ ID NO: 3345329 - DNA, 19 bp, Homo sapiens
tttccccactaataaagtg

SEQ ID NO: 3345330 - DNA, 13 bp, Homo sapiens
tttccccagccca

SEQ ID NO: 3345331 - DNA, 19 bp, Homo sapiens
tttccccaggggaaaatga

SEQ ID NO: 3345332 - DNA, 21 bp, Homo sapiens
tttccccaggggaaaatgaag

SEQ ID NO: 3345333 - DNA, 19 bp, Homo sapiens
tttccccccactctcccca

SEQ ID NO: 3345334 - DNA, 13 bp, Homo sapiens
tttccccctcctc

SEQ ID NO: 3345335 - DNA, 20 bp, Homo sapiens
tttccccgggggaggaaggg

SEQ ID NO: 3345336 - DNA, 14 bp, Homo sapiens
tttcccctctctgc

SEQ ID NO: 3345337 - DNA, 14 bp, Homo sapiens
tttcccctggcctc

SEQ ID NO: 3345338 - DNA, 23 bp, Homo sapiens
tttcccctgtcctgatggtcagc

SEQ ID NO: 3345339 - DNA, 21 bp, Homo sapiens
tttcccctgtggggatctcag

SEQ ID NO: 3345340 - DNA, 15 bp, Homo sapiens
tttccccttcccctc

SEQ ID NO: 3345341 - DNA, 16 bp, Homo sapiens
tttccccttcccctcc

SEQ ID NO: 3345342 - DNA, 13 bp, Homo sapiens
tttccctaaaata

SEQ ID NO: 3345343 - DNA, 19 bp, Homo sapiens
tttccctaaaatacattta

SEQ ID NO: 3345344 - DNA, 23 bp, Homo sapiens
tttccctcaaatgcgcgtgtgca

SEQ ID NO: 3345345 - DNA, 13 bp, Homo sapiens
tttccctcaggtt

SEQ ID NO: 3345346 - DNA, 12 bp, Homo sapiens
tttccctgctga

SEQ ID NO: 3345347 - DNA, 22 bp, Homo sapiens
tttcccttaaatacagataatt

SEQ ID NO: 3345348 - DNA, 20 bp, Homo sapiens
tttcccttcagtaccctctc

SEQ ID NO: 3345349 - DNA, 16 bp, Homo sapiens
tttcccttcccttcca

SEQ ID NO: 3345350 - DNA, 12 bp, Homo sapiens
tttccgcccaca

SEQ ID NO: 3345351 - DNA, 17 bp, Homo sapiens
tttccggcacactgcca

SEQ ID NO: 3345352 - DNA, 18 bp, Homo sapiens
tttccggcacactgccaa

SEQ ID NO: 3345353 - DNA, 22 bp, Homo sapiens
tttccgtaataacacccttcct

SEQ ID NO: 3345354 - DNA, 23 bp, Homo sapiens
tttcctaaacataattgtggatt

SEQ ID NO: 3345355 - DNA, 22 bp, Homo sapiens
tttcctaatcagaaatttttat

SEQ ID NO: 3345356 - DNA, 18 bp, Homo sapiens
tttcctactgtcctcaga

SEQ ID NO: 3345357 - DNA, 19 bp, Homo sapiens
tttcctcagcttatctctt

SEQ ID NO: 3345358 - DNA, 19 bp, Homo sapiens
tttcctcatctttaaaatg

SEQ ID NO: 3345359 - DNA, 14 bp, Homo sapiens
tttcctcattttga

SEQ ID NO: 3345360 - DNA, 15 bp, Homo sapiens
tttcctccccctgca

SEQ ID NO: 3345361 - DNA, 15 bp, Homo sapiens
tttcctcccttgggt

SEQ ID NO: 3345362 - DNA, 18 bp, Homo sapiens
tttcctctatacatctct

SEQ ID NO: 3345363 - DNA, 20 bp, Homo sapiens
tttcctctattgatgtacag

SEQ ID NO: 3345364 - DNA, 23 bp, Homo sapiens
tttcctctctttgttctcagctc

SEQ ID NO: 3345365 - DNA, 23 bp, Homo sapiens
tttcctctgagttctgtacttca

SEQ ID NO: 3345366 - DNA, 13 bp, Homo sapiens
tttcctcttgtga

SEQ ID NO: 3345367 - DNA, 18 bp, Homo sapiens
tttcctgaaccatgtgga

SEQ ID NO: 3345368 - DNA, 23 bp, Homo sapiens
tttcctgacagaaggactcaggt

SEQ ID NO: 3345369 - DNA, 21 bp, Homo sapiens
tttcctgataaagcacagctg

SEQ ID NO: 3345370 - DNA, 16 bp, Homo sapiens
tttcctgccttcttct

SEQ ID NO: 3345371 - DNA, 20 bp, Homo sapiens
tttcctggacttaaagaaaa

SEQ ID NO: 3345372 - DNA, 19 bp, Homo sapiens
tttcctggccctccactcc

SEQ ID NO: 3345373 - DNA, 19 bp, Homo sapiens
tttcctggtgccaatttca

SEQ ID NO: 3345374 - DNA, 20 bp, Homo sapiens
tttcctgtacaatcatgaac

SEQ ID NO: 3345375 - DNA, 13 bp, Homo sapiens
tttcctgttcagc

SEQ ID NO: 3345376 - DNA, 13 bp, Homo sapiens
tttccttaatcca

SEQ ID NO: 3345377 - DNA, 14 bp, Homo sapiens
tttccttatttgct

SEQ ID NO: 3345378 - DNA, 14 bp, Homo sapiens
tttccttccatccc

SEQ ID NO: 3345379 - DNA, 14 bp, Homo sapiens
tttccttccctttt

SEQ ID NO: 3345380 - DNA, 20 bp, Homo sapiens
tttccttcccttttctgttc

SEQ ID NO: 3345381 - DNA, 12 bp, Homo sapiens
tttccttcctaa

SEQ ID NO: 3345382 - DNA, 15 bp, Homo sapiens
tttccttgtgcaaaa

SEQ ID NO: 3345383 - DNA, 19 bp, Homo sapiens
tttccttgtttatcagata

SEQ ID NO: 3345384 - DNA, 22 bp, Homo sapiens
tttcctttaaaaaaatttaagt

SEQ ID NO: 3345385 - DNA, 23 bp, Homo sapiens
tttcctttaaaaaaatttaagtg

SEQ ID NO: 3345386 - DNA, 20 bp, Homo sapiens
tttcctttccccagcccagg

SEQ ID NO: 3345387 - DNA, 9 bp, Homo sapiens
tttcctttg

SEQ ID NO: 3345388 - DNA, 13 bp, Homo sapiens
tttcctttgctct

SEQ ID NO: 3345389 - DNA, 12 bp, Homo sapiens
tttcctttggag

SEQ ID NO: 3345390 - DNA, 17 bp, Homo sapiens
tttcctttgtaatcact

SEQ ID NO: 3345391 - DNA, 21 bp, Homo sapiens
tttccttttaaaacacttcca

SEQ ID NO: 3345392 - DNA, 21 bp, Homo sapiens
tttccttttctattccttctg

SEQ ID NO: 3345393 - DNA, 22 bp, Homo sapiens
tttcctttttaatatgcttaaa

SEQ ID NO: 3345394 - DNA, 16 bp, Homo sapiens
tttcgactggtccagc

SEQ ID NO: 3345395 - DNA, 15 bp, Homo sapiens
tttcgttaacattga

SEQ ID NO: 3345396 - DNA, 19 bp, Homo sapiens
tttcgttaacattgaccaa

SEQ ID NO: 3345397 - DNA, 14 bp, Homo sapiens
tttcgttccctgat

SEQ ID NO: 3345398 - DNA, 19 bp, Homo sapiens
tttcgtttttcttggggta

SEQ ID NO: 3345399 - DNA, 15 bp, Homo sapiens
tttctaaaaagatta

SEQ ID NO: 3345400 - DNA, 20 bp, Homo sapiens
tttctaaaacattcccctcc

SEQ ID NO: 3345401 - DNA, 15 bp, Homo sapiens
tttctaaaagaatat

SEQ ID NO: 3345402 - DNA, 16 bp, Homo sapiens
tttctaaaagctttca

SEQ ID NO: 3345403 - DNA, 12 bp, Homo sapiens
tttctaaaatct

SEQ ID NO: 3345404 - DNA, 21 bp, Homo sapiens
tttctaaaatcttatagttct

SEQ ID NO: 3345405 - DNA, 23 bp, Homo sapiens
tttctaaacaagaaccatttgca

SEQ ID NO: 3345406 - DNA, 13 bp, Homo sapiens
tttctaaagaaat

SEQ ID NO: 3345407 - DNA, 17 bp, Homo sapiens
tttctaaagggatctgc

SEQ ID NO: 3345408 - DNA, 13 bp, Homo sapiens
tttctaaagtgtt

SEQ ID NO: 3345409 - DNA, 21 bp, Homo sapiens
tttctaaatgttggaatgtta

SEQ ID NO: 3345410 - DNA, 19 bp, Homo sapiens
tttctagaagtttcccttc

SEQ ID NO: 3345411 - DNA, 23 bp, Homo sapiens
tttctagaagtttcccttcctcc

SEQ ID NO: 3345412 - DNA, 19 bp, Homo sapiens
tttctagcaattttctttg

SEQ ID NO: 3345413 - DNA, 23 bp, Homo sapiens
tttctagtggtctttgtaagagt

SEQ ID NO: 3345414 - DNA, 15 bp, Homo sapiens
tttctagtttttaat

SEQ ID NO: 3345415 - DNA, 13 bp, Homo sapiens
tttctataaatca

SEQ ID NO: 3345416 - DNA, 20 bp, Homo sapiens
tttctataaatcagtatttt

SEQ ID NO: 3345417 - DNA, 16 bp, Homo sapiens
tttctataacctggat

SEQ ID NO: 3345418 - DNA, 14 bp, Homo sapiens
tttctatacaaata

SEQ ID NO: 3345419 - DNA, 15 bp, Homo sapiens
tttctatataaaatg

SEQ ID NO: 3345420 - DNA, 22 bp, Homo sapiens
tttctatcatggaatatttata

SEQ ID NO: 3345421 - DNA, 20 bp, Homo sapiens
tttctattaaatagttatat

SEQ ID NO: 3345422 - DNA, 15 bp, Homo sapiens
tttctattaatcatt

SEQ ID NO: 3345423 - DNA, 18 bp, Homo sapiens
tttctattccttctggcc

SEQ ID NO: 3345424 - DNA, 22 bp, Homo sapiens
tttctcaaaagcatttatcatt

SEQ ID NO: 3345425 - DNA, 14 bp, Homo sapiens
tttctcaaagtttt

SEQ ID NO: 3345426 - DNA, 23 bp, Homo sapiens
tttctcaccgcagtcgtcgcaca

SEQ ID NO: 3345427 - DNA, 16 bp, Homo sapiens
tttctcagttttcata

SEQ ID NO: 3345428 - DNA, 20 bp, Homo sapiens
tttctcataatgtgaaatat

SEQ ID NO: 3345429 - DNA, 12 bp, Homo sapiens
tttctcatactt

SEQ ID NO: 3345430 - DNA, 15 bp, Homo sapiens
tttctcatgtatctt

SEQ ID NO: 3345431 - DNA, 14 bp, Homo sapiens
tttctcattcttgt

SEQ ID NO: 3345432 - DNA, 14 bp, Homo sapiens
tttctccaaataaa

SEQ ID NO: 3345433 - DNA, 18 bp, Homo sapiens
tttctccagccagcaatg

SEQ ID NO: 3345434 - DNA, 15 bp, Homo sapiens
tttctccatctttat

SEQ ID NO: 3345435 - DNA, 15 bp, Homo sapiens
tttctccccctgggc

SEQ ID NO: 3345436 - DNA, 15 bp, Homo sapiens
tttctccctgttcct

SEQ ID NO: 3345437 - DNA, 16 bp, Homo sapiens
tttctcctcccttcct

SEQ ID NO: 3345438 - DNA, 14 bp, Homo sapiens
tttctctacactaa

SEQ ID NO: 3345439 - DNA, 14 bp, Homo sapiens
tttctctcagaaat

SEQ ID NO: 3345440 - DNA, 14 bp, Homo sapiens
tttctctcagtgaa

SEQ ID NO: 3345441 - DNA, 18 bp, Homo sapiens
tttctctctacagtgcca

SEQ ID NO: 3345442 - DNA, 18 bp, Homo sapiens
tttctctctcctctctgc

SEQ ID NO: 3345443 - DNA, 18 bp, Homo sapiens
tttctctgtacttttcat

SEQ ID NO: 3345444 - DNA, 13 bp, Homo sapiens
tttctctgtagtt

SEQ ID NO: 3345445 - DNA, 14 bp, Homo sapiens
tttctctgttgtaa

SEQ ID NO: 3345446 - DNA, 16 bp, Homo sapiens
tttctcttcatacttt

SEQ ID NO: 3345447 - DNA, 16 bp, Homo sapiens
tttctcttgagctggc

SEQ ID NO: 3345448 - DNA, 18 bp, Homo sapiens
tttctcttgagctggcct

SEQ ID NO: 3345449 - DNA, 23 bp, Homo sapiens
tttctctttgtctgccttcccaa

SEQ ID NO: 3345450 - DNA, 17 bp, Homo sapiens
tttctcttttgctttct

SEQ ID NO: 3345451 - DNA, 21 bp, Homo sapiens
tttctgaaaatgtttaagtat

SEQ ID NO: 3345452 - DNA, 18 bp, Homo sapiens
tttctgaaaattccagaa

SEQ ID NO: 3345453 - DNA, 21 bp, Homo sapiens
tttctgaaaattccagaaagg

SEQ ID NO: 3345454 - DNA, 23 bp, Homo sapiens
tttctgaaagatgagtaatttct

SEQ ID NO: 3345455 - DNA, 14 bp, Homo sapiens
tttctgaactgtta

SEQ ID NO: 3345456 - DNA, 15 bp, Homo sapiens
tttctgaactgttac

SEQ ID NO: 3345457 - DNA, 17 bp, Homo sapiens
tttctgaactgttacaa

SEQ ID NO: 3345458 - DNA, 14 bp, Homo sapiens
tttctgaaggaaga

SEQ ID NO: 3345459 - DNA, 19 bp, Homo sapiens
tttctgaaggtagcattct

SEQ ID NO: 3345460 - DNA, 19 bp, Homo sapiens
tttctgaagtacttaaact

SEQ ID NO: 3345461 - DNA, 18 bp, Homo sapiens
tttctgaattcaaagctt

SEQ ID NO: 3345462 - DNA, 13 bp, Homo sapiens
tttctgacagttt

SEQ ID NO: 3345463 - DNA, 16 bp, Homo sapiens
tttctgacatgcattg

SEQ ID NO: 3345464 - DNA, 15 bp, Homo sapiens
tttctgagaaaagaa

SEQ ID NO: 3345465 - DNA, 16 bp, Homo sapiens
tttctgagcacacttt

SEQ ID NO: 3345466 - DNA, 15 bp, Homo sapiens
tttctgagcccgggc

SEQ ID NO: 3345467 - DNA, 21 bp, Homo sapiens
tttctgatcagaggtgtacac

SEQ ID NO: 3345468 - DNA, 14 bp, Homo sapiens
tttctgatgtctcc

SEQ ID NO: 3345469 - DNA, 13 bp, Homo sapiens
tttctgcagaaat

SEQ ID NO: 3345470 - DNA, 17 bp, Homo sapiens
tttctgcatatgttgaa

SEQ ID NO: 3345471 - DNA, 22 bp, Homo sapiens
tttctgcatgaatatcatacaa

SEQ ID NO: 3345472 - DNA, 12 bp, Homo sapiens
tttctgccctgg

SEQ ID NO: 3345473 - DNA, 15 bp, Homo sapiens
tttctgccctggctg

SEQ ID NO: 3345474 - DNA, 22 bp, Homo sapiens
tttctgcctggagtgtatgact

SEQ ID NO: 3345475 - DNA, 22 bp, Homo sapiens
tttctgctctggaataaagttg

SEQ ID NO: 3345476 - DNA, 20 bp, Homo sapiens
tttctggaagggcagcatat

SEQ ID NO: 3345477 - DNA, 20 bp, Homo sapiens
tttctggaatacatgaaata

SEQ ID NO: 3345478 - DNA, 21 bp, Homo sapiens
tttctggactgaagcctgcag

SEQ ID NO: 3345479 - DNA, 18 bp, Homo sapiens
tttctggagtgaaccaga

SEQ ID NO: 3345480 - DNA, 16 bp, Homo sapiens
tttctggcctgccttc

SEQ ID NO: 3345481 - DNA, 16 bp, Homo sapiens
tttctgggataagtaa

SEQ ID NO: 3345482 - DNA, 14 bp, Homo sapiens
tttctggggcctag

SEQ ID NO: 3345483 - DNA, 15 bp, Homo sapiens
tttctgggtcttttg

SEQ ID NO: 3345484 - DNA, 24 bp, Homo sapiens
tttctggtgccatttctgaactgt

SEQ ID NO: 3345485 - DNA, 15 bp, Homo sapiens
tttctgtaccagtta

SEQ ID NO: 3345486 - DNA, 19 bp, Homo sapiens
tttctgtcacagtaaaaat

SEQ ID NO: 3345487 - DNA, 16 bp, Homo sapiens
tttctgtcagaatgct

SEQ ID NO: 3345488 - DNA, 20 bp, Homo sapiens
tttctgtcagatgagaacaa

SEQ ID NO: 3345489 - DNA, 23 bp, Homo sapiens
tttctgtcagatgagaacaaagc

SEQ ID NO: 3345490 - DNA, 23 bp, Homo sapiens
tttctgtccttttggcactgaga

SEQ ID NO: 3345491 - DNA, 13 bp, Homo sapiens
tttctgtgcccta

SEQ ID NO: 3345492 - DNA, 17 bp, Homo sapiens
tttctgtgcctgaatat

SEQ ID NO: 3345493 - DNA, 11 bp, Homo sapiens
tttctgtgtgc

SEQ ID NO: 3345494 - DNA, 22 bp, Homo sapiens
tttctgttccaaattcagtttc

SEQ ID NO: 3345495 - DNA, 15 bp, Homo sapiens
tttctgttgaagttt

SEQ ID NO: 3345496 - DNA, 14 bp, Homo sapiens
tttctgttgccaca

SEQ ID NO: 3345497 - DNA, 14 bp, Homo sapiens
tttctgttgtaact

SEQ ID NO: 3345498 - DNA, 20 bp, Homo sapiens
tttctgtttcttcttgtgat

SEQ ID NO: 3345499 - DNA, 14 bp, Homo sapiens
tttcttaaaagtac

SEQ ID NO: 3345500 - DNA, 15 bp, Homo sapiens
tttcttaaaagtact

SEQ ID NO: 3345501 - DNA, 13 bp, Homo sapiens
tttcttaaaccaa

SEQ ID NO: 3345502 - DNA, 21 bp, Homo sapiens
tttcttaaataatgcttcaga

SEQ ID NO: 3345503 - DNA, 22 bp, Homo sapiens
tttcttaaataatgcttcagat

SEQ ID NO: 3345504 - DNA, 13 bp, Homo sapiens
tttcttaaatata

SEQ ID NO: 3345505 - DNA, 13 bp, Homo sapiens
tttcttaaatctt

SEQ ID NO: 3345506 - DNA, 22 bp, Homo sapiens
tttcttaaatggaattattttg

SEQ ID NO: 3345507 - DNA, 18 bp, Homo sapiens
tttcttaaatttttcaac

SEQ ID NO: 3345508 - DNA, 14 bp, Homo sapiens
tttcttaacttctt

SEQ ID NO: 3345509 - DNA, 23 bp, Homo sapiens
tttcttaattattataaaaatat

SEQ ID NO: 3345510 - DNA, 16 bp, Homo sapiens
tttcttagagattaaa

SEQ ID NO: 3345511 - DNA, 14 bp, Homo sapiens
tttcttataaattt

SEQ ID NO: 3345512 - DNA, 21 bp, Homo sapiens
tttcttataatactctgttgt

SEQ ID NO: 3345513 - DNA, 22 bp, Homo sapiens
tttcttatgtgggtcttatgct

SEQ ID NO: 3345514 - DNA, 21 bp, Homo sapiens
tttcttcactgttgaaaatta

SEQ ID NO: 3345515 - DNA, 15 bp, Homo sapiens
tttcttcatccaact

SEQ ID NO: 3345516 - DNA, 19 bp, Homo sapiens
tttcttcatgcaatgacat

SEQ ID NO: 3345517 - DNA, 17 bp, Homo sapiens
tttcttcctaccaagtc

SEQ ID NO: 3345518 - DNA, 13 bp, Homo sapiens
tttcttcctcagc

SEQ ID NO: 3345519 - DNA, 14 bp, Homo sapiens
tttgggatgtctta

SEQ ID NO: 3345520 - DNA, 22 bp, Homo sapiens
tttgggatgtcttatttttaga

SEQ ID NO: 3345521 - DNA, 11 bp, Homo sapiens
tttgggcagag

SEQ ID NO: 3345522 - DNA, 15 bp, Homo sapiens
tttgggcccctcaga

SEQ ID NO: 3345523 - DNA, 17 bp, Homo sapiens
tttgggcccctcagagc

SEQ ID NO: 3345524 - DNA, 17 bp, Homo sapiens
tttggggaaaaaagcac

SEQ ID NO: 3345525 - DNA, 18 bp, Homo sapiens
tttggggaaacctagaga

SEQ ID NO: 3345526 - DNA, 23 bp, Homo sapiens
tttggggaagggtttgaattgtt

SEQ ID NO: 3345527 - DNA, 17 bp, Homo sapiens
tttggggcatcctggat

SEQ ID NO: 3345528 - DNA, 21 bp, Homo sapiens
tttgggggctcatttttgctg

SEQ ID NO: 3345529 - DNA, 21 bp, Homo sapiens
tttggggtacccactgctctg

SEQ ID NO: 3345530 - DNA, 16 bp, Homo sapiens
tttggggtctttgtgg

SEQ ID NO: 3345531 - DNA, 12 bp, Homo sapiens
tttgggttgacc

SEQ ID NO: 3345532 - DNA, 16 bp, Homo sapiens
tttggtaaaaatgctg

SEQ ID NO: 3345533 - DNA, 19 bp, Homo sapiens
tttggtagctgggaaagca

SEQ ID NO: 3345534 - DNA, 18 bp, Homo sapiens
tttggtataatgtttaaa

SEQ ID NO: 3345535 - DNA, 13 bp, Homo sapiens
tttggtatattac

SEQ ID NO: 3345536 - DNA, 12 bp, Homo sapiens
tttggtatttgc

SEQ ID NO: 3345537 - DNA, 13 bp, Homo sapiens
tttggtccaaaaa

SEQ ID NO: 3345538 - DNA, 22 bp, Homo sapiens
tttggtcgaggagtaacaatac

SEQ ID NO: 3345539 - DNA, 19 bp, Homo sapiens
tttggtgagagtcaaagct

SEQ ID NO: 3345540 - DNA, 15 bp, Homo sapiens
tttggtgcaaagtat

SEQ ID NO: 3345541 - DNA, 16 bp, Homo sapiens
tttggtgcatagaact

SEQ ID NO: 3345542 - DNA, 16 bp, Homo sapiens
tttggtggatgtaaat

SEQ ID NO: 3345543 - DNA, 18 bp, Homo sapiens
tttggtgtggattttcta

SEQ ID NO: 3345544 - DNA, 13 bp, Homo sapiens
tttggtgtgttcc

SEQ ID NO: 3345545 - DNA, 14 bp, Homo sapiens
tttggtgtgttccc

SEQ ID NO: 3345546 - DNA, 13 bp, Homo sapiens
tttggtgttcctg

SEQ ID NO: 3345547 - DNA, 19 bp, Homo sapiens
tttggttaagttggcttct

SEQ ID NO: 3345548 - DNA, 13 bp, Homo sapiens
tttggttcctctc

SEQ ID NO: 3345549 - DNA, 11 bp, Homo sapiens
tttggttctaa

SEQ ID NO: 3345550 - DNA, 18 bp, Homo sapiens
tttggtttatattcttat

SEQ ID NO: 3345551 - DNA, 19 bp, Homo sapiens
tttggtttatttttgtaat

SEQ ID NO: 3345552 - DNA, 9 bp, Homo sapiens
tttggtttt

SEQ ID NO: 3345553 - DNA, 14 bp, Homo sapiens
tttgtaaaaatctt

SEQ ID NO: 3345554 - DNA, 15 bp, Homo sapiens
tttgtaaaagacatt

SEQ ID NO: 3345555 - DNA, 17 bp, Homo sapiens
tttgtaaactaaggatt

SEQ ID NO: 3345556 - DNA, 17 bp, Homo sapiens
tttgtaaactcaaaata

SEQ ID NO: 3345557 - DNA, 15 bp, Homo sapiens
tttgtaaacttctga

SEQ ID NO: 3345558 - DNA, 22 bp, Homo sapiens
tttgtaaagaaatttactatat

SEQ ID NO: 3345559 - DNA, 22 bp, Homo sapiens
tttgtaaagttgcctttatttg

SEQ ID NO: 3345560 - DNA, 14 bp, Homo sapiens
tttgtaaataagag

SEQ ID NO: 3345561 - DNA, 22 bp, Homo sapiens
tttgtaaataagagatttggag

SEQ ID NO: 3345562 - DNA, 17 bp, Homo sapiens
tttgtaaatactgcttg

SEQ ID NO: 3345563 - DNA, 17 bp, Homo sapiens
tttgtaaatctgccaca

SEQ ID NO: 3345564 - DNA, 18 bp, Homo sapiens
tttgtaacctcagctctg

SEQ ID NO: 3345565 - DNA, 19 bp, Homo sapiens
tttgtaacctcagctctgg

SEQ ID NO: 3345566 - DNA, 21 bp, Homo sapiens
tttgtaagacatttgtatatt

SEQ ID NO: 3345567 - DNA, 16 bp, Homo sapiens
tttgtaagagtgtaga

SEQ ID NO: 3345568 - DNA, 19 bp, Homo sapiens
tttgtaagatatttgcagt

SEQ ID NO: 3345569 - DNA, 14 bp, Homo sapiens
tttgtaagtttcag

SEQ ID NO: 3345570 - DNA, 21 bp, Homo sapiens
tttgtaatgtgaaaagtatca

SEQ ID NO: 3345571 - DNA, 18 bp, Homo sapiens
tttgtaatgtgtgaaaaa

SEQ ID NO: 3345572 - DNA, 24 bp, Homo sapiens
tttgtaattaaattatggtattaa

SEQ ID NO: 3345573 - DNA, 12 bp, Homo sapiens
tttgtacactgc

SEQ ID NO: 3345574 - DNA, 15 bp, Homo sapiens
tttgtacactgctgt

SEQ ID NO: 3345575 - DNA, 16 bp, Homo sapiens
tttgtacactgctgta

SEQ ID NO: 3345576 - DNA, 14 bp, Homo sapiens
tttgtacagagtgc

SEQ ID NO: 3345577 - DNA, 18 bp, Homo sapiens
tttgtacaggactgtaaa

SEQ ID NO: 3345578 - DNA, 18 bp, Homo sapiens
tttgtacagtttgctgta

SEQ ID NO: 3345579 - DNA, 14 bp, Homo sapiens
tttgtacatattgt

SEQ ID NO: 3345580 - DNA, 13 bp, Homo sapiens
tttgtactgtaaa

SEQ ID NO: 3345581 - DNA, 19 bp, Homo sapiens
tttgtacttggaagtgttt

SEQ ID NO: 3345582 - DNA, 20 bp, Homo sapiens
tttgtactttatcatgaatg

SEQ ID NO: 3345583 - DNA, 15 bp, Homo sapiens
tttgtagagacaggg

SEQ ID NO: 3345584 - DNA, 15 bp, Homo sapiens
tttgtaggtaaaatg

SEQ ID NO: 3345585 - DNA, 20 bp, Homo sapiens
tttgtataaaagtgtgaaat

SEQ ID NO: 3345586 - DNA, 13 bp, Homo sapiens
tttgtataattgg

SEQ ID NO: 3345587 - DNA, 17 bp, Homo sapiens
tttgtatacatcctggg

SEQ ID NO: 3345588 - DNA, 19 bp, Homo sapiens
tttgtatacatcctgggta

SEQ ID NO: 3345589 - DNA, 20 bp, Homo sapiens
tttgtatacatcctgggtaa

SEQ ID NO: 3345590 - DNA, 16 bp, Homo sapiens
tttgtatatacagtta

SEQ ID NO: 3345591 - DNA, 12 bp, Homo sapiens
tttgtatattgt

SEQ ID NO: 3345592 - DNA, 20 bp, Homo sapiens
tttgtatctctgaagcatgt

SEQ ID NO: 3345593 - DNA, 14 bp, Homo sapiens
tttgtatcttcctt

SEQ ID NO: 3345594 - DNA, 16 bp, Homo sapiens
tttgtatctttatgct

SEQ ID NO: 3345595 - DNA, 17 bp, Homo sapiens
tttgtatgagatggtta

SEQ ID NO: 3345596 - DNA, 15 bp, Homo sapiens
tttgtatgtgtgggt

SEQ ID NO: 3345597 - DNA, 18 bp, Homo sapiens
tttgtatgttatgaacat

SEQ ID NO: 3345598 - DNA, 11 bp, Homo sapiens
tttgtattaat

SEQ ID NO: 3345599 - DNA, 12 bp, Homo sapiens
tttgtattaata

SEQ ID NO: 3345600 - DNA, 18 bp, Homo sapiens
tttgtattaataaagcat

SEQ ID NO: 3345601 - DNA, 21 bp, Homo sapiens
tttgtattctttactaaagat

SEQ ID NO: 3345602 - DNA, 21 bp, Homo sapiens
tttgtattttcatgaaaatac

SEQ ID NO: 3345603 - DNA, 14 bp, Homo sapiens
tttgtatttttaat

SEQ ID NO: 3345604 - DNA, 20 bp, Homo sapiens
tttgtattttttatttacat

SEQ ID NO: 3345605 - DNA, 17 bp, Homo sapiens
tttgtcaaactgtagaa

SEQ ID NO: 3345606 - DNA, 11 bp, Homo sapiens
tttgtcaatga

SEQ ID NO: 3345607 - DNA, 17 bp, Homo sapiens
tttgtcaatgacagttt

SEQ ID NO: 3345608 - DNA, 23 bp, Homo sapiens
tttgtcacaatcctaacacatta

SEQ ID NO: 3345609 - DNA, 20 bp, Homo sapiens
tttgtcacattatttattaa

SEQ ID NO: 3345610 - DNA, 21 bp, Homo sapiens
tttgtcacattatttattaaa

SEQ ID NO: 3345611 - DNA, 15 bp, Homo sapiens
tttgtcagtatggct

SEQ ID NO: 3345612 - DNA, 19 bp, Homo sapiens
tttgtcatcagatggaaat

SEQ ID NO: 3345613 - DNA, 22 bp, Homo sapiens
tttgtcatcagatggaaatatt

SEQ ID NO: 3345614 - DNA, 22 bp, Homo sapiens
tttgtcatgctgggatttccaa

SEQ ID NO: 3345615 - DNA, 16 bp, Homo sapiens
tttgtcattttatgaa

SEQ ID NO: 3345616 - DNA, 13 bp, Homo sapiens
tttgtccatttgt

SEQ ID NO: 3345617 - DNA, 16 bp, Homo sapiens
tttgtccccagggccc

SEQ ID NO: 3345618 - DNA, 20 bp, Homo sapiens
tttgtccccagggcccctcc

SEQ ID NO: 3345619 - DNA, 17 bp, Homo sapiens
tttgtcctaaaacacct

SEQ ID NO: 3345620 - DNA, 14 bp, Homo sapiens
tttgtctatgaagt

SEQ ID NO: 3345621 - DNA, 18 bp, Homo sapiens
tttgtctatgaagttgct

SEQ ID NO: 3345622 - DNA, 22 bp, Homo sapiens
tttgtctctccttttcttttgt

SEQ ID NO: 3345623 - DNA, 14 bp, Homo sapiens
tttgtctgaaaaat

SEQ ID NO: 3345624 - DNA, 13 bp, Homo sapiens
tttgtctgtcgtg

SEQ ID NO: 3345625 - DNA, 16 bp, Homo sapiens
tttgtctgtgttgctg

SEQ ID NO: 3345626 - DNA, 20 bp, Homo sapiens
tttgtctgtgttgctgttta

SEQ ID NO: 3345627 - DNA, 23 bp, Homo sapiens
tttgtcttatcccccccagcctg

SEQ ID NO: 3345628 - DNA, 15 bp, Homo sapiens
tttgtcttattctta

SEQ ID NO: 3345629 - DNA, 16 bp, Homo sapiens
tttgtcttattcttaa

SEQ ID NO: 3345630 - DNA, 12 bp, Homo sapiens
tttgtcttgtac

SEQ ID NO: 3345631 - DNA, 20 bp, Homo sapiens
tttgtcttgtacttctgtgt

SEQ ID NO: 3345632 - DNA, 23 bp, Homo sapiens
tttgtcttgtacttctgtgttca

SEQ ID NO: 3345633 - DNA, 22 bp, Homo sapiens
tttgtgaaatgatggtgaaagt

SEQ ID NO: 3345634 - DNA, 14 bp, Homo sapiens
tttgtgactatata

SEQ ID NO: 3345635 - DNA, 22 bp, Homo sapiens
tttgtgactatatagagatgtt

SEQ ID NO: 3345636 - DNA, 16 bp, Homo sapiens
tttgtgagcctatgat

SEQ ID NO: 3345637 - DNA, 14 bp, Homo sapiens
tttgtgataattta

SEQ ID NO: 3345638 - DNA, 15 bp, Homo sapiens
tttgtgatgaataaa

SEQ ID NO: 3345639 - DNA, 22 bp, Homo sapiens
tttgtgatgaataaaataatta

SEQ ID NO: 3345640 - DNA, 17 bp, Homo sapiens
tttgtgatgatgctgtg

SEQ ID NO: 3345641 - DNA, 15 bp, Homo sapiens
tttgtgattcaatct

SEQ ID NO: 3345642 - DNA, 13 bp, Homo sapiens
tttgtgcattctg

SEQ ID NO: 3345643 - DNA, 18 bp, Homo sapiens
tttgtgcattctttggta

SEQ ID NO: 3345644 - DNA, 20 bp, Homo sapiens
tttgtgcctggcttctttct

SEQ ID NO: 3345645 - DNA, 20 bp, Homo sapiens
tttgtgctagaaattttcaa

SEQ ID NO: 3345646 - DNA, 23 bp, Homo sapiens
tttgtgctatcagactgtaggat

SEQ ID NO: 3345647 - DNA, 21 bp, Homo sapiens
tttgtgctcatttaagtttca

SEQ ID NO: 3345648 - DNA, 21 bp, Homo sapiens
tttgtgctccattttttcttc

SEQ ID NO: 3345649 - DNA, 21 bp, Homo sapiens
ttgcttgaacacagtattttc

SEQ ID NO: 3345650 - DNA, 15 bp, Homo sapiens
ttgcttgccgagcct

SEQ ID NO: 3345651 - DNA, 18 bp, Homo sapiens
ttgcttggaaattccttg

SEQ ID NO: 3345652 - DNA, 23 bp, Homo sapiens
ttgctttaatgtgtattgaagaa

SEQ ID NO: 3345653 - DNA, 16 bp, Homo sapiens
ttgctttaattaatta

SEQ ID NO: 3345654 - DNA, 10 bp, Homo sapiens
ttgctttcct

SEQ ID NO: 3345655 - DNA, 14 bp, Homo sapiens
ttgcttttaattaa

SEQ ID NO: 3345656 - DNA, 17 bp, Homo sapiens
ttgcttttattttgaaa

SEQ ID NO: 3345657 - DNA, 20 bp, Homo sapiens
ttgcttttggcaaaactcta

SEQ ID NO: 3345658 - DNA, 13 bp, Homo sapiens
ttgcttttttgta

SEQ ID NO: 3345659 - DNA, 21 bp, Homo sapiens
ttggaaaaatgggtcttttat

SEQ ID NO: 3345660 - DNA, 14 bp, Homo sapiens
ttggaaaaatgttt

SEQ ID NO: 3345661 - DNA, 16 bp, Homo sapiens
ttggaaactgctaaat

SEQ ID NO: 3345662 - DNA, 14 bp, Homo sapiens
ttggaaagagacca

SEQ ID NO: 3345663 - DNA, 21 bp, Homo sapiens
ttggaaagatgttaagcattt

SEQ ID NO: 3345664 - DNA, 22 bp, Homo sapiens
ttggaaagtacactctgctgtt

SEQ ID NO: 3345665 - DNA, 12 bp, Homo sapiens
ttggaaagtcag

SEQ ID NO: 3345666 - DNA, 14 bp, Homo sapiens
ttggaaagtcagaa

SEQ ID NO: 3345667 - DNA, 24 bp, Homo sapiens
ttggaaatcctagtttcctctcct

SEQ ID NO: 3345668 - DNA, 21 bp, Homo sapiens
ttggaaatggatgcaaagtac

SEQ ID NO: 3345669 - DNA, 16 bp, Homo sapiens
ttggaacaaagtgaag

SEQ ID NO: 3345670 - DNA, 22 bp, Homo sapiens
ttggaacattggaatgttctca

SEQ ID NO: 3345671 - DNA, 16 bp, Homo sapiens
ttggaactctgcttga

SEQ ID NO: 3345672 - DNA, 19 bp, Homo sapiens
ttggaagaaaaaaatcttc

SEQ ID NO: 3345673 - DNA, 14 bp, Homo sapiens
ttggaatatttgaa

SEQ ID NO: 3345674 - DNA, 21 bp, Homo sapiens
ttggaatgactataaacatta

SEQ ID NO: 3345675 - DNA, 11 bp, Homo sapiens
ttggaatgtta

SEQ ID NO: 3345676 - DNA, 17 bp, Homo sapiens
ttggaatgttctcagat

SEQ ID NO: 3345677 - DNA, 17 bp, Homo sapiens
ttggaattaacctggtg

SEQ ID NO: 3345678 - DNA, 15 bp, Homo sapiens
ttggaattgtcttta

SEQ ID NO: 3345679 - DNA, 21 bp, Homo sapiens
ttggaatttgtaacctcagct

SEQ ID NO: 3345680 - DNA, 20 bp, Homo sapiens
ttggacaaacctagaatttt

SEQ ID NO: 3345681 - DNA, 15 bp, Homo sapiens
ttggacactgtacaa

SEQ ID NO: 3345682 - DNA, 13 bp, Homo sapiens
ttggacagccccc

SEQ ID NO: 3345683 - DNA, 15 bp, Homo sapiens
ttggacagccccctt

SEQ ID NO: 3345684 - DNA, 16 bp, Homo sapiens
ttggacatagatattt

SEQ ID NO: 3345685 - DNA, 18 bp, Homo sapiens
ttggacattttcttcaga

SEQ ID NO: 3345686 - DNA, 15 bp, Homo sapiens
ttggaccccagctgg

SEQ ID NO: 3345687 - DNA, 17 bp, Homo sapiens
ttggaccccagctggga

SEQ ID NO: 3345688 - DNA, 19 bp, Homo sapiens
ttggacctaaatggcctca

SEQ ID NO: 3345689 - DNA, 21 bp, Homo sapiens
ttggacctaaatggcctcatg

SEQ ID NO: 3345690 - DNA, 13 bp, Homo sapiens
ttggacggcctga

SEQ ID NO: 3345691 - DNA, 17 bp, Homo sapiens
ttggactaaatgcctag

SEQ ID NO: 3345692 - DNA, 23 bp, Homo sapiens
ttggactaaatgcctagttttta

SEQ ID NO: 3345693 - DNA, 16 bp, Homo sapiens
ttggactcttgctctt

SEQ ID NO: 3345694 - DNA, 14 bp, Homo sapiens
ttggactgacattt

SEQ ID NO: 3345695 - DNA, 15 bp, Homo sapiens
ttggactgacattta

SEQ ID NO: 3345696 - DNA, 14 bp, Homo sapiens
ttggactttcaaaa

SEQ ID NO: 3345697 - DNA, 15 bp, Homo sapiens
ttggagactctgtgg

SEQ ID NO: 3345698 - DNA, 11 bp, Homo sapiens
ttggagactga

SEQ ID NO: 3345699 - DNA, 15 bp, Homo sapiens
ttggagcacaaaatt

SEQ ID NO: 3345700 - DNA, 21 bp, Homo sapiens
ttggagcacaaaattcaaagc

SEQ ID NO: 3345701 - DNA, 22 bp, Homo sapiens
ttggagcaggcaaaaaagggac

SEQ ID NO: 3345702 - DNA, 20 bp, Homo sapiens
ttggagccactcctgtcccg

SEQ ID NO: 3345703 - DNA, 20 bp, Homo sapiens
ttggagccccaggggacaag

SEQ ID NO: 3345704 - DNA, 11 bp, Homo sapiens
ttggagctgac

SEQ ID NO: 3345705 - DNA, 15 bp, Homo sapiens
ttgcagaagagggtg

SEQ ID NO: 3345706 - DNA, 21 bp, Homo sapiens
ttgcagaagagggtgtgtttg

SEQ ID NO: 3345707 - DNA, 20 bp, Homo sapiens
ttgcagacgggcaagaagct

SEQ ID NO: 3345708 - DNA, 19 bp, Homo sapiens
ttgcagactcagtttgtca

SEQ ID NO: 3345709 - DNA, 17 bp, Homo sapiens
ttgcagcagataacttt

SEQ ID NO: 3345710 - DNA, 17 bp, Homo sapiens
ttgcaggctctgggctc

SEQ ID NO: 3345711 - DNA, 21 bp, Homo sapiens
ttgcagggctaaggcccccaa

SEQ ID NO: 3345712 - DNA, 23 bp, Homo sapiens
ttgcagggtcctcttctgggcct

SEQ ID NO: 3345713 - DNA, 23 bp, Homo sapiens
ttgcaggtaagtctggttttgtc

SEQ ID NO: 3345714 - DNA, 13 bp, Homo sapiens
ttgcagtacatca

SEQ ID NO: 3345715 - DNA, 19 bp, Homo sapiens
ttgcagtacatcaaaggaa

SEQ ID NO: 3345716 - DNA, 23 bp, Homo sapiens
ttgcagtcgtgtaattggcccaa

SEQ ID NO: 3345717 - DNA, 16 bp, Homo sapiens
ttgcagttcagcacca

SEQ ID NO: 3345718 - DNA, 19 bp, Homo sapiens
ttgcagttggactctcagg

SEQ ID NO: 3345719 - DNA, 15 bp, Homo sapiens
ttgcagtttttcatt

SEQ ID NO: 3345720 - DNA, 14 bp, Homo sapiens
ttgcataaagcata

SEQ ID NO: 3345721 - DNA, 13 bp, Homo sapiens
ttgcataagagct

SEQ ID NO: 3345722 - DNA, 16 bp, Homo sapiens
ttgcataagattaaag

SEQ ID NO: 3345723 - DNA, 18 bp, Homo sapiens
ttgcataatgcaatcaaa

SEQ ID NO: 3345724 - DNA, 19 bp, Homo sapiens
ttgcataatgcaatcaaaa

SEQ ID NO: 3345725 - DNA, 14 bp, Homo sapiens
ttgcatactgaaaa

SEQ ID NO: 3345726 - DNA, 17 bp, Homo sapiens
ttgcatactttgtattt

SEQ ID NO: 3345727 - DNA, 15 bp, Homo sapiens
ttgcatccattgttg

SEQ ID NO: 3345728 - DNA, 20 bp, Homo sapiens
ttgcatccattgttgtgtct

SEQ ID NO: 3345729 - DNA, 15 bp, Homo sapiens
ttgcatccttcctat

SEQ ID NO: 3345730 - DNA, 21 bp, Homo sapiens
ttgcatccttcctataacttg

SEQ ID NO: 3345731 - DNA, 17 bp, Homo sapiens
ttgcatctcaaaattat

SEQ ID NO: 3345732 - DNA, 11 bp, Homo sapiens
ttgcatgaaat

SEQ ID NO: 3345733 - DNA, 16 bp, Homo sapiens
ttgcatgaagagaagc

SEQ ID NO: 3345734 - DNA, 13 bp, Homo sapiens
ttgcatgatatct

SEQ ID NO: 3345735 - DNA, 16 bp, Homo sapiens
ttgcatgcatgcaaat

SEQ ID NO: 3345736 - DNA, 16 bp, Homo sapiens
ttgcatgtcgcacaat

SEQ ID NO: 3345737 - DNA, 13 bp, Homo sapiens
ttgcattaaattc

SEQ ID NO: 3345738 - DNA, 22 bp, Homo sapiens
ttgcattaaattcacaaacttt

SEQ ID NO: 3345739 - DNA, 13 bp, Homo sapiens
ttgcattcatttt

SEQ ID NO: 3345740 - DNA, 14 bp, Homo sapiens
ttgcattgaacaca

SEQ ID NO: 3345741 - DNA, 22 bp, Homo sapiens
ttgcattgaacacaaactgtaa

SEQ ID NO: 3345742 - DNA, 21 bp, Homo sapiens
ttgcattgaccgcgactaatt

SEQ ID NO: 3345743 - DNA, 15 bp, Homo sapiens
ttgcattgaggaaat

SEQ ID NO: 3345744 - DNA, 21 bp, Homo sapiens
ttgcattgaggaaatattaat

SEQ ID NO: 3345745 - DNA, 14 bp, Homo sapiens
ttgcatttactttt

SEQ ID NO: 3345746 - DNA, 16 bp, Homo sapiens
ttgcatttacttttaa

SEQ ID NO: 3345747 - DNA, 15 bp, Homo sapiens
ttgcatttatggtca

SEQ ID NO: 3345748 - DNA, 23 bp, Homo sapiens
ttgcatttatttatacagtgcct

SEQ ID NO: 3345749 - DNA, 15 bp, Homo sapiens
ttgcatttgctcttt

SEQ ID NO: 3345750 - DNA, 20 bp, Homo sapiens
ttgccaaaataccagagcct

SEQ ID NO: 3345751 - DNA, 22 bp, Homo sapiens
ttgccaaaataccagagccttc

SEQ ID NO: 3345752 - DNA, 14 bp, Homo sapiens
ttgccaactcttct

SEQ ID NO: 3345753 - DNA, 15 bp, Homo sapiens
ttgccaagaaaatga

SEQ ID NO: 3345754 - DNA, 21 bp, Homo sapiens
ttgccaagaaaatgaagggat

SEQ ID NO: 3345755 - DNA, 12 bp, Homo sapiens
ttgccaagacaa

SEQ ID NO: 3345756 - DNA, 13 bp, Homo sapiens
ttgccaagacaaa

SEQ ID NO: 3345757 - DNA, 16 bp, Homo sapiens
ttgccaagacaaatca

SEQ ID NO: 3345758 - DNA, 17 bp, Homo sapiens
ttgccaagacaaatcaa

SEQ ID NO: 3345759 - DNA, 24 bp, Homo sapiens
ttgccaagacaaatcaacagaagc

SEQ ID NO: 3345760 - DNA, 12 bp, Homo sapiens
ttgccaagcccc

SEQ ID NO: 3345761 - DNA, 16 bp, Homo sapiens
ttgccaagttgctgtc

SEQ ID NO: 3345762 - DNA, 22 bp, Homo sapiens
ttgccaagttgctgtcactgtt

SEQ ID NO: 3345763 - DNA, 20 bp, Homo sapiens
ttgccacaagtccagctggg

SEQ ID NO: 3345764 - DNA, 22 bp, Homo sapiens
ttgccacagctggagctctcaa

SEQ ID NO: 3345765 - DNA, 16 bp, Homo sapiens
ttgccacaggcctccc

SEQ ID NO: 3345766 - DNA, 19 bp, Homo sapiens
ttgccacaggcctccctgt

SEQ ID NO: 3345767 - DNA, 18 bp, Homo sapiens
ttgccacagtagaactgt

SEQ ID NO: 3345768 - DNA, 12 bp, Homo sapiens
ttgccacattta

SEQ ID NO: 3345769 - DNA, 13 bp, Homo sapiens
ttgccacatttct

SEQ ID NO: 3345770 - DNA, 18 bp, Homo sapiens
ttgccaccacctctgtgg

SEQ ID NO: 3345771 - DNA, 13 bp, Homo sapiens
ttgccaccaggag

SEQ ID NO: 3345772 - DNA, 15 bp, Homo sapiens
ttgccactgcctctt

SEQ ID NO: 3345773 - DNA, 17 bp, Homo sapiens
ttgccagaaagcataaa

SEQ ID NO: 3345774 - DNA, 24 bp, Homo sapiens
ttgccagactctaggttatacaat

SEQ ID NO: 3345775 - DNA, 12 bp, Homo sapiens
ttgccagctttt

SEQ ID NO: 3345776 - DNA, 18 bp, Homo sapiens
ttgccagcttttcctccc

SEQ ID NO: 3345777 - DNA, 22 bp, Homo sapiens
ttgccagcttttcctcccttgg

SEQ ID NO: 3345778 - DNA, 16 bp, Homo sapiens
ttgccaggacatgcaa

SEQ ID NO: 3345779 - DNA, 13 bp, Homo sapiens
ttgccaggggcat

SEQ ID NO: 3345780 - DNA, 19 bp, Homo sapiens
ttgccagtattatgcatat

SEQ ID NO: 3345781 - DNA, 16 bp, Homo sapiens
ttgccagtgtctttct

SEQ ID NO: 3345782 - DNA, 18 bp, Homo sapiens
ttgccagtgtctttcttt

SEQ ID NO: 3345783 - DNA, 22 bp, Homo sapiens
ttgccatgggcttcactgtata

SEQ ID NO: 3345784 - DNA, 16 bp, Homo sapiens
ttgccatgttggccag

SEQ ID NO: 3345785 - DNA, 18 bp, Homo sapiens
ttgccatgttggccaggc

SEQ ID NO: 3345786 - DNA, 17 bp, Homo sapiens
ttgccattggacagttg

SEQ ID NO: 3345787 - DNA, 18 bp, Homo sapiens
ttgccattggacagttgt

SEQ ID NO: 3345788 - DNA, 18 bp, Homo sapiens
ttgcccaacaccagcccc

SEQ ID NO: 3345789 - DNA, 19 bp, Homo sapiens
ttgcccaacaccagcccct

SEQ ID NO: 3345790 - DNA, 21 bp, Homo sapiens
ttgcccaacaccagcccctgc

SEQ ID NO: 3345791 - DNA, 13 bp, Homo sapiens
ttgcccagagcac

SEQ ID NO: 3345792 - DNA, 14 bp, Homo sapiens
ttgcccaggcaggt

SEQ ID NO: 3345793 - DNA, 18 bp, Homo sapiens
ttgcccaggcaggtcttg

SEQ ID NO: 3345794 - DNA, 14 bp, Homo sapiens
ttgcccaggctggc

SEQ ID NO: 3345795 - DNA, 18 bp, Homo sapiens
ttgcccaggctggtctca

SEQ ID NO: 3345796 - DNA, 15 bp, Homo sapiens
ttgcccatttacact

SEQ ID NO: 3345797 - DNA, 23 bp, Homo sapiens
ttgcccccacctctggtccacac

SEQ ID NO: 3345798 - DNA, 13 bp, Homo sapiens
ttgcccccatccc

SEQ ID NO: 3345799 - DNA, 14 bp, Homo sapiens
ttgcccccatccct

SEQ ID NO: 3345800 - DNA, 23 bp, Homo sapiens
ttgccccggccccggccccagcc

SEQ ID NO: 3345801 - DNA, 23 bp, Homo sapiens
ttgcccctggggcttccatccca

SEQ ID NO: 3345802 - DNA, 17 bp, Homo sapiens
ttgcccgcgctctttct

SEQ ID NO: 3345803 - DNA, 17 bp, Homo sapiens
ttgcccggattctggga

SEQ ID NO: 3345804 - DNA, 15 bp, Homo sapiens
ttgccctagcccaga

SEQ ID NO: 3345805 - DNA, 18 bp, Homo sapiens
ttgccctgacctcccagc

SEQ ID NO: 3345806 - DNA, 21 bp, Homo sapiens
ttgccctgacctcccagccct

SEQ ID NO: 3345807 - DNA, 17 bp, Homo sapiens
ttgcccttcacagtgtt

SEQ ID NO: 3345808 - DNA, 18 bp, Homo sapiens
ttgcccttcacagtgttt

SEQ ID NO: 3345809 - DNA, 11 bp, Homo sapiens
ttgcccttccc

SEQ ID NO: 3345810 - DNA, 16 bp, Homo sapiens
ttgcccttgccctgac

SEQ ID NO: 3345811 - DNA, 17 bp, Homo sapiens
ttgcccttgccctgacc

SEQ ID NO: 3345812 - DNA, 18 bp, Homo sapiens
ttgccgagcctaatgaaa

SEQ ID NO: 3345813 - DNA, 18 bp, Homo sapiens
ttgccgccgcgggtgtgc

SEQ ID NO: 3345814 - DNA, 15 bp, Homo sapiens
ttgccgtctaggatt

SEQ ID NO: 3345815 - DNA, 21 bp, Homo sapiens
ttgccgtctcatcttctctca

SEQ ID NO: 3345816 - DNA, 18 bp, Homo sapiens
ttgcctaaatttaatgct

SEQ ID NO: 3345817 - DNA, 19 bp, Homo sapiens
ttgcctaagcattgcctgg

SEQ ID NO: 3345818 - DNA, 19 bp, Homo sapiens
ttgcctctgtgctgtgtgt

SEQ ID NO: 3345819 - DNA, 21 bp, Homo sapiens
ttgcctgacaattgcaaatca

SEQ ID NO: 3345820 - DNA, 23 bp, Homo sapiens
ttgcctgcaacagagagaaaaag

SEQ ID NO: 3345821 - DNA, 16 bp, Homo sapiens
ttgcctggctgtggag

SEQ ID NO: 3345822 - DNA, 16 bp, Homo sapiens
ttgccttaaagaaagt

SEQ ID NO: 3345823 - DNA, 14 bp, Homo sapiens
ttgccttcccctgt

SEQ ID NO: 3345824 - DNA, 22 bp, Homo sapiens
ttgccttcctttctccaggacc

SEQ ID NO: 3345825 - DNA, 23 bp, Homo sapiens
ttgccttgcaattagcattctgt

SEQ ID NO: 3345826 - DNA, 20 bp, Homo sapiens
ttgccttgggctgctcctca

SEQ ID NO: 3345827 - DNA, 11 bp, Homo sapiens
ttgcctttctc

SEQ ID NO: 3345828 - DNA, 20 bp, Homo sapiens
ttgcctttctgggagcagaa

SEQ ID NO: 3345829 - DNA, 18 bp, Homo sapiens
ttgcctttcttctgccct

SEQ ID NO: 3345830 - DNA, 13 bp, Homo sapiens
ttgcctttgtggc

SEQ ID NO: 3345831 - DNA, 20 bp, Homo sapiens
ttgcgaatccaagctccctg

SEQ ID NO: 3345832 - DNA, 13 bp, Homo sapiens
ttgcgccactgca

SEQ ID NO: 3345833 - DNA, 21 bp, Homo sapiens
ttgcggccagtattagactgg

SEQ ID NO: 3345834 - DNA, 13 bp, Homo sapiens
ttcttgaaagctg

SEQ ID NO: 3345835 - DNA, 13 bp, Homo sapiens
ttcttgacaagct

SEQ ID NO: 3345836 - DNA, 23 bp, Homo sapiens
ttcttgacaagctgacttggcac

SEQ ID NO: 3345837 - DNA, 18 bp, Homo sapiens
ttcttgatcttaaagatc

SEQ ID NO: 3345838 - DNA, 16 bp, Homo sapiens
ttcttgatgttgctta

SEQ ID NO: 3345839 - DNA, 20 bp, Homo sapiens
ttcttgcatccttcctataa

SEQ ID NO: 3345840 - DNA, 16 bp, Homo sapiens
ttcttgcctctgtgct

SEQ ID NO: 3345841 - DNA, 17 bp, Homo sapiens
ttcttgcctctgtgctg

SEQ ID NO: 3345842 - DNA, 13 bp, Homo sapiens
ttcttgctagtat

SEQ ID NO: 3345843 - DNA, 13 bp, Homo sapiens
ttcttgctgctag

SEQ ID NO: 3345844 - DNA, 14 bp, Homo sapiens
ttcttgctgctaga

SEQ ID NO: 3345845 - DNA, 17 bp, Homo sapiens
ttcttgcttggaagcca

SEQ ID NO: 3345846 - DNA, 19 bp, Homo sapiens
ttcttggcaaaagccttgt

SEQ ID NO: 3345847 - DNA, 15 bp, Homo sapiens
ttcttggcccaggat

SEQ ID NO: 3345848 - DNA, 23 bp, Homo sapiens
ttcttgggcctcaggctctgcac

SEQ ID NO: 3345849 - DNA, 23 bp, Homo sapiens
ttcttggggtactcttgatgtga

SEQ ID NO: 3345850 - DNA, 14 bp, Homo sapiens
ttcttggtgctctg

SEQ ID NO: 3345851 - DNA, 17 bp, Homo sapiens
ttcttggtgctctgtgt

SEQ ID NO: 3345852 - DNA, 13 bp, Homo sapiens
ttcttgtatttat

SEQ ID NO: 3345853 - DNA, 14 bp, Homo sapiens
ttcttgtcaaaaaa

SEQ ID NO: 3345854 - DNA, 14 bp, Homo sapiens
ttcttgtcacaaat

SEQ ID NO: 3345855 - DNA, 17 bp, Homo sapiens
ttcttgtcagacataaa

SEQ ID NO: 3345856 - DNA, 22 bp, Homo sapiens
ttcttgtgccatagtcacatgg

SEQ ID NO: 3345857 - DNA, 22 bp, Homo sapiens
ttcttgtggtgtaaagctggcc

SEQ ID NO: 3345858 - DNA, 16 bp, Homo sapiens
ttctttaaaagaatga

SEQ ID NO: 3345859 - DNA, 22 bp, Homo sapiens
ttctttaaagaagttgaagttt

SEQ ID NO: 3345860 - DNA, 19 bp, Homo sapiens
ttctttaactgccgtaatt

SEQ ID NO: 3345861 - DNA, 12 bp, Homo sapiens
ttctttaatgct

SEQ ID NO: 3345862 - DNA, 14 bp, Homo sapiens
ttctttacctgaga

SEQ ID NO: 3345863 - DNA, 20 bp, Homo sapiens
ttctttacctgagaccagtt

SEQ ID NO: 3345864 - DNA, 17 bp, Homo sapiens
ttctttactattaaaat

SEQ ID NO: 3345865 - DNA, 16 bp, Homo sapiens
ttctttatactgtaat

SEQ ID NO: 3345866 - DNA, 13 bp, Homo sapiens
ttctttcagatgt

SEQ ID NO: 3345867 - DNA, 22 bp, Homo sapiens
ttctttcatctggggatgacaa

SEQ ID NO: 3345868 - DNA, 19 bp, Homo sapiens
ttctttccaaaacatttct

SEQ ID NO: 3345869 - DNA, 13 bp, Homo sapiens
ttctttcccagtg

SEQ ID NO: 3345870 - DNA, 11 bp, Homo sapiens
ttctttcctcc

SEQ ID NO: 3345871 - DNA, 18 bp, Homo sapiens
ttctttctagtggtcttt

SEQ ID NO: 3345872 - DNA, 23 bp, Homo sapiens
ttctttctctcagccttacattt

SEQ ID NO: 3345873 - DNA, 12 bp, Homo sapiens
ttctttctggac

SEQ ID NO: 3345874 - DNA, 13 bp, Homo sapiens
ttctttcttcctc

SEQ ID NO: 3345875 - DNA, 15 bp, Homo sapiens
ttctttctttcctta

SEQ ID NO: 3345876 - DNA, 11 bp, Homo sapiens
ttctttgaatg

SEQ ID NO: 3345877 - DNA, 18 bp, Homo sapiens
ttctttgatctggacaga

SEQ ID NO: 3345878 - DNA, 22 bp, Homo sapiens
ttctttgcttgaacacagtatt

SEQ ID NO: 3345879 - DNA, 20 bp, Homo sapiens
ttctttggagttaaaatgca

SEQ ID NO: 3345880 - DNA, 18 bp, Homo sapiens
ttctttggtgcctttcct

SEQ ID NO: 3345881 - DNA, 19 bp, Homo sapiens
ttctttggtgcctttcctg

SEQ ID NO: 3345882 - DNA, 16 bp, Homo sapiens
ttcttttacagactag

SEQ ID NO: 3345883 - DNA, 21 bp, Homo sapiens
ttcttttctggaatgtaatca

SEQ ID NO: 3345884 - DNA, 14 bp, Homo sapiens
ttcttttgtctccc

SEQ ID NO: 3345885 - DNA, 13 bp, Homo sapiens
ttcttttgttact

SEQ ID NO: 3345886 - DNA, 15 bp, Homo sapiens
ttcttttgttactgt

SEQ ID NO: 3345887 - DNA, 16 bp, Homo sapiens
ttcttttgttactgtt

SEQ ID NO: 3345888 - DNA, 21 bp, Homo sapiens
ttcttttgttactgttcttgc

SEQ ID NO: 3345889 - DNA, 13 bp, Homo sapiens
ttcttttgtttgg

SEQ ID NO: 3345890 - DNA, 14 bp, Homo sapiens
ttcttttgtttggt

SEQ ID NO: 3345891 - DNA, 16 bp, Homo sapiens
ttctttttaaaatggt

SEQ ID NO: 3345892 - DNA, 13 bp, Homo sapiens
ttctttttacagc

SEQ ID NO: 3345893 - DNA, 22 bp, Homo sapiens
ttctttttacagcattgtcttt

SEQ ID NO: 3345894 - DNA, 14 bp, Homo sapiens
ttctttttgctgtt

SEQ ID NO: 3345895 - DNA, 17 bp, Homo sapiens
ttcttttttaaattaat

SEQ ID NO: 3345896 - DNA, 20 bp, Homo sapiens
ttcttttttatcttgcactt

SEQ ID NO: 3345897 - DNA, 18 bp, Homo sapiens
ttcttttttttcattata

SEQ ID NO: 3345898 - DNA, 23 bp, Homo sapiens
ttctttttttttttttttgaaag

SEQ ID NO: 3345899 - DNA, 19 bp, Homo sapiens
ttgaaaaaatttaaaagta

SEQ ID NO: 3345900 - DNA, 21 bp, Homo sapiens
ttgaaaaaatttaaaagtaaa

SEQ ID NO: 3345901 - DNA, 17 bp, Homo sapiens
ttgaaaaagttccatag

SEQ ID NO: 3345902 - DNA, 20 bp, Homo sapiens
ttgaaaaagttccatagaaa

SEQ ID NO: 3345903 - DNA, 13 bp, Homo sapiens
ttgaaaaatactg

SEQ ID NO: 3345904 - DNA, 15 bp, Homo sapiens
ttgaaaaatctagtt

SEQ ID NO: 3345905 - DNA, 18 bp, Homo sapiens
ttgaaaaattatcagtta

SEQ ID NO: 3345906 - DNA, 12 bp, Homo sapiens
ttgaaaacacac

SEQ ID NO: 3345907 - DNA, 20 bp, Homo sapiens
ttgaaaacacactcaaaaga

SEQ ID NO: 3345908 - DNA, 13 bp, Homo sapiens
ttgaaaacttcaa

SEQ ID NO: 3345909 - DNA, 16 bp, Homo sapiens
ttgaaaacttcaaagc

SEQ ID NO: 3345910 - DNA, 13 bp, Homo sapiens
ttgaaaagctatt

SEQ ID NO: 3345911 - DNA, 14 bp, Homo sapiens
ttgaaaagctatta

SEQ ID NO: 3345912 - DNA, 22 bp, Homo sapiens
ttgaaaataacctaattaatat

SEQ ID NO: 3345913 - DNA, 20 bp, Homo sapiens
ttgaaaattcaaaaagtgtt

SEQ ID NO: 3345914 - DNA, 16 bp, Homo sapiens
ttgaaaattgaaaagt

SEQ ID NO: 3345915 - DNA, 18 bp, Homo sapiens
ttgaaaattttacttcca

SEQ ID NO: 3345916 - DNA, 13 bp, Homo sapiens
ttgaaacagaaaa

SEQ ID NO: 3345917 - DNA, 15 bp, Homo sapiens
ttgaaaccaggacat

SEQ ID NO: 3345918 - DNA, 16 bp, Homo sapiens
ttgaaaccaggacatt

SEQ ID NO: 3345919 - DNA, 13 bp, Homo sapiens
ttgaaacccacag

SEQ ID NO: 3345920 - DNA, 14 bp, Homo sapiens
ttgaaacccacagt

SEQ ID NO: 3345921 - DNA, 14 bp, Homo sapiens
ttgaaacctgctct

SEQ ID NO: 3345922 - DNA, 14 bp, Homo sapiens
ttgaaagaatagaa

SEQ ID NO: 3345923 - DNA, 15 bp, Homo sapiens
ttgaaagattcaggt

SEQ ID NO: 3345924 - DNA, 22 bp, Homo sapiens
ttgaaagattcaggtatgttgc

SEQ ID NO: 3345925 - DNA, 22 bp, Homo sapiens
ttgaaagattttattgtataaa

SEQ ID NO: 3345926 - DNA, 22 bp, Homo sapiens
ttgaaaggttttttttcagttg

SEQ ID NO: 3345927 - DNA, 23 bp, Homo sapiens
ttgaaagttttccagtattgaaa

SEQ ID NO: 3345928 - DNA, 16 bp, Homo sapiens
ttgaaataactggaac

SEQ ID NO: 3345929 - DNA, 17 bp, Homo sapiens
ttgaaatacctcatgtt

SEQ ID NO: 3345930 - DNA, 20 bp, Homo sapiens
ttgaaatacctttgtagtta

SEQ ID NO: 3345931 - DNA, 20 bp, Homo sapiens
ttgaaatatgtagtattaaa

SEQ ID NO: 3345932 - DNA, 14 bp, Homo sapiens
ttgaaatgaaattt

SEQ ID NO: 3345933 - DNA, 14 bp, Homo sapiens
ttgaaatgtcacgt

SEQ ID NO: 3345934 - DNA, 15 bp, Homo sapiens
ttgaaattactgtgt

SEQ ID NO: 3345935 - DNA, 16 bp, Homo sapiens
ttgaaattactgtgta

SEQ ID NO: 3345936 - DNA, 18 bp, Homo sapiens
ttgaaattatgtatgttt

SEQ ID NO: 3345937 - DNA, 19 bp, Homo sapiens
ttgaaattttgcaaatata

SEQ ID NO: 3345938 - DNA, 20 bp, Homo sapiens
ttgaaattttgcaaatataa

SEQ ID NO: 3345939 - DNA, 14 bp, Homo sapiens
ttgaacacaaactg

SEQ ID NO: 3345940 - DNA, 16 bp, Homo sapiens
ttgaaccattatactt

SEQ ID NO: 3345941 - DNA, 19 bp, Homo sapiens
ttgaaccattatactttat

SEQ ID NO: 3345942 - DNA, 22 bp, Homo sapiens
ttgaaccattatactttatatc

SEQ ID NO: 3345943 - DNA, 15 bp, Homo sapiens
ttgaacccctgtgtc

SEQ ID NO: 3345944 - DNA, 20 bp, Homo sapiens
ttgaacctttttttttgaaa

SEQ ID NO: 3345945 - DNA, 18 bp, Homo sapiens
ttgaactaagaaactttt

SEQ ID NO: 3345946 - DNA, 23 bp, Homo sapiens
ttgaactctgttcccccaccctc

SEQ ID NO: 3345947 - DNA, 20 bp, Homo sapiens
ttgaactggcaattgtctat

SEQ ID NO: 3345948 - DNA, 15 bp, Homo sapiens
ttgaactttgccaaa

SEQ ID NO: 3345949 - DNA, 16 bp, Homo sapiens
ttgaactttgccaaaa

SEQ ID NO: 3345950 - DNA, 17 bp, Homo sapiens
ttgaagaaacagagtgg

SEQ ID NO: 3345951 - DNA, 19 bp, Homo sapiens
ttgaagaaacagataccat

SEQ ID NO: 3345952 - DNA, 19 bp, Homo sapiens
ttgaagaaaggaacctggg

SEQ ID NO: 3345953 - DNA, 16 bp, Homo sapiens
ttgaagaactgcaggc

SEQ ID NO: 3345954 - DNA, 20 bp, Homo sapiens
ttgaagataataatcttggc

SEQ ID NO: 3345955 - DNA, 15 bp, Homo sapiens
ttgaagcagttgtgt

SEQ ID NO: 3345956 - DNA, 23 bp, Homo sapiens
ttgaagcatagataatattgttt

SEQ ID NO: 3345957 - DNA, 11 bp, Homo sapiens
ttgaagccaaa

SEQ ID NO: 3345958 - DNA, 14 bp, Homo sapiens
ttgaagccaaagaa

SEQ ID NO: 3345959 - DNA, 17 bp, Homo sapiens
ttgaagccgactctggc

SEQ ID NO: 3345960 - DNA, 19 bp, Homo sapiens
ttgaagccgactctggccc

SEQ ID NO: 3345961 - DNA, 21 bp, Homo sapiens
ttgaagcctgcccttgtctga

SEQ ID NO: 3345962 - DNA, 14 bp, Homo sapiens
ttgaagctgaaaat

SEQ ID NO: 3345963 - DNA, 14 bp, Homo sapiens
ttgaaggaaacagt

SEQ ID NO: 3345964 - DNA, 16 bp, Homo sapiens
ttgatttgttcttaca

SEQ ID NO: 3345965 - DNA, 21 bp, Homo sapiens
ttgattttgctgactttaaaa

SEQ ID NO: 3345966 - DNA, 16 bp, Homo sapiens
ttgattttggaaagat

SEQ ID NO: 3345967 - DNA, 20 bp, Homo sapiens
ttgatttttgcctcttccag

SEQ ID NO: 3345968 - DNA, 19 bp, Homo sapiens
ttgcaaaatagcatttgtt

SEQ ID NO: 3345969 - DNA, 15 bp, Homo sapiens
ttgcaaaatgagttg

SEQ ID NO: 3345970 - DNA, 11 bp, Homo sapiens
ttgcaaaattt

SEQ ID NO: 3345971 - DNA, 12 bp, Homo sapiens
ttgcaaagaact

SEQ ID NO: 3345972 - DNA, 12 bp, Homo sapiens
ttgcaaatcttg

SEQ ID NO: 3345973 - DNA, 17 bp, Homo sapiens
ttgcaaatcttgaaatt

SEQ ID NO: 3345974 - DNA, 19 bp, Homo sapiens
ttgcaacaggggaggaaaa

SEQ ID NO: 3345975 - DNA, 21 bp, Homo sapiens
ttgcaacaggggaggaaaaaa

SEQ ID NO: 3345976 - DNA, 13 bp, Homo sapiens
ttgcaacatatta

SEQ ID NO: 3345977 - DNA, 14 bp, Homo sapiens
ttgcaacgtttaca

SEQ ID NO: 3345978 - DNA, 22 bp, Homo sapiens
ttgcaacttcatgtcaacttct

SEQ ID NO: 3345979 - DNA, 18 bp, Homo sapiens
ttgcaagatttaacacta

SEQ ID NO: 3345980 - DNA, 16 bp, Homo sapiens
ttgcaaggcagtctct

SEQ ID NO: 3345981 - DNA, 13 bp, Homo sapiens
ttgcaataacttc

SEQ ID NO: 3345982 - DNA, 14 bp, Homo sapiens
ttgcaataacttct

SEQ ID NO: 3345983 - DNA, 15 bp, Homo sapiens
ttgcaataacttcta

SEQ ID NO: 3345984 - DNA, 21 bp, Homo sapiens
ttgcaatagcagttataacag

SEQ ID NO: 3345985 - DNA, 22 bp, Homo sapiens
ttgcaatatctgaagccctccc

SEQ ID NO: 3345986 - DNA, 23 bp, Homo sapiens
ttgcaatgcttttatatggccca

SEQ ID NO: 3345987 - DNA, 22 bp, Homo sapiens
ttgcaatgtcacaacctctctg

SEQ ID NO: 3345988 - DNA, 17 bp, Homo sapiens
ttgcacaagttccctgg

SEQ ID NO: 3345989 - DNA, 16 bp, Homo sapiens
ttgcacacagatgtga

SEQ ID NO: 3345990 - DNA, 22 bp, Homo sapiens
ttgcacacagatgtgaaatgaa

SEQ ID NO: 3345991 - DNA, 14 bp, Homo sapiens
ttgcacagaatttg

SEQ ID NO: 3345992 - DNA, 12 bp, Homo sapiens
ttgcaccaaaga

SEQ ID NO: 3345993 - DNA, 12 bp, Homo sapiens
ttgcacccctcc

SEQ ID NO: 3345994 - DNA, 16 bp, Homo sapiens
ttgcacccctcccatt

SEQ ID NO: 3345995 - DNA, 16 bp, Homo sapiens
ttgcacccgcctctcc

SEQ ID NO: 3345996 - DNA, 22 bp, Homo sapiens
ttgcaccctgtagatgttctag

SEQ ID NO: 3345997 - DNA, 13 bp, Homo sapiens
ttgcacctgtccc

SEQ ID NO: 3345998 - DNA, 15 bp, Homo sapiens
ttgcacgtggcctct

SEQ ID NO: 3345999 - DNA, 19 bp, Homo sapiens
ttgcactaaagtatgtaaa

SEQ ID NO: 3346000 - DNA, 19 bp, Homo sapiens
ttgcactacattatggaat

SEQ ID NO: 3346001 - DNA, 15 bp, Homo sapiens
ttgcactccttccct

SEQ ID NO: 3346002 - DNA, 22 bp, Homo sapiens
ttgcactctaaaaggttcaggg

SEQ ID NO: 3346003 - DNA, 17 bp, Homo sapiens
ttgcactctagcctggg

SEQ ID NO: 3346004 - DNA, 20 bp, Homo sapiens
ttgcactgaagtttttgaaa

SEQ ID NO: 3346005 - DNA, 12 bp, Homo sapiens
ttgcactgaggg

SEQ ID NO: 3346006 - DNA, 13 bp, Homo sapiens
ttgcactgctgtt

SEQ ID NO: 3346007 - DNA, 14 bp, Homo sapiens
ttgcacttaaaaat

SEQ ID NO: 3346008 - DNA, 18 bp, Homo sapiens
ttgcacttatgtacttga

SEQ ID NO: 3346009 - DNA, 12 bp, Homo sapiens
ttgcagaaagga

SEQ ID NO: 3346010 - DNA, 19 bp, Homo sapiens
ttcatttgttttgcttttg

SEQ ID NO: 3346011 - DNA, 17 bp, Homo sapiens
ttcatttgttttttcaa

SEQ ID NO: 3346012 - DNA, 19 bp, Homo sapiens
ttcattttaacatgatttc

SEQ ID NO: 3346013 - DNA, 17 bp, Homo sapiens
ttcattttagtgactgt

SEQ ID NO: 3346014 - DNA, 17 bp, Homo sapiens
ttcattttcatcactgg

SEQ ID NO: 3346015 - DNA, 17 bp, Homo sapiens
ttcattttctgacatgc

SEQ ID NO: 3346016 - DNA, 23 bp, Homo sapiens
ttcatttttttcactggagttac

SEQ ID NO: 3346017 - DNA, 15 bp, Homo sapiens
ttccaaaaattatta

SEQ ID NO: 3346018 - DNA, 22 bp, Homo sapiens
ttccaaaacatttctggacagt

SEQ ID NO: 3346019 - DNA, 21 bp, Homo sapiens
ttccaaaataattttaagaaa

SEQ ID NO: 3346020 - DNA, 16 bp, Homo sapiens
ttccaaaattcttatt

SEQ ID NO: 3346021 - DNA, 15 bp, Homo sapiens
ttccaaagaattctt

SEQ ID NO: 3346022 - DNA, 21 bp, Homo sapiens
ttccaaagagtagaattgcat

SEQ ID NO: 3346023 - DNA, 20 bp, Homo sapiens
ttccaaagccagtgaaatgt

SEQ ID NO: 3346024 - DNA, 21 bp, Homo sapiens
ttccaaatgtaataaacttta

SEQ ID NO: 3346025 - DNA, 12 bp, Homo sapiens
ttccaacaccac

SEQ ID NO: 3346026 - DNA, 18 bp, Homo sapiens
ttccaacaccacagacac

SEQ ID NO: 3346027 - DNA, 23 bp, Homo sapiens
ttccaacaccacagacacacaca

SEQ ID NO: 3346028 - DNA, 18 bp, Homo sapiens
ttccaactactaatagaa

SEQ ID NO: 3346029 - DNA, 14 bp, Homo sapiens
ttccaactcaggtt

SEQ ID NO: 3346030 - DNA, 20 bp, Homo sapiens
ttccaactggcactctgtgg

SEQ ID NO: 3346031 - DNA, 22 bp, Homo sapiens
ttccaactgtatatattcccaa

SEQ ID NO: 3346032 - DNA, 13 bp, Homo sapiens
ttccaagacattg

SEQ ID NO: 3346033 - DNA, 16 bp, Homo sapiens
ttccaagacattgtca

SEQ ID NO: 3346034 - DNA, 15 bp, Homo sapiens
ttccaagactctaga

SEQ ID NO: 3346035 - DNA, 16 bp, Homo sapiens
ttccaagactctagag

SEQ ID NO: 3346036 - DNA, 21 bp, Homo sapiens
ttccaagactctagagtccaa

SEQ ID NO: 3346037 - DNA, 12 bp, Homo sapiens
ttccaagagtct

SEQ ID NO: 3346038 - DNA, 14 bp, Homo sapiens
ttccaagagtctaa

SEQ ID NO: 3346039 - DNA, 13 bp, Homo sapiens
ttccaaggccctg

SEQ ID NO: 3346040 - DNA, 13 bp, Homo sapiens
ttccaaggcttct

SEQ ID NO: 3346041 - DNA, 13 bp, Homo sapiens
ttccaagtaatat

SEQ ID NO: 3346042 - DNA, 16 bp, Homo sapiens
ttccaagttgctaata

SEQ ID NO: 3346043 - DNA, 16 bp, Homo sapiens
ttccaatatgatgact

SEQ ID NO: 3346044 - DNA, 24 bp, Homo sapiens
ttccaatatttctgctttctttga

SEQ ID NO: 3346045 - DNA, 15 bp, Homo sapiens
ttccaatcctggctc

SEQ ID NO: 3346046 - DNA, 23 bp, Homo sapiens
ttccaatcctggctctgtggctt

SEQ ID NO: 3346047 - DNA, 20 bp, Homo sapiens
ttccaatctctgttctgttt

SEQ ID NO: 3346048 - DNA, 22 bp, Homo sapiens
ttccaatttacatactctgctt

SEQ ID NO: 3346049 - DNA, 13 bp, Homo sapiens
ttccaatttggaa

SEQ ID NO: 3346050 - DNA, 22 bp, Homo sapiens
ttccacaccttttattgacaca

SEQ ID NO: 3346051 - DNA, 18 bp, Homo sapiens
ttccacagattgtttcta

SEQ ID NO: 3346052 - DNA, 15 bp, Homo sapiens
ttccacagcagcaga

SEQ ID NO: 3346053 - DNA, 21 bp, Homo sapiens
ttccacagttgccaccacctc

SEQ ID NO: 3346054 - DNA, 15 bp, Homo sapiens
ttccacatgtacata

SEQ ID NO: 3346055 - DNA, 11 bp, Homo sapiens
ttccacatttt

SEQ ID NO: 3346056 - DNA, 16 bp, Homo sapiens
ttccaccacagccagc

SEQ ID NO: 3346057 - DNA, 15 bp, Homo sapiens
ttccaccccaagaga

SEQ ID NO: 3346058 - DNA, 14 bp, Homo sapiens
ttccacctccctcc

SEQ ID NO: 3346059 - DNA, 15 bp, Homo sapiens
ttccaccttcccatg

SEQ ID NO: 3346060 - DNA, 19 bp, Homo sapiens
ttccacgtgttttattcct

SEQ ID NO: 3346061 - DNA, 18 bp, Homo sapiens
ttccactaaaaatattgt

SEQ ID NO: 3346062 - DNA, 16 bp, Homo sapiens
ttccactacacctggc

SEQ ID NO: 3346063 - DNA, 19 bp, Homo sapiens
ttccactacacctggctga

SEQ ID NO: 3346064 - DNA, 13 bp, Homo sapiens
ttccactgcaaaa

SEQ ID NO: 3346065 - DNA, 19 bp, Homo sapiens
ttccactgcaaataaagcc

SEQ ID NO: 3346066 - DNA, 14 bp, Homo sapiens
ttccactgcctctg

SEQ ID NO: 3346067 - DNA, 21 bp, Homo sapiens
ttccacttagaaattgcattt

SEQ ID NO: 3346068 - DNA, 18 bp, Homo sapiens
ttccagaaaaccccagca

SEQ ID NO: 3346069 - DNA, 21 bp, Homo sapiens
ttccagaaaaccccagcatcc

SEQ ID NO: 3346070 - DNA, 15 bp, Homo sapiens
ttccagaaaggatat

SEQ ID NO: 3346071 - DNA, 22 bp, Homo sapiens
ttccagaaaggatatttaagaa

SEQ ID NO: 3346072 - DNA, 18 bp, Homo sapiens
ttccagaatgctgtacat

SEQ ID NO: 3346073 - DNA, 22 bp, Homo sapiens
ttccagacctgcttcctgaaat

SEQ ID NO: 3346074 - DNA, 23 bp, Homo sapiens
ttccagacctgcttcctgaaata

SEQ ID NO: 3346075 - DNA, 13 bp, Homo sapiens
ttccagacttcaa

SEQ ID NO: 3346076 - DNA, 18 bp, Homo sapiens
ttccagagagtggctcct

SEQ ID NO: 3346077 - DNA, 19 bp, Homo sapiens
ttccagaggctattatttt

SEQ ID NO: 3346078 - DNA, 20 bp, Homo sapiens
ttccagaggctattattttc

SEQ ID NO: 3346079 - DNA, 18 bp, Homo sapiens
ttccagataaccagctgt

SEQ ID NO: 3346080 - DNA, 14 bp, Homo sapiens
ttccagatgtggat

SEQ ID NO: 3346081 - DNA, 16 bp, Homo sapiens
ttccagattcctatga

SEQ ID NO: 3346082 - DNA, 22 bp, Homo sapiens
ttccagcaattctcctgcctca

SEQ ID NO: 3346083 - DNA, 22 bp, Homo sapiens
ttccagcagaagacaaaaagac

SEQ ID NO: 3346084 - DNA, 17 bp, Homo sapiens
ttccagcccctctggtc

SEQ ID NO: 3346085 - DNA, 11 bp, Homo sapiens
ttccagctcct

SEQ ID NO: 3346086 - DNA, 14 bp, Homo sapiens
ttccagctcctgta

SEQ ID NO: 3346087 - DNA, 19 bp, Homo sapiens
ttccagctctaataaaaca

SEQ ID NO: 3346088 - DNA, 14 bp, Homo sapiens
ttccagcttcaggc

SEQ ID NO: 3346089 - DNA, 15 bp, Homo sapiens
ttccagcttcaggca

SEQ ID NO: 3346090 - DNA, 23 bp, Homo sapiens
ttccaggaaactccacatctgcc

SEQ ID NO: 3346091 - DNA, 24 bp, Homo sapiens
ttccaggaaactccacatctgcct

SEQ ID NO: 3346092 - DNA, 13 bp, Homo sapiens
ttccaggacccct

SEQ ID NO: 3346093 - DNA, 18 bp, Homo sapiens
ttccaggatcctgcagga

SEQ ID NO: 3346094 - DNA, 13 bp, Homo sapiens
ttccaggcccctg

SEQ ID NO: 3346095 - DNA, 20 bp, Homo sapiens
ttccaggctcttcctggacc

SEQ ID NO: 3346096 - DNA, 19 bp, Homo sapiens
ttccaggcttccctgactt

SEQ ID NO: 3346097 - DNA, 12 bp, Homo sapiens
ttccagggccct

SEQ ID NO: 3346098 - DNA, 18 bp, Homo sapiens
ttccaggggaacctgcca

SEQ ID NO: 3346099 - DNA, 17 bp, Homo sapiens
ttccaggtaaaaacaga

SEQ ID NO: 3346100 - DNA, 15 bp, Homo sapiens
ttccagtattgaaaa

SEQ ID NO: 3346101 - DNA, 11 bp, Homo sapiens
ttccagtgcta

SEQ ID NO: 3346102 - DNA, 13 bp, Homo sapiens
ttccagtgttcta

SEQ ID NO: 3346103 - DNA, 19 bp, Homo sapiens
ttccataaggaatgtagct

SEQ ID NO: 3346104 - DNA, 22 bp, Homo sapiens
ttccataatctggactcctctg

SEQ ID NO: 3346105 - DNA, 16 bp, Homo sapiens
ttccataatgtataaa

SEQ ID NO: 3346106 - DNA, 12 bp, Homo sapiens
ttccataattat

SEQ ID NO: 3346107 - DNA, 22 bp, Homo sapiens
ttccataattatgacagttata

SEQ ID NO: 3346108 - DNA, 18 bp, Homo sapiens
ttccataggacatactgc

SEQ ID NO: 3346109 - DNA, 22 bp, Homo sapiens
ttccatattgggaatatgtaga

SEQ ID NO: 3346110 - DNA, 12 bp, Homo sapiens
ttccatatttgg

SEQ ID NO: 3346111 - DNA, 14 bp, Homo sapiens
ttccatatttggaa

SEQ ID NO: 3346112 - DNA, 19 bp, Homo sapiens
ttccatattttttgcacag

SEQ ID NO: 3346113 - DNA, 13 bp, Homo sapiens
ttccatcatttta

SEQ ID NO: 3346114 - DNA, 23 bp, Homo sapiens
ttccatcccaaccagtgccaagg

SEQ ID NO: 3346115 - DNA, 14 bp, Homo sapiens
ttccatctagtcac

SEQ ID NO: 3346116 - DNA, 22 bp, Homo sapiens
ttccatctcctataatctgtca

SEQ ID NO: 3346117 - DNA, 22 bp, Homo sapiens
ttccatcttctccccacagcct

SEQ ID NO: 3346118 - DNA, 12 bp, Homo sapiens
ttccatcttgct

SEQ ID NO: 3346119 - DNA, 15 bp, Homo sapiens
ttccatcttgctaat

SEQ ID NO: 3346120 - DNA, 13 bp, Homo sapiens
ttccatctttaca

SEQ ID NO: 3346121 - DNA, 18 bp, Homo sapiens
ttccatctttacaaaact

SEQ ID NO: 3346122 - DNA, 13 bp, Homo sapiens
ttccatgaaaacg

SEQ ID NO: 3346123 - DNA, 15 bp, Homo sapiens
ttccatgaaaacgtt

SEQ ID NO: 3346124 - DNA, 22 bp, Homo sapiens
ttccatgaaaacgttttattgt

SEQ ID NO: 3346125 - DNA, 12 bp, Homo sapiens
ttccatgaatgt

SEQ ID NO: 3346126 - DNA, 18 bp, Homo sapiens
ttccatgagaacagcagg

SEQ ID NO: 3346127 - DNA, 23 bp, Homo sapiens
ttccatgcctgagggtggagact

SEQ ID NO: 3346128 - DNA, 18 bp, Homo sapiens
ttccatgcgtgtttctga

SEQ ID NO: 3346129 - DNA, 23 bp, Homo sapiens
ttccatgggagccagctgctttt

SEQ ID NO: 3346130 - DNA, 15 bp, Homo sapiens
ttctgggaatcatgt

SEQ ID NO: 3346131 - DNA, 22 bp, Homo sapiens
ttctgggacacagttcaattct

SEQ ID NO: 3346132 - DNA, 22 bp, Homo sapiens
ttctgggagacacccaaagggt

SEQ ID NO: 3346133 - DNA, 21 bp, Homo sapiens
ttctgggagcagaaacagcca

SEQ ID NO: 3346134 - DNA, 16 bp, Homo sapiens
ttctgggaggaagcag

SEQ ID NO: 3346135 - DNA, 16 bp, Homo sapiens
ttctgggctctttcct

SEQ ID NO: 3346136 - DNA, 13 bp, Homo sapiens
ttctggggcccag

SEQ ID NO: 3346137 - DNA, 15 bp, Homo sapiens
ttctggtactctcct

SEQ ID NO: 3346138 - DNA, 22 bp, Homo sapiens
ttctggtcaagggctgtcattg

SEQ ID NO: 3346139 - DNA, 17 bp, Homo sapiens
ttctggtgtgttaacat

SEQ ID NO: 3346140 - DNA, 12 bp, Homo sapiens
ttctggttctaa

SEQ ID NO: 3346141 - DNA, 17 bp, Homo sapiens
ttctggttgtatttcta

SEQ ID NO: 3346142 - DNA, 18 bp, Homo sapiens
ttctggttgtatttctat

SEQ ID NO: 3346143 - DNA, 17 bp, Homo sapiens
ttctggtttaaacttgt

SEQ ID NO: 3346144 - DNA, 22 bp, Homo sapiens
ttctggtttaaacttgtttgct

SEQ ID NO: 3346145 - DNA, 17 bp, Homo sapiens
ttctgtaaaatgtctgt

SEQ ID NO: 3346146 - DNA, 19 bp, Homo sapiens
ttctgtaaactcaaaactt

SEQ ID NO: 3346147 - DNA, 20 bp, Homo sapiens
ttctgtaaactcaaaactta

SEQ ID NO: 3346148 - DNA, 14 bp, Homo sapiens
ttctgtaaatacca

SEQ ID NO: 3346149 - DNA, 17 bp, Homo sapiens
ttctgtaatggaactga

SEQ ID NO: 3346150 - DNA, 18 bp, Homo sapiens
ttctgtacatagcctata

SEQ ID NO: 3346151 - DNA, 13 bp, Homo sapiens
ttctgtaccagtt

SEQ ID NO: 3346152 - DNA, 17 bp, Homo sapiens
ttctgtacttcctgagt

SEQ ID NO: 3346153 - DNA, 20 bp, Homo sapiens
ttctgtagagccttctgatg

SEQ ID NO: 3346154 - DNA, 16 bp, Homo sapiens
ttctgtaggttctgtg

SEQ ID NO: 3346155 - DNA, 24 bp, Homo sapiens
ttctgtatacaaccctggcattat

SEQ ID NO: 3346156 - DNA, 15 bp, Homo sapiens
ttctgtatttctagg

SEQ ID NO: 3346157 - DNA, 22 bp, Homo sapiens
ttctgtatttttttttctaaga

SEQ ID NO: 3346158 - DNA, 15 bp, Homo sapiens
ttctgtcccttccac

SEQ ID NO: 3346159 - DNA, 17 bp, Homo sapiens
ttctgtcctactctgtg

SEQ ID NO: 3346160 - DNA, 22 bp, Homo sapiens
ttctgtccttttggcactgaga

SEQ ID NO: 3346161 - DNA, 16 bp, Homo sapiens
ttctgtgaaatataat

SEQ ID NO: 3346162 - DNA, 15 bp, Homo sapiens
ttctgtgcctgaata

SEQ ID NO: 3346163 - DNA, 16 bp, Homo sapiens
ttctgtgcttggattt

SEQ ID NO: 3346164 - DNA, 17 bp, Homo sapiens
ttctgtggttcctctgc

SEQ ID NO: 3346165 - DNA, 21 bp, Homo sapiens
ttctgtgtaaacagaagcctg

SEQ ID NO: 3346166 - DNA, 16 bp, Homo sapiens
ttctgtgtatttaatt

SEQ ID NO: 3346167 - DNA, 23 bp, Homo sapiens
ttctgtgtgcaccttaccaactt

SEQ ID NO: 3346168 - DNA, 20 bp, Homo sapiens
ttctgtgtgttttcataata

SEQ ID NO: 3346169 - DNA, 16 bp, Homo sapiens
ttctgtgttcattttt

SEQ ID NO: 3346170 - DNA, 17 bp, Homo sapiens
ttctgtgtttaatttct

SEQ ID NO: 3346171 - DNA, 20 bp, Homo sapiens
ttctgtgtttaatttcttca

SEQ ID NO: 3346172 - DNA, 13 bp, Homo sapiens
ttctgttaaaatc

SEQ ID NO: 3346173 - DNA, 17 bp, Homo sapiens
ttctgttaaaatctatt

SEQ ID NO: 3346174 - DNA, 19 bp, Homo sapiens
ttctgttatatcccctgct

SEQ ID NO: 3346175 - DNA, 21 bp, Homo sapiens
ttctgttatatcccctgctac

SEQ ID NO: 3346176 - DNA, 19 bp, Homo sapiens
ttctgttccaaattcagtt

SEQ ID NO: 3346177 - DNA, 14 bp, Homo sapiens
ttctgttctagttt

SEQ ID NO: 3346178 - DNA, 21 bp, Homo sapiens
ttctgttctagttttttactt

SEQ ID NO: 3346179 - DNA, 15 bp, Homo sapiens
ttctgttctggagga

SEQ ID NO: 3346180 - DNA, 14 bp, Homo sapiens
ttctgttctggggg

SEQ ID NO: 3346181 - DNA, 15 bp, Homo sapiens
ttctgttgaagatta

SEQ ID NO: 3346182 - DNA, 15 bp, Homo sapiens
ttctgttgtaactta

SEQ ID NO: 3346183 - DNA, 17 bp, Homo sapiens
ttctgttgtaacttatg

SEQ ID NO: 3346184 - DNA, 22 bp, Homo sapiens
ttctgttgtaacttatgtagat

SEQ ID NO: 3346185 - DNA, 15 bp, Homo sapiens
ttctgttgttccatt

SEQ ID NO: 3346186 - DNA, 18 bp, Homo sapiens
ttctgttgttccatttta

SEQ ID NO: 3346187 - DNA, 20 bp, Homo sapiens
ttctgttgttccattttatg

SEQ ID NO: 3346188 - DNA, 17 bp, Homo sapiens
ttctgtttcttcttgtg

SEQ ID NO: 3346189 - DNA, 15 bp, Homo sapiens
ttctgtttggcactt

SEQ ID NO: 3346190 - DNA, 20 bp, Homo sapiens
ttctgtttggcacttgtatt

SEQ ID NO: 3346191 - DNA, 14 bp, Homo sapiens
ttctgtttgttaaa

SEQ ID NO: 3346192 - DNA, 17 bp, Homo sapiens
ttcttaaaagtacttta

SEQ ID NO: 3346193 - DNA, 21 bp, Homo sapiens
ttcttaaaccaacctttaaaa

SEQ ID NO: 3346194 - DNA, 16 bp, Homo sapiens
ttcttaaaggcctgga

SEQ ID NO: 3346195 - DNA, 19 bp, Homo sapiens
ttcttaaaggcctggaacc

SEQ ID NO: 3346196 - DNA, 16 bp, Homo sapiens
ttcttaaatatgtata

SEQ ID NO: 3346197 - DNA, 20 bp, Homo sapiens
ttcttaaatctttcttcaaa

SEQ ID NO: 3346198 - DNA, 13 bp, Homo sapiens
ttcttaacctttg

SEQ ID NO: 3346199 - DNA, 18 bp, Homo sapiens
ttcttaagacatgtatca

SEQ ID NO: 3346200 - DNA, 17 bp, Homo sapiens
ttcttaagggcacacac

SEQ ID NO: 3346201 - DNA, 14 bp, Homo sapiens
ttcttaattaattt

SEQ ID NO: 3346202 - DNA, 22 bp, Homo sapiens
ttcttaattaatttgattaaca

SEQ ID NO: 3346203 - DNA, 21 bp, Homo sapiens
ttcttaattattataaaaata

SEQ ID NO: 3346204 - DNA, 20 bp, Homo sapiens
ttcttaattgcactctaaaa

SEQ ID NO: 3346205 - DNA, 13 bp, Homo sapiens
ttcttacacttct

SEQ ID NO: 3346206 - DNA, 14 bp, Homo sapiens
ttcttacatgcatt

SEQ ID NO: 3346207 - DNA, 16 bp, Homo sapiens
ttcttacccaaagcac

SEQ ID NO: 3346208 - DNA, 23 bp, Homo sapiens
ttcttacttttcctggacttaaa

SEQ ID NO: 3346209 - DNA, 22 bp, Homo sapiens
ttcttagaacagtggaaactat

SEQ ID NO: 3346210 - DNA, 19 bp, Homo sapiens
ttcttagagtgtagctgta

SEQ ID NO: 3346211 - DNA, 18 bp, Homo sapiens
ttcttagcctgtggcagt

SEQ ID NO: 3346212 - DNA, 18 bp, Homo sapiens
ttcttaggggaaggagaa

SEQ ID NO: 3346213 - DNA, 19 bp, Homo sapiens
ttcttagtgcttcagagtt

SEQ ID NO: 3346214 - DNA, 23 bp, Homo sapiens
ttcttagtgcttcagagtttgtg

SEQ ID NO: 3346215 - DNA, 18 bp, Homo sapiens
ttcttagttctcactgtt

SEQ ID NO: 3346216 - DNA, 19 bp, Homo sapiens
ttcttagttctcactgttc

SEQ ID NO: 3346217 - DNA, 13 bp, Homo sapiens
ttcttataatact

SEQ ID NO: 3346218 - DNA, 19 bp, Homo sapiens
ttcttataatactctgttg

SEQ ID NO: 3346219 - DNA, 18 bp, Homo sapiens
ttcttatggaattgattt

SEQ ID NO: 3346220 - DNA, 22 bp, Homo sapiens
ttcttattaattcttcacctgt

SEQ ID NO: 3346221 - DNA, 19 bp, Homo sapiens
ttcttattgcgctgctacc

SEQ ID NO: 3346222 - DNA, 18 bp, Homo sapiens
ttcttatttaatcttttc

SEQ ID NO: 3346223 - DNA, 23 bp, Homo sapiens
ttcttatttaatgaaagactgta

SEQ ID NO: 3346224 - DNA, 14 bp, Homo sapiens
ttcttcaaaatgta

SEQ ID NO: 3346225 - DNA, 22 bp, Homo sapiens
ttctcctcccagcgtgtgtatc

SEQ ID NO: 3346226 - DNA, 17 bp, Homo sapiens
ttctcctctctgggcct

SEQ ID NO: 3346227 - DNA, 23 bp, Homo sapiens
ttctcctgaaacccaaagccctg

SEQ ID NO: 3346228 - DNA, 23 bp, Homo sapiens
ttctcctgcgccccgcccacacc

SEQ ID NO: 3346229 - DNA, 10 bp, Homo sapiens
ttctcctgga

SEQ ID NO: 3346230 - DNA, 20 bp, Homo sapiens
ttctcctgtttattcccatc

SEQ ID NO: 3346231 - DNA, 13 bp, Homo sapiens
ttctcctgtttta

SEQ ID NO: 3346232 - DNA, 15 bp, Homo sapiens
ttctccttagtcttc

SEQ ID NO: 3346233 - DNA, 22 bp, Homo sapiens
ttctccttcattaatgatgatc

SEQ ID NO: 3346234 - DNA, 14 bp, Homo sapiens
ttctccttctcctt

SEQ ID NO: 3346235 - DNA, 17 bp, Homo sapiens
ttctcctttcacaacct

SEQ ID NO: 3346236 - DNA, 18 bp, Homo sapiens
ttctccttttcctctctc

SEQ ID NO: 3346237 - DNA, 17 bp, Homo sapiens
ttctcgtgcctccccac

SEQ ID NO: 3346238 - DNA, 15 bp, Homo sapiens
ttctctaatcgaaag

SEQ ID NO: 3346239 - DNA, 18 bp, Homo sapiens
ttctctaatgcttgattt

SEQ ID NO: 3346240 - DNA, 19 bp, Homo sapiens
ttctctaatgcttgattta

SEQ ID NO: 3346241 - DNA, 18 bp, Homo sapiens
ttctctagctctctaggc

SEQ ID NO: 3346242 - DNA, 20 bp, Homo sapiens
ttctctcagccttacatttg

SEQ ID NO: 3346243 - DNA, 20 bp, Homo sapiens
ttctctccccctatttattg

SEQ ID NO: 3346244 - DNA, 19 bp, Homo sapiens
ttctctcccttcctctctc

SEQ ID NO: 3346245 - DNA, 15 bp, Homo sapiens
ttctctcctccccaa

SEQ ID NO: 3346246 - DNA, 17 bp, Homo sapiens
ttctctcctccccaaat

SEQ ID NO: 3346247 - DNA, 17 bp, Homo sapiens
ttctctcggctccccat

SEQ ID NO: 3346248 - DNA, 19 bp, Homo sapiens
ttctctgaacacaggcagc

SEQ ID NO: 3346249 - DNA, 20 bp, Homo sapiens
ttctctgaggacactaacca

SEQ ID NO: 3346250 - DNA, 14 bp, Homo sapiens
ttctctgagtggtg

SEQ ID NO: 3346251 - DNA, 22 bp, Homo sapiens
ttctctgagtggtggttccttt

SEQ ID NO: 3346252 - DNA, 16 bp, Homo sapiens
ttctctgatcaaaatt

SEQ ID NO: 3346253 - DNA, 20 bp, Homo sapiens
ttctctgcaatgcttctgta

SEQ ID NO: 3346254 - DNA, 10 bp, Homo sapiens
ttctctgcag

SEQ ID NO: 3346255 - DNA, 21 bp, Homo sapiens
ttctctgccgctacctccctc

SEQ ID NO: 3346256 - DNA, 19 bp, Homo sapiens
ttctctgcctttgacattt

SEQ ID NO: 3346257 - DNA, 15 bp, Homo sapiens
ttctctgctagattt

SEQ ID NO: 3346258 - DNA, 15 bp, Homo sapiens
ttctctgctccacca

SEQ ID NO: 3346259 - DNA, 20 bp, Homo sapiens
ttctctggctgtaaggctct

SEQ ID NO: 3346260 - DNA, 19 bp, Homo sapiens
ttctctggtaatattgact

SEQ ID NO: 3346261 - DNA, 21 bp, Homo sapiens
ttctctgtacttttcattctc

SEQ ID NO: 3346262 - DNA, 17 bp, Homo sapiens
ttctctgtctcagactt

SEQ ID NO: 3346263 - DNA, 22 bp, Homo sapiens
ttctctgtctcagacttttgta

SEQ ID NO: 3346264 - DNA, 12 bp, Homo sapiens
ttctctgtgaac

SEQ ID NO: 3346265 - DNA, 20 bp, Homo sapiens
ttctctgtgaacgatttaga

SEQ ID NO: 3346266 - DNA, 16 bp, Homo sapiens
ttctctgtgtctaaga

SEQ ID NO: 3346267 - DNA, 23 bp, Homo sapiens
ttctctgtgtctaagattctaga

SEQ ID NO: 3346268 - DNA, 23 bp, Homo sapiens
ttctctgttgtcgtaaagatttg

SEQ ID NO: 3346269 - DNA, 21 bp, Homo sapiens
ttctcttaggtggctctggga

SEQ ID NO: 3346270 - DNA, 17 bp, Homo sapiens
ttctcttatctgccatg

SEQ ID NO: 3346271 - DNA, 18 bp, Homo sapiens
ttctcttctctgcaatgc

SEQ ID NO: 3346272 - DNA, 18 bp, Homo sapiens
ttctcttgagctggcctc

SEQ ID NO: 3346273 - DNA, 19 bp, Homo sapiens
ttctcttgtataagatcct

SEQ ID NO: 3346274 - DNA, 23 bp, Homo sapiens
ttctcttgtataagatcctagat

SEQ ID NO: 3346275 - DNA, 14 bp, Homo sapiens
ttctctttctctcc

SEQ ID NO: 3346276 - DNA, 16 bp, Homo sapiens
ttctctttctctcctt

SEQ ID NO: 3346277 - DNA, 16 bp, Homo sapiens
ttctcttttcaaaaca

SEQ ID NO: 3346278 - DNA, 19 bp, Homo sapiens
ttctgaaaacctaccagcc

SEQ ID NO: 3346279 - DNA, 19 bp, Homo sapiens
ttctgaaagttacccactg

SEQ ID NO: 3346280 - DNA, 16 bp, Homo sapiens
ttctgaactcaaactg

SEQ ID NO: 3346281 - DNA, 22 bp, Homo sapiens
ttctgaactcaaactgaggaat

SEQ ID NO: 3346282 - DNA, 19 bp, Homo sapiens
ttctgaaggtagcattctt

SEQ ID NO: 3346283 - DNA, 13 bp, Homo sapiens
ttctgaagtactt

SEQ ID NO: 3346284 - DNA, 16 bp, Homo sapiens
ttctgaataatttctt

SEQ ID NO: 3346285 - DNA, 18 bp, Homo sapiens
ttctgaattcaaagcttg

SEQ ID NO: 3346286 - DNA, 21 bp, Homo sapiens
ttctgacagtttttctgtttt

SEQ ID NO: 3346287 - DNA, 18 bp, Homo sapiens
ttctgacatgcattgttg

SEQ ID NO: 3346288 - DNA, 20 bp, Homo sapiens
ttctgacattaacagttttc

SEQ ID NO: 3346289 - DNA, 15 bp, Homo sapiens
ttctgacggccctgc

SEQ ID NO: 3346290 - DNA, 16 bp, Homo sapiens
ttctgaggctttatga

SEQ ID NO: 3346291 - DNA, 13 bp, Homo sapiens
ttctgagtacaga

SEQ ID NO: 3346292 - DNA, 20 bp, Homo sapiens
ttctgagtttcattctcctg

SEQ ID NO: 3346293 - DNA, 18 bp, Homo sapiens
ttctgataaaagatggcc

SEQ ID NO: 3346294 - DNA, 14 bp, Homo sapiens
ttctgattagaaat

SEQ ID NO: 3346295 - DNA, 15 bp, Homo sapiens
ttctgattagaaatg

SEQ ID NO: 3346296 - DNA, 17 bp, Homo sapiens
ttctgatttgtattaaa

SEQ ID NO: 3346297 - DNA, 17 bp, Homo sapiens
ttctgattttaggagct

SEQ ID NO: 3346298 - DNA, 23 bp, Homo sapiens
ttctgattttaggagctaaggct

SEQ ID NO: 3346299 - DNA, 19 bp, Homo sapiens
ttctgcaaaaatatttata

SEQ ID NO: 3346300 - DNA, 13 bp, Homo sapiens
ttctgcaaaatag

SEQ ID NO: 3346301 - DNA, 22 bp, Homo sapiens
ttctgcaaagtgtatgtgacca

SEQ ID NO: 3346302 - DNA, 13 bp, Homo sapiens
ttctgcaccctcc

SEQ ID NO: 3346303 - DNA, 17 bp, Homo sapiens
ttctgcaccctccaccc

SEQ ID NO: 3346304 - DNA, 19 bp, Homo sapiens
ttctgcaccctccaccctg

SEQ ID NO: 3346305 - DNA, 22 bp, Homo sapiens
ttctgcagaaatttgcaactca

SEQ ID NO: 3346306 - DNA, 20 bp, Homo sapiens
ttctgcagcatgacctgtga

SEQ ID NO: 3346307 - DNA, 18 bp, Homo sapiens
ttctgcagtaaatctttt

SEQ ID NO: 3346308 - DNA, 17 bp, Homo sapiens
ttctgcatatgttgaat

SEQ ID NO: 3346309 - DNA, 19 bp, Homo sapiens
ttctgcatggattcagcat

SEQ ID NO: 3346310 - DNA, 15 bp, Homo sapiens
ttctgcattcctgta

SEQ ID NO: 3346311 - DNA, 15 bp, Homo sapiens
ttctgccacataaaa

SEQ ID NO: 3346312 - DNA, 15 bp, Homo sapiens
ttctgccagggagct

SEQ ID NO: 3346313 - DNA, 15 bp, Homo sapiens
ttctgccatattctg

SEQ ID NO: 3346314 - DNA, 21 bp, Homo sapiens
ttctgccatctagccagcccc

SEQ ID NO: 3346315 - DNA, 23 bp, Homo sapiens
ttctgcccacgatcccctccccc

SEQ ID NO: 3346316 - DNA, 15 bp, Homo sapiens
ttctgcccccagccc

SEQ ID NO: 3346317 - DNA, 22 bp, Homo sapiens
ttctgccgacccctagttccct

SEQ ID NO: 3346318 - DNA, 15 bp, Homo sapiens
ttctgccgccccctc

SEQ ID NO: 3346319 - DNA, 15 bp, Homo sapiens
ttctgcctagagtgt

SEQ ID NO: 3346320 - DNA, 16 bp, Homo sapiens
ttctgcctagagtgta

SEQ ID NO: 3346321 - DNA, 15 bp, Homo sapiens
ttctgcctttgatgt

SEQ ID NO: 3346322 - DNA, 16 bp, Homo sapiens
ttctgccttttcactg

SEQ ID NO: 3346323 - DNA, 22 bp, Homo sapiens
ttctgcgccacttcctttgtgt

SEQ ID NO: 3346324 - DNA, 23 bp, Homo sapiens
ttctgcgccacttcctttgtgtt

SEQ ID NO: 3346325 - DNA, 14 bp, Homo sapiens
ttctgcgcctcagg

SEQ ID NO: 3346326 - DNA, 17 bp, Homo sapiens
ttctgctacttcactgt

SEQ ID NO: 3346327 - DNA, 13 bp, Homo sapiens
ttctgctccaccc

SEQ ID NO: 3346328 - DNA, 14 bp, Homo sapiens
ttctgctcctctcc

SEQ ID NO: 3346329 - DNA, 17 bp, Homo sapiens
ttctgctcctctccagg

SEQ ID NO: 3346330 - DNA, 17 bp, Homo sapiens
ttctgctgcccaggcca

SEQ ID NO: 3346331 - DNA, 20 bp, Homo sapiens
ttctgctgggagttctagaa

SEQ ID NO: 3346332 - DNA, 17 bp, Homo sapiens
ttcccttccggtgcgtg

SEQ ID NO: 3346333 - DNA, 23 bp, Homo sapiens
ttcccttgaaattttaaactata

SEQ ID NO: 3346334 - DNA, 14 bp, Homo sapiens
ttcccttgctttgt

SEQ ID NO: 3346335 - DNA, 11 bp, Homo sapiens
ttcccttggcc

SEQ ID NO: 3346336 - DNA, 16 bp, Homo sapiens
ttcccttggcctcaga

SEQ ID NO: 3346337 - DNA, 11 bp, Homo sapiens
ttcccttgtat

SEQ ID NO: 3346338 - DNA, 20 bp, Homo sapiens
ttcccttttccctcccagtt

SEQ ID NO: 3346339 - DNA, 14 bp, Homo sapiens
ttcccttttctgtt

SEQ ID NO: 3346340 - DNA, 12 bp, Homo sapiens
ttccgacatccc

SEQ ID NO: 3346341 - DNA, 16 bp, Homo sapiens
ttccgacatcccagac

SEQ ID NO: 3346342 - DNA, 17 bp, Homo sapiens
ttccgaccctctgggaa

SEQ ID NO: 3346343 - DNA, 15 bp, Homo sapiens
ttccgcactttccac

SEQ ID NO: 3346344 - DNA, 22 bp, Homo sapiens
ttccgcactttccacttcttcc

SEQ ID NO: 3346345 - DNA, 17 bp, Homo sapiens
ttccgccccttcccttc

SEQ ID NO: 3346346 - DNA, 22 bp, Homo sapiens
ttccgctgtcgccccaggccct

SEQ ID NO: 3346347 - DNA, 23 bp, Homo sapiens
ttccgctttgaaagaagcaagac

SEQ ID NO: 3346348 - DNA, 17 bp, Homo sapiens
ttccggcacactgccaa

SEQ ID NO: 3346349 - DNA, 21 bp, Homo sapiens
ttccgtggtcagagtgccact

SEQ ID NO: 3346350 - DNA, 16 bp, Homo sapiens
ttcctaaacataattg

SEQ ID NO: 3346351 - DNA, 20 bp, Homo sapiens
ttcctaaagccatcatgcct

SEQ ID NO: 3346352 - DNA, 13 bp, Homo sapiens
ttcctaaatgcag

SEQ ID NO: 3346353 - DNA, 15 bp, Homo sapiens
ttcctaacaggatga

SEQ ID NO: 3346354 - DNA, 22 bp, Homo sapiens
ttcctaacttttcaatgacatt

SEQ ID NO: 3346355 - DNA, 16 bp, Homo sapiens
ttcctaagaagcttct

SEQ ID NO: 3346356 - DNA, 20 bp, Homo sapiens
ttcctacaagagcagcctgt

SEQ ID NO: 3346357 - DNA, 20 bp, Homo sapiens
ttcctactccctcttccaaa

SEQ ID NO: 3346358 - DNA, 19 bp, Homo sapiens
ttcctacttgcagtacatc

SEQ ID NO: 3346359 - DNA, 16 bp, Homo sapiens
ttcctagcctgtttct

SEQ ID NO: 3346360 - DNA, 18 bp, Homo sapiens
ttcctagctgtgtgaata

SEQ ID NO: 3346361 - DNA, 21 bp, Homo sapiens
ttcctaggcccaggcctgggt

SEQ ID NO: 3346362 - DNA, 19 bp, Homo sapiens
ttcctagtgaaccacaggt

SEQ ID NO: 3346363 - DNA, 22 bp, Homo sapiens
ttcctataacttcttcctgctg

SEQ ID NO: 3346364 - DNA, 23 bp, Homo sapiens
ttcctataacttcttcctgctgg

SEQ ID NO: 3346365 - DNA, 19 bp, Homo sapiens
ttcctataacttgatgcat

SEQ ID NO: 3346366 - DNA, 21 bp, Homo sapiens
ttcctatgaagttggcacatt

SEQ ID NO: 3346367 - DNA, 22 bp, Homo sapiens
ttcctatgcccaggtaccaccc

SEQ ID NO: 3346368 - DNA, 23 bp, Homo sapiens
ttcctatttgccatgggcttcac

SEQ ID NO: 3346369 - DNA, 19 bp, Homo sapiens
ttcctatttgttttcatgg

SEQ ID NO: 3346370 - DNA, 21 bp, Homo sapiens
ttcctatttgttttcatggtg

SEQ ID NO: 3346371 - DNA, 21 bp, Homo sapiens
ttcctcaacagtgttttcaga

SEQ ID NO: 3346372 - DNA, 20 bp, Homo sapiens
ttcctcaagcaataattgtt

SEQ ID NO: 3346373 - DNA, 18 bp, Homo sapiens
ttcctcaagtatcttcta

SEQ ID NO: 3346374 - DNA, 22 bp, Homo sapiens
ttcctcaagtatcttctatttt

SEQ ID NO: 3346375 - DNA, 18 bp, Homo sapiens
ttcctcaatcacactaca

SEQ ID NO: 3346376 - DNA, 18 bp, Homo sapiens
ttcctcacagccttggct

SEQ ID NO: 3346377 - DNA, 18 bp, Homo sapiens
ttcctcatccaccccatc

SEQ ID NO: 3346378 - DNA, 15 bp, Homo sapiens
ttcctccccctgcaa

SEQ ID NO: 3346379 - DNA, 14 bp, Homo sapiens
ttcctccgtccacc

SEQ ID NO: 3346380 - DNA, 22 bp, Homo sapiens
ttcctccgtccacccaggctgc

SEQ ID NO: 3346381 - DNA, 13 bp, Homo sapiens
ttcctcctcaggc

SEQ ID NO: 3346382 - DNA, 16 bp, Homo sapiens
ttcctcctccacagtg

SEQ ID NO: 3346383 - DNA, 20 bp, Homo sapiens
ttcctcctccacagtgctgc

SEQ ID NO: 3346384 - DNA, 15 bp, Homo sapiens
ttcctcctgcagaca

SEQ ID NO: 3346385 - DNA, 23 bp, Homo sapiens
ttcctcctgcagacacctggact

SEQ ID NO: 3346386 - DNA, 13 bp, Homo sapiens
ttcctcctgctca

SEQ ID NO: 3346387 - DNA, 15 bp, Homo sapiens
ttcctcctgctcata

SEQ ID NO: 3346388 - DNA, 13 bp, Homo sapiens
ttcctcctgctgt

SEQ ID NO: 3346389 - DNA, 11 bp, Homo sapiens
ttcctcctgga

SEQ ID NO: 3346390 - DNA, 13 bp, Homo sapiens
ttcctcctggaaa

SEQ ID NO: 3346391 - DNA, 14 bp, Homo sapiens
ttcctcctttatca

SEQ ID NO: 3346392 - DNA, 22 bp, Homo sapiens
ttcctctaggcaagcaggacct

SEQ ID NO: 3346393 - DNA, 19 bp, Homo sapiens
ttcctctagtgccctccac

SEQ ID NO: 3346394 - DNA, 17 bp, Homo sapiens
ttcctctatacatctct

SEQ ID NO: 3346395 - DNA, 20 bp, Homo sapiens
ttcctctatacatctctccc

SEQ ID NO: 3346396 - DNA, 19 bp, Homo sapiens
ttcctctcactaaacttta

SEQ ID NO: 3346397 - DNA, 21 bp, Homo sapiens
ttcctctcactcctgcctccg

SEQ ID NO: 3346398 - DNA, 22 bp, Homo sapiens
ttcctctcactcctgcctccgc

SEQ ID NO: 3346399 - DNA, 12 bp, Homo sapiens
ttcctctccact

SEQ ID NO: 3346400 - DNA, 19 bp, Homo sapiens
ttcctctccactgccttcg

SEQ ID NO: 3346401 - DNA, 17 bp, Homo sapiens
ttcctctccctctctct

SEQ ID NO: 3346402 - DNA, 19 bp, Homo sapiens
ttcctctccttcgtatccc

SEQ ID NO: 3346403 - DNA, 18 bp, Homo sapiens
ttcctctctggtggctct

SEQ ID NO: 3346404 - DNA, 18 bp, Homo sapiens
ttcctctctttgttctca

SEQ ID NO: 3346405 - DNA, 13 bp, Homo sapiens
ttcctctgagccc

SEQ ID NO: 3346406 - DNA, 17 bp, Homo sapiens
ttcctctgagcccagct

SEQ ID NO: 3346407 - DNA, 12 bp, Homo sapiens
ttcctctgcctg

SEQ ID NO: 3346408 - DNA, 15 bp, Homo sapiens
ttcctctgcctgccc

SEQ ID NO: 3346409 - DNA, 16 bp, Homo sapiens
ttcctctgcctgcccc

SEQ ID NO: 3346410 - DNA, 12 bp, Homo sapiens
ttcctctgggaa

SEQ ID NO: 3346411 - DNA, 14 bp, Homo sapiens
ttcctctgttcaca

SEQ ID NO: 3346412 - DNA, 19 bp, Homo sapiens
ttcctcttccccttgccct

SEQ ID NO: 3346413 - DNA, 20 bp, Homo sapiens
ttcctcttctattttgtaaa

SEQ ID NO: 3346414 - DNA, 18 bp, Homo sapiens
ttcctcttgcctctctca

SEQ ID NO: 3346415 - DNA, 15 bp, Homo sapiens
ttcctcttgtctgat

SEQ ID NO: 3346416 - DNA, 12 bp, Homo sapiens
ttcctgaaataa

SEQ ID NO: 3346417 - DNA, 13 bp, Homo sapiens
ttcctgaaataaa

SEQ ID NO: 3346418 - DNA, 16 bp, Homo sapiens
ttcctgaaataaacac

SEQ ID NO: 3346419 - DNA, 17 bp, Homo sapiens
ttcctgaaataaacact

SEQ ID NO: 3346420 - DNA, 14 bp, Homo sapiens
ttcctgaaccatgt

SEQ ID NO: 3346421 - DNA, 18 bp, Homo sapiens
ttcctgaatccaaactaa

SEQ ID NO: 3346422 - DNA, 22 bp, Homo sapiens
ttcctgaattctatttgctggg

SEQ ID NO: 3346423 - DNA, 16 bp, Homo sapiens
ttcctgacatcacagc

SEQ ID NO: 3346424 - DNA, 13 bp, Homo sapiens
ttcctgacccagg

SEQ ID NO: 3346425 - DNA, 15 bp, Homo sapiens
ttcctgacccaggcc

SEQ ID NO: 3346426 - DNA, 23 bp, Homo sapiens
ttcctgacccaggccgcagctct

SEQ ID NO: 3346427 - DNA, 16 bp, Homo sapiens
ttcctgacttgagtgt

SEQ ID NO: 3346428 - DNA, 18 bp, Homo sapiens
ttcctgacttgagtgttc

SEQ ID NO: 3346429 - DNA, 21 bp, Homo sapiens
ttcctgagatttcctcctggc

SEQ ID NO: 3346430 - DNA, 23 bp, Homo sapiens
ttcctgagtgtgggcttctgaaa

SEQ ID NO: 3346431 - DNA, 17 bp, Homo sapiens
ttcctgattgtttacag

SEQ ID NO: 3346432 - DNA, 17 bp, Homo sapiens
ttcctgcaattttctaa

SEQ ID NO: 3346433 - DNA, 18 bp, Homo sapiens
ttcctgcatttgtgaaat

SEQ ID NO: 3346434 - DNA, 18 bp, Homo sapiens
ttcctgccatgtttagtg

SEQ ID NO: 3346435 - DNA, 13 bp, Homo sapiens
ttcctgccccacc

SEQ ID NO: 3346436 - DNA, 22 bp, Homo sapiens
ttcctgccgagtgctctgatgc

SEQ ID NO: 3346437 - DNA, 23 bp, Homo sapiens
ttcctgccttcttctttttgctg

SEQ ID NO: 3346438 - DNA, 15 bp, Homo sapiens
ttcctgcctttaagc

SEQ ID NO: 3346439 - DNA, 19 bp, Homo sapiens
ttcctgcctttaagccaaa

SEQ ID NO: 3346440 - DNA, 17 bp, Homo sapiens
ttcctgcggagtgaaga

SEQ ID NO: 3346441 - DNA, 15 bp, Homo sapiens
ttcctgcgtcctcct

SEQ ID NO: 3346442 - DNA, 14 bp, Homo sapiens
ttcctgctacagga

SEQ ID NO: 3346443 - DNA, 16 bp, Homo sapiens
ttcctgctacaggagg

SEQ ID NO: 3346444 - DNA, 21 bp, Homo sapiens
ttcctgctccatgactggctg

SEQ ID NO: 3346445 - DNA, 24 bp, Homo sapiens
ttcctgctgctgtaactgctgagc

SEQ ID NO: 3346446 - DNA, 14 bp, Homo sapiens
ttcctggaaacagc

SEQ ID NO: 3346447 - DNA, 19 bp, Homo sapiens
ttcctggacactcagacct

SEQ ID NO: 3346448 - DNA, 12 bp, Homo sapiens
ttcctggacatc

SEQ ID NO: 3346449 - DNA, 20 bp, Homo sapiens
ttcctggacatcctcttctg

SEQ ID NO: 3346450 - DNA, 24 bp, Homo sapiens
ttcctggacatcctcttctgctta

SEQ ID NO: 3346451 - DNA, 15 bp, Homo sapiens
ttcctggcaatagtg

SEQ ID NO: 3346452 - DNA, 21 bp, Homo sapiens
ttcctggcccactctgtaata

SEQ ID NO: 3346453 - DNA, 18 bp, Homo sapiens
ttcctggctttttaactc

SEQ ID NO: 3346454 - DNA, 20 bp, Homo sapiens
ttcctgggaggacaggcagg

SEQ ID NO: 3346455 - DNA, 22 bp, Homo sapiens
ttctaatactttgtttattgta

SEQ ID NO: 3346456 - DNA, 16 bp, Homo sapiens
ttctaatggaatggtt

SEQ ID NO: 3346457 - DNA, 18 bp, Homo sapiens
ttctaatgtagctatttt

SEQ ID NO: 3346458 - DNA, 14 bp, Homo sapiens
ttctaatgtcttca

SEQ ID NO: 3346459 - DNA, 13 bp, Homo sapiens
ttctaatgtttct

SEQ ID NO: 3346460 - DNA, 23 bp, Homo sapiens
ttctaattaaaattgtgcataat

SEQ ID NO: 3346461 - DNA, 21 bp, Homo sapiens
ttctaatttcaaaaatataac

SEQ ID NO: 3346462 - DNA, 12 bp, Homo sapiens
ttctacaattaa

SEQ ID NO: 3346463 - DNA, 15 bp, Homo sapiens
ttctacatgactggg

SEQ ID NO: 3346464 - DNA, 19 bp, Homo sapiens
tgtatatttgtatattaca

SEQ ID NO: 3346465 - DNA, 15 bp, Homo sapiens
tgtatattttatata

SEQ ID NO: 3346466 - DNA, 17 bp, Homo sapiens
tgtatattttatataaa

SEQ ID NO: 3346467 - DNA, 14 bp, Homo sapiens
tgtatcaaatctgt

SEQ ID NO: 3346468 - DNA, 17 bp, Homo sapiens
tgtatcaatgagtaaca

SEQ ID NO: 3346469 - DNA, 16 bp, Homo sapiens
tgtatcaggtcaggga

SEQ ID NO: 3346470 - DNA, 16 bp, Homo sapiens
tgtatcatagaaatgt

SEQ ID NO: 3346471 - DNA, 17 bp, Homo sapiens
tgtatcatttgaacaac

SEQ ID NO: 3346472 - DNA, 15 bp, Homo sapiens
tgtatcccatgagcc

SEQ ID NO: 3346473 - DNA, 20 bp, Homo sapiens
tgtatcccccccctgtatag

SEQ ID NO: 3346474 - DNA, 21 bp, Homo sapiens
tgtatcccccccctgtatagt

SEQ ID NO: 3346475 - DNA, 18 bp, Homo sapiens
tgtatccgactctaagct

SEQ ID NO: 3346476 - DNA, 22 bp, Homo sapiens
tgtatcgcatattagttaatct

SEQ ID NO: 3346477 - DNA, 15 bp, Homo sapiens
tgtatcggagacagt

SEQ ID NO: 3346478 - DNA, 17 bp, Homo sapiens
tgtatcggagacagtga

SEQ ID NO: 3346479 - DNA, 19 bp, Homo sapiens
tgtatctagtgcagctgat

SEQ ID NO: 3346480 - DNA, 18 bp, Homo sapiens
tgtatctcatactgtctg

SEQ ID NO: 3346481 - DNA, 19 bp, Homo sapiens
tgtatctctgaagcatgtt

SEQ ID NO: 3346482 - DNA, 22 bp, Homo sapiens
tgtatctctgaagcatgtttca

SEQ ID NO: 3346483 - DNA, 13 bp, Homo sapiens
tgtatctcttaaa

SEQ ID NO: 3346484 - DNA, 16 bp, Homo sapiens
tgtatctctttcacat

SEQ ID NO: 3346485 - DNA, 23 bp, Homo sapiens
tgtatctgagttgccaagacaaa

SEQ ID NO: 3346486 - DNA, 13 bp, Homo sapiens
tgtatctgtgaag

SEQ ID NO: 3346487 - DNA, 12 bp, Homo sapiens
tgtatcttcctt

SEQ ID NO: 3346488 - DNA, 14 bp, Homo sapiens
tgtatctttatgct

SEQ ID NO: 3346489 - DNA, 21 bp, Homo sapiens
tgtatctttatgctgtatttt

SEQ ID NO: 3346490 - DNA, 11 bp, Homo sapiens
tgtatgaaaat

SEQ ID NO: 3346491 - DNA, 15 bp, Homo sapiens
tgtatgaaaatcctt

SEQ ID NO: 3346492 - DNA, 16 bp, Homo sapiens
tgtatgactaaagaga

SEQ ID NO: 3346493 - DNA, 18 bp, Homo sapiens
tgtatgatgtgttgtgat

SEQ ID NO: 3346494 - DNA, 22 bp, Homo sapiens
tgtatgattactggcctttttc

SEQ ID NO: 3346495 - DNA, 15 bp, Homo sapiens
tgtatgccttctgta

SEQ ID NO: 3346496 - DNA, 23 bp, Homo sapiens
tgtatgcctttaaatctgtgatg

SEQ ID NO: 3346497 - DNA, 14 bp, Homo sapiens
tgtatgctgatgat

SEQ ID NO: 3346498 - DNA, 16 bp, Homo sapiens
tgtatggaaacactga

SEQ ID NO: 3346499 - DNA, 19 bp, Homo sapiens
tgtatggaaacactgattt

SEQ ID NO: 3346500 - DNA, 23 bp, Homo sapiens
tgtatggaaataaatgtatcata

SEQ ID NO: 3346501 - DNA, 16 bp, Homo sapiens
tgtatggaaatgcacc

SEQ ID NO: 3346502 - DNA, 16 bp, Homo sapiens
tgtatggaatacagtg

SEQ ID NO: 3346503 - DNA, 18 bp, Homo sapiens
tgtatggaatacagtgtt

SEQ ID NO: 3346504 - DNA, 19 bp, Homo sapiens
tgtatggaatacagtgtta

SEQ ID NO: 3346505 - DNA, 19 bp, Homo sapiens
tgtatggaatcccactgta

SEQ ID NO: 3346506 - DNA, 19 bp, Homo sapiens
tgtatgggattggtgggct

SEQ ID NO: 3346507 - DNA, 20 bp, Homo sapiens
tgtatgggtagggtaaatca

SEQ ID NO: 3346508 - DNA, 19 bp, Homo sapiens
tgtatggttactaaaaagt

SEQ ID NO: 3346509 - DNA, 19 bp, Homo sapiens
tgtatgtgtgaaacaatgt

SEQ ID NO: 3346510 - DNA, 22 bp, Homo sapiens
tgtatgttaaagagaatgagtc

SEQ ID NO: 3346511 - DNA, 16 bp, Homo sapiens
tgtatgttatgaacat

SEQ ID NO: 3346512 - DNA, 17 bp, Homo sapiens
tgtatgttatgaacatg

SEQ ID NO: 3346513 - DNA, 15 bp, Homo sapiens
tgtatgttatgatat

SEQ ID NO: 3346514 - DNA, 21 bp, Homo sapiens
tgtatgttattatattccgta

SEQ ID NO: 3346515 - DNA, 16 bp, Homo sapiens
tgtatgtttacatatc

SEQ ID NO: 3346516 - DNA, 22 bp, Homo sapiens
tgtatgtttttgactcttttga

SEQ ID NO: 3346517 - DNA, 18 bp, Homo sapiens
tgtattaaatcttaaaca

SEQ ID NO: 3346518 - DNA, 22 bp, Homo sapiens
tgtattaaatcttaaacaatgt

SEQ ID NO: 3346519 - DNA, 12 bp, Homo sapiens
tgtattaacaaa

SEQ ID NO: 3346520 - DNA, 13 bp, Homo sapiens
tgtattaacaaaa

SEQ ID NO: 3346521 - DNA, 15 bp, Homo sapiens
tgtattaataaagca

SEQ ID NO: 3346522 - DNA, 16 bp, Homo sapiens
tgtattaataaagcat

SEQ ID NO: 3346523 - DNA, 15 bp, Homo sapiens
tgtattatttataat

SEQ ID NO: 3346524 - DNA, 14 bp, Homo sapiens
tgtattcaagcaaa

SEQ ID NO: 3346525 - DNA, 13 bp, Homo sapiens
tgtattccaagac

SEQ ID NO: 3346526 - DNA, 15 bp, Homo sapiens
tgtattccaagacat

SEQ ID NO: 3346527 - DNA, 20 bp, Homo sapiens
tgtattccaagacatgtctg

SEQ ID NO: 3346528 - DNA, 21 bp, Homo sapiens
tgtattccaagacatgtctgt

SEQ ID NO: 3346529 - DNA, 18 bp, Homo sapiens
tgtattcccttgtatttt

SEQ ID NO: 3346530 - DNA, 20 bp, Homo sapiens
tgtattcccttgtattttgt

SEQ ID NO: 3346531 - DNA, 22 bp, Homo sapiens
tgtattcccttgtattttgtta

SEQ ID NO: 3346532 - DNA, 14 bp, Homo sapiens
tgtattcctgaaaa

SEQ ID NO: 3346533 - DNA, 19 bp, Homo sapiens
tgtattcttttccaagctc

SEQ ID NO: 3346534 - DNA, 16 bp, Homo sapiens
tgtattcttttctcag

SEQ ID NO: 3346535 - DNA, 17 bp, Homo sapiens
tgtattgtacataaaat

SEQ ID NO: 3346536 - DNA, 20 bp, Homo sapiens
tgtatttaattcttcacctt

SEQ ID NO: 3346537 - DNA, 17 bp, Homo sapiens
tgtatttaattgtaaac

SEQ ID NO: 3346538 - DNA, 18 bp, Homo sapiens
tgtatttaattgtaaact

SEQ ID NO: 3346539 - DNA, 13 bp, Homo sapiens
tgtatttactgta

SEQ ID NO: 3346540 - DNA, 14 bp, Homo sapiens
tgtatttataaata

SEQ ID NO: 3346541 - DNA, 17 bp, Homo sapiens
tgtatttatgtgtgagg

SEQ ID NO: 3346542 - DNA, 14 bp, Homo sapiens
tgtatttattaatt

SEQ ID NO: 3346543 - DNA, 14 bp, Homo sapiens
tgtatttattccat

SEQ ID NO: 3346544 - DNA, 23 bp, Homo sapiens
tgtatttattccatattcatgta

SEQ ID NO: 3346545 - DNA, 23 bp, Homo sapiens
tgtatttattgaagaaacagata

SEQ ID NO: 3346546 - DNA, 15 bp, Homo sapiens
tgtatttctaagaag

SEQ ID NO: 3346547 - DNA, 12 bp, Homo sapiens
tgtatttggaaa

SEQ ID NO: 3346548 - DNA, 20 bp, Homo sapiens
tgtatttggaatatttgaat

SEQ ID NO: 3346549 - DNA, 23 bp, Homo sapiens
tgtatttggaatatttgaataat

SEQ ID NO: 3346550 - DNA, 13 bp, Homo sapiens
tgtatttgtatta

SEQ ID NO: 3346551 - DNA, 14 bp, Homo sapiens
tgtatttgttcatg

SEQ ID NO: 3346552 - DNA, 13 bp, Homo sapiens
tgtattttcctgg

SEQ ID NO: 3346553 - DNA, 14 bp, Homo sapiens
tgtattttcctgga

SEQ ID NO: 3346554 - DNA, 13 bp, Homo sapiens
tgtattttgaaga

SEQ ID NO: 3346555 - DNA, 14 bp, Homo sapiens
tgtattttgaagaa

SEQ ID NO: 3346556 - DNA, 15 bp, Homo sapiens
tgtattttgatgaga

SEQ ID NO: 3346557 - DNA, 14 bp, Homo sapiens
tgtattttgtgtga

SEQ ID NO: 3346558 - DNA, 16 bp, Homo sapiens
tgtattttgtgtgacc

SEQ ID NO: 3346559 - DNA, 12 bp, Homo sapiens
tgtattttgtta

SEQ ID NO: 3346560 - DNA, 16 bp, Homo sapiens
tgtattttgttaaagc

SEQ ID NO: 3346561 - DNA, 17 bp, Homo sapiens
tgtattttgttaaagct

SEQ ID NO: 3346562 - DNA, 14 bp, Homo sapiens
tgtatttttaatgg

SEQ ID NO: 3346563 - DNA, 19 bp, Homo sapiens
tgtatttttcaataaagca

SEQ ID NO: 3346564 - DNA, 14 bp, Homo sapiens
tgtatttttctaca

SEQ ID NO: 3346565 - DNA, 14 bp, Homo sapiens
tgtattttttaaaa

SEQ ID NO: 3346566 - DNA, 15 bp, Homo sapiens
tgtattttttaaaat

SEQ ID NO: 3346567 - DNA, 18 bp, Homo sapiens
tgtattttttatttacat

SEQ ID NO: 3346568 - DNA, 22 bp, Homo sapiens
tgtattttttatttacatttta

SEQ ID NO: 3346569 - DNA, 13 bp, Homo sapiens
tgtcaaaacactg

SEQ ID NO: 3346570 - DNA, 16 bp, Homo sapiens
tgtcaaaacactgtgg

SEQ ID NO: 3346571 - DNA, 18 bp, Homo sapiens
tgtcaaaacactgtggaa

SEQ ID NO: 3346572 - DNA, 16 bp, Homo sapiens
tgtcaaaagttggact

SEQ ID NO: 3346573 - DNA, 14 bp, Homo sapiens
tgtcacaggcaggt

SEQ ID NO: 3346574 - DNA, 15 bp, Homo sapiens
tgtcacaggcaggtc

SEQ ID NO: 3346575 - DNA, 16 bp, Homo sapiens
tgtcacaggcaggtcc

SEQ ID NO: 3346576 - DNA, 12 bp, Homo sapiens
tgtcacagggcc

SEQ ID NO: 3346577 - DNA, 12 bp, Homo sapiens
tgtcacagttct

SEQ ID NO: 3346578 - DNA, 18 bp, Homo sapiens
tgtcacatagtttttcct

SEQ ID NO: 3346579 - DNA, 20 bp, Homo sapiens
tgtcacctctctcagagcat

SEQ ID NO: 3346580 - DNA, 13 bp, Homo sapiens
tgtcacctctgtt

SEQ ID NO: 3346581 - DNA, 13 bp, Homo sapiens
tgtcacgtactgt

SEQ ID NO: 3346582 - DNA, 22 bp, Homo sapiens
tgtcactcacatggacccaaga

SEQ ID NO: 3346583 - DNA, 15 bp, Homo sapiens
tgtcactcattgctg

SEQ ID NO: 3346584 - DNA, 16 bp, Homo sapiens
tgtcactctaggaaga

SEQ ID NO: 3346585 - DNA, 22 bp, Homo sapiens
tgtcactctaggaagaagacaa

SEQ ID NO: 3346586 - DNA, 16 bp, Homo sapiens
tgtcactggctggctc

SEQ ID NO: 3346587 - DNA, 17 bp, Homo sapiens
tgtcactggctggctcc

SEQ ID NO: 3346588 - DNA, 17 bp, Homo sapiens
tgtcactgtttctctgc

SEQ ID NO: 3346589 - DNA, 14 bp, Homo sapiens
tgtcacttactgtt

SEQ ID NO: 3346590 - DNA, 21 bp, Homo sapiens
tgtcacttactgtttctgtca

SEQ ID NO: 3346591 - DNA, 15 bp, Homo sapiens
tgtcacttgtgcttt

SEQ ID NO: 3346592 - DNA, 20 bp, Homo sapiens
tgtcacttgtgctttgctct

SEQ ID NO: 3346593 - DNA, 14 bp, Homo sapiens
tgtcactttgctct

SEQ ID NO: 3346594 - DNA, 16 bp, Homo sapiens
tgtcactttgctctgg

SEQ ID NO: 3346595 - DNA, 17 bp, Homo sapiens
tgtcagaaaccctggtc

SEQ ID NO: 3346596 - DNA, 19 bp, Homo sapiens
tgtcagaaaccctggtctc

SEQ ID NO: 3346597 - DNA, 18 bp, Homo sapiens
tgtcagaagcctccaagc

SEQ ID NO: 3346598 - DNA, 18 bp, Homo sapiens
tgtcagaatcctttacat

SEQ ID NO: 3346599 - DNA, 14 bp, Homo sapiens
tgtcagacataaag

SEQ ID NO: 3346600 - DNA, 20 bp, Homo sapiens
tgtcagacataaagccatgt

SEQ ID NO: 3346601 - DNA, 20 bp, Homo sapiens
tgtcagacctatttgacata

SEQ ID NO: 3346602 - DNA, 12 bp, Homo sapiens
tgtcagaggcta

SEQ ID NO: 3346603 - DNA, 20 bp, Homo sapiens
tgtcagatattttttcagaa

SEQ ID NO: 3346604 - DNA, 18 bp, Homo sapiens
tgtcagatgagaacaaag

SEQ ID NO: 3346605 - DNA, 10 bp, Homo sapiens
tgtcagatgc

SEQ ID NO: 3346606 - DNA, 18 bp, Homo sapiens
tgtcagattaaattacag

SEQ ID NO: 3346607 - DNA, 19 bp, Homo sapiens
tgtcagccagccgccctgg

SEQ ID NO: 3346608 - DNA, 20 bp, Homo sapiens
tgtcagccatcgtcctggga

SEQ ID NO: 3346609 - DNA, 22 bp, Homo sapiens
tgtcagccatcgtcctgggact

SEQ ID NO: 3346610 - DNA, 23 bp, Homo sapiens
tgtcagccatcgtcctgggactc

SEQ ID NO: 3346611 - DNA, 23 bp, Homo sapiens
tgtcagccgagccgggcctgggg

SEQ ID NO: 3346612 - DNA, 13 bp, Homo sapiens
tgtcagcctgtgc

SEQ ID NO: 3346613 - DNA, 14 bp, Homo sapiens
tgtcagcctgtgct

SEQ ID NO: 3346614 - DNA, 17 bp, Homo sapiens
tgtcagcctgtgctgtg

SEQ ID NO: 3346615 - DNA, 23 bp, Homo sapiens
tgtcagctactgcggaaaaggaa

SEQ ID NO: 3346616 - DNA, 19 bp, Homo sapiens
tgtcagctcaggcagctcg

SEQ ID NO: 3346617 - DNA, 23 bp, Homo sapiens
tgtcagctgcaaggtactctggt

SEQ ID NO: 3346618 - DNA, 17 bp, Homo sapiens
tgtcagcttcccagcca

SEQ ID NO: 3346619 - DNA, 20 bp, Homo sapiens
tgtcagcttcccagccatgc

SEQ ID NO: 3346620 - DNA, 21 bp, Homo sapiens
tgtcagcttcccagccatgcc

SEQ ID NO: 3346621 - DNA, 14 bp, Homo sapiens
tgtcaggcatggct

SEQ ID NO: 3346622 - DNA, 22 bp, Homo sapiens
tgtcaggcatggctcagagctt

SEQ ID NO: 3346623 - DNA, 14 bp, Homo sapiens
tgtcaggcctgtgt

SEQ ID NO: 3346624 - DNA, 14 bp, Homo sapiens
tgtcaggctctggc

SEQ ID NO: 3346625 - DNA, 22 bp, Homo sapiens
tgtcaggctctggcccttgcct

SEQ ID NO: 3346626 - DNA, 17 bp, Homo sapiens
tgtcaggtggggcagct

SEQ ID NO: 3346627 - DNA, 18 bp, Homo sapiens
tgtcaggtggggcagctt

SEQ ID NO: 3346628 - DNA, 20 bp, Homo sapiens
tgtcaggtggggcagcttga

SEQ ID NO: 3346629 - DNA, 14 bp, Homo sapiens
tgtcagtatccagg

SEQ ID NO: 3346630 - DNA, 20 bp, Homo sapiens
tgtcagtatctgtatctctc

SEQ ID NO: 3346631 - DNA, 15 bp, Homo sapiens
tgtcagtatttcaac

SEQ ID NO: 3346632 - DNA, 16 bp, Homo sapiens
tgtcagtatttcaact

SEQ ID NO: 3346633 - DNA, 21 bp, Homo sapiens
tgtcagtatttcaactgctgt

SEQ ID NO: 3346634 - DNA, 22 bp, Homo sapiens
tgtcagtatttcaactgctgta

SEQ ID NO: 3346635 - DNA, 17 bp, Homo sapiens
tgtcagtatttttgccg

SEQ ID NO: 3346636 - DNA, 11 bp, Homo sapiens
tgtcagtgttt

SEQ ID NO: 3346637 - DNA, 13 bp, Homo sapiens
tgtcagtgttttt

SEQ ID NO: 3346638 - DNA, 18 bp, Homo sapiens
tgtcagtgtttttgaaac

SEQ ID NO: 3346639 - DNA, 17 bp, Homo sapiens
tgtcataagaatgaata

SEQ ID NO: 3346640 - DNA, 18 bp, Homo sapiens
tgtcataatggtgaatgt

SEQ ID NO: 3346641 - DNA, 15 bp, Homo sapiens
tgtcatagaaattac

SEQ ID NO: 3346642 - DNA, 14 bp, Homo sapiens
tgtcatcactccct

SEQ ID NO: 3346643 - DNA, 15 bp, Homo sapiens
tgtcatcactccctg

SEQ ID NO: 3346644 - DNA, 17 bp, Homo sapiens
tgtcatcagaagataac

SEQ ID NO: 3346645 - DNA, 19 bp, Homo sapiens
tgtcatcagagctcctctg

SEQ ID NO: 3346646 - DNA, 19 bp, Homo sapiens
tgtcatcctcaaagaaagt

SEQ ID NO: 3346647 - DNA, 23 bp, Homo sapiens
tgtcatcctcaaagaaagtgtat

SEQ ID NO: 3346648 - DNA, 20 bp, Homo sapiens
tgtcatccttggtctttgta

SEQ ID NO: 3346649 - DNA, 14 bp, Homo sapiens
tgtcatctgaggag

SEQ ID NO: 3346650 - DNA, 16 bp, Homo sapiens
tgtcatgaattcttat

SEQ ID NO: 3346651 - DNA, 14 bp, Homo sapiens
tgtcatgcccccct

SEQ ID NO: 3346652 - DNA, 16 bp, Homo sapiens
tgtcatgctgggattt

SEQ ID NO: 3346653 - DNA, 22 bp, Homo sapiens
tgtcatgcttcatcattccctc

SEQ ID NO: 3346654 - DNA, 12 bp, Homo sapiens
tgtcatggtcct

SEQ ID NO: 3346655 - DNA, 21 bp, Homo sapiens
tgtcatggtcctttctggaag

SEQ ID NO: 3346656 - DNA, 14 bp, Homo sapiens
tgtcattaatgtgt

SEQ ID NO: 3346657 - DNA, 20 bp, Homo sapiens
tgtcattatattctaattaa

SEQ ID NO: 3346658 - DNA, 22 bp, Homo sapiens
tgtcattatattctaattaaaa

SEQ ID NO: 3346659 - DNA, 17 bp, Homo sapiens
tgtcattgcacataagc

SEQ ID NO: 3346660 - DNA, 21 bp, Homo sapiens
tgtcattgcacataagcttcc

SEQ ID NO: 3346661 - DNA, 14 bp, Homo sapiens
tgtcattgtaaaca

SEQ ID NO: 3346662 - DNA, 19 bp, Homo sapiens
tgtcatttgagcagggctc

SEQ ID NO: 3346663 - DNA, 22 bp, Homo sapiens
tgtcatttgagcagggctcagc

SEQ ID NO: 3346664 - DNA, 15 bp, Homo sapiens
tgtcattttatgaat

SEQ ID NO: 3346665 - DNA, 19 bp, Homo sapiens
tgtcatttttaacagcatg

SEQ ID NO: 3346666 - DNA, 22 bp, Homo sapiens
tgtcatttttaatattactgtc

SEQ ID NO: 3346667 - DNA, 23 bp, Homo sapiens
tgtcatttttaatattactgtct

SEQ ID NO: 3346668 - DNA, 15 bp, Homo sapiens
tgtccaaaactgcct

SEQ ID NO: 3346669 - DNA, 16 bp, Homo sapiens
tgtccaaaactgcctc

SEQ ID NO: 3346670 - DNA, 19 bp, Homo sapiens
tgtccaaaggaggctggca

SEQ ID NO: 3346671 - DNA, 13 bp, Homo sapiens
tgtccaacaataa

SEQ ID NO: 3346672 - DNA, 18 bp, Homo sapiens
tgtccaacaataaacagg

SEQ ID NO: 3346673 - DNA, 22 bp, Homo sapiens
tgtccaagttcttcacctctat

SEQ ID NO: 3346674 - DNA, 16 bp, Homo sapiens
tgtcccccagctctgg

SEQ ID NO: 3346675 - DNA, 14 bp, Homo sapiens
tgtcccccccagtg

SEQ ID NO: 3346676 - DNA, 19 bp, Homo sapiens
tgtccccctcccctcccag

SEQ ID NO: 3346677 - DNA, 18 bp, Homo sapiens
tgtcccctcactctgtca

SEQ ID NO: 3346678 - DNA, 18 bp, Homo sapiens
tgtcccctccactgtcac

SEQ ID NO: 3346679 - DNA, 13 bp, Homo sapiens
tgtcccctgagtt

SEQ ID NO: 3346680 - DNA, 22 bp, Homo sapiens
tgtcccgccttcctcctccaca

SEQ ID NO: 3346681 - DNA, 16 bp, Homo sapiens
tgtcccggggtcctgt

SEQ ID NO: 3346682 - DNA, 22 bp, Homo sapiens
tgtccctaatttaacccagctc

SEQ ID NO: 3346683 - DNA, 21 bp, Homo sapiens
tgtccctaccgagtctcttct

SEQ ID NO: 3346684 - DNA, 22 bp, Homo sapiens
tgtccctaccgagtctcttctc

SEQ ID NO: 3346685 - DNA, 16 bp, Homo sapiens
tgtccctatacactag

SEQ ID NO: 3346686 - DNA, 22 bp, Homo sapiens
tgtccctctcactccccagccc

SEQ ID NO: 3346687 - DNA, 15 bp, Homo sapiens
tgtccctgaaaccta

SEQ ID NO: 3346688 - DNA, 16 bp, Homo sapiens
tgtccctgcagggcca

SEQ ID NO: 3346689 - DNA, 13 bp, Homo sapiens
tgtccctggacac

SEQ ID NO: 3346690 - DNA, 17 bp, Homo sapiens
tgtccctggacacagct

SEQ ID NO: 3346691 - DNA, 18 bp, Homo sapiens
tgtccctggacacagctc

SEQ ID NO: 3346692 - DNA, 23 bp, Homo sapiens
tgtccctggacacagctcttcat

SEQ ID NO: 3346693 - DNA, 14 bp, Homo sapiens
tgtccctgggccag

SEQ ID NO: 3346694 - DNA, 17 bp, Homo sapiens
tgtccctgtccttccct

SEQ ID NO: 3346695 - DNA, 22 bp, Homo sapiens
tgtccctgtccttccctgttct

SEQ ID NO: 3346696 - DNA, 17 bp, Homo sapiens
tgtcccttccacttcta

SEQ ID NO: 3346697 - DNA, 15 bp, Homo sapiens
tgtccctttcagaga

SEQ ID NO: 3346698 - DNA, 19 bp, Homo sapiens
tgtccgatggtatctgggt

SEQ ID NO: 3346699 - DNA, 15 bp, Homo sapiens
tgtccggcccagtgc

SEQ ID NO: 3346700 - DNA, 18 bp, Homo sapiens
tgtcctacttctgacttt

SEQ ID NO: 3346701 - DNA, 21 bp, Homo sapiens
tgtcctacttctgactttact

SEQ ID NO: 3346702 - DNA, 18 bp, Homo sapiens
tgtcctatggacaactta

SEQ ID NO: 3346703 - DNA, 13 bp, Homo sapiens
tgtcctatgtgtg

SEQ ID NO: 3346704 - DNA, 22 bp, Homo sapiens
tgtcctatgtgtgactctaaat

SEQ ID NO: 3346705 - DNA, 19 bp, Homo sapiens
tgtcctcagaggcgtgctg

SEQ ID NO: 3346706 - DNA, 12 bp, Homo sapiens
tgtcctcaggga

SEQ ID NO: 3346707 - DNA, 16 bp, Homo sapiens
tgtcctccagaagcct

SEQ ID NO: 3346708 - DNA, 21 bp, Homo sapiens
tgtcctccagaagcctctggc

SEQ ID NO: 3346709 - DNA, 22 bp, Homo sapiens
tgtcctccagaagcctctggct

SEQ ID NO: 3346710 - DNA, 17 bp, Homo sapiens
tgtcctcccatcccctg

SEQ ID NO: 3346711 - DNA, 23 bp, Homo sapiens
tgtcctcccatcccctggactgg

SEQ ID NO: 3346712 - DNA, 14 bp, Homo sapiens
tgtcctcctggaag

SEQ ID NO: 3346713 - DNA, 14 bp, Homo sapiens
tgtcctgaccaccc

SEQ ID NO: 3346714 - DNA, 21 bp, Homo sapiens
tgtcctgaccaccctcccctc

SEQ ID NO: 3346715 - DNA, 21 bp, Homo sapiens
tgtcctgatggtcagctccct

SEQ ID NO: 3346716 - DNA, 12 bp, Homo sapiens
tgtcctgccagc

SEQ ID NO: 3346717 - DNA, 17 bp, Homo sapiens
tgtcctgccagctgcct

SEQ ID NO: 3346718 - DNA, 17 bp, Homo sapiens
tgtcctgcctattatct

SEQ ID NO: 3346719 - DNA, 24 bp, Homo sapiens
tgtcctgcctattatctgtcagct

SEQ ID NO: 3346720 - DNA, 21 bp, Homo sapiens
tgtcctgggcctgcccctgtg

SEQ ID NO: 3346721 - DNA, 16 bp, Homo sapiens
tgtcctggtgtcactt

SEQ ID NO: 3346722 - DNA, 21 bp, Homo sapiens
tgtcctggtgtcacttactgt

SEQ ID NO: 3346723 - DNA, 15 bp, Homo sapiens
tgtcctggttcccgt

SEQ ID NO: 3346724 - DNA, 16 bp, Homo sapiens
tgtcctgtacattgtg

SEQ ID NO: 3346725 - DNA, 14 bp, Homo sapiens
tgtccttcagagct

SEQ ID NO: 3346726 - DNA, 16 bp, Homo sapiens
tgtccttcagagctct

SEQ ID NO: 3346727 - DNA, 12 bp, Homo sapiens
tgtccttccctg

SEQ ID NO: 3346728 - DNA, 19 bp, Homo sapiens
tgtccttccctgttctccc

SEQ ID NO: 3346729 - DNA, 18 bp, Homo sapiens
tgtccttggaagtttcat

SEQ ID NO: 3346730 - DNA, 14 bp, Homo sapiens
tgtccttgggttgc

SEQ ID NO: 3346731 - DNA, 18 bp, Homo sapiens
tgtccttgggttgctggt

SEQ ID NO: 3346732 - DNA, 15 bp, Homo sapiens
tgtcctttcccctct

SEQ ID NO: 3346733 - DNA, 18 bp, Homo sapiens
tgtcctttcccctctctg

SEQ ID NO: 3346734 - DNA, 17 bp, Homo sapiens
tgtccttttatttctcc

SEQ ID NO: 3346735 - DNA, 16 bp, Homo sapiens
tgtccttttgtcttct

SEQ ID NO: 3346736 - DNA, 22 bp, Homo sapiens
tgtcgaaaagagtcttccaatt

SEQ ID NO: 3346737 - DNA, 14 bp, Homo sapiens
tgtcgacatgtttt

SEQ ID NO: 3346738 - DNA, 15 bp, Homo sapiens
tgtcgcccagtctgg

SEQ ID NO: 3346739 - DNA, 17 bp, Homo sapiens
tgtcgccccaggccctc

SEQ ID NO: 3346740 - DNA, 14 bp, Homo sapiens
tgtcgcgctcagca

SEQ ID NO: 3346741 - DNA, 16 bp, Homo sapiens
tgtcgctcatgtgtgc

SEQ ID NO: 3346742 - DNA, 17 bp, Homo sapiens
tgtcgctctgctggcct

SEQ ID NO: 3346743 - DNA, 19 bp, Homo sapiens
tgtcgctctgctggcctgg

SEQ ID NO: 3346744 - DNA, 23 bp, Homo sapiens
tgtcggttttttttaaataaaag

SEQ ID NO: 3346745 - DNA, 16 bp, Homo sapiens
tgtcgtaaagatttgg

SEQ ID NO: 3346746 - DNA, 12 bp, Homo sapiens
tgtcgtctgtga

SEQ ID NO: 3346747 - DNA, 13 bp, Homo sapiens
tgtcgtctgtgaa

SEQ ID NO: 3346748 - DNA, 17 bp, Homo sapiens
tgtcgtctgtgaatgct

SEQ ID NO: 3346749 - DNA, 21 bp, Homo sapiens
tgtctaaacaatgctgatttg

SEQ ID NO: 3346750 - DNA, 16 bp, Homo sapiens
tgtctaagattctaga

SEQ ID NO: 3346751 - DNA, 17 bp, Homo sapiens
tgtctaagattctagat

SEQ ID NO: 3346752 - DNA, 19 bp, Homo sapiens
tgtctaattgcatctcaaa

SEQ ID NO: 3346753 - DNA, 22 bp, Homo sapiens
tgtctagaaagtaagaaaacaa

SEQ ID NO: 3346754 - DNA, 17 bp, Homo sapiens
tgtctagagtcatgtga

SEQ ID NO: 3346755 - DNA, 16 bp, Homo sapiens
tgtctagtttcccaca

SEQ ID NO: 3346756 - DNA, 22 bp, Homo sapiens
tgtctataatcccagcactttg

SEQ ID NO: 3346757 - DNA, 16 bp, Homo sapiens
tgtctatgaagttgct

SEQ ID NO: 3346758 - DNA, 19 bp, Homo sapiens
tgtctatgaagttgctgtt

SEQ ID NO: 3346759 - DNA, 22 bp, Homo sapiens
tgtctatgaagttgctgtttat

SEQ ID NO: 3346760 - DNA, 17 bp, Homo sapiens
tgtctatgattgtactt

SEQ ID NO: 3346761 - DNA, 21 bp, Homo sapiens
tgtctatgattgtactttgaa

SEQ ID NO: 3346762 - DNA, 15 bp, Homo sapiens
tgtctatgcagcctg

SEQ ID NO: 3346763 - DNA, 16 bp, Homo sapiens
tgtctatgcagcctgc

SEQ ID NO: 3346764 - DNA, 17 bp, Homo sapiens
tgtctatgcagcctgct

SEQ ID NO: 3346765 - DNA, 19 bp, Homo sapiens
tgtctatgtagctgaaaat

SEQ ID NO: 3346766 - DNA, 13 bp, Homo sapiens
tgtctattcagct

SEQ ID NO: 3346767 - DNA, 17 bp, Homo sapiens
tgtctattctgagcctt

SEQ ID NO: 3346768 - DNA, 18 bp, Homo sapiens
tgtctattctgagccttg

SEQ ID NO: 3346769 - DNA, 12 bp, Homo sapiens
tgtctcaaaaaa

SEQ ID NO: 3346770 - DNA, 23 bp, Homo sapiens
tgtgtggattgcctctgaaaagt

SEQ ID NO: 3346771 - DNA, 15 bp, Homo sapiens
tgtgtgggactgtac

SEQ ID NO: 3346772 - DNA, 18 bp, Homo sapiens
tgtgtgggactgtacaca

SEQ ID NO: 3346773 - DNA, 20 bp, Homo sapiens
tgtgtggtgtcgtctgtgaa

SEQ ID NO: 3346774 - DNA, 20 bp, Homo sapiens
tgtgtggtttggtgtgttcc

SEQ ID NO: 3346775 - DNA, 10 bp, Homo sapiens
tgtgtgtact

SEQ ID NO: 3346776 - DNA, 14 bp, Homo sapiens
tgtgtgtatatatg

SEQ ID NO: 3346777 - DNA, 12 bp, Homo sapiens
tgtgtgtatttg

SEQ ID NO: 3346778 - DNA, 16 bp, Homo sapiens
tgtgtgtccaaaactg

SEQ ID NO: 3346779 - DNA, 16 bp, Homo sapiens
tgtgtgtcttaattat

SEQ ID NO: 3346780 - DNA, 20 bp, Homo sapiens
tgtgtgtgaatgaacactct

SEQ ID NO: 3346781 - DNA, 13 bp, Homo sapiens
tgtgtgtgtatgt

SEQ ID NO: 3346782 - DNA, 11 bp, Homo sapiens
tgtgtgtgtgt

SEQ ID NO: 3346783 - DNA, 15 bp, Homo sapiens
tgtgtgtgtgtatga

SEQ ID NO: 3346784 - DNA, 20 bp, Homo sapiens
tgtgtgttcttcaagccagc

SEQ ID NO: 3346785 - DNA, 16 bp, Homo sapiens
tgtgtgttgtcagcct

SEQ ID NO: 3346786 - DNA, 18 bp, Homo sapiens
tgtgtgttgtctcttgag

SEQ ID NO: 3346787 - DNA, 18 bp, Homo sapiens
tgtgtgttgtcttgaaag

SEQ ID NO: 3346788 - DNA, 15 bp, Homo sapiens
tgtgtgtttcacttt

SEQ ID NO: 3346789 - DNA, 10 bp, Homo sapiens
tgtgtgtttg

SEQ ID NO: 3346790 - DNA, 15 bp, Homo sapiens
tgtgtgtttgtgctg

SEQ ID NO: 3346791 - DNA, 22 bp, Homo sapiens
tgtgttaagtatgtgtaaaatg

SEQ ID NO: 3346792 - DNA, 14 bp, Homo sapiens
tgtgttatgaagca

SEQ ID NO: 3346793 - DNA, 22 bp, Homo sapiens
tgtgttattcgtgaatagtctt

SEQ ID NO: 3346794 - DNA, 18 bp, Homo sapiens
tgtgttcatgctgaatcc

SEQ ID NO: 3346795 - DNA, 23 bp, Homo sapiens
tgtgttcatgctgaatccacctc

SEQ ID NO: 3346796 - DNA, 19 bp, Homo sapiens
tgtgttccaactgccccca

SEQ ID NO: 3346797 - DNA, 14 bp, Homo sapiens
tgtgttcccagagg

SEQ ID NO: 3346798 - DNA, 15 bp, Homo sapiens
tgtgttcctcctgct

SEQ ID NO: 3346799 - DNA, 16 bp, Homo sapiens
tgtgttcctggcaata

SEQ ID NO: 3346800 - DNA, 19 bp, Homo sapiens
tgtgttctgtttgttaaaa

SEQ ID NO: 3346801 - DNA, 21 bp, Homo sapiens
tgtgttctgtttgttaaaact

SEQ ID NO: 3346802 - DNA, 12 bp, Homo sapiens
tgtgttgaaaca

SEQ ID NO: 3346803 - DNA, 24 bp, Homo sapiens
tgtgttgcattattcatttagtga

SEQ ID NO: 3346804 - DNA, 22 bp, Homo sapiens
tgtgttgccacagtagaactgt

SEQ ID NO: 3346805 - DNA, 23 bp, Homo sapiens
tgtgttgctaaaaaaagtgcatg

SEQ ID NO: 3346806 - DNA, 18 bp, Homo sapiens
tgtgttgctgtttagagt

SEQ ID NO: 3346807 - DNA, 15 bp, Homo sapiens
tgtgttggacagaga

SEQ ID NO: 3346808 - DNA, 19 bp, Homo sapiens
tgtgttgtattaacaaaag

SEQ ID NO: 3346809 - DNA, 13 bp, Homo sapiens
tgtgttgtgatag

SEQ ID NO: 3346810 - DNA, 13 bp, Homo sapiens
tgtgttgttgctt

SEQ ID NO: 3346811 - DNA, 14 bp, Homo sapiens
tgtgttgttgcttt

SEQ ID NO: 3346812 - DNA, 16 bp, Homo sapiens
tgtgtttaatttcttc

SEQ ID NO: 3346813 - DNA, 16 bp, Homo sapiens
tgtgtttacagacaga

SEQ ID NO: 3346814 - DNA, 14 bp, Homo sapiens
tgtgtttatttcac

SEQ ID NO: 3346815 - DNA, 13 bp, Homo sapiens
tgtgtttcacttt

SEQ ID NO: 3346816 - DNA, 17 bp, Homo sapiens
tgtgtttgaaagtgaaa

SEQ ID NO: 3346817 - DNA, 16 bp, Homo sapiens
tgtgtttgaaatcatc

SEQ ID NO: 3346818 - DNA, 15 bp, Homo sapiens
tgtgtttgcttaaac

SEQ ID NO: 3346819 - DNA, 15 bp, Homo sapiens
tgttgggattcctga

SEQ ID NO: 3346820 - DNA, 17 bp, Homo sapiens
tgttgggattcctgacc

SEQ ID NO: 3346821 - DNA, 18 bp, Homo sapiens
tgttggggaaaccttcat

SEQ ID NO: 3346822 - DNA, 20 bp, Homo sapiens
tgttggggaagggcctgccc

SEQ ID NO: 3346823 - DNA, 23 bp, Homo sapiens
tgttggtctttctaatgtagcta

SEQ ID NO: 3346824 - DNA, 14 bp, Homo sapiens
tgttggttccaagc

SEQ ID NO: 3346825 - DNA, 14 bp, Homo sapiens
tgttggtttacttt

SEQ ID NO: 3346826 - DNA, 17 bp, Homo sapiens
tgttggtttactttcaa

SEQ ID NO: 3346827 - DNA, 13 bp, Homo sapiens
tgttgtaaaacaa

SEQ ID NO: 3346828 - DNA, 15 bp, Homo sapiens
tgttgtaaattagga

SEQ ID NO: 3346829 - DNA, 18 bp, Homo sapiens
tgttgtaacctgctgtga

SEQ ID NO: 3346830 - DNA, 16 bp, Homo sapiens
tgttgtaagaattctg

SEQ ID NO: 3346831 - DNA, 18 bp, Homo sapiens
tgttgtaataaaacttat

SEQ ID NO: 3346832 - DNA, 13 bp, Homo sapiens
tgttgtaatgctg

SEQ ID NO: 3346833 - DNA, 18 bp, Homo sapiens
tgttgtacaatcaaaaca

SEQ ID NO: 3346834 - DNA, 23 bp, Homo sapiens
tgttgtacaattaagttacaatt

SEQ ID NO: 3346835 - DNA, 17 bp, Homo sapiens
tgttgtacgtaaagctt

SEQ ID NO: 3346836 - DNA, 15 bp, Homo sapiens
tgttgtacttaaatg

SEQ ID NO: 3346837 - DNA, 14 bp, Homo sapiens
tgttgtattaacaa

SEQ ID NO: 3346838 - DNA, 15 bp, Homo sapiens
tgttgtattaacaaa

SEQ ID NO: 3346839 - DNA, 16 bp, Homo sapiens
tgttgtattaacaaaa

SEQ ID NO: 3346840 - DNA, 13 bp, Homo sapiens
tgttgtattttaa

SEQ ID NO: 3346841 - DNA, 19 bp, Homo sapiens
tgttgtcattgtaaacaaa

SEQ ID NO: 3346842 - DNA, 21 bp, Homo sapiens
tgttgtcattgtaaacaaact

SEQ ID NO: 3346843 - DNA, 12 bp, Homo sapiens
tgttgtccaaca

SEQ ID NO: 3346844 - DNA, 15 bp, Homo sapiens
tgttgtctcttgagt

SEQ ID NO: 3346845 - DNA, 16 bp, Homo sapiens
tgttgtgatcttgcat

SEQ ID NO: 3346846 - DNA, 20 bp, Homo sapiens
tgttgtgatgtattctagct

SEQ ID NO: 3346847 - DNA, 13 bp, Homo sapiens
tgttgtgatgtct

SEQ ID NO: 3346848 - DNA, 14 bp, Homo sapiens
tgttgtgatgtctt

SEQ ID NO: 3346849 - DNA, 13 bp, Homo sapiens
tgttgtggctctt

SEQ ID NO: 3346850 - DNA, 17 bp, Homo sapiens
tgttgtggtttaaatac

SEQ ID NO: 3346851 - DNA, 17 bp, Homo sapiens
tgttgttaatgaaaatg

SEQ ID NO: 3346852 - DNA, 18 bp, Homo sapiens
tgttgttaatgaaaatgt

SEQ ID NO: 3346853 - DNA, 11 bp, Homo sapiens
tgttgttattt

SEQ ID NO: 3346854 - DNA, 13 bp, Homo sapiens
tgttgttatttaa

SEQ ID NO: 3346855 - DNA, 23 bp, Homo sapiens
tgttgttcaaatgcattttgggg

SEQ ID NO: 3346856 - DNA, 13 bp, Homo sapiens
tgttgttccaaat

SEQ ID NO: 3346857 - DNA, 15 bp, Homo sapiens
tgttgttccatttta

SEQ ID NO: 3346858 - DNA, 19 bp, Homo sapiens
tgttgttccattttatgca

SEQ ID NO: 3346859 - DNA, 13 bp, Homo sapiens
tgttgttggttgt

SEQ ID NO: 3346860 - DNA, 12 bp, Homo sapiens
tgttgtttcttt

SEQ ID NO: 3346861 - DNA, 11 bp, Homo sapiens
tgttgtttgat

SEQ ID NO: 3346862 - DNA, 12 bp, Homo sapiens
tgttgtttgtaa

SEQ ID NO: 3346863 - DNA, 20 bp, Homo sapiens
tgttgttttgttttaaatac

SEQ ID NO: 3346864 - DNA, 21 bp, Homo sapiens
tgtttaaaaagtaagttaata

SEQ ID NO: 3346865 - DNA, 22 bp, Homo sapiens
tgtttaaaactcagaatataac

SEQ ID NO: 3346866 - DNA, 15 bp, Homo sapiens
tgtttaaaataaaat

SEQ ID NO: 3346867 - DNA, 19 bp, Homo sapiens
tgtttaaaataaaatgaaa

SEQ ID NO: 3346868 - DNA, 20 bp, Homo sapiens
tgtttaaaatgtaatttaaa

SEQ ID NO: 3346869 - DNA, 14 bp, Homo sapiens
tgtttaaaattcag

SEQ ID NO: 3346870 - DNA, 15 bp, Homo sapiens
tgtttaaaattcagt

SEQ ID NO: 3346871 - DNA, 17 bp, Homo sapiens
tgtttaaagagaggtta

SEQ ID NO: 3346872 - DNA, 22 bp, Homo sapiens
tgtttaaatataaatgtttaaa

SEQ ID NO: 3346873 - DNA, 14 bp, Homo sapiens
tgtttaaatcatgt

SEQ ID NO: 3346874 - DNA, 21 bp, Homo sapiens
tgtttaaatcatgtatgttat

SEQ ID NO: 3346875 - DNA, 13 bp, Homo sapiens
tgtttaacaaatc

SEQ ID NO: 3346876 - DNA, 14 bp, Homo sapiens
tgtttaagatgggc

SEQ ID NO: 3346877 - DNA, 21 bp, Homo sapiens
tgtttaagtattaacttacaa

SEQ ID NO: 3346878 - DNA, 13 bp, Homo sapiens
tgtttaatgtgaa

SEQ ID NO: 3346879 - DNA, 14 bp, Homo sapiens
tgtttaatgtgaac

SEQ ID NO: 3346880 - DNA, 16 bp, Homo sapiens
tgtttaatgtgaactt

SEQ ID NO: 3346881 - DNA, 22 bp, Homo sapiens
tgtttaatgtgaacttgtagct

SEQ ID NO: 3346882 - DNA, 23 bp, Homo sapiens
tgtttaatgtgaacttgtagctg

SEQ ID NO: 3346883 - DNA, 14 bp, Homo sapiens
tgtttaatttcttc

SEQ ID NO: 3346884 - DNA, 21 bp, Homo sapiens
tgtttaatttcttcaaaatgt

SEQ ID NO: 3346885 - DNA, 13 bp, Homo sapiens
tgtttacacaatt

SEQ ID NO: 3346886 - DNA, 11 bp, Homo sapiens
tgtttacagac

SEQ ID NO: 3346887 - DNA, 17 bp, Homo sapiens
tgtttacagggagcctc

SEQ ID NO: 3346888 - DNA, 17 bp, Homo sapiens
tgtttcttctgtcttta

SEQ ID NO: 3346889 - DNA, 13 bp, Homo sapiens
tgtttctttctag

SEQ ID NO: 3346890 - DNA, 15 bp, Homo sapiens
tgtttcttttcacat

SEQ ID NO: 3346891 - DNA, 15 bp, Homo sapiens
tgtttcttttgtttg

SEQ ID NO: 3346892 - DNA, 16 bp, Homo sapiens
tgtttgaaatcatcgg

SEQ ID NO: 3346893 - DNA, 13 bp, Homo sapiens
tgtttgaaatctt

SEQ ID NO: 3346894 - DNA, 17 bp, Homo sapiens
tgtttgaagcctgccct

SEQ ID NO: 3346895 - DNA, 18 bp, Homo sapiens
tgtttgaccccagtttct

SEQ ID NO: 3346896 - DNA, 20 bp, Homo sapiens
tgtttgaggagcatgttttg

SEQ ID NO: 3346897 - DNA, 20 bp, Homo sapiens
tgtttgaggcaaattaactg

SEQ ID NO: 3346898 - DNA, 14 bp, Homo sapiens
tgtttgatgtcccc

SEQ ID NO: 3346899 - DNA, 11 bp, Homo sapiens
tgtttgatttc

SEQ ID NO: 3346900 - DNA, 12 bp, Homo sapiens
tgtttgcaatgc

SEQ ID NO: 3346901 - DNA, 15 bp, Homo sapiens
tgtttgcaggagaaa

SEQ ID NO: 3346902 - DNA, 23 bp, Homo sapiens
tgtttgctgccttgctcctagca

SEQ ID NO: 3346903 - DNA, 15 bp, Homo sapiens
tgtttgcttaaacaa

SEQ ID NO: 3346904 - DNA, 18 bp, Homo sapiens
tgtttgcttattgttcca

SEQ ID NO: 3346905 - DNA, 20 bp, Homo sapiens
tgtttgcttattgttccaag

SEQ ID NO: 3346906 - DNA, 19 bp, Homo sapiens
tgtttgcttggaaattcct

SEQ ID NO: 3346907 - DNA, 20 bp, Homo sapiens
tgtttgcttggaaattcctt

SEQ ID NO: 3346908 - DNA, 19 bp, Homo sapiens
tgtttggatgtaatttagg

SEQ ID NO: 3346909 - DNA, 16 bp, Homo sapiens
tgtttggattcctcac

SEQ ID NO: 3346910 - DNA, 17 bp, Homo sapiens
tgtttggcttataaaca

SEQ ID NO: 3346911 - DNA, 18 bp, Homo sapiens
tgtttgggatcagcttct

SEQ ID NO: 3346912 - DNA, 22 bp, Homo sapiens
tgtttgggatcagcttcttgca

SEQ ID NO: 3346913 - DNA, 19 bp, Homo sapiens
tgtttgggggacgtttctc

SEQ ID NO: 3346914 - DNA, 15 bp, Homo sapiens
tgtttgggtatcctg

SEQ ID NO: 3346915 - DNA, 18 bp, Homo sapiens
tgtttgggtatcctgccc

SEQ ID NO: 3346916 - DNA, 12 bp, Homo sapiens
tgtttggtaaat

SEQ ID NO: 3346917 - DNA, 19 bp, Homo sapiens
tgtttgtaaataagagatt

SEQ ID NO: 3346918 - DNA, 15 bp, Homo sapiens
tgtttgtaaatgcct

SEQ ID NO: 3346919 - DNA, 16 bp, Homo sapiens
tgtttgtaaatgcctc

SEQ ID NO: 3346920 - DNA, 22 bp, Homo sapiens
tgtttgtaaatgcctcttaaat

SEQ ID NO: 3346921 - DNA, 16 bp, Homo sapiens
tgtttgtaaattaata

SEQ ID NO: 3346922 - DNA, 21 bp, Homo sapiens
tgtttgtattttttatttaca

SEQ ID NO: 3346923 - DNA, 22 bp, Homo sapiens
tgtttgtattttttatttacat

SEQ ID NO: 3346924 - DNA, 16 bp, Homo sapiens
tgtttgtcagatatga

SEQ ID NO: 3346925 - DNA, 22 bp, Homo sapiens
tgtttgtctcacttttcatctg

SEQ ID NO: 3346926 - DNA, 15 bp, Homo sapiens
tgtttgtctctcctt

SEQ ID NO: 3346927 - DNA, 18 bp, Homo sapiens
tgtttgtctctccttttc

SEQ ID NO: 3346928 - DNA, 13 bp, Homo sapiens
tgtttgtgcatcc

SEQ ID NO: 3346929 - DNA, 14 bp, Homo sapiens
tgtttgtggcctca

SEQ ID NO: 3346930 - DNA, 12 bp, Homo sapiens
tgtttgtgtatt

SEQ ID NO: 3346931 - DNA, 14 bp, Homo sapiens
tgtttgtgtctgac

SEQ ID NO: 3346932 - DNA, 17 bp, Homo sapiens
tgtttgtttcctttgtt

SEQ ID NO: 3346933 - DNA, 22 bp, Homo sapiens
tgttttaaacattaatagcagc

SEQ ID NO: 3346934 - DNA, 12 bp, Homo sapiens
tgttttaaattc

SEQ ID NO: 3346935 - DNA, 13 bp, Homo sapiens
tgttttaaattct

SEQ ID NO: 3346936 - DNA, 15 bp, Homo sapiens
tgttttaaattctga

SEQ ID NO: 3346937 - DNA, 22 bp, Homo sapiens
tgttttaaattctgagacatgt

SEQ ID NO: 3346938 - DNA, 17 bp, Homo sapiens
tgttttaagaggcaggg

SEQ ID NO: 3346939 - DNA, 18 bp, Homo sapiens
tgttttaatctgaaattc

SEQ ID NO: 3346940 - DNA, 20 bp, Homo sapiens
tgttttaatctgaaattcta

SEQ ID NO: 3346941 - DNA, 13 bp, Homo sapiens
tgttttaattgta

SEQ ID NO: 3346942 - DNA, 22 bp, Homo sapiens
tgttttaatttaaacacctcct

SEQ ID NO: 3346943 - DNA, 22 bp, Homo sapiens
tgttttactgtcagattaaatt

SEQ ID NO: 3346944 - DNA, 15 bp, Homo sapiens
tgttttactgtgaaa

SEQ ID NO: 3346945 - DNA, 13 bp, Homo sapiens
tgttttagcattt

SEQ ID NO: 3346946 - DNA, 13 bp, Homo sapiens
tgttttatatatt

SEQ ID NO: 3346947 - DNA, 14 bp, Homo sapiens
tgttttatatatta

SEQ ID NO: 3346948 - DNA, 19 bp, Homo sapiens
tgttttatatattatgtga

SEQ ID NO: 3346949 - DNA, 15 bp, Homo sapiens
tgttttattcctgta

SEQ ID NO: 3346950 - DNA, 23 bp, Homo sapiens
tgttttattttttattgttttca

SEQ ID NO: 3346951 - DNA, 14 bp, Homo sapiens
tgttttcacttgta

SEQ ID NO: 3346952 - DNA, 16 bp, Homo sapiens
ttaaaaatatttcaga

SEQ ID NO: 3346953 - DNA, 17 bp, Homo sapiens
ttaaaaatggaactgtg

SEQ ID NO: 3346954 - DNA, 21 bp, Homo sapiens
ttaaaaatggctcaagtagaa

SEQ ID NO: 3346955 - DNA, 17 bp, Homo sapiens
ttaaaaatggtatcaaa

SEQ ID NO: 3346956 - DNA, 19 bp, Homo sapiens
ttaaaaatggtatcaaaat

SEQ ID NO: 3346957 - DNA, 13 bp, Homo sapiens
ttaaaaatgtaaa

SEQ ID NO: 3346958 - DNA, 14 bp, Homo sapiens
ttaaaaatgtaaat

SEQ ID NO: 3346959 - DNA, 16 bp, Homo sapiens
ttaaaaatgtaaatat

SEQ ID NO: 3346960 - DNA, 13 bp, Homo sapiens
ttaaaaatgttct

SEQ ID NO: 3346961 - DNA, 18 bp, Homo sapiens
ttaaaaatgttctcaaat

SEQ ID NO: 3346962 - DNA, 13 bp, Homo sapiens
ttaaaaattgttt

SEQ ID NO: 3346963 - DNA, 17 bp, Homo sapiens
ttaaaacaacactcaca

SEQ ID NO: 3346964 - DNA, 21 bp, Homo sapiens
ttaaaacaattttttttttcc

SEQ ID NO: 3346965 - DNA, 21 bp, Homo sapiens
ttaaaacagacactggcatgg

SEQ ID NO: 3346966 - DNA, 17 bp, Homo sapiens
ttaaaacatatttcatt

SEQ ID NO: 3346967 - DNA, 14 bp, Homo sapiens
ttaaaacatgcacg

SEQ ID NO: 3346968 - DNA, 19 bp, Homo sapiens
ttaaaacctggaccttttc

SEQ ID NO: 3346969 - DNA, 23 bp, Homo sapiens
ttaaaacctggaccttttctgga

SEQ ID NO: 3346970 - DNA, 13 bp, Homo sapiens
ttaaaactaaatt

SEQ ID NO: 3346971 - DNA, 21 bp, Homo sapiens
ttaaaactcagaatataacat

SEQ ID NO: 3346972 - DNA, 16 bp, Homo sapiens
ttaaaagaaaaaatga

SEQ ID NO: 3346973 - DNA, 17 bp, Homo sapiens
ttaaaagaagactggaa

SEQ ID NO: 3346974 - DNA, 18 bp, Homo sapiens
ttaaaagaagactggaag

SEQ ID NO: 3346975 - DNA, 12 bp, Homo sapiens
ttaaaagaatga

SEQ ID NO: 3346976 - DNA, 14 bp, Homo sapiens
ttaaaagaatgact

SEQ ID NO: 3346977 - DNA, 23 bp, Homo sapiens
ttaaaagacatttttatttagtt

SEQ ID NO: 3346978 - DNA, 17 bp, Homo sapiens
ttaaaagcacaatcact

SEQ ID NO: 3346979 - DNA, 12 bp, Homo sapiens
ttaaaagccatg

SEQ ID NO: 3346980 - DNA, 13 bp, Homo sapiens
ttaaaagcctgct

SEQ ID NO: 3346981 - DNA, 17 bp, Homo sapiens
ttaaaaggtataattaa

SEQ ID NO: 3346982 - DNA, 16 bp, Homo sapiens
ttaaaagtaaaattgt

SEQ ID NO: 3346983 - DNA, 12 bp, Homo sapiens
ttaaaagtactt

SEQ ID NO: 3346984 - DNA, 20 bp, Homo sapiens
ttaaaagtactttaaaaagg

SEQ ID NO: 3346985 - DNA, 12 bp, Homo sapiens
ttaaaagtattc

SEQ ID NO: 3346986 - DNA, 14 bp, Homo sapiens
ttaaaagtattcat

SEQ ID NO: 3346987 - DNA, 15 bp, Homo sapiens
ttaaaagtctatttt

SEQ ID NO: 3346988 - DNA, 20 bp, Homo sapiens
ttaaaagtctattttattat

SEQ ID NO: 3346989 - DNA, 18 bp, Homo sapiens
ttaaaagttttgttcttt

SEQ ID NO: 3346990 - DNA, 15 bp, Homo sapiens
ttaaaataaaatgaa

SEQ ID NO: 3346991 - DNA, 17 bp, Homo sapiens
ttaaaataaaatgaaaa

SEQ ID NO: 3346992 - DNA, 15 bp, Homo sapiens
ttaaaataaaccaaa

SEQ ID NO: 3346993 - DNA, 22 bp, Homo sapiens
ttaaaataggggatatttaagg

SEQ ID NO: 3346994 - DNA, 16 bp, Homo sapiens
ttaaaatattcctgca

SEQ ID NO: 3346995 - DNA, 19 bp, Homo sapiens
ttaaaatattcctgcattt

SEQ ID NO: 3346996 - DNA, 12 bp, Homo sapiens
ttaaaatattta

SEQ ID NO: 3346997 - DNA, 17 bp, Homo sapiens
ttaaaatatttatttat

SEQ ID NO: 3346998 - DNA, 12 bp, Homo sapiens
ttaaaatatttt

SEQ ID NO: 3346999 - DNA, 17 bp, Homo sapiens
ttaaaatattttggatg

SEQ ID NO: 3347000 - DNA, 23 bp, Homo sapiens
ttaaaatcactaacattatattg

SEQ ID NO: 3347001 - DNA, 16 bp, Homo sapiens
ttaaaatgattgtaaa

SEQ ID NO: 3347002 - DNA, 22 bp, Homo sapiens
ttaaaatggatttaatccattt

SEQ ID NO: 3347003 - DNA, 14 bp, Homo sapiens
ttaaaattcagttt

SEQ ID NO: 3347004 - DNA, 23 bp, Homo sapiens
ttaaaattcagtttttgtatctt

SEQ ID NO: 3347005 - DNA, 22 bp, Homo sapiens
ttaaaattgtgcataatgcttt

SEQ ID NO: 3347006 - DNA, 19 bp, Homo sapiens
ttaaaattttacttttgtt

SEQ ID NO: 3347007 - DNA, 16 bp, Homo sapiens
ttaaaattttgtatgt

SEQ ID NO: 3347008 - DNA, 20 bp, Homo sapiens
ttaaacaaaatagaagctgt

SEQ ID NO: 3347009 - DNA, 13 bp, Homo sapiens
ttaaacaagtatt

SEQ ID NO: 3347010 - DNA, 14 bp, Homo sapiens
ttaaacaatgtata

SEQ ID NO: 3347011 - DNA, 16 bp, Homo sapiens
ttaaacaatgtataaa

SEQ ID NO: 3347012 - DNA, 19 bp, Homo sapiens
ttaaacaatgtataaagat

SEQ ID NO: 3347013 - DNA, 23 bp, Homo sapiens
ttaaacacacagatacacacaca

SEQ ID NO: 3347014 - DNA, 14 bp, Homo sapiens
ttaaacacattgtc

SEQ ID NO: 3347015 - DNA, 16 bp, Homo sapiens
ttaaacacctcctcat

SEQ ID NO: 3347016 - DNA, 17 bp, Homo sapiens
ttaaacagactttagct

SEQ ID NO: 3347017 - DNA, 22 bp, Homo sapiens
ttaaacagatgatgagaatttc

SEQ ID NO: 3347018 - DNA, 18 bp, Homo sapiens
ttaaacagtgagcctgaa

SEQ ID NO: 3347019 - DNA, 22 bp, Homo sapiens
ttaaacatgctaaatagttcta

SEQ ID NO: 3347020 - DNA, 13 bp, Homo sapiens
ttaaacattaaaa

SEQ ID NO: 3347021 - DNA, 23 bp, Homo sapiens
ttaaacattaatagcagcctttc

SEQ ID NO: 3347022 - DNA, 13 bp, Homo sapiens
ttaaacattgaag

SEQ ID NO: 3347023 - DNA, 21 bp, Homo sapiens
ttaaaccaacctttaaaattg

SEQ ID NO: 3347024 - DNA, 15 bp, Homo sapiens
ttaaacctgtctcca

SEQ ID NO: 3347025 - DNA, 20 bp, Homo sapiens
ttaaacctgtctccactgtg

SEQ ID NO: 3347026 - DNA, 22 bp, Homo sapiens
ttaaacctgtttttttttcatt

SEQ ID NO: 3347027 - DNA, 14 bp, Homo sapiens
ttaaaccttttatt

SEQ ID NO: 3347028 - DNA, 14 bp, Homo sapiens
ttaaacgtgcagac

SEQ ID NO: 3347029 - DNA, 20 bp, Homo sapiens
ttaaactaaaaaaaaaaagg

SEQ ID NO: 3347030 - DNA, 22 bp, Homo sapiens
ttaaactaaaaaaaaaaaggcc

SEQ ID NO: 3347031 - DNA, 20 bp, Homo sapiens
ttaaactaaataatgaataa

SEQ ID NO: 3347032 - DNA, 14 bp, Homo sapiens
ttaaactaaatgtg

SEQ ID NO: 3347033 - DNA, 16 bp, Homo sapiens
ttaaactcaagacaat

SEQ ID NO: 3347034 - DNA, 14 bp, Homo sapiens
ttaaactcagggac

SEQ ID NO: 3347035 - DNA, 22 bp, Homo sapiens
ttaaactcagggacagagccat

SEQ ID NO: 3347036 - DNA, 16 bp, Homo sapiens
ttaaacttccaaagaa

SEQ ID NO: 3347037 - DNA, 18 bp, Homo sapiens
ttaaacttccaaagaaag

SEQ ID NO: 3347038 - DNA, 14 bp, Homo sapiens
ttaaagaaacagct

SEQ ID NO: 3347039 - DNA, 21 bp, Homo sapiens
ttaaagaaacagctttcaagt

SEQ ID NO: 3347040 - DNA, 12 bp, Homo sapiens
ttaaagaaagtg

SEQ ID NO: 3347041 - DNA, 12 bp, Homo sapiens
ttaaagacagag

SEQ ID NO: 3347042 - DNA, 20 bp, Homo sapiens
ttaaagaccctcctattcta

SEQ ID NO: 3347043 - DNA, 14 bp, Homo sapiens
ttaaagagaatgag

SEQ ID NO: 3347044 - DNA, 15 bp, Homo sapiens
ttaaagagtctagat

SEQ ID NO: 3347045 - DNA, 17 bp, Homo sapiens
ttaaagagtctagattc

SEQ ID NO: 3347046 - DNA, 14 bp, Homo sapiens
ttaaagatattgtt

SEQ ID NO: 3347047 - DNA, 17 bp, Homo sapiens
ttaaagatattgttcaa

SEQ ID NO: 3347048 - DNA, 19 bp, Homo sapiens
ttaaagatattgttcaaac

SEQ ID NO: 3347049 - DNA, 18 bp, Homo sapiens
ttaaagatcatgacatat

SEQ ID NO: 3347050 - DNA, 18 bp, Homo sapiens
ttaaagatgaactctgaa

SEQ ID NO: 3347051 - DNA, 16 bp, Homo sapiens
ttaaagcaaaaaatga

SEQ ID NO: 3347052 - DNA, 14 bp, Homo sapiens
ttaaagcagacagt

SEQ ID NO: 3347053 - DNA, 22 bp, Homo sapiens
ttaaagcagagggactttgtat

SEQ ID NO: 3347054 - DNA, 16 bp, Homo sapiens
ttaaagcattgctttt

SEQ ID NO: 3347055 - DNA, 22 bp, Homo sapiens
ttaaagcattgcttttattttg

SEQ ID NO: 3347056 - DNA, 18 bp, Homo sapiens
ttaaagcctttagtatca

SEQ ID NO: 3347057 - DNA, 22 bp, Homo sapiens
ttaaagctcatgcatttcaagc

SEQ ID NO: 3347058 - DNA, 17 bp, Homo sapiens
ttaaagctgcctgtagt

SEQ ID NO: 3347059 - DNA, 12 bp, Homo sapiens
ttaaaggaagga

SEQ ID NO: 3347060 - DNA, 13 bp, Homo sapiens
ttaaaggataatg

SEQ ID NO: 3347061 - DNA, 16 bp, Homo sapiens
ttaaaggcccagcccc

SEQ ID NO: 3347062 - DNA, 18 bp, Homo sapiens
ttaaaggcccagccccta

SEQ ID NO: 3347063 - DNA, 20 bp, Homo sapiens
ttaaaggcccagcccctaga

SEQ ID NO: 3347064 - DNA, 15 bp, Homo sapiens
ttaaaggctgtggta

SEQ ID NO: 3347065 - DNA, 16 bp, Homo sapiens
ttaaaggtcctgccct

SEQ ID NO: 3347066 - DNA, 16 bp, Homo sapiens
ttaaagtaatttctaa

SEQ ID NO: 3347067 - DNA, 16 bp, Homo sapiens
ttaaagtactttctta

SEQ ID NO: 3347068 - DNA, 19 bp, Homo sapiens
ttaaagtgctaaggttcta

SEQ ID NO: 3347069 - DNA, 17 bp, Homo sapiens
ttaaagtgtaataatat

SEQ ID NO: 3347070 - DNA, 14 bp, Homo sapiens
ttaaagttcattgc

SEQ ID NO: 3347071 - DNA, 15 bp, Homo sapiens
ttaaagttctgtgta

SEQ ID NO: 3347072 - DNA, 21 bp, Homo sapiens
ttaaagttggtattaataaaa

SEQ ID NO: 3347073 - DNA, 20 bp, Homo sapiens
ttaaagttttgtacaaagtt

SEQ ID NO: 3347074 - DNA, 11 bp, Homo sapiens
ttaaataaaag

SEQ ID NO: 3347075 - DNA, 13 bp, Homo sapiens
ttaaataaaagaa

SEQ ID NO: 3347076 - DNA, 13 bp, Homo sapiens
ttaaataaacttt

SEQ ID NO: 3347077 - DNA, 20 bp, Homo sapiens
ttaaataaactttttttcaa

SEQ ID NO: 3347078 - DNA, 22 bp, Homo sapiens
ttaaataaactttttttcaatg

SEQ ID NO: 3347079 - DNA, 23 bp, Homo sapiens
ttaaataaactttttttcaatgt

SEQ ID NO: 3347080 - DNA, 12 bp, Homo sapiens
ttaaataaatga

SEQ ID NO: 3347081 - DNA, 19 bp, Homo sapiens
ttaaataacctctggccct

SEQ ID NO: 3347082 - DNA, 20 bp, Homo sapiens
ttaaataacctctggccctt

SEQ ID NO: 3347083 - DNA, 21 bp, Homo sapiens
ttaaataacctctggcccttg

SEQ ID NO: 3347084 - DNA, 23 bp, Homo sapiens
ttaaataacctctggcccttgga

SEQ ID NO: 3347085 - DNA, 14 bp, Homo sapiens
ttaaataagattct

SEQ ID NO: 3347086 - DNA, 15 bp, Homo sapiens
ttaaataagattcta

SEQ ID NO: 3347087 - DNA, 18 bp, Homo sapiens
ttaaataagattctaacg

SEQ ID NO: 3347088 - DNA, 16 bp, Homo sapiens
ttaaataagcaaataa

SEQ ID NO: 3347089 - DNA, 19 bp, Homo sapiens
ttaaataagcaaataaaca

SEQ ID NO: 3347090 - DNA, 24 bp, Homo sapiens
ttaaataatatggctatgcttaaa

SEQ ID NO: 3347091 - DNA, 20 bp, Homo sapiens
ttaaataatgcttcagatat

SEQ ID NO: 3347092 - DNA, 12 bp, Homo sapiens
ttaaataatttc

SEQ ID NO: 3347093 - DNA, 18 bp, Homo sapiens
ttaaatacaaaacttcca

SEQ ID NO: 3347094 - DNA, 20 bp, Homo sapiens
ttaaatacagacactaagtt

SEQ ID NO: 3347095 - DNA, 18 bp, Homo sapiens
ttaaatacagataattca

SEQ ID NO: 3347096 - DNA, 21 bp, Homo sapiens
ttaaatacagataattcattt

SEQ ID NO: 3347097 - DNA, 15 bp, Homo sapiens
ttaaatacataaata

SEQ ID NO: 3347098 - DNA, 19 bp, Homo sapiens
ttaaatacgcactacatgt

SEQ ID NO: 3347099 - DNA, 22 bp, Homo sapiens
ttaaatactgtgcagaataatg

SEQ ID NO: 3347100 - DNA, 18 bp, Homo sapiens
ttaaatagttatataatt

SEQ ID NO: 3347101 - DNA, 16 bp, Homo sapiens
ttaaatataaatagct

SEQ ID NO: 3347102 - DNA, 14 bp, Homo sapiens
ttaaatataattct

SEQ ID NO: 3347103 - DNA, 16 bp, Homo sapiens
ttaaatataattctgt

SEQ ID NO: 3347104 - DNA, 20 bp, Homo sapiens
ttaaatataattctgtaaat

SEQ ID NO: 3347105 - DNA, 16 bp, Homo sapiens
ttaaatatatattttg

SEQ ID NO: 3347106 - DNA, 20 bp, Homo sapiens
ttaaatatgtatatgacatt

SEQ ID NO: 3347107 - DNA, 14 bp, Homo sapiens
ttaaatattttcca

SEQ ID NO: 3347108 - DNA, 18 bp, Homo sapiens
ttaaatattttctatttt

SEQ ID NO: 3347109 - DNA, 20 bp, Homo sapiens
ttaaatcatgtatgttatga

SEQ ID NO: 3347110 - DNA, 21 bp, Homo sapiens
ttaaatcatgtatgttatgat

SEQ ID NO: 3347111 - DNA, 20 bp, Homo sapiens
ttaaatctaaatctatttat

SEQ ID NO: 3347112 - DNA, 12 bp, Homo sapiens
ttaaatctcaaa

SEQ ID NO: 3347113 - DNA, 22 bp, Homo sapiens
ttaaatcttaaacaatgtataa

SEQ ID NO: 3347114 - DNA, 15 bp, Homo sapiens
ttaaatgaaagcatg

SEQ ID NO: 3347115 - DNA, 23 bp, Homo sapiens
ttaaatgaaattgtaaaacctgt

SEQ ID NO: 3347116 - DNA, 11 bp, Homo sapiens
ttaaatgattg

SEQ ID NO: 3347117 - DNA, 16 bp, Homo sapiens
ttaaatgcatcaatat

SEQ ID NO: 3347118 - DNA, 17 bp, Homo sapiens
ttaaatgccttgtataa

SEQ ID NO: 3347119 - DNA, 20 bp, Homo sapiens
ttaaatgccttgtataaaat

SEQ ID NO: 3347120 - DNA, 15 bp, Homo sapiens
ttaaatgctctctca

SEQ ID NO: 3347121 - DNA, 13 bp, Homo sapiens
ttaaatgtaaaga

SEQ ID NO: 3347122 - DNA, 13 bp, Homo sapiens
ttaaatgtattta

SEQ ID NO: 3347123 - DNA, 16 bp, Homo sapiens
ttaaatgtatttaatt

SEQ ID NO: 3347124 - DNA, 22 bp, Homo sapiens
ttaaatgttttataagttcaca

SEQ ID NO: 3347125 - DNA, 15 bp, Homo sapiens
ttaaattacagcttt

SEQ ID NO: 3347126 - DNA, 19 bp, Homo sapiens
ttaaattacagcttttatg

SEQ ID NO: 3347127 - DNA, 21 bp, Homo sapiens
ttaaattataacttaaaatat

SEQ ID NO: 3347128 - DNA, 22 bp, Homo sapiens
ttaaattcccgttttgtcactt

SEQ ID NO: 3347129 - DNA, 22 bp, Homo sapiens
ttaaattcttttttaaattttc

SEQ ID NO: 3347130 - DNA, 17 bp, Homo sapiens
ttaaattgtgtacactt

SEQ ID NO: 3347131 - DNA, 15 bp, Homo sapiens
ttaaatttaaagata

SEQ ID NO: 3347132 - DNA, 23 bp, Homo sapiens
ttaaatttggtttgttaattctt

SEQ ID NO: 3347133 - DNA, 14 bp, Homo sapiens
ttaaatttgtaagt

SEQ ID NO: 3347134 - DNA, 19 bp, Homo sapiens
ttaaatttgttgacaaaat

SEQ ID NO: 3347135 - DNA, 23 bp, Homo sapiens
ttaaattttaccctttagactgt

SEQ ID NO: 3347136 - DNA, 18 bp, Homo sapiens
ttaaattttagtacattt

SEQ ID NO: 3347137 - DNA, 14 bp, Homo sapiens
ttaagaccagcctg

SEQ ID NO: 3347138 - DNA, 15 bp, Homo sapiens
ttaagaccagcctgg

SEQ ID NO: 3347139 - DNA, 18 bp, Homo sapiens
ttaagacctactgttcta

SEQ ID NO: 3347140 - DNA, 14 bp, Homo sapiens
ttaagactgatttt

SEQ ID NO: 3347141 - DNA, 13 bp, Homo sapiens
ttaagagactcac

SEQ ID NO: 3347142 - DNA, 15 bp, Homo sapiens
ttaagagagaaatct

SEQ ID NO: 3347143 - DNA, 13 bp, Homo sapiens
ttaagagtccaag

SEQ ID NO: 3347144 - DNA, 13 bp, Homo sapiens
ttaagataactta

SEQ ID NO: 3347145 - DNA, 20 bp, Homo sapiens
ttaagataacttactgtata

SEQ ID NO: 3347146 - DNA, 16 bp, Homo sapiens
ttaagataattataat

SEQ ID NO: 3347147 - DNA, 20 bp, Homo sapiens
ttaagatacaaattaatttt

SEQ ID NO: 3347148 - DNA, 21 bp, Homo sapiens
ttaagatggattctcagatat

SEQ ID NO: 3347149 - DNA, 21 bp, Homo sapiens
ttaagatggcaattactttgg

SEQ ID NO: 3347150 - DNA, 16 bp, Homo sapiens
ttaagattttacaaaa

SEQ ID NO: 3347151 - DNA, 18 bp, Homo sapiens
ttaagattttacaaaaga

SEQ ID NO: 3347152 - DNA, 15 bp, Homo sapiens
ttaagatttttctca

SEQ ID NO: 3347153 - DNA, 20 bp, Homo sapiens
ttaagatttttctcaaagtt

SEQ ID NO: 3347154 - DNA, 19 bp, Homo sapiens
ttaagcaaaagaaaaagat

SEQ ID NO: 3347155 - DNA, 17 bp, Homo sapiens
ttaagcactacataaac

SEQ ID NO: 3347156 - DNA, 15 bp, Homo sapiens
ttaagcagcatggaa

SEQ ID NO: 3347157 - DNA, 12 bp, Homo sapiens
ttaagcagctct

SEQ ID NO: 3347158 - DNA, 11 bp, Homo sapiens
ttaagcagctt

SEQ ID NO: 3347159 - DNA, 22 bp, Homo sapiens
ttaagcattgtttgcttattgt

SEQ ID NO: 3347160 - DNA, 16 bp, Homo sapiens
ttaagccaaagaaaca

SEQ ID NO: 3347161 - DNA, 17 bp, Homo sapiens
ttaagccaaagaaacaa

SEQ ID NO: 3347162 - DNA, 14 bp, Homo sapiens
ttaagcgttcatat

SEQ ID NO: 3347163 - DNA, 22 bp, Homo sapiens
ttaagctttggacccaaggaaa

SEQ ID NO: 3347164 - DNA, 13 bp, Homo sapiens
ttaagctttttgg

SEQ ID NO: 3347165 - DNA, 14 bp, Homo sapiens
ttaaggaaactctt

SEQ ID NO: 3347166 - DNA, 20 bp, Homo sapiens
ttaaggaaactcttatctca

SEQ ID NO: 3347167 - DNA, 23 bp, Homo sapiens
ttaaggataaatcataaagtcag

SEQ ID NO: 3347168 - DNA, 18 bp, Homo sapiens
ttaaggcccaacattaaa

SEQ ID NO: 3347169 - DNA, 23 bp, Homo sapiens
ttaaggggggcagggagtgatga

SEQ ID NO: 3347170 - DNA, 16 bp, Homo sapiens
ttaagtaacttaagga

SEQ ID NO: 3347171 - DNA, 23 bp, Homo sapiens
ttaagtatctgggattattcttt

SEQ ID NO: 3347172 - DNA, 14 bp, Homo sapiens
ttaagtatcttttt

SEQ ID NO: 3347173 - DNA, 19 bp, Homo sapiens
ttaagtatcttttttcaaa

SEQ ID NO: 3347174 - DNA, 11 bp, Homo sapiens
ttaagtattta

SEQ ID NO: 3347175 - DNA, 18 bp, Homo sapiens
ttaagtcccagtatacct

SEQ ID NO: 3347176 - DNA, 19 bp, Homo sapiens
ttaagtctaaatatttcct

SEQ ID NO: 3347177 - DNA, 19 bp, Homo sapiens
ttaagtctgggatgtagaa

SEQ ID NO: 3347178 - DNA, 21 bp, Homo sapiens
ttaagtgcacttttttatgaa

SEQ ID NO: 3347179 - DNA, 23 bp, Homo sapiens
ttaagtgcacttttttatgaaga

SEQ ID NO: 3347180 - DNA, 17 bp, Homo sapiens
ttaagtgcgtgtgtaga

SEQ ID NO: 3347181 - DNA, 21 bp, Homo sapiens
ttaagtgcgtgtgtagagtta

SEQ ID NO: 3347182 - DNA, 20 bp, Homo sapiens
ttaagtgttggaaaaaattt

SEQ ID NO: 3347183 - DNA, 21 bp, Homo sapiens
ttaagtgttgtaaatatttat

SEQ ID NO: 3347184 - DNA, 21 bp, Homo sapiens
ttaagttacaattacatctct

SEQ ID NO: 3347185 - DNA, 19 bp, Homo sapiens
ttaagttagagaatatatt

SEQ ID NO: 3347186 - DNA, 23 bp, Homo sapiens
ttaagttagagaatatatttttg

SEQ ID NO: 3347187 - DNA, 13 bp, Homo sapiens
ttaagttccagca

SEQ ID NO: 3347188 - DNA, 22 bp, Homo sapiens
ttaagttggcttctgtttctag

SEQ ID NO: 3347189 - DNA, 13 bp, Homo sapiens
ttaggttctaaag

SEQ ID NO: 3347190 - DNA, 14 bp, Homo sapiens
ttaggttctaaagt

SEQ ID NO: 3347191 - DNA, 19 bp, Homo sapiens
ttaggttctaaagttctaa

SEQ ID NO: 3347192 - DNA, 19 bp, Homo sapiens
ttaggtttggtttggtttt

SEQ ID NO: 3347193 - DNA, 19 bp, Homo sapiens
ttagtaactttttatgtaa

SEQ ID NO: 3347194 - DNA, 16 bp, Homo sapiens
ttagtaatggcagagc

SEQ ID NO: 3347195 - DNA, 19 bp, Homo sapiens
ttagtaatggcagagcagt

SEQ ID NO: 3347196 - DNA, 19 bp, Homo sapiens
ttagtaccagagctagttt

SEQ ID NO: 3347197 - DNA, 23 bp, Homo sapiens
ttagtactgaagccaaatgaaac

SEQ ID NO: 3347198 - DNA, 17 bp, Homo sapiens
ttagtagagacagggtt

SEQ ID NO: 3347199 - DNA, 15 bp, Homo sapiens
ttagtatcagtgttt

SEQ ID NO: 3347200 - DNA, 15 bp, Homo sapiens
ttagtatctaacatg

SEQ ID NO: 3347201 - DNA, 13 bp, Homo sapiens
ttagtatgtctgt

SEQ ID NO: 3347202 - DNA, 15 bp, Homo sapiens
ttagtattttaatcc

SEQ ID NO: 3347203 - DNA, 16 bp, Homo sapiens
ttagtcaatcactgca

SEQ ID NO: 3347204 - DNA, 13 bp, Homo sapiens
ttagtcttctcat

SEQ ID NO: 3347205 - DNA, 12 bp, Homo sapiens
ttagtgaagatg

SEQ ID NO: 3347206 - DNA, 13 bp, Homo sapiens
ttagtgaatggga

SEQ ID NO: 3347207 - DNA, 15 bp, Homo sapiens
ttagtgattctgatt

SEQ ID NO: 3347208 - DNA, 17 bp, Homo sapiens
ttagtgcggacaagttt

SEQ ID NO: 3347209 - DNA, 20 bp, Homo sapiens
ttagtggctcaacattgtgt

SEQ ID NO: 3347210 - DNA, 23 bp, Homo sapiens
ttagtggctcaacattgtgttcc

SEQ ID NO: 3347211 - DNA, 13 bp, Homo sapiens
ttagtgtatccat

SEQ ID NO: 3347212 - DNA, 18 bp, Homo sapiens
ttagttaatgagccatca

SEQ ID NO: 3347213 - DNA, 18 bp, Homo sapiens
ttagttaccttatagtta

SEQ ID NO: 3347214 - DNA, 16 bp, Homo sapiens
ttagttatagatgtct

SEQ ID NO: 3347215 - DNA, 12 bp, Homo sapiens
ttagttcaatac

SEQ ID NO: 3347216 - DNA, 18 bp, Homo sapiens
ttagttggtgctgatgga

SEQ ID NO: 3347217 - DNA, 20 bp, Homo sapiens
ttagtttacccggtttcttt

SEQ ID NO: 3347218 - DNA, 14 bp, Homo sapiens
ttagtttagtgtgt

SEQ ID NO: 3347219 - DNA, 21 bp, Homo sapiens
ttagtttagtgtgtgtgcaga

SEQ ID NO: 3347220 - DNA, 22 bp, Homo sapiens
ttagtttgcagttacactaaaa

SEQ ID NO: 3347221 - DNA, 15 bp, Homo sapiens
ttagttttagttgca

SEQ ID NO: 3347222 - DNA, 17 bp, Homo sapiens
ttagttttagttgcaga

SEQ ID NO: 3347223 - DNA, 16 bp, Homo sapiens
ttagttttgatgagtt

SEQ ID NO: 3347224 - DNA, 15 bp, Homo sapiens
ttataaaaaatggtt

SEQ ID NO: 3347225 - DNA, 17 bp, Homo sapiens
ttataaaaaatggttca

SEQ ID NO: 3347226 - DNA, 16 bp, Homo sapiens
ttataaaaatattaag

SEQ ID NO: 3347227 - DNA, 23 bp, Homo sapiens
ttataaaagaataaaattgcact

SEQ ID NO: 3347228 - DNA, 16 bp, Homo sapiens
ttataaaagtgttcat

SEQ ID NO: 3347229 - DNA, 10 bp, Homo sapiens
ttataaaatt

SEQ ID NO: 3347230 - DNA, 14 bp, Homo sapiens
ttataaaattaaaa

SEQ ID NO: 3347231 - DNA, 17 bp, Homo sapiens
ttataaaattttgcttt

SEQ ID NO: 3347232 - DNA, 23 bp, Homo sapiens
ttataaacagacaatatgtgagt

SEQ ID NO: 3347233 - DNA, 17 bp, Homo sapiens
ttataaaccttcagaag

SEQ ID NO: 3347234 - DNA, 13 bp, Homo sapiens
ttataaactttta

SEQ ID NO: 3347235 - DNA, 21 bp, Homo sapiens
ttataaatataagccttttat

SEQ ID NO: 3347236 - DNA, 19 bp, Homo sapiens
ttataaatatatataaaga

SEQ ID NO: 3347237 - DNA, 12 bp, Homo sapiens
ttataaatcata

SEQ ID NO: 3347238 - DNA, 18 bp, Homo sapiens
ttataaatcttatgctct

SEQ ID NO: 3347239 - DNA, 21 bp, Homo sapiens
ttataacagatgtgaaaatat

SEQ ID NO: 3347240 - DNA, 15 bp, Homo sapiens
ttataaccccagcct

SEQ ID NO: 3347241 - DNA, 23 bp, Homo sapiens
ttataacctagttaaagaaagga

SEQ ID NO: 3347242 - DNA, 15 bp, Homo sapiens
ttataactaacatgt

SEQ ID NO: 3347243 - DNA, 16 bp, Homo sapiens
ttataactcatcataa

SEQ ID NO: 3347244 - DNA, 20 bp, Homo sapiens
ttataactcatcataaaata

SEQ ID NO: 3347245 - DNA, 12 bp, Homo sapiens
ttataagactct

SEQ ID NO: 3347246 - DNA, 12 bp, Homo sapiens
ttataagcattg

SEQ ID NO: 3347247 - DNA, 14 bp, Homo sapiens
ttataagggagagc

SEQ ID NO: 3347248 - DNA, 18 bp, Homo sapiens
ttataagtcattgtatgt

SEQ ID NO: 3347249 - DNA, 17 bp, Homo sapiens
ttataagttcacaaaat

SEQ ID NO: 3347250 - DNA, 21 bp, Homo sapiens
ttataatataatatggaacct

SEQ ID NO: 3347251 - DNA, 17 bp, Homo sapiens
ttataatcaaagctcat

SEQ ID NO: 3347252 - DNA, 15 bp, Homo sapiens
ttataatctcaaagg

SEQ ID NO: 3347253 - DNA, 16 bp, Homo sapiens
ttataatctcaaagga

SEQ ID NO: 3347254 - DNA, 13 bp, Homo sapiens
ttataattcataa

SEQ ID NO: 3347255 - DNA, 22 bp, Homo sapiens
ttataattggtgctatttgaag

SEQ ID NO: 3347256 - DNA, 20 bp, Homo sapiens
ttataattttagtttatatt

SEQ ID NO: 3347257 - DNA, 20 bp, Homo sapiens
ttatacaaacctaccaaaat

SEQ ID NO: 3347258 - DNA, 18 bp, Homo sapiens
ttatacaaattaaaaaga

SEQ ID NO: 3347259 - DNA, 13 bp, Homo sapiens
ttatacaataacc

SEQ ID NO: 3347260 - DNA, 17 bp, Homo sapiens
ttatacaataacccagt

SEQ ID NO: 3347261 - DNA, 22 bp, Homo sapiens
ttatacagatagagttccatat

SEQ ID NO: 3347262 - DNA, 16 bp, Homo sapiens
ttataccattcagatc

SEQ ID NO: 3347263 - DNA, 17 bp, Homo sapiens
ttatacccccaggaaac

SEQ ID NO: 3347264 - DNA, 17 bp, Homo sapiens
ttatacgtgtagctata

SEQ ID NO: 3347265 - DNA, 18 bp, Homo sapiens
ttatactccagtgtacat

SEQ ID NO: 3347266 - DNA, 19 bp, Homo sapiens
ttatactgcacagtggcac

SEQ ID NO: 3347267 - DNA, 14 bp, Homo sapiens
ttatactttatatc

SEQ ID NO: 3347268 - DNA, 23 bp, Homo sapiens
ttatagaataaaagctataaagt

SEQ ID NO: 3347269 - DNA, 21 bp, Homo sapiens
ttatagaggctagcttctgct

SEQ ID NO: 3347270 - DNA, 13 bp, Homo sapiens
ttatagattctaa

SEQ ID NO: 3347271 - DNA, 19 bp, Homo sapiens
ttatagattctaaagattc

SEQ ID NO: 3347272 - DNA, 20 bp, Homo sapiens
ttatagcaacaacaattggt

SEQ ID NO: 3347273 - DNA, 14 bp, Homo sapiens
ttatagcttactga

SEQ ID NO: 3347274 - DNA, 13 bp, Homo sapiens
ttataggaaaaaa

SEQ ID NO: 3347275 - DNA, 18 bp, Homo sapiens
ttataggaaaaaaactgg

SEQ ID NO: 3347276 - DNA, 19 bp, Homo sapiens
ttataggaatagaggaaga

SEQ ID NO: 3347277 - DNA, 21 bp, Homo sapiens
ttataggagagattgggagaa

SEQ ID NO: 3347278 - DNA, 17 bp, Homo sapiens
ttataggtcactcctgg

SEQ ID NO: 3347279 - DNA, 22 bp, Homo sapiens
ttataggtgttggttttggggg

SEQ ID NO: 3347280 - DNA, 18 bp, Homo sapiens
ttatagtatatctggaca

SEQ ID NO: 3347281 - DNA, 21 bp, Homo sapiens
ttatagtgaatactgctacag

SEQ ID NO: 3347282 - DNA, 13 bp, Homo sapiens
ttatagttactgt

SEQ ID NO: 3347283 - DNA, 19 bp, Homo sapiens
ttatagttactgtgtaatt

SEQ ID NO: 3347284 - DNA, 20 bp, Homo sapiens
ttatagttgtgggtgggaga

SEQ ID NO: 3347285 - DNA, 15 bp, Homo sapiens
ttatagtttgtacat

SEQ ID NO: 3347286 - DNA, 16 bp, Homo sapiens
ttatagtttgtacatg

SEQ ID NO: 3347287 - DNA, 14 bp, Homo sapiens
ttatataaaggttt

SEQ ID NO: 3347288 - DNA, 16 bp, Homo sapiens
ttatataaagtattct

SEQ ID NO: 3347289 - DNA, 19 bp, Homo sapiens
ttatatacctggcttttac

SEQ ID NO: 3347290 - DNA, 23 bp, Homo sapiens
ttatatacctggcttttacttta

SEQ ID NO: 3347291 - DNA, 13 bp, Homo sapiens
ttatatagcttga

SEQ ID NO: 3347292 - DNA, 14 bp, Homo sapiens
ttatatagcttgaa

SEQ ID NO: 3347293 - DNA, 18 bp, Homo sapiens
ttatatagcttgaaacat

SEQ ID NO: 3347294 - DNA, 18 bp, Homo sapiens
ttatataggttgtgcaaa

SEQ ID NO: 3347295 - DNA, 14 bp, Homo sapiens
ttatatatgtattt

SEQ ID NO: 3347296 - DNA, 17 bp, Homo sapiens
ttatatatgtatttata

SEQ ID NO: 3347297 - DNA, 22 bp, Homo sapiens
ttatatattatgtgaagaattt

SEQ ID NO: 3347298 - DNA, 15 bp, Homo sapiens
ttatatattgttgtt

SEQ ID NO: 3347299 - DNA, 15 bp, Homo sapiens
ttatatatttataac

SEQ ID NO: 3347300 - DNA, 20 bp, Homo sapiens
ttatatatttataactcatc

SEQ ID NO: 3347301 - DNA, 19 bp, Homo sapiens
ttatatatttctaactata

SEQ ID NO: 3347302 - DNA, 13 bp, Homo sapiens
ttatatcaaagta

SEQ ID NO: 3347303 - DNA, 16 bp, Homo sapiens
ttatatcagcctgagt

SEQ ID NO: 3347304 - DNA, 16 bp, Homo sapiens
ttatatcatgcaaaat

SEQ ID NO: 3347305 - DNA, 18 bp, Homo sapiens
ttatatcgaaatacagtt

SEQ ID NO: 3347306 - DNA, 15 bp, Homo sapiens
ttatatctgtaatga

SEQ ID NO: 3347307 - DNA, 22 bp, Homo sapiens
ttatatctgtaatgatactgat

SEQ ID NO: 3347308 - DNA, 20 bp, Homo sapiens
ttatatcttttggttattct

SEQ ID NO: 3347309 - DNA, 19 bp, Homo sapiens
ttatatgaagaaaatcact

SEQ ID NO: 3347310 - DNA, 17 bp, Homo sapiens
ttatatgccctcaagta

SEQ ID NO: 3347311 - DNA, 20 bp, Homo sapiens
ttatatggatgattcagaaa

SEQ ID NO: 3347312 - DNA, 20 bp, Homo sapiens
ttatatggcgttttgtctgt

SEQ ID NO: 3347313 - DNA, 17 bp, Homo sapiens
ttatattagtgaagatg

SEQ ID NO: 3347314 - DNA, 23 bp, Homo sapiens
ttatattagtgaagatggtttca

SEQ ID NO: 3347315 - DNA, 16 bp, Homo sapiens
ttatattcacagtttt

SEQ ID NO: 3347316 - DNA, 17 bp, Homo sapiens
ttatattctaattaaaa

SEQ ID NO: 3347317 - DNA, 21 bp, Homo sapiens
ttatattctaattaaaattgt

SEQ ID NO: 3347318 - DNA, 15 bp, Homo sapiens
ttattattttggggt

SEQ ID NO: 3347319 - DNA, 21 bp, Homo sapiens
ttattcaaaccaatttcttcc

SEQ ID NO: 3347320 - DNA, 16 bp, Homo sapiens
ttattcaaatttgtac

SEQ ID NO: 3347321 - DNA, 21 bp, Homo sapiens
ttattcactgaagttctcctg

SEQ ID NO: 3347322 - DNA, 15 bp, Homo sapiens
ttattcataaagaga

SEQ ID NO: 3347323 - DNA, 12 bp, Homo sapiens
ttattcatttaa

SEQ ID NO: 3347324 - DNA, 13 bp, Homo sapiens
ttattcatttaaa

SEQ ID NO: 3347325 - DNA, 16 bp, Homo sapiens
ttattcatttaaaatg

SEQ ID NO: 3347326 - DNA, 17 bp, Homo sapiens
ttattccagaatgctgt

SEQ ID NO: 3347327 - DNA, 22 bp, Homo sapiens
ttattccagaatgctgtacatc

SEQ ID NO: 3347328 - DNA, 12 bp, Homo sapiens
ttattccatcaa

SEQ ID NO: 3347329 - DNA, 14 bp, Homo sapiens
ttattccctgccca

SEQ ID NO: 3347330 - DNA, 21 bp, Homo sapiens
ttattccctgcccaaaccctt

SEQ ID NO: 3347331 - DNA, 15 bp, Homo sapiens
ttattctcaaagcag

SEQ ID NO: 3347332 - DNA, 11 bp, Homo sapiens
ttattctgctc

SEQ ID NO: 3347333 - DNA, 17 bp, Homo sapiens
ttattcttctcataaat

SEQ ID NO: 3347334 - DNA, 12 bp, Homo sapiens
ttattcttgctg

SEQ ID NO: 3347335 - DNA, 22 bp, Homo sapiens
ttattgaaaaaaaaaatgttga

SEQ ID NO: 3347336 - DNA, 15 bp, Homo sapiens
ttattgcccacgctg

SEQ ID NO: 3347337 - DNA, 15 bp, Homo sapiens
ttattgcgctgctac

SEQ ID NO: 3347338 - DNA, 22 bp, Homo sapiens
ttattggaagtgttcaagaaat

SEQ ID NO: 3347339 - DNA, 22 bp, Homo sapiens
ttattggaattaacctggtgct

SEQ ID NO: 3347340 - DNA, 14 bp, Homo sapiens
ttattgggttttta

SEQ ID NO: 3347341 - DNA, 19 bp, Homo sapiens
ttattgtaagttgtacaaa

SEQ ID NO: 3347342 - DNA, 18 bp, Homo sapiens
ttattgtacagactgttt

SEQ ID NO: 3347343 - DNA, 14 bp, Homo sapiens
ttattgtatttatg

SEQ ID NO: 3347344 - DNA, 21 bp, Homo sapiens
ttattgtctgtctacatttct

SEQ ID NO: 3347345 - DNA, 22 bp, Homo sapiens
ttattgtctgtctacatttctg

SEQ ID NO: 3347346 - DNA, 23 bp, Homo sapiens
ttattgtgggccatgaaccaaat

SEQ ID NO: 3347347 - DNA, 20 bp, Homo sapiens
ttattgtgtttttaatttat

SEQ ID NO: 3347348 - DNA, 17 bp, Homo sapiens
ttattgttccaagacat

SEQ ID NO: 3347349 - DNA, 18 bp, Homo sapiens
ttattgttccaagacatt

SEQ ID NO: 3347350 - DNA, 22 bp, Homo sapiens
ttattgttccaagacattgtca

SEQ ID NO: 3347351 - DNA, 14 bp, Homo sapiens
ttattgttgaacat

SEQ ID NO: 3347352 - DNA, 14 bp, Homo sapiens
ttatttaaagcatt

SEQ ID NO: 3347353 - DNA, 19 bp, Homo sapiens
ttatttaaataaaatcacc

SEQ ID NO: 3347354 - DNA, 14 bp, Homo sapiens
ttatttaataacaa

SEQ ID NO: 3347355 - DNA, 15 bp, Homo sapiens
ttatttaataacatt

SEQ ID NO: 3347356 - DNA, 22 bp, Homo sapiens
ttatttaatcacagtcatcttt

SEQ ID NO: 3347357 - DNA, 20 bp, Homo sapiens
ttatttacagatgaatgtat

SEQ ID NO: 3347358 - DNA, 17 bp, Homo sapiens
ttatttacccctcccct

SEQ ID NO: 3347359 - DNA, 19 bp, Homo sapiens
ttatttaccttttaagaca

SEQ ID NO: 3347360 - DNA, 17 bp, Homo sapiens
ttatttactgagcttct

SEQ ID NO: 3347361 - DNA, 14 bp, Homo sapiens
ttatttagacaaga

SEQ ID NO: 3347362 - DNA, 18 bp, Homo sapiens
ttatttagacaagagatg

SEQ ID NO: 3347363 - DNA, 12 bp, Homo sapiens
ttatttagagat

SEQ ID NO: 3347364 - DNA, 21 bp, Homo sapiens
ttatttatatggggaatatat

SEQ ID NO: 3347365 - DNA, 14 bp, Homo sapiens
ttatttatcagtga

SEQ ID NO: 3347366 - DNA, 18 bp, Homo sapiens
ttatttatcagtgacaga

SEQ ID NO: 3347367 - DNA, 20 bp, Homo sapiens
ttatttatgcctctgtattt

SEQ ID NO: 3347368 - DNA, 21 bp, Homo sapiens
ttatttatggaccacttttat

SEQ ID NO: 3347369 - DNA, 20 bp, Homo sapiens
ttatttattaaaaatgttct

SEQ ID NO: 3347370 - DNA, 21 bp, Homo sapiens
ttatttattaaaaatgttctc

SEQ ID NO: 3347371 - DNA, 17 bp, Homo sapiens
ttatttattcagcttca

SEQ ID NO: 3347372 - DNA, 12 bp, Homo sapiens
ttatttatttct

SEQ ID NO: 3347373 - DNA, 20 bp, Homo sapiens
ttatttcactatcttcttca

SEQ ID NO: 3347374 - DNA, 14 bp, Homo sapiens
ttatttcatccagt

SEQ ID NO: 3347375 - DNA, 16 bp, Homo sapiens
ttatttcatgtcttta

SEQ ID NO: 3347376 - DNA, 18 bp, Homo sapiens
ttatttccactaaaaata

SEQ ID NO: 3347377 - DNA, 19 bp, Homo sapiens
ttatttccactaaaaatat

SEQ ID NO: 3347378 - DNA, 18 bp, Homo sapiens
ttatttccagtgttctat

SEQ ID NO: 3347379 - DNA, 21 bp, Homo sapiens
ttatttccatcatgtcagagc

SEQ ID NO: 3347380 - DNA, 21 bp, Homo sapiens
ttatttctaaatgagacgaaa

SEQ ID NO: 3347381 - DNA, 18 bp, Homo sapiens
ttatttctagctttttaa

SEQ ID NO: 3347382 - DNA, 19 bp, Homo sapiens
ttatttctagttctttcct

SEQ ID NO: 3347383 - DNA, 11 bp, Homo sapiens
ttatttctgaa

SEQ ID NO: 3347384 - DNA, 16 bp, Homo sapiens
ttatttctgtcattca

SEQ ID NO: 3347385 - DNA, 12 bp, Homo sapiens
ttatttgattgc

SEQ ID NO: 3347386 - DNA, 18 bp, Homo sapiens
ttatttgccagagccaaa

SEQ ID NO: 3347387 - DNA, 21 bp, Homo sapiens
ttatttgtaaaccattgtaac

SEQ ID NO: 3347388 - DNA, 13 bp, Homo sapiens
ttatttgtgtaat

SEQ ID NO: 3347389 - DNA, 21 bp, Homo sapiens
ttatttgtgtaatagaaaact

SEQ ID NO: 3347390 - DNA, 17 bp, Homo sapiens
ttattttaaaaaatgaa

SEQ ID NO: 3347391 - DNA, 14 bp, Homo sapiens
ttattttaaaatat

SEQ ID NO: 3347392 - DNA, 23 bp, Homo sapiens
ttattttaatgtgatgatgtaat

SEQ ID NO: 3347393 - DNA, 15 bp, Homo sapiens
ttattttaggcactg

SEQ ID NO: 3347394 - DNA, 19 bp, Homo sapiens
ttattttcagtatactgtg

SEQ ID NO: 3347395 - DNA, 14 bp, Homo sapiens
ttattttcagtatt

SEQ ID NO: 3347396 - DNA, 14 bp, Homo sapiens
ttattttcattaca

SEQ ID NO: 3347397 - DNA, 18 bp, Homo sapiens
ttattttctccaaataaa

SEQ ID NO: 3347398 - DNA, 18 bp, Homo sapiens
ttattttgcatatatgtt

SEQ ID NO: 3347399 - DNA, 15 bp, Homo sapiens
ttattttgctttggt

SEQ ID NO: 3347400 - DNA, 18 bp, Homo sapiens
ttattttgctttggttaa

SEQ ID NO: 3347401 - DNA, 22 bp, Homo sapiens
ttattttggaaaataaattatt

SEQ ID NO: 3347402 - DNA, 16 bp, Homo sapiens
ttattttggatatatt

SEQ ID NO: 3347403 - DNA, 22 bp, Homo sapiens
ttattttgtattacatctaatg

SEQ ID NO: 3347404 - DNA, 19 bp, Homo sapiens
ttattttgtgctcatttaa

SEQ ID NO: 3347405 - DNA, 16 bp, Homo sapiens
ttatttttaaaaagaa

SEQ ID NO: 3347406 - DNA, 13 bp, Homo sapiens
ttatttttacgta

SEQ ID NO: 3347407 - DNA, 13 bp, Homo sapiens
ttatttttagatg

SEQ ID NO: 3347408 - DNA, 14 bp, Homo sapiens
ttatttttcatatt

SEQ ID NO: 3347409 - DNA, 11 bp, Homo sapiens
ttatttttgaa

SEQ ID NO: 3347410 - DNA, 14 bp, Homo sapiens
ttatttttgtacat

SEQ ID NO: 3347411 - DNA, 16 bp, Homo sapiens
ttatttttgtacatgt

SEQ ID NO: 3347412 - DNA, 16 bp, Homo sapiens
ttatttttttaaaatt

SEQ ID NO: 3347413 - DNA, 14 bp, Homo sapiens
ttatttttttctac

SEQ ID NO: 3347414 - DNA, 22 bp, Homo sapiens
ttcaaaaagggaagtaagcaaa

SEQ ID NO: 3347415 - DNA, 14 bp, Homo sapiens
ttcaaaaagtgttt

SEQ ID NO: 3347416 - DNA, 12 bp, Homo sapiens
ttcaaaaataat

SEQ ID NO: 3347417 - DNA, 15 bp, Homo sapiens
ttcaaaaatataact

SEQ ID NO: 3347418 - DNA, 13 bp, Homo sapiens
ttcaaaacattcc

SEQ ID NO: 3347419 - DNA, 15 bp, Homo sapiens
ttcaaaacattccaa

SEQ ID NO: 3347420 - DNA, 16 bp, Homo sapiens
ttcaaaacattccaag

SEQ ID NO: 3347421 - DNA, 15 bp, Homo sapiens
ttcacattcttggct

SEQ ID NO: 3347422 - DNA, 16 bp, Homo sapiens
ttcacattcttggctt

SEQ ID NO: 3347423 - DNA, 19 bp, Homo sapiens
ttcacattttccttttcaa

SEQ ID NO: 3347424 - DNA, 15 bp, Homo sapiens
ttcaccaaaattatc

SEQ ID NO: 3347425 - DNA, 22 bp, Homo sapiens
ttcaccacatgtgcacatgcac

SEQ ID NO: 3347426 - DNA, 21 bp, Homo sapiens
ttcaccagtctgtctactgtg

SEQ ID NO: 3347427 - DNA, 22 bp, Homo sapiens
ttcaccagtctgtctactgtgg

SEQ ID NO: 3347428 - DNA, 18 bp, Homo sapiens
ttcacccagctaatctgt

SEQ ID NO: 3347429 - DNA, 13 bp, Homo sapiens
ttcaccccaccct

SEQ ID NO: 3347430 - DNA, 23 bp, Homo sapiens
ttcaccccccactcaccagtgtc

SEQ ID NO: 3347431 - DNA, 21 bp, Homo sapiens
ttcaccccctgagatcccctg

SEQ ID NO: 3347432 - DNA, 19 bp, Homo sapiens
ttcaccccctttcctggac

SEQ ID NO: 3347433 - DNA, 20 bp, Homo sapiens
ttcaccccggcaggccctgc

SEQ ID NO: 3347434 - DNA, 21 bp, Homo sapiens
ttcaccccggcaggccctgca

SEQ ID NO: 3347435 - DNA, 16 bp, Homo sapiens
ttcaccctcatgaaaa

SEQ ID NO: 3347436 - DNA, 17 bp, Homo sapiens
ttcacctccttagtccc

SEQ ID NO: 3347437 - DNA, 16 bp, Homo sapiens
ttcacctgtaaacctg

SEQ ID NO: 3347438 - DNA, 18 bp, Homo sapiens
ttcacctgtaaacctgag

SEQ ID NO: 3347439 - DNA, 19 bp, Homo sapiens
ttcagtacttttttaaata

SEQ ID NO: 3347440 - DNA, 14 bp, Homo sapiens
ttcagtagaattac

SEQ ID NO: 3347441 - DNA, 17 bp, Homo sapiens
ttcagtagaattaccat

SEQ ID NO: 3347442 - DNA, 20 bp, Homo sapiens
ttcagtataatttaacttca

SEQ ID NO: 3347443 - DNA, 16 bp, Homo sapiens
ttcagtatactgtgtg

SEQ ID NO: 3347444 - DNA, 21 bp, Homo sapiens
ttcagtattttggagaaatta

SEQ ID NO: 3347445 - DNA, 20 bp, Homo sapiens
ttcagtcagaaaactttaaa

SEQ ID NO: 3347446 - DNA, 12 bp, Homo sapiens
ttcagtcctgct

SEQ ID NO: 3347447 - DNA, 19 bp, Homo sapiens
ttcagtcttaatactttat

SEQ ID NO: 3347448 - DNA, 13 bp, Homo sapiens
ttcagtgcaatca

SEQ ID NO: 3347449 - DNA, 16 bp, Homo sapiens
ttcagtggcagctgct

SEQ ID NO: 3347450 - DNA, 17 bp, Homo sapiens
ttcagtggcagctgctt

SEQ ID NO: 3347451 - DNA, 13 bp, Homo sapiens
ttcagtgtacatg

SEQ ID NO: 3347452 - DNA, 14 bp, Homo sapiens
ttcagtgtagttaa

SEQ ID NO: 3347453 - DNA, 20 bp, Homo sapiens
ttcagtgtagttaatttatc

SEQ ID NO: 3347454 - DNA, 24 bp, Homo sapiens
ttcagtgtagttaatttatctaaa

SEQ ID NO: 3347455 - DNA, 20 bp, Homo sapiens
ttcagtgtcccaccttgacc

SEQ ID NO: 3347456 - DNA, 16 bp, Homo sapiens
ttcagtgtcccaggca

SEQ ID NO: 3347457 - DNA, 20 bp, Homo sapiens
ttcagttctttggattctaa

SEQ ID NO: 3347458 - DNA, 16 bp, Homo sapiens
ttcagttgatcactgg

SEQ ID NO: 3347459 - DNA, 17 bp, Homo sapiens
ttcagttgcttgtcttc

SEQ ID NO: 3347460 - DNA, 16 bp, Homo sapiens
ttcagtttcataaaag

SEQ ID NO: 3347461 - DNA, 21 bp, Homo sapiens
ttcagtttgaaaatattttgt

SEQ ID NO: 3347462 - DNA, 19 bp, Homo sapiens
ttcagttttatttttgcca

SEQ ID NO: 3347463 - DNA, 14 bp, Homo sapiens
ttcagtttttcatt

SEQ ID NO: 3347464 - DNA, 16 bp, Homo sapiens
ttcagtttttgtatct

SEQ ID NO: 3347465 - DNA, 21 bp, Homo sapiens
ttcataacagtgccattgtct

SEQ ID NO: 3347466 - DNA, 22 bp, Homo sapiens
ttcataacagtgccattgtctt

SEQ ID NO: 3347467 - DNA, 13 bp, Homo sapiens
ttcataacggaaa

SEQ ID NO: 3347468 - DNA, 19 bp, Homo sapiens
ttcataagtattatgtctc

SEQ ID NO: 3347469 - DNA, 20 bp, Homo sapiens
ttcataagtattatgtctct

SEQ ID NO: 3347470 - DNA, 21 bp, Homo sapiens
ttcataataggtagtttggat

SEQ ID NO: 3347471 - DNA, 22 bp, Homo sapiens
ttcataatgaattataacagtt

SEQ ID NO: 3347472 - DNA, 14 bp, Homo sapiens
ttcatacctaagta

SEQ ID NO: 3347473 - DNA, 16 bp, Homo sapiens
ttcatacctaagtact

SEQ ID NO: 3347474 - DNA, 20 bp, Homo sapiens
ttcatacctaagtactgtaa

SEQ ID NO: 3347475 - DNA, 21 bp, Homo sapiens
ttcatacctaagtactgtaat

SEQ ID NO: 3347476 - DNA, 20 bp, Homo sapiens
ttcatagagatttgtctaat

SEQ ID NO: 3347477 - DNA, 17 bp, Homo sapiens
ttcatagctccttggag

SEQ ID NO: 3347478 - DNA, 21 bp, Homo sapiens
ttcatagggaaaggttttgta

SEQ ID NO: 3347479 - DNA, 22 bp, Homo sapiens
ttcatagggaaaggttttgtat

SEQ ID NO: 3347480 - DNA, 17 bp, Homo sapiens
ttcatagttcagaattt

SEQ ID NO: 3347481 - DNA, 19 bp, Homo sapiens
ttcatatgctctgctttta

SEQ ID NO: 3347482 - DNA, 13 bp, Homo sapiens
ttcatatgctgta

SEQ ID NO: 3347483 - DNA, 20 bp, Homo sapiens
ttcatatgtaccatgtacat

SEQ ID NO: 3347484 - DNA, 13 bp, Homo sapiens
ttcatatgttgct

SEQ ID NO: 3347485 - DNA, 16 bp, Homo sapiens
ttcatatgttgctcag

SEQ ID NO: 3347486 - DNA, 14 bp, Homo sapiens
ttcatattaagaca

SEQ ID NO: 3347487 - DNA, 18 bp, Homo sapiens
ttcatattgctgagagaa

SEQ ID NO: 3347488 - DNA, 21 bp, Homo sapiens
ttcatatttacttcttataca

SEQ ID NO: 3347489 - DNA, 18 bp, Homo sapiens
ttcatatttatactttgc

SEQ ID NO: 3347490 - DNA, 23 bp, Homo sapiens
ttcatatttttgatcatcccttt

SEQ ID NO: 3347491 - DNA, 11 bp, Homo sapiens
ttcatcactgg

SEQ ID NO: 3347492 - DNA, 13 bp, Homo sapiens
ttcatcagcattt

SEQ ID NO: 3347493 - DNA, 15 bp, Homo sapiens
ttcatcattgtttct

SEQ ID NO: 3347494 - DNA, 18 bp, Homo sapiens
ttcatccaatcctcactg

SEQ ID NO: 3347495 - DNA, 20 bp, Homo sapiens
ttcatccaatcctcactggg

SEQ ID NO: 3347496 - DNA, 21 bp, Homo sapiens
ttcatccaggcccaactgtga

SEQ ID NO: 3347497 - DNA, 13 bp, Homo sapiens
ttcatcctataag

SEQ ID NO: 3347498 - DNA, 16 bp, Homo sapiens
ttcatcctattgttga

SEQ ID NO: 3347499 - DNA, 21 bp, Homo sapiens
ttcatcctcattgcctcctgt

SEQ ID NO: 3347500 - DNA, 17 bp, Homo sapiens
ttcatctgggaggcaga

SEQ ID NO: 3347501 - DNA, 15 bp, Homo sapiens
ttcatctggggtggg

SEQ ID NO: 3347502 - DNA, 13 bp, Homo sapiens
ttcatctggggtt

SEQ ID NO: 3347503 - DNA, 16 bp, Homo sapiens
ttcatctgtccatggc

SEQ ID NO: 3347504 - DNA, 20 bp, Homo sapiens
ttcatctgtccatggccttt

SEQ ID NO: 3347505 - DNA, 22 bp, Homo sapiens
ttcatctgtccatggcctttct

SEQ ID NO: 3347506 - DNA, 16 bp, Homo sapiens
ttcatcttctggaata

SEQ ID NO: 3347507 - DNA, 15 bp, Homo sapiens
ttcatgattagaaat

SEQ ID NO: 3347508 - DNA, 15 bp, Homo sapiens
ttcatgcagctgtgg

SEQ ID NO: 3347509 - DNA, 19 bp, Homo sapiens
ttcatgccaccatggccag

SEQ ID NO: 3347510 - DNA, 22 bp, Homo sapiens
ttcatgccaccatggccagcca

SEQ ID NO: 3347511 - DNA, 14 bp, Homo sapiens
ttcatgcctttgta

SEQ ID NO: 3347512 - DNA, 18 bp, Homo sapiens
ttcatgcctttgtaagtt

SEQ ID NO: 3347513 - DNA, 17 bp, Homo sapiens
ttcatgctatctctgtg

SEQ ID NO: 3347514 - DNA, 18 bp, Homo sapiens
ttcatgctatctctgtgt

SEQ ID NO: 3347515 - DNA, 21 bp, Homo sapiens
ttcatgctgaatccacctcgg

SEQ ID NO: 3347516 - DNA, 20 bp, Homo sapiens
ttcatggaatggacatcctg

SEQ ID NO: 3347517 - DNA, 18 bp, Homo sapiens
ttcatggctgctgttgct

SEQ ID NO: 3347518 - DNA, 13 bp, Homo sapiens
ttcatgtaatttt

SEQ ID NO: 3347519 - DNA, 20 bp, Homo sapiens
ttcatgtagaactcagcagt

SEQ ID NO: 3347520 - DNA, 21 bp, Homo sapiens
ttcatgtagagaaaagcacac

SEQ ID NO: 3347521 - DNA, 19 bp, Homo sapiens
ttcatgtgtggaaatggga

SEQ ID NO: 3347522 - DNA, 18 bp, Homo sapiens
ttcatgttcactgtgagt

SEQ ID NO: 3347523 - DNA, 14 bp, Homo sapiens
ttcatgtttgcttc

SEQ ID NO: 3347524 - DNA, 17 bp, Homo sapiens
ttcatgtttgtaaatta

SEQ ID NO: 3347525 - DNA, 16 bp, Homo sapiens
ttcatgttttgtgact

SEQ ID NO: 3347526 - DNA, 17 bp, Homo sapiens
ttcatgttttgtgacta

SEQ ID NO: 3347527 - DNA, 12 bp, Homo sapiens
ttcattaaactt

SEQ ID NO: 3347528 - DNA, 15 bp, Homo sapiens
ttcattaaatgtttg

SEQ ID NO: 3347529 - DNA, 14 bp, Homo sapiens
ttcattacttttaa

SEQ ID NO: 3347530 - DNA, 17 bp, Homo sapiens
ttcattataatctcaaa

SEQ ID NO: 3347531 - DNA, 22 bp, Homo sapiens
ttcattatagacaacgatgaat

SEQ ID NO: 3347532 - DNA, 16 bp, Homo sapiens
ttcattatgttcatgt

SEQ ID NO: 3347533 - DNA, 17 bp, Homo sapiens
ttcattatgttcatgta

SEQ ID NO: 3347534 - DNA, 19 bp, Homo sapiens
ttcattcaaatcagtgatc

SEQ ID NO: 3347535 - DNA, 24 bp, Homo sapiens
ttcattcaagctatttaatatctg

SEQ ID NO: 3347536 - DNA, 14 bp, Homo sapiens
ttcattcattcact

SEQ ID NO: 3347537 - DNA, 16 bp, Homo sapiens
ttcattcctaaagaaa

SEQ ID NO: 3347538 - DNA, 21 bp, Homo sapiens
ttcattctcattgcagaataa

SEQ ID NO: 3347539 - DNA, 15 bp, Homo sapiens
ttcattctccttgtt

SEQ ID NO: 3347540 - DNA, 17 bp, Homo sapiens
ttcattctccttgttgt

SEQ ID NO: 3347541 - DNA, 14 bp, Homo sapiens
ttcattctctttta

SEQ ID NO: 3347542 - DNA, 13 bp, Homo sapiens
ttcattctgcaag

SEQ ID NO: 3347543 - DNA, 17 bp, Homo sapiens
ttcattctgtgatcatt

SEQ ID NO: 3347544 - DNA, 19 bp, Homo sapiens
ttcattcttgaaagctgtg

SEQ ID NO: 3347545 - DNA, 18 bp, Homo sapiens
ttcattgagttggttact

SEQ ID NO: 3347546 - DNA, 22 bp, Homo sapiens
ttcattgagttggttacttcat

SEQ ID NO: 3347547 - DNA, 17 bp, Homo sapiens
ttcattgccagtgtctt

SEQ ID NO: 3347548 - DNA, 16 bp, Homo sapiens
ttcattgtatgatgtg

SEQ ID NO: 3347549 - DNA, 12 bp, Homo sapiens
ttcattgtgtat

SEQ ID NO: 3347550 - DNA, 15 bp, Homo sapiens
ttcatttaaaatgat

SEQ ID NO: 3347551 - DNA, 16 bp, Homo sapiens
ttcatttaaaatgatt

SEQ ID NO: 3347552 - DNA, 18 bp, Homo sapiens
ttcatttagataatttga

SEQ ID NO: 3347553 - DNA, 18 bp, Homo sapiens
ttcatttagtgagttatt

SEQ ID NO: 3347554 - DNA, 18 bp, Homo sapiens
ttcatttcaatcattgaa

SEQ ID NO: 3347555 - DNA, 18 bp, Homo sapiens
tgtacttttcattctctt

SEQ ID NO: 3347556 - DNA, 15 bp, Homo sapiens
tgtactttttagtaa

SEQ ID NO: 3347557 - DNA, 13 bp, Homo sapiens
tgtagaaacattt

SEQ ID NO: 3347558 - DNA, 19 bp, Homo sapiens
tgtagaacactaattcata

SEQ ID NO: 3347559 - DNA, 20 bp, Homo sapiens
tgtagaactcactctgggct

SEQ ID NO: 3347560 - DNA, 21 bp, Homo sapiens
tgtagaagatggactctgaaa

SEQ ID NO: 3347561 - DNA, 14 bp, Homo sapiens
tgtagaatatggct

SEQ ID NO: 3347562 - DNA, 17 bp, Homo sapiens
tgtagaatgatttcatg

SEQ ID NO: 3347563 - DNA, 14 bp, Homo sapiens
tgtagaattgttat

SEQ ID NO: 3347564 - DNA, 16 bp, Homo sapiens
tgtagacaaagtacat

SEQ ID NO: 3347565 - DNA, 19 bp, Homo sapiens
tgtagacaaagtacattct

SEQ ID NO: 3347566 - DNA, 18 bp, Homo sapiens
tgtagactatatacatgt

SEQ ID NO: 3347567 - DNA, 23 bp, Homo sapiens
tgtagactatatacatgtgtgta

SEQ ID NO: 3347568 - DNA, 17 bp, Homo sapiens
tgtagagacaatacagt

SEQ ID NO: 3347569 - DNA, 12 bp, Homo sapiens
tgtagagttaag

SEQ ID NO: 3347570 - DNA, 16 bp, Homo sapiens
tgtagagttaagaagc

SEQ ID NO: 3347571 - DNA, 18 bp, Homo sapiens
tgtagagttaagaagctg

SEQ ID NO: 3347572 - DNA, 21 bp, Homo sapiens
tgtagagttaagaagctgttg

SEQ ID NO: 3347573 - DNA, 21 bp, Homo sapiens
tgtagatattgtgaagtacat

SEQ ID NO: 3347574 - DNA, 16 bp, Homo sapiens
tgtagatatttggctt

SEQ ID NO: 3347575 - DNA, 17 bp, Homo sapiens
tgtagatatttggctta

SEQ ID NO: 3347576 - DNA, 21 bp, Homo sapiens
tgtagatgggggaactgtgaa

SEQ ID NO: 3347577 - DNA, 16 bp, Homo sapiens
tgtagatgttctagga

SEQ ID NO: 3347578 - DNA, 13 bp, Homo sapiens
tgtagattaggat

SEQ ID NO: 3347579 - DNA, 13 bp, Homo sapiens
tgtagcactgagg

SEQ ID NO: 3347580 - DNA, 14 bp, Homo sapiens
tgtagcataactgt

SEQ ID NO: 3347581 - DNA, 17 bp, Homo sapiens
tgtagcatttcttgatg

SEQ ID NO: 3347582 - DNA, 22 bp, Homo sapiens
tgtagccaggtatggctctgca

SEQ ID NO: 3347583 - DNA, 19 bp, Homo sapiens
tgtagccatggctcaggca

SEQ ID NO: 3347584 - DNA, 16 bp, Homo sapiens
tgtagccccctggcct

SEQ ID NO: 3347585 - DNA, 17 bp, Homo sapiens
tgtagccccctggcctc

SEQ ID NO: 3347586 - DNA, 19 bp, Homo sapiens
tgtagccccctggcctctg

SEQ ID NO: 3347587 - DNA, 18 bp, Homo sapiens
tgtagcctaaagggcagg

SEQ ID NO: 3347588 - DNA, 13 bp, Homo sapiens
tgtagcctttttg

SEQ ID NO: 3347589 - DNA, 19 bp, Homo sapiens
tgtagctgaaaataaaatg

SEQ ID NO: 3347590 - DNA, 18 bp, Homo sapiens
tgtagctgtaaaacgctg

SEQ ID NO: 3347591 - DNA, 15 bp, Homo sapiens
tgtagctgtaagggc

SEQ ID NO: 3347592 - DNA, 21 bp, Homo sapiens
tgtagctgtaagggcagtgcc

SEQ ID NO: 3347593 - DNA, 22 bp, Homo sapiens
tgtagctgtaagggcagtgccc

SEQ ID NO: 3347594 - DNA, 15 bp, Homo sapiens
tgtagctttcctggt

SEQ ID NO: 3347595 - DNA, 20 bp, Homo sapiens
tgtagctttcctggtccctc

SEQ ID NO: 3347596 - DNA, 12 bp, Homo sapiens
tgtagctttgct

SEQ ID NO: 3347597 - DNA, 13 bp, Homo sapiens
tgtagctttgctc

SEQ ID NO: 3347598 - DNA, 21 bp, Homo sapiens
tgtaggaagagtagcatttca

SEQ ID NO: 3347599 - DNA, 19 bp, Homo sapiens
tgtaggaaggtctcattct

SEQ ID NO: 3347600 - DNA, 21 bp, Homo sapiens
tgtaggaaggtctcattcttc

SEQ ID NO: 3347601 - DNA, 13 bp, Homo sapiens
tgtaggagaaact

SEQ ID NO: 3347602 - DNA, 20 bp, Homo sapiens
tgtaggagctacccttttcc

SEQ ID NO: 3347603 - DNA, 12 bp, Homo sapiens
tgtagggaactc

SEQ ID NO: 3347604 - DNA, 12 bp, Homo sapiens
tgtagggctgga

SEQ ID NO: 3347605 - DNA, 13 bp, Homo sapiens
tgtaggggcaggg

SEQ ID NO: 3347606 - DNA, 15 bp, Homo sapiens
tgtaggggccacctc

SEQ ID NO: 3347607 - DNA, 19 bp, Homo sapiens
tgtaggggccacctcctcc

SEQ ID NO: 3347608 - DNA, 20 bp, Homo sapiens
tgtaggggccacctcctccc

SEQ ID NO: 3347609 - DNA, 22 bp, Homo sapiens
tgtaggggccacctcctccccc

SEQ ID NO: 3347610 - DNA, 15 bp, Homo sapiens
tgtaggggttaactt

SEQ ID NO: 3347611 - DNA, 23 bp, Homo sapiens
tgtagggtagcggaaaagttgtc

SEQ ID NO: 3347612 - DNA, 12 bp, Homo sapiens
tgtaggtgactt

SEQ ID NO: 3347613 - DNA, 20 bp, Homo sapiens
tgtaggtgcaagatggaaag

SEQ ID NO: 3347614 - DNA, 13 bp, Homo sapiens
tgtagtaatttat

SEQ ID NO: 3347615 - DNA, 19 bp, Homo sapiens
tgtagtattttttgtataa

SEQ ID NO: 3347616 - DNA, 23 bp, Homo sapiens
tgtagtcccagctacttgggagg

SEQ ID NO: 3347617 - DNA, 20 bp, Homo sapiens
tgtagtcctagctactcagg

SEQ ID NO: 3347618 - DNA, 22 bp, Homo sapiens
tgtagtcctttctgccttggcc

SEQ ID NO: 3347619 - DNA, 18 bp, Homo sapiens
tgtagtgaatcctctgtt

SEQ ID NO: 3347620 - DNA, 13 bp, Homo sapiens
tgtagttaatgat

SEQ ID NO: 3347621 - DNA, 14 bp, Homo sapiens
tgtagttactcaag

SEQ ID NO: 3347622 - DNA, 16 bp, Homo sapiens
tgtagttactcaagca

SEQ ID NO: 3347623 - DNA, 16 bp, Homo sapiens
tgtagttctgccaggc

SEQ ID NO: 3347624 - DNA, 20 bp, Homo sapiens
tgtagttgcgtggactctgc

SEQ ID NO: 3347625 - DNA, 19 bp, Homo sapiens
tgtagtttttatatgttgt

SEQ ID NO: 3347626 - DNA, 21 bp, Homo sapiens
tgtataaaagtgtgaaataaa

SEQ ID NO: 3347627 - DNA, 20 bp, Homo sapiens
tgtataaaatccaaaatgaa

SEQ ID NO: 3347628 - DNA, 19 bp, Homo sapiens
tgtataaagcaactgttat

SEQ ID NO: 3347629 - DNA, 13 bp, Homo sapiens
tgtataaataata

SEQ ID NO: 3347630 - DNA, 21 bp, Homo sapiens
tgtataaataataaagaactc

SEQ ID NO: 3347631 - DNA, 13 bp, Homo sapiens
tgtataaatatac

SEQ ID NO: 3347632 - DNA, 18 bp, Homo sapiens
tgtataaatgtatataca

SEQ ID NO: 3347633 - DNA, 20 bp, Homo sapiens
tgtataaatgtatatacaca

SEQ ID NO: 3347634 - DNA, 21 bp, Homo sapiens
tgtataaatgtatatacacat

SEQ ID NO: 3347635 - DNA, 13 bp, Homo sapiens
tgtataacttaaa

SEQ ID NO: 3347636 - DNA, 16 bp, Homo sapiens
tgtataagcactgaaa

SEQ ID NO: 3347637 - DNA, 19 bp, Homo sapiens
tgtataagtactagatgca

SEQ ID NO: 3347638 - DNA, 15 bp, Homo sapiens
tgtataagtcaagca

SEQ ID NO: 3347639 - DNA, 21 bp, Homo sapiens
tgtataagtcaagcacatgta

SEQ ID NO: 3347640 - DNA, 16 bp, Homo sapiens
tgtataagtggaggca

SEQ ID NO: 3347641 - DNA, 20 bp, Homo sapiens
tgtataatattgaaaattga

SEQ ID NO: 3347642 - DNA, 21 bp, Homo sapiens
tgtataatattgaaaattgaa

SEQ ID NO: 3347643 - DNA, 19 bp, Homo sapiens
tgtataattggatttccta

SEQ ID NO: 3347644 - DNA, 13 bp, Homo sapiens
tgtatacaaatat

SEQ ID NO: 3347645 - DNA, 16 bp, Homo sapiens
tgtatacaaccctggc

SEQ ID NO: 3347646 - DNA, 17 bp, Homo sapiens
tgtatacagattctagc

SEQ ID NO: 3347647 - DNA, 15 bp, Homo sapiens
tgtatacatgccagt

SEQ ID NO: 3347648 - DNA, 19 bp, Homo sapiens
tgtatacattttgttatag

SEQ ID NO: 3347649 - DNA, 12 bp, Homo sapiens
tgtatactttag

SEQ ID NO: 3347650 - DNA, 13 bp, Homo sapiens
tgtatactttagt

SEQ ID NO: 3347651 - DNA, 14 bp, Homo sapiens
tgtatactttagta

SEQ ID NO: 3347652 - DNA, 19 bp, Homo sapiens
tgtatactttagtatgacg

SEQ ID NO: 3347653 - DNA, 22 bp, Homo sapiens
tgtatagagaatttaagtagaa

SEQ ID NO: 3347654 - DNA, 19 bp, Homo sapiens
tgtataggtagatccagat

SEQ ID NO: 3347655 - DNA, 20 bp, Homo sapiens
tgtatagttaggatagcatt

SEQ ID NO: 3347656 - DNA, 17 bp, Homo sapiens
tgtatatacacatatac

SEQ ID NO: 3347657 - DNA, 14 bp, Homo sapiens
tgtatatacagtta

SEQ ID NO: 3347658 - DNA, 13 bp, Homo sapiens
tgtatatactttt

SEQ ID NO: 3347659 - DNA, 13 bp, Homo sapiens
tgtatatatacat

SEQ ID NO: 3347660 - DNA, 18 bp, Homo sapiens
tgtatatatacatacact

SEQ ID NO: 3347661 - DNA, 19 bp, Homo sapiens
tgtatatatacatacactt

SEQ ID NO: 3347662 - DNA, 17 bp, Homo sapiens
tgtatatatattaagag

SEQ ID NO: 3347663 - DNA, 16 bp, Homo sapiens
tgtatatatgtgtata

SEQ ID NO: 3347664 - DNA, 18 bp, Homo sapiens
tgtatatatttagtgctg

SEQ ID NO: 3347665 - DNA, 18 bp, Homo sapiens
tgtatatcagaaaaggga

SEQ ID NO: 3347666 - DNA, 21 bp, Homo sapiens
tgtatatcattctacagaata

SEQ ID NO: 3347667 - DNA, 22 bp, Homo sapiens
tgtatatcattctacagaataa

SEQ ID NO: 3347668 - DNA, 17 bp, Homo sapiens
tgtatatccttccaaaa

SEQ ID NO: 3347669 - DNA, 20 bp, Homo sapiens
tgtatatccttccaaaaaat

SEQ ID NO: 3347670 - DNA, 18 bp, Homo sapiens
tgtatatctcttggaaaa

SEQ ID NO: 3347671 - DNA, 19 bp, Homo sapiens
tgtatatctcttggaaaat

SEQ ID NO: 3347672 - DNA, 14 bp, Homo sapiens
tgtatatgtattcc

SEQ ID NO: 3347673 - DNA, 19 bp, Homo sapiens
tgtatatgtttatatactg

SEQ ID NO: 3347674 - DNA, 21 bp, Homo sapiens
tgtatattatggaagatttta

SEQ ID NO: 3347675 - DNA, 13 bp, Homo sapiens
tgtatattatttg

SEQ ID NO: 3347676 - DNA, 21 bp, Homo sapiens
tgtatattatttggcagtttg

SEQ ID NO: 3347677 - DNA, 22 bp, Homo sapiens
tgtatattatttggcagtttgg

SEQ ID NO: 3347678 - DNA, 13 bp, Homo sapiens
tgtatatttattc

SEQ ID NO: 3347679 - DNA, 16 bp, Homo sapiens
tgtatatttattcata

SEQ ID NO: 3347680 - DNA, 17 bp, Homo sapiens
tgtatatttattcataa

SEQ ID NO: 3347681 - DNA, 22 bp, Homo sapiens
tgtatatttattcataatgaat

SEQ ID NO: 3347682 - DNA, 16 bp, Homo sapiens
tgtatatttgtacaaa

SEQ ID NO: 3347683 - DNA, 15 bp, Homo sapiens
tgtatatttgtatat

SEQ ID NO: 3347684 - DNA, 14 bp, Homo sapiens
tggtgactgtccca

SEQ ID NO: 3347685 - DNA, 22 bp, Homo sapiens
tggtgagaaatttctgtgaaac

SEQ ID NO: 3347686 - DNA, 18 bp, Homo sapiens
tggtgagagtcaaagctg

SEQ ID NO: 3347687 - DNA, 19 bp, Homo sapiens
tggtgaggtttaaaggata

SEQ ID NO: 3347688 - DNA, 18 bp, Homo sapiens
tggtgagtcttggcggca

SEQ ID NO: 3347689 - DNA, 17 bp, Homo sapiens
tggtgatcaattaaatg

SEQ ID NO: 3347690 - DNA, 17 bp, Homo sapiens
tggtgatcctctatttt

SEQ ID NO: 3347691 - DNA, 21 bp, Homo sapiens
tggtgatctgtagacttctgg

SEQ ID NO: 3347692 - DNA, 14 bp, Homo sapiens
tggtgatttgaaaa

SEQ ID NO: 3347693 - DNA, 20 bp, Homo sapiens
tggtgatttgaaaaatataa

SEQ ID NO: 3347694 - DNA, 22 bp, Homo sapiens
tggtgatttgaaaaatataaaa

SEQ ID NO: 3347695 - DNA, 15 bp, Homo sapiens
tggtgcacagtgatt

SEQ ID NO: 3347696 - DNA, 21 bp, Homo sapiens
tggtgcagagaagctggactt

SEQ ID NO: 3347697 - DNA, 22 bp, Homo sapiens
tggtgcagagaagctggacttc

SEQ ID NO: 3347698 - DNA, 22 bp, Homo sapiens
tggtgcatataaatatatttaa

SEQ ID NO: 3347699 - DNA, 13 bp, Homo sapiens
tggtgcattacag

SEQ ID NO: 3347700 - DNA, 20 bp, Homo sapiens
tggtgccatttctgaactgt

SEQ ID NO: 3347701 - DNA, 22 bp, Homo sapiens
tggtgccatttctgaactgtta

SEQ ID NO: 3347702 - DNA, 21 bp, Homo sapiens
tggtgcccctcgccagcttct

SEQ ID NO: 3347703 - DNA, 10 bp, Homo sapiens
tggtgcctca

SEQ ID NO: 3347704 - DNA, 18 bp, Homo sapiens
tggtgcctgagaggcagg

SEQ ID NO: 3347705 - DNA, 19 bp, Homo sapiens
tggtgcctggcctggcaca

SEQ ID NO: 3347706 - DNA, 23 bp, Homo sapiens
tggtgcctggcctggcacacatc

SEQ ID NO: 3347707 - DNA, 15 bp, Homo sapiens
tggtgcctttcctgt

SEQ ID NO: 3347708 - DNA, 22 bp, Homo sapiens
tggtgcctttcctgttcagcat

SEQ ID NO: 3347709 - DNA, 17 bp, Homo sapiens
tggtgcgatctgggttc

SEQ ID NO: 3347710 - DNA, 14 bp, Homo sapiens
tggtgctatttgaa

SEQ ID NO: 3347711 - DNA, 22 bp, Homo sapiens
tggtgctatttgaagaaaaaaa

SEQ ID NO: 3347712 - DNA, 22 bp, Homo sapiens
tggtgctctgtgttcccagagg

SEQ ID NO: 3347713 - DNA, 19 bp, Homo sapiens
tggtgctgctgctgctgtg

SEQ ID NO: 3347714 - DNA, 17 bp, Homo sapiens
tggtgctggatattttc

SEQ ID NO: 3347715 - DNA, 12 bp, Homo sapiens
tggtgcttccca

SEQ ID NO: 3347716 - DNA, 15 bp, Homo sapiens
tggtggagggggctg

SEQ ID NO: 3347717 - DNA, 21 bp, Homo sapiens
tggtggatatggtgcagagaa

SEQ ID NO: 3347718 - DNA, 14 bp, Homo sapiens
tggtggatgtaaat

SEQ ID NO: 3347719 - DNA, 16 bp, Homo sapiens
tggtggcaccagatgc

SEQ ID NO: 3347720 - DNA, 21 bp, Homo sapiens
tggtggcaccagatgcaacct

SEQ ID NO: 3347721 - DNA, 13 bp, Homo sapiens
tggtggcagctgc

SEQ ID NO: 3347722 - DNA, 14 bp, Homo sapiens
tggtggcagctgcg

SEQ ID NO: 3347723 - DNA, 15 bp, Homo sapiens
tggtggcagctgcgg

SEQ ID NO: 3347724 - DNA, 12 bp, Homo sapiens
tggtggcagtgg

SEQ ID NO: 3347725 - DNA, 17 bp, Homo sapiens
tggtggcagtggaggtg

SEQ ID NO: 3347726 - DNA, 19 bp, Homo sapiens
tggtggcccgacagcctgg

SEQ ID NO: 3347727 - DNA, 21 bp, Homo sapiens
tggtggccttctgctgcccag

SEQ ID NO: 3347728 - DNA, 23 bp, Homo sapiens
tggtggccttctgctgcccaggc

SEQ ID NO: 3347729 - DNA, 14 bp, Homo sapiens
tggtggctcatgcc

SEQ ID NO: 3347730 - DNA, 16 bp, Homo sapiens
tggtggctcatgcctg

SEQ ID NO: 3347731 - DNA, 12 bp, Homo sapiens
tggtgggagggg

SEQ ID NO: 3347732 - DNA, 20 bp, Homo sapiens
tggtgggcagctgaggacac

SEQ ID NO: 3347733 - DNA, 20 bp, Homo sapiens
tggtggggaggggcgctggc

SEQ ID NO: 3347734 - DNA, 23 bp, Homo sapiens
tggtggggaggggcgctggccca

SEQ ID NO: 3347735 - DNA, 21 bp, Homo sapiens
tggtgggttcaggggactcag

SEQ ID NO: 3347736 - DNA, 18 bp, Homo sapiens
tggtggttattttaaata

SEQ ID NO: 3347737 - DNA, 17 bp, Homo sapiens
tggtgtaaagctggccc

SEQ ID NO: 3347738 - DNA, 23 bp, Homo sapiens
tggtgtaaagctggccctgcctc

SEQ ID NO: 3347739 - DNA, 16 bp, Homo sapiens
tggtgtaataagacat

SEQ ID NO: 3347740 - DNA, 18 bp, Homo sapiens
tggtgtcacttactgttt

SEQ ID NO: 3347741 - DNA, 18 bp, Homo sapiens
tggtgtcagtatccaggc

SEQ ID NO: 3347742 - DNA, 20 bp, Homo sapiens
tggtgtcctgaccaccctcc

SEQ ID NO: 3347743 - DNA, 21 bp, Homo sapiens
tggtgtcctgaccaccctccc

SEQ ID NO: 3347744 - DNA, 15 bp, Homo sapiens
tggtgtcgtctgtga

SEQ ID NO: 3347745 - DNA, 16 bp, Homo sapiens
tggtgtcgtctgtgaa

SEQ ID NO: 3347746 - DNA, 17 bp, Homo sapiens
tggtgtctcttctttag

SEQ ID NO: 3347747 - DNA, 17 bp, Homo sapiens
tggtgtgattgcacaga

SEQ ID NO: 3347748 - DNA, 14 bp, Homo sapiens
tggtgtgctgaggt

SEQ ID NO: 3347749 - DNA, 16 bp, Homo sapiens
tggtgtggattttcta

SEQ ID NO: 3347750 - DNA, 16 bp, Homo sapiens
tggtgtgtccctggac

SEQ ID NO: 3347751 - DNA, 17 bp, Homo sapiens
tggtgtgtccctggaca

SEQ ID NO: 3347752 - DNA, 19 bp, Homo sapiens
tggtgtgtccctggacaca

SEQ ID NO: 3347753 - DNA, 21 bp, Homo sapiens
tggtgtgtccctggacacagc

SEQ ID NO: 3347754 - DNA, 22 bp, Homo sapiens
tggtgtgtccctggacacagct

SEQ ID NO: 3347755 - DNA, 23 bp, Homo sapiens
tggtgttacacagcccaagagga

SEQ ID NO: 3347756 - DNA, 16 bp, Homo sapiens
tggtgttgtatgcctt

SEQ ID NO: 3347757 - DNA, 17 bp, Homo sapiens
tggtgttttaaagagaa

SEQ ID NO: 3347758 - DNA, 14 bp, Homo sapiens
tggttaaaaaggcc

SEQ ID NO: 3347759 - DNA, 21 bp, Homo sapiens
tggttaaaaaggccaaagata

SEQ ID NO: 3347760 - DNA, 21 bp, Homo sapiens
tggttaacaataaagtgacaa

SEQ ID NO: 3347761 - DNA, 23 bp, Homo sapiens
tggttaacaataaagtgacaaaa

SEQ ID NO: 3347762 - DNA, 19 bp, Homo sapiens
tggttaataaaactgcaca

SEQ ID NO: 3347763 - DNA, 22 bp, Homo sapiens
tggttacactgttagaacacta

SEQ ID NO: 3347764 - DNA, 23 bp, Homo sapiens
tggttacactgttagaacactat

SEQ ID NO: 3347765 - DNA, 19 bp, Homo sapiens
tggttatgaaagaatatat

SEQ ID NO: 3347766 - DNA, 18 bp, Homo sapiens
tggttatttaatcacagt

SEQ ID NO: 3347767 - DNA, 22 bp, Homo sapiens
tggttattttaaatataaatag

SEQ ID NO: 3347768 - DNA, 17 bp, Homo sapiens
tggttcagaataaattg

SEQ ID NO: 3347769 - DNA, 16 bp, Homo sapiens
tggttcagctactttc

SEQ ID NO: 3347770 - DNA, 22 bp, Homo sapiens
tggttcagctactttccatttg

SEQ ID NO: 3347771 - DNA, 22 bp, Homo sapiens
tggttcagggttggcccctgcc

SEQ ID NO: 3347772 - DNA, 18 bp, Homo sapiens
tggttcatcagtgttaaa

SEQ ID NO: 3347773 - DNA, 23 bp, Homo sapiens
tggttcatcagtgttaaaaaatt

SEQ ID NO: 3347774 - DNA, 16 bp, Homo sapiens
tggttcattaattcta

SEQ ID NO: 3347775 - DNA, 20 bp, Homo sapiens
tggttccatgcagccttggg

SEQ ID NO: 3347776 - DNA, 13 bp, Homo sapiens
tggttccatgcct

SEQ ID NO: 3347777 - DNA, 15 bp, Homo sapiens
tggttccatgcctga

SEQ ID NO: 3347778 - DNA, 11 bp, Homo sapiens
tggttcccctg

SEQ ID NO: 3347779 - DNA, 15 bp, Homo sapiens
tggttcctctctggt

SEQ ID NO: 3347780 - DNA, 21 bp, Homo sapiens
tggttcctttgcaccctgtag

SEQ ID NO: 3347781 - DNA, 17 bp, Homo sapiens
tggttctaaggacctga

SEQ ID NO: 3347782 - DNA, 14 bp, Homo sapiens
tggttctatttaat

SEQ ID NO: 3347783 - DNA, 15 bp, Homo sapiens
tggttctgcttcaat

SEQ ID NO: 3347784 - DNA, 21 bp, Homo sapiens
tggttcttggtagagattcat

SEQ ID NO: 3347785 - DNA, 16 bp, Homo sapiens
tggttgaaaataaaaa

SEQ ID NO: 3347786 - DNA, 18 bp, Homo sapiens
tggttgaggggcctggag

SEQ ID NO: 3347787 - DNA, 12 bp, Homo sapiens
tggttgatggaa

SEQ ID NO: 3347788 - DNA, 16 bp, Homo sapiens
tggttggagaatttag

SEQ ID NO: 3347789 - DNA, 17 bp, Homo sapiens
tggttgtcaatattaaa

SEQ ID NO: 3347790 - DNA, 22 bp, Homo sapiens
tggtttaaaaagtttcacgtct

SEQ ID NO: 3347791 - DNA, 15 bp, Homo sapiens
tggtttaaaagaaaa

SEQ ID NO: 3347792 - DNA, 18 bp, Homo sapiens
tggtttaaaagaaaaaat

SEQ ID NO: 3347793 - DNA, 15 bp, Homo sapiens
tggtttacaggccct

SEQ ID NO: 3347794 - DNA, 20 bp, Homo sapiens
tggtttacaggccctgctcc

SEQ ID NO: 3347795 - DNA, 22 bp, Homo sapiens
tggtttattttgtattgtggta

SEQ ID NO: 3347796 - DNA, 23 bp, Homo sapiens
tggtttcaaagtaaaggcctcct

SEQ ID NO: 3347797 - DNA, 15 bp, Homo sapiens
tggtttcatgttagt

SEQ ID NO: 3347798 - DNA, 21 bp, Homo sapiens
tggtttccacgatgaaaaact

SEQ ID NO: 3347799 - DNA, 20 bp, Homo sapiens
tggtttcccccttctacatt

SEQ ID NO: 3347800 - DNA, 15 bp, Homo sapiens
tggtttctcattctt

SEQ ID NO: 3347801 - DNA, 12 bp, Homo sapiens
tggtttctccag

SEQ ID NO: 3347802 - DNA, 21 bp, Homo sapiens
tggtttctctctacagtgcca

SEQ ID NO: 3347803 - DNA, 13 bp, Homo sapiens
tggtttctgaaaa

SEQ ID NO: 3347804 - DNA, 19 bp, Homo sapiens
tggtttgaaagattatgat

SEQ ID NO: 3347805 - DNA, 20 bp, Homo sapiens
tggtttgacttgtttgtgca

SEQ ID NO: 3347806 - DNA, 17 bp, Homo sapiens
tggtttgccatgtcgct

SEQ ID NO: 3347807 - DNA, 20 bp, Homo sapiens
tggtttggcaagaacttgtt

SEQ ID NO: 3347808 - DNA, 16 bp, Homo sapiens
tgtaatagaaaactga

SEQ ID NO: 3347809 - DNA, 20 bp, Homo sapiens
tgtaatagaaaactgaaaat

SEQ ID NO: 3347810 - DNA, 17 bp, Homo sapiens
tgtaatatattgtacaa

SEQ ID NO: 3347811 - DNA, 17 bp, Homo sapiens
tgtaatatttcttcaaa

SEQ ID NO: 3347812 - DNA, 22 bp, Homo sapiens
tgtaatcagctctcctggctcc

SEQ ID NO: 3347813 - DNA, 17 bp, Homo sapiens
tgtaatcatataataaa

SEQ ID NO: 3347814 - DNA, 16 bp, Homo sapiens
tgtaatcatgtacttt

SEQ ID NO: 3347815 - DNA, 16 bp, Homo sapiens
tgtaatcccagctact

SEQ ID NO: 3347816 - DNA, 18 bp, Homo sapiens
tgtaatgaaaatgaatat

SEQ ID NO: 3347817 - DNA, 18 bp, Homo sapiens
tgtaatgcactgttttta

SEQ ID NO: 3347818 - DNA, 14 bp, Homo sapiens
tgtaatgctgcact

SEQ ID NO: 3347819 - DNA, 19 bp, Homo sapiens
tgtaatgctgcacttcctg

SEQ ID NO: 3347820 - DNA, 17 bp, Homo sapiens
tgtaatgtgaaaagtat

SEQ ID NO: 3347821 - DNA, 22 bp, Homo sapiens
tgtaatgtgtggtggcctcagc

SEQ ID NO: 3347822 - DNA, 14 bp, Homo sapiens
tgtaatgttactga

SEQ ID NO: 3347823 - DNA, 16 bp, Homo sapiens
tgtaatgttactgatc

SEQ ID NO: 3347824 - DNA, 19 bp, Homo sapiens
tgtaatgttactgatcatg

SEQ ID NO: 3347825 - DNA, 16 bp, Homo sapiens
tgtaatgtttgttacc

SEQ ID NO: 3347826 - DNA, 19 bp, Homo sapiens
tgtaattaagtactatgta

SEQ ID NO: 3347827 - DNA, 17 bp, Homo sapiens
tgtaattagctctgggg

SEQ ID NO: 3347828 - DNA, 23 bp, Homo sapiens
tgtaattagtgccacttaatgta

SEQ ID NO: 3347829 - DNA, 16 bp, Homo sapiens
tgtaattatgttttca

SEQ ID NO: 3347830 - DNA, 15 bp, Homo sapiens
tgtaattgcttacat

SEQ ID NO: 3347831 - DNA, 17 bp, Homo sapiens
tgtaattgcttacattt

SEQ ID NO: 3347832 - DNA, 18 bp, Homo sapiens
tgtaattgcttacatttt

SEQ ID NO: 3347833 - DNA, 13 bp, Homo sapiens
tgtaattgtgtaa

SEQ ID NO: 3347834 - DNA, 16 bp, Homo sapiens
tgtaatttaaacaggc

SEQ ID NO: 3347835 - DNA, 20 bp, Homo sapiens
tgtaatttaaacaggcccag

SEQ ID NO: 3347836 - DNA, 22 bp, Homo sapiens
tgtaatttaaacaggcccagca

SEQ ID NO: 3347837 - DNA, 15 bp, Homo sapiens
tgtaatttaatgaaa

SEQ ID NO: 3347838 - DNA, 14 bp, Homo sapiens
tgtaatttagaaac

SEQ ID NO: 3347839 - DNA, 22 bp, Homo sapiens
tgtaattttaaaagtctatttt

SEQ ID NO: 3347840 - DNA, 21 bp, Homo sapiens
tgtaattttaaataaaagtga

SEQ ID NO: 3347841 - DNA, 22 bp, Homo sapiens
tgtaatttttcagctctctgta

SEQ ID NO: 3347842 - DNA, 16 bp, Homo sapiens
tgtacaaaactgtaaa

SEQ ID NO: 3347843 - DNA, 20 bp, Homo sapiens
tgtacaaaactgtaaataaa

SEQ ID NO: 3347844 - DNA, 13 bp, Homo sapiens
tgtacaaaataaa

SEQ ID NO: 3347845 - DNA, 22 bp, Homo sapiens
tgtacaaaataaacaaataaca

SEQ ID NO: 3347846 - DNA, 19 bp, Homo sapiens
tgtacaaaattaagcaaat

SEQ ID NO: 3347847 - DNA, 19 bp, Homo sapiens
tgtacaaagtagaagtctt

SEQ ID NO: 3347848 - DNA, 19 bp, Homo sapiens
tgtacaaatgtaagcaaag

SEQ ID NO: 3347849 - DNA, 14 bp, Homo sapiens
tgtacaaatgtatt

SEQ ID NO: 3347850 - DNA, 17 bp, Homo sapiens
tgtacaaggtaattgtt

SEQ ID NO: 3347851 - DNA, 13 bp, Homo sapiens
tgtacacacttta

SEQ ID NO: 3347852 - DNA, 19 bp, Homo sapiens
tgtacacactttatttact

SEQ ID NO: 3347853 - DNA, 19 bp, Homo sapiens
tgtacaccatagtttacaa

SEQ ID NO: 3347854 - DNA, 16 bp, Homo sapiens
tgtacacctcaaatac

SEQ ID NO: 3347855 - DNA, 12 bp, Homo sapiens
tgtacactgaat

SEQ ID NO: 3347856 - DNA, 15 bp, Homo sapiens
tgtacactgaatatt

SEQ ID NO: 3347857 - DNA, 21 bp, Homo sapiens
tgtacactgaatatttatatt

SEQ ID NO: 3347858 - DNA, 12 bp, Homo sapiens
tgtacactgctg

SEQ ID NO: 3347859 - DNA, 19 bp, Homo sapiens
tgtacagaattttggaaga

SEQ ID NO: 3347860 - DNA, 21 bp, Homo sapiens
tgtacagactgttttactgtt

SEQ ID NO: 3347861 - DNA, 19 bp, Homo sapiens
tgtacagagtgcttttctg

SEQ ID NO: 3347862 - DNA, 22 bp, Homo sapiens
tgtacagattttatttgtaatt

SEQ ID NO: 3347863 - DNA, 15 bp, Homo sapiens
tgtacagtctgtcat

SEQ ID NO: 3347864 - DNA, 18 bp, Homo sapiens
tgtacagtgaattgtctt

SEQ ID NO: 3347865 - DNA, 22 bp, Homo sapiens
tgtacagtgtctgtgccatgga

SEQ ID NO: 3347866 - DNA, 14 bp, Homo sapiens
tgtacagtgttacc

SEQ ID NO: 3347867 - DNA, 15 bp, Homo sapiens
tgtacagtttgctgt

SEQ ID NO: 3347868 - DNA, 17 bp, Homo sapiens
tgtacataaaattttct

SEQ ID NO: 3347869 - DNA, 14 bp, Homo sapiens
tgtacataaacaat

SEQ ID NO: 3347870 - DNA, 19 bp, Homo sapiens
tgtacataaacaatgatgc

SEQ ID NO: 3347871 - DNA, 14 bp, Homo sapiens
tgtacataactgaa

SEQ ID NO: 3347872 - DNA, 19 bp, Homo sapiens
tgtacataactgaaaatgt

SEQ ID NO: 3347873 - DNA, 17 bp, Homo sapiens
tgtacatatgtgctgga

SEQ ID NO: 3347874 - DNA, 15 bp, Homo sapiens
tgtacatattactgt

SEQ ID NO: 3347875 - DNA, 15 bp, Homo sapiens
tgtacatcatgttat

SEQ ID NO: 3347876 - DNA, 14 bp, Homo sapiens
tgtacatctatttt

SEQ ID NO: 3347877 - DNA, 21 bp, Homo sapiens
tgtacatctattttggattgt

SEQ ID NO: 3347878 - DNA, 15 bp, Homo sapiens
tgtacatctggctta

SEQ ID NO: 3347879 - DNA, 16 bp, Homo sapiens
tgtacatgagaaggaa

SEQ ID NO: 3347880 - DNA, 17 bp, Homo sapiens
tgtacatggcagagttt

SEQ ID NO: 3347881 - DNA, 15 bp, Homo sapiens
tgtacatgtgtagcc

SEQ ID NO: 3347882 - DNA, 20 bp, Homo sapiens
tgtacatgtgtagcctgtgc

SEQ ID NO: 3347883 - DNA, 21 bp, Homo sapiens
tgtacatgttcgggtgtgggt

SEQ ID NO: 3347884 - DNA, 15 bp, Homo sapiens
tgtacatttaaaatt

SEQ ID NO: 3347885 - DNA, 20 bp, Homo sapiens
tgtacatttatgatttaata

SEQ ID NO: 3347886 - DNA, 16 bp, Homo sapiens
tgtacatttattcata

SEQ ID NO: 3347887 - DNA, 15 bp, Homo sapiens
tgtaccaaaatttta

SEQ ID NO: 3347888 - DNA, 17 bp, Homo sapiens
tgtaccaaatctgacat

SEQ ID NO: 3347889 - DNA, 15 bp, Homo sapiens
tgtaccagttaattt

SEQ ID NO: 3347890 - DNA, 21 bp, Homo sapiens
tgtaccagttaatttttccaa

SEQ ID NO: 3347891 - DNA, 22 bp, Homo sapiens
tgtaccagttaatttttccaac

SEQ ID NO: 3347892 - DNA, 23 bp, Homo sapiens
tgtaccagttaatttttccaact

SEQ ID NO: 3347893 - DNA, 18 bp, Homo sapiens
tgtaccatggttgtgcac

SEQ ID NO: 3347894 - DNA, 12 bp, Homo sapiens
tgtaccatgtac

SEQ ID NO: 3347895 - DNA, 14 bp, Homo sapiens
tgtacccagatgcc

SEQ ID NO: 3347896 - DNA, 12 bp, Homo sapiens
tgtacccagctc

SEQ ID NO: 3347897 - DNA, 13 bp, Homo sapiens
tgtacccagctcc

SEQ ID NO: 3347898 - DNA, 14 bp, Homo sapiens
tgtacccagctcct

SEQ ID NO: 3347899 - DNA, 20 bp, Homo sapiens
tgtacccttccacctcctag

SEQ ID NO: 3347900 - DNA, 21 bp, Homo sapiens
tgtaccgggctggcctgtgcc

SEQ ID NO: 3347901 - DNA, 21 bp, Homo sapiens
tgtacctaatccaaatatcat

SEQ ID NO: 3347902 - DNA, 14 bp, Homo sapiens
tgtacctcaaatga

SEQ ID NO: 3347903 - DNA, 21 bp, Homo sapiens
tgtacggattttcagttactt

SEQ ID NO: 3347904 - DNA, 19 bp, Homo sapiens
tgtacgtttgtatgtgtgt

SEQ ID NO: 3347905 - DNA, 20 bp, Homo sapiens
tgtacgtttgtatgtgtgta

SEQ ID NO: 3347906 - DNA, 16 bp, Homo sapiens
tgtactaactagcatt

SEQ ID NO: 3347907 - DNA, 19 bp, Homo sapiens
tgtactagagatctggttt

SEQ ID NO: 3347908 - DNA, 15 bp, Homo sapiens
tgtactataagtagt

SEQ ID NO: 3347909 - DNA, 19 bp, Homo sapiens
tgtactatggaaaatcagc

SEQ ID NO: 3347910 - DNA, 21 bp, Homo sapiens
tgtactatggaaaatcagctg

SEQ ID NO: 3347911 - DNA, 19 bp, Homo sapiens
tgtactctggggtgctgcc

SEQ ID NO: 3347912 - DNA, 13 bp, Homo sapiens
tgtactctgtgtg

SEQ ID NO: 3347913 - DNA, 18 bp, Homo sapiens
tgtactctgtgtgtgtat

SEQ ID NO: 3347914 - DNA, 15 bp, Homo sapiens
tgtactgacttgagg

SEQ ID NO: 3347915 - DNA, 17 bp, Homo sapiens
tgtactgagccttgtaa

SEQ ID NO: 3347916 - DNA, 20 bp, Homo sapiens
tgtactgagccttgtaattc

SEQ ID NO: 3347917 - DNA, 17 bp, Homo sapiens
tgtactgatttcagtaa

SEQ ID NO: 3347918 - DNA, 19 bp, Homo sapiens
tgtactgcatatgaaagga

SEQ ID NO: 3347919 - DNA, 12 bp, Homo sapiens
tgtactgggaca

SEQ ID NO: 3347920 - DNA, 18 bp, Homo sapiens
tgtactgtaaagagacct

SEQ ID NO: 3347921 - DNA, 22 bp, Homo sapiens
tgtacttaaatggtaataagca

SEQ ID NO: 3347922 - DNA, 17 bp, Homo sapiens
tgtacttcctgagtggc

SEQ ID NO: 3347923 - DNA, 21 bp, Homo sapiens
tgtacttcgtcttctaatttc

SEQ ID NO: 3347924 - DNA, 17 bp, Homo sapiens
tgtacttctgtgttcat

SEQ ID NO: 3347925 - DNA, 24 bp, Homo sapiens
tgggttcaggggactcagccctga

SEQ ID NO: 3347926 - DNA, 18 bp, Homo sapiens
tgggttcattattggaat

SEQ ID NO: 3347927 - DNA, 20 bp, Homo sapiens
tgggttcattattggaatta

SEQ ID NO: 3347928 - DNA, 18 bp, Homo sapiens
tgggttccaatcctggct

SEQ ID NO: 3347929 - DNA, 19 bp, Homo sapiens
tgggtttcaagaaaatctt

SEQ ID NO: 3347930 - DNA, 20 bp, Homo sapiens
tgggtttcaagaaaatcttt

SEQ ID NO: 3347931 - DNA, 15 bp, Homo sapiens
tgggtttcctgcagg

SEQ ID NO: 3347932 - DNA, 16 bp, Homo sapiens
tgggtttggttagagg

SEQ ID NO: 3347933 - DNA, 12 bp, Homo sapiens
tggtaaaaatgc

SEQ ID NO: 3347934 - DNA, 19 bp, Homo sapiens
tggtaaaaatgctgctctc

SEQ ID NO: 3347935 - DNA, 21 bp, Homo sapiens
tggtaaaagggatacacagga

SEQ ID NO: 3347936 - DNA, 12 bp, Homo sapiens
tggtaaaccaag

SEQ ID NO: 3347937 - DNA, 13 bp, Homo sapiens
tggtaaactattt

SEQ ID NO: 3347938 - DNA, 21 bp, Homo sapiens
tggtaaactatttgtctttca

SEQ ID NO: 3347939 - DNA, 14 bp, Homo sapiens
tggtaaatgtttct

SEQ ID NO: 3347940 - DNA, 15 bp, Homo sapiens
tggtaaatgtttctt

SEQ ID NO: 3347941 - DNA, 16 bp, Homo sapiens
tggtaacagctctctt

SEQ ID NO: 3347942 - DNA, 17 bp, Homo sapiens
tggtaacagttcatgtt

SEQ ID NO: 3347943 - DNA, 22 bp, Homo sapiens
tggtaaccaaatattaaagatt

SEQ ID NO: 3347944 - DNA, 20 bp, Homo sapiens
tggtaactgctttggtctct

SEQ ID NO: 3347945 - DNA, 14 bp, Homo sapiens
tggtaagagaaaag

SEQ ID NO: 3347946 - DNA, 15 bp, Homo sapiens
tggtaagagacagaa

SEQ ID NO: 3347947 - DNA, 18 bp, Homo sapiens
tggtaatcagttttgtat

SEQ ID NO: 3347948 - DNA, 16 bp, Homo sapiens
tggtaatcatatgtgt

SEQ ID NO: 3347949 - DNA, 21 bp, Homo sapiens
tggtaatcccctaaaataaca

SEQ ID NO: 3347950 - DNA, 23 bp, Homo sapiens
tggtaatcccctaaaataacagt

SEQ ID NO: 3347951 - DNA, 18 bp, Homo sapiens
tggtacagttgcaggagc

SEQ ID NO: 3347952 - DNA, 15 bp, Homo sapiens
tggtacatggccagt

SEQ ID NO: 3347953 - DNA, 15 bp, Homo sapiens
tggtacatggtgttt

SEQ ID NO: 3347954 - DNA, 13 bp, Homo sapiens
tggtaccagccct

SEQ ID NO: 3347955 - DNA, 18 bp, Homo sapiens
tggtaccagccctggggc

SEQ ID NO: 3347956 - DNA, 20 bp, Homo sapiens
tggtaccagccctggggctg

SEQ ID NO: 3347957 - DNA, 14 bp, Homo sapiens
tggtacccagccat

SEQ ID NO: 3347958 - DNA, 15 bp, Homo sapiens
tggtacctgccctct

SEQ ID NO: 3347959 - DNA, 20 bp, Homo sapiens
tggtactactagatgtcttt

SEQ ID NO: 3347960 - DNA, 17 bp, Homo sapiens
tggtactccctctcagg

SEQ ID NO: 3347961 - DNA, 22 bp, Homo sapiens
tggtactccctctcaggatcca

SEQ ID NO: 3347962 - DNA, 17 bp, Homo sapiens
tggtactctcctagaga

SEQ ID NO: 3347963 - DNA, 17 bp, Homo sapiens
tggtactgctgtcttcc

SEQ ID NO: 3347964 - DNA, 16 bp, Homo sapiens
tggtactttattcttg

SEQ ID NO: 3347965 - DNA, 19 bp, Homo sapiens
tggtactttattcttgctg

SEQ ID NO: 3347966 - DNA, 16 bp, Homo sapiens
tggtagagacccccag

SEQ ID NO: 3347967 - DNA, 14 bp, Homo sapiens
tggtagaggcctgg

SEQ ID NO: 3347968 - DNA, 15 bp, Homo sapiens
tggtagattaaatat

SEQ ID NO: 3347969 - DNA, 18 bp, Homo sapiens
tggtagattaaatataga

SEQ ID NO: 3347970 - DNA, 21 bp, Homo sapiens
tggtagcataaataaaactga

SEQ ID NO: 3347971 - DNA, 12 bp, Homo sapiens
tggtagctcagg

SEQ ID NO: 3347972 - DNA, 23 bp, Homo sapiens
tggtagctcatgcctgtaaccct

SEQ ID NO: 3347973 - DNA, 17 bp, Homo sapiens
tggtagcttttcccttc

SEQ ID NO: 3347974 - DNA, 21 bp, Homo sapiens
tggtagcttttcccttctttt

SEQ ID NO: 3347975 - DNA, 13 bp, Homo sapiens
tggtagggtggga

SEQ ID NO: 3347976 - DNA, 16 bp, Homo sapiens
tggtaggtagcacagt

SEQ ID NO: 3347977 - DNA, 14 bp, Homo sapiens
tggtaggttgggac

SEQ ID NO: 3347978 - DNA, 21 bp, Homo sapiens
tggtaggttgggacaccaggg

SEQ ID NO: 3347979 - DNA, 22 bp, Homo sapiens
tggtagtaatcacagttggcct

SEQ ID NO: 3347980 - DNA, 22 bp, Homo sapiens
tggtagtggaatagtgaatact

SEQ ID NO: 3347981 - DNA, 20 bp, Homo sapiens
tggtataatgtttaaatcat

SEQ ID NO: 3347982 - DNA, 22 bp, Homo sapiens
tggtatatggcttcaagttgta

SEQ ID NO: 3347983 - DNA, 15 bp, Homo sapiens
tggtatcaagaaagt

SEQ ID NO: 3347984 - DNA, 13 bp, Homo sapiens
tggtatctcagaa

SEQ ID NO: 3347985 - DNA, 16 bp, Homo sapiens
tggtatctcagaaagt

SEQ ID NO: 3347986 - DNA, 16 bp, Homo sapiens
tggtatcttaaagtgt

SEQ ID NO: 3347987 - DNA, 16 bp, Homo sapiens
tggtatgacttaaaat

SEQ ID NO: 3347988 - DNA, 16 bp, Homo sapiens
tggtatgctggccagc

SEQ ID NO: 3347989 - DNA, 17 bp, Homo sapiens
tggtatgctggccagca

SEQ ID NO: 3347990 - DNA, 15 bp, Homo sapiens
tggtatgtctcttta

SEQ ID NO: 3347991 - DNA, 16 bp, Homo sapiens
tggtattaataaaaag

SEQ ID NO: 3347992 - DNA, 14 bp, Homo sapiens
tggtattacacagt

SEQ ID NO: 3347993 - DNA, 16 bp, Homo sapiens
tggtatttctttctcg

SEQ ID NO: 3347994 - DNA, 18 bp, Homo sapiens
tggtatttgctgtcacat

SEQ ID NO: 3347995 - DNA, 14 bp, Homo sapiens
tggtcaacacttaa

SEQ ID NO: 3347996 - DNA, 14 bp, Homo sapiens
tggtcacacactga

SEQ ID NO: 3347997 - DNA, 20 bp, Homo sapiens
tggtcacaggactctgcctc

SEQ ID NO: 3347998 - DNA, 23 bp, Homo sapiens
tggtcacaggactctgcctcctc

SEQ ID NO: 3347999 - DNA, 16 bp, Homo sapiens
tggtcacccttaatat

SEQ ID NO: 3348000 - DNA, 15 bp, Homo sapiens
tggtcactgctgtca

SEQ ID NO: 3348001 - DNA, 12 bp, Homo sapiens
tggtcactgtgc

SEQ ID NO: 3348002 - DNA, 17 bp, Homo sapiens
tggtcactgtgcactgc

SEQ ID NO: 3348003 - DNA, 16 bp, Homo sapiens
tggtcagatttgaact

SEQ ID NO: 3348004 - DNA, 22 bp, Homo sapiens
tggtcagatttgaactcttcaa

SEQ ID NO: 3348005 - DNA, 21 bp, Homo sapiens
tggtcaggttatactcctcct

SEQ ID NO: 3348006 - DNA, 15 bp, Homo sapiens
tggtcatgaatagaa

SEQ ID NO: 3348007 - DNA, 18 bp, Homo sapiens
tggtccaaaaaaaggaaa

SEQ ID NO: 3348008 - DNA, 23 bp, Homo sapiens
tggtccaaaagattgctgaaatt

SEQ ID NO: 3348009 - DNA, 15 bp, Homo sapiens
tggtccaagattccg

SEQ ID NO: 3348010 - DNA, 18 bp, Homo sapiens
tggtccaattagtttcct

SEQ ID NO: 3348011 - DNA, 23 bp, Homo sapiens
tggtccaattagtttccttttta

SEQ ID NO: 3348012 - DNA, 19 bp, Homo sapiens
tggtccacactagaaagaa

SEQ ID NO: 3348013 - DNA, 23 bp, Homo sapiens
tggtccacactagaaagaagctc

SEQ ID NO: 3348014 - DNA, 12 bp, Homo sapiens
tggtccagctct

SEQ ID NO: 3348015 - DNA, 13 bp, Homo sapiens
tggtccagctctg

SEQ ID NO: 3348016 - DNA, 13 bp, Homo sapiens
tggtccagggcta

SEQ ID NO: 3348017 - DNA, 15 bp, Homo sapiens
tggtccatgctgatg

SEQ ID NO: 3348018 - DNA, 15 bp, Homo sapiens
tggtcccctcctcag

SEQ ID NO: 3348019 - DNA, 17 bp, Homo sapiens
tggtcccctcctcagtg

SEQ ID NO: 3348020 - DNA, 22 bp, Homo sapiens
tggtccctctgtgtctgctctc

SEQ ID NO: 3348021 - DNA, 13 bp, Homo sapiens
tggtcccttaagg

SEQ ID NO: 3348022 - DNA, 16 bp, Homo sapiens
tggtcccttaaggcac

SEQ ID NO: 3348023 - DNA, 17 bp, Homo sapiens
tggtccgagctgaggac

SEQ ID NO: 3348024 - DNA, 19 bp, Homo sapiens
tggtcctgactcaacatgt

SEQ ID NO: 3348025 - DNA, 14 bp, Homo sapiens
tggtcctggggctc

SEQ ID NO: 3348026 - DNA, 19 bp, Homo sapiens
tggtcctggggctctgtgc

SEQ ID NO: 3348027 - DNA, 20 bp, Homo sapiens
tggtcctgtgtgcagtgaag

SEQ ID NO: 3348028 - DNA, 13 bp, Homo sapiens
tggtcctttctcc

SEQ ID NO: 3348029 - DNA, 16 bp, Homo sapiens
tggtcgaggagtaaca

SEQ ID NO: 3348030 - DNA, 17 bp, Homo sapiens
tggtcgaggagtaacaa

SEQ ID NO: 3348031 - DNA, 23 bp, Homo sapiens
tggtctaacactggcatgttcaa

SEQ ID NO: 3348032 - DNA, 18 bp, Homo sapiens
tggtctaaggttcagcct

SEQ ID NO: 3348033 - DNA, 17 bp, Homo sapiens
tggtctattttgatttt

SEQ ID NO: 3348034 - DNA, 12 bp, Homo sapiens
tggtctcagaaa

SEQ ID NO: 3348035 - DNA, 12 bp, Homo sapiens
tggtctcaggat

SEQ ID NO: 3348036 - DNA, 17 bp, Homo sapiens
tggtctcgatctcctga

SEQ ID NO: 3348037 - DNA, 22 bp, Homo sapiens
tggtctctgctgaaggttgtaa

SEQ ID NO: 3348038 - DNA, 13 bp, Homo sapiens
tggtctgaatgtt

SEQ ID NO: 3348039 - DNA, 15 bp, Homo sapiens
tggtctgaatgttct

SEQ ID NO: 3348040 - DNA, 16 bp, Homo sapiens
tggtctgaatgttctg

SEQ ID NO: 3348041 - DNA, 17 bp, Homo sapiens
tggtctgaatgttctga

SEQ ID NO: 3348042 - DNA, 17 bp, Homo sapiens
tggtctgacccactgct

SEQ ID NO: 3348043 - DNA, 11 bp, Homo sapiens
tggtctgctgt

SEQ ID NO: 3348044 - DNA, 17 bp, Homo sapiens
tggtctgtgtgtgttct

SEQ ID NO: 3348045 - DNA, 21 bp, Homo sapiens
tggtctgtgtgtgttcttcaa

SEQ ID NO: 3348046 - DNA, 17 bp, Homo sapiens
tggtcttgagatgtctt

SEQ ID NO: 3348047 - DNA, 15 bp, Homo sapiens
tggtcttgagccagt

SEQ ID NO: 3348048 - DNA, 22 bp, Homo sapiens
tggtcttgagccagtaatcttt

SEQ ID NO: 3348049 - DNA, 14 bp, Homo sapiens
tggtctttctgtgc

SEQ ID NO: 3348050 - DNA, 23 bp, Homo sapiens
tggtgaaagctgagaactcctga

SEQ ID NO: 3348051 - DNA, 11 bp, Homo sapiens
tggtgaacagt

SEQ ID NO: 3348052 - DNA, 15 bp, Homo sapiens
tggtgacctctgcct

SEQ ID NO: 3348053 - DNA, 16 bp, Homo sapiens
tggtgacctctgcctg

SEQ ID NO: 3348054 - DNA, 17 bp, Homo sapiens
tggtgacctctgcctga

SEQ ID NO: 3348055 - DNA, 16 bp, Homo sapiens
tggaggaggaaggcaa

SEQ ID NO: 3348056 - DNA, 17 bp, Homo sapiens
tggaggaggaaggcaag

SEQ ID NO: 3348057 - DNA, 21 bp, Homo sapiens
tggaggaggaaggcaagaggg

SEQ ID NO: 3348058 - DNA, 21 bp, Homo sapiens
tggaggaggagggaggcgctg

SEQ ID NO: 3348059 - DNA, 22 bp, Homo sapiens
tggaggagggtttgggcagagc

SEQ ID NO: 3348060 - DNA, 13 bp, Homo sapiens
tggaggcacttta

SEQ ID NO: 3348061 - DNA, 14 bp, Homo sapiens
tggaggcagagacc

SEQ ID NO: 3348062 - DNA, 21 bp, Homo sapiens
tggaggcagagacctccaata

SEQ ID NO: 3348063 - DNA, 14 bp, Homo sapiens
tggaggcccaggct

SEQ ID NO: 3348064 - DNA, 16 bp, Homo sapiens
tggaggcccctggagc

SEQ ID NO: 3348065 - DNA, 17 bp, Homo sapiens
tggaggcccctggagcc

SEQ ID NO: 3348066 - DNA, 20 bp, Homo sapiens
tggaggcccctggagccaga

SEQ ID NO: 3348067 - DNA, 16 bp, Homo sapiens
tggaggccctcctgtg

SEQ ID NO: 3348068 - DNA, 14 bp, Homo sapiens
tggaggcctctggc

SEQ ID NO: 3348069 - DNA, 18 bp, Homo sapiens
tggaggcctctggccctc

SEQ ID NO: 3348070 - DNA, 17 bp, Homo sapiens
tggaggctccaggactc

SEQ ID NO: 3348071 - DNA, 15 bp, Homo sapiens
tggaggcttttcact

SEQ ID NO: 3348072 - DNA, 13 bp, Homo sapiens
tggagggaggctg

SEQ ID NO: 3348073 - DNA, 12 bp, Homo sapiens
tggagggcacag

SEQ ID NO: 3348074 - DNA, 20 bp, Homo sapiens
tggagggcttggcccagcgc

SEQ ID NO: 3348075 - DNA, 21 bp, Homo sapiens
tggaggggccctccgagggtg

SEQ ID NO: 3348076 - DNA, 21 bp, Homo sapiens
tggagggggctgggctcacag

SEQ ID NO: 3348077 - DNA, 20 bp, Homo sapiens
tggaggggtggtcctgactc

SEQ ID NO: 3348078 - DNA, 16 bp, Homo sapiens
tggaggggtgttgtat

SEQ ID NO: 3348079 - DNA, 15 bp, Homo sapiens
tggaggtatttgaaa

SEQ ID NO: 3348080 - DNA, 18 bp, Homo sapiens
tggaggtctccaggggcc

SEQ ID NO: 3348081 - DNA, 22 bp, Homo sapiens
tggaggtgagatcacagcctcc

SEQ ID NO: 3348082 - DNA, 17 bp, Homo sapiens
tggaggtgggagcagga

SEQ ID NO: 3348083 - DNA, 21 bp, Homo sapiens
tggaggtggggcgaggcaggc

SEQ ID NO: 3348084 - DNA, 16 bp, Homo sapiens
tggaggttctaaggcc

SEQ ID NO: 3348085 - DNA, 16 bp, Homo sapiens
tggaggttctcagagc

SEQ ID NO: 3348086 - DNA, 21 bp, Homo sapiens
tggaggttctcagagccaagt

SEQ ID NO: 3348087 - DNA, 18 bp, Homo sapiens
tggaggttgaagccaagt

SEQ ID NO: 3348088 - DNA, 18 bp, Homo sapiens
tggagtatgtctgatgga

SEQ ID NO: 3348089 - DNA, 15 bp, Homo sapiens
tggagtcccctcacc

SEQ ID NO: 3348090 - DNA, 15 bp, Homo sapiens
tggagtgagactgac

SEQ ID NO: 3348091 - DNA, 19 bp, Homo sapiens
tggagtgaggcttccaggc

SEQ ID NO: 3348092 - DNA, 20 bp, Homo sapiens
tggagtgaggcttccaggct

SEQ ID NO: 3348093 - DNA, 22 bp, Homo sapiens
tggagtgaggcttccaggctct

SEQ ID NO: 3348094 - DNA, 23 bp, Homo sapiens
tggagtgaggcttccaggctctt

SEQ ID NO: 3348095 - DNA, 18 bp, Homo sapiens
tggagtgcccaccctggg

SEQ ID NO: 3348096 - DNA, 20 bp, Homo sapiens
tggagtggaaggtctattgg

SEQ ID NO: 3348097 - DNA, 16 bp, Homo sapiens
tggagtggagtgagag

SEQ ID NO: 3348098 - DNA, 14 bp, Homo sapiens
tggagtgggcagag

SEQ ID NO: 3348099 - DNA, 17 bp, Homo sapiens
tggagtgtatgactgca

SEQ ID NO: 3348100 - DNA, 19 bp, Homo sapiens
tggagtgtgtattgttccc

SEQ ID NO: 3348101 - DNA, 20 bp, Homo sapiens
tggagtgtttctaataaact

SEQ ID NO: 3348102 - DNA, 17 bp, Homo sapiens
tggagttacattaatgt

SEQ ID NO: 3348103 - DNA, 18 bp, Homo sapiens
tggagttacattaatgtt

SEQ ID NO: 3348104 - DNA, 20 bp, Homo sapiens
tggagttacattaatgttaa

SEQ ID NO: 3348105 - DNA, 22 bp, Homo sapiens
tggagttcgtaccgcttcctta

SEQ ID NO: 3348106 - DNA, 16 bp, Homo sapiens
tggagttcttgtgcca

SEQ ID NO: 3348107 - DNA, 17 bp, Homo sapiens
tggagtttctaaggtcc

SEQ ID NO: 3348108 - DNA, 14 bp, Homo sapiens
tggataaactgagc

SEQ ID NO: 3348109 - DNA, 13 bp, Homo sapiens
tggataaatcatt

SEQ ID NO: 3348110 - DNA, 20 bp, Homo sapiens
tggataaatcatttcagtat

SEQ ID NO: 3348111 - DNA, 15 bp, Homo sapiens
tggataaattgttta

SEQ ID NO: 3348112 - DNA, 13 bp, Homo sapiens
tggataagtttct

SEQ ID NO: 3348113 - DNA, 19 bp, Homo sapiens
tggataatattcattggtt

SEQ ID NO: 3348114 - DNA, 14 bp, Homo sapiens
tggatacttggatt

SEQ ID NO: 3348115 - DNA, 21 bp, Homo sapiens
tggatagcattgttttctttt

SEQ ID NO: 3348116 - DNA, 15 bp, Homo sapiens
tggatataatgtatt

SEQ ID NO: 3348117 - DNA, 16 bp, Homo sapiens
tggatattattagaaa

SEQ ID NO: 3348118 - DNA, 13 bp, Homo sapiens
tggatattttcaa

SEQ ID NO: 3348119 - DNA, 22 bp, Homo sapiens
tggatattttcaaattgtatct

SEQ ID NO: 3348120 - DNA, 19 bp, Homo sapiens
tctaattgcatctcaaaat

SEQ ID NO: 3348121 - DNA, 12 bp, Homo sapiens
tctaatttactg

SEQ ID NO: 3348122 - DNA, 15 bp, Homo sapiens
tctaattttggataa

SEQ ID NO: 3348123 - DNA, 16 bp, Homo sapiens
tctaattttggataat

SEQ ID NO: 3348124 - DNA, 22 bp, Homo sapiens
tctaattttggataatattcat

SEQ ID NO: 3348125 - DNA, 16 bp, Homo sapiens
tctaattttggatgga

SEQ ID NO: 3348126 - DNA, 18 bp, Homo sapiens
tctacaaaaaataaaata

SEQ ID NO: 3348127 - DNA, 19 bp, Homo sapiens
tctacaaaaaataaaataa

SEQ ID NO: 3348128 - DNA, 20 bp, Homo sapiens
tctacaaaaaggtataaata

SEQ ID NO: 3348129 - DNA, 22 bp, Homo sapiens
tctacaaaaaggtataaataat

SEQ ID NO: 3348130 - DNA, 23 bp, Homo sapiens
tctacaaaaaggtataaataata

SEQ ID NO: 3348131 - DNA, 23 bp, Homo sapiens
tctacaaagcactagagaatgca

SEQ ID NO: 3348132 - DNA, 16 bp, Homo sapiens
tctacaactggagttt

SEQ ID NO: 3348133 - DNA, 15 bp, Homo sapiens
tctacaagtatatgt

SEQ ID NO: 3348134 - DNA, 22 bp, Homo sapiens
tctacaatctctttttgtttgc

SEQ ID NO: 3348135 - DNA, 14 bp, Homo sapiens
tctacacagagcag

SEQ ID NO: 3348136 - DNA, 15 bp, Homo sapiens
tctacagaagccaag

SEQ ID NO: 3348137 - DNA, 12 bp, Homo sapiens
tctacagaataa

SEQ ID NO: 3348138 - DNA, 18 bp, Homo sapiens
tctacagacttctccaga

SEQ ID NO: 3348139 - DNA, 16 bp, Homo sapiens
tctacagaggccatgg

SEQ ID NO: 3348140 - DNA, 21 bp, Homo sapiens
tctacagaggccatgggcctc

SEQ ID NO: 3348141 - DNA, 21 bp, Homo sapiens
tctacagatagagagttgttg

SEQ ID NO: 3348142 - DNA, 16 bp, Homo sapiens
tctacagatccttttt

SEQ ID NO: 3348143 - DNA, 19 bp, Homo sapiens
tctacagatcctttttcca

SEQ ID NO: 3348144 - DNA, 21 bp, Homo sapiens
tctacagtggttttatactga

SEQ ID NO: 3348145 - DNA, 17 bp, Homo sapiens
tctacataagtaattca

SEQ ID NO: 3348146 - DNA, 22 bp, Homo sapiens
tctacataagtaattcaagaaa

SEQ ID NO: 3348147 - DNA, 15 bp, Homo sapiens
tctacatcttctgcc

SEQ ID NO: 3348148 - DNA, 16 bp, Homo sapiens
tctacatcttctgcct

SEQ ID NO: 3348149 - DNA, 17 bp, Homo sapiens
tctacatgactgggcct

SEQ ID NO: 3348150 - DNA, 15 bp, Homo sapiens
tctacatttaaacaa

SEQ ID NO: 3348151 - DNA, 18 bp, Homo sapiens
tctacatttaaacaagta

SEQ ID NO: 3348152 - DNA, 20 bp, Homo sapiens
tctacatttaaacaagtatt

SEQ ID NO: 3348153 - DNA, 16 bp, Homo sapiens
tctacatttcacatta

SEQ ID NO: 3348154 - DNA, 17 bp, Homo sapiens
tctaccaggcaaattca

SEQ ID NO: 3348155 - DNA, 16 bp, Homo sapiens
tctacccaaaccctag

SEQ ID NO: 3348156 - DNA, 17 bp, Homo sapiens
tctacccatgagcctgc

SEQ ID NO: 3348157 - DNA, 21 bp, Homo sapiens
tctacccatgagcctgcccgc

SEQ ID NO: 3348158 - DNA, 13 bp, Homo sapiens
tctacccctttct

SEQ ID NO: 3348159 - DNA, 18 bp, Homo sapiens
tctaccctcccaccccct

SEQ ID NO: 3348160 - DNA, 15 bp, Homo sapiens
tctaccctgctccct

SEQ ID NO: 3348161 - DNA, 18 bp, Homo sapiens
tctaccggagagagaatg

SEQ ID NO: 3348162 - DNA, 23 bp, Homo sapiens
tctacctaatgtctcactgttct

SEQ ID NO: 3348163 - DNA, 16 bp, Homo sapiens
tctacctccttagctt

SEQ ID NO: 3348164 - DNA, 21 bp, Homo sapiens
tctacctccttagctttccct

SEQ ID NO: 3348165 - DNA, 20 bp, Homo sapiens
tctacctgctggacagcctc

SEQ ID NO: 3348166 - DNA, 20 bp, Homo sapiens
tggcctcatgctggagggag

SEQ ID NO: 3348167 - DNA, 15 bp, Homo sapiens
tggcctcatgtggct

SEQ ID NO: 3348168 - DNA, 17 bp, Homo sapiens
tggcctcatgtggctgg

SEQ ID NO: 3348169 - DNA, 14 bp, Homo sapiens
tggcctcccacccg

SEQ ID NO: 3348170 - DNA, 21 bp, Homo sapiens
tggcctcccacccgatgctgc

SEQ ID NO: 3348171 - DNA, 15 bp, Homo sapiens
tggcctcccctgcca

SEQ ID NO: 3348172 - DNA, 17 bp, Homo sapiens
tggcctcccctgccacc

SEQ ID NO: 3348173 - DNA, 16 bp, Homo sapiens
tggcctcggcgggctt

SEQ ID NO: 3348174 - DNA, 19 bp, Homo sapiens
tggcctcgggacacctgcc

SEQ ID NO: 3348175 - DNA, 23 bp, Homo sapiens
tggcctcgggacacctgccctgc

SEQ ID NO: 3348176 - DNA, 17 bp, Homo sapiens
tggcctcgtgaggggca

SEQ ID NO: 3348177 - DNA, 21 bp, Homo sapiens
tggcctcgtgaggggcaagct

SEQ ID NO: 3348178 - DNA, 14 bp, Homo sapiens
tggcctctggccag

SEQ ID NO: 3348179 - DNA, 16 bp, Homo sapiens
tggcctctggctctca

SEQ ID NO: 3348180 - DNA, 22 bp, Homo sapiens
tggcctcttgagcagtggctgg

SEQ ID NO: 3348181 - DNA, 18 bp, Homo sapiens
tggcctgagctggggcca

SEQ ID NO: 3348182 - DNA, 18 bp, Homo sapiens
tggcctgagtcctggtcc

SEQ ID NO: 3348183 - DNA, 13 bp, Homo sapiens
tggcctgctggga

SEQ ID NO: 3348184 - DNA, 11 bp, Homo sapiens
tggcctggaca

SEQ ID NO: 3348185 - DNA, 16 bp, Homo sapiens
tggcctggcacacatc

SEQ ID NO: 3348186 - DNA, 18 bp, Homo sapiens
tggcctggccctgccctg

SEQ ID NO: 3348187 - DNA, 20 bp, Homo sapiens
tggcctggccctgccctgag

SEQ ID NO: 3348188 - DNA, 13 bp, Homo sapiens
tggcctggccggc

SEQ ID NO: 3348189 - DNA, 13 bp, Homo sapiens
tggcctggcctgg

SEQ ID NO: 3348190 - DNA, 17 bp, Homo sapiens
tggcctggcctggccct

SEQ ID NO: 3348191 - DNA, 11 bp, Homo sapiens
tggcctggctc

SEQ ID NO: 3348192 - DNA, 12 bp, Homo sapiens
tggcctggctcc

SEQ ID NO: 3348193 - DNA, 11 bp, Homo sapiens
tggcctgggca

SEQ ID NO: 3348194 - DNA, 16 bp, Homo sapiens
tggcctggttcaattt

SEQ ID NO: 3348195 - DNA, 14 bp, Homo sapiens
tggcctgtctcatc

SEQ ID NO: 3348196 - DNA, 24 bp, Homo sapiens
tggcctgtctcatccccaggggtc

SEQ ID NO: 3348197 - DNA, 15 bp, Homo sapiens
tggcctgtggcctgt

SEQ ID NO: 3348198 - DNA, 16 bp, Homo sapiens
tggcctgtgtccagca

SEQ ID NO: 3348199 - DNA, 21 bp, Homo sapiens
tggcctgtgtccagcagctgc

SEQ ID NO: 3348200 - DNA, 22 bp, Homo sapiens
tggcctgtgtccagcagctgcg

SEQ ID NO: 3348201 - DNA, 14 bp, Homo sapiens
tggcctgtgtccca

SEQ ID NO: 3348202 - DNA, 22 bp, Homo sapiens
tggcctgtgtcccatgacccac

SEQ ID NO: 3348203 - DNA, 12 bp, Homo sapiens
tggcctgtttga

SEQ ID NO: 3348204 - DNA, 16 bp, Homo sapiens
tggcctgtttgatgta

SEQ ID NO: 3348205 - DNA, 19 bp, Homo sapiens
tggccttaaaaggggccca

SEQ ID NO: 3348206 - DNA, 16 bp, Homo sapiens
tggccttaaagaggga

SEQ ID NO: 3348207 - DNA, 11 bp, Homo sapiens
tggccttcccc

SEQ ID NO: 3348208 - DNA, 22 bp, Homo sapiens
tggccttccccttttgcctggc

SEQ ID NO: 3348209 - DNA, 23 bp, Homo sapiens
tggccttccccttttgcctggct

SEQ ID NO: 3348210 - DNA, 14 bp, Homo sapiens
tggccttcggcctc

SEQ ID NO: 3348211 - DNA, 13 bp, Homo sapiens
tggccttctgctg

SEQ ID NO: 3348212 - DNA, 19 bp, Homo sapiens
tggccttctgctgcccagg

SEQ ID NO: 3348213 - DNA, 13 bp, Homo sapiens
tggccttgaaaca

SEQ ID NO: 3348214 - DNA, 15 bp, Homo sapiens
tggcctttttaagta

SEQ ID NO: 3348215 - DNA, 19 bp, Homo sapiens
tggcctttttcatttatct

SEQ ID NO: 3348216 - DNA, 22 bp, Homo sapiens
tggcctttttcatttatctata

SEQ ID NO: 3348217 - DNA, 21 bp, Homo sapiens
tggcgcaggtgggctggactt

SEQ ID NO: 3348218 - DNA, 15 bp, Homo sapiens
tggcgcgggaggcac

SEQ ID NO: 3348219 - DNA, 20 bp, Homo sapiens
tggcgcgggaggcaccagct

SEQ ID NO: 3348220 - DNA, 23 bp, Homo sapiens
tggcggcagcagccatcatagga

SEQ ID NO: 3348221 - DNA, 16 bp, Homo sapiens
tggcgggatgggccac

SEQ ID NO: 3348222 - DNA, 18 bp, Homo sapiens
tgggactacaggcaccca

SEQ ID NO: 3348223 - DNA, 17 bp, Homo sapiens
tgggactcagccttcag

SEQ ID NO: 3348224 - DNA, 16 bp, Homo sapiens
tgggactcctggtgcc

SEQ ID NO: 3348225 - DNA, 18 bp, Homo sapiens
tgggactcggagactatg

SEQ ID NO: 3348226 - DNA, 23 bp, Homo sapiens
tgggactggccaggtttctgccc

SEQ ID NO: 3348227 - DNA, 18 bp, Homo sapiens
tgggactgtacacacttt

SEQ ID NO: 3348228 - DNA, 22 bp, Homo sapiens
tgggactgtacacactttattt

SEQ ID NO: 3348229 - DNA, 14 bp, Homo sapiens
tgggacttaactcc

SEQ ID NO: 3348230 - DNA, 15 bp, Homo sapiens
tgggacttattacaa

SEQ ID NO: 3348231 - DNA, 20 bp, Homo sapiens
tgggacttctacccagatgg

SEQ ID NO: 3348232 - DNA, 15 bp, Homo sapiens
tgggacttcttaccc

SEQ ID NO: 3348233 - DNA, 12 bp, Homo sapiens
tgggagaaatca

SEQ ID NO: 3348234 - DNA, 22 bp, Homo sapiens
tgggagacaagaaatccctgtt

SEQ ID NO: 3348235 - DNA, 18 bp, Homo sapiens
tgggagacctgtaatcat

SEQ ID NO: 3348236 - DNA, 14 bp, Homo sapiens
tgggagagcccagc

SEQ ID NO: 3348237 - DNA, 18 bp, Homo sapiens
tgggagagcccctggggc

SEQ ID NO: 3348238 - DNA, 18 bp, Homo sapiens
tgggagatttttttgagt

SEQ ID NO: 3348239 - DNA, 12 bp, Homo sapiens
tgggagcactgg

SEQ ID NO: 3348240 - DNA, 14 bp, Homo sapiens
tgggagcagaaaca

SEQ ID NO: 3348241 - DNA, 14 bp, Homo sapiens
tgggagcaggagat

SEQ ID NO: 3348242 - DNA, 21 bp, Homo sapiens
tgggagcatagcagaggggcc

SEQ ID NO: 3348243 - DNA, 20 bp, Homo sapiens
tgggagccacttctccccag

SEQ ID NO: 3348244 - DNA, 16 bp, Homo sapiens
tgggagccagctgctt

SEQ ID NO: 3348245 - DNA, 14 bp, Homo sapiens
tgggagcccagagg

SEQ ID NO: 3348246 - DNA, 19 bp, Homo sapiens
tgggagcccagagggtggc

SEQ ID NO: 3348247 - DNA, 23 bp, Homo sapiens
tgggagccccagggtcttcccta

SEQ ID NO: 3348248 - DNA, 18 bp, Homo sapiens
tgggagcctagctcctgc

SEQ ID NO: 3348249 - DNA, 21 bp, Homo sapiens
tgggagcctagctcctgccac

SEQ ID NO: 3348250 - DNA, 17 bp, Homo sapiens
tgggagctgaaccaaag

SEQ ID NO: 3348251 - DNA, 18 bp, Homo sapiens
tgggagctgagctggaag

SEQ ID NO: 3348252 - DNA, 16 bp, Homo sapiens
tgggagctgccaagag

SEQ ID NO: 3348253 - DNA, 20 bp, Homo sapiens
tgggagctggttagaaatgc

SEQ ID NO: 3348254 - DNA, 18 bp, Homo sapiens
tgggaggaaagagagcag

SEQ ID NO: 3348255 - DNA, 13 bp, Homo sapiens
tgggaggaagcag

SEQ ID NO: 3348256 - DNA, 12 bp, Homo sapiens
tgggaggacagg

SEQ ID NO: 3348257 - DNA, 15 bp, Homo sapiens
tgggaggaggaaaag

SEQ ID NO: 3348258 - DNA, 21 bp, Homo sapiens
tgggaggaggaaaagaaacct

SEQ ID NO: 3348259 - DNA, 14 bp, Homo sapiens
tgggaggaggaaga

SEQ ID NO: 3348260 - DNA, 13 bp, Homo sapiens
tgggaggaggcct

SEQ ID NO: 3348261 - DNA, 22 bp, Homo sapiens
tgctttctgttccaaattcagt

SEQ ID NO: 3348262 - DNA, 14 bp, Homo sapiens
tgctttctgtttct

SEQ ID NO: 3348263 - DNA, 15 bp, Homo sapiens
tgctttgaagcagtt

SEQ ID NO: 3348264 - DNA, 16 bp, Homo sapiens
tgctttgaagtagctc

SEQ ID NO: 3348265 - DNA, 14 bp, Homo sapiens
tgctttgcacagga

SEQ ID NO: 3348266 - DNA, 24 bp, Homo sapiens
tgctttgccaagttgctgtcactg

SEQ ID NO: 3348267 - DNA, 12 bp, Homo sapiens
tgctttgctaga

SEQ ID NO: 3348268 - DNA, 17 bp, Homo sapiens
tgctttgctagatgctg

SEQ ID NO: 3348269 - DNA, 12 bp, Homo sapiens
tgctttgctctt

SEQ ID NO: 3348270 - DNA, 12 bp, Homo sapiens
tgctttgctgct

SEQ ID NO: 3348271 - DNA, 21 bp, Homo sapiens
tgctttgctgctatgaaaatg

SEQ ID NO: 3348272 - DNA, 22 bp, Homo sapiens
tgctttggacctaaatggcctc

SEQ ID NO: 3348273 - DNA, 17 bp, Homo sapiens
tgctttgggaggccaag

SEQ ID NO: 3348274 - DNA, 14 bp, Homo sapiens
tgctttgggctgcc

SEQ ID NO: 3348275 - DNA, 15 bp, Homo sapiens
tgctttgggctgccc

SEQ ID NO: 3348276 - DNA, 17 bp, Homo sapiens
tgctttgggctgccctg

SEQ ID NO: 3348277 - DNA, 19 bp, Homo sapiens
tgctttgggctgccctggt

SEQ ID NO: 3348278 - DNA, 12 bp, Homo sapiens
tgcttttaatta

SEQ ID NO: 3348279 - DNA, 13 bp, Homo sapiens
tgcttttaattaa

SEQ ID NO: 3348280 - DNA, 13 bp, Homo sapiens
tgcttttagaaaa

SEQ ID NO: 3348281 - DNA, 18 bp, Homo sapiens
tgcttttatatggcccag

SEQ ID NO: 3348282 - DNA, 16 bp, Homo sapiens
tgcttttattttgaaa

SEQ ID NO: 3348283 - DNA, 14 bp, Homo sapiens
tgcttttcatgtag

SEQ ID NO: 3348284 - DNA, 23 bp, Homo sapiens
tgcttttcatgtagaactcagca

SEQ ID NO: 3348285 - DNA, 15 bp, Homo sapiens
tgcttttgagcctca

SEQ ID NO: 3348286 - DNA, 16 bp, Homo sapiens
tgcttttgagcctcag

SEQ ID NO: 3348287 - DNA, 16 bp, Homo sapiens
tgcttttgcttgcaat

SEQ ID NO: 3348288 - DNA, 20 bp, Homo sapiens
tgcttttgtctatgggactc

SEQ ID NO: 3348289 - DNA, 23 bp, Homo sapiens
tgcttttgttccaatgtcaatgt

SEQ ID NO: 3348290 - DNA, 16 bp, Homo sapiens
tgcttttgttgtgact

SEQ ID NO: 3348291 - DNA, 21 bp, Homo sapiens
tgcttttgtttgctcttttaa

SEQ ID NO: 3348292 - DNA, 20 bp, Homo sapiens
tgcttttgtttttttcctca

SEQ ID NO: 3348293 - DNA, 15 bp, Homo sapiens
tgctttttataaaaa

SEQ ID NO: 3348294 - DNA, 16 bp, Homo sapiens
tgctttttataaaaag

SEQ ID NO: 3348295 - DNA, 18 bp, Homo sapiens
tgctttttatttctgcat

SEQ ID NO: 3348296 - DNA, 14 bp, Homo sapiens
tgctttttccaact

SEQ ID NO: 3348297 - DNA, 14 bp, Homo sapiens
tgctttttgaaatg

SEQ ID NO: 3348298 - DNA, 15 bp, Homo sapiens
tgctttttgaaatga

SEQ ID NO: 3348299 - DNA, 17 bp, Homo sapiens
tgcttttttttttccag

SEQ ID NO: 3348300 - DNA, 18 bp, Homo sapiens
tggaaaaaaacataaaaa

SEQ ID NO: 3348301 - DNA, 23 bp, Homo sapiens
tggaaaaaagagaaaaaccaatg

SEQ ID NO: 3348302 - DNA, 17 bp, Homo sapiens
tggaaaaataacaacta

SEQ ID NO: 3348303 - DNA, 13 bp, Homo sapiens
tggaaaaatccag

SEQ ID NO: 3348304 - DNA, 19 bp, Homo sapiens
tggaaaaatccagaaagaa

SEQ ID NO: 3348305 - DNA, 16 bp, Homo sapiens
tggaaaaatggttgat

SEQ ID NO: 3348306 - DNA, 14 bp, Homo sapiens
tggaaaacctcctt

SEQ ID NO: 3348307 - DNA, 12 bp, Homo sapiens
tggaaaagacag

SEQ ID NO: 3348308 - DNA, 16 bp, Homo sapiens
tggaaaaggaagacta

SEQ ID NO: 3348309 - DNA, 20 bp, Homo sapiens
tggaaaaggaagactagagg

SEQ ID NO: 3348310 - DNA, 22 bp, Homo sapiens
tggaaaaggaagactagaggct

SEQ ID NO: 3348311 - DNA, 21 bp, Homo sapiens
tggaaaatacctaattgtgga

SEQ ID NO: 3348312 - DNA, 18 bp, Homo sapiens
tggaaaatgccatgaatt

SEQ ID NO: 3348313 - DNA, 13 bp, Homo sapiens
tggaaacagcatg

SEQ ID NO: 3348314 - DNA, 18 bp, Homo sapiens
tggaaacagcatgaataa

SEQ ID NO: 3348315 - DNA, 18 bp, Homo sapiens
tggaaacattacagttca

SEQ ID NO: 3348316 - DNA, 17 bp, Homo sapiens
tggaaacctgaaaaaaa

SEQ ID NO: 3348317 - DNA, 21 bp, Homo sapiens
tggaaactatgtgtttttctc

SEQ ID NO: 3348318 - DNA, 18 bp, Homo sapiens
tggaaactctttaacttc

SEQ ID NO: 3348319 - DNA, 15 bp, Homo sapiens
tggaaactgctaaat

SEQ ID NO: 3348320 - DNA, 13 bp, Homo sapiens
tctgccacccact

SEQ ID NO: 3348321 - DNA, 14 bp, Homo sapiens
tctgccacccactc

SEQ ID NO: 3348322 - DNA, 13 bp, Homo sapiens
tctgccagacctt

SEQ ID NO: 3348323 - DNA, 12 bp, Homo sapiens
tctgccagggag

SEQ ID NO: 3348324 - DNA, 13 bp, Homo sapiens
tctgccagggagc

SEQ ID NO: 3348325 - DNA, 19 bp, Homo sapiens
tctgccagggagcttgaaa

SEQ ID NO: 3348326 - DNA, 11 bp, Homo sapiens
tctgccagggc

SEQ ID NO: 3348327 - DNA, 13 bp, Homo sapiens
tctgccagggcag

SEQ ID NO: 3348328 - DNA, 16 bp, Homo sapiens
tctgccagggcagtgc

SEQ ID NO: 3348329 - DNA, 17 bp, Homo sapiens
tctgccagggcagtgct

SEQ ID NO: 3348330 - DNA, 21 bp, Homo sapiens
tctgccagtggatcccctgcg

SEQ ID NO: 3348331 - DNA, 22 bp, Homo sapiens
tctgccatattctgttggccag

SEQ ID NO: 3348332 - DNA, 23 bp, Homo sapiens
tctgccatattctgttggccagt

SEQ ID NO: 3348333 - DNA, 14 bp, Homo sapiens
tctgccatgtccat

SEQ ID NO: 3348334 - DNA, 18 bp, Homo sapiens
tctgcccacattggaccc

SEQ ID NO: 3348335 - DNA, 13 bp, Homo sapiens
tctgcccactcgg

SEQ ID NO: 3348336 - DNA, 21 bp, Homo sapiens
tctgcccaggggtgccccctc

SEQ ID NO: 3348337 - DNA, 17 bp, Homo sapiens
tctgccccaagcagcca

SEQ ID NO: 3348338 - DNA, 22 bp, Homo sapiens
tctgccccaagcagccagccag

SEQ ID NO: 3348339 - DNA, 16 bp, Homo sapiens
tctgccccaagccccc

SEQ ID NO: 3348340 - DNA, 15 bp, Homo sapiens
tctgcccccagccca

SEQ ID NO: 3348341 - DNA, 13 bp, Homo sapiens
tctgcccctcccc

SEQ ID NO: 3348342 - DNA, 14 bp, Homo sapiens
tctgcccctgatca

SEQ ID NO: 3348343 - DNA, 15 bp, Homo sapiens
tctgcccctgatcac

SEQ ID NO: 3348344 - DNA, 19 bp, Homo sapiens
tctgccccttgggcatcca

SEQ ID NO: 3348345 - DNA, 22 bp, Homo sapiens
tctgccccttgggcatccaccc

SEQ ID NO: 3348346 - DNA, 18 bp, Homo sapiens
tctgccctcattactggg

SEQ ID NO: 3348347 - DNA, 16 bp, Homo sapiens
tctgccctggctgctg

SEQ ID NO: 3348348 - DNA, 17 bp, Homo sapiens
tctgccctggctgctgc

SEQ ID NO: 3348349 - DNA, 14 bp, Homo sapiens
tctgccgcctcagc

SEQ ID NO: 3348350 - DNA, 20 bp, Homo sapiens
tctgccgcctcagcttctca

SEQ ID NO: 3348351 - DNA, 19 bp, Homo sapiens
tctgccgctacctccctcc

SEQ ID NO: 3348352 - DNA, 13 bp, Homo sapiens
tctgccggctctt

SEQ ID NO: 3348353 - DNA, 20 bp, Homo sapiens
tctgccggtcgggcagccag

SEQ ID NO: 3348354 - DNA, 21 bp, Homo sapiens
tctgccggtcgggcagccagc

SEQ ID NO: 3348355 - DNA, 21 bp, Homo sapiens
tctgcctacagaacttcagaa

SEQ ID NO: 3348356 - DNA, 19 bp, Homo sapiens
tctgcctagagtgtagcct

SEQ ID NO: 3348357 - DNA, 15 bp, Homo sapiens
tctgcctctgacaca

SEQ ID NO: 3348358 - DNA, 20 bp, Homo sapiens
tctgcctgaagtcacacagt

SEQ ID NO: 3348359 - DNA, 18 bp, Homo sapiens
tctgcctgcccaggcccc

SEQ ID NO: 3348360 - DNA, 20 bp, Homo sapiens
tctgcctgcccaggcccctg

SEQ ID NO: 3348361 - DNA, 14 bp, Homo sapiens
tctgcctgccccgc

SEQ ID NO: 3348362 - DNA, 15 bp, Homo sapiens
tctgcctggcctggc

SEQ ID NO: 3348363 - DNA, 16 bp, Homo sapiens
tctgcctggcctggct

SEQ ID NO: 3348364 - DNA, 18 bp, Homo sapiens
tctgcctggcctggctcc

SEQ ID NO: 3348365 - DNA, 12 bp, Homo sapiens
tctgcctgggcc

SEQ ID NO: 3348366 - DNA, 16 bp, Homo sapiens
tctgcctgggcctgtg

SEQ ID NO: 3348367 - DNA, 17 bp, Homo sapiens
tctgcctgggcctgtgc

SEQ ID NO: 3348368 - DNA, 12 bp, Homo sapiens
tctgcctgtctc

SEQ ID NO: 3348369 - DNA, 14 bp, Homo sapiens
tctgcctgtctccc

SEQ ID NO: 3348370 - DNA, 13 bp, Homo sapiens
tctgcctgttctg

SEQ ID NO: 3348371 - DNA, 17 bp, Homo sapiens
tctgcctgttctgagga

SEQ ID NO: 3348372 - DNA, 17 bp, Homo sapiens
tctgccttaaaaccaaa

SEQ ID NO: 3348373 - DNA, 20 bp, Homo sapiens
tctgccttaaaaccaaagag

SEQ ID NO: 3348374 - DNA, 15 bp, Homo sapiens
tctgccttagtctca

SEQ ID NO: 3348375 - DNA, 17 bp, Homo sapiens
tctgccttcaggcttct

SEQ ID NO: 3348376 - DNA, 14 bp, Homo sapiens
tctgcctttgacat

SEQ ID NO: 3348377 - DNA, 11 bp, Homo sapiens
tctgccttttc

SEQ ID NO: 3348378 - DNA, 16 bp, Homo sapiens
tctgcgccacttcctt

SEQ ID NO: 3348379 - DNA, 17 bp, Homo sapiens
tctgcgccacttccttt

SEQ ID NO: 3348380 - DNA, 21 bp, Homo sapiens
tctgcgccacttcctttgtgt

SEQ ID NO: 3348381 - DNA, 14 bp, Homo sapiens
tctgcgcctcaggc

SEQ ID NO: 3348382 - DNA, 23 bp, Homo sapiens
tctgcgcttggtctttctgtgct

SEQ ID NO: 3348383 - DNA, 15 bp, Homo sapiens
tctgcggaccccagc

SEQ ID NO: 3348384 - DNA, 17 bp, Homo sapiens
tctgcggatctcagctt

SEQ ID NO: 3348385 - DNA, 19 bp, Homo sapiens
tctgcggatctcagctttg

SEQ ID NO: 3348386 - DNA, 17 bp, Homo sapiens
tctgcggggcagggcct

SEQ ID NO: 3348387 - DNA, 14 bp, Homo sapiens
tctgctaataaaac

SEQ ID NO: 3348388 - DNA, 16 bp, Homo sapiens
tctgctaatgtaaact

SEQ ID NO: 3348389 - DNA, 16 bp, Homo sapiens
tctgctacttcactgt

SEQ ID NO: 3348390 - DNA, 18 bp, Homo sapiens
tctgctacttcactgtca

SEQ ID NO: 3348391 - DNA, 16 bp, Homo sapiens
tctgctagatttctac

SEQ ID NO: 3348392 - DNA, 17 bp, Homo sapiens
tctgctagatttctaca

SEQ ID NO: 3348393 - DNA, 22 bp, Homo sapiens
tctgctagccaatattaaaaga

SEQ ID NO: 3348394 - DNA, 17 bp, Homo sapiens
tctgctcacagtaaccc

SEQ ID NO: 3348395 - DNA, 16 bp, Homo sapiens
tctgctcacatatctg

SEQ ID NO: 3348396 - DNA, 19 bp, Homo sapiens
tctgctcactttaaacctg

SEQ ID NO: 3348397 - DNA, 12 bp, Homo sapiens
tctgctccaccc

SEQ ID NO: 3348398 - DNA, 18 bp, Homo sapiens
tctgctccacccttggcc

SEQ ID NO: 3348399 - DNA, 21 bp, Homo sapiens
tctgctccacccttggcctgt

SEQ ID NO: 3348400 - DNA, 16 bp, Homo sapiens
tctgctccccagggga

SEQ ID NO: 3348401 - DNA, 16 bp, Homo sapiens
tctgctcctctccagg

SEQ ID NO: 3348402 - DNA, 18 bp, Homo sapiens
tctgctcctctccaggca

SEQ ID NO: 3348403 - DNA, 23 bp, Homo sapiens
tctgctccttcactgttccctct

SEQ ID NO: 3348404 - DNA, 12 bp, Homo sapiens
tctgctctagcc

SEQ ID NO: 3348405 - DNA, 13 bp, Homo sapiens
tctgctctagcca

SEQ ID NO: 3348406 - DNA, 14 bp, Homo sapiens
tctgctctagccag

SEQ ID NO: 3348407 - DNA, 15 bp, Homo sapiens
tctgctctagccagg

SEQ ID NO: 3348408 - DNA, 20 bp, Homo sapiens
tctgctctagggaatctgga

SEQ ID NO: 3348409 - DNA, 21 bp, Homo sapiens
tctgctctagggaatctggat

SEQ ID NO: 3348410 - DNA, 19 bp, Homo sapiens
tctgctctctatgtatgta

SEQ ID NO: 3348411 - DNA, 14 bp, Homo sapiens
tctgctctttctct

SEQ ID NO: 3348412 - DNA, 15 bp, Homo sapiens
tctgctctttctctg

SEQ ID NO: 3348413 - DNA, 16 bp, Homo sapiens
tctgctctttctctgc

SEQ ID NO: 3348414 - DNA, 22 bp, Homo sapiens
tctgctgacagacacaggcccg

SEQ ID NO: 3348415 - DNA, 14 bp, Homo sapiens
tctgctgagctggg

SEQ ID NO: 3348416 - DNA, 18 bp, Homo sapiens
tctgctgagctgggccca

SEQ ID NO: 3348417 - DNA, 23 bp, Homo sapiens
tctgctgagctgggcccagcccc

SEQ ID NO: 3348418 - DNA, 11 bp, Homo sapiens
tctgctgagga

SEQ ID NO: 3348419 - DNA, 12 bp, Homo sapiens
tctgctgcccag

SEQ ID NO: 3348420 - DNA, 14 bp, Homo sapiens
tctgctgcccaggc

SEQ ID NO: 3348421 - DNA, 18 bp, Homo sapiens
tctgctgcccaggccaca

SEQ ID NO: 3348422 - DNA, 21 bp, Homo sapiens
tctgctgcccaggccacagcc

SEQ ID NO: 3348423 - DNA, 17 bp, Homo sapiens
tctgctgcctgcccgca

SEQ ID NO: 3348424 - DNA, 19 bp, Homo sapiens
tctgctggagtttcatgta

SEQ ID NO: 3348425 - DNA, 23 bp, Homo sapiens
tctgctggagtttcatgtacaag

SEQ ID NO: 3348426 - DNA, 16 bp, Homo sapiens
tctgctggataaaatg

SEQ ID NO: 3348427 - DNA, 18 bp, Homo sapiens
tctgctggataaaatgag

SEQ ID NO: 3348428 - DNA, 12 bp, Homo sapiens
tctgctggccca

SEQ ID NO: 3348429 - DNA, 14 bp, Homo sapiens
tctgctggcccagc

SEQ ID NO: 3348430 - DNA, 17 bp, Homo sapiens
tctgctggcctggatct

SEQ ID NO: 3348431 - DNA, 18 bp, Homo sapiens
tctgctggcctggatctc

SEQ ID NO: 3348432 - DNA, 15 bp, Homo sapiens
tctgctggcctggcc

SEQ ID NO: 3348433 - DNA, 21 bp, Homo sapiens
tctgctgggagttctagaacc

SEQ ID NO: 3348434 - DNA, 13 bp, Homo sapiens
tctgctggtgaat

SEQ ID NO: 3348435 - DNA, 14 bp, Homo sapiens
tctgctggtggaaa

SEQ ID NO: 3348436 - DNA, 21 bp, Homo sapiens
tctgctggttcctgactggca

SEQ ID NO: 3348437 - DNA, 22 bp, Homo sapiens
tctgctggttcctgactggcaa

SEQ ID NO: 3348438 - DNA, 13 bp, Homo sapiens
tctgctgttaact

SEQ ID NO: 3348439 - DNA, 12 bp, Homo sapiens
tctgctgttgcc

SEQ ID NO: 3348440 - DNA, 17 bp, Homo sapiens
tctgctgttgccatagc

SEQ ID NO: 3348441 - DNA, 14 bp, Homo sapiens
tctgcttctctcac

SEQ ID NO: 3348442 - DNA, 16 bp, Homo sapiens
tctgcttctctcacct

SEQ ID NO: 3348443 - DNA, 18 bp, Homo sapiens
tctgcttgatttttgcct

SEQ ID NO: 3348444 - DNA, 21 bp, Homo sapiens
tctgctttaaagggcctgcct

SEQ ID NO: 3348445 - DNA, 18 bp, Homo sapiens
tctgctttatcttttcat

SEQ ID NO: 3348446 - DNA, 22 bp, Homo sapiens
tctgctttggggtttatcagaa

SEQ ID NO: 3348447 - DNA, 13 bp, Homo sapiens
tctgcttttatct

SEQ ID NO: 3348448 - DNA, 15 bp, Homo sapiens
tctgcttttctgccc

SEQ ID NO: 3348449 - DNA, 17 bp, Homo sapiens
tctgcttttctgccctg

SEQ ID NO: 3348450 - DNA, 22 bp, Homo sapiens
tctggaaacctgtcattgtatt

SEQ ID NO: 3348451 - DNA, 14 bp, Homo sapiens
tggaaggcagagaa

SEQ ID NO: 3348452 - DNA, 14 bp, Homo sapiens
tggaaggcagggca

SEQ ID NO: 3348453 - DNA, 13 bp, Homo sapiens
tggaagggctggg

SEQ ID NO: 3348454 - DNA, 15 bp, Homo sapiens
tggaagggctgggtg

SEQ ID NO: 3348455 - DNA, 18 bp, Homo sapiens
tggaaggggccttgctga

SEQ ID NO: 3348456 - DNA, 21 bp, Homo sapiens
tggaaggtttgtatattgtca

SEQ ID NO: 3348457 - DNA, 17 bp, Homo sapiens
tggaagtctacctgctg

SEQ ID NO: 3348458 - DNA, 17 bp, Homo sapiens
tggaagtgttcaagaaa

SEQ ID NO: 3348459 - DNA, 11 bp, Homo sapiens
tggaagttatt

SEQ ID NO: 3348460 - DNA, 14 bp, Homo sapiens
tggaagttttgcat

SEQ ID NO: 3348461 - DNA, 19 bp, Homo sapiens
tggaataaacattaatttt

SEQ ID NO: 3348462 - DNA, 16 bp, Homo sapiens
tggaataaagttgcag

SEQ ID NO: 3348463 - DNA, 22 bp, Homo sapiens
tggaatacagtgttattttctt

SEQ ID NO: 3348464 - DNA, 14 bp, Homo sapiens
tggaatacatgaaa

SEQ ID NO: 3348465 - DNA, 12 bp, Homo sapiens
tggaatactttt

SEQ ID NO: 3348466 - DNA, 13 bp, Homo sapiens
tggaatacttttt

SEQ ID NO: 3348467 - DNA, 16 bp, Homo sapiens
tggaatagtgaatact

SEQ ID NO: 3348468 - DNA, 21 bp, Homo sapiens
tggaatataaggaaagcaata

SEQ ID NO: 3348469 - DNA, 14 bp, Homo sapiens
tggaatatcatctg

SEQ ID NO: 3348470 - DNA, 12 bp, Homo sapiens
tggaatattaaa

SEQ ID NO: 3348471 - DNA, 24 bp, Homo sapiens
tggaatatttataggccagggcat

SEQ ID NO: 3348472 - DNA, 18 bp, Homo sapiens
tggaatcccactgtatga

SEQ ID NO: 3348473 - DNA, 18 bp, Homo sapiens
tggaatctagccgatgga

SEQ ID NO: 3348474 - DNA, 21 bp, Homo sapiens
tggaatcttctctttgacaat

SEQ ID NO: 3348475 - DNA, 17 bp, Homo sapiens
tggaatgaattaaataa

SEQ ID NO: 3348476 - DNA, 22 bp, Homo sapiens
tggaatggaactactgtacttt

SEQ ID NO: 3348477 - DNA, 14 bp, Homo sapiens
tggaatgtgcccct

SEQ ID NO: 3348478 - DNA, 17 bp, Homo sapiens
tggaattaaaaggatag

SEQ ID NO: 3348479 - DNA, 16 bp, Homo sapiens
tggaattaacctggtg

SEQ ID NO: 3348480 - DNA, 17 bp, Homo sapiens
tggaattaacctggtgc

SEQ ID NO: 3348481 - DNA, 19 bp, Homo sapiens
tggaattaacctggtgctg

SEQ ID NO: 3348482 - DNA, 17 bp, Homo sapiens
tggaattcagcaccctg

SEQ ID NO: 3348483 - DNA, 21 bp, Homo sapiens
tggaattcagcaccctgggtg

SEQ ID NO: 3348484 - DNA, 16 bp, Homo sapiens
tggaattgatttgcat

SEQ ID NO: 3348485 - DNA, 18 bp, Homo sapiens
tggaattgcttaccaaag

SEQ ID NO: 3348486 - DNA, 17 bp, Homo sapiens
tggaatttgcctgctgg

SEQ ID NO: 3348487 - DNA, 16 bp, Homo sapiens
tggacaaactggagtc

SEQ ID NO: 3348488 - DNA, 22 bp, Homo sapiens
tggacaaactggagtctggagt

SEQ ID NO: 3348489 - DNA, 16 bp, Homo sapiens
tggacaacttatttaa

SEQ ID NO: 3348490 - DNA, 16 bp, Homo sapiens
tggacacaaacaggaa

SEQ ID NO: 3348491 - DNA, 15 bp, Homo sapiens
tggacacagctcttc

SEQ ID NO: 3348492 - DNA, 17 bp, Homo sapiens
tggacacagctcttcat

SEQ ID NO: 3348493 - DNA, 18 bp, Homo sapiens
tggacacagctcttctcc

SEQ ID NO: 3348494 - DNA, 15 bp, Homo sapiens
tggacactcagacct

SEQ ID NO: 3348495 - DNA, 12 bp, Homo sapiens
tggacagaccca

SEQ ID NO: 3348496 - DNA, 17 bp, Homo sapiens
tggacagacccaggtct

SEQ ID NO: 3348497 - DNA, 18 bp, Homo sapiens
tggacagacccaggtctt

SEQ ID NO: 3348498 - DNA, 19 bp, Homo sapiens
tggacagacccaggtcttc

SEQ ID NO: 3348499 - DNA, 17 bp, Homo sapiens
tggacaggagtcagtgt

SEQ ID NO: 3348500 - DNA, 16 bp, Homo sapiens
tggacaggcatgttct

SEQ ID NO: 3348501 - DNA, 18 bp, Homo sapiens
tggacaggcatgttctct

SEQ ID NO: 3348502 - DNA, 18 bp, Homo sapiens
tggacagtacctgattgt

SEQ ID NO: 3348503 - DNA, 19 bp, Homo sapiens
tggacagtacctgattgta

SEQ ID NO: 3348504 - DNA, 22 bp, Homo sapiens
tggacagtacctgattgtattt

SEQ ID NO: 3348505 - DNA, 17 bp, Homo sapiens
tggacagtcctgggaga

SEQ ID NO: 3348506 - DNA, 21 bp, Homo sapiens
tggacagtctttgatcatcat

SEQ ID NO: 3348507 - DNA, 22 bp, Homo sapiens
tggacagtctttgatcatcatg

SEQ ID NO: 3348508 - DNA, 21 bp, Homo sapiens
tggacagttcacaccctgcaa

SEQ ID NO: 3348509 - DNA, 23 bp, Homo sapiens
tggacagtttaccagttgccttt

SEQ ID NO: 3348510 - DNA, 18 bp, Homo sapiens
tggacatcctcctcccac

SEQ ID NO: 3348511 - DNA, 18 bp, Homo sapiens
tggacatcctcttctgct

SEQ ID NO: 3348512 - DNA, 16 bp, Homo sapiens
tggatttcttagagat

SEQ ID NO: 3348513 - DNA, 19 bp, Homo sapiens
tggattttaaaaattggaa

SEQ ID NO: 3348514 - DNA, 19 bp, Homo sapiens
tggattttctattgttact

SEQ ID NO: 3348515 - DNA, 15 bp, Homo sapiens
tggatttttctttaa

SEQ ID NO: 3348516 - DNA, 19 bp, Homo sapiens
tggatttttgactctggca

SEQ ID NO: 3348517 - DNA, 21 bp, Homo sapiens
tggcaaaagccttgtgtatat

SEQ ID NO: 3348518 - DNA, 21 bp, Homo sapiens
tggcaaaatatggtttggttt

SEQ ID NO: 3348519 - DNA, 14 bp, Homo sapiens
tggcaaagtgctgt

SEQ ID NO: 3348520 - DNA, 15 bp, Homo sapiens
tggcaacagaagcag

SEQ ID NO: 3348521 - DNA, 19 bp, Homo sapiens
tggcaacaggacagagttc

SEQ ID NO: 3348522 - DNA, 21 bp, Homo sapiens
tggcaacagttagctggagct

SEQ ID NO: 3348523 - DNA, 13 bp, Homo sapiens
tggcaagaacttg

SEQ ID NO: 3348524 - DNA, 20 bp, Homo sapiens
tggcaagaacttgtttacaa

SEQ ID NO: 3348525 - DNA, 17 bp, Homo sapiens
tggcaagaggcctcatg

SEQ ID NO: 3348526 - DNA, 21 bp, Homo sapiens
tggcaagaggcctcatgcctg

SEQ ID NO: 3348527 - DNA, 18 bp, Homo sapiens
tggcaagatgaaataatt

SEQ ID NO: 3348528 - DNA, 15 bp, Homo sapiens
tggcaagcagggaaa

SEQ ID NO: 3348529 - DNA, 23 bp, Homo sapiens
tggcaagcagggaaagctccacg

SEQ ID NO: 3348530 - DNA, 12 bp, Homo sapiens
tggcaaggaaag

SEQ ID NO: 3348531 - DNA, 15 bp, Homo sapiens
tggcaagtcacatgc

SEQ ID NO: 3348532 - DNA, 16 bp, Homo sapiens
tggcaagtcacatgcg

SEQ ID NO: 3348533 - DNA, 11 bp, Homo sapiens
tggcaataaac

SEQ ID NO: 3348534 - DNA, 13 bp, Homo sapiens
tggcaataaactc

SEQ ID NO: 3348535 - DNA, 19 bp, Homo sapiens
tggcaattccaatatttct

SEQ ID NO: 3348536 - DNA, 13 bp, Homo sapiens
tggcaattgtcta

SEQ ID NO: 3348537 - DNA, 15 bp, Homo sapiens
tggcaatttcctggc

SEQ ID NO: 3348538 - DNA, 16 bp, Homo sapiens
tggcaatttcctggcc

SEQ ID NO: 3348539 - DNA, 14 bp, Homo sapiens
tggcaattttgtaa

SEQ ID NO: 3348540 - DNA, 14 bp, Homo sapiens
tggcacagaacagg

SEQ ID NO: 3348541 - DNA, 21 bp, Homo sapiens
tggcacagacttctggaaggc

SEQ ID NO: 3348542 - DNA, 13 bp, Homo sapiens
tggcacatttcag

SEQ ID NO: 3348543 - DNA, 16 bp, Homo sapiens
tggcacatttcaggga

SEQ ID NO: 3348544 - DNA, 17 bp, Homo sapiens
tggcacatttcagggag

SEQ ID NO: 3348545 - DNA, 18 bp, Homo sapiens
tggcacatttcagggaga

SEQ ID NO: 3348546 - DNA, 13 bp, Homo sapiens
tggcaccagcccc

SEQ ID NO: 3348547 - DNA, 18 bp, Homo sapiens
tggcaccagccccctgga

SEQ ID NO: 3348548 - DNA, 15 bp, Homo sapiens
tggcaccatgtgcca

SEQ ID NO: 3348549 - DNA, 16 bp, Homo sapiens
tggcacccctttctag

SEQ ID NO: 3348550 - DNA, 20 bp, Homo sapiens
tggcacccggcccctgctgg

SEQ ID NO: 3348551 - DNA, 21 bp, Homo sapiens
tggcacccggcccctgctggt

SEQ ID NO: 3348552 - DNA, 17 bp, Homo sapiens
tggcacctcctgagaag

SEQ ID NO: 3348553 - DNA, 14 bp, Homo sapiens
tggcacgccctact

SEQ ID NO: 3348554 - DNA, 15 bp, Homo sapiens
tggcacgccctactc

SEQ ID NO: 3348555 - DNA, 15 bp, Homo sapiens
tggcactcaactctg

SEQ ID NO: 3348556 - DNA, 23 bp, Homo sapiens
tggcactcaactctgagcccata

SEQ ID NO: 3348557 - DNA, 19 bp, Homo sapiens
tggcactcacagacctgga

SEQ ID NO: 3348558 - DNA, 22 bp, Homo sapiens
tggcactgagatttaaatgcaa

SEQ ID NO: 3348559 - DNA, 17 bp, Homo sapiens
tggcactgagccccccc

SEQ ID NO: 3348560 - DNA, 18 bp, Homo sapiens
tggcactgagccccccca

SEQ ID NO: 3348561 - DNA, 18 bp, Homo sapiens
tggcactggatgcagaaa

SEQ ID NO: 3348562 - DNA, 18 bp, Homo sapiens
tggcacttagcccaagag

SEQ ID NO: 3348563 - DNA, 21 bp, Homo sapiens
tggcacttagctatcagaaga

SEQ ID NO: 3348564 - DNA, 22 bp, Homo sapiens
tggcacttgtatttaattcttc

SEQ ID NO: 3348565 - DNA, 11 bp, Homo sapiens
tggcactttga

SEQ ID NO: 3348566 - DNA, 16 bp, Homo sapiens
tggcactttgaagggg

SEQ ID NO: 3348567 - DNA, 19 bp, Homo sapiens
tggcactttttcgtgtgga

SEQ ID NO: 3348568 - DNA, 20 bp, Homo sapiens
tggcactttttcgtgtggat

SEQ ID NO: 3348569 - DNA, 12 bp, Homo sapiens
tggcagaaaaga

SEQ ID NO: 3348570 - DNA, 19 bp, Homo sapiens
tggcagaaaagaggagacc

SEQ ID NO: 3348571 - DNA, 13 bp, Homo sapiens
tggcagaagacac

SEQ ID NO: 3348572 - DNA, 18 bp, Homo sapiens
tggcagaagacaccagag

SEQ ID NO: 3348573 - DNA, 12 bp, Homo sapiens
tggcagactctt

SEQ ID NO: 3348574 - DNA, 22 bp, Homo sapiens
tggcagactctttaataaattg

SEQ ID NO: 3348575 - DNA, 18 bp, Homo sapiens
tggcagagaaggcctctt

SEQ ID NO: 3348576 - DNA, 13 bp, Homo sapiens
tggccccagccct

SEQ ID NO: 3348577 - DNA, 20 bp, Homo sapiens
tggccccagccctgctgggg

SEQ ID NO: 3348578 - DNA, 21 bp, Homo sapiens
tggccccagccctgctgggga

SEQ ID NO: 3348579 - DNA, 22 bp, Homo sapiens
tggccccaggcccacagcgtgg

SEQ ID NO: 3348580 - DNA, 14 bp, Homo sapiens
tggccccagggcac

SEQ ID NO: 3348581 - DNA, 18 bp, Homo sapiens
tggccccagggcaccctg

SEQ ID NO: 3348582 - DNA, 13 bp, Homo sapiens
tggccccatccca

SEQ ID NO: 3348583 - DNA, 15 bp, Homo sapiens
tggccccatcccagt

SEQ ID NO: 3348584 - DNA, 18 bp, Homo sapiens
tggccccatcccagttgg

SEQ ID NO: 3348585 - DNA, 18 bp, Homo sapiens
tggcccccaataaaggca

SEQ ID NO: 3348586 - DNA, 20 bp, Homo sapiens
tggcccccaataaaggcagc

SEQ ID NO: 3348587 - DNA, 23 bp, Homo sapiens
tggcccccaataaaggcagctgc

SEQ ID NO: 3348588 - DNA, 17 bp, Homo sapiens
tggcccccaggggcagg

SEQ ID NO: 3348589 - DNA, 21 bp, Homo sapiens
tggcccccaggggcaggactg

SEQ ID NO: 3348590 - DNA, 12 bp, Homo sapiens
tggcccctcaac

SEQ ID NO: 3348591 - DNA, 19 bp, Homo sapiens
tggcccctccccctgccag

SEQ ID NO: 3348592 - DNA, 14 bp, Homo sapiens
tggcccctgcccgg

SEQ ID NO: 3348593 - DNA, 21 bp, Homo sapiens
tggcccctgcccggctgcgga

SEQ ID NO: 3348594 - DNA, 14 bp, Homo sapiens
tggcccgacagcct

SEQ ID NO: 3348595 - DNA, 15 bp, Homo sapiens
tggcccgacagcctg

SEQ ID NO: 3348596 - DNA, 18 bp, Homo sapiens
tggcccgacagcctggca

SEQ ID NO: 3348597 - DNA, 16 bp, Homo sapiens
tggcccggccggcctg

SEQ ID NO: 3348598 - DNA, 21 bp, Homo sapiens
tggccctgccctctccttcct

SEQ ID NO: 3348599 - DNA, 16 bp, Homo sapiens
tggccctgcctcctgg

SEQ ID NO: 3348600 - DNA, 13 bp, Homo sapiens
tggccctggccct

SEQ ID NO: 3348601 - DNA, 15 bp, Homo sapiens
tggccctgtccctcc

SEQ ID NO: 3348602 - DNA, 20 bp, Homo sapiens
tggccctgtccctcccacct

SEQ ID NO: 3348603 - DNA, 12 bp, Homo sapiens
tggccctgtgta

SEQ ID NO: 3348604 - DNA, 23 bp, Homo sapiens
tggcccttacttgcttctctagc

SEQ ID NO: 3348605 - DNA, 22 bp, Homo sapiens
tggcccttgcctttgtggcctt

SEQ ID NO: 3348606 - DNA, 12 bp, Homo sapiens
tggcccttggaa

SEQ ID NO: 3348607 - DNA, 12 bp, Homo sapiens
tggccctttccc

SEQ ID NO: 3348608 - DNA, 13 bp, Homo sapiens
tggccctttcccc

SEQ ID NO: 3348609 - DNA, 18 bp, Homo sapiens
tggccctttccccttccc

SEQ ID NO: 3348610 - DNA, 21 bp, Homo sapiens
tggccctttccccttcccctc

SEQ ID NO: 3348611 - DNA, 19 bp, Homo sapiens
tggccgagggtcctggctc

SEQ ID NO: 3348612 - DNA, 12 bp, Homo sapiens
tggccgccaccc

SEQ ID NO: 3348613 - DNA, 13 bp, Homo sapiens
tggccgccccctg

SEQ ID NO: 3348614 - DNA, 17 bp, Homo sapiens
tggccgccccctgcccc

SEQ ID NO: 3348615 - DNA, 19 bp, Homo sapiens
tggccgctgagtggcaggg

SEQ ID NO: 3348616 - DNA, 20 bp, Homo sapiens
tggccggctgtgctcagaga

SEQ ID NO: 3348617 - DNA, 13 bp, Homo sapiens
tggccgggcaggc

SEQ ID NO: 3348618 - DNA, 18 bp, Homo sapiens
tggccggtctgcaagtca

SEQ ID NO: 3348619 - DNA, 18 bp, Homo sapiens
tggcctaaaactggcctg

SEQ ID NO: 3348620 - DNA, 13 bp, Homo sapiens
tggcctaaatttc

SEQ ID NO: 3348621 - DNA, 16 bp, Homo sapiens
tggcctaaatttcttc

SEQ ID NO: 3348622 - DNA, 14 bp, Homo sapiens
tggcctagcccacc

SEQ ID NO: 3348623 - DNA, 19 bp, Homo sapiens
tggcctagcccaccctgct

SEQ ID NO: 3348624 - DNA, 23 bp, Homo sapiens
tggcctagcccaccctgctgcct

SEQ ID NO: 3348625 - DNA, 21 bp, Homo sapiens
tggcctaggagatatctgagg

SEQ ID NO: 3348626 - DNA, 15 bp, Homo sapiens
tggcctatccgctgc

SEQ ID NO: 3348627 - DNA, 21 bp, Homo sapiens
tggcctatccgctgccagcct

SEQ ID NO: 3348628 - DNA, 19 bp, Homo sapiens
tggcctatgtggtctaagg

SEQ ID NO: 3348629 - DNA, 17 bp, Homo sapiens
tggcctattatattaaa

SEQ ID NO: 3348630 - DNA, 15 bp, Homo sapiens
tggcctcaagagcac

SEQ ID NO: 3348631 - DNA, 18 bp, Homo sapiens
tggcctcaagagcacaca

SEQ ID NO: 3348632 - DNA, 19 bp, Homo sapiens
tggcctcaagagcacacag

SEQ ID NO: 3348633 - DNA, 22 bp, Homo sapiens
tggcctcaagagcacacagaga

SEQ ID NO: 3348634 - DNA, 14 bp, Homo sapiens
tggcctcaccctga

SEQ ID NO: 3348635 - DNA, 13 bp, Homo sapiens
tggcctcactggc

SEQ ID NO: 3348636 - DNA, 16 bp, Homo sapiens
tggcctcactggctgg

SEQ ID NO: 3348637 - DNA, 14 bp, Homo sapiens
tggcctcagccctc

SEQ ID NO: 3348638 - DNA, 16 bp, Homo sapiens
tggcctcagccctcag

SEQ ID NO: 3348639 - DNA, 18 bp, Homo sapiens
tggcctcagctgaatgcc

SEQ ID NO: 3348640 - DNA, 22 bp, Homo sapiens
tggcctcagctgaatgcctcct

SEQ ID NO: 3348641 - DNA, 18 bp, Homo sapiens
tggcctcagctgcctcac

SEQ ID NO: 3348642 - DNA, 18 bp, Homo sapiens
tggcctcagggccaggaa

SEQ ID NO: 3348643 - DNA, 20 bp, Homo sapiens
tggcctcagttcccagctcc

SEQ ID NO: 3348644 - DNA, 13 bp, Homo sapiens
tctctcccctcaa

SEQ ID NO: 3348645 - DNA, 21 bp, Homo sapiens
tctctcccctcaaagtctgca

SEQ ID NO: 3348646 - DNA, 11 bp, Homo sapiens
tctctccctgc

SEQ ID NO: 3348647 - DNA, 11 bp, Homo sapiens
tctctcctctc

SEQ ID NO: 3348648 - DNA, 13 bp, Homo sapiens
tctctcctctctg

SEQ ID NO: 3348649 - DNA, 11 bp, Homo sapiens
tctctcctggc

SEQ ID NO: 3348650 - DNA, 10 bp, Homo sapiens
tctctccttt

SEQ ID NO: 3348651 - DNA, 18 bp, Homo sapiens
tctctcggttccacgtcc

SEQ ID NO: 3348652 - DNA, 23 bp, Homo sapiens
tctctcggttccacgtccccctg

SEQ ID NO: 3348653 - DNA, 15 bp, Homo sapiens
tctctctacagtgcc

SEQ ID NO: 3348654 - DNA, 20 bp, Homo sapiens
tctctctcactcacattttc

SEQ ID NO: 3348655 - DNA, 12 bp, Homo sapiens
tctctctcctct

SEQ ID NO: 3348656 - DNA, 13 bp, Homo sapiens
tctctctctctct

SEQ ID NO: 3348657 - DNA, 13 bp, Homo sapiens
tctctctctgtgt

SEQ ID NO: 3348658 - DNA, 11 bp, Homo sapiens
tctctctgccc

SEQ ID NO: 3348659 - DNA, 15 bp, Homo sapiens
tctctctgcccactc

SEQ ID NO: 3348660 - DNA, 11 bp, Homo sapiens
tctctctgggc

SEQ ID NO: 3348661 - DNA, 17 bp, Homo sapiens
tctctctgggcccaggg

SEQ ID NO: 3348662 - DNA, 17 bp, Homo sapiens
tctctctgtgtctttct

SEQ ID NO: 3348663 - DNA, 12 bp, Homo sapiens
tctctcttctct

SEQ ID NO: 3348664 - DNA, 19 bp, Homo sapiens
tctctcttctgctccaccc

SEQ ID NO: 3348665 - DNA, 15 bp, Homo sapiens
tctctcttttcattg

SEQ ID NO: 3348666 - DNA, 18 bp, Homo sapiens
tctctgaacacaggcagc

SEQ ID NO: 3348667 - DNA, 12 bp, Homo sapiens
tctctgaagcat

SEQ ID NO: 3348668 - DNA, 13 bp, Homo sapiens
tctctgaagcatg

SEQ ID NO: 3348669 - DNA, 14 bp, Homo sapiens
tctctgaatcctaa

SEQ ID NO: 3348670 - DNA, 12 bp, Homo sapiens
tctctgaggcta

SEQ ID NO: 3348671 - DNA, 19 bp, Homo sapiens
tctctgagtggtggttcct

SEQ ID NO: 3348672 - DNA, 20 bp, Homo sapiens
tctctgagtggtggttcctt

SEQ ID NO: 3348673 - DNA, 21 bp, Homo sapiens
tctctgagtggtggttccttt

SEQ ID NO: 3348674 - DNA, 20 bp, Homo sapiens
tctctgcaatgcttctgtag

SEQ ID NO: 3348675 - DNA, 24 bp, Homo sapiens
tctctgcaatgcttctgtagcttc

SEQ ID NO: 3348676 - DNA, 19 bp, Homo sapiens
tctctgcagtaaaacacat

SEQ ID NO: 3348677 - DNA, 16 bp, Homo sapiens
tctctgccacccactc

SEQ ID NO: 3348678 - DNA, 18 bp, Homo sapiens
tctctgccacccactcag

SEQ ID NO: 3348679 - DNA, 16 bp, Homo sapiens
tctctgccgctacctc

SEQ ID NO: 3348680 - DNA, 21 bp, Homo sapiens
tctctgccggctctttccttg

SEQ ID NO: 3348681 - DNA, 23 bp, Homo sapiens
tctctgcctggtggtcagatgca

SEQ ID NO: 3348682 - DNA, 23 bp, Homo sapiens
tctctgctagatttctacattaa

SEQ ID NO: 3348683 - DNA, 14 bp, Homo sapiens
tctctgctccacca

SEQ ID NO: 3348684 - DNA, 11 bp, Homo sapiens
tctctgctcct

SEQ ID NO: 3348685 - DNA, 22 bp, Homo sapiens
tctctgctccttcactgttccc

SEQ ID NO: 3348686 - DNA, 22 bp, Homo sapiens
tctctgctcgccctcctttctg

SEQ ID NO: 3348687 - DNA, 17 bp, Homo sapiens
tctctgctctagccagg

SEQ ID NO: 3348688 - DNA, 14 bp, Homo sapiens
tctctgctgagctg

SEQ ID NO: 3348689 - DNA, 21 bp, Homo sapiens
tctctgctgagctgggcccag

SEQ ID NO: 3348690 - DNA, 11 bp, Homo sapiens
tctctgctgta

SEQ ID NO: 3348691 - DNA, 20 bp, Homo sapiens
tctctggaagcccctgggcc

SEQ ID NO: 3348692 - DNA, 19 bp, Homo sapiens
tctctggcctcccacccga

SEQ ID NO: 3348693 - DNA, 19 bp, Homo sapiens
tctctggctgtaaggctct

SEQ ID NO: 3348694 - DNA, 21 bp, Homo sapiens
tctctgggcttggggcttcct

SEQ ID NO: 3348695 - DNA, 20 bp, Homo sapiens
tctctggggcaggctgcttc

SEQ ID NO: 3348696 - DNA, 20 bp, Homo sapiens
tctctggggccctgggcctc

SEQ ID NO: 3348697 - DNA, 22 bp, Homo sapiens
tctctggggccctgggcctcag

SEQ ID NO: 3348698 - DNA, 23 bp, Homo sapiens
tctctggggccctgggcctcagt

SEQ ID NO: 3348699 - DNA, 22 bp, Homo sapiens
tctctggtaaagttacactttt

SEQ ID NO: 3348700 - DNA, 14 bp, Homo sapiens
tctctggttgtcta

SEQ ID NO: 3348701 - DNA, 16 bp, Homo sapiens
tctctgtacttttcat

SEQ ID NO: 3348702 - DNA, 22 bp, Homo sapiens
tctctgtataaacattaaatgt

SEQ ID NO: 3348703 - DNA, 16 bp, Homo sapiens
tctctgtcccttgctg

SEQ ID NO: 3348704 - DNA, 17 bp, Homo sapiens
tctctgtcccttgctgt

SEQ ID NO: 3348705 - DNA, 16 bp, Homo sapiens
tctctgtgaacgattt

SEQ ID NO: 3348706 - DNA, 19 bp, Homo sapiens
tctctgtgaatacaattaa

SEQ ID NO: 3348707 - DNA, 22 bp, Homo sapiens
tctctgtgaatacaattaaagg

SEQ ID NO: 3348708 - DNA, 18 bp, Homo sapiens
tctctgtgacctgccccg

SEQ ID NO: 3348709 - DNA, 15 bp, Homo sapiens
tctctgtgtctaaga

SEQ ID NO: 3348710 - DNA, 21 bp, Homo sapiens
tctctgtgtctaagattctag

SEQ ID NO: 3348711 - DNA, 23 bp, Homo sapiens
tctctgtgtctaagattctagat

SEQ ID NO: 3348712 - DNA, 20 bp, Homo sapiens
tctctgttctgtttggcact

SEQ ID NO: 3348713 - DNA, 13 bp, Homo sapiens
tctctgttgtcgt

SEQ ID NO: 3348714 - DNA, 15 bp, Homo sapiens
tctcttatagaatat

SEQ ID NO: 3348715 - DNA, 15 bp, Homo sapiens
tctcttcaggttctt

SEQ ID NO: 3348716 - DNA, 23 bp, Homo sapiens
tctcttcaggttcttagtgtcac

SEQ ID NO: 3348717 - DNA, 17 bp, Homo sapiens
tctcttccctgcgcctg

SEQ ID NO: 3348718 - DNA, 11 bp, Homo sapiens
tctcttcctac

SEQ ID NO: 3348719 - DNA, 18 bp, Homo sapiens
tctcttctcagctcttcc

SEQ ID NO: 3348720 - DNA, 13 bp, Homo sapiens
tctcttctccact

SEQ ID NO: 3348721 - DNA, 14 bp, Homo sapiens
tctcttctccactg

SEQ ID NO: 3348722 - DNA, 13 bp, Homo sapiens
tctcttctcccag

SEQ ID NO: 3348723 - DNA, 16 bp, Homo sapiens
tctcttctcccagaat

SEQ ID NO: 3348724 - DNA, 12 bp, Homo sapiens
tctcttctctcc

SEQ ID NO: 3348725 - DNA, 22 bp, Homo sapiens
tctcttctgagctatttcatct

SEQ ID NO: 3348726 - DNA, 18 bp, Homo sapiens
tctcttcttttggcttcc

SEQ ID NO: 3348727 - DNA, 23 bp, Homo sapiens
tctcttgaataaagtattctagt

SEQ ID NO: 3348728 - DNA, 16 bp, Homo sapiens
tctcttgagctggcct

SEQ ID NO: 3348729 - DNA, 13 bp, Homo sapiens
tctcttgagggag

SEQ ID NO: 3348730 - DNA, 15 bp, Homo sapiens
tctcttgagtttgtc

SEQ ID NO: 3348731 - DNA, 13 bp, Homo sapiens
tctcttgcacccg

SEQ ID NO: 3348732 - DNA, 17 bp, Homo sapiens
tctcttgcacccgcctc

SEQ ID NO: 3348733 - DNA, 16 bp, Homo sapiens
tctcttgcctcagcct

SEQ ID NO: 3348734 - DNA, 22 bp, Homo sapiens
tctctttaaaaaagactgaaca

SEQ ID NO: 3348735 - DNA, 17 bp, Homo sapiens
tctctttaatcttcagt

SEQ ID NO: 3348736 - DNA, 21 bp, Homo sapiens
tctctttaatgtcacaggcag

SEQ ID NO: 3348737 - DNA, 17 bp, Homo sapiens
tctctttatacagctgt

SEQ ID NO: 3348738 - DNA, 22 bp, Homo sapiens
tctctttcacattgtttgctgc

SEQ ID NO: 3348739 - DNA, 15 bp, Homo sapiens
tctctttctctcttc

SEQ ID NO: 3348740 - DNA, 13 bp, Homo sapiens
tctctttctgtac

SEQ ID NO: 3348741 - DNA, 18 bp, Homo sapiens
tctctttcttcctttcta

SEQ ID NO: 3348742 - DNA, 20 bp, Homo sapiens
tctctttgtggggcttggcg

SEQ ID NO: 3348743 - DNA, 21 bp, Homo sapiens
tctctttgtggggcttggcgt

SEQ ID NO: 3348744 - DNA, 14 bp, Homo sapiens
tctctttgttctca

SEQ ID NO: 3348745 - DNA, 19 bp, Homo sapiens
tctctttgttctcagctcc

SEQ ID NO: 3348746 - DNA, 20 bp, Homo sapiens
tctcttttatatttgtagga

SEQ ID NO: 3348747 - DNA, 16 bp, Homo sapiens
tctcttttcaaaacat

SEQ ID NO: 3348748 - DNA, 18 bp, Homo sapiens
tctcttttcattgtgtat

SEQ ID NO: 3348749 - DNA, 19 bp, Homo sapiens
tctcttttcattgtgtatc

SEQ ID NO: 3348750 - DNA, 24 bp, Homo sapiens
tctcttttcattgtgtatcagttt

SEQ ID NO: 3348751 - DNA, 15 bp, Homo sapiens
tctcttttgctttct

SEQ ID NO: 3348752 - DNA, 19 bp, Homo sapiens
tctctttttggaggtgctt

SEQ ID NO: 3348753 - DNA, 14 bp, Homo sapiens
tctctttttgtttg

SEQ ID NO: 3348754 - DNA, 20 bp, Homo sapiens
tctgaaaacctaccagccag

SEQ ID NO: 3348755 - DNA, 15 bp, Homo sapiens
tctgaaaagtgtgta

SEQ ID NO: 3348756 - DNA, 23 bp, Homo sapiens
tctgaaaagtgtgtatatatttt

SEQ ID NO: 3348757 - DNA, 13 bp, Homo sapiens
tctgaaaatgtat

SEQ ID NO: 3348758 - DNA, 16 bp, Homo sapiens
tctgaaaatgtatgtg

SEQ ID NO: 3348759 - DNA, 20 bp, Homo sapiens
tctgaaacatttcataattt

SEQ ID NO: 3348760 - DNA, 16 bp, Homo sapiens
tctgaaaccacagttt

SEQ ID NO: 3348761 - DNA, 21 bp, Homo sapiens
tctgaaaccacagtttcatta

SEQ ID NO: 3348762 - DNA, 16 bp, Homo sapiens
tctgaaacccacagat

SEQ ID NO: 3348763 - DNA, 19 bp, Homo sapiens
tctgaaacttcataaatgt

SEQ ID NO: 3348764 - DNA, 12 bp, Homo sapiens
tctgaaagcaca

SEQ ID NO: 3348765 - DNA, 15 bp, Homo sapiens
tctgaaatctgaaga

SEQ ID NO: 3348766 - DNA, 22 bp, Homo sapiens
tctgaaatcttcccatgcattc

SEQ ID NO: 3348767 - DNA, 12 bp, Homo sapiens
tctgaaattcta

SEQ ID NO: 3348768 - DNA, 20 bp, Homo sapiens
tctgaaatttttttcctaag

SEQ ID NO: 3348769 - DNA, 18 bp, Homo sapiens
tctgactttacttgtggt

SEQ ID NO: 3348770 - DNA, 22 bp, Homo sapiens
tctgagaaaagaacgtatttta

SEQ ID NO: 3348771 - DNA, 15 bp, Homo sapiens
tctgagaactgactt

SEQ ID NO: 3348772 - DNA, 16 bp, Homo sapiens
tctgagaagaggagcc

SEQ ID NO: 3348773 - DNA, 21 bp, Homo sapiens
tctgagaatcacggtggtaaa

SEQ ID NO: 3348774 - DNA, 16 bp, Homo sapiens
tctgagaccacagagg

SEQ ID NO: 3348775 - DNA, 14 bp, Homo sapiens
tctgagactcacag

SEQ ID NO: 3348776 - DNA, 16 bp, Homo sapiens
tctgagactctttaga

SEQ ID NO: 3348777 - DNA, 20 bp, Homo sapiens
tctgagactctttagagcag

SEQ ID NO: 3348778 - DNA, 15 bp, Homo sapiens
tctgagactggcaga

SEQ ID NO: 3348779 - DNA, 17 bp, Homo sapiens
tctgagagtctagattc

SEQ ID NO: 3348780 - DNA, 18 bp, Homo sapiens
tctgagagtctagattct

SEQ ID NO: 3348781 - DNA, 19 bp, Homo sapiens
tctgagagtctagattctc

SEQ ID NO: 3348782 - DNA, 19 bp, Homo sapiens
tctgagatttttttgtgta

SEQ ID NO: 3348783 - DNA, 21 bp, Homo sapiens
tctgagatttttttgtgtatg

SEQ ID NO: 3348784 - DNA, 22 bp, Homo sapiens
tctgagatttttttgtgtatgt

SEQ ID NO: 3348785 - DNA, 15 bp, Homo sapiens
tctgagcacacttta

SEQ ID NO: 3348786 - DNA, 18 bp, Homo sapiens
tctgagccaaagagaatg

SEQ ID NO: 3348787 - DNA, 13 bp, Homo sapiens
tctgagcccagct

SEQ ID NO: 3348788 - DNA, 20 bp, Homo sapiens
tctgagcccagctgcctgga

SEQ ID NO: 3348789 - DNA, 14 bp, Homo sapiens
tctgagcccaggcc

SEQ ID NO: 3348790 - DNA, 15 bp, Homo sapiens
tctgagcccaggccg

SEQ ID NO: 3348791 - DNA, 13 bp, Homo sapiens
tctgagcccgggc

SEQ ID NO: 3348792 - DNA, 15 bp, Homo sapiens
tctgagcccgggctg

SEQ ID NO: 3348793 - DNA, 24 bp, Homo sapiens
tctgagcccgggctgcctgggctg

SEQ ID NO: 3348794 - DNA, 14 bp, Homo sapiens
tctgagcgcctcca

SEQ ID NO: 3348795 - DNA, 22 bp, Homo sapiens
tctgagcgggaggcagagtttg

SEQ ID NO: 3348796 - DNA, 20 bp, Homo sapiens
tctgagctatttcatctatt

SEQ ID NO: 3348797 - DNA, 18 bp, Homo sapiens
tctgagcttttcatggaa

SEQ ID NO: 3348798 - DNA, 22 bp, Homo sapiens
tctgaggacaccagtgaaagaa

SEQ ID NO: 3348799 - DNA, 23 bp, Homo sapiens
tctgaggacactaaccacgctgg

SEQ ID NO: 3348800 - DNA, 14 bp, Homo sapiens
tctgaggcctcatc

SEQ ID NO: 3348801 - DNA, 22 bp, Homo sapiens
tctgagggaggaggccacctct

SEQ ID NO: 3348802 - DNA, 21 bp, Homo sapiens
tctgaggtgcctgtcccaccc

SEQ ID NO: 3348803 - DNA, 13 bp, Homo sapiens
tctgagtacagag

SEQ ID NO: 3348804 - DNA, 22 bp, Homo sapiens
tctgagtcctgtctctgcctgc

SEQ ID NO: 3348805 - DNA, 13 bp, Homo sapiens
tctgagtgaacct

SEQ ID NO: 3348806 - DNA, 17 bp, Homo sapiens
tctgagtggtggttcct

SEQ ID NO: 3348807 - DNA, 19 bp, Homo sapiens
tctgagttctgtgtatttt

SEQ ID NO: 3348808 - DNA, 14 bp, Homo sapiens
tctgagtttaccat

SEQ ID NO: 3348809 - DNA, 21 bp, Homo sapiens
tctgagtttaccatttgtaat

SEQ ID NO: 3348810 - DNA, 22 bp, Homo sapiens
tctgagtttaccatttgtaata

SEQ ID NO: 3348811 - DNA, 20 bp, Homo sapiens
tctgagtttcattctcctgc

SEQ ID NO: 3348812 - DNA, 24 bp, Homo sapiens
tctgagtttcattctcctgcctgt

SEQ ID NO: 3348813 - DNA, 21 bp, Homo sapiens
tctgatagaaagcaagtgttt

SEQ ID NO: 3348814 - DNA, 13 bp, Homo sapiens
tctgatatgggac

SEQ ID NO: 3348815 - DNA, 21 bp, Homo sapiens
tctgatatgggactgagcctg

SEQ ID NO: 3348816 - DNA, 17 bp, Homo sapiens
tctgatattaatcaaaa

SEQ ID NO: 3348817 - DNA, 17 bp, Homo sapiens
tctgatattccatgaat

SEQ ID NO: 3348818 - DNA, 20 bp, Homo sapiens
tctgatattccatgaatgta

SEQ ID NO: 3348819 - DNA, 22 bp, Homo sapiens
tctgatattccatgaatgtatc

SEQ ID NO: 3348820 - DNA, 15 bp, Homo sapiens
tctgatcacttcatg

SEQ ID NO: 3348821 - DNA, 13 bp, Homo sapiens
tctgatcagaggt

SEQ ID NO: 3348822 - DNA, 22 bp, Homo sapiens
tctgatcagaggtgtacactaa

SEQ ID NO: 3348823 - DNA, 17 bp, Homo sapiens
tctgatcatccactgtg

SEQ ID NO: 3348824 - DNA, 17 bp, Homo sapiens
tctgatcccatattctt

SEQ ID NO: 3348825 - DNA, 20 bp, Homo sapiens
tctgatgtctctaaagcact

SEQ ID NO: 3348826 - DNA, 22 bp, Homo sapiens
tctgatgtgtgttgtcagcctg

SEQ ID NO: 3348827 - DNA, 20 bp, Homo sapiens
tctgattaatatatttaata

SEQ ID NO: 3348828 - DNA, 18 bp, Homo sapiens
tctcatactgtctgggat

SEQ ID NO: 3348829 - DNA, 13 bp, Homo sapiens
tctcatagcatta

SEQ ID NO: 3348830 - DNA, 22 bp, Homo sapiens
tctcataggaaaagtacattta

SEQ ID NO: 3348831 - DNA, 22 bp, Homo sapiens
tctcatatatattttaaaaaca

SEQ ID NO: 3348832 - DNA, 15 bp, Homo sapiens
tctcatcaactgaat

SEQ ID NO: 3348833 - DNA, 15 bp, Homo sapiens
tctcatcagaaatgt

SEQ ID NO: 3348834 - DNA, 15 bp, Homo sapiens
tctcatccattcctc

SEQ ID NO: 3348835 - DNA, 16 bp, Homo sapiens
tctcatccccagtccc

SEQ ID NO: 3348836 - DNA, 23 bp, Homo sapiens
tctcatccccagtcccaatgcac

SEQ ID NO: 3348837 - DNA, 18 bp, Homo sapiens
tctcatcctcctggaacc

SEQ ID NO: 3348838 - DNA, 14 bp, Homo sapiens
tctcatctcttcag

SEQ ID NO: 3348839 - DNA, 16 bp, Homo sapiens
tctcatcttaaaaata

SEQ ID NO: 3348840 - DNA, 22 bp, Homo sapiens
tctcatgacggcttttgtcagt

SEQ ID NO: 3348841 - DNA, 14 bp, Homo sapiens
tctcatgcctcagc

SEQ ID NO: 3348842 - DNA, 21 bp, Homo sapiens
tctcatgtcctgctggcttcc

SEQ ID NO: 3348843 - DNA, 12 bp, Homo sapiens
tctcattcagta

SEQ ID NO: 3348844 - DNA, 17 bp, Homo sapiens
tctcattcagtattaaa

SEQ ID NO: 3348845 - DNA, 21 bp, Homo sapiens
tctcattcccagagtcagagg

SEQ ID NO: 3348846 - DNA, 21 bp, Homo sapiens
tctcattccgttgtctgtgga

SEQ ID NO: 3348847 - DNA, 12 bp, Homo sapiens
tctcattcttgt

SEQ ID NO: 3348848 - DNA, 22 bp, Homo sapiens
tctcattgacttttataaagca

SEQ ID NO: 3348849 - DNA, 14 bp, Homo sapiens
tctcattgcttctg

SEQ ID NO: 3348850 - DNA, 18 bp, Homo sapiens
tctcatttagaacttgca

SEQ ID NO: 3348851 - DNA, 14 bp, Homo sapiens
tctcatttgtcaca

SEQ ID NO: 3348852 - DNA, 21 bp, Homo sapiens
tctccaaacaccggcagaaaa

SEQ ID NO: 3348853 - DNA, 22 bp, Homo sapiens
tctccaaactgaagcagcctct

SEQ ID NO: 3348854 - DNA, 20 bp, Homo sapiens
tctccaaaggggctgctggg

SEQ ID NO: 3348855 - DNA, 12 bp, Homo sapiens
tctccaaatgag

SEQ ID NO: 3348856 - DNA, 20 bp, Homo sapiens
tctccaaccccggaaaacat

SEQ ID NO: 3348857 - DNA, 18 bp, Homo sapiens
tctccaagataagcctga

SEQ ID NO: 3348858 - DNA, 22 bp, Homo sapiens
tctccaagataagcctgagcct

SEQ ID NO: 3348859 - DNA, 17 bp, Homo sapiens
tctccaaggatcctctc

SEQ ID NO: 3348860 - DNA, 16 bp, Homo sapiens
tctccaagggcttctg

SEQ ID NO: 3348861 - DNA, 17 bp, Homo sapiens
tctccaagtctctctgt

SEQ ID NO: 3348862 - DNA, 18 bp, Homo sapiens
tctccaagtctctctgtg

SEQ ID NO: 3348863 - DNA, 19 bp, Homo sapiens
tctccaagtctctctgtga

SEQ ID NO: 3348864 - DNA, 20 bp, Homo sapiens
tctccaagtctctctgtgaa

SEQ ID NO: 3348865 - DNA, 23 bp, Homo sapiens
tctccaagtgccagaggtgggca

SEQ ID NO: 3348866 - DNA, 23 bp, Homo sapiens
tctccaccacccaacccaaacca

SEQ ID NO: 3348867 - DNA, 17 bp, Homo sapiens
tctccaccctgctctcc

SEQ ID NO: 3348868 - DNA, 14 bp, Homo sapiens
tctccactgccttc

SEQ ID NO: 3348869 - DNA, 14 bp, Homo sapiens
tctccagatgtttc

SEQ ID NO: 3348870 - DNA, 21 bp, Homo sapiens
tctccagatttttcggaggcc

SEQ ID NO: 3348871 - DNA, 14 bp, Homo sapiens
tctccagcctggac

SEQ ID NO: 3348872 - DNA, 22 bp, Homo sapiens
tctccagcctggacccccagct

SEQ ID NO: 3348873 - DNA, 23 bp, Homo sapiens
tctccagctcagaacccagggct

SEQ ID NO: 3348874 - DNA, 12 bp, Homo sapiens
tctccagctgac

SEQ ID NO: 3348875 - DNA, 17 bp, Homo sapiens
tctccagctgggctctg

SEQ ID NO: 3348876 - DNA, 19 bp, Homo sapiens
tctccagctgggctctgca

SEQ ID NO: 3348877 - DNA, 17 bp, Homo sapiens
tctccaggggcctgcag

SEQ ID NO: 3348878 - DNA, 20 bp, Homo sapiens
tctccaggggcctgcagaag

SEQ ID NO: 3348879 - DNA, 18 bp, Homo sapiens
tctccaggggctgcttcc

SEQ ID NO: 3348880 - DNA, 21 bp, Homo sapiens
tctccagttgggactcaggat

SEQ ID NO: 3348881 - DNA, 16 bp, Homo sapiens
tctccatgtttgatgt

SEQ ID NO: 3348882 - DNA, 12 bp, Homo sapiens
tctcccaaggct

SEQ ID NO: 3348883 - DNA, 21 bp, Homo sapiens
tctcccacagagtgctggact

SEQ ID NO: 3348884 - DNA, 24 bp, Homo sapiens
tctcccacatgaggccatctcagg

SEQ ID NO: 3348885 - DNA, 14 bp, Homo sapiens
tctcccaccctgta

SEQ ID NO: 3348886 - DNA, 15 bp, Homo sapiens
tctcccagaatccca

SEQ ID NO: 3348887 - DNA, 19 bp, Homo sapiens
tctcccagaatcccagccg

SEQ ID NO: 3348888 - DNA, 12 bp, Homo sapiens
tctcccagcaca

SEQ ID NO: 3348889 - DNA, 16 bp, Homo sapiens
tctcccaggccccctg

SEQ ID NO: 3348890 - DNA, 11 bp, Homo sapiens
tctcccatccc

SEQ ID NO: 3348891 - DNA, 13 bp, Homo sapiens
tctcccatccccc

SEQ ID NO: 3348892 - DNA, 17 bp, Homo sapiens
tctcccatccccctgcc

SEQ ID NO: 3348893 - DNA, 22 bp, Homo sapiens
tctcccatccccctgccctcgt

SEQ ID NO: 3348894 - DNA, 15 bp, Homo sapiens
tctcccatcctgggg

SEQ ID NO: 3348895 - DNA, 14 bp, Homo sapiens
tctcccatttcagg

SEQ ID NO: 3348896 - DNA, 10 bp, Homo sapiens
tctccccaca

SEQ ID NO: 3348897 - DNA, 22 bp, Homo sapiens
tctccccacactaacctgggtt

SEQ ID NO: 3348898 - DNA, 23 bp, Homo sapiens
tctccccacagcctctggctcca

SEQ ID NO: 3348899 - DNA, 23 bp, Homo sapiens
tccttgggctcctggctgccagg

SEQ ID NO: 3348900 - DNA, 22 bp, Homo sapiens
tccttgggtcattgacctctca

SEQ ID NO: 3348901 - DNA, 15 bp, Homo sapiens
tccttgggttgctgg

SEQ ID NO: 3348902 - DNA, 19 bp, Homo sapiens
tccttggtcctagtaagaa

SEQ ID NO: 3348903 - DNA, 23 bp, Homo sapiens
tccttggtctttgtatcttccat

SEQ ID NO: 3348904 - DNA, 14 bp, Homo sapiens
tccttggtgcctgg

SEQ ID NO: 3348905 - DNA, 15 bp, Homo sapiens
tccttgtactcttag

SEQ ID NO: 3348906 - DNA, 23 bp, Homo sapiens
tccttgtgcaaaatatttgacta

SEQ ID NO: 3348907 - DNA, 16 bp, Homo sapiens
tccttgttggtcagag

SEQ ID NO: 3348908 - DNA, 18 bp, Homo sapiens
tccttgttggtcagagga

SEQ ID NO: 3348909 - DNA, 14 bp, Homo sapiens
tccttgttgttggt

SEQ ID NO: 3348910 - DNA, 21 bp, Homo sapiens
tccttgtttatcagatacatc

SEQ ID NO: 3348911 - DNA, 15 bp, Homo sapiens
tcctttaaaaaagaa

SEQ ID NO: 3348912 - DNA, 22 bp, Homo sapiens
tcctttacaaaagaaatacctt

SEQ ID NO: 3348913 - DNA, 19 bp, Homo sapiens
tcctttagcgcccagttgg

SEQ ID NO: 3348914 - DNA, 21 bp, Homo sapiens
tcctttatgtggaaaacagaa

SEQ ID NO: 3348915 - DNA, 19 bp, Homo sapiens
tcctttcacaaccttctgt

SEQ ID NO: 3348916 - DNA, 15 bp, Homo sapiens
tcctttcaccacatg

SEQ ID NO: 3348917 - DNA, 18 bp, Homo sapiens
tcctttccaaggcttctc

SEQ ID NO: 3348918 - DNA, 13 bp, Homo sapiens
tcctttccccagc

SEQ ID NO: 3348919 - DNA, 20 bp, Homo sapiens
tcctttccccagcccagggt

SEQ ID NO: 3348920 - DNA, 13 bp, Homo sapiens
tcctttcccctct

SEQ ID NO: 3348921 - DNA, 16 bp, Homo sapiens
tcctttcccctctctg

SEQ ID NO: 3348922 - DNA, 21 bp, Homo sapiens
tcctttctatcatttttgtac

SEQ ID NO: 3348923 - DNA, 18 bp, Homo sapiens
tcctttctccagccagca

SEQ ID NO: 3348924 - DNA, 15 bp, Homo sapiens
tcctttctcctgtga

SEQ ID NO: 3348925 - DNA, 16 bp, Homo sapiens
tcctttctgccgaccc

SEQ ID NO: 3348926 - DNA, 13 bp, Homo sapiens
tcctttctgtgcc

SEQ ID NO: 3348927 - DNA, 16 bp, Homo sapiens
tcctttctgtgcccta

SEQ ID NO: 3348928 - DNA, 16 bp, Homo sapiens
tcctttcttaattttg

SEQ ID NO: 3348929 - DNA, 17 bp, Homo sapiens
tcctttcttgtctttcc

SEQ ID NO: 3348930 - DNA, 14 bp, Homo sapiens
tcctttgcagggca

SEQ ID NO: 3348931 - DNA, 15 bp, Homo sapiens
tcctttgggtgactc

SEQ ID NO: 3348932 - DNA, 15 bp, Homo sapiens
tcctttggtgcctca

SEQ ID NO: 3348933 - DNA, 12 bp, Homo sapiens
tcctttgtcttc

SEQ ID NO: 3348934 - DNA, 21 bp, Homo sapiens
tcctttgtcttcaaactgtga

SEQ ID NO: 3348935 - DNA, 17 bp, Homo sapiens
tcctttgtggttttatg

SEQ ID NO: 3348936 - DNA, 20 bp, Homo sapiens
tcctttgtgtgtactcactg

SEQ ID NO: 3348937 - DNA, 15 bp, Homo sapiens
tcctttgtgtttata

SEQ ID NO: 3348938 - DNA, 16 bp, Homo sapiens
tcctttgttcttacct

SEQ ID NO: 3348939 - DNA, 24 bp, Homo sapiens
tcctttgttcttacctgtatgtct

SEQ ID NO: 3348940 - DNA, 20 bp, Homo sapiens
tcctttgttttctgactaat

SEQ ID NO: 3348941 - DNA, 15 bp, Homo sapiens
tccttttataggtga

SEQ ID NO: 3348942 - DNA, 15 bp, Homo sapiens
tccttttattaaaac

SEQ ID NO: 3348943 - DNA, 14 bp, Homo sapiens
tccttttatttctc

SEQ ID NO: 3348944 - DNA, 15 bp, Homo sapiens
tccttttcctctctc

SEQ ID NO: 3348945 - DNA, 15 bp, Homo sapiens
tccttttcttttgtt

SEQ ID NO: 3348946 - DNA, 16 bp, Homo sapiens
tccttttcttttgtta

SEQ ID NO: 3348947 - DNA, 19 bp, Homo sapiens
tccttttcttttgttactg

SEQ ID NO: 3348948 - DNA, 21 bp, Homo sapiens
tccttttcttttgttactgtt

SEQ ID NO: 3348949 - DNA, 18 bp, Homo sapiens
tccttttgacactgctct

SEQ ID NO: 3348950 - DNA, 22 bp, Homo sapiens
tccttttgacactgctctaaca

SEQ ID NO: 3348951 - DNA, 21 bp, Homo sapiens
tccttttgactccttttggaa

SEQ ID NO: 3348952 - DNA, 16 bp, Homo sapiens
tccttttggaacattt

SEQ ID NO: 3348953 - DNA, 20 bp, Homo sapiens
tccttttgtccccagggccc

SEQ ID NO: 3348954 - DNA, 15 bp, Homo sapiens
tcctttttccatcat

SEQ ID NO: 3348955 - DNA, 17 bp, Homo sapiens
tcctttttccatcattt

SEQ ID NO: 3348956 - DNA, 12 bp, Homo sapiens
tccttttttgtc

SEQ ID NO: 3348957 - DNA, 15 bp, Homo sapiens
tccttttttgtctat

SEQ ID NO: 3348958 - DNA, 20 bp, Homo sapiens
tcgaaacctacaagatttcc

SEQ ID NO: 3348959 - DNA, 22 bp, Homo sapiens
tcgaaacctacaagatttcctt

SEQ ID NO: 3348960 - DNA, 19 bp, Homo sapiens
tcgaaacctgggattcagg

SEQ ID NO: 3348961 - DNA, 14 bp, Homo sapiens
tcgaaataacaatg

SEQ ID NO: 3348962 - DNA, 16 bp, Homo sapiens
tcgaaataacaatgtt

SEQ ID NO: 3348963 - DNA, 19 bp, Homo sapiens
tcgaaataacaatgttaag

SEQ ID NO: 3348964 - DNA, 17 bp, Homo sapiens
tcgaacatgtttcactt

SEQ ID NO: 3348965 - DNA, 21 bp, Homo sapiens
tcgaaccaaggcagcctccag

SEQ ID NO: 3348966 - DNA, 18 bp, Homo sapiens
tcgaaccgttttgaagct

SEQ ID NO: 3348967 - DNA, 13 bp, Homo sapiens
tcgaactggctgc

SEQ ID NO: 3348968 - DNA, 18 bp, Homo sapiens
tcgaacttcacaactagg

SEQ ID NO: 3348969 - DNA, 18 bp, Homo sapiens
tcgaaggctctctctttc

SEQ ID NO: 3348970 - DNA, 14 bp, Homo sapiens
tcgaatctctgtgc

SEQ ID NO: 3348971 - DNA, 21 bp, Homo sapiens
tcgaatcttaatttattattt

SEQ ID NO: 3348972 - DNA, 18 bp, Homo sapiens
tcgaatggggtagaaaca

SEQ ID NO: 3348973 - DNA, 16 bp, Homo sapiens
tcgaattaatagcttt

SEQ ID NO: 3348974 - DNA, 15 bp, Homo sapiens
tcgacagcgcccctg

SEQ ID NO: 3348975 - DNA, 19 bp, Homo sapiens
tcgacagcgcccctgctgt

SEQ ID NO: 3348976 - DNA, 18 bp, Homo sapiens
tcgacagggcctggagcc

SEQ ID NO: 3348977 - DNA, 19 bp, Homo sapiens
tcgacccagaatggagcct

SEQ ID NO: 3348978 - DNA, 15 bp, Homo sapiens
tcgactggtccagct

SEQ ID NO: 3348979 - DNA, 15 bp, Homo sapiens
tcgagaccagcctgg

SEQ ID NO: 3348980 - DNA, 17 bp, Homo sapiens
tcgagaccagcctggcc

SEQ ID NO: 3348981 - DNA, 18 bp, Homo sapiens
tcgagaccatcctggcta

SEQ ID NO: 3348982 - DNA, 19 bp, Homo sapiens
tcgagaccatcctggctaa

SEQ ID NO: 3348983 - DNA, 18 bp, Homo sapiens
tcgagatttgggagctga

SEQ ID NO: 3348984 - DNA, 13 bp, Homo sapiens
tcgagccaactct

SEQ ID NO: 3348985 - DNA, 15 bp, Homo sapiens
tcgagccactgcact

SEQ ID NO: 3348986 - DNA, 17 bp, Homo sapiens
tcgaggacagggaggtg

SEQ ID NO: 3348987 - DNA, 15 bp, Homo sapiens
tcgtctttcccatgg

SEQ ID NO: 3348988 - DNA, 18 bp, Homo sapiens
tcgtctttcccatgggga

SEQ ID NO: 3348989 - DNA, 14 bp, Homo sapiens
tcgtgaaaccctgt

SEQ ID NO: 3348990 - DNA, 22 bp, Homo sapiens
tcgtgacagtggtgtgtggtgt

SEQ ID NO: 3348991 - DNA, 15 bp, Homo sapiens
tcgtgagctggggac

SEQ ID NO: 3348992 - DNA, 20 bp, Homo sapiens
tcgtgcactctgctaatcat

SEQ ID NO: 3348993 - DNA, 15 bp, Homo sapiens
tcgtgcctgtgtcca

SEQ ID NO: 3348994 - DNA, 21 bp, Homo sapiens
tcgtgcctgtgtccatgcgct

SEQ ID NO: 3348995 - DNA, 18 bp, Homo sapiens
tcgtgctaaattttcagt

SEQ ID NO: 3348996 - DNA, 16 bp, Homo sapiens
tcgtgctactgcactc

SEQ ID NO: 3348997 - DNA, 22 bp, Homo sapiens
tcgtggcagataatcagcctct

SEQ ID NO: 3348998 - DNA, 23 bp, Homo sapiens
tcgtggcagataatcagcctctt

SEQ ID NO: 3348999 - DNA, 14 bp, Homo sapiens
tcgtggccagcccg

SEQ ID NO: 3349000 - DNA, 15 bp, Homo sapiens
tcgtggccagcccgg

SEQ ID NO: 3349001 - DNA, 12 bp, Homo sapiens
tcgtggggaggt

SEQ ID NO: 3349002 - DNA, 15 bp, Homo sapiens
tcgtggggtgtgctg

SEQ ID NO: 3349003 - DNA, 18 bp, Homo sapiens
tcgtggggtgtgctggga

SEQ ID NO: 3349004 - DNA, 22 bp, Homo sapiens
tcgtgggtgtgtgtagccaagg

SEQ ID NO: 3349005 - DNA, 22 bp, Homo sapiens
tcgtggtccccaacagcgacat

SEQ ID NO: 3349006 - DNA, 17 bp, Homo sapiens
tcgtggttcttaaatgt

SEQ ID NO: 3349007 - DNA, 20 bp, Homo sapiens
tcgtgtagtggaagagcagc

SEQ ID NO: 3349008 - DNA, 14 bp, Homo sapiens
tcgtgtcagctcag

SEQ ID NO: 3349009 - DNA, 14 bp, Homo sapiens
tcgtgtctctccca

SEQ ID NO: 3349010 - DNA, 18 bp, Homo sapiens
tcgtgtggatcttgccac

SEQ ID NO: 3349011 - DNA, 15 bp, Homo sapiens
tcgtgtgtagaaaaa

SEQ ID NO: 3349012 - DNA, 21 bp, Homo sapiens
tcgttaactgtgtatgtacat

SEQ ID NO: 3349013 - DNA, 22 bp, Homo sapiens
tcgttaactgtgtatgtacata

SEQ ID NO: 3349014 - DNA, 16 bp, Homo sapiens
tcgttccctgattatt

SEQ ID NO: 3349015 - DNA, 14 bp, Homo sapiens
tcgttggagactga

SEQ ID NO: 3349016 - DNA, 13 bp, Homo sapiens
tcgtttctgtata

SEQ ID NO: 3349017 - DNA, 13 bp, Homo sapiens
tcgtttgtttgtt

SEQ ID NO: 3349018 - DNA, 20 bp, Homo sapiens
tcgttttccaaactgactca

SEQ ID NO: 3349019 - DNA, 17 bp, Homo sapiens
tctaaaaaacattttta

SEQ ID NO: 3349020 - DNA, 21 bp, Homo sapiens
tctaaaaaaggagaattgaat

SEQ ID NO: 3349021 - DNA, 18 bp, Homo sapiens
tctaaaacaaaatctgaa

SEQ ID NO: 3349022 - DNA, 19 bp, Homo sapiens
tctaaaacattcccctccc

SEQ ID NO: 3349023 - DNA, 22 bp, Homo sapiens
tctaaaagaatattcagagaat

SEQ ID NO: 3349024 - DNA, 17 bp, Homo sapiens
tctaaaagcagaaaata

SEQ ID NO: 3349025 - DNA, 15 bp, Homo sapiens
tctaaaatcttatag

SEQ ID NO: 3349026 - DNA, 19 bp, Homo sapiens
tctaaaatgtgatgttcta

SEQ ID NO: 3349027 - DNA, 20 bp, Homo sapiens
tctaaaatgtgatgttctaa

SEQ ID NO: 3349028 - DNA, 21 bp, Homo sapiens
tctaaaatgtgatgttctaag

SEQ ID NO: 3349029 - DNA, 22 bp, Homo sapiens
tccctgttttctgagcccgggc

SEQ ID NO: 3349030 - DNA, 16 bp, Homo sapiens
tcccttaacttttcct

SEQ ID NO: 3349031 - DNA, 18 bp, Homo sapiens
tcccttaacttttccttg

SEQ ID NO: 3349032 - DNA, 23 bp, Homo sapiens
tcccttaacttttccttgtatgt

SEQ ID NO: 3349033 - DNA, 16 bp, Homo sapiens
tcccttagaagagagc

SEQ ID NO: 3349034 - DNA, 21 bp, Homo sapiens
tcccttcaaccattccccatg

SEQ ID NO: 3349035 - DNA, 17 bp, Homo sapiens
tcccttcagcccccagc

SEQ ID NO: 3349036 - DNA, 18 bp, Homo sapiens
tcccttcagcccccagcc

SEQ ID NO: 3349037 - DNA, 23 bp, Homo sapiens
tcccttcagtaccctctcagctc

SEQ ID NO: 3349038 - DNA, 17 bp, Homo sapiens
tcccttccactgcctct

SEQ ID NO: 3349039 - DNA, 20 bp, Homo sapiens
tcccttccactgcctctgcc

SEQ ID NO: 3349040 - DNA, 20 bp, Homo sapiens
tcccttcccctccctggctc

SEQ ID NO: 3349041 - DNA, 15 bp, Homo sapiens
tcccttccctgcagg

SEQ ID NO: 3349042 - DNA, 21 bp, Homo sapiens
tcccttccgaccctctgggaa

SEQ ID NO: 3349043 - DNA, 14 bp, Homo sapiens
tcccttcctctctc

SEQ ID NO: 3349044 - DNA, 13 bp, Homo sapiens
tcccttcctggaa

SEQ ID NO: 3349045 - DNA, 17 bp, Homo sapiens
tcccttcctggaaacag

SEQ ID NO: 3349046 - DNA, 16 bp, Homo sapiens
tcccttctcacagcac

SEQ ID NO: 3349047 - DNA, 20 bp, Homo sapiens
tcccttctctgtagggaact

SEQ ID NO: 3349048 - DNA, 23 bp, Homo sapiens
tcccttctctgtagggaactctg

SEQ ID NO: 3349049 - DNA, 13 bp, Homo sapiens
tcccttcttgcat

SEQ ID NO: 3349050 - DNA, 15 bp, Homo sapiens
tcccttgaaggaaga

SEQ ID NO: 3349051 - DNA, 14 bp, Homo sapiens
tcccttgaccttaa

SEQ ID NO: 3349052 - DNA, 12 bp, Homo sapiens
tcccttgcctca

SEQ ID NO: 3349053 - DNA, 19 bp, Homo sapiens
tcccttgctggccccagcc

SEQ ID NO: 3349054 - DNA, 13 bp, Homo sapiens
tcccttgctttgt

SEQ ID NO: 3349055 - DNA, 14 bp, Homo sapiens
tcccttggcctcag

SEQ ID NO: 3349056 - DNA, 19 bp, Homo sapiens
tcccttggtggcaagagcc

SEQ ID NO: 3349057 - DNA, 19 bp, Homo sapiens
tcccttgtgtcaagacatt

SEQ ID NO: 3349058 - DNA, 22 bp, Homo sapiens
tcccttgtgtcaagacatttct

SEQ ID NO: 3349059 - DNA, 13 bp, Homo sapiens
tcccttgtgtgtg

SEQ ID NO: 3349060 - DNA, 17 bp, Homo sapiens
tccctttacaatgtgaa

SEQ ID NO: 3349061 - DNA, 15 bp, Homo sapiens
tccctttccccagca

SEQ ID NO: 3349062 - DNA, 13 bp, Homo sapiens
tccctttccctac

SEQ ID NO: 3349063 - DNA, 16 bp, Homo sapiens
tccctttccctacctt

SEQ ID NO: 3349064 - DNA, 13 bp, Homo sapiens
tccctttcccttc

SEQ ID NO: 3349065 - DNA, 17 bp, Homo sapiens
tccctttccttccatcc

SEQ ID NO: 3349066 - DNA, 18 bp, Homo sapiens
tccctttccttccatccc

SEQ ID NO: 3349067 - DNA, 19 bp, Homo sapiens
tccctttccttccatccct

SEQ ID NO: 3349068 - DNA, 23 bp, Homo sapiens
tccctttccttccatccctaccc

SEQ ID NO: 3349069 - DNA, 16 bp, Homo sapiens
tccctttccttcctaa

SEQ ID NO: 3349070 - DNA, 17 bp, Homo sapiens
tccctttccttcctaat

SEQ ID NO: 3349071 - DNA, 18 bp, Homo sapiens
tccctttctctctcctct

SEQ ID NO: 3349072 - DNA, 21 bp, Homo sapiens
tccctttctctctcctctctg

SEQ ID NO: 3349073 - DNA, 13 bp, Homo sapiens
tccctttctcttc

SEQ ID NO: 3349074 - DNA, 17 bp, Homo sapiens
tccctttctcttcttcc

SEQ ID NO: 3349075 - DNA, 16 bp, Homo sapiens
tccctttcttggccag

SEQ ID NO: 3349076 - DNA, 17 bp, Homo sapiens
tccctttgcccagaaag

SEQ ID NO: 3349077 - DNA, 17 bp, Homo sapiens
tcccttttaatataaaa

SEQ ID NO: 3349078 - DNA, 14 bp, Homo sapiens
tcccttttcctgtc

SEQ ID NO: 3349079 - DNA, 13 bp, Homo sapiens
tcccttttctgtt

SEQ ID NO: 3349080 - DNA, 14 bp, Homo sapiens
tcccttttctgttc

SEQ ID NO: 3349081 - DNA, 22 bp, Homo sapiens
tcccttttctgtttaggaagaa

SEQ ID NO: 3349082 - DNA, 19 bp, Homo sapiens
tccctttttttacatttca

SEQ ID NO: 3349083 - DNA, 16 bp, Homo sapiens
tccgaagaaaagaatt

SEQ ID NO: 3349084 - DNA, 21 bp, Homo sapiens
tccgaagtatgagggaaaatg

SEQ ID NO: 3349085 - DNA, 17 bp, Homo sapiens
tccgaatgggttttcta

SEQ ID NO: 3349086 - DNA, 17 bp, Homo sapiens
tccgacagccccctctg

SEQ ID NO: 3349087 - DNA, 20 bp, Homo sapiens
tccgacagccccctctgccg

SEQ ID NO: 3349088 - DNA, 20 bp, Homo sapiens
tccgacatcccagaccagcc

SEQ ID NO: 3349089 - DNA, 13 bp, Homo sapiens
tccgaccagacac

SEQ ID NO: 3349090 - DNA, 15 bp, Homo sapiens
tccgactctaagctg

SEQ ID NO: 3349091 - DNA, 16 bp, Homo sapiens
tccgactctaagctgt

SEQ ID NO: 3349092 - DNA, 17 bp, Homo sapiens
tccgactctaagctgtg

SEQ ID NO: 3349093 - DNA, 18 bp, Homo sapiens
tccgactctaagctgtgt

SEQ ID NO: 3349094 - DNA, 19 bp, Homo sapiens
tccgactctaagctgtgtg

SEQ ID NO: 3349095 - DNA, 21 bp, Homo sapiens
tccgactctaagctgtgtgca

SEQ ID NO: 3349096 - DNA, 17 bp, Homo sapiens
tccgagacagtccagtg

SEQ ID NO: 3349097 - DNA, 14 bp, Homo sapiens
tccgagagggagag

SEQ ID NO: 3349098 - DNA, 15 bp, Homo sapiens
tccgagagggagaga

SEQ ID NO: 3349099 - DNA, 16 bp, Homo sapiens
tccgcaccagctgctc

SEQ ID NO: 3349100 - DNA, 15 bp, Homo sapiens
tccgcactttccact

SEQ ID NO: 3349101 - DNA, 16 bp, Homo sapiens
tccgcactttccactt

SEQ ID NO: 3349102 - DNA, 22 bp, Homo sapiens
tccgcactttccacttcttcct

SEQ ID NO: 3349103 - DNA, 15 bp, Homo sapiens
tccgcagaagccctg

SEQ ID NO: 3349104 - DNA, 16 bp, Homo sapiens
tccgcaggtgctggtc

SEQ ID NO: 3349105 - DNA, 21 bp, Homo sapiens
tccgccactcagccatttccc

SEQ ID NO: 3349106 - DNA, 12 bp, Homo sapiens
tccgccagcctc

SEQ ID NO: 3349107 - DNA, 13 bp, Homo sapiens
tccgccagcctcc

SEQ ID NO: 3349108 - DNA, 21 bp, Homo sapiens
tccgcccacaggaagcctgca

SEQ ID NO: 3349109 - DNA, 13 bp, Homo sapiens
tccgcccccagcc

SEQ ID NO: 3349110 - DNA, 21 bp, Homo sapiens
tccgcccgctcctgccgcaga

SEQ ID NO: 3349111 - DNA, 15 bp, Homo sapiens
tccgccctgccactc

SEQ ID NO: 3349112 - DNA, 16 bp, Homo sapiens
tccgccctgccactca

SEQ ID NO: 3349113 - DNA, 12 bp, Homo sapiens
tccgccctgctc

SEQ ID NO: 3349114 - DNA, 19 bp, Homo sapiens
tccgccctgctcctccctg

SEQ ID NO: 3349115 - DNA, 20 bp, Homo sapiens
tccgccctgctcctccctgg

SEQ ID NO: 3349116 - DNA, 11 bp, Homo sapiens
tccgcctcccc

SEQ ID NO: 3349117 - DNA, 11 bp, Homo sapiens
tccgcctgcct

SEQ ID NO: 3349118 - DNA, 13 bp, Homo sapiens
tccgcctgcctct

SEQ ID NO: 3349119 - DNA, 17 bp, Homo sapiens
tccgcctgcctctgcct

SEQ ID NO: 3349120 - DNA, 12 bp, Homo sapiens
tccgcgaaaata

SEQ ID NO: 3349121 - DNA, 19 bp, Homo sapiens
tccgcggagcccttggccc

SEQ ID NO: 3349122 - DNA, 20 bp, Homo sapiens
tccgctcccaccgcccccac

SEQ ID NO: 3349123 - DNA, 13 bp, Homo sapiens
tccgctgccacca

SEQ ID NO: 3349124 - DNA, 19 bp, Homo sapiens
tccgctgccagccttgagc

SEQ ID NO: 3349125 - DNA, 13 bp, Homo sapiens
tccgctgctcctt

SEQ ID NO: 3349126 - DNA, 18 bp, Homo sapiens
tccgctgtcgccccaggc

SEQ ID NO: 3349127 - DNA, 16 bp, Homo sapiens
tccgctttctacccag

SEQ ID NO: 3349128 - DNA, 18 bp, Homo sapiens
tccgctttctacccagcg

SEQ ID NO: 3349129 - DNA, 21 bp, Homo sapiens
tccgctttctacccagcgagc

SEQ ID NO: 3349130 - DNA, 14 bp, Homo sapiens
tccggactggtgcc

SEQ ID NO: 3349131 - DNA, 15 bp, Homo sapiens
tccggagtagctggg

SEQ ID NO: 3349132 - DNA, 17 bp, Homo sapiens
tccggattggcttgtgt

SEQ ID NO: 3349133 - DNA, 16 bp, Homo sapiens
tccggcacactgccaa

SEQ ID NO: 3349134 - DNA, 23 bp, Homo sapiens
tccggcacactgccaaataaaca

SEQ ID NO: 3349135 - DNA, 16 bp, Homo sapiens
tccggccatactgcct

SEQ ID NO: 3349136 - DNA, 22 bp, Homo sapiens
tccggcccagtgccactgcccc

SEQ ID NO: 3349137 - DNA, 22 bp, Homo sapiens
tccggcctctttttttcttttc

SEQ ID NO: 3349138 - DNA, 21 bp, Homo sapiens
tccggcttgacctgtttctct

SEQ ID NO: 3349139 - DNA, 19 bp, Homo sapiens
tccgggagagcggctgccc

SEQ ID NO: 3349140 - DNA, 18 bp, Homo sapiens
tccgggctttcccccagg

SEQ ID NO: 3349141 - DNA, 14 bp, Homo sapiens
tccggggtctgtgc

SEQ ID NO: 3349142 - DNA, 20 bp, Homo sapiens
tccggggtctgtgctgtgcc

SEQ ID NO: 3349143 - DNA, 15 bp, Homo sapiens
tccgggtgtggcctc

SEQ ID NO: 3349144 - DNA, 20 bp, Homo sapiens
tccgggtgtggcctcagccc

SEQ ID NO: 3349145 - DNA, 19 bp, Homo sapiens
tccggtagggaggcagcct

SEQ ID NO: 3349146 - DNA, 20 bp, Homo sapiens
tccggtcccctgcctggaac

SEQ ID NO: 3349147 - DNA, 16 bp, Homo sapiens
tccggtgttctaagat

SEQ ID NO: 3349148 - DNA, 22 bp, Homo sapiens
tccgtaggtagatgtgtaacct

SEQ ID NO: 3349149 - DNA, 11 bp, Homo sapiens
tcccaggaact

SEQ ID NO: 3349150 - DNA, 18 bp, Homo sapiens
tcccaggacaccacaccc

SEQ ID NO: 3349151 - DNA, 21 bp, Homo sapiens
tcccaggacaccacacccagc

SEQ ID NO: 3349152 - DNA, 22 bp, Homo sapiens
tcccaggacaccacacccagcc

SEQ ID NO: 3349153 - DNA, 15 bp, Homo sapiens
tcccaggatgctggg

SEQ ID NO: 3349154 - DNA, 18 bp, Homo sapiens
tcccaggccccctgcatc

SEQ ID NO: 3349155 - DNA, 19 bp, Homo sapiens
tcccaggccccctgcatct

SEQ ID NO: 3349156 - DNA, 20 bp, Homo sapiens
tcccaggccccctgcatcta

SEQ ID NO: 3349157 - DNA, 20 bp, Homo sapiens
tcccccaccggtccagctgg

SEQ ID NO: 3349158 - DNA, 11 bp, Homo sapiens
tcccccagcaa

SEQ ID NO: 3349159 - DNA, 11 bp, Homo sapiens
tcccccagcca

SEQ ID NO: 3349160 - DNA, 19 bp, Homo sapiens
tcccccagccaaactgtct

SEQ ID NO: 3349161 - DNA, 11 bp, Homo sapiens
tcccccaggga

SEQ ID NO: 3349162 - DNA, 14 bp, Homo sapiens
tcccccagtacctc

SEQ ID NO: 3349163 - DNA, 16 bp, Homo sapiens
tcccccagtacctcca

SEQ ID NO: 3349164 - DNA, 23 bp, Homo sapiens
tcccccatcatgtggcccaactc

SEQ ID NO: 3349165 - DNA, 17 bp, Homo sapiens
tcccccatctcccaccc

SEQ ID NO: 3349166 - DNA, 14 bp, Homo sapiens
tcccccatgtggct

SEQ ID NO: 3349167 - DNA, 15 bp, Homo sapiens
tccccccatcttgct

SEQ ID NO: 3349168 - DNA, 14 bp, Homo sapiens
tcccccccagcctg

SEQ ID NO: 3349169 - DNA, 14 bp, Homo sapiens
tcccccccagtgca

SEQ ID NO: 3349170 - DNA, 16 bp, Homo sapiens
tcccccccctgtatag

SEQ ID NO: 3349171 - DNA, 17 bp, Homo sapiens
tcccccgacactgctgc

SEQ ID NO: 3349172 - DNA, 18 bp, Homo sapiens
tcccccgacactgctgca

SEQ ID NO: 3349173 - DNA, 19 bp, Homo sapiens
tcccccgacactgctgcac

SEQ ID NO: 3349174 - DNA, 22 bp, Homo sapiens
tcccccgacactgctgcaccag

SEQ ID NO: 3349175 - DNA, 14 bp, Homo sapiens
tcccccgagctctt

SEQ ID NO: 3349176 - DNA, 20 bp, Homo sapiens
tcccccgagctcttggcctt

SEQ ID NO: 3349177 - DNA, 21 bp, Homo sapiens
tcccccgagctcttggccttt

SEQ ID NO: 3349178 - DNA, 20 bp, Homo sapiens
tcccccgcagtccccagccc

SEQ ID NO: 3349179 - DNA, 19 bp, Homo sapiens
tcccccgccgcttttctcc

SEQ ID NO: 3349180 - DNA, 14 bp, Homo sapiens
tccccctacccacc

SEQ ID NO: 3349181 - DNA, 15 bp, Homo sapiens
tccccctacccaccg

SEQ ID NO: 3349182 - DNA, 19 bp, Homo sapiens
tccccctcccagggccagg

SEQ ID NO: 3349183 - DNA, 12 bp, Homo sapiens
tccccctcctca

SEQ ID NO: 3349184 - DNA, 11 bp, Homo sapiens
tccccctgcaa

SEQ ID NO: 3349185 - DNA, 12 bp, Homo sapiens
tccccctgcaac

SEQ ID NO: 3349186 - DNA, 21 bp, Homo sapiens
tccccctgcaacttccgctga

SEQ ID NO: 3349187 - DNA, 13 bp, Homo sapiens
tccccctgcccca

SEQ ID NO: 3349188 - DNA, 20 bp, Homo sapiens
tccccctgccctcgtggcca

SEQ ID NO: 3349189 - DNA, 12 bp, Homo sapiens
tccccctgggct

SEQ ID NO: 3349190 - DNA, 20 bp, Homo sapiens
tccccctgggctctgcccca

SEQ ID NO: 3349191 - DNA, 19 bp, Homo sapiens
tccccctgtcccctcagct

SEQ ID NO: 3349192 - DNA, 16 bp, Homo sapiens
tcccccttcctagtga

SEQ ID NO: 3349193 - DNA, 14 bp, Homo sapiens
tccccgagtgccta

SEQ ID NO: 3349194 - DNA, 21 bp, Homo sapiens
tccccgatgtcccctgcgggc

SEQ ID NO: 3349195 - DNA, 14 bp, Homo sapiens
tccccgcctggcca

SEQ ID NO: 3349196 - DNA, 19 bp, Homo sapiens
tccccgcctggccaggagc

SEQ ID NO: 3349197 - DNA, 14 bp, Homo sapiens
tccccgcctgttcc

SEQ ID NO: 3349198 - DNA, 15 bp, Homo sapiens
tccccgctaaggaag

SEQ ID NO: 3349199 - DNA, 18 bp, Homo sapiens
tccccggcaccctctggc

SEQ ID NO: 3349200 - DNA, 19 bp, Homo sapiens
tccccggcaccctctggcc

SEQ ID NO: 3349201 - DNA, 16 bp, Homo sapiens
tccccgggcatctttg

SEQ ID NO: 3349202 - DNA, 17 bp, Homo sapiens
tccccgggcatctttgg

SEQ ID NO: 3349203 - DNA, 15 bp, Homo sapiens
tccccgggggaggaa

SEQ ID NO: 3349204 - DNA, 13 bp, Homo sapiens
tccccgtggtctc

SEQ ID NO: 3349205 - DNA, 22 bp, Homo sapiens
tccccgtgtcctctccctgcca

SEQ ID NO: 3349206 - DNA, 14 bp, Homo sapiens
tccccgttcctgac

SEQ ID NO: 3349207 - DNA, 15 bp, Homo sapiens
tccccgttcctgaca

SEQ ID NO: 3349208 - DNA, 17 bp, Homo sapiens
tcccctaagtctttact

SEQ ID NO: 3349209 - DNA, 14 bp, Homo sapiens
tcccctacagaatt

SEQ ID NO: 3349210 - DNA, 16 bp, Homo sapiens
tcccctactccctctt

SEQ ID NO: 3349211 - DNA, 15 bp, Homo sapiens
tcccctatcccattc

SEQ ID NO: 3349212 - DNA, 22 bp, Homo sapiens
tcccctcactctgtcagccagc

SEQ ID NO: 3349213 - DNA, 13 bp, Homo sapiens
tcccctcactgga

SEQ ID NO: 3349214 - DNA, 20 bp, Homo sapiens
tcccctccacatcccagcag

SEQ ID NO: 3349215 - DNA, 12 bp, Homo sapiens
tcccctccactg

SEQ ID NO: 3349216 - DNA, 15 bp, Homo sapiens
tcccctccactgtca

SEQ ID NO: 3349217 - DNA, 13 bp, Homo sapiens
tcccctccaggaa

SEQ ID NO: 3349218 - DNA, 14 bp, Homo sapiens
tcccctccaggaag

SEQ ID NO: 3349219 - DNA, 20 bp, Homo sapiens
tcccctccatccctggcccc

SEQ ID NO: 3349220 - DNA, 14 bp, Homo sapiens
tcccctcccatctg

SEQ ID NO: 3349221 - DNA, 17 bp, Homo sapiens
tcccctccccactcctc

SEQ ID NO: 3349222 - DNA, 17 bp, Homo sapiens
tcccctccccgcctggc

SEQ ID NO: 3349223 - DNA, 11 bp, Homo sapiens
tcccctcccct

SEQ ID NO: 3349224 - DNA, 17 bp, Homo sapiens
tcccctcccctccttgt

SEQ ID NO: 3349225 - DNA, 21 bp, Homo sapiens
tcccctccctggctcccatga

SEQ ID NO: 3349226 - DNA, 20 bp, Homo sapiens
tcccctcccttgtccttgaa

SEQ ID NO: 3349227 - DNA, 16 bp, Homo sapiens
tcccctccggactggt

SEQ ID NO: 3349228 - DNA, 18 bp, Homo sapiens
tcccctccggactggtgc

SEQ ID NO: 3349229 - DNA, 13 bp, Homo sapiens
tcccctcctcagt

SEQ ID NO: 3349230 - DNA, 15 bp, Homo sapiens
tcccctcctcagtga

SEQ ID NO: 3349231 - DNA, 10 bp, Homo sapiens
tcccctcctt

SEQ ID NO: 3349232 - DNA, 18 bp, Homo sapiens
tcccctccttctcccttt

SEQ ID NO: 3349233 - DNA, 20 bp, Homo sapiens
tcccctcgtcctgtcccaga

SEQ ID NO: 3349234 - DNA, 16 bp, Homo sapiens
tcccctcgtgtcagct

SEQ ID NO: 3349235 - DNA, 15 bp, Homo sapiens
tcccctctccttcct

SEQ ID NO: 3349236 - DNA, 16 bp, Homo sapiens
tcccctctctgcccct

SEQ ID NO: 3349237 - DNA, 13 bp, Homo sapiens
tcccctctgctgc

SEQ ID NO: 3349238 - DNA, 17 bp, Homo sapiens
tcccctcttcccttcaa

SEQ ID NO: 3349239 - DNA, 13 bp, Homo sapiens
tcccctgccacca

SEQ ID NO: 3349240 - DNA, 15 bp, Homo sapiens
tcccctgccctggtc

SEQ ID NO: 3349241 - DNA, 15 bp, Homo sapiens
tcccctgcctggaac

SEQ ID NO: 3349242 - DNA, 15 bp, Homo sapiens
tcccctgctgcaggg

SEQ ID NO: 3349243 - DNA, 16 bp, Homo sapiens
tcccctggactgggag

SEQ ID NO: 3349244 - DNA, 13 bp, Homo sapiens
tcccctggcctca

SEQ ID NO: 3349245 - DNA, 12 bp, Homo sapiens
tcccctggcctt

SEQ ID NO: 3349246 - DNA, 21 bp, Homo sapiens
tcccctgggcatcttctggct

SEQ ID NO: 3349247 - DNA, 20 bp, Homo sapiens
tcccctgggggtttcacctg

SEQ ID NO: 3349248 - DNA, 18 bp, Homo sapiens
tcccctgtcttcacctgc

SEQ ID NO: 3349249 - DNA, 19 bp, Homo sapiens
tcccctgtcttcacctgcc

SEQ ID NO: 3349250 - DNA, 12 bp, Homo sapiens
tcccctgtgggg

SEQ ID NO: 3349251 - DNA, 16 bp, Homo sapiens
tccccttcccctcccc

SEQ ID NO: 3349252 - DNA, 23 bp, Homo sapiens
tccccttcctcattatcaaacag

SEQ ID NO: 3349253 - DNA, 16 bp, Homo sapiens
tccccttgccttcccc

SEQ ID NO: 3349254 - DNA, 19 bp, Homo sapiens
tccccttgccttcccctgt

SEQ ID NO: 3349255 - DNA, 21 bp, Homo sapiens
tccccttgccttcccctgtct

SEQ ID NO: 3349256 - DNA, 24 bp, Homo sapiens
tccccttttgcctggctgtggagg

SEQ ID NO: 3349257 - DNA, 21 bp, Homo sapiens
tcccgaagaatggagaggaac

SEQ ID NO: 3349258 - DNA, 15 bp, Homo sapiens
tcccgaatagctggg

SEQ ID NO: 3349259 - DNA, 18 bp, Homo sapiens
tcccgagtagctgggact

SEQ ID NO: 3349260 - DNA, 20 bp, Homo sapiens
tcccgagtagctgggactac

SEQ ID NO: 3349261 - DNA, 12 bp, Homo sapiens
tcccgagtctgg

SEQ ID NO: 3349262 - DNA, 15 bp, Homo sapiens
tcccgagtctgggac

SEQ ID NO: 3349263 - DNA, 21 bp, Homo sapiens
tcccgcaaaccccctttgtgc

SEQ ID NO: 3349264 - DNA, 15 bp, Homo sapiens
tcccgcgcctttccg

SEQ ID NO: 3349265 - DNA, 15 bp, Homo sapiens
tcccgctcagccctc

SEQ ID NO: 3349266 - DNA, 23 bp, Homo sapiens
tcccggcatgggaaagccacctc

SEQ ID NO: 3349267 - DNA, 12 bp, Homo sapiens
tcccggctgcct

SEQ ID NO: 3349268 - DNA, 21 bp, Homo sapiens
tcccgggccacgccccagccc

SEQ ID NO: 3349269 - DNA, 22 bp, Homo sapiens
tcccgggccacgccccagcccg

SEQ ID NO: 3349270 - DNA, 16 bp, Homo sapiens
tcccggggccagcact

SEQ ID NO: 3349271 - DNA, 19 bp, Homo sapiens
tcccggggtcctgtggcag

SEQ ID NO: 3349272 - DNA, 20 bp, Homo sapiens
tcccgtacctcttcccatga

SEQ ID NO: 3349273 - DNA, 17 bp, Homo sapiens
tcccgtagtctcctggg

SEQ ID NO: 3349274 - DNA, 16 bp, Homo sapiens
tcccgtcagggcccaa

SEQ ID NO: 3349275 - DNA, 13 bp, Homo sapiens
tcccgtctcagaa

SEQ ID NO: 3349276 - DNA, 20 bp, Homo sapiens
tcccgtttctccacctagac

SEQ ID NO: 3349277 - DNA, 19 bp, Homo sapiens
tccctaaaatacatttaaa

SEQ ID NO: 3349278 - DNA, 19 bp, Homo sapiens
tccctaatttatgtgctat

SEQ ID NO: 3349279 - DNA, 13 bp, Homo sapiens
tccctacatgtat

SEQ ID NO: 3349280 - DNA, 13 bp, Homo sapiens
tattttaatattg

SEQ ID NO: 3349281 - DNA, 14 bp, Homo sapiens
tattttaatattga

SEQ ID NO: 3349282 - DNA, 13 bp, Homo sapiens
tattttaatgtaa

SEQ ID NO: 3349283 - DNA, 21 bp, Homo sapiens
tattttaatgtgatgatgtaa

SEQ ID NO: 3349284 - DNA, 13 bp, Homo sapiens
tattttactttgt

SEQ ID NO: 3349285 - DNA, 15 bp, Homo sapiens
tattttatcctctgg

SEQ ID NO: 3349286 - DNA, 19 bp, Homo sapiens
tattttattctatgtatgt

SEQ ID NO: 3349287 - DNA, 17 bp, Homo sapiens
tattttatttttttcta

SEQ ID NO: 3349288 - DNA, 16 bp, Homo sapiens
tattttcaagaaactg

SEQ ID NO: 3349289 - DNA, 11 bp, Homo sapiens
tattttcacaa

SEQ ID NO: 3349290 - DNA, 12 bp, Homo sapiens
tattttcacaat

SEQ ID NO: 3349291 - DNA, 20 bp, Homo sapiens
tattttcagtatactgtgtg

SEQ ID NO: 3349292 - DNA, 17 bp, Homo sapiens
tattttcagtattttgg

SEQ ID NO: 3349293 - DNA, 17 bp, Homo sapiens
tattttcagtgcatcat

SEQ ID NO: 3349294 - DNA, 13 bp, Homo sapiens
tattttcattaca

SEQ ID NO: 3349295 - DNA, 13 bp, Homo sapiens
tattttcatttgt

SEQ ID NO: 3349296 - DNA, 15 bp, Homo sapiens
tattttcatttgtac

SEQ ID NO: 3349297 - DNA, 16 bp, Homo sapiens
tattttcctaaagaga

SEQ ID NO: 3349298 - DNA, 14 bp, Homo sapiens
tattttcctggatt

SEQ ID NO: 3349299 - DNA, 13 bp, Homo sapiens
tattttcgggatt

SEQ ID NO: 3349300 - DNA, 16 bp, Homo sapiens
tattttcgtatgaaaa

SEQ ID NO: 3349301 - DNA, 17 bp, Homo sapiens
tattttctccaaataaa

SEQ ID NO: 3349302 - DNA, 20 bp, Homo sapiens
tattttctggtagatagaaa

SEQ ID NO: 3349303 - DNA, 12 bp, Homo sapiens
tattttctgtca

SEQ ID NO: 3349304 - DNA, 21 bp, Homo sapiens
tattttctgtgcctgaatatt

SEQ ID NO: 3349305 - DNA, 21 bp, Homo sapiens
tattttcttacccaatttccc

SEQ ID NO: 3349306 - DNA, 14 bp, Homo sapiens
tattttgaaaagct

SEQ ID NO: 3349307 - DNA, 20 bp, Homo sapiens
tattttgaagaatatttaag

SEQ ID NO: 3349308 - DNA, 21 bp, Homo sapiens
tattttgaagaatatttaaga

SEQ ID NO: 3349309 - DNA, 16 bp, Homo sapiens
tattttgaatgtcaca

SEQ ID NO: 3349310 - DNA, 15 bp, Homo sapiens
tattttgataataat

SEQ ID NO: 3349311 - DNA, 19 bp, Homo sapiens
tattttgataataatattg

SEQ ID NO: 3349312 - DNA, 18 bp, Homo sapiens
tattttgattattgtatt

SEQ ID NO: 3349313 - DNA, 14 bp, Homo sapiens
tattttgctgagtt

SEQ ID NO: 3349314 - DNA, 13 bp, Homo sapiens
tattttggaaact

SEQ ID NO: 3349315 - DNA, 16 bp, Homo sapiens
tattttggaaactgct

SEQ ID NO: 3349316 - DNA, 18 bp, Homo sapiens
tattttggaaagaagaaa

SEQ ID NO: 3349317 - DNA, 16 bp, Homo sapiens
tattttggagaaatta

SEQ ID NO: 3349318 - DNA, 20 bp, Homo sapiens
tattttggattgtatattgt

SEQ ID NO: 3349319 - DNA, 21 bp, Homo sapiens
tattttggcttcatttcaatc

SEQ ID NO: 3349320 - DNA, 17 bp, Homo sapiens
tattttggtacttttat

SEQ ID NO: 3349321 - DNA, 15 bp, Homo sapiens
tattttgtatatatc

SEQ ID NO: 3349322 - DNA, 19 bp, Homo sapiens
tattttgtggttctatttt

SEQ ID NO: 3349323 - DNA, 21 bp, Homo sapiens
tattttgtgtgaccaactgtg

SEQ ID NO: 3349324 - DNA, 12 bp, Homo sapiens
tattttgttaaa

SEQ ID NO: 3349325 - DNA, 15 bp, Homo sapiens
tattttgttaaagct

SEQ ID NO: 3349326 - DNA, 13 bp, Homo sapiens
tatttttaaagat

SEQ ID NO: 3349327 - DNA, 20 bp, Homo sapiens
tatttttagatggttacact

SEQ ID NO: 3349328 - DNA, 22 bp, Homo sapiens
tatttttagatggttacactgt

SEQ ID NO: 3349329 - DNA, 20 bp, Homo sapiens
tatttttataattgtacaaa

SEQ ID NO: 3349330 - DNA, 21 bp, Homo sapiens
tatttttatactcttcctatt

SEQ ID NO: 3349331 - DNA, 19 bp, Homo sapiens
tatttttatatagcttgaa

SEQ ID NO: 3349332 - DNA, 19 bp, Homo sapiens
tatttttatatcatgcaaa

SEQ ID NO: 3349333 - DNA, 20 bp, Homo sapiens
tatttttatatcatgcaaaa

SEQ ID NO: 3349334 - DNA, 17 bp, Homo sapiens
tatttttatcatgaatt

SEQ ID NO: 3349335 - DNA, 12 bp, Homo sapiens
tatttttatcta

SEQ ID NO: 3349336 - DNA, 18 bp, Homo sapiens
tatttttatctatataaa

SEQ ID NO: 3349337 - DNA, 14 bp, Homo sapiens
tatttttcaaggaa

SEQ ID NO: 3349338 - DNA, 11 bp, Homo sapiens
tatttttcata

SEQ ID NO: 3349339 - DNA, 15 bp, Homo sapiens
tatttttcatattgt

SEQ ID NO: 3349340 - DNA, 14 bp, Homo sapiens
tatttttctaaggt

SEQ ID NO: 3349341 - DNA, 20 bp, Homo sapiens
tatttttctacattattgct

SEQ ID NO: 3349342 - DNA, 19 bp, Homo sapiens
tatttttgaacccctgtgt

SEQ ID NO: 3349343 - DNA, 15 bp, Homo sapiens
tatttttggggcatc

SEQ ID NO: 3349344 - DNA, 21 bp, Homo sapiens
tatttttggggcatcctggat

SEQ ID NO: 3349345 - DNA, 14 bp, Homo sapiens
tatttttgtaatgt

SEQ ID NO: 3349346 - DNA, 21 bp, Homo sapiens
tatttttgtaatgtgaaaagt

SEQ ID NO: 3349347 - DNA, 22 bp, Homo sapiens
tatttttgtaatgtgaaaagta

SEQ ID NO: 3349348 - DNA, 20 bp, Homo sapiens
tatttttgtaattttaaata

SEQ ID NO: 3349349 - DNA, 20 bp, Homo sapiens
tatttttgtacatattgtta

SEQ ID NO: 3349350 - DNA, 14 bp, Homo sapiens
tatttttgtacatg

SEQ ID NO: 3349351 - DNA, 13 bp, Homo sapiens
tatttttgtactt

SEQ ID NO: 3349352 - DNA, 17 bp, Homo sapiens
tatttttgtacttgatt

SEQ ID NO: 3349353 - DNA, 17 bp, Homo sapiens
tatttttgtagagccag

SEQ ID NO: 3349354 - DNA, 21 bp, Homo sapiens
tatttttgtgaagtattcaca

SEQ ID NO: 3349355 - DNA, 22 bp, Homo sapiens
tatttttgtgttttcttgtaaa

SEQ ID NO: 3349356 - DNA, 21 bp, Homo sapiens
tattttttaagtatttatata

SEQ ID NO: 3349357 - DNA, 23 bp, Homo sapiens
tattttttaatttgatgaaagct

SEQ ID NO: 3349358 - DNA, 16 bp, Homo sapiens
tattttttatatatac

SEQ ID NO: 3349359 - DNA, 14 bp, Homo sapiens
tccagggaatccaa

SEQ ID NO: 3349360 - DNA, 20 bp, Homo sapiens
tccagggaatccaagcctcc

SEQ ID NO: 3349361 - DNA, 15 bp, Homo sapiens
tccagggagcctaga

SEQ ID NO: 3349362 - DNA, 21 bp, Homo sapiens
tccagggagcctagaagctgg

SEQ ID NO: 3349363 - DNA, 20 bp, Homo sapiens
tccaggggcccttgggacag

SEQ ID NO: 3349364 - DNA, 16 bp, Homo sapiens
tccaggggcctgcaga

SEQ ID NO: 3349365 - DNA, 18 bp, Homo sapiens
tccaggggcctgcagaag

SEQ ID NO: 3349366 - DNA, 21 bp, Homo sapiens
tccaggggctgcttcctcctg

SEQ ID NO: 3349367 - DNA, 22 bp, Homo sapiens
tccaggggctgcttcctcctgg

SEQ ID NO: 3349368 - DNA, 20 bp, Homo sapiens
tccaggttcaacccacagct

SEQ ID NO: 3349369 - DNA, 16 bp, Homo sapiens
tccaggttcagcttgt

SEQ ID NO: 3349370 - DNA, 19 bp, Homo sapiens
tccagtaacttttttgtgt

SEQ ID NO: 3349371 - DNA, 20 bp, Homo sapiens
tccagtaacttttttgtgta

SEQ ID NO: 3349372 - DNA, 21 bp, Homo sapiens
tccagtaacttttttgtgtat

SEQ ID NO: 3349373 - DNA, 19 bp, Homo sapiens
tccagtaatctaatatggc

SEQ ID NO: 3349374 - DNA, 16 bp, Homo sapiens
tccagtaccataatct

SEQ ID NO: 3349375 - DNA, 18 bp, Homo sapiens
tccagtaccataatctta

SEQ ID NO: 3349376 - DNA, 20 bp, Homo sapiens
tccagtaccataatcttaga

SEQ ID NO: 3349377 - DNA, 15 bp, Homo sapiens
tccagtaccttgctt

SEQ ID NO: 3349378 - DNA, 19 bp, Homo sapiens
tccagtattcttgtcaaaa

SEQ ID NO: 3349379 - DNA, 14 bp, Homo sapiens
tccagtattgctga

SEQ ID NO: 3349380 - DNA, 23 bp, Homo sapiens
tccagtccccctatccttggcac

SEQ ID NO: 3349381 - DNA, 16 bp, Homo sapiens
tccagtctcttgtaca

SEQ ID NO: 3349382 - DNA, 22 bp, Homo sapiens
tccagtcttcctgacactttaa

SEQ ID NO: 3349383 - DNA, 20 bp, Homo sapiens
tccagtgacaaaccatccag

SEQ ID NO: 3349384 - DNA, 17 bp, Homo sapiens
tccagtgccagcaatga

SEQ ID NO: 3349385 - DNA, 15 bp, Homo sapiens
tccagtgctggattt

SEQ ID NO: 3349386 - DNA, 22 bp, Homo sapiens
tccagtggaggtttgtcgggca

SEQ ID NO: 3349387 - DNA, 19 bp, Homo sapiens
tccagtggctggtttctga

SEQ ID NO: 3349388 - DNA, 20 bp, Homo sapiens
tccagtgtcacctctctcag

SEQ ID NO: 3349389 - DNA, 21 bp, Homo sapiens
tccagtgtcacctctctcaga

SEQ ID NO: 3349390 - DNA, 18 bp, Homo sapiens
tccagtgtccttagaaca

SEQ ID NO: 3349391 - DNA, 18 bp, Homo sapiens
tccagtgtgggcttgacc

SEQ ID NO: 3349392 - DNA, 16 bp, Homo sapiens
tccagttataagaaga

SEQ ID NO: 3349393 - DNA, 16 bp, Homo sapiens
tccagttcatgagaat

SEQ ID NO: 3349394 - DNA, 17 bp, Homo sapiens
tccagttcctttagaaa

SEQ ID NO: 3349395 - DNA, 16 bp, Homo sapiens
tccagttgggactcag

SEQ ID NO: 3349396 - DNA, 18 bp, Homo sapiens
tccagttgggactcagga

SEQ ID NO: 3349397 - DNA, 17 bp, Homo sapiens
tccagtttgttctccgg

SEQ ID NO: 3349398 - DNA, 15 bp, Homo sapiens
tccataaatgtgttc

SEQ ID NO: 3349399 - DNA, 16 bp, Homo sapiens
tccataaatgtgttcc

SEQ ID NO: 3349400 - DNA, 22 bp, Homo sapiens
tccataatgcattcttctctgt

SEQ ID NO: 3349401 - DNA, 14 bp, Homo sapiens
tccatacagctcta

SEQ ID NO: 3349402 - DNA, 15 bp, Homo sapiens
tccataccagctcgc

SEQ ID NO: 3349403 - DNA, 23 bp, Homo sapiens
tccatatcttaaagaaacagctt

SEQ ID NO: 3349404 - DNA, 21 bp, Homo sapiens
tccatatcttgcgaatccaag

SEQ ID NO: 3349405 - DNA, 18 bp, Homo sapiens
tccatatggattttctat

SEQ ID NO: 3349406 - DNA, 13 bp, Homo sapiens
tccatattttcac

SEQ ID NO: 3349407 - DNA, 17 bp, Homo sapiens
tccatcaccctcttcct

SEQ ID NO: 3349408 - DNA, 19 bp, Homo sapiens
tccatcacgttagctgtcc

SEQ ID NO: 3349409 - DNA, 13 bp, Homo sapiens
tccatccaaggcc

SEQ ID NO: 3349410 - DNA, 15 bp, Homo sapiens
tccatccatctccag

SEQ ID NO: 3349411 - DNA, 19 bp, Homo sapiens
tccatcccaacagccatgc

SEQ ID NO: 3349412 - DNA, 22 bp, Homo sapiens
tccatcccaaccagtgccaagg

SEQ ID NO: 3349413 - DNA, 15 bp, Homo sapiens
tccatccctctaatg

SEQ ID NO: 3349414 - DNA, 23 bp, Homo sapiens
tccatccctctaatgagactgac

SEQ ID NO: 3349415 - DNA, 13 bp, Homo sapiens
tccatccctggcc

SEQ ID NO: 3349416 - DNA, 15 bp, Homo sapiens
tccatccctggcccc

SEQ ID NO: 3349417 - DNA, 17 bp, Homo sapiens
tccatcccttttcctgt

SEQ ID NO: 3349418 - DNA, 11 bp, Homo sapiens
tccatcctgag

SEQ ID NO: 3349419 - DNA, 21 bp, Homo sapiens
tccatcctgaggctccacttg

SEQ ID NO: 3349420 - DNA, 20 bp, Homo sapiens
tccatctcctataatctgtc

SEQ ID NO: 3349421 - DNA, 21 bp, Homo sapiens
tccatctcctataatctgtca

SEQ ID NO: 3349422 - DNA, 18 bp, Homo sapiens
tccatctctcatcctcca

SEQ ID NO: 3349423 - DNA, 20 bp, Homo sapiens
tccatcttctccccacagcc

SEQ ID NO: 3349424 - DNA, 23 bp, Homo sapiens
tccatcttctccccacagcctct

SEQ ID NO: 3349425 - DNA, 24 bp, Homo sapiens
tccatcttctccccacagcctctg

SEQ ID NO: 3349426 - DNA, 17 bp, Homo sapiens
tccatcttgctaataaa

SEQ ID NO: 3349427 - DNA, 15 bp, Homo sapiens
tccatctttatagaa

SEQ ID NO: 3349428 - DNA, 14 bp, Homo sapiens
tccatctttgaact

SEQ ID NO: 3349429 - DNA, 18 bp, Homo sapiens
tccatgaaaacgttttat

SEQ ID NO: 3349430 - DNA, 21 bp, Homo sapiens
tccatgaaaacgttttattgt

SEQ ID NO: 3349431 - DNA, 12 bp, Homo sapiens
tccatgaatgta

SEQ ID NO: 3349432 - DNA, 16 bp, Homo sapiens
tccatgaatgtatcag

SEQ ID NO: 3349433 - DNA, 15 bp, Homo sapiens
tccatgacaggcctg

SEQ ID NO: 3349434 - DNA, 20 bp, Homo sapiens
tccatgacaggcctgaagat

SEQ ID NO: 3349435 - DNA, 14 bp, Homo sapiens
tccatgactggctg

SEQ ID NO: 3349436 - DNA, 13 bp, Homo sapiens
tccatgagcaccc

SEQ ID NO: 3349437 - DNA, 19 bp, Homo sapiens
tccatgagtttgccctggt

SEQ ID NO: 3349438 - DNA, 15 bp, Homo sapiens
tccatgattctctga

SEQ ID NO: 3349439 - DNA, 17 bp, Homo sapiens
tccatgattctctgagt

SEQ ID NO: 3349440 - DNA, 21 bp, Homo sapiens
tccatgcagactcctcagatc

SEQ ID NO: 3349441 - DNA, 19 bp, Homo sapiens
tccatgcctctggaggcct

SEQ ID NO: 3349442 - DNA, 15 bp, Homo sapiens
tccatgcctgagggt

SEQ ID NO: 3349443 - DNA, 20 bp, Homo sapiens
tccatgcctgtagctttcct

SEQ ID NO: 3349444 - DNA, 22 bp, Homo sapiens
tccatgcctgtagctttcctgg

SEQ ID NO: 3349445 - DNA, 23 bp, Homo sapiens
tccatgcctgtagctttcctggt

SEQ ID NO: 3349446 - DNA, 16 bp, Homo sapiens
tccatgcgctcagggc

SEQ ID NO: 3349447 - DNA, 22 bp, Homo sapiens
tccatgcgtgtttctgactctg

SEQ ID NO: 3349448 - DNA, 21 bp, Homo sapiens
tccatgctcctcacctgtcta

SEQ ID NO: 3349449 - DNA, 14 bp, Homo sapiens
tccatgctgcctcc

SEQ ID NO: 3349450 - DNA, 17 bp, Homo sapiens
tccatggcaattttgta

SEQ ID NO: 3349451 - DNA, 13 bp, Homo sapiens
tccatggcaccag

SEQ ID NO: 3349452 - DNA, 15 bp, Homo sapiens
tccatggcaccagcc

SEQ ID NO: 3349453 - DNA, 17 bp, Homo sapiens
tccatggcaccagcccc

SEQ ID NO: 3349454 - DNA, 14 bp, Homo sapiens
tccatggcctttct

SEQ ID NO: 3349455 - DNA, 15 bp, Homo sapiens
tccatggcctttcta

SEQ ID NO: 3349456 - DNA, 15 bp, Homo sapiens
tccatgggagccagc

SEQ ID NO: 3349457 - DNA, 20 bp, Homo sapiens
tccatgggagccagctgctt

SEQ ID NO: 3349458 - DNA, 20 bp, Homo sapiens
tccatgggctagtgtgagtg

SEQ ID NO: 3349459 - DNA, 21 bp, Homo sapiens
tccatgtactgtagtttttct

SEQ ID NO: 3349460 - DNA, 18 bp, Homo sapiens
tccatgtacttgtttgca

SEQ ID NO: 3349461 - DNA, 17 bp, Homo sapiens
tccatgtgaacagcata

SEQ ID NO: 3349462 - DNA, 23 bp, Homo sapiens
tccatgtgattaatgttttcatt

SEQ ID NO: 3349463 - DNA, 20 bp, Homo sapiens
tccatgtgggctagttgggc

SEQ ID NO: 3349464 - DNA, 20 bp, Homo sapiens
tccatgttagtaatggcaga

SEQ ID NO: 3349465 - DNA, 17 bp, Homo sapiens
tccatgtttgcaatgct

SEQ ID NO: 3349466 - DNA, 19 bp, Homo sapiens
tccatgtttgtaaaactac

SEQ ID NO: 3349467 - DNA, 22 bp, Homo sapiens
tccattaacttagcatgtgttg

SEQ ID NO: 3349468 - DNA, 20 bp, Homo sapiens
tccattaggccagcaacgct

SEQ ID NO: 3349469 - DNA, 12 bp, Homo sapiens
tccattatttat

SEQ ID NO: 3349470 - DNA, 12 bp, Homo sapiens
tccattccagaa

SEQ ID NO: 3349471 - DNA, 15 bp, Homo sapiens
tccattctcccaggt

SEQ ID NO: 3349472 - DNA, 14 bp, Homo sapiens
tccattgtttaaag

SEQ ID NO: 3349473 - DNA, 21 bp, Homo sapiens
tccattttcccccactactgc

SEQ ID NO: 3349474 - DNA, 14 bp, Homo sapiens
tccatttttcctct

SEQ ID NO: 3349475 - DNA, 13 bp, Homo sapiens
tcccaaagtgctg

SEQ ID NO: 3349476 - DNA, 15 bp, Homo sapiens
tcccaaagtgctggg

SEQ ID NO: 3349477 - DNA, 19 bp, Homo sapiens
tcccaaatttgattgattt

SEQ ID NO: 3349478 - DNA, 20 bp, Homo sapiens
tcccaaatttgattgatttg

SEQ ID NO: 3349479 - DNA, 19 bp, Homo sapiens
tcccaacaacatccatgtc

SEQ ID NO: 3349480 - DNA, 14 bp, Homo sapiens
tcccaacactttgg

SEQ ID NO: 3349481 - DNA, 15 bp, Homo sapiens
tcccaacagccatgc

SEQ ID NO: 3349482 - DNA, 17 bp, Homo sapiens
tcccaacagccatgccc

SEQ ID NO: 3349483 - DNA, 22 bp, Homo sapiens
tcccaacagccttagctgccag

SEQ ID NO: 3349484 - DNA, 17 bp, Homo sapiens
tcccaaccagtgccaag

SEQ ID NO: 3349485 - DNA, 18 bp, Homo sapiens
tcccaaccagtgccaagg

SEQ ID NO: 3349486 - DNA, 20 bp, Homo sapiens
tcccaaccagtgccaaggac

SEQ ID NO: 3349487 - DNA, 13 bp, Homo sapiens
tcccaacccagcc

SEQ ID NO: 3349488 - DNA, 18 bp, Homo sapiens
tcccaacccccctcctgc

SEQ ID NO: 3349489 - DNA, 15 bp, Homo sapiens
tcccaaccctggctt

SEQ ID NO: 3349490 - DNA, 22 bp, Homo sapiens
tcccaacttcatactggcagga

SEQ ID NO: 3349491 - DNA, 13 bp, Homo sapiens
tcccaagcctcct

SEQ ID NO: 3349492 - DNA, 18 bp, Homo sapiens
tcccaagctagtgagcaa

SEQ ID NO: 3349493 - DNA, 14 bp, Homo sapiens
tcccaaggagctga

SEQ ID NO: 3349494 - DNA, 23 bp, Homo sapiens
tcccaaggagctgatttccaggc

SEQ ID NO: 3349495 - DNA, 18 bp, Homo sapiens
tcccaaggctctgagcaa

SEQ ID NO: 3349496 - DNA, 20 bp, Homo sapiens
tcccaaggctgcgtctggag

SEQ ID NO: 3349497 - DNA, 20 bp, Homo sapiens
tcccaagggtgccctttggg

SEQ ID NO: 3349498 - DNA, 17 bp, Homo sapiens
tcccaaggtcctctcag

SEQ ID NO: 3349499 - DNA, 15 bp, Homo sapiens
tcccaagtcagacag

SEQ ID NO: 3349500 - DNA, 23 bp, Homo sapiens
tcccaatagcactttcattgcca

SEQ ID NO: 3349501 - DNA, 14 bp, Homo sapiens
tcccaatcagcact

SEQ ID NO: 3349502 - DNA, 20 bp, Homo sapiens
tcccaatctctacccctttc

SEQ ID NO: 3349503 - DNA, 22 bp, Homo sapiens
tcccaatctctacccctttctt

SEQ ID NO: 3349504 - DNA, 23 bp, Homo sapiens
tcccaatctctacccctttcttc

SEQ ID NO: 3349505 - DNA, 21 bp, Homo sapiens
tcccaatcttaccagatgcta

SEQ ID NO: 3349506 - DNA, 14 bp, Homo sapiens
tcccaatctttcta

SEQ ID NO: 3349507 - DNA, 15 bp, Homo sapiens
tcccaatctttctat

SEQ ID NO: 3349508 - DNA, 20 bp, Homo sapiens
tcccaatctttctatataaa

SEQ ID NO: 3349509 - DNA, 24 bp, Homo sapiens
tcccaatctttctatataaaatgt

SEQ ID NO: 3349510 - DNA, 14 bp, Homo sapiens
tcccaatgcacatc

SEQ ID NO: 3349511 - DNA, 22 bp, Homo sapiens
tcccaatgcacatccattccca

SEQ ID NO: 3349512 - DNA, 14 bp, Homo sapiens
tcccaattaggaag

SEQ ID NO: 3349513 - DNA, 19 bp, Homo sapiens
tcccaattaggaagtgtaa

SEQ ID NO: 3349514 - DNA, 20 bp, Homo sapiens
tcccaattaggaagtgtaac

SEQ ID NO: 3349515 - DNA, 13 bp, Homo sapiens
tcccacaccctgg

SEQ ID NO: 3349516 - DNA, 16 bp, Homo sapiens
tcccacacctccacag

SEQ ID NO: 3349517 - DNA, 19 bp, Homo sapiens
tcccacacgattagcttta

SEQ ID NO: 3349518 - DNA, 14 bp, Homo sapiens
tcccacacttgctg

SEQ ID NO: 3349519 - DNA, 17 bp, Homo sapiens
tcccacacttgctgggg

SEQ ID NO: 3349520 - DNA, 16 bp, Homo sapiens
tcccacagagtgctgg

SEQ ID NO: 3349521 - DNA, 17 bp, Homo sapiens
tcccacagagtgctgga

SEQ ID NO: 3349522 - DNA, 19 bp, Homo sapiens
tcccacagagtgctggact

SEQ ID NO: 3349523 - DNA, 19 bp, Homo sapiens
tcccaccattcctgccttt

SEQ ID NO: 3349524 - DNA, 14 bp, Homo sapiens
tcccacccacccgc

SEQ ID NO: 3349525 - DNA, 23 bp, Homo sapiens
tcccacccacccgccgcctccca

SEQ ID NO: 3349526 - DNA, 16 bp, Homo sapiens
tcccacccacctcacc

SEQ ID NO: 3349527 - DNA, 17 bp, Homo sapiens
tcccacccccttctctg

SEQ ID NO: 3349528 - DNA, 19 bp, Homo sapiens
tcccacccccttctctgct

SEQ ID NO: 3349529 - DNA, 21 bp, Homo sapiens
tcccacccccttctctgctcc

SEQ ID NO: 3349530 - DNA, 18 bp, Homo sapiens
tcccaccccggcctccac

SEQ ID NO: 3349531 - DNA, 13 bp, Homo sapiens
tcccacccctccc

SEQ ID NO: 3349532 - DNA, 19 bp, Homo sapiens
tcccacccctgcctcccat

SEQ ID NO: 3349533 - DNA, 20 bp, Homo sapiens
tcccaccctgtacctcatcc

SEQ ID NO: 3349534 - DNA, 15 bp, Homo sapiens
tcccaccgcccccac

SEQ ID NO: 3349535 - DNA, 22 bp, Homo sapiens
tcccaccgcccccaccccttcc

SEQ ID NO: 3349536 - DNA, 14 bp, Homo sapiens
tcccacctagccca

SEQ ID NO: 3349537 - DNA, 13 bp, Homo sapiens
tcccacctccagc

SEQ ID NO: 3349538 - DNA, 16 bp, Homo sapiens
tcccacctccagcccg

SEQ ID NO: 3349539 - DNA, 17 bp, Homo sapiens
tcccacctccatcccag

SEQ ID NO: 3349540 - DNA, 15 bp, Homo sapiens
tcccacctccctgcc

SEQ ID NO: 3349541 - DNA, 16 bp, Homo sapiens
tcccacctccctgccc

SEQ ID NO: 3349542 - DNA, 18 bp, Homo sapiens
tcccacctccctgcccag

SEQ ID NO: 3349543 - DNA, 13 bp, Homo sapiens
tcccacctctgtg

SEQ ID NO: 3349544 - DNA, 18 bp, Homo sapiens
tcccacctctgtgacctc

SEQ ID NO: 3349545 - DNA, 16 bp, Homo sapiens
tcccaccttggctgca

SEQ ID NO: 3349546 - DNA, 20 bp, Homo sapiens
tcccacgaatttgctgggga

SEQ ID NO: 3349547 - DNA, 14 bp, Homo sapiens
tcccacgtctggcc

SEQ ID NO: 3349548 - DNA, 17 bp, Homo sapiens
tcccacgtctggccagg

SEQ ID NO: 3349549 - DNA, 14 bp, Homo sapiens
tcccacgtgtcttc

SEQ ID NO: 3349550 - DNA, 14 bp, Homo sapiens
tcccactcagtcca

SEQ ID NO: 3349551 - DNA, 23 bp, Homo sapiens
tcccactgcctcaggttcctatg

SEQ ID NO: 3349552 - DNA, 22 bp, Homo sapiens
tcccacttgcaacttctttctg

SEQ ID NO: 3349553 - DNA, 17 bp, Homo sapiens
tcccacttggaggcctt

SEQ ID NO: 3349554 - DNA, 14 bp, Homo sapiens
tcccagagcccgct

SEQ ID NO: 3349555 - DNA, 20 bp, Homo sapiens
tcccagaggagccaccagtt

SEQ ID NO: 3349556 - DNA, 14 bp, Homo sapiens
tcccagaggtccag

SEQ ID NO: 3349557 - DNA, 18 bp, Homo sapiens
tcccagaggtccagccca

SEQ ID NO: 3349558 - DNA, 23 bp, Homo sapiens
tcccagaggtgggatcctccctc

SEQ ID NO: 3349559 - DNA, 20 bp, Homo sapiens
tcccagaggttatctgcctg

SEQ ID NO: 3349560 - DNA, 23 bp, Homo sapiens
tcccagaggttatctgcctggcc

SEQ ID NO: 3349561 - DNA, 17 bp, Homo sapiens
tcccagagtcagaggag

SEQ ID NO: 3349562 - DNA, 12 bp, Homo sapiens
tcccagcacctg

SEQ ID NO: 3349563 - DNA, 15 bp, Homo sapiens
tcccagcactcccct

SEQ ID NO: 3349564 - DNA, 16 bp, Homo sapiens
tcccagcactcccctt

SEQ ID NO: 3349565 - DNA, 19 bp, Homo sapiens
tcccagcactccccttgcc

SEQ ID NO: 3349566 - DNA, 22 bp, Homo sapiens
tcccagcactttgggaggccta

SEQ ID NO: 3349567 - DNA, 18 bp, Homo sapiens
tcccagcagcccaagctt

SEQ ID NO: 3349568 - DNA, 17 bp, Homo sapiens
tcccagcatccctggag

SEQ ID NO: 3349569 - DNA, 19 bp, Homo sapiens
tcccagcatccctggagca

SEQ ID NO: 3349570 - DNA, 14 bp, Homo sapiens
tcccagccaccccg

SEQ ID NO: 3349571 - DNA, 24 bp, Homo sapiens
tcccagccaccccgggctctctgc

SEQ ID NO: 3349572 - DNA, 16 bp, Homo sapiens
tcccagccatgcccag

SEQ ID NO: 3349573 - DNA, 18 bp, Homo sapiens
tcccagccctatggatgt

SEQ ID NO: 3349574 - DNA, 23 bp, Homo sapiens
tcccagccggccaatggaaacct

SEQ ID NO: 3349575 - DNA, 12 bp, Homo sapiens
tcccagcctgcc

SEQ ID NO: 3349576 - DNA, 22 bp, Homo sapiens
tcccagcctgccctccagctgc

SEQ ID NO: 3349577 - DNA, 14 bp, Homo sapiens
tcccagcctgctga

SEQ ID NO: 3349578 - DNA, 22 bp, Homo sapiens
tcccagcctgctgagagccccc

SEQ ID NO: 3349579 - DNA, 15 bp, Homo sapiens
tcccagcctggggct

SEQ ID NO: 3349580 - DNA, 16 bp, Homo sapiens
tcccagcgtgtgtatc

SEQ ID NO: 3349581 - DNA, 17 bp, Homo sapiens
tcccagcgtgtgtatcc

SEQ ID NO: 3349582 - DNA, 16 bp, Homo sapiens
tcccagctactcagaa

SEQ ID NO: 3349583 - DNA, 19 bp, Homo sapiens
tcccagctactcagaagcc

SEQ ID NO: 3349584 - DNA, 16 bp, Homo sapiens
tcccagctactcagga

SEQ ID NO: 3349585 - DNA, 12 bp, Homo sapiens
tcccagctcctt

SEQ ID NO: 3349586 - DNA, 23 bp, Homo sapiens
tcccagctgtgctctggacaggc

SEQ ID NO: 3349587 - DNA, 19 bp, Homo sapiens
tcccagcttgtaggagctg

SEQ ID NO: 3349588 - DNA, 22 bp, Homo sapiens
tcaccctttgctgtgaggctgt

SEQ ID NO: 3349589 - DNA, 20 bp, Homo sapiens
tcaccgcagtcgtcgcacag

SEQ ID NO: 3349590 - DNA, 20 bp, Homo sapiens
tcaccgcccatcagggttct

SEQ ID NO: 3349591 - DNA, 14 bp, Homo sapiens
tcaccgctgggtgg

SEQ ID NO: 3349592 - DNA, 14 bp, Homo sapiens
tcaccggagctttc

SEQ ID NO: 3349593 - DNA, 15 bp, Homo sapiens
tcaccggtcagtgcc

SEQ ID NO: 3349594 - DNA, 15 bp, Homo sapiens
tcaccgtgcagagct

SEQ ID NO: 3349595 - DNA, 16 bp, Homo sapiens
tcaccgtgcagagctg

SEQ ID NO: 3349596 - DNA, 15 bp, Homo sapiens
tcacctagagccaga

SEQ ID NO: 3349597 - DNA, 18 bp, Homo sapiens
tcacctcccgaagccacc

SEQ ID NO: 3349598 - DNA, 12 bp, Homo sapiens
tcacctcctcta

SEQ ID NO: 3349599 - DNA, 12 bp, Homo sapiens
tcacctctatcc

SEQ ID NO: 3349600 - DNA, 13 bp, Homo sapiens
tcacctctctcag

SEQ ID NO: 3349601 - DNA, 16 bp, Homo sapiens
tcacctctctcagagc

SEQ ID NO: 3349602 - DNA, 18 bp, Homo sapiens
tcacctctggactggcta

SEQ ID NO: 3349603 - DNA, 19 bp, Homo sapiens
tcacctctggactggctag

SEQ ID NO: 3349604 - DNA, 13 bp, Homo sapiens
tcacctctgtaat

SEQ ID NO: 3349605 - DNA, 13 bp, Homo sapiens
tcacctctgttaa

SEQ ID NO: 3349606 - DNA, 22 bp, Homo sapiens
tcacctgagcccggatgcttct

SEQ ID NO: 3349607 - DNA, 15 bp, Homo sapiens
tcacctgcaagcccc

SEQ ID NO: 3349608 - DNA, 17 bp, Homo sapiens
tcacctgcaagccccag

SEQ ID NO: 3349609 - DNA, 20 bp, Homo sapiens
tcacctgcaagccccagggc

SEQ ID NO: 3349610 - DNA, 13 bp, Homo sapiens
tcacctgccacca

SEQ ID NO: 3349611 - DNA, 14 bp, Homo sapiens
tcacctgccaccac

SEQ ID NO: 3349612 - DNA, 15 bp, Homo sapiens
tcacctgccaccaca

SEQ ID NO: 3349613 - DNA, 17 bp, Homo sapiens
tcacctgtaaacctgag

SEQ ID NO: 3349614 - DNA, 19 bp, Homo sapiens
tcacctgtaaacctgagtc

SEQ ID NO: 3349615 - DNA, 14 bp, Homo sapiens
tcacctgtgacaaa

SEQ ID NO: 3349616 - DNA, 15 bp, Homo sapiens
tcacctgttatgtat

SEQ ID NO: 3349617 - DNA, 22 bp, Homo sapiens
tcacctgtttttaagctgtttc

SEQ ID NO: 3349618 - DNA, 13 bp, Homo sapiens
tcaccttccaaac

SEQ ID NO: 3349619 - DNA, 12 bp, Homo sapiens
tcaccttcgagt

SEQ ID NO: 3349620 - DNA, 17 bp, Homo sapiens
tcaccttcgagtagaga

SEQ ID NO: 3349621 - DNA, 16 bp, Homo sapiens
tcaccttctttgtaat

SEQ ID NO: 3349622 - DNA, 14 bp, Homo sapiens
tcacctttcccatc

SEQ ID NO: 3349623 - DNA, 14 bp, Homo sapiens
tcacctttgtgtat

SEQ ID NO: 3349624 - DNA, 15 bp, Homo sapiens
tcaccttttcaggaa

SEQ ID NO: 3349625 - DNA, 13 bp, Homo sapiens
tcacgacgctgca

SEQ ID NO: 3349626 - DNA, 16 bp, Homo sapiens
tcacgacgctgcagag

SEQ ID NO: 3349627 - DNA, 16 bp, Homo sapiens
tcacgccactgcacta

SEQ ID NO: 3349628 - DNA, 17 bp, Homo sapiens
tcacgccactgcactcc

SEQ ID NO: 3349629 - DNA, 22 bp, Homo sapiens
tcacgccactgcactccagcct

SEQ ID NO: 3349630 - DNA, 19 bp, Homo sapiens
tcacgcctatgatcccagc

SEQ ID NO: 3349631 - DNA, 16 bp, Homo sapiens
tcacgctccccgcctg

SEQ ID NO: 3349632 - DNA, 21 bp, Homo sapiens
tcacgctggggctctctgaga

SEQ ID NO: 3349633 - DNA, 23 bp, Homo sapiens
tcacgctggggctctctgagact

SEQ ID NO: 3349634 - DNA, 14 bp, Homo sapiens
tcacgctttcctga

SEQ ID NO: 3349635 - DNA, 22 bp, Homo sapiens
tcacgctttcctgaatccaaac

SEQ ID NO: 3349636 - DNA, 23 bp, Homo sapiens
tcacggaccactcgaggcctgca

SEQ ID NO: 3349637 - DNA, 22 bp, Homo sapiens
tcacgggagatttcttgttgct

SEQ ID NO: 3349638 - DNA, 17 bp, Homo sapiens
tcacggggcctccaacc

SEQ ID NO: 3349639 - DNA, 17 bp, Homo sapiens
tcacgtaccccactggg

SEQ ID NO: 3349640 - DNA, 17 bp, Homo sapiens
tcacgtactgtctgatt

SEQ ID NO: 3349641 - DNA, 13 bp, Homo sapiens
tcacgtctgacaa

SEQ ID NO: 3349642 - DNA, 13 bp, Homo sapiens
tcactaaacttta

SEQ ID NO: 3349643 - DNA, 16 bp, Homo sapiens
tcactaacattatatt

SEQ ID NO: 3349644 - DNA, 19 bp, Homo sapiens
tcactaacattatattgca

SEQ ID NO: 3349645 - DNA, 21 bp, Homo sapiens
tcactaacattatattgcaat

SEQ ID NO: 3349646 - DNA, 19 bp, Homo sapiens
tcactaatactaattcatt

SEQ ID NO: 3349647 - DNA, 15 bp, Homo sapiens
tcactactacatctg

SEQ ID NO: 3349648 - DNA, 21 bp, Homo sapiens
tcactagaagaaaagcccatt

SEQ ID NO: 3349649 - DNA, 17 bp, Homo sapiens
tcactaggtaacttatt

SEQ ID NO: 3349650 - DNA, 13 bp, Homo sapiens
tcactatggtatg

SEQ ID NO: 3349651 - DNA, 22 bp, Homo sapiens
tcactatttaaactatgataaa

SEQ ID NO: 3349652 - DNA, 18 bp, Homo sapiens
tcactatttttatttata

SEQ ID NO: 3349653 - DNA, 14 bp, Homo sapiens
tcactcaattgttt

SEQ ID NO: 3349654 - DNA, 14 bp, Homo sapiens
tcactcacattttc

SEQ ID NO: 3349655 - DNA, 19 bp, Homo sapiens
tcactcattgctgagcctc

SEQ ID NO: 3349656 - DNA, 20 bp, Homo sapiens
tcactcattgctgagcctct

SEQ ID NO: 3349657 - DNA, 22 bp, Homo sapiens
tcactcattgctgagcctctgc

SEQ ID NO: 3349658 - DNA, 15 bp, Homo sapiens
tcactcccagcactc

SEQ ID NO: 3349659 - DNA, 20 bp, Homo sapiens
tcactccccaacccccaact

SEQ ID NO: 3349660 - DNA, 14 bp, Homo sapiens
tcactccccaagga

SEQ ID NO: 3349661 - DNA, 17 bp, Homo sapiens
tcactccccaaggaaga

SEQ ID NO: 3349662 - DNA, 15 bp, Homo sapiens
tcactccctccatca

SEQ ID NO: 3349663 - DNA, 11 bp, Homo sapiens
tcactcctgcc

SEQ ID NO: 3349664 - DNA, 20 bp, Homo sapiens
tcactcctgcctccgctggc

SEQ ID NO: 3349665 - DNA, 11 bp, Homo sapiens
tcactcctggg

SEQ ID NO: 3349666 - DNA, 14 bp, Homo sapiens
tcactcggcaccct

SEQ ID NO: 3349667 - DNA, 17 bp, Homo sapiens
tcactctaaaaaacatt

SEQ ID NO: 3349668 - DNA, 15 bp, Homo sapiens
tcactctctgaagat

SEQ ID NO: 3349669 - DNA, 13 bp, Homo sapiens
tcactctgctgct

SEQ ID NO: 3349670 - DNA, 17 bp, Homo sapiens
tcactctgtcagccagc

SEQ ID NO: 3349671 - DNA, 24 bp, Homo sapiens
tcactctgtccctgtccttccctg

SEQ ID NO: 3349672 - DNA, 12 bp, Homo sapiens
tcactctgtcgc

SEQ ID NO: 3349673 - DNA, 16 bp, Homo sapiens
tcactctgtcgcccag

SEQ ID NO: 3349674 - DNA, 17 bp, Homo sapiens
tcactcttattgcccac

SEQ ID NO: 3349675 - DNA, 12 bp, Homo sapiens
tcactctttttt

SEQ ID NO: 3349676 - DNA, 19 bp, Homo sapiens
tcactgaaacaaaaattgt

SEQ ID NO: 3349677 - DNA, 14 bp, Homo sapiens
tcactgaaacatgg

SEQ ID NO: 3349678 - DNA, 23 bp, Homo sapiens
tcactgaacaaactaaaggtgca

SEQ ID NO: 3349679 - DNA, 14 bp, Homo sapiens
tcactgaagacgcc

SEQ ID NO: 3349680 - DNA, 17 bp, Homo sapiens
tcactgacctttgtttc

SEQ ID NO: 3349681 - DNA, 20 bp, Homo sapiens
tcactgagctccccagatct

SEQ ID NO: 3349682 - DNA, 21 bp, Homo sapiens
tcactgagctccccagatctc

SEQ ID NO: 3349683 - DNA, 18 bp, Homo sapiens
tcactgatgggaaaactg

SEQ ID NO: 3349684 - DNA, 21 bp, Homo sapiens
tcactgatgtacaattaaaaa

SEQ ID NO: 3349685 - DNA, 17 bp, Homo sapiens
tcactgcaacctctgcc

SEQ ID NO: 3349686 - DNA, 21 bp, Homo sapiens
tcactgcaacctctgcctccc

SEQ ID NO: 3349687 - DNA, 16 bp, Homo sapiens
tcactgcaaccttcac

SEQ ID NO: 3349688 - DNA, 18 bp, Homo sapiens
tcactgcaagctctgcct

SEQ ID NO: 3349689 - DNA, 20 bp, Homo sapiens
tcactgcacagtgcatctca

SEQ ID NO: 3349690 - DNA, 14 bp, Homo sapiens
tcactgcagcccag

SEQ ID NO: 3349691 - DNA, 15 bp, Homo sapiens
tcactgcagcccagg

SEQ ID NO: 3349692 - DNA, 22 bp, Homo sapiens
tcactgcagcccaggaggcaga

SEQ ID NO: 3349693 - DNA, 15 bp, Homo sapiens
tcactgcagcctcaa

SEQ ID NO: 3349694 - DNA, 17 bp, Homo sapiens
tcactgccactttgcac

SEQ ID NO: 3349695 - DNA, 22 bp, Homo sapiens
tcactgccactttgcacatttt

SEQ ID NO: 3349696 - DNA, 23 bp, Homo sapiens
tcactgccactttgcacattttg

SEQ ID NO: 3349697 - DNA, 18 bp, Homo sapiens
tcactgccaggccagcct

SEQ ID NO: 3349698 - DNA, 20 bp, Homo sapiens
tcactgccaggccagcctcc

SEQ ID NO: 3349699 - DNA, 20 bp, Homo sapiens
tcactgccatgatagctggg

SEQ ID NO: 3349700 - DNA, 12 bp, Homo sapiens
tcactgcccgca

SEQ ID NO: 3349701 - DNA, 18 bp, Homo sapiens
tcactgcccgcacaccct

SEQ ID NO: 3349702 - DNA, 14 bp, Homo sapiens
tcactgctccctga

SEQ ID NO: 3349703 - DNA, 16 bp, Homo sapiens
tcactgctggctgcct

SEQ ID NO: 3349704 - DNA, 10 bp, Homo sapiens
tcactgctgt

SEQ ID NO: 3349705 - DNA, 19 bp, Homo sapiens
tcactgcttgaactaggct

SEQ ID NO: 3349706 - DNA, 15 bp, Homo sapiens
tcactggaaagggga

SEQ ID NO: 3349707 - DNA, 18 bp, Homo sapiens
tcactggaaaggggagag

SEQ ID NO: 3349708 - DNA, 19 bp, Homo sapiens
tcactggaggagcagcttc

SEQ ID NO: 3349709 - DNA, 21 bp, Homo sapiens
tcactggagttacattaatgt

SEQ ID NO: 3349710 - DNA, 22 bp, Homo sapiens
tcactggagttacattaatgtt

SEQ ID NO: 3349711 - DNA, 14 bp, Homo sapiens
tcactggatgaaga

SEQ ID NO: 3349712 - DNA, 19 bp, Homo sapiens
tcactggatgaagattctc

SEQ ID NO: 3349713 - DNA, 16 bp, Homo sapiens
tcactggcaatgaaaa

SEQ ID NO: 3349714 - DNA, 15 bp, Homo sapiens
tcactggctctccaa

SEQ ID NO: 3349715 - DNA, 11 bp, Homo sapiens
tcactggctgg

SEQ ID NO: 3349716 - DNA, 19 bp, Homo sapiens
tcactggctggcctgagca

SEQ ID NO: 3349717 - DNA, 16 bp, Homo sapiens
tcactggctggctcct

SEQ ID NO: 3349718 - DNA, 15 bp, Homo sapiens
tcagctactaatgat

SEQ ID NO: 3349719 - DNA, 20 bp, Homo sapiens
tcagctactaatgatgtttt

SEQ ID NO: 3349720 - DNA, 14 bp, Homo sapiens
tcagctactgattt

SEQ ID NO: 3349721 - DNA, 21 bp, Homo sapiens
tcagctactttccatttggta

SEQ ID NO: 3349722 - DNA, 20 bp, Homo sapiens
tcagctatttactgccaaag

SEQ ID NO: 3349723 - DNA, 14 bp, Homo sapiens
tcagctcaattgtt

SEQ ID NO: 3349724 - DNA, 12 bp, Homo sapiens
tcagctccagct

SEQ ID NO: 3349725 - DNA, 15 bp, Homo sapiens
tcagctccagctcac

SEQ ID NO: 3349726 - DNA, 18 bp, Homo sapiens
tcagctccagctcaccag

SEQ ID NO: 3349727 - DNA, 14 bp, Homo sapiens
tcagctccaggtgg

SEQ ID NO: 3349728 - DNA, 18 bp, Homo sapiens
tcagctccccctgtcccc

SEQ ID NO: 3349729 - DNA, 23 bp, Homo sapiens
tcagctccccctgtcccctcagc

SEQ ID NO: 3349730 - DNA, 14 bp, Homo sapiens
tcagctctcctggc

SEQ ID NO: 3349731 - DNA, 20 bp, Homo sapiens
tcagctctcctggctccctc

SEQ ID NO: 3349732 - DNA, 14 bp, Homo sapiens
tcagctctctggga

SEQ ID NO: 3349733 - DNA, 17 bp, Homo sapiens
tcagctctggagaacag

SEQ ID NO: 3349734 - DNA, 12 bp, Homo sapiens
tcagctcttcca

SEQ ID NO: 3349735 - DNA, 21 bp, Homo sapiens
tcagctgaatgcctcctgtgg

SEQ ID NO: 3349736 - DNA, 23 bp, Homo sapiens
tcagctgaatgcctcctgtgggg

SEQ ID NO: 3349737 - DNA, 17 bp, Homo sapiens
tcagctgagccctgggg

SEQ ID NO: 3349738 - DNA, 15 bp, Homo sapiens
tcagctgcctcactt

SEQ ID NO: 3349739 - DNA, 17 bp, Homo sapiens
tcagctgcctgaaacag

SEQ ID NO: 3349740 - DNA, 22 bp, Homo sapiens
tcagctgcctgaaacagccatg

SEQ ID NO: 3349741 - DNA, 15 bp, Homo sapiens
tcagctgctactact

SEQ ID NO: 3349742 - DNA, 15 bp, Homo sapiens
tcagctgctcagaat

SEQ ID NO: 3349743 - DNA, 18 bp, Homo sapiens
tcagctgctcagaattca

SEQ ID NO: 3349744 - DNA, 19 bp, Homo sapiens
tcagctgctccctggcatt

SEQ ID NO: 3349745 - DNA, 22 bp, Homo sapiens
tcagctggaagtctacctgctg

SEQ ID NO: 3349746 - DNA, 13 bp, Homo sapiens
tcagctggctgta

SEQ ID NO: 3349747 - DNA, 18 bp, Homo sapiens
tcagctggttactcaggg

SEQ ID NO: 3349748 - DNA, 23 bp, Homo sapiens
tcagctgtaagaagagactggga

SEQ ID NO: 3349749 - DNA, 12 bp, Homo sapiens
tcagctgtactt

SEQ ID NO: 3349750 - DNA, 13 bp, Homo sapiens
tcagctgtcctcc

SEQ ID NO: 3349751 - DNA, 17 bp, Homo sapiens
tcagctgtcctccctcc

SEQ ID NO: 3349752 - DNA, 18 bp, Homo sapiens
tcagctgtcctccctcca

SEQ ID NO: 3349753 - DNA, 16 bp, Homo sapiens
tcagctgtttgtcata

SEQ ID NO: 3349754 - DNA, 17 bp, Homo sapiens
tcagcttaaaataaaca

SEQ ID NO: 3349755 - DNA, 19 bp, Homo sapiens
tcagcttatctcttttata

SEQ ID NO: 3349756 - DNA, 20 bp, Homo sapiens
tcagcttatctcttttatat

SEQ ID NO: 3349757 - DNA, 16 bp, Homo sapiens
tcagcttcatttgtgt

SEQ ID NO: 3349758 - DNA, 15 bp, Homo sapiens
tcagcttcccagcca

SEQ ID NO: 3349759 - DNA, 21 bp, Homo sapiens
tcagcttcgtttattttcaag

SEQ ID NO: 3349760 - DNA, 21 bp, Homo sapiens
tcagcttcttcacaggcactc

SEQ ID NO: 3349761 - DNA, 21 bp, Homo sapiens
tcagcttgtaaatagctcagg

SEQ ID NO: 3349762 - DNA, 22 bp, Homo sapiens
tcagcttgtaaatagctcaggt

SEQ ID NO: 3349763 - DNA, 16 bp, Homo sapiens
tcagctttcagagcca

SEQ ID NO: 3349764 - DNA, 19 bp, Homo sapiens
tcagctttcagagccagtg

SEQ ID NO: 3349765 - DNA, 15 bp, Homo sapiens
tcagctttcagggcc

SEQ ID NO: 3349766 - DNA, 23 bp, Homo sapiens
tcagctttgactttatctcctgc

SEQ ID NO: 3349767 - DNA, 15 bp, Homo sapiens
tcagctttgagaagc

SEQ ID NO: 3349768 - DNA, 19 bp, Homo sapiens
tcagctttttgatcctcta

SEQ ID NO: 3349769 - DNA, 16 bp, Homo sapiens
tcaggaaagagattag

SEQ ID NO: 3349770 - DNA, 18 bp, Homo sapiens
tcaggaaatatatatgtg

SEQ ID NO: 3349771 - DNA, 21 bp, Homo sapiens
tcaggaaatatatatgtgtgt

SEQ ID NO: 3349772 - DNA, 18 bp, Homo sapiens
tcaggaacagctatggga

SEQ ID NO: 3349773 - DNA, 17 bp, Homo sapiens
tcaggaacagtggctgg

SEQ ID NO: 3349774 - DNA, 21 bp, Homo sapiens
tcaggaacagtggctgggtgg

SEQ ID NO: 3349775 - DNA, 14 bp, Homo sapiens
tcaggaagaagaga

SEQ ID NO: 3349776 - DNA, 23 bp, Homo sapiens
tcaggaagcccggtggcgtggca

SEQ ID NO: 3349777 - DNA, 17 bp, Homo sapiens
tcaggaatattttccaa

SEQ ID NO: 3349778 - DNA, 18 bp, Homo sapiens
tcaggaatattttccaaa

SEQ ID NO: 3349779 - DNA, 18 bp, Homo sapiens
tcaggaattcagtgcctt

SEQ ID NO: 3349780 - DNA, 18 bp, Homo sapiens
tcaggaattcttggagaa

SEQ ID NO: 3349781 - DNA, 13 bp, Homo sapiens
tcaggaatttaaa

SEQ ID NO: 3349782 - DNA, 16 bp, Homo sapiens
tcaggacaacacttca

SEQ ID NO: 3349783 - DNA, 12 bp, Homo sapiens
tcaggacccagg

SEQ ID NO: 3349784 - DNA, 15 bp, Homo sapiens
tcaggacccaggccc

SEQ ID NO: 3349785 - DNA, 17 bp, Homo sapiens
tcaggacccaggccctc

SEQ ID NO: 3349786 - DNA, 20 bp, Homo sapiens
tcaggacttaacggctccag

SEQ ID NO: 3349787 - DNA, 18 bp, Homo sapiens
tcaggagcacaggcagct

SEQ ID NO: 3349788 - DNA, 15 bp, Homo sapiens
tcaggaggctgaggg

SEQ ID NO: 3349789 - DNA, 14 bp, Homo sapiens
tcaggaggctggag

SEQ ID NO: 3349790 - DNA, 22 bp, Homo sapiens
tcaggagttcgagaccagcctc

SEQ ID NO: 3349791 - DNA, 17 bp, Homo sapiens
tcaggagttgtttctga

SEQ ID NO: 3349792 - DNA, 15 bp, Homo sapiens
tcaggatacatgtgc

SEQ ID NO: 3349793 - DNA, 16 bp, Homo sapiens
tcaggatacatgtgcc

SEQ ID NO: 3349794 - DNA, 23 bp, Homo sapiens
tcaggatatccttatcagagcta

SEQ ID NO: 3349795 - DNA, 23 bp, Homo sapiens
tcaggatattagttaatgagcca

SEQ ID NO: 3349796 - DNA, 20 bp, Homo sapiens
tcaggatcaaaccccgacca

SEQ ID NO: 3349797 - DNA, 17 bp, Homo sapiens
tcaggatcaagaaagtg

SEQ ID NO: 3349798 - DNA, 22 bp, Homo sapiens
tcaggatccaagctaagcactg

SEQ ID NO: 3349799 - DNA, 23 bp, Homo sapiens
tcaggatgcacatttctggattg

SEQ ID NO: 3349800 - DNA, 24 bp, Homo sapiens
tcaggcaagcccctcagcccttgc

SEQ ID NO: 3349801 - DNA, 16 bp, Homo sapiens
tcaggcaccagcatcc

SEQ ID NO: 3349802 - DNA, 20 bp, Homo sapiens
tcaggcaccagcatccacct

SEQ ID NO: 3349803 - DNA, 16 bp, Homo sapiens
tcaggcactggtggca

SEQ ID NO: 3349804 - DNA, 21 bp, Homo sapiens
tcaggcaggaagggcaggaag

SEQ ID NO: 3349805 - DNA, 20 bp, Homo sapiens
tcaggcattggatatttttt

SEQ ID NO: 3349806 - DNA, 18 bp, Homo sapiens
tcaggccaggtgcagtgg

SEQ ID NO: 3349807 - DNA, 16 bp, Homo sapiens
tcaggcccggcagggc

SEQ ID NO: 3349808 - DNA, 11 bp, Homo sapiens
tcaggccctgg

SEQ ID NO: 3349809 - DNA, 16 bp, Homo sapiens
tcaggccgagccaggt

SEQ ID NO: 3349810 - DNA, 20 bp, Homo sapiens
tcaggcgatccacctgtctc

SEQ ID NO: 3349811 - DNA, 16 bp, Homo sapiens
tcaggcgcctggcaca

SEQ ID NO: 3349812 - DNA, 15 bp, Homo sapiens
tcaggctccattagg

SEQ ID NO: 3349813 - DNA, 16 bp, Homo sapiens
tcaggctccattagga

SEQ ID NO: 3349814 - DNA, 13 bp, Homo sapiens
tcaggctctgcac

SEQ ID NO: 3349815 - DNA, 17 bp, Homo sapiens
tcaggctctgcacagac

SEQ ID NO: 3349816 - DNA, 18 bp, Homo sapiens
tcaggctctgcacagaca

SEQ ID NO: 3349817 - DNA, 22 bp, Homo sapiens
tcaggctctgcacagacaagca

SEQ ID NO: 3349818 - DNA, 13 bp, Homo sapiens
tcaggctctgctg

SEQ ID NO: 3349819 - DNA, 16 bp, Homo sapiens
tcaggctcttctcctt

SEQ ID NO: 3349820 - DNA, 17 bp, Homo sapiens
tcaggctgcagaggcac

SEQ ID NO: 3349821 - DNA, 17 bp, Homo sapiens
tcaggctgggcagcccc

SEQ ID NO: 3349822 - DNA, 19 bp, Homo sapiens
tcaggctgggcagccccag

SEQ ID NO: 3349823 - DNA, 21 bp, Homo sapiens
tcaggctgggcagccccagag

SEQ ID NO: 3349824 - DNA, 16 bp, Homo sapiens
tcaggcttgaaatgca

SEQ ID NO: 3349825 - DNA, 13 bp, Homo sapiens
tcagggaccagct

SEQ ID NO: 3349826 - DNA, 17 bp, Homo sapiens
tcagggaccagctttac

SEQ ID NO: 3349827 - DNA, 20 bp, Homo sapiens
tcagggaccggtgctgcagg

SEQ ID NO: 3349828 - DNA, 18 bp, Homo sapiens
tcagggagaaactccaaa

SEQ ID NO: 3349829 - DNA, 13 bp, Homo sapiens
tcagggagtgctg

SEQ ID NO: 3349830 - DNA, 17 bp, Homo sapiens
tcagggagtgctggctc

SEQ ID NO: 3349831 - DNA, 19 bp, Homo sapiens
tcagggcacgcaggaccag

SEQ ID NO: 3349832 - DNA, 19 bp, Homo sapiens
tcagggccagaaggagggc

SEQ ID NO: 3349833 - DNA, 21 bp, Homo sapiens
tcagggccagaaggagggcag

SEQ ID NO: 3349834 - DNA, 23 bp, Homo sapiens
tcagggccagaaggagggcagag

SEQ ID NO: 3349835 - DNA, 15 bp, Homo sapiens
tcagggccagactgg

SEQ ID NO: 3349836 - DNA, 18 bp, Homo sapiens
tcagggccagactggaag

SEQ ID NO: 3349837 - DNA, 13 bp, Homo sapiens
tcagggccaggaa

SEQ ID NO: 3349838 - DNA, 14 bp, Homo sapiens
tcagggccaggaag

SEQ ID NO: 3349839 - DNA, 18 bp, Homo sapiens
tcagggccatgctgaggc

SEQ ID NO: 3349840 - DNA, 14 bp, Homo sapiens
tcagggcccaagtc

SEQ ID NO: 3349841 - DNA, 17 bp, Homo sapiens
tcagggcccagaggctg

SEQ ID NO: 3349842 - DNA, 21 bp, Homo sapiens
tcagggcctggggcctgagag

SEQ ID NO: 3349843 - DNA, 13 bp, Homo sapiens
tcagggcgctcag

SEQ ID NO: 3349844 - DNA, 14 bp, Homo sapiens
tcagggctcccagg

SEQ ID NO: 3349845 - DNA, 18 bp, Homo sapiens
tcagggctcctcccagct

SEQ ID NO: 3349846 - DNA, 12 bp, Homo sapiens
tcagggctggag

SEQ ID NO: 3349847 - DNA, 23 bp, Homo sapiens
tcagggctggagtgcgctcttgg

SEQ ID NO: 3349848 - DNA, 16 bp, Homo sapiens
tcaggggactcagccc

SEQ ID NO: 3349849 - DNA, 16 bp, Homo sapiens
tcaggggatgggtgtg

SEQ ID NO: 3349850 - DNA, 12 bp, Homo sapiens
tcaggggccaga

SEQ ID NO: 3349851 - DNA, 14 bp, Homo sapiens
tcaggggccagagg

SEQ ID NO: 3349852 - DNA, 18 bp, Homo sapiens
tcaggggctgtttgagga

SEQ ID NO: 3349853 - DNA, 22 bp, Homo sapiens
tcaggggttcgagaccagtctg

SEQ ID NO: 3349854 - DNA, 17 bp, Homo sapiens
tcagggtaaataggaat

SEQ ID NO: 3349855 - DNA, 14 bp, Homo sapiens
tcagggttcatctg

SEQ ID NO: 3349856 - DNA, 19 bp, Homo sapiens
tcagggttggcccctgccc

SEQ ID NO: 3349857 - DNA, 23 bp, Homo sapiens
tcagggttggcccctgcccggct

SEQ ID NO: 3349858 - DNA, 15 bp, Homo sapiens
tcaggtaacaggcag

SEQ ID NO: 3349859 - DNA, 23 bp, Homo sapiens
tcaggtaacaggcagatacagga

SEQ ID NO: 3349860 - DNA, 17 bp, Homo sapiens
tcaggtacggagaagaa

SEQ ID NO: 3349861 - DNA, 13 bp, Homo sapiens
tcaggtaggccct

SEQ ID NO: 3349862 - DNA, 17 bp, Homo sapiens
tcaggtcagggacttgg

SEQ ID NO: 3349863 - DNA, 19 bp, Homo sapiens
tcaggtctcccacgtggga

SEQ ID NO: 3349864 - DNA, 17 bp, Homo sapiens
tcaggtgaaaatgttca

SEQ ID NO: 3349865 - DNA, 17 bp, Homo sapiens
tcaggtgacatgtgaaa

SEQ ID NO: 3349866 - DNA, 21 bp, Homo sapiens
tcaggtgacatgtgaaacctt

SEQ ID NO: 3349867 - DNA, 19 bp, Homo sapiens
tcaggtgatttgtatgctc

SEQ ID NO: 3349868 - DNA, 15 bp, Homo sapiens
tcaggtgctgccatc

SEQ ID NO: 3349869 - DNA, 16 bp, Homo sapiens
tcaggtggggcagctt

SEQ ID NO: 3349870 - DNA, 15 bp, Homo sapiens
tcaggtgtccctgca

SEQ ID NO: 3349871 - DNA, 17 bp, Homo sapiens
tcaggtgtccctgcact

SEQ ID NO: 3349872 - DNA, 18 bp, Homo sapiens
tcaggttatcgaaataac

SEQ ID NO: 3349873 - DNA, 15 bp, Homo sapiens
tcaggttgctggttg

SEQ ID NO: 3349874 - DNA, 19 bp, Homo sapiens
tcaggttgctggttgctgt

SEQ ID NO: 3349875 - DNA, 15 bp, Homo sapiens
tcaggtttaacattt

SEQ ID NO: 3349876 - DNA, 19 bp, Homo sapiens
tcaggtttgtcatcagatg

SEQ ID NO: 3349877 - DNA, 15 bp, Homo sapiens
tcaggtttgttttgt

SEQ ID NO: 3349878 - DNA, 17 bp, Homo sapiens
tcagtaacatttctgtt

SEQ ID NO: 3349879 - DNA, 21 bp, Homo sapiens
tcagtaacccccttaaattta

SEQ ID NO: 3349880 - DNA, 22 bp, Homo sapiens
tcagtaacccccttaaatttaa

SEQ ID NO: 3349881 - DNA, 19 bp, Homo sapiens
tcagtaagaaaaagaagaa

SEQ ID NO: 3349882 - DNA, 19 bp, Homo sapiens
tcagtaataaactgtgttt

SEQ ID NO: 3349883 - DNA, 17 bp, Homo sapiens
tcagtaatttgaggaca

SEQ ID NO: 3349884 - DNA, 18 bp, Homo sapiens
tcagtaatttgaggacaa

SEQ ID NO: 3349885 - DNA, 20 bp, Homo sapiens
tcagtacacttggtgtactg

SEQ ID NO: 3349886 - DNA, 22 bp, Homo sapiens
tcagtacccctggtaaaccaag

SEQ ID NO: 3349887 - DNA, 17 bp, Homo sapiens
tcagtaccctctcagct

SEQ ID NO: 3349888 - DNA, 16 bp, Homo sapiens
tcagtactcaaattca

SEQ ID NO: 3349889 - DNA, 14 bp, Homo sapiens
tcactgggtgttga

SEQ ID NO: 3349890 - DNA, 20 bp, Homo sapiens
tcactggtagaccaaaataa

SEQ ID NO: 3349891 - DNA, 16 bp, Homo sapiens
tcactggttttactta

SEQ ID NO: 3349892 - DNA, 21 bp, Homo sapiens
tcactgtagaatgatttcatg

SEQ ID NO: 3349893 - DNA, 18 bp, Homo sapiens
tcactgtataaacttttt

SEQ ID NO: 3349894 - DNA, 14 bp, Homo sapiens
tcactgtataaata

SEQ ID NO: 3349895 - DNA, 24 bp, Homo sapiens
tcactgtataaataggagaggatg

SEQ ID NO: 3349896 - DNA, 23 bp, Homo sapiens
tcactgtcaatgattattttcat

SEQ ID NO: 3349897 - DNA, 20 bp, Homo sapiens
tcactgtctttaattctgta

SEQ ID NO: 3349898 - DNA, 14 bp, Homo sapiens
tcactgtgcactgc

SEQ ID NO: 3349899 - DNA, 16 bp, Homo sapiens
tcactgtgcactgccc

SEQ ID NO: 3349900 - DNA, 18 bp, Homo sapiens
tcactgtgcactgccctg

SEQ ID NO: 3349901 - DNA, 11 bp, Homo sapiens
tcactgtgctt

SEQ ID NO: 3349902 - DNA, 22 bp, Homo sapiens
tcactgtgcttattttgtttca

SEQ ID NO: 3349903 - DNA, 20 bp, Homo sapiens
tcactgtggccacagccccc

SEQ ID NO: 3349904 - DNA, 19 bp, Homo sapiens
tcactgtgtcacccagact

SEQ ID NO: 3349905 - DNA, 22 bp, Homo sapiens
tcactgttagctttttaaaaca

SEQ ID NO: 3349906 - DNA, 17 bp, Homo sapiens
tcactgttccctctgct

SEQ ID NO: 3349907 - DNA, 17 bp, Homo sapiens
tcactgttccctctggc

SEQ ID NO: 3349908 - DNA, 12 bp, Homo sapiens
tcactgttctgc

SEQ ID NO: 3349909 - DNA, 14 bp, Homo sapiens
tcactgttctgcaa

SEQ ID NO: 3349910 - DNA, 19 bp, Homo sapiens
tcactgttgaaaattattt

SEQ ID NO: 3349911 - DNA, 20 bp, Homo sapiens
tcactgttgaaaattatttt

SEQ ID NO: 3349912 - DNA, 14 bp, Homo sapiens
tcactgttgcccag

SEQ ID NO: 3349913 - DNA, 22 bp, Homo sapiens
tcactgtttttagacaccttca

SEQ ID NO: 3349914 - DNA, 17 bp, Homo sapiens
tcacttacctagattta

SEQ ID NO: 3349915 - DNA, 16 bp, Homo sapiens
tcacttactgtttctg

SEQ ID NO: 3349916 - DNA, 19 bp, Homo sapiens
tcacttactgtttctgtca

SEQ ID NO: 3349917 - DNA, 14 bp, Homo sapiens
tcacttcatgtttt

SEQ ID NO: 3349918 - DNA, 16 bp, Homo sapiens
tcacttcatgttttgt

SEQ ID NO: 3349919 - DNA, 18 bp, Homo sapiens
tcacttccatacagctct

SEQ ID NO: 3349920 - DNA, 16 bp, Homo sapiens
tcacttctaaatgcat

SEQ ID NO: 3349921 - DNA, 22 bp, Homo sapiens
tcacttgaggtcaggagttcct

SEQ ID NO: 3349922 - DNA, 14 bp, Homo sapiens
tcacttgatgatac

SEQ ID NO: 3349923 - DNA, 11 bp, Homo sapiens
tcacttgtatt

SEQ ID NO: 3349924 - DNA, 17 bp, Homo sapiens
tcacttgtattgacttt

SEQ ID NO: 3349925 - DNA, 13 bp, Homo sapiens
tcacttgtgcttt

SEQ ID NO: 3349926 - DNA, 18 bp, Homo sapiens
tcacttgtgctttgctct

SEQ ID NO: 3349927 - DNA, 20 bp, Homo sapiens
tcactttaaagcaattgcat

SEQ ID NO: 3349928 - DNA, 18 bp, Homo sapiens
tcactttccaccaagtgt

SEQ ID NO: 3349929 - DNA, 14 bp, Homo sapiens
tcactttctcagtt

SEQ ID NO: 3349930 - DNA, 13 bp, Homo sapiens
tcactttgtctaa

SEQ ID NO: 3349931 - DNA, 22 bp, Homo sapiens
tcacttttagggagagtcatat

SEQ ID NO: 3349932 - DNA, 14 bp, Homo sapiens
tcacttttcatcct

SEQ ID NO: 3349933 - DNA, 13 bp, Homo sapiens
tcacttttcatct

SEQ ID NO: 3349934 - DNA, 20 bp, Homo sapiens
tcactttttaaaccactgta

SEQ ID NO: 3349935 - DNA, 22 bp, Homo sapiens
tcactttttgaactaagaaact

SEQ ID NO: 3349936 - DNA, 20 bp, Homo sapiens
tcactttttttttttttccc

SEQ ID NO: 3349937 - DNA, 23 bp, Homo sapiens
tcagaaaacaacttggcatttct

SEQ ID NO: 3349938 - DNA, 14 bp, Homo sapiens
tcagaaaacagaga

SEQ ID NO: 3349939 - DNA, 22 bp, Homo sapiens
tcagaaaactttaaaaaatatt

SEQ ID NO: 3349940 - DNA, 17 bp, Homo sapiens
tcagaaaagaaaaccat

SEQ ID NO: 3349941 - DNA, 14 bp, Homo sapiens
tcagaaaagggaag

SEQ ID NO: 3349942 - DNA, 21 bp, Homo sapiens
tcagaaaagtaattttgtcac

SEQ ID NO: 3349943 - DNA, 22 bp, Homo sapiens
tcagaaaagtaattttgtcaca

SEQ ID NO: 3349944 - DNA, 18 bp, Homo sapiens
tcagaaaatgttctgttt

SEQ ID NO: 3349945 - DNA, 13 bp, Homo sapiens
tcagaaaccagtt

SEQ ID NO: 3349946 - DNA, 20 bp, Homo sapiens
tcagaaacccggcttcctgt

SEQ ID NO: 3349947 - DNA, 13 bp, Homo sapiens
tcagaaagacttg

SEQ ID NO: 3349948 - DNA, 23 bp, Homo sapiens
tcagaaagtgcctgacacactaa

SEQ ID NO: 3349949 - DNA, 12 bp, Homo sapiens
tcagaaatatgt

SEQ ID NO: 3349950 - DNA, 18 bp, Homo sapiens
tcagaaattggaacagaa

SEQ ID NO: 3349951 - DNA, 16 bp, Homo sapiens
tcagaacaatccgatt

SEQ ID NO: 3349952 - DNA, 14 bp, Homo sapiens
tcagaacacacaga

SEQ ID NO: 3349953 - DNA, 21 bp, Homo sapiens
tcagaacacacagactttctg

SEQ ID NO: 3349954 - DNA, 18 bp, Homo sapiens
tcagaacattcagctctg

SEQ ID NO: 3349955 - DNA, 22 bp, Homo sapiens
tcagaacattcagctctggaga

SEQ ID NO: 3349956 - DNA, 16 bp, Homo sapiens
tcagaacccagggctc

SEQ ID NO: 3349957 - DNA, 17 bp, Homo sapiens
tcagaactgcagggcct

SEQ ID NO: 3349958 - DNA, 12 bp, Homo sapiens
tcagaactgccc

SEQ ID NO: 3349959 - DNA, 16 bp, Homo sapiens
tcagaactgcccttgc

SEQ ID NO: 3349960 - DNA, 14 bp, Homo sapiens
tcagaagaaataaa

SEQ ID NO: 3349961 - DNA, 14 bp, Homo sapiens
tcagaagacactga

SEQ ID NO: 3349962 - DNA, 14 bp, Homo sapiens
tcagaagataactt

SEQ ID NO: 3349963 - DNA, 15 bp, Homo sapiens
tcagaagtcatcttg

SEQ ID NO: 3349964 - DNA, 15 bp, Homo sapiens
tcagaataaggcagg

SEQ ID NO: 3349965 - DNA, 21 bp, Homo sapiens
tcagaatagccacatttggaa

SEQ ID NO: 3349966 - DNA, 23 bp, Homo sapiens
tcagaatagccacatttggaata

SEQ ID NO: 3349967 - DNA, 20 bp, Homo sapiens
tcagaatataacatgtaaaa

SEQ ID NO: 3349968 - DNA, 17 bp, Homo sapiens
tcagaatattaataaaa

SEQ ID NO: 3349969 - DNA, 20 bp, Homo sapiens
tcagaattaaacttttaatt

SEQ ID NO: 3349970 - DNA, 23 bp, Homo sapiens
tcagaattaaacttttaattcat

SEQ ID NO: 3349971 - DNA, 10 bp, Homo sapiens
tcagaattct

SEQ ID NO: 3349972 - DNA, 21 bp, Homo sapiens
tcagaattgatcattttcccc

SEQ ID NO: 3349973 - DNA, 19 bp, Homo sapiens
tcagaatttatctccctta

SEQ ID NO: 3349974 - DNA, 11 bp, Homo sapiens
tcagacaagca

SEQ ID NO: 3349975 - DNA, 13 bp, Homo sapiens
tcagacaagcact

SEQ ID NO: 3349976 - DNA, 14 bp, Homo sapiens
tcagacaagcacta

SEQ ID NO: 3349977 - DNA, 20 bp, Homo sapiens
tcagacactaaatgcagaca

SEQ ID NO: 3349978 - DNA, 14 bp, Homo sapiens
tcagacactttgga

SEQ ID NO: 3349979 - DNA, 18 bp, Homo sapiens
tcagacagaacccctaca

SEQ ID NO: 3349980 - DNA, 22 bp, Homo sapiens
tcagacagagaggactgtaggg

SEQ ID NO: 3349981 - DNA, 19 bp, Homo sapiens
tcagacagatgtcagcttc

SEQ ID NO: 3349982 - DNA, 20 bp, Homo sapiens
tcagacagatgtcagcttcc

SEQ ID NO: 3349983 - DNA, 15 bp, Homo sapiens
tcagacatgttttcc

SEQ ID NO: 3349984 - DNA, 21 bp, Homo sapiens
tcagaccccaggtcagcatct

SEQ ID NO: 3349985 - DNA, 22 bp, Homo sapiens
tcagaccccagttctaggggag

SEQ ID NO: 3349986 - DNA, 14 bp, Homo sapiens
tcagacccctgcct

SEQ ID NO: 3349987 - DNA, 21 bp, Homo sapiens
tcagacctagcagggaaggtg

SEQ ID NO: 3349988 - DNA, 13 bp, Homo sapiens
tcagacggcggcc

SEQ ID NO: 3349989 - DNA, 17 bp, Homo sapiens
tcagacggcggccaggc

SEQ ID NO: 3349990 - DNA, 23 bp, Homo sapiens
tcagacggcggccaggcacaggg

SEQ ID NO: 3349991 - DNA, 20 bp, Homo sapiens
tcagactctcagcccagaag

SEQ ID NO: 3349992 - DNA, 21 bp, Homo sapiens
tcagactctcagcccagaaga

SEQ ID NO: 3349993 - DNA, 14 bp, Homo sapiens
tcagactgcatgta

SEQ ID NO: 3349994 - DNA, 17 bp, Homo sapiens
tcagactgctgggactg

SEQ ID NO: 3349995 - DNA, 16 bp, Homo sapiens
tcagactttaaagaat

SEQ ID NO: 3349996 - DNA, 20 bp, Homo sapiens
tcagagaaggaaaagactga

SEQ ID NO: 3349997 - DNA, 21 bp, Homo sapiens
tcagagaaggaaaagactgaa

SEQ ID NO: 3349998 - DNA, 12 bp, Homo sapiens
tcagagaatttc

SEQ ID NO: 3349999 - DNA, 13 bp, Homo sapiens
tcagagaatttct

SEQ ID NO: 3350000 - DNA, 21 bp, Homo sapiens
tcagagacaaaatatttccca

SEQ ID NO: 3350001 - DNA, 22 bp, Homo sapiens
tcagagacaaaatatttcccat

SEQ ID NO: 3350002 - DNA, 15 bp, Homo sapiens
tcagagacagctgat

SEQ ID NO: 3350003 - DNA, 17 bp, Homo sapiens
tcagagacctgaagtgt

SEQ ID NO: 3350004 - DNA, 20 bp, Homo sapiens
tcagagacggcagaaaacag

SEQ ID NO: 3350005 - DNA, 12 bp, Homo sapiens
tcagagagcagc

SEQ ID NO: 3350006 - DNA, 22 bp, Homo sapiens
tcagagaggccttttggaatgt

SEQ ID NO: 3350007 - DNA, 15 bp, Homo sapiens
tcagagagtgtacat

SEQ ID NO: 3350008 - DNA, 16 bp, Homo sapiens
tcagagagtgtacatc

SEQ ID NO: 3350009 - DNA, 23 bp, Homo sapiens
tcagagatggtaatctacagctc

SEQ ID NO: 3350010 - DNA, 15 bp, Homo sapiens
tcagagcactcccta

SEQ ID NO: 3350011 - DNA, 15 bp, Homo sapiens
tcagagcagagcaaa

SEQ ID NO: 3350012 - DNA, 14 bp, Homo sapiens
tcagagcaggacct

SEQ ID NO: 3350013 - DNA, 18 bp, Homo sapiens
tcagagcaggacctccct

SEQ ID NO: 3350014 - DNA, 21 bp, Homo sapiens
tcagagcaggacctcccttcc

SEQ ID NO: 3350015 - DNA, 15 bp, Homo sapiens
tcagagcaggagcat

SEQ ID NO: 3350016 - DNA, 14 bp, Homo sapiens
tcagagcatgtgtc

SEQ ID NO: 3350017 - DNA, 17 bp, Homo sapiens
tcagagcatttaaggaa

SEQ ID NO: 3350018 - DNA, 15 bp, Homo sapiens
tcagagccagtgaag

SEQ ID NO: 3350019 - DNA, 17 bp, Homo sapiens
tcagagcccccagccct

SEQ ID NO: 3350020 - DNA, 20 bp, Homo sapiens
tcagagcccccagccctggg

SEQ ID NO: 3350021 - DNA, 18 bp, Homo sapiens
tcagagcccctacagcat

SEQ ID NO: 3350022 - DNA, 16 bp, Homo sapiens
tcagagccctggctgg

SEQ ID NO: 3350023 - DNA, 18 bp, Homo sapiens
tcagagccctggctgggt

SEQ ID NO: 3350024 - DNA, 19 bp, Homo sapiens
tcagagccctggctgggtt

SEQ ID NO: 3350025 - DNA, 20 bp, Homo sapiens
tcagagccctggctgggttc

SEQ ID NO: 3350026 - DNA, 16 bp, Homo sapiens
tcagagctcttaatgt

SEQ ID NO: 3350027 - DNA, 22 bp, Homo sapiens
tcagagctcttcaagctgtccc

SEQ ID NO: 3350028 - DNA, 13 bp, Homo sapiens
tcagaggagctct

SEQ ID NO: 3350029 - DNA, 21 bp, Homo sapiens
tcagaggagtgattgaaccag

SEQ ID NO: 3350030 - DNA, 14 bp, Homo sapiens
tcagaggatggcca

SEQ ID NO: 3350031 - DNA, 18 bp, Homo sapiens
tcagaggatggccagtgt

SEQ ID NO: 3350032 - DNA, 19 bp, Homo sapiens
tcagaggatggccagtgtc

SEQ ID NO: 3350033 - DNA, 22 bp, Homo sapiens
tcagaggcagcttcaagtgcct

SEQ ID NO: 3350034 - DNA, 18 bp, Homo sapiens
tcagaggcctgctgccag

SEQ ID NO: 3350035 - DNA, 16 bp, Homo sapiens
tcagaggcgtgctggt

SEQ ID NO: 3350036 - DNA, 20 bp, Homo sapiens
tcagaggctgggagcatagc

SEQ ID NO: 3350037 - DNA, 18 bp, Homo sapiens
tcagaggtagggctgcca

SEQ ID NO: 3350038 - DNA, 16 bp, Homo sapiens
tcagaggtgtacacta

SEQ ID NO: 3350039 - DNA, 23 bp, Homo sapiens
tcagaggtttacctagagaacag

SEQ ID NO: 3350040 - DNA, 19 bp, Homo sapiens
tcagagtccactgtggcac

SEQ ID NO: 3350041 - DNA, 19 bp, Homo sapiens
tcagagtcctcattataaa

SEQ ID NO: 3350042 - DNA, 18 bp, Homo sapiens
tcagagtccttaaaatgt

SEQ ID NO: 3350043 - DNA, 16 bp, Homo sapiens
tcagagtctataacag

SEQ ID NO: 3350044 - DNA, 13 bp, Homo sapiens
tcagagtgccact

SEQ ID NO: 3350045 - DNA, 21 bp, Homo sapiens
tcagagttgctgcaaacctga

SEQ ID NO: 3350046 - DNA, 20 bp, Homo sapiens
tcagagttgtacactgtgta

SEQ ID NO: 3350047 - DNA, 20 bp, Homo sapiens
tcagagtttgtgtgtatttg

SEQ ID NO: 3350048 - DNA, 12 bp, Homo sapiens
tcagatacatca

SEQ ID NO: 3350049 - DNA, 14 bp, Homo sapiens
tcagatacatcact

SEQ ID NO: 3350050 - DNA, 16 bp, Homo sapiens
tcagatacatcactgc

SEQ ID NO: 3350051 - DNA, 19 bp, Homo sapiens
tcagatacatcactgcttg

SEQ ID NO: 3350052 - DNA, 21 bp, Homo sapiens
tcagatacatcactgcttgat

SEQ ID NO: 3350053 - DNA, 13 bp, Homo sapiens
tcagatatttata

SEQ ID NO: 3350054 - DNA, 18 bp, Homo sapiens
tcagatcggccacagggc

SEQ ID NO: 3350055 - DNA, 14 bp, Homo sapiens
tcagatctgaacac

SEQ ID NO: 3350056 - DNA, 21 bp, Homo sapiens
tcagatgaactcttagaaatg

SEQ ID NO: 3350057 - DNA, 21 bp, Homo sapiens
tcagatgagaacaaagctgtt

SEQ ID NO: 3350058 - DNA, 15 bp, Homo sapiens
tcagatgaggacaga

SEQ ID NO: 3350059 - DNA, 15 bp, Homo sapiens
tcagatgcaggttgg

SEQ ID NO: 3350060 - DNA, 21 bp, Homo sapiens
tcagatgcgtgcccagctctt

SEQ ID NO: 3350061 - DNA, 12 bp, Homo sapiens
tcagatggaaaa

SEQ ID NO: 3350062 - DNA, 20 bp, Homo sapiens
tcagatgggaggaaagagag

SEQ ID NO: 3350063 - DNA, 13 bp, Homo sapiens
tcagatgtcttct

SEQ ID NO: 3350064 - DNA, 16 bp, Homo sapiens
tcagatgtcttctgcc

SEQ ID NO: 3350065 - DNA, 20 bp, Homo sapiens
tcagatgtcttctgcctgtt

SEQ ID NO: 3350066 - DNA, 16 bp, Homo sapiens
tcagatgttaaaataa

SEQ ID NO: 3350067 - DNA, 17 bp, Homo sapiens
tcagatgttaaaataaa

SEQ ID NO: 3350068 - DNA, 18 bp, Homo sapiens
tcagatgttaaaataaat

SEQ ID NO: 3350069 - DNA, 14 bp, Homo sapiens
tcagattaaattac

SEQ ID NO: 3350070 - DNA, 19 bp, Homo sapiens
tcagattcccagagcaaaa

SEQ ID NO: 3350071 - DNA, 14 bp, Homo sapiens
tcagattgctggga

SEQ ID NO: 3350072 - DNA, 14 bp, Homo sapiens
tcagattgtcttgc

SEQ ID NO: 3350073 - DNA, 16 bp, Homo sapiens
tcagattgtcttgcaa

SEQ ID NO: 3350074 - DNA, 19 bp, Homo sapiens
tcagatttctggttgttat

SEQ ID NO: 3350075 - DNA, 17 bp, Homo sapiens
tcagatttttaaagttt

SEQ ID NO: 3350076 - DNA, 20 bp, Homo sapiens
tcagcaaaccatttttaaag

SEQ ID NO: 3350077 - DNA, 15 bp, Homo sapiens
tcagcaaactctttt

SEQ ID NO: 3350078 - DNA, 21 bp, Homo sapiens
tcagcaacctttcacctttgt

SEQ ID NO: 3350079 - DNA, 21 bp, Homo sapiens
tcagcaagttagaactagcca

SEQ ID NO: 3350080 - DNA, 14 bp, Homo sapiens
tcagcaccccttcc

SEQ ID NO: 3350081 - DNA, 14 bp, Homo sapiens
tcagcaccctgggt

SEQ ID NO: 3350082 - DNA, 16 bp, Homo sapiens
tcagcaccctgggtgc

SEQ ID NO: 3350083 - DNA, 23 bp, Homo sapiens
tcagcaccctgggtgccattccc

SEQ ID NO: 3350084 - DNA, 16 bp, Homo sapiens
tcagcactcagaaaag

SEQ ID NO: 3350085 - DNA, 11 bp, Homo sapiens
tcagcactgaa

SEQ ID NO: 3350086 - DNA, 17 bp, Homo sapiens
tcagcactgatttcaca

SEQ ID NO: 3350087 - DNA, 20 bp, Homo sapiens
tcagcactgatttcacaaca

SEQ ID NO: 3350088 - DNA, 20 bp, Homo sapiens
tcagcacttaactatgagcc

SEQ ID NO: 3350089 - DNA, 18 bp, Homo sapiens
tcagcagcaaattttcag

SEQ ID NO: 3350090 - DNA, 15 bp, Homo sapiens
tcagcagcagctctg

SEQ ID NO: 3350091 - DNA, 16 bp, Homo sapiens
tcagcagcagctctga

SEQ ID NO: 3350092 - DNA, 13 bp, Homo sapiens
tcagcagtgacca

SEQ ID NO: 3350093 - DNA, 17 bp, Homo sapiens
tcagcagttgacatcca

SEQ ID NO: 3350094 - DNA, 15 bp, Homo sapiens
tcagcatcctggcac

SEQ ID NO: 3350095 - DNA, 23 bp, Homo sapiens
tcagcatctaaagcagcaggtct

SEQ ID NO: 3350096 - DNA, 17 bp, Homo sapiens
tcagcatctgtgatggg

SEQ ID NO: 3350097 - DNA, 13 bp, Homo sapiens
tcagcatgaaaat

SEQ ID NO: 3350098 - DNA, 15 bp, Homo sapiens
tcagcatgcttccca

SEQ ID NO: 3350099 - DNA, 17 bp, Homo sapiens
tcagcatgcttcccaga

SEQ ID NO: 3350100 - DNA, 19 bp, Homo sapiens
tcagcatgcttcccagagg

SEQ ID NO: 3350101 - DNA, 22 bp, Homo sapiens
tcagcatgcttcccagagggag

SEQ ID NO: 3350102 - DNA, 22 bp, Homo sapiens
tcagcatgtccaacatggtaat

SEQ ID NO: 3350103 - DNA, 23 bp, Homo sapiens
tcagccaaatgtaattgaataaa

SEQ ID NO: 3350104 - DNA, 22 bp, Homo sapiens
tcagccaaggttttataaggct

SEQ ID NO: 3350105 - DNA, 19 bp, Homo sapiens
tcagccacgaccagcccct

SEQ ID NO: 3350106 - DNA, 22 bp, Homo sapiens
tcagccagcccatggcccccaa

SEQ ID NO: 3350107 - DNA, 15 bp, Homo sapiens
tcagccagccgccct

SEQ ID NO: 3350108 - DNA, 19 bp, Homo sapiens
tcagccagccgccctgggc

SEQ ID NO: 3350109 - DNA, 19 bp, Homo sapiens
tcagccaggagctgtcacc

SEQ ID NO: 3350110 - DNA, 18 bp, Homo sapiens
tcagccagtgaatctgtt

SEQ ID NO: 3350111 - DNA, 16 bp, Homo sapiens
tcagccagtggggatg

SEQ ID NO: 3350112 - DNA, 20 bp, Homo sapiens
tcagccatcgtcctgggact

SEQ ID NO: 3350113 - DNA, 17 bp, Homo sapiens
tcagccatttttaatga

SEQ ID NO: 3350114 - DNA, 20 bp, Homo sapiens
tcagcccacctgcacccagg

SEQ ID NO: 3350115 - DNA, 15 bp, Homo sapiens
tcagcccagaagaaa

SEQ ID NO: 3350116 - DNA, 18 bp, Homo sapiens
tcagcccccagcccctcc

SEQ ID NO: 3350117 - DNA, 16 bp, Homo sapiens
tcagcccccaggccag

SEQ ID NO: 3350118 - DNA, 14 bp, Homo sapiens
tcagcccctaggag

SEQ ID NO: 3350119 - DNA, 16 bp, Homo sapiens
tcagcccctaggagta

SEQ ID NO: 3350120 - DNA, 16 bp, Homo sapiens
tcagccctccctgccc

SEQ ID NO: 3350121 - DNA, 18 bp, Homo sapiens
tcagccgagccgggcctg

SEQ ID NO: 3350122 - DNA, 22 bp, Homo sapiens
tcagccgagccgggcctggggc

SEQ ID NO: 3350123 - DNA, 12 bp, Homo sapiens
tcagcctcccaa

SEQ ID NO: 3350124 - DNA, 20 bp, Homo sapiens
tcagcctcccaagtagctgg

SEQ ID NO: 3350125 - DNA, 12 bp, Homo sapiens
tcagcctcccga

SEQ ID NO: 3350126 - DNA, 20 bp, Homo sapiens
tcagcctcccgaatagctgg

SEQ ID NO: 3350127 - DNA, 21 bp, Homo sapiens
tcagcctcccgaatagctggg

SEQ ID NO: 3350128 - DNA, 13 bp, Homo sapiens
tcagcctcctgag

SEQ ID NO: 3350129 - DNA, 15 bp, Homo sapiens
tcagcctcctgagcc

SEQ ID NO: 3350130 - DNA, 21 bp, Homo sapiens
tcagcctctcaagtagctggg

SEQ ID NO: 3350131 - DNA, 22 bp, Homo sapiens
tcagcctcttaaagctgcctgt

SEQ ID NO: 3350132 - DNA, 10 bp, Homo sapiens
tcagcctgag

SEQ ID NO: 3350133 - DNA, 15 bp, Homo sapiens
tcagcctgagtctcc

SEQ ID NO: 3350134 - DNA, 16 bp, Homo sapiens
tcagcctgctgcccag

SEQ ID NO: 3350135 - DNA, 19 bp, Homo sapiens
tcagcctgtgctgtggcat

SEQ ID NO: 3350136 - DNA, 17 bp, Homo sapiens
tcagccttaagaaccat

SEQ ID NO: 3350137 - DNA, 15 bp, Homo sapiens
tcagccttacatttg

SEQ ID NO: 3350138 - DNA, 24 bp, Homo sapiens
tcagccttccccctcccagggcca

SEQ ID NO: 3350139 - DNA, 17 bp, Homo sapiens
tcagcgaagtctcatgg

SEQ ID NO: 3350140 - DNA, 16 bp, Homo sapiens
tcagcgctcctcctgt

SEQ ID NO: 3350141 - DNA, 19 bp, Homo sapiens
tcagcgctcctcctgtgtg

SEQ ID NO: 3350142 - DNA, 23 bp, Homo sapiens
tcagcggcgcgccctgcagaggg

SEQ ID NO: 3350143 - DNA, 14 bp, Homo sapiens
tcagcggctccagc

SEQ ID NO: 3350144 - DNA, 16 bp, Homo sapiens
tcagcggggacagctc

SEQ ID NO: 3350145 - DNA, 18 bp, Homo sapiens
tcagctaaagcccaacct

SEQ ID NO: 3350146 - DNA, 19 bp, Homo sapiens
tcagctacccactatcctt

SEQ ID NO: 3350147 - DNA, 15 bp, Homo sapiens
tatttacaaataaaa

SEQ ID NO: 3350148 - DNA, 10 bp, Homo sapiens
tatttacatt

SEQ ID NO: 3350149 - DNA, 17 bp, Homo sapiens
tatttacccctccccta

SEQ ID NO: 3350150 - DNA, 13 bp, Homo sapiens
tatttactctttg

SEQ ID NO: 3350151 - DNA, 19 bp, Homo sapiens
tatttactgagcttctctg

SEQ ID NO: 3350152 - DNA, 14 bp, Homo sapiens
tatttactgtacta

SEQ ID NO: 3350153 - DNA, 23 bp, Homo sapiens
tatttacttttaccactatttaa

SEQ ID NO: 3350154 - DNA, 15 bp, Homo sapiens
tatttagacaagaga

SEQ ID NO: 3350155 - DNA, 20 bp, Homo sapiens
tatttagacaagagatggga

SEQ ID NO: 3350156 - DNA, 18 bp, Homo sapiens
tatttagatataacacta

SEQ ID NO: 3350157 - DNA, 21 bp, Homo sapiens
tatttagatgataaagagaca

SEQ ID NO: 3350158 - DNA, 23 bp, Homo sapiens
tatttagatgataaagagacagt

SEQ ID NO: 3350159 - DNA, 15 bp, Homo sapiens
tatttaggaagtgtt

SEQ ID NO: 3350160 - DNA, 17 bp, Homo sapiens
tatttaggcagattgaa

SEQ ID NO: 3350161 - DNA, 20 bp, Homo sapiens
tatttagtgctgcatcttat

SEQ ID NO: 3350162 - DNA, 19 bp, Homo sapiens
tatttataaatatatttaa

SEQ ID NO: 3350163 - DNA, 19 bp, Homo sapiens
tatttataacaacctaaat

SEQ ID NO: 3350164 - DNA, 21 bp, Homo sapiens
tatttataactcatcataaaa

SEQ ID NO: 3350165 - DNA, 23 bp, Homo sapiens
tatttataactcatcataaaata

SEQ ID NO: 3350166 - DNA, 19 bp, Homo sapiens
tatttatacccccaggaaa

SEQ ID NO: 3350167 - DNA, 16 bp, Homo sapiens
tatttatagtcattta

SEQ ID NO: 3350168 - DNA, 13 bp, Homo sapiens
tatttatatattt

SEQ ID NO: 3350169 - DNA, 19 bp, Homo sapiens
tatttatatatttataact

SEQ ID NO: 3350170 - DNA, 17 bp, Homo sapiens
tatttatatatttgaat

SEQ ID NO: 3350171 - DNA, 13 bp, Homo sapiens
tatttatatcttt

SEQ ID NO: 3350172 - DNA, 17 bp, Homo sapiens
tatttatatgtacatga

SEQ ID NO: 3350173 - DNA, 16 bp, Homo sapiens
tatttatatttcacta

SEQ ID NO: 3350174 - DNA, 21 bp, Homo sapiens
tatttatatttttattttatt

SEQ ID NO: 3350175 - DNA, 13 bp, Homo sapiens
tatttatcagtga

SEQ ID NO: 3350176 - DNA, 15 bp, Homo sapiens
tatttatcagtgaca

SEQ ID NO: 3350177 - DNA, 18 bp, Homo sapiens
tatttatcagtgacagag

SEQ ID NO: 3350178 - DNA, 16 bp, Homo sapiens
tatttatctctattta

SEQ ID NO: 3350179 - DNA, 21 bp, Homo sapiens
tatttatctgattaagttgtc

SEQ ID NO: 3350180 - DNA, 13 bp, Homo sapiens
tatttatgaaaaa

SEQ ID NO: 3350181 - DNA, 19 bp, Homo sapiens
tatttatggatgcaacacg

SEQ ID NO: 3350182 - DNA, 21 bp, Homo sapiens
tatttatgtctatttaagcct

SEQ ID NO: 3350183 - DNA, 15 bp, Homo sapiens
tatttattaaataaa

SEQ ID NO: 3350184 - DNA, 15 bp, Homo sapiens
tatttattaatttga

SEQ ID NO: 3350185 - DNA, 20 bp, Homo sapiens
tatttattatgctttattgg

SEQ ID NO: 3350186 - DNA, 16 bp, Homo sapiens
tatttattatttgaag

SEQ ID NO: 3350187 - DNA, 24 bp, Homo sapiens
tatttattcagcttcatttgtgtc

SEQ ID NO: 3350188 - DNA, 15 bp, Homo sapiens
tatttattcataatg

SEQ ID NO: 3350189 - DNA, 21 bp, Homo sapiens
tatttattgaagaaacagata

SEQ ID NO: 3350190 - DNA, 12 bp, Homo sapiens
tatttattgact

SEQ ID NO: 3350191 - DNA, 20 bp, Homo sapiens
tatttattgcattgctggta

SEQ ID NO: 3350192 - DNA, 23 bp, Homo sapiens
tatttattgggatgtgagcccca

SEQ ID NO: 3350193 - DNA, 15 bp, Homo sapiens
tatttattgttagaa

SEQ ID NO: 3350194 - DNA, 16 bp, Homo sapiens
tatttattgttagaaa

SEQ ID NO: 3350195 - DNA, 20 bp, Homo sapiens
tatttattgttagaaaatga

SEQ ID NO: 3350196 - DNA, 11 bp, Homo sapiens
tatttatttaa

SEQ ID NO: 3350197 - DNA, 12 bp, Homo sapiens
tatttatttaaa

SEQ ID NO: 3350198 - DNA, 13 bp, Homo sapiens
tatttatttactg

SEQ ID NO: 3350199 - DNA, 12 bp, Homo sapiens
tatttatttcta

SEQ ID NO: 3350200 - DNA, 13 bp, Homo sapiens
tatttatttgtga

SEQ ID NO: 3350201 - DNA, 20 bp, Homo sapiens
tatttcaaaatatacattca

SEQ ID NO: 3350202 - DNA, 15 bp, Homo sapiens
tatttcaactgctgt

SEQ ID NO: 3350203 - DNA, 15 bp, Homo sapiens
tatttcaagtgccta

SEQ ID NO: 3350204 - DNA, 18 bp, Homo sapiens
tatttcacaggctgtaaa

SEQ ID NO: 3350205 - DNA, 23 bp, Homo sapiens
tatttcactatcttcttcaaata

SEQ ID NO: 3350206 - DNA, 20 bp, Homo sapiens
tatttcactttagatgctga

SEQ ID NO: 3350207 - DNA, 19 bp, Homo sapiens
tatttcagatatcaaaatt

SEQ ID NO: 3350208 - DNA, 22 bp, Homo sapiens
tatttcagtgtagttaatttat

SEQ ID NO: 3350209 - DNA, 17 bp, Homo sapiens
tatttcatgtggctgta

SEQ ID NO: 3350210 - DNA, 12 bp, Homo sapiens
tatttcatttta

SEQ ID NO: 3350211 - DNA, 17 bp, Homo sapiens
tatttccactaaaaata

SEQ ID NO: 3350212 - DNA, 21 bp, Homo sapiens
tatttcccatttgtgccagag

SEQ ID NO: 3350213 - DNA, 16 bp, Homo sapiens
tatttccctaaaatac

SEQ ID NO: 3350214 - DNA, 21 bp, Homo sapiens
tatttccctaaaatacattta

SEQ ID NO: 3350215 - DNA, 18 bp, Homo sapiens
tatttccctctcattttg

SEQ ID NO: 3350216 - DNA, 17 bp, Homo sapiens
tatttcctgacttgagt

SEQ ID NO: 3350217 - DNA, 15 bp, Homo sapiens
tatttcgaaagctgc

SEQ ID NO: 3350218 - DNA, 15 bp, Homo sapiens
tatttctaagtattt

SEQ ID NO: 3350219 - DNA, 23 bp, Homo sapiens
tatttctaagtatttaaatgttc

SEQ ID NO: 3350220 - DNA, 19 bp, Homo sapiens
tatttctagttctttcctc

SEQ ID NO: 3350221 - DNA, 21 bp, Homo sapiens
tatttctcataatgtgaaata

SEQ ID NO: 3350222 - DNA, 19 bp, Homo sapiens
tatttctcctttgcaatag

SEQ ID NO: 3350223 - DNA, 13 bp, Homo sapiens
tatttctctcccc

SEQ ID NO: 3350224 - DNA, 14 bp, Homo sapiens
tatttctgaaggta

SEQ ID NO: 3350225 - DNA, 21 bp, Homo sapiens
tatttctgaaggtagcattct

SEQ ID NO: 3350226 - DNA, 15 bp, Homo sapiens
tatttctgaattcaa

SEQ ID NO: 3350227 - DNA, 13 bp, Homo sapiens
tatttctgctctg

SEQ ID NO: 3350228 - DNA, 18 bp, Homo sapiens
tatttctgggtcttttgc

SEQ ID NO: 3350229 - DNA, 22 bp, Homo sapiens
tatttcttcaaatccttccaaa

SEQ ID NO: 3350230 - DNA, 13 bp, Homo sapiens
tatttctttgtta

SEQ ID NO: 3350231 - DNA, 23 bp, Homo sapiens
tatttctttttaattattttaaa

SEQ ID NO: 3350232 - DNA, 18 bp, Homo sapiens
tatttgaaaattttactt

SEQ ID NO: 3350233 - DNA, 19 bp, Homo sapiens
tatttgaaactgaatgttt

SEQ ID NO: 3350234 - DNA, 16 bp, Homo sapiens
tatttgaaatactaaa

SEQ ID NO: 3350235 - DNA, 23 bp, Homo sapiens
tatttgaaatactaaaagcaaat

SEQ ID NO: 3350236 - DNA, 12 bp, Homo sapiens
tatttgaagaaa

SEQ ID NO: 3350237 - DNA, 15 bp, Homo sapiens
tatttgaatgaaaac

SEQ ID NO: 3350238 - DNA, 21 bp, Homo sapiens
tatttgacaacgtttcagcga

SEQ ID NO: 3350239 - DNA, 17 bp, Homo sapiens
tatttgacttgcatgaa

SEQ ID NO: 3350240 - DNA, 19 bp, Homo sapiens
tatttgagagttctaaatt

SEQ ID NO: 3350241 - DNA, 17 bp, Homo sapiens
tatttgaggagtgttaa

SEQ ID NO: 3350242 - DNA, 16 bp, Homo sapiens
tatttgagtcacttgt

SEQ ID NO: 3350243 - DNA, 23 bp, Homo sapiens
tatttgcagataattctggacca

SEQ ID NO: 3350244 - DNA, 15 bp, Homo sapiens
tatttgcagttactt

SEQ ID NO: 3350245 - DNA, 20 bp, Homo sapiens
tatttgcagttacttgaata

SEQ ID NO: 3350246 - DNA, 23 bp, Homo sapiens
tatttgcagttcacctgcactta

SEQ ID NO: 3350247 - DNA, 17 bp, Homo sapiens
tatttgccaataaagct

SEQ ID NO: 3350248 - DNA, 20 bp, Homo sapiens
tatttgctgtcacatagttt

SEQ ID NO: 3350249 - DNA, 11 bp, Homo sapiens
tatttgctttt

SEQ ID NO: 3350250 - DNA, 15 bp, Homo sapiens
tatttgctttttgct

SEQ ID NO: 3350251 - DNA, 16 bp, Homo sapiens
tatttggaaagagacc

SEQ ID NO: 3350252 - DNA, 17 bp, Homo sapiens
tatttggaatatttgaa

SEQ ID NO: 3350253 - DNA, 21 bp, Homo sapiens
tatttggcagtttggtatttg

SEQ ID NO: 3350254 - DNA, 15 bp, Homo sapiens
tatttggctgggcta

SEQ ID NO: 3350255 - DNA, 22 bp, Homo sapiens
tatttggtgggagttatatcag

SEQ ID NO: 3350256 - DNA, 23 bp, Homo sapiens
tatttgtaaaagaacagtaaaca

SEQ ID NO: 3350257 - DNA, 13 bp, Homo sapiens
tatttgtaaatct

SEQ ID NO: 3350258 - DNA, 17 bp, Homo sapiens
tatttgtaaatctgcca

SEQ ID NO: 3350259 - DNA, 17 bp, Homo sapiens
tatttgtaagatatttg

SEQ ID NO: 3350260 - DNA, 12 bp, Homo sapiens
tatttgtatctc

SEQ ID NO: 3350261 - DNA, 23 bp, Homo sapiens
tatttgtatctctgaagcatgtt

SEQ ID NO: 3350262 - DNA, 19 bp, Homo sapiens
tatttgtattaataaagca

SEQ ID NO: 3350263 - DNA, 20 bp, Homo sapiens
tatttgtcatgctgggattt

SEQ ID NO: 3350264 - DNA, 17 bp, Homo sapiens
tatttgtgtaatagaaa

SEQ ID NO: 3350265 - DNA, 19 bp, Homo sapiens
tatttgtgttttaatttaa

SEQ ID NO: 3350266 - DNA, 14 bp, Homo sapiens
tatttgttcatgtt

SEQ ID NO: 3350267 - DNA, 15 bp, Homo sapiens
tatttgttcatgttt

SEQ ID NO: 3350268 - DNA, 16 bp, Homo sapiens
tatttgttcatgtttg

SEQ ID NO: 3350269 - DNA, 17 bp, Homo sapiens
tatttgtttttcattca

SEQ ID NO: 3350270 - DNA, 19 bp, Homo sapiens
tattttaaaaaatgaaaat

SEQ ID NO: 3350271 - DNA, 14 bp, Homo sapiens
tattttaaaagcca

SEQ ID NO: 3350272 - DNA, 13 bp, Homo sapiens
tattttaaaattt

SEQ ID NO: 3350273 - DNA, 15 bp, Homo sapiens
tattttaaaatttca

SEQ ID NO: 3350274 - DNA, 15 bp, Homo sapiens
tattttaaatatact

SEQ ID NO: 3350275 - DNA, 16 bp, Homo sapiens
tattttaacactttgt

SEQ ID NO: 3350276 - DNA, 21 bp, Homo sapiens
tcacaagcgctcccagcctgc

SEQ ID NO: 3350277 - DNA, 20 bp, Homo sapiens
tcacaatacagataacatta

SEQ ID NO: 3350278 - DNA, 15 bp, Homo sapiens
tcacaattattaaat

SEQ ID NO: 3350279 - DNA, 14 bp, Homo sapiens
tcacacacacagct

SEQ ID NO: 3350280 - DNA, 15 bp, Homo sapiens
tcacacacacagctg

SEQ ID NO: 3350281 - DNA, 13 bp, Homo sapiens
tcacacagtgagt

SEQ ID NO: 3350282 - DNA, 14 bp, Homo sapiens
tcacacatccagac

SEQ ID NO: 3350283 - DNA, 16 bp, Homo sapiens
tcacaccagctaagga

SEQ ID NO: 3350284 - DNA, 22 bp, Homo sapiens
tcacacccaccgtccgccctgc

SEQ ID NO: 3350285 - DNA, 23 bp, Homo sapiens
tcacacccaccgtccgccctgct

SEQ ID NO: 3350286 - DNA, 24 bp, Homo sapiens
tcacacccaccgtccgccctgctc

SEQ ID NO: 3350287 - DNA, 12 bp, Homo sapiens
tcacaccccagg

SEQ ID NO: 3350288 - DNA, 13 bp, Homo sapiens
tcacaccctgcaa

SEQ ID NO: 3350289 - DNA, 14 bp, Homo sapiens
tcacaccctgcaag

SEQ ID NO: 3350290 - DNA, 23 bp, Homo sapiens
tcacacctgactctgaaatctga

SEQ ID NO: 3350291 - DNA, 19 bp, Homo sapiens
tcacacctgcaatcccagc

SEQ ID NO: 3350292 - DNA, 21 bp, Homo sapiens
tcacacctgcaatcccagcac

SEQ ID NO: 3350293 - DNA, 19 bp, Homo sapiens
tcacacctgtaatcccaac

SEQ ID NO: 3350294 - DNA, 16 bp, Homo sapiens
tcacactcagaaagag

SEQ ID NO: 3350295 - DNA, 21 bp, Homo sapiens
tcacactcagttgtgactaac

SEQ ID NO: 3350296 - DNA, 16 bp, Homo sapiens
tcacactgggtggtgg

SEQ ID NO: 3350297 - DNA, 23 bp, Homo sapiens
tcacactgggtggtggcctggtc

SEQ ID NO: 3350298 - DNA, 18 bp, Homo sapiens
tcacactggtctgctgtc

SEQ ID NO: 3350299 - DNA, 16 bp, Homo sapiens
tcacactgtcttctga

SEQ ID NO: 3350300 - DNA, 16 bp, Homo sapiens
tcacacttctgtgaga

SEQ ID NO: 3350301 - DNA, 23 bp, Homo sapiens
tcacacttctgtgagacccccac

SEQ ID NO: 3350302 - DNA, 22 bp, Homo sapiens
tcacactttttatttaattaaa

SEQ ID NO: 3350303 - DNA, 17 bp, Homo sapiens
tcacagacctggagccc

SEQ ID NO: 3350304 - DNA, 18 bp, Homo sapiens
tcacagacctggagcccc

SEQ ID NO: 3350305 - DNA, 20 bp, Homo sapiens
tcacagacctggagcccctg

SEQ ID NO: 3350306 - DNA, 23 bp, Homo sapiens
tcacagacctggagcccctgggt

SEQ ID NO: 3350307 - DNA, 21 bp, Homo sapiens
tcacagcacatgctggccagc

SEQ ID NO: 3350308 - DNA, 13 bp, Homo sapiens
tcacagcagcctc

SEQ ID NO: 3350309 - DNA, 15 bp, Homo sapiens
tcacagcctccaggg

SEQ ID NO: 3350310 - DNA, 12 bp, Homo sapiens
tcacagcctctg

SEQ ID NO: 3350311 - DNA, 13 bp, Homo sapiens
tcacagcctctga

SEQ ID NO: 3350312 - DNA, 20 bp, Homo sapiens
tcacagcctctgacccctcc

SEQ ID NO: 3350313 - DNA, 22 bp, Homo sapiens
tcacagcctctgacccctcctc

SEQ ID NO: 3350314 - DNA, 16 bp, Homo sapiens
tcacagctcctcccac

SEQ ID NO: 3350315 - DNA, 12 bp, Homo sapiens
tcacagctgcag

SEQ ID NO: 3350316 - DNA, 14 bp, Homo sapiens
tcacagctgcagct

SEQ ID NO: 3350317 - DNA, 16 bp, Homo sapiens
tcacagctgcagctgg

SEQ ID NO: 3350318 - DNA, 22 bp, Homo sapiens
tcacagctgcagctgggcccca

SEQ ID NO: 3350319 - DNA, 16 bp, Homo sapiens
tcacaggactctgcct

SEQ ID NO: 3350320 - DNA, 19 bp, Homo sapiens
tcacaggaggccagtgggc

SEQ ID NO: 3350321 - DNA, 15 bp, Homo sapiens
tcacaggatgccagc

SEQ ID NO: 3350322 - DNA, 17 bp, Homo sapiens
tcacaggatgccagccc

SEQ ID NO: 3350323 - DNA, 22 bp, Homo sapiens
tcacaggatgccagcccctgcc

SEQ ID NO: 3350324 - DNA, 15 bp, Homo sapiens
tcacaggcaggtcca

SEQ ID NO: 3350325 - DNA, 19 bp, Homo sapiens
tcacaggcagtgcatgtga

SEQ ID NO: 3350326 - DNA, 13 bp, Homo sapiens
tcacaggcccaga

SEQ ID NO: 3350327 - DNA, 13 bp, Homo sapiens
tcacaggcctctc

SEQ ID NO: 3350328 - DNA, 17 bp, Homo sapiens
tcacagggccccagaag

SEQ ID NO: 3350329 - DNA, 23 bp, Homo sapiens
tcacagggccccagaaggcaggg

SEQ ID NO: 3350330 - DNA, 16 bp, Homo sapiens
tcacagggttgggccc

SEQ ID NO: 3350331 - DNA, 24 bp, Homo sapiens
tcacagggttgggcccagatctgg

SEQ ID NO: 3350332 - DNA, 19 bp, Homo sapiens
tcacaggtgtggtgtaatt

SEQ ID NO: 3350333 - DNA, 14 bp, Homo sapiens
tcacagtagagcca

SEQ ID NO: 3350334 - DNA, 16 bp, Homo sapiens
tcacagtagagccagc

SEQ ID NO: 3350335 - DNA, 17 bp, Homo sapiens
tcacagtagagccagct

SEQ ID NO: 3350336 - DNA, 21 bp, Homo sapiens
tcacagtagagccagcttggg

SEQ ID NO: 3350337 - DNA, 12 bp, Homo sapiens
tcacagtcccag

SEQ ID NO: 3350338 - DNA, 18 bp, Homo sapiens
tcacagtctctttaatct

SEQ ID NO: 3350339 - DNA, 19 bp, Homo sapiens
tcacagtctctttaatctt

SEQ ID NO: 3350340 - DNA, 21 bp, Homo sapiens
tcacagtctctttaatcttca

SEQ ID NO: 3350341 - DNA, 23 bp, Homo sapiens
tcacagtctctttaatcttcagt

SEQ ID NO: 3350342 - DNA, 18 bp, Homo sapiens
tcacagtgctcttttctc

SEQ ID NO: 3350343 - DNA, 17 bp, Homo sapiens
tcacagtgctgtgtgcc

SEQ ID NO: 3350344 - DNA, 11 bp, Homo sapiens
tcacagtgttt

SEQ ID NO: 3350345 - DNA, 23 bp, Homo sapiens
tcacagttccctttatttcacat

SEQ ID NO: 3350346 - DNA, 13 bp, Homo sapiens
tcacagttgacaa

SEQ ID NO: 3350347 - DNA, 23 bp, Homo sapiens
tcacataaaaaagaagcactttg

SEQ ID NO: 3350348 - DNA, 17 bp, Homo sapiens
tcacataaaacctcatt

SEQ ID NO: 3350349 - DNA, 16 bp, Homo sapiens
tcacataccctccccc

SEQ ID NO: 3350350 - DNA, 16 bp, Homo sapiens
tcacatagatgtccct

SEQ ID NO: 3350351 - DNA, 18 bp, Homo sapiens
tcacatatatcaaagtga

SEQ ID NO: 3350352 - DNA, 12 bp, Homo sapiens
tcacatatctgt

SEQ ID NO: 3350353 - DNA, 17 bp, Homo sapiens
tcacatcagataagaca

SEQ ID NO: 3350354 - DNA, 14 bp, Homo sapiens
tcacatctctgcct

SEQ ID NO: 3350355 - DNA, 15 bp, Homo sapiens
tcacatctttaactt

SEQ ID NO: 3350356 - DNA, 23 bp, Homo sapiens
tcacatgagctatttccattcca

SEQ ID NO: 3350357 - DNA, 21 bp, Homo sapiens
tcacatgatctgtttttcacc

SEQ ID NO: 3350358 - DNA, 19 bp, Homo sapiens
tcacatgctaaagccagga

SEQ ID NO: 3350359 - DNA, 21 bp, Homo sapiens
tcacattatttattaaaaatg

SEQ ID NO: 3350360 - DNA, 21 bp, Homo sapiens
tcacattcttggcttaatcat

SEQ ID NO: 3350361 - DNA, 14 bp, Homo sapiens
tcacattgaatcat

SEQ ID NO: 3350362 - DNA, 23 bp, Homo sapiens
tcacattgtaactgaacttcagg

SEQ ID NO: 3350363 - DNA, 18 bp, Homo sapiens
tcacattgtttgctgcta

SEQ ID NO: 3350364 - DNA, 23 bp, Homo sapiens
tcacatttatgtggcttgtttat

SEQ ID NO: 3350365 - DNA, 17 bp, Homo sapiens
tcacatttattctgctc

SEQ ID NO: 3350366 - DNA, 13 bp, Homo sapiens
tcacattttctca

SEQ ID NO: 3350367 - DNA, 17 bp, Homo sapiens
tcacattttttatgggc

SEQ ID NO: 3350368 - DNA, 13 bp, Homo sapiens
tcaccaaaaacat

SEQ ID NO: 3350369 - DNA, 17 bp, Homo sapiens
tcaccaaatagtgtgaa

SEQ ID NO: 3350370 - DNA, 20 bp, Homo sapiens
tcaccaaatcagctgctact

SEQ ID NO: 3350371 - DNA, 21 bp, Homo sapiens
tcaccaaatcagctgctacta

SEQ ID NO: 3350372 - DNA, 22 bp, Homo sapiens
tcaccaacacagttgggaccca

SEQ ID NO: 3350373 - DNA, 13 bp, Homo sapiens
tcaccaagcccag

SEQ ID NO: 3350374 - DNA, 12 bp, Homo sapiens
tcaccaaggtga

SEQ ID NO: 3350375 - DNA, 16 bp, Homo sapiens
tcaccaccacactaca

SEQ ID NO: 3350376 - DNA, 20 bp, Homo sapiens
tcaccaccgcctctggccgc

SEQ ID NO: 3350377 - DNA, 21 bp, Homo sapiens
tcaccagatttgctaatttat

SEQ ID NO: 3350378 - DNA, 20 bp, Homo sapiens
tcaccaggacttggggtcag

SEQ ID NO: 3350379 - DNA, 17 bp, Homo sapiens
tcaccaggggaggagcc

SEQ ID NO: 3350380 - DNA, 18 bp, Homo sapiens
tcaccaggggaggagcct

SEQ ID NO: 3350381 - DNA, 22 bp, Homo sapiens
tcaccagggtccgcaccagctg

SEQ ID NO: 3350382 - DNA, 14 bp, Homo sapiens
tcaccagttaaaag

SEQ ID NO: 3350383 - DNA, 14 bp, Homo sapiens
tcaccataacctct

SEQ ID NO: 3350384 - DNA, 20 bp, Homo sapiens
tcaccatctcttcattcaaa

SEQ ID NO: 3350385 - DNA, 16 bp, Homo sapiens
tcaccatgcttccagc

SEQ ID NO: 3350386 - DNA, 14 bp, Homo sapiens
tcacccacccctgc

SEQ ID NO: 3350387 - DNA, 21 bp, Homo sapiens
tcacccagctaatctgtaggg

SEQ ID NO: 3350388 - DNA, 13 bp, Homo sapiens
tcaccccaccctt

SEQ ID NO: 3350389 - DNA, 22 bp, Homo sapiens
tcacccccatggccccaggccc

SEQ ID NO: 3350390 - DNA, 15 bp, Homo sapiens
tcaccccccaatctc

SEQ ID NO: 3350391 - DNA, 18 bp, Homo sapiens
tcaccccccactcaccag

SEQ ID NO: 3350392 - DNA, 21 bp, Homo sapiens
tcaccccgctgtaagctcctt

SEQ ID NO: 3350393 - DNA, 15 bp, Homo sapiens
tcaccccggcaggcc

SEQ ID NO: 3350394 - DNA, 14 bp, Homo sapiens
tcacccctgtcctc

SEQ ID NO: 3350395 - DNA, 17 bp, Homo sapiens
tcacccctgtcctcact

SEQ ID NO: 3350396 - DNA, 15 bp, Homo sapiens
tcaccctacctgtgc

SEQ ID NO: 3350397 - DNA, 15 bp, Homo sapiens
tcaccctcatgaaaa

SEQ ID NO: 3350398 - DNA, 18 bp, Homo sapiens
tcaccctcttcctgtgat

SEQ ID NO: 3350399 - DNA, 14 bp, Homo sapiens
tcaccctgcccgct

SEQ ID NO: 3350400 - DNA, 21 bp, Homo sapiens
tcaccctgcccgctcccaacc

SEQ ID NO: 3350401 - DNA, 13 bp, Homo sapiens
tcaccctgtcaag

SEQ ID NO: 3350402 - DNA, 18 bp, Homo sapiens
tcacccttaacccaagga

SEQ ID NO: 3350403 - DNA, 22 bp, Homo sapiens
tcacccttgcaccgtcctcagc

SEQ ID NO: 3350404 - DNA, 15 bp, Homo sapiens
tcaccctttgctgtg

SEQ ID NO: 3350405 - DNA, 14 bp, Homo sapiens
tatgttgctcagtc

SEQ ID NO: 3350406 - DNA, 20 bp, Homo sapiens
tatgttgctcagtctccctt

SEQ ID NO: 3350407 - DNA, 14 bp, Homo sapiens
tatgttgtaataaa

SEQ ID NO: 3350408 - DNA, 13 bp, Homo sapiens
tatgttgtatgat

SEQ ID NO: 3350409 - DNA, 16 bp, Homo sapiens
tatgttgtccaattgt

SEQ ID NO: 3350410 - DNA, 19 bp, Homo sapiens
tatgtttaatctgttatgt

SEQ ID NO: 3350411 - DNA, 15 bp, Homo sapiens
tatgtttacacaatt

SEQ ID NO: 3350412 - DNA, 14 bp, Homo sapiens
tatgtttacatatc

SEQ ID NO: 3350413 - DNA, 18 bp, Homo sapiens
tatgtttgtctcactttt

SEQ ID NO: 3350414 - DNA, 21 bp, Homo sapiens
tatgttttcaagtctcctcca

SEQ ID NO: 3350415 - DNA, 17 bp, Homo sapiens
tatgtttttgactcttt

SEQ ID NO: 3350416 - DNA, 17 bp, Homo sapiens
tatgttttttaaaatat

SEQ ID NO: 3350417 - DNA, 15 bp, Homo sapiens
tattaaaaaagtcta

SEQ ID NO: 3350418 - DNA, 22 bp, Homo sapiens
tattaaaaatatggaacttcta

SEQ ID NO: 3350419 - DNA, 17 bp, Homo sapiens
tattaaaaatgttctca

SEQ ID NO: 3350420 - DNA, 14 bp, Homo sapiens
tattaaaactaaat

SEQ ID NO: 3350421 - DNA, 19 bp, Homo sapiens
tattaaaactaaatttcac

SEQ ID NO: 3350422 - DNA, 20 bp, Homo sapiens
tattaaaataagcactgtgc

SEQ ID NO: 3350423 - DNA, 20 bp, Homo sapiens
tattaaaatgattgtaaaat

SEQ ID NO: 3350424 - DNA, 16 bp, Homo sapiens
tattaaaattacagat

SEQ ID NO: 3350425 - DNA, 15 bp, Homo sapiens
tattaaaattccaaa

SEQ ID NO: 3350426 - DNA, 17 bp, Homo sapiens
tattaaacaaagtttca

SEQ ID NO: 3350427 - DNA, 16 bp, Homo sapiens
tattaaacattttcat

SEQ ID NO: 3350428 - DNA, 14 bp, Homo sapiens
tattaaagtgctaa

SEQ ID NO: 3350429 - DNA, 18 bp, Homo sapiens
tattaaagtgctaaggtt

SEQ ID NO: 3350430 - DNA, 24 bp, Homo sapiens
tattaaagtgctaaggttctaagg

SEQ ID NO: 3350431 - DNA, 15 bp, Homo sapiens
tattaaataaaatca

SEQ ID NO: 3350432 - DNA, 13 bp, Homo sapiens
tattaaatacaga

SEQ ID NO: 3350433 - DNA, 18 bp, Homo sapiens
tattaaatacagacacta

SEQ ID NO: 3350434 - DNA, 20 bp, Homo sapiens
tattaaatcttaaacaatgt

SEQ ID NO: 3350435 - DNA, 21 bp, Homo sapiens
tattaaatcttaaacaatgta

SEQ ID NO: 3350436 - DNA, 23 bp, Homo sapiens
tattaaatgcttcatttgtatgt

SEQ ID NO: 3350437 - DNA, 18 bp, Homo sapiens
tattaacaaaagttccct

SEQ ID NO: 3350438 - DNA, 21 bp, Homo sapiens
tattgttccaagacattgtca

SEQ ID NO: 3350439 - DNA, 17 bp, Homo sapiens
tattgttccagcagttt

SEQ ID NO: 3350440 - DNA, 15 bp, Homo sapiens
tattgttctcacact

SEQ ID NO: 3350441 - DNA, 13 bp, Homo sapiens
tattgttggtaat

SEQ ID NO: 3350442 - DNA, 16 bp, Homo sapiens
tattgtttaaaatgta

SEQ ID NO: 3350443 - DNA, 14 bp, Homo sapiens
tattgtttatgtaa

SEQ ID NO: 3350444 - DNA, 15 bp, Homo sapiens
tattgtttctgcatt

SEQ ID NO: 3350445 - DNA, 22 bp, Homo sapiens
tattgttttcagtgtacatgga

SEQ ID NO: 3350446 - DNA, 21 bp, Homo sapiens
tatttaaaaaattatggaata

SEQ ID NO: 3350447 - DNA, 22 bp, Homo sapiens
tatttaaaaaattatggaatat

SEQ ID NO: 3350448 - DNA, 21 bp, Homo sapiens
tatttaaaaatatttcagata

SEQ ID NO: 3350449 - DNA, 19 bp, Homo sapiens
tatttaaaaattgtttctt

SEQ ID NO: 3350450 - DNA, 16 bp, Homo sapiens
tatttaaaataaattc

SEQ ID NO: 3350451 - DNA, 20 bp, Homo sapiens
tatttaaacctttttcttga

SEQ ID NO: 3350452 - DNA, 15 bp, Homo sapiens
tatttaaactatctt

SEQ ID NO: 3350453 - DNA, 16 bp, Homo sapiens
tatttaaatgggaata

SEQ ID NO: 3350454 - DNA, 14 bp, Homo sapiens
tatttaaattacaa

SEQ ID NO: 3350455 - DNA, 13 bp, Homo sapiens
tatttaaattctt

SEQ ID NO: 3350456 - DNA, 15 bp, Homo sapiens
tatttaaattctttt

SEQ ID NO: 3350457 - DNA, 16 bp, Homo sapiens
tatttaaattcttttt

SEQ ID NO: 3350458 - DNA, 15 bp, Homo sapiens
tatttaacaagatct

SEQ ID NO: 3350459 - DNA, 21 bp, Homo sapiens
tatttaacagctgaattatct

SEQ ID NO: 3350460 - DNA, 19 bp, Homo sapiens
tatttaacttaacccagat

SEQ ID NO: 3350461 - DNA, 23 bp, Homo sapiens
tatttaacttaacccagatttta

SEQ ID NO: 3350462 - DNA, 16 bp, Homo sapiens
tatttaagaaaagcac

SEQ ID NO: 3350463 - DNA, 20 bp, Homo sapiens
tatttaagaaaagcactttt

SEQ ID NO: 3350464 - DNA, 23 bp, Homo sapiens
tatttaagaaaagcacttttgtt

SEQ ID NO: 3350465 - DNA, 14 bp, Homo sapiens
tatttaagaaaata

SEQ ID NO: 3350466 - DNA, 20 bp, Homo sapiens
tatttaagataattataata

SEQ ID NO: 3350467 - DNA, 18 bp, Homo sapiens
tatttaagcctcatattt

SEQ ID NO: 3350468 - DNA, 21 bp, Homo sapiens
tatttaagccttataaaccaa

SEQ ID NO: 3350469 - DNA, 18 bp, Homo sapiens
tatttaaggtagcttcag

SEQ ID NO: 3350470 - DNA, 15 bp, Homo sapiens
tatttaagttatcaa

SEQ ID NO: 3350471 - DNA, 19 bp, Homo sapiens
tatttaagttatcaacttt

SEQ ID NO: 3350472 - DNA, 11 bp, Homo sapiens
tatttaataac

SEQ ID NO: 3350473 - DNA, 17 bp, Homo sapiens
tatttaataacaattgt

SEQ ID NO: 3350474 - DNA, 15 bp, Homo sapiens
tatttaataacatta

SEQ ID NO: 3350475 - DNA, 22 bp, Homo sapiens
tatttaatatctggcactgtta

SEQ ID NO: 3350476 - DNA, 17 bp, Homo sapiens
tatttaatgaaacccta

SEQ ID NO: 3350477 - DNA, 21 bp, Homo sapiens
tatttaatgcattaaacctgt

SEQ ID NO: 3350478 - DNA, 22 bp, Homo sapiens
tatttaatgcattaaacctgtc

SEQ ID NO: 3350479 - DNA, 23 bp, Homo sapiens
tatttaattattaactacattta

SEQ ID NO: 3350480 - DNA, 22 bp, Homo sapiens
tatttaattctttctattttca

SEQ ID NO: 3350481 - DNA, 13 bp, Homo sapiens
tatttaattgtaa

SEQ ID NO: 3350482 - DNA, 18 bp, Homo sapiens
tatcatgaattttaaagt

SEQ ID NO: 3350483 - DNA, 13 bp, Homo sapiens
tatcatgacatgt

SEQ ID NO: 3350484 - DNA, 17 bp, Homo sapiens
tatcatgcatgtcctgt

SEQ ID NO: 3350485 - DNA, 18 bp, Homo sapiens
tatcatgcccctgtactc

SEQ ID NO: 3350486 - DNA, 21 bp, Homo sapiens
tatcatgctttaaagtgtaat

SEQ ID NO: 3350487 - DNA, 12 bp, Homo sapiens
tatcatgtatgg

SEQ ID NO: 3350488 - DNA, 16 bp, Homo sapiens
tatcattaaattggaa

SEQ ID NO: 3350489 - DNA, 14 bp, Homo sapiens
tatcattctacaga

SEQ ID NO: 3350490 - DNA, 20 bp, Homo sapiens
tatcatttattttttacatt

SEQ ID NO: 3350491 - DNA, 20 bp, Homo sapiens
tatcattttcttttttaacc

SEQ ID NO: 3350492 - DNA, 17 bp, Homo sapiens
tatcatttttgtacagt

SEQ ID NO: 3350493 - DNA, 18 bp, Homo sapiens
tatccaaaatgtgtattt

SEQ ID NO: 3350494 - DNA, 22 bp, Homo sapiens
tatccaaaatgtgtatttctta

SEQ ID NO: 3350495 - DNA, 14 bp, Homo sapiens
tatccaaacatgta

SEQ ID NO: 3350496 - DNA, 19 bp, Homo sapiens
tatccaaaccaaataaaaa

SEQ ID NO: 3350497 - DNA, 14 bp, Homo sapiens
tatccaaagactgt

SEQ ID NO: 3350498 - DNA, 19 bp, Homo sapiens
tatccaaagactgtactgg

SEQ ID NO: 3350499 - DNA, 17 bp, Homo sapiens
tatccaaatctgaagat

SEQ ID NO: 3350500 - DNA, 16 bp, Homo sapiens
tatccaaatcttgaat

SEQ ID NO: 3350501 - DNA, 19 bp, Homo sapiens
tatccaacatcaacatctt

SEQ ID NO: 3350502 - DNA, 20 bp, Homo sapiens
tatccaagtaccaatgctgt

SEQ ID NO: 3350503 - DNA, 22 bp, Homo sapiens
tatccacagagagtcccactgc

SEQ ID NO: 3350504 - DNA, 15 bp, Homo sapiens
tatccactttgcaca

SEQ ID NO: 3350505 - DNA, 17 bp, Homo sapiens
tatccaggcaccaggac

SEQ ID NO: 3350506 - DNA, 14 bp, Homo sapiens
tatccagttactgc

SEQ ID NO: 3350507 - DNA, 22 bp, Homo sapiens
tatccatgacaggcctgaagat

SEQ ID NO: 3350508 - DNA, 16 bp, Homo sapiens
tatccatgcaccaaac

SEQ ID NO: 3350509 - DNA, 13 bp, Homo sapiens
tatccatgtactg

SEQ ID NO: 3350510 - DNA, 14 bp, Homo sapiens
tatccatgtactgt

SEQ ID NO: 3350511 - DNA, 15 bp, Homo sapiens
tatccatgtactgta

SEQ ID NO: 3350512 - DNA, 20 bp, Homo sapiens
tatcccaatcaaagaattac

SEQ ID NO: 3350513 - DNA, 16 bp, Homo sapiens
tatcccacatccaact

SEQ ID NO: 3350514 - DNA, 20 bp, Homo sapiens
tatcccacctccatcccaga

SEQ ID NO: 3350515 - DNA, 17 bp, Homo sapiens
tatccccccatcttgct

SEQ ID NO: 3350516 - DNA, 13 bp, Homo sapiens
tatcccctgctac

SEQ ID NO: 3350517 - DNA, 14 bp, Homo sapiens
tatccctcttgtaa

SEQ ID NO: 3350518 - DNA, 19 bp, Homo sapiens
tatccctcttgtaagtcat

SEQ ID NO: 3350519 - DNA, 12 bp, Homo sapiens
tatcccttccgg

SEQ ID NO: 3350520 - DNA, 15 bp, Homo sapiens
tatccctttacaatg

SEQ ID NO: 3350521 - DNA, 20 bp, Homo sapiens
tatccctttacaatgtgaat

SEQ ID NO: 3350522 - DNA, 18 bp, Homo sapiens
tatccgactctaagctgt

SEQ ID NO: 3350523 - DNA, 16 bp, Homo sapiens
tatcctacagtacaat

SEQ ID NO: 3350524 - DNA, 20 bp, Homo sapiens
tatcctactgagcatttgca

SEQ ID NO: 3350525 - DNA, 13 bp, Homo sapiens
tatcctcactgcc

SEQ ID NO: 3350526 - DNA, 14 bp, Homo sapiens
tatcctgaaatttc

SEQ ID NO: 3350527 - DNA, 17 bp, Homo sapiens
tatcctgaaatttcaga

SEQ ID NO: 3350528 - DNA, 13 bp, Homo sapiens
tatcctgagccat

SEQ ID NO: 3350529 - DNA, 15 bp, Homo sapiens
tatcctgcccagtgt

SEQ ID NO: 3350530 - DNA, 16 bp, Homo sapiens
tatcctgcccagtgtt

SEQ ID NO: 3350531 - DNA, 21 bp, Homo sapiens
tatcctgcgggttttaattta

SEQ ID NO: 3350532 - DNA, 19 bp, Homo sapiens
tatcctgtgacatgtaaca

SEQ ID NO: 3350533 - DNA, 17 bp, Homo sapiens
tatcctgtgactgtctc

SEQ ID NO: 3350534 - DNA, 23 bp, Homo sapiens
tatcctgtgactgtctcacttaa

SEQ ID NO: 3350535 - DNA, 17 bp, Homo sapiens
tatcctttctaacaaaa

SEQ ID NO: 3350536 - DNA, 21 bp, Homo sapiens
tatcctttgtgagcctatgat

SEQ ID NO: 3350537 - DNA, 22 bp, Homo sapiens
tatcctttgtggcaccttttct

SEQ ID NO: 3350538 - DNA, 16 bp, Homo sapiens
tatcgagtttgcaatg

SEQ ID NO: 3350539 - DNA, 22 bp, Homo sapiens
tatcgatgttttattatttcta

SEQ ID NO: 3350540 - DNA, 14 bp, Homo sapiens
tatcggaagcagtg

SEQ ID NO: 3350541 - DNA, 15 bp, Homo sapiens
tatcggaagcagtgc

SEQ ID NO: 3350542 - DNA, 14 bp, Homo sapiens
tatcgggaacagtg

SEQ ID NO: 3350543 - DNA, 17 bp, Homo sapiens
tatcgggagcagtgtct

SEQ ID NO: 3350544 - DNA, 14 bp, Homo sapiens
tatctaaaccatat

SEQ ID NO: 3350545 - DNA, 12 bp, Homo sapiens
tatctaaagttt

SEQ ID NO: 3350546 - DNA, 15 bp, Homo sapiens
tatctaatacctctg

SEQ ID NO: 3350547 - DNA, 13 bp, Homo sapiens
tatctaatttata

SEQ ID NO: 3350548 - DNA, 21 bp, Homo sapiens
tatctacccaagggcagaaag

SEQ ID NO: 3350549 - DNA, 22 bp, Homo sapiens
tatctaccccagactagatgta

SEQ ID NO: 3350550 - DNA, 12 bp, Homo sapiens
tatctagaaaga

SEQ ID NO: 3350551 - DNA, 15 bp, Homo sapiens
tatctagaaagaaaa

SEQ ID NO: 3350552 - DNA, 18 bp, Homo sapiens
tatctagaaagaaaagac

SEQ ID NO: 3350553 - DNA, 14 bp, Homo sapiens
tatctagtgcagct

SEQ ID NO: 3350554 - DNA, 20 bp, Homo sapiens
tatctagtgcagctgatttt

SEQ ID NO: 3350555 - DNA, 14 bp, Homo sapiens
tatctataatttac

SEQ ID NO: 3350556 - DNA, 16 bp, Homo sapiens
tatctataatttacct

SEQ ID NO: 3350557 - DNA, 19 bp, Homo sapiens
tatctataatttacctaag

SEQ ID NO: 3350558 - DNA, 18 bp, Homo sapiens
tatctatataaaataact

SEQ ID NO: 3350559 - DNA, 15 bp, Homo sapiens
tatctatatatgtgt

SEQ ID NO: 3350560 - DNA, 17 bp, Homo sapiens
tatctatatatgtgtat

SEQ ID NO: 3350561 - DNA, 15 bp, Homo sapiens
tatctatattctata

SEQ ID NO: 3350562 - DNA, 14 bp, Homo sapiens
tatctatcttccaa

SEQ ID NO: 3350563 - DNA, 19 bp, Homo sapiens
tatctattaatatatgtat

SEQ ID NO: 3350564 - DNA, 15 bp, Homo sapiens
tatctcagatgttaa

SEQ ID NO: 3350565 - DNA, 11 bp, Homo sapiens
tatctcctgac

SEQ ID NO: 3350566 - DNA, 21 bp, Homo sapiens
tatctcctgacagaaggtgcc

SEQ ID NO: 3350567 - DNA, 20 bp, Homo sapiens
tatctctatttaatatttat

SEQ ID NO: 3350568 - DNA, 17 bp, Homo sapiens
tatctctatttgagaat

SEQ ID NO: 3350569 - DNA, 18 bp, Homo sapiens
tatctctgtgtgcacaaa

SEQ ID NO: 3350570 - DNA, 23 bp, Homo sapiens
tatctctgtgtgcacaaatattt

SEQ ID NO: 3350571 - DNA, 19 bp, Homo sapiens
tatctcttggaaaataaga

SEQ ID NO: 3350572 - DNA, 18 bp, Homo sapiens
tatctgagggaggaggcc

SEQ ID NO: 3350573 - DNA, 23 bp, Homo sapiens
tatctgagggaggaggccacctc

SEQ ID NO: 3350574 - DNA, 22 bp, Homo sapiens
tatctgattttgtgcaaaagct

SEQ ID NO: 3350575 - DNA, 22 bp, Homo sapiens
tatctgcaagtgaggtgtgtca

SEQ ID NO: 3350576 - DNA, 12 bp, Homo sapiens
tatctgcagaac

SEQ ID NO: 3350577 - DNA, 14 bp, Homo sapiens
tatctgcagaacat

SEQ ID NO: 3350578 - DNA, 16 bp, Homo sapiens
tatctgccatgtccat

SEQ ID NO: 3350579 - DNA, 17 bp, Homo sapiens
tatctgccatgtccata

SEQ ID NO: 3350580 - DNA, 15 bp, Homo sapiens
tatctgcctggcctg

SEQ ID NO: 3350581 - DNA, 20 bp, Homo sapiens
tatctggaagttgagactta

SEQ ID NO: 3350582 - DNA, 23 bp, Homo sapiens
tatctggccctcgacactcacca

SEQ ID NO: 3350583 - DNA, 16 bp, Homo sapiens
tatctgggattattct

SEQ ID NO: 3350584 - DNA, 19 bp, Homo sapiens
tatctgggattctacttta

SEQ ID NO: 3350585 - DNA, 16 bp, Homo sapiens
tatgcattatatcaaa

SEQ ID NO: 3350586 - DNA, 22 bp, Homo sapiens
tatgcattcacatttagaaaag

SEQ ID NO: 3350587 - DNA, 15 bp, Homo sapiens
tatgcatttcattca

SEQ ID NO: 3350588 - DNA, 17 bp, Homo sapiens
tatgccatgatggaaat

SEQ ID NO: 3350589 - DNA, 18 bp, Homo sapiens
tatgcccaggtaccaccc

SEQ ID NO: 3350590 - DNA, 19 bp, Homo sapiens
tatgccccaccaaggctga

SEQ ID NO: 3350591 - DNA, 19 bp, Homo sapiens
tatgcccggcgccgggcac

SEQ ID NO: 3350592 - DNA, 20 bp, Homo sapiens
tatgccgaatgccctcaggg

SEQ ID NO: 3350593 - DNA, 16 bp, Homo sapiens
tatgcctctgtattta

SEQ ID NO: 3350594 - DNA, 19 bp, Homo sapiens
tatgccttcttattgcttt

SEQ ID NO: 3350595 - DNA, 23 bp, Homo sapiens
tatgccttggggaggacaaaact

SEQ ID NO: 3350596 - DNA, 14 bp, Homo sapiens
tatgccttgtataa

SEQ ID NO: 3350597 - DNA, 13 bp, Homo sapiens
tatgcggttaatt

SEQ ID NO: 3350598 - DNA, 18 bp, Homo sapiens
tatgctagaaaaggcatt

SEQ ID NO: 3350599 - DNA, 20 bp, Homo sapiens
tatgctagtttattggaagt

SEQ ID NO: 3350600 - DNA, 23 bp, Homo sapiens
tatgctccatcccattcacttct

SEQ ID NO: 3350601 - DNA, 18 bp, Homo sapiens
tatgctctgcatgttaca

SEQ ID NO: 3350602 - DNA, 19 bp, Homo sapiens
tatgctctgcatgttacat

SEQ ID NO: 3350603 - DNA, 13 bp, Homo sapiens
tatgctctgcttt

SEQ ID NO: 3350604 - DNA, 14 bp, Homo sapiens
tatgctgacagctc

SEQ ID NO: 3350605 - DNA, 15 bp, Homo sapiens
tatgctgacagctct

SEQ ID NO: 3350606 - DNA, 12 bp, Homo sapiens
tatgctggccag

SEQ ID NO: 3350607 - DNA, 20 bp, Homo sapiens
tatgctggccagcaccctct

SEQ ID NO: 3350608 - DNA, 16 bp, Homo sapiens
tatgcttaaaataagc

SEQ ID NO: 3350609 - DNA, 21 bp, Homo sapiens
tatggaaaaaccatttgaagt

SEQ ID NO: 3350610 - DNA, 15 bp, Homo sapiens
tatggaaaaataaaa

SEQ ID NO: 3350611 - DNA, 20 bp, Homo sapiens
tatggaaaaataaaactgtc

SEQ ID NO: 3350612 - DNA, 13 bp, Homo sapiens
tatggaaaactgt

SEQ ID NO: 3350613 - DNA, 15 bp, Homo sapiens
tatggaaaactgtgt

SEQ ID NO: 3350614 - DNA, 14 bp, Homo sapiens
tatggaagaaagta

SEQ ID NO: 3350615 - DNA, 17 bp, Homo sapiens
tataaacatcacacaca

SEQ ID NO: 3350616 - DNA, 17 bp, Homo sapiens
tataaacattaaaagaa

SEQ ID NO: 3350617 - DNA, 17 bp, Homo sapiens
tataaaccaatcttaaa

SEQ ID NO: 3350618 - DNA, 19 bp, Homo sapiens
tataaactatcagtttgtc

SEQ ID NO: 3350619 - DNA, 13 bp, Homo sapiens
tataaactttaga

SEQ ID NO: 3350620 - DNA, 22 bp, Homo sapiens
tataaagaacaaggtagttttt

SEQ ID NO: 3350621 - DNA, 18 bp, Homo sapiens
tataaagaagaacttgca

SEQ ID NO: 3350622 - DNA, 12 bp, Homo sapiens
tataaagaattc

SEQ ID NO: 3350623 - DNA, 10 bp, Homo sapiens
tataaagaca

SEQ ID NO: 3350624 - DNA, 15 bp, Homo sapiens
tataaagatatatag

SEQ ID NO: 3350625 - DNA, 16 bp, Homo sapiens
tataaagtagtcctgt

SEQ ID NO: 3350626 - DNA, 18 bp, Homo sapiens
tataaagtagtcctgtga

SEQ ID NO: 3350627 - DNA, 12 bp, Homo sapiens
tataaataataa

SEQ ID NO: 3350628 - DNA, 14 bp, Homo sapiens
tataaataataata

SEQ ID NO: 3350629 - DNA, 19 bp, Homo sapiens
tataaataggagaggatga

SEQ ID NO: 3350630 - DNA, 14 bp, Homo sapiens
tataaatatacagt

SEQ ID NO: 3350631 - DNA, 16 bp, Homo sapiens
tataaatcaatgtcac

SEQ ID NO: 3350632 - DNA, 20 bp, Homo sapiens
tataaatgtataaatataca

SEQ ID NO: 3350633 - DNA, 19 bp, Homo sapiens
tataaatgtatatacacat

SEQ ID NO: 3350634 - DNA, 12 bp, Homo sapiens
tataaatgttta

SEQ ID NO: 3350635 - DNA, 12 bp, Homo sapiens
tataaattctgt

SEQ ID NO: 3350636 - DNA, 16 bp, Homo sapiens
tataaattttttgaaa

SEQ ID NO: 3350637 - DNA, 13 bp, Homo sapiens
tataacacatttt

SEQ ID NO: 3350638 - DNA, 15 bp, Homo sapiens
tataacagatgtgaa

SEQ ID NO: 3350639 - DNA, 19 bp, Homo sapiens
tataacagatgtgaaaata

SEQ ID NO: 3350640 - DNA, 14 bp, Homo sapiens
tataacagttatat

SEQ ID NO: 3350641 - DNA, 16 bp, Homo sapiens
tataaccccagcctga

SEQ ID NO: 3350642 - DNA, 20 bp, Homo sapiens
tataaccctaggaatttaga

SEQ ID NO: 3350643 - DNA, 22 bp, Homo sapiens
tataactcaaggataccttctt

SEQ ID NO: 3350644 - DNA, 20 bp, Homo sapiens
tataactcatcataaaataa

SEQ ID NO: 3350645 - DNA, 22 bp, Homo sapiens
tataacttaaaaaaatgacaga

SEQ ID NO: 3350646 - DNA, 20 bp, Homo sapiens
tataacttaaaaatgtaaat

SEQ ID NO: 3350647 - DNA, 22 bp, Homo sapiens
tataacttaaaaatgtaaatat

SEQ ID NO: 3350648 - DNA, 18 bp, Homo sapiens
tataacttaaaatatttt

SEQ ID NO: 3350649 - DNA, 15 bp, Homo sapiens
tataacttattagca

SEQ ID NO: 3350650 - DNA, 16 bp, Homo sapiens
tataacttcttaaaag

SEQ ID NO: 3350651 - DNA, 19 bp, Homo sapiens
tataacttcttcctgctgg

SEQ ID NO: 3350652 - DNA, 22 bp, Homo sapiens
tataagaagccttaatttgcac

SEQ ID NO: 3350653 - DNA, 15 bp, Homo sapiens
tataagcactgaaaa

SEQ ID NO: 3350654 - DNA, 14 bp, Homo sapiens
tataagctgggaaa

SEQ ID NO: 3350655 - DNA, 13 bp, Homo sapiens
tataagcttaaat

SEQ ID NO: 3350656 - DNA, 15 bp, Homo sapiens
tataagcttaaatag

SEQ ID NO: 3350657 - DNA, 13 bp, Homo sapiens
tataagggagagc

SEQ ID NO: 3350658 - DNA, 17 bp, Homo sapiens
tataagggagagctgag

SEQ ID NO: 3350659 - DNA, 15 bp, Homo sapiens
tataagtcaagcaca

SEQ ID NO: 3350660 - DNA, 15 bp, Homo sapiens
tataagtcacaaaga

SEQ ID NO: 3350661 - DNA, 18 bp, Homo sapiens
tataagtcattgtatgtt

SEQ ID NO: 3350662 - DNA, 18 bp, Homo sapiens
tataagtggaggcacttt

SEQ ID NO: 3350663 - DNA, 15 bp, Homo sapiens
tataagtgtacatat

SEQ ID NO: 3350664 - DNA, 13 bp, Homo sapiens
tataagtttgaag

SEQ ID NO: 3350665 - DNA, 14 bp, Homo sapiens
tataataaaatgtg

SEQ ID NO: 3350666 - DNA, 20 bp, Homo sapiens
tataatacagaatcttgttt

SEQ ID NO: 3350667 - DNA, 17 bp, Homo sapiens
tataatatactatattt

SEQ ID NO: 3350668 - DNA, 16 bp, Homo sapiens
tataatattgaaaatt

SEQ ID NO: 3350669 - DNA, 17 bp, Homo sapiens
tataatcaaagctcata

SEQ ID NO: 3350670 - DNA, 13 bp, Homo sapiens
tataatcaaatga

SEQ ID NO: 3350671 - DNA, 23 bp, Homo sapiens
tataatcaaatgatttcatattg

SEQ ID NO: 3350672 - DNA, 22 bp, Homo sapiens
tataatccttgataatatattg

SEQ ID NO: 3350673 - DNA, 21 bp, Homo sapiens
tataatctcaaaggagaaaaa

SEQ ID NO: 3350674 - DNA, 19 bp, Homo sapiens
tataatctgtcaaaacact

SEQ ID NO: 3350675 - DNA, 22 bp, Homo sapiens
tataatctgtcaaaacactgtg

SEQ ID NO: 3350676 - DNA, 23 bp, Homo sapiens
tataatctgtcaaaacactgtgg

SEQ ID NO: 3350677 - DNA, 22 bp, Homo sapiens
tataatcttgtagacacttact

SEQ ID NO: 3350678 - DNA, 13 bp, Homo sapiens
tataatctttcta

SEQ ID NO: 3350679 - DNA, 14 bp, Homo sapiens
tataatgaagcttt

SEQ ID NO: 3350680 - DNA, 20 bp, Homo sapiens
tataatgtaagctctactga

SEQ ID NO: 3350681 - DNA, 17 bp, Homo sapiens
tataatgtcattaaaca

SEQ ID NO: 3350682 - DNA, 20 bp, Homo sapiens
tataatgtgtgtatgtgtat

SEQ ID NO: 3350683 - DNA, 16 bp, Homo sapiens
tataatgtttaaatca

SEQ ID NO: 3350684 - DNA, 17 bp, Homo sapiens
tataatgtttattaaat

SEQ ID NO: 3350685 - DNA, 20 bp, Homo sapiens
tataatgtttattaaatgct

SEQ ID NO: 3350686 - DNA, 15 bp, Homo sapiens
tataatgtttgctat

SEQ ID NO: 3350687 - DNA, 11 bp, Homo sapiens
tataattaaac

SEQ ID NO: 3350688 - DNA, 21 bp, Homo sapiens
tataattcctatatcctgtga

SEQ ID NO: 3350689 - DNA, 22 bp, Homo sapiens
tataattcctatatcctgtgac

SEQ ID NO: 3350690 - DNA, 15 bp, Homo sapiens
tataattctgtaaat

SEQ ID NO: 3350691 - DNA, 17 bp, Homo sapiens
tataattggatttccta

SEQ ID NO: 3350692 - DNA, 20 bp, Homo sapiens
tataattggtgctatttgaa

SEQ ID NO: 3350693 - DNA, 21 bp, Homo sapiens
tataattggtgctatttgaag

SEQ ID NO: 3350694 - DNA, 13 bp, Homo sapiens
tataattgtacaa

SEQ ID NO: 3350695 - DNA, 14 bp, Homo sapiens
tataattgtacaaa

SEQ ID NO: 3350696 - DNA, 17 bp, Homo sapiens
tataatttacctaagat

SEQ ID NO: 3350697 - DNA, 19 bp, Homo sapiens
tataatttatttccactaa

SEQ ID NO: 3350698 - DNA, 20 bp, Homo sapiens
tataatttttttatgttttg

SEQ ID NO: 3350699 - DNA, 22 bp, Homo sapiens
tataatttttttatgttttgtt

SEQ ID NO: 3350700 - DNA, 18 bp, Homo sapiens
tataatttttttcaatat

SEQ ID NO: 3350701 - DNA, 13 bp, Homo sapiens
tatacaaaacttt

SEQ ID NO: 3350702 - DNA, 14 bp, Homo sapiens
tatacaaatatatt

SEQ ID NO: 3350703 - DNA, 20 bp, Homo sapiens
tatacaaatatattgttaat

SEQ ID NO: 3350704 - DNA, 16 bp, Homo sapiens
tatacaaattaaaaag

SEQ ID NO: 3350705 - DNA, 17 bp, Homo sapiens
tatacaaattaaaaaga

SEQ ID NO: 3350706 - DNA, 20 bp, Homo sapiens
tatacaaattttcagaaggt

SEQ ID NO: 3350707 - DNA, 22 bp, Homo sapiens
tatacaaccctggcattatgtc

SEQ ID NO: 3350708 - DNA, 16 bp, Homo sapiens
tatacaataacccagt

SEQ ID NO: 3350709 - DNA, 14 bp, Homo sapiens
tatacaatatataa

SEQ ID NO: 3350710 - DNA, 18 bp, Homo sapiens
tatacaatatataaaaat

SEQ ID NO: 3350711 - DNA, 14 bp, Homo sapiens
tatacacaccctgc

SEQ ID NO: 3350712 - DNA, 16 bp, Homo sapiens
tatacacaccctgccc

SEQ ID NO: 3350713 - DNA, 21 bp, Homo sapiens
tatacacaccctgcccctgca

SEQ ID NO: 3350714 - DNA, 15 bp, Homo sapiens
tatacacatatacct

SEQ ID NO: 3350715 - DNA, 17 bp, Homo sapiens
tatacacatatacctat

SEQ ID NO: 3350716 - DNA, 19 bp, Homo sapiens
tatacacccagttctgaat

SEQ ID NO: 3350717 - DNA, 21 bp, Homo sapiens
tatacagatgaaaatttgaga

SEQ ID NO: 3350718 - DNA, 20 bp, Homo sapiens
tatacagctgtattgtctga

SEQ ID NO: 3350719 - DNA, 21 bp, Homo sapiens
tatacagtaactttatgtgta

SEQ ID NO: 3350720 - DNA, 16 bp, Homo sapiens
tatacagtgccttgct

SEQ ID NO: 3350721 - DNA, 13 bp, Homo sapiens
tatacagttattt

SEQ ID NO: 3350722 - DNA, 15 bp, Homo sapiens
tatacagttattttg

SEQ ID NO: 3350723 - DNA, 20 bp, Homo sapiens
tatacagttcaataaactta

SEQ ID NO: 3350724 - DNA, 19 bp, Homo sapiens
tatacatacacttgtataa

SEQ ID NO: 3350725 - DNA, 19 bp, Homo sapiens
tatacatatgtagactata

SEQ ID NO: 3350726 - DNA, 15 bp, Homo sapiens
tatacatcctgggta

SEQ ID NO: 3350727 - DNA, 18 bp, Homo sapiens
tatacatgtgatacattt

SEQ ID NO: 3350728 - DNA, 20 bp, Homo sapiens
tatacatgtgatacattttt

SEQ ID NO: 3350729 - DNA, 14 bp, Homo sapiens
tatacatgtgtgta

SEQ ID NO: 3350730 - DNA, 16 bp, Homo sapiens
tatacatgtgtgtata

SEQ ID NO: 3350731 - DNA, 17 bp, Homo sapiens
tatacatgtgtgtatat

SEQ ID NO: 3350732 - DNA, 19 bp, Homo sapiens
tatacatgtgtgtatatat

SEQ ID NO: 3350733 - DNA, 22 bp, Homo sapiens
tatacattctttatcttgacat

SEQ ID NO: 3350734 - DNA, 15 bp, Homo sapiens
tatacattgtgtgaa

SEQ ID NO: 3350735 - DNA, 22 bp, Homo sapiens
tatacattgtgtgaaaaaagaa

SEQ ID NO: 3350736 - DNA, 21 bp, Homo sapiens
taatttagtgatcttagcata

SEQ ID NO: 3350737 - DNA, 17 bp, Homo sapiens
taatttagttgtttcta

SEQ ID NO: 3350738 - DNA, 16 bp, Homo sapiens
taatttataaaaaggt

SEQ ID NO: 3350739 - DNA, 16 bp, Homo sapiens
taatttatagcaagat

SEQ ID NO: 3350740 - DNA, 21 bp, Homo sapiens
taatttatagcaagatattga

SEQ ID NO: 3350741 - DNA, 23 bp, Homo sapiens
taatttatcttgtctctgggctt

SEQ ID NO: 3350742 - DNA, 14 bp, Homo sapiens
taatttatgagttt

SEQ ID NO: 3350743 - DNA, 13 bp, Homo sapiens
taatttattaatc

SEQ ID NO: 3350744 - DNA, 15 bp, Homo sapiens
taatttattaatcta

SEQ ID NO: 3350745 - DNA, 20 bp, Homo sapiens
taatttattattgaaattgt

SEQ ID NO: 3350746 - DNA, 20 bp, Homo sapiens
taatttattgtctgtctaca

SEQ ID NO: 3350747 - DNA, 13 bp, Homo sapiens
taatttatttaat

SEQ ID NO: 3350748 - DNA, 14 bp, Homo sapiens
taatttatttatta

SEQ ID NO: 3350749 - DNA, 17 bp, Homo sapiens
taatttatttattaaga

SEQ ID NO: 3350750 - DNA, 15 bp, Homo sapiens
taatttatttcatcc

SEQ ID NO: 3350751 - DNA, 16 bp, Homo sapiens
taatttcaaaatgctt

SEQ ID NO: 3350752 - DNA, 20 bp, Homo sapiens
taatttcaaaatgcttttta

SEQ ID NO: 3350753 - DNA, 11 bp, Homo sapiens
taatttcagtg

SEQ ID NO: 3350754 - DNA, 17 bp, Homo sapiens
taatttcccttcttgca

SEQ ID NO: 3350755 - DNA, 17 bp, Homo sapiens
taatttctaaagataat

SEQ ID NO: 3350756 - DNA, 22 bp, Homo sapiens
taatttctaaagataatattac

SEQ ID NO: 3350757 - DNA, 13 bp, Homo sapiens
taatttctaatgt

SEQ ID NO: 3350758 - DNA, 21 bp, Homo sapiens
taatttctactctgtcttaaa

SEQ ID NO: 3350759 - DNA, 20 bp, Homo sapiens
taatttctagaaacaaacat

SEQ ID NO: 3350760 - DNA, 14 bp, Homo sapiens
taatttctcctccc

SEQ ID NO: 3350761 - DNA, 19 bp, Homo sapiens
taatttctcctcccttcct

SEQ ID NO: 3350762 - DNA, 17 bp, Homo sapiens
taatttcttcaaaatgt

SEQ ID NO: 3350763 - DNA, 22 bp, Homo sapiens
taatttcttcaaaatgtatata

SEQ ID NO: 3350764 - DNA, 22 bp, Homo sapiens
taatttgaaaacataatctgca

SEQ ID NO: 3350765 - DNA, 18 bp, Homo sapiens
taatttgaggacaaccat

SEQ ID NO: 3350766 - DNA, 17 bp, Homo sapiens
taatttgatgaaagctg

SEQ ID NO: 3350767 - DNA, 18 bp, Homo sapiens
taatttgatgaaagctga

SEQ ID NO: 3350768 - DNA, 19 bp, Homo sapiens
taatttgatgaaagctgat

SEQ ID NO: 3350769 - DNA, 18 bp, Homo sapiens
taatttgattaacaaata

SEQ ID NO: 3350770 - DNA, 13 bp, Homo sapiens
taatttgcacagt

SEQ ID NO: 3350771 - DNA, 19 bp, Homo sapiens
taatttgcatattctattg

SEQ ID NO: 3350772 - DNA, 20 bp, Homo sapiens
taatttgcattaaattcaca

SEQ ID NO: 3350773 - DNA, 23 bp, Homo sapiens
taatttggagcacaaaattcaaa

SEQ ID NO: 3350774 - DNA, 17 bp, Homo sapiens
taatttgtaaacttctg

SEQ ID NO: 3350775 - DNA, 19 bp, Homo sapiens
taatttgtaaacttctgaa

SEQ ID NO: 3350776 - DNA, 23 bp, Homo sapiens
taatttgtaaacttctgaagact

SEQ ID NO: 3350777 - DNA, 21 bp, Homo sapiens
taattttaaagtaatttctaa

SEQ ID NO: 3350778 - DNA, 19 bp, Homo sapiens
taattttaaataatttcta

SEQ ID NO: 3350779 - DNA, 15 bp, Homo sapiens
gtcacctagcaagct

SEQ ID NO: 3350780 - DNA, 15 bp, Homo sapiens
gtcacctctctcaga

SEQ ID NO: 3350781 - DNA, 22 bp, Homo sapiens
gtcacctgggggggttgggcgg

SEQ ID NO: 3350782 - DNA, 18 bp, Homo sapiens
gtcacgctggggctctct

SEQ ID NO: 3350783 - DNA, 20 bp, Homo sapiens
gtcacgctggggctctctga

SEQ ID NO: 3350784 - DNA, 21 bp, Homo sapiens
gtcacgctggggctctctgag

SEQ ID NO: 3350785 - DNA, 18 bp, Homo sapiens
gtcactaggatgcagatg

SEQ ID NO: 3350786 - DNA, 23 bp, Homo sapiens
gtcactcattgctgagcctctgc

SEQ ID NO: 3350787 - DNA, 24 bp, Homo sapiens
gtcactcattgctgagcctctgct

SEQ ID NO: 3350788 - DNA, 16 bp, Homo sapiens
gtcactccaccatccc

SEQ ID NO: 3350789 - DNA, 19 bp, Homo sapiens
gtcactccaccatccccac

SEQ ID NO: 3350790 - DNA, 12 bp, Homo sapiens
gtcactcctggg

SEQ ID NO: 3350791 - DNA, 14 bp, Homo sapiens
gtcactgacacaaa

SEQ ID NO: 3350792 - DNA, 20 bp, Homo sapiens
gtcactgcacagtgcatctc

SEQ ID NO: 3350793 - DNA, 11 bp, Homo sapiens
gtcactgctgt

SEQ ID NO: 3350794 - DNA, 12 bp, Homo sapiens
gtcactggaaag

SEQ ID NO: 3350795 - DNA, 14 bp, Homo sapiens
gtcactggctctcc

SEQ ID NO: 3350796 - DNA, 16 bp, Homo sapiens
gtcactggctctccaa

SEQ ID NO: 3350797 - DNA, 17 bp, Homo sapiens
gtcactggctctccaag

SEQ ID NO: 3350798 - DNA, 16 bp, Homo sapiens
gtcactggctggctcc

SEQ ID NO: 3350799 - DNA, 20 bp, Homo sapiens
gtcactgtactgacttgagg

SEQ ID NO: 3350800 - DNA, 17 bp, Homo sapiens
gtcactgtgcactgccc

SEQ ID NO: 3350801 - DNA, 14 bp, Homo sapiens
gtcactgtggtcct

SEQ ID NO: 3350802 - DNA, 18 bp, Homo sapiens
gttccctctgctcagcca

SEQ ID NO: 3350803 - DNA, 15 bp, Homo sapiens
gttccctctggcttc

SEQ ID NO: 3350804 - DNA, 16 bp, Homo sapiens
gttccctctggcttcc

SEQ ID NO: 3350805 - DNA, 15 bp, Homo sapiens
gttccctgaaacacg

SEQ ID NO: 3350806 - DNA, 16 bp, Homo sapiens
gttccctgaaacacga

SEQ ID NO: 3350807 - DNA, 12 bp, Homo sapiens
gttccctgcacc

SEQ ID NO: 3350808 - DNA, 17 bp, Homo sapiens
gttccctgcaccctgga

SEQ ID NO: 3350809 - DNA, 17 bp, Homo sapiens
gttccctgttcttcctc

SEQ ID NO: 3350810 - DNA, 18 bp, Homo sapiens
gttccctgttcttcctcc

SEQ ID NO: 3350811 - DNA, 18 bp, Homo sapiens
gttcccttggcctcagaa

SEQ ID NO: 3350812 - DNA, 19 bp, Homo sapiens
gttccctttccttccatcc

SEQ ID NO: 3350813 - DNA, 22 bp, Homo sapiens
gttccctttccttccatcccta

SEQ ID NO: 3350814 - DNA, 22 bp, Homo sapiens
gttccgaagatgctgtagtaac

SEQ ID NO: 3350815 - DNA, 18 bp, Homo sapiens
gttccgcactttccactt

SEQ ID NO: 3350816 - DNA, 23 bp, Homo sapiens
gttccgcactttccacttcttcc

SEQ ID NO: 3350817 - DNA, 19 bp, Homo sapiens
gttccggattggcttgtgt

SEQ ID NO: 3350818 - DNA, 17 bp, Homo sapiens
gttcctaacaggatgaa

SEQ ID NO: 3350819 - DNA, 19 bp, Homo sapiens
gttcctaagaagcttctaa

SEQ ID NO: 3350820 - DNA, 21 bp, Homo sapiens
gttcctaagaagcttctaata

SEQ ID NO: 3350821 - DNA, 17 bp, Homo sapiens
gttcctccccgccttcc

SEQ ID NO: 3350822 - DNA, 10 bp, Homo sapiens
gttcctcctg

SEQ ID NO: 3350823 - DNA, 15 bp, Homo sapiens
tacaatattgattgg

SEQ ID NO: 3350824 - DNA, 23 bp, Homo sapiens
tacaatattgattgggaaaacat

SEQ ID NO: 3350825 - DNA, 14 bp, Homo sapiens
tacaatattttatt

SEQ ID NO: 3350826 - DNA, 20 bp, Homo sapiens
tacaatcaaaggaaaatagt

SEQ ID NO: 3350827 - DNA, 19 bp, Homo sapiens
tacaatcatgaacagctct

SEQ ID NO: 3350828 - DNA, 23 bp, Homo sapiens
tacaatcctgtttataatctgaa

SEQ ID NO: 3350829 - DNA, 17 bp, Homo sapiens
tacaatctctttttgtt

SEQ ID NO: 3350830 - DNA, 23 bp, Homo sapiens
tacaatctttattatgcattctt

SEQ ID NO: 3350831 - DNA, 14 bp, Homo sapiens
tacaatgaactgct

SEQ ID NO: 3350832 - DNA, 21 bp, Homo sapiens
tacaatgtgaactttattaaa

SEQ ID NO: 3350833 - DNA, 22 bp, Homo sapiens
tacaatgtgaactttattaaat

SEQ ID NO: 3350834 - DNA, 13 bp, Homo sapiens
tacaatgtgtttt

SEQ ID NO: 3350835 - DNA, 19 bp, Homo sapiens
tacaatgtgtttttctcca

SEQ ID NO: 3350836 - DNA, 18 bp, Homo sapiens
tacaattaaaaaaaaaga

SEQ ID NO: 3350837 - DNA, 22 bp, Homo sapiens
tacaattaaaaaaaaagatctg

SEQ ID NO: 3350838 - DNA, 22 bp, Homo sapiens
tacaattaaaggtcctgccctc

SEQ ID NO: 3350839 - DNA, 13 bp, Homo sapiens
tacaattgtgggc

SEQ ID NO: 3350840 - DNA, 19 bp, Homo sapiens
tacaatttgtattactttc

SEQ ID NO: 3350841 - DNA, 23 bp, Homo sapiens
tacaatttgttaattcctatgaa

SEQ ID NO: 3350842 - DNA, 18 bp, Homo sapiens
tacaattttatctgtttc

SEQ ID NO: 3350843 - DNA, 17 bp, Homo sapiens
tacaattttttatcatg

SEQ ID NO: 3350844 - DNA, 15 bp, Homo sapiens
tacacaagtaaacat

SEQ ID NO: 3350845 - DNA, 16 bp, Homo sapiens
tacacaagtaaacatt

SEQ ID NO: 3350846 - DNA, 21 bp, Homo sapiens
tacacaattaattcatccctt

SEQ ID NO: 3350847 - DNA, 13 bp, Homo sapiens
tacacacacacac

SEQ ID NO: 3350848 - DNA, 16 bp, Homo sapiens
tacacacacacacaca

SEQ ID NO: 3350849 - DNA, 15 bp, Homo sapiens
tacacacacagatgt

SEQ ID NO: 3350850 - DNA, 16 bp, Homo sapiens
tacacacatgccctcc

SEQ ID NO: 3350851 - DNA, 15 bp, Homo sapiens
tacacacccgcctga

SEQ ID NO: 3350852 - DNA, 13 bp, Homo sapiens
tacacaccctgcc

SEQ ID NO: 3350853 - DNA, 23 bp, Homo sapiens
tacacaccctgcccctgcaaaga

SEQ ID NO: 3350854 - DNA, 17 bp, Homo sapiens
tacacactttatttact

SEQ ID NO: 3350855 - DNA, 16 bp, Homo sapiens
tacacagacccctccc

SEQ ID NO: 3350856 - DNA, 18 bp, Homo sapiens
tacacagagcaggactgc

SEQ ID NO: 3350857 - DNA, 16 bp, Homo sapiens
tacacagcccaagagg

SEQ ID NO: 3350858 - DNA, 13 bp, Homo sapiens
tacacagtacttt

SEQ ID NO: 3350859 - DNA, 21 bp, Homo sapiens
tacacataagaccgtgtccca

SEQ ID NO: 3350860 - DNA, 21 bp, Homo sapiens
tacacatcacacaagatttga

SEQ ID NO: 3350861 - DNA, 14 bp, Homo sapiens
tacacatttcacat

SEQ ID NO: 3350862 - DNA, 16 bp, Homo sapiens
tacacatttgtacaga

SEQ ID NO: 3350863 - DNA, 18 bp, Homo sapiens
tacaccacctcactcctg

SEQ ID NO: 3350864 - DNA, 18 bp, Homo sapiens
taagggttgaaggcagtc

SEQ ID NO: 3350865 - DNA, 18 bp, Homo sapiens
taaggtctttcagtactt

SEQ ID NO: 3350866 - DNA, 16 bp, Homo sapiens
taaggtggaaaatgga

SEQ ID NO: 3350867 - DNA, 18 bp, Homo sapiens
taaggtggaaaatggact

SEQ ID NO: 3350868 - DNA, 22 bp, Homo sapiens
taaggtttcgtttctgtataca

SEQ ID NO: 3350869 - DNA, 13 bp, Homo sapiens
taagtaaatgcta

SEQ ID NO: 3350870 - DNA, 17 bp, Homo sapiens
taagtaagtttcttcct

SEQ ID NO: 3350871 - DNA, 18 bp, Homo sapiens
taagtaatcaataaagaa

SEQ ID NO: 3350872 - DNA, 23 bp, Homo sapiens
taagtaattatcgggaacagtgt

SEQ ID NO: 3350873 - DNA, 16 bp, Homo sapiens
taagtaccctgatgcc

SEQ ID NO: 3350874 - DNA, 21 bp, Homo sapiens
taagtactagatgcatcactg

SEQ ID NO: 3350875 - DNA, 22 bp, Homo sapiens
taagtactagatgcatcactgg

SEQ ID NO: 3350876 - DNA, 16 bp, Homo sapiens
taagtactatgtatca

SEQ ID NO: 3350877 - DNA, 12 bp, Homo sapiens
taagtactgtaa

SEQ ID NO: 3350878 - DNA, 14 bp, Homo sapiens
taagtactgtaata

SEQ ID NO: 3350879 - DNA, 23 bp, Homo sapiens
taagtactgtaataatacctcaa

SEQ ID NO: 3350880 - DNA, 20 bp, Homo sapiens
taagtagttggtttgtatga

SEQ ID NO: 3350881 - DNA, 13 bp, Homo sapiens
taagtatacagtt

SEQ ID NO: 3350882 - DNA, 17 bp, Homo sapiens
taagtattatgtctctt

SEQ ID NO: 3350883 - DNA, 14 bp, Homo sapiens
taagtatttatata

SEQ ID NO: 3350884 - DNA, 18 bp, Homo sapiens
taagtatttatatattta

SEQ ID NO: 3350885 - DNA, 19 bp, Homo sapiens
taagtatttatatatttat

SEQ ID NO: 3350886 - DNA, 16 bp, Homo sapiens
taagtcaagcacatgt

SEQ ID NO: 3350887 - DNA, 20 bp, Homo sapiens
taagtcaagcacatgtaata

SEQ ID NO: 3350888 - DNA, 21 bp, Homo sapiens
taagtcaagcacatgtaataa

SEQ ID NO: 3350889 - DNA, 22 bp, Homo sapiens
taagtcaagcacatgtaataaa

SEQ ID NO: 3350890 - DNA, 19 bp, Homo sapiens
taagtcatctacttaataa

SEQ ID NO: 3350891 - DNA, 17 bp, Homo sapiens
taagtcatgtgtcccag

SEQ ID NO: 3350892 - DNA, 14 bp, Homo sapiens
taagtcccccaggg

SEQ ID NO: 3350893 - DNA, 20 bp, Homo sapiens
taagtcctttatgtggaaaa

SEQ ID NO: 3350894 - DNA, 14 bp, Homo sapiens
taagtgaatttata

SEQ ID NO: 3350895 - DNA, 19 bp, Homo sapiens
taagtgcacacagaaatat

SEQ ID NO: 3350896 - DNA, 14 bp, Homo sapiens
taagtgcccaaagt

SEQ ID NO: 3350897 - DNA, 16 bp, Homo sapiens
taagtgcgtgtgtaga

SEQ ID NO: 3350898 - DNA, 19 bp, Homo sapiens
taagtgcgtgtgtagagtt

SEQ ID NO: 3350899 - DNA, 21 bp, Homo sapiens
taagtgcgtgtgtagagttaa

SEQ ID NO: 3350900 - DNA, 13 bp, Homo sapiens
taagtgctttgta

SEQ ID NO: 3350901 - DNA, 13 bp, Homo sapiens
taagtggaaaaaa

SEQ ID NO: 3350902 - DNA, 16 bp, Homo sapiens
taagtggaaaaaagag

SEQ ID NO: 3350903 - DNA, 17 bp, Homo sapiens
taagtggaaaaaagaga

SEQ ID NO: 3350904 - DNA, 17 bp, Homo sapiens
taagtggaggcacttta

SEQ ID NO: 3350905 - DNA, 21 bp, Homo sapiens
taagtggattggctttgtgct

SEQ ID NO: 3350906 - DNA, 19 bp, Homo sapiens
taagtggggcaaaaccttg

SEQ ID NO: 3350907 - DNA, 16 bp, Homo sapiens
taagtgtaaaagtagt

SEQ ID NO: 3350908 - DNA, 16 bp, Homo sapiens
taagtgtgtcttccta

SEQ ID NO: 3350909 - DNA, 23 bp, Homo sapiens
taagtgttcgtctttagttttga

SEQ ID NO: 3350910 - DNA, 17 bp, Homo sapiens
taagtgttggaaaaaat

SEQ ID NO: 3350911 - DNA, 14 bp, Homo sapiens
taagttaataatgt

SEQ ID NO: 3350912 - DNA, 20 bp, Homo sapiens
taagttaatgtatataaaaa

SEQ ID NO: 3350913 - DNA, 19 bp, Homo sapiens
taagttacaattacatctc

SEQ ID NO: 3350914 - DNA, 14 bp, Homo sapiens
taagttatagtata

SEQ ID NO: 3350915 - DNA, 18 bp, Homo sapiens
taagttatagtgaatact

SEQ ID NO: 3350916 - DNA, 17 bp, Homo sapiens
taagttatttcttgttt

SEQ ID NO: 3350917 - DNA, 20 bp, Homo sapiens
taagttatttcttgtttgtt

SEQ ID NO: 3350918 - DNA, 17 bp, Homo sapiens
taagttatttttgtaca

SEQ ID NO: 3350919 - DNA, 13 bp, Homo sapiens
taagttctaagtt

SEQ ID NO: 3350920 - DNA, 15 bp, Homo sapiens
taagttgtacaaatg

SEQ ID NO: 3350921 - DNA, 18 bp, Homo sapiens
taagttgtacaaatgtat

SEQ ID NO: 3350922 - DNA, 22 bp, Homo sapiens
taagtttatccaaatcttgaat

SEQ ID NO: 3350923 - DNA, 16 bp, Homo sapiens
taagtttcaggtgaca

SEQ ID NO: 3350924 - DNA, 17 bp, Homo sapiens
taagtttcaggtgacat

SEQ ID NO: 3350925 - DNA, 20 bp, Homo sapiens
taagtttcaggtgacatgtg

SEQ ID NO: 3350926 - DNA, 13 bp, Homo sapiens
taagtttctaaga

SEQ ID NO: 3350927 - DNA, 18 bp, Homo sapiens
taagtttctaagattcta

SEQ ID NO: 3350928 - DNA, 21 bp, Homo sapiens
taagtttctaagattctaaag

SEQ ID NO: 3350929 - DNA, 14 bp, Homo sapiens
taagtttctgggac

SEQ ID NO: 3350930 - DNA, 18 bp, Homo sapiens
taagtttgaaggaaacag

SEQ ID NO: 3350931 - DNA, 15 bp, Homo sapiens
taataaaaagacaac

SEQ ID NO: 3350932 - DNA, 16 bp, Homo sapiens
taataaaaagattgaa

SEQ ID NO: 3350933 - DNA, 12 bp, Homo sapiens
taataaaatcac

SEQ ID NO: 3350934 - DNA, 13 bp, Homo sapiens
taataaactgtat

SEQ ID NO: 3350935 - DNA, 16 bp, Homo sapiens
taataaactgtattaa

SEQ ID NO: 3350936 - DNA, 12 bp, Homo sapiens
taataaagcatt

SEQ ID NO: 3350937 - DNA, 13 bp, Homo sapiens
taataaagcattc

SEQ ID NO: 3350938 - DNA, 14 bp, Homo sapiens
taataaagcattct

SEQ ID NO: 3350939 - DNA, 15 bp, Homo sapiens
taataaagctactga

SEQ ID NO: 3350940 - DNA, 15 bp, Homo sapiens
taataaatatttatg

SEQ ID NO: 3350941 - DNA, 15 bp, Homo sapiens
taataaatcacacat

SEQ ID NO: 3350942 - DNA, 17 bp, Homo sapiens
taataaatgtacattaa

SEQ ID NO: 3350943 - DNA, 19 bp, Homo sapiens
taataaattgaaattgtga

SEQ ID NO: 3350944 - DNA, 18 bp, Homo sapiens
taataaattgaataggta

SEQ ID NO: 3350945 - DNA, 14 bp, Homo sapiens
taataaattgctta

SEQ ID NO: 3350946 - DNA, 22 bp, Homo sapiens
taataacaatatatagaattgt

SEQ ID NO: 3350947 - DNA, 15 bp, Homo sapiens
taataacagctcctt

SEQ ID NO: 3350948 - DNA, 17 bp, Homo sapiens
taataacagctccttta

SEQ ID NO: 3350949 - DNA, 12 bp, Homo sapiens
taataacattac

SEQ ID NO: 3350950 - DNA, 21 bp, Homo sapiens
taataactgtgaagtttacat

SEQ ID NO: 3350951 - DNA, 19 bp, Homo sapiens
taataagaatggttgcctt

SEQ ID NO: 3350952 - DNA, 12 bp, Homo sapiens
taataagacata

SEQ ID NO: 3350953 - DNA, 14 bp, Homo sapiens
taataagacataac

SEQ ID NO: 3350954 - DNA, 14 bp, Homo sapiens
taataataatgttt

SEQ ID NO: 3350955 - DNA, 15 bp, Homo sapiens
taataataatttgca

SEQ ID NO: 3350956 - DNA, 19 bp, Homo sapiens
taataatattgtttttctt

SEQ ID NO: 3350957 - DNA, 13 bp, Homo sapiens
taataatgtattg

SEQ ID NO: 3350958 - DNA, 14 bp, Homo sapiens
taataatgtattgt

SEQ ID NO: 3350959 - DNA, 20 bp, Homo sapiens
taataattgctcataagcaa

SEQ ID NO: 3350960 - DNA, 14 bp, Homo sapiens
taatacacagtact

SEQ ID NO: 3350961 - DNA, 19 bp, Homo sapiens
taatacagcagtgtcatca

SEQ ID NO: 3350962 - DNA, 23 bp, Homo sapiens
taatacagcagtgtcatcagaag

SEQ ID NO: 3350963 - DNA, 22 bp, Homo sapiens
taataccattttttaaggaaac

SEQ ID NO: 3350964 - DNA, 18 bp, Homo sapiens
taatacctcaatgtttga

SEQ ID NO: 3350965 - DNA, 13 bp, Homo sapiens
taatacctctgtg

SEQ ID NO: 3350966 - DNA, 17 bp, Homo sapiens
taatactaaaatatgtc

SEQ ID NO: 3350967 - DNA, 16 bp, Homo sapiens
taatactcaaatgagt

SEQ ID NO: 3350968 - DNA, 18 bp, Homo sapiens
taatactcaaatgagtaa

SEQ ID NO: 3350969 - DNA, 13 bp, Homo sapiens
taatactctattt

SEQ ID NO: 3350970 - DNA, 15 bp, Homo sapiens
taatactctgttgta

SEQ ID NO: 3350971 - DNA, 19 bp, Homo sapiens
taatacttcatttggtgct

SEQ ID NO: 3350972 - DNA, 15 bp, Homo sapiens
taatagaaaactgaa

SEQ ID NO: 3350973 - DNA, 16 bp, Homo sapiens
taatagaaaactgaaa

SEQ ID NO: 3350974 - DNA, 20 bp, Homo sapiens
taatagaaataaattcctaa

SEQ ID NO: 3350975 - DNA, 12 bp, Homo sapiens
taatagagcaaa

SEQ ID NO: 3350976 - DNA, 21 bp, Homo sapiens
taatagcaacttttgtgtaat

SEQ ID NO: 3350977 - DNA, 14 bp, Homo sapiens
taatagcagccttt

SEQ ID NO: 3350978 - DNA, 21 bp, Homo sapiens
taatagcagcctttctctctt

SEQ ID NO: 3350979 - DNA, 21 bp, Homo sapiens
taatagcttttattgtataaa

SEQ ID NO: 3350980 - DNA, 21 bp, Homo sapiens
taataggaacaatctttgctg

SEQ ID NO: 3350981 - DNA, 14 bp, Homo sapiens
taatagggaatata

SEQ ID NO: 3350982 - DNA, 15 bp, Homo sapiens
taatagggaatatat

SEQ ID NO: 3350983 - DNA, 21 bp, Homo sapiens
taatagttcaggtaacaggca

SEQ ID NO: 3350984 - DNA, 19 bp, Homo sapiens
taatagtttacatgtagta

SEQ ID NO: 3350985 - DNA, 18 bp, Homo sapiens
taatagtttgttgatctg

SEQ ID NO: 3350986 - DNA, 20 bp, Homo sapiens
taatataatggaagagaaat

SEQ ID NO: 3350987 - DNA, 16 bp, Homo sapiens
taatatactaaaccaa

SEQ ID NO: 3350988 - DNA, 20 bp, Homo sapiens
taatatctattccatttgta

SEQ ID NO: 3350989 - DNA, 17 bp, Homo sapiens
taatatcttcacattgt

SEQ ID NO: 3350990 - DNA, 15 bp, Homo sapiens
taatatctttctgca

SEQ ID NO: 3350991 - DNA, 21 bp, Homo sapiens
taatatctttgtgataattta

SEQ ID NO: 3350992 - DNA, 15 bp, Homo sapiens
taatatgaaaactta

SEQ ID NO: 3350993 - DNA, 10 bp, Homo sapiens
taatatgcat

SEQ ID NO: 3350994 - DNA, 18 bp, Homo sapiens
taatatgctgccaaattt

SEQ ID NO: 3350995 - DNA, 15 bp, Homo sapiens
taatatggcaaaaat

SEQ ID NO: 3350996 - DNA, 16 bp, Homo sapiens
taatatggcaaaaatg

SEQ ID NO: 3350997 - DNA, 18 bp, Homo sapiens
taatatggctatgcttaa

SEQ ID NO: 3350998 - DNA, 21 bp, Homo sapiens
taatatggctatgcttaaaag

SEQ ID NO: 3350999 - DNA, 15 bp, Homo sapiens
taatatgggcattgt

SEQ ID NO: 3351000 - DNA, 18 bp, Homo sapiens
taatatgggcattgtagt

SEQ ID NO: 3351001 - DNA, 14 bp, Homo sapiens
taatattaaaaata

SEQ ID NO: 3351002 - DNA, 18 bp, Homo sapiens
taatattaaaaatatgga

SEQ ID NO: 3351003 - DNA, 21 bp, Homo sapiens
taatattactgtctttattct

SEQ ID NO: 3351004 - DNA, 18 bp, Homo sapiens
taatattagtgattctga

SEQ ID NO: 3351005 - DNA, 19 bp, Homo sapiens
taatattagtgattctgat

SEQ ID NO: 3351006 - DNA, 17 bp, Homo sapiens
taatattctccccaccc

SEQ ID NO: 3351007 - DNA, 18 bp, Homo sapiens
taatattgcttcttgtgt

SEQ ID NO: 3351008 - DNA, 21 bp, Homo sapiens
taatattgttgtataatttcg

SEQ ID NO: 3351009 - DNA, 19 bp, Homo sapiens
taatattgtttttctttct

SEQ ID NO: 3351010 - DNA, 14 bp, Homo sapiens
taatatttcaagtg

SEQ ID NO: 3351011 - DNA, 19 bp, Homo sapiens
taatcaaaattgtctcttc

SEQ ID NO: 3351012 - DNA, 14 bp, Homo sapiens
taatcaaagctcat

SEQ ID NO: 3351013 - DNA, 20 bp, Homo sapiens
taatcaaagctcataatgga

SEQ ID NO: 3351014 - DNA, 10 bp, Homo sapiens
taatcaagat

SEQ ID NO: 3351015 - DNA, 14 bp, Homo sapiens
taatcaagttgaat

SEQ ID NO: 3351016 - DNA, 17 bp, Homo sapiens
taatcaatgaatattga

SEQ ID NO: 3351017 - DNA, 19 bp, Homo sapiens
taatcaatgaatattgaag

SEQ ID NO: 3351018 - DNA, 17 bp, Homo sapiens
taatcaccttctttgta

SEQ ID NO: 3351019 - DNA, 18 bp, Homo sapiens
taatcaccttctttgtaa

SEQ ID NO: 3351020 - DNA, 12 bp, Homo sapiens
taatcagcctct

SEQ ID NO: 3351021 - DNA, 15 bp, Homo sapiens
taatcagtgactgaa

SEQ ID NO: 3351022 - DNA, 21 bp, Homo sapiens
taatcagtgactgaaaccatt

SEQ ID NO: 3351023 - DNA, 23 bp, Homo sapiens
taatcagtgtgtctaaatttgaa

SEQ ID NO: 3351024 - DNA, 22 bp, Homo sapiens
taatcagttactggtatctgtc

SEQ ID NO: 3351025 - DNA, 16 bp, Homo sapiens
taatcatctataaaga

SEQ ID NO: 3351026 - DNA, 19 bp, Homo sapiens
taatcatgtgggtgagcca

SEQ ID NO: 3351027 - DNA, 21 bp, Homo sapiens
taatcatgtgggtgagccagt

SEQ ID NO: 3351028 - DNA, 17 bp, Homo sapiens
taatcattagttttaga

SEQ ID NO: 3351029 - DNA, 21 bp, Homo sapiens
taatcatttgtttacatttga

SEQ ID NO: 3351030 - DNA, 18 bp, Homo sapiens
taatcattttcattccta

SEQ ID NO: 3351031 - DNA, 19 bp, Homo sapiens
taatccaatgggtttttcc

SEQ ID NO: 3351032 - DNA, 18 bp, Homo sapiens
taatccagtattgctgat

SEQ ID NO: 3351033 - DNA, 19 bp, Homo sapiens
taatccagttataagaaga

SEQ ID NO: 3351034 - DNA, 23 bp, Homo sapiens
taatccagttataagaagaagtt

SEQ ID NO: 3351035 - DNA, 13 bp, Homo sapiens
taatcccaccacc

SEQ ID NO: 3351036 - DNA, 16 bp, Homo sapiens
taatcccacccacctc

SEQ ID NO: 3351037 - DNA, 21 bp, Homo sapiens
taatcccagcactttgggagg

SEQ ID NO: 3351038 - DNA, 23 bp, Homo sapiens
taatcccagcactttgggaggcc

SEQ ID NO: 3351039 - DNA, 19 bp, Homo sapiens
taatcccagctacttggga

SEQ ID NO: 3351040 - DNA, 15 bp, Homo sapiens
taatcccccaggaga

SEQ ID NO: 3351041 - DNA, 16 bp, Homo sapiens
taatccctatgtttgt

SEQ ID NO: 3351042 - DNA, 22 bp, Homo sapiens
taatccctgggcattgctttcc

SEQ ID NO: 3351043 - DNA, 18 bp, Homo sapiens
taattaaccttactaatt

SEQ ID NO: 3351044 - DNA, 14 bp, Homo sapiens
taattaagtactat

SEQ ID NO: 3351045 - DNA, 13 bp, Homo sapiens
taattaagtatct

SEQ ID NO: 3351046 - DNA, 14 bp, Homo sapiens
taattaagtatctg

SEQ ID NO: 3351047 - DNA, 20 bp, Homo sapiens
taattaatatattaaaattc

SEQ ID NO: 3351048 - DNA, 14 bp, Homo sapiens
taattaattaagta

SEQ ID NO: 3351049 - DNA, 15 bp, Homo sapiens
taattaattgtcatt

SEQ ID NO: 3351050 - DNA, 23 bp, Homo sapiens
taattaatttgattaacaaatat

SEQ ID NO: 3351051 - DNA, 15 bp, Homo sapiens
taattacatacagat

SEQ ID NO: 3351052 - DNA, 16 bp, Homo sapiens
taattaccaacctgtt

SEQ ID NO: 3351053 - DNA, 17 bp, Homo sapiens
taattagaaaatatagt

SEQ ID NO: 3351054 - DNA, 14 bp, Homo sapiens
taattagctctggg

SEQ ID NO: 3351055 - DNA, 17 bp, Homo sapiens
taattaggcaaggctat

SEQ ID NO: 3351056 - DNA, 19 bp, Homo sapiens
taattagggtacatttata

SEQ ID NO: 3351057 - DNA, 20 bp, Homo sapiens
taattagggtacatttataa

SEQ ID NO: 3351058 - DNA, 21 bp, Homo sapiens
taattagggtacatttataat

SEQ ID NO: 3351059 - DNA, 22 bp, Homo sapiens
taattagggtacatttataatt

SEQ ID NO: 3351060 - DNA, 14 bp, Homo sapiens
taattagtgccact

SEQ ID NO: 3351061 - DNA, 22 bp, Homo sapiens
taattagtgccacttaatgtat

SEQ ID NO: 3351062 - DNA, 19 bp, Homo sapiens
taattatcggaagcagtgc

SEQ ID NO: 3351063 - DNA, 13 bp, Homo sapiens
taattatgacagt

SEQ ID NO: 3351064 - DNA, 22 bp, Homo sapiens
taattatgggaataattgcttt

SEQ ID NO: 3351065 - DNA, 13 bp, Homo sapiens
taattattattta

SEQ ID NO: 3351066 - DNA, 18 bp, Homo sapiens
taattatttcactttaga

SEQ ID NO: 3351067 - DNA, 20 bp, Homo sapiens
taattattttaaaatattta

SEQ ID NO: 3351068 - DNA, 16 bp, Homo sapiens
taattattttggtact

SEQ ID NO: 3351069 - DNA, 21 bp, Homo sapiens
taattattttggtacttttat

SEQ ID NO: 3351070 - DNA, 22 bp, Homo sapiens
taattcaaagctctattaagat

SEQ ID NO: 3351071 - DNA, 13 bp, Homo sapiens
taattcaagaaaa

SEQ ID NO: 3351072 - DNA, 22 bp, Homo sapiens
taattcaaggaatttcttaact

SEQ ID NO: 3351073 - DNA, 16 bp, Homo sapiens
taattcaatgtgaaca

SEQ ID NO: 3351074 - DNA, 19 bp, Homo sapiens
taattcacagaatagcaca

SEQ ID NO: 3351075 - DNA, 22 bp, Homo sapiens
taattcacagtgctcttttctc

SEQ ID NO: 3351076 - DNA, 15 bp, Homo sapiens
taattcacctatgtt

SEQ ID NO: 3351077 - DNA, 18 bp, Homo sapiens
taattcagcactgatttc

SEQ ID NO: 3351078 - DNA, 19 bp, Homo sapiens
taattcagcactgatttca

SEQ ID NO: 3351079 - DNA, 21 bp, Homo sapiens
taattcagggtggtaaagtat

SEQ ID NO: 3351080 - DNA, 23 bp, Homo sapiens
taattcagggtggtaaagtatgt

SEQ ID NO: 3351081 - DNA, 12 bp, Homo sapiens
taattcatttgt

SEQ ID NO: 3351082 - DNA, 14 bp, Homo sapiens
taattcatttgtat

SEQ ID NO: 3351083 - DNA, 18 bp, Homo sapiens
taattccaatatgatgac

SEQ ID NO: 3351084 - DNA, 15 bp, Homo sapiens
taattccacaccttt

SEQ ID NO: 3351085 - DNA, 17 bp, Homo sapiens
taattccacacctttta

SEQ ID NO: 3351086 - DNA, 20 bp, Homo sapiens
taattccctatcttttagtt

SEQ ID NO: 3351087 - DNA, 19 bp, Homo sapiens
taattcctcaacgtattgt

SEQ ID NO: 3351088 - DNA, 22 bp, Homo sapiens
taattcctctcactaaacttta

SEQ ID NO: 3351089 - DNA, 21 bp, Homo sapiens
taattcgtacataataagttt

SEQ ID NO: 3351090 - DNA, 12 bp, Homo sapiens
taattctaaagg

SEQ ID NO: 3351091 - DNA, 16 bp, Homo sapiens
taattctctttcaaag

SEQ ID NO: 3351092 - DNA, 15 bp, Homo sapiens
taattcttaagtctt

SEQ ID NO: 3351093 - DNA, 17 bp, Homo sapiens
taattcttcacctttgt

SEQ ID NO: 3351094 - DNA, 19 bp, Homo sapiens
taattcttcacctttgtaa

SEQ ID NO: 3351095 - DNA, 15 bp, Homo sapiens
taattcttctgtcct

SEQ ID NO: 3351096 - DNA, 16 bp, Homo sapiens
taattcttgtatatta

SEQ ID NO: 3351097 - DNA, 21 bp, Homo sapiens
taattctttctattttcacaa

SEQ ID NO: 3351098 - DNA, 19 bp, Homo sapiens
taattctttgttctgtttt

SEQ ID NO: 3351099 - DNA, 20 bp, Homo sapiens
taattgacaggattattgga

SEQ ID NO: 3351100 - DNA, 17 bp, Homo sapiens
taattgacggtttttta

SEQ ID NO: 3351101 - DNA, 12 bp, Homo sapiens
taattgctattt

SEQ ID NO: 3351102 - DNA, 15 bp, Homo sapiens
taattgcttacattt

SEQ ID NO: 3351103 - DNA, 15 bp, Homo sapiens
taattggatttccta

SEQ ID NO: 3351104 - DNA, 23 bp, Homo sapiens
taattggatttcctaatactgtc

SEQ ID NO: 3351105 - DNA, 21 bp, Homo sapiens
taattggcccaagtcattgtt

SEQ ID NO: 3351106 - DNA, 18 bp, Homo sapiens
taattggtgctatttgaa

SEQ ID NO: 3351107 - DNA, 16 bp, Homo sapiens
taattgtaaactgtac

SEQ ID NO: 3351108 - DNA, 15 bp, Homo sapiens
taattgtacaaaatt

SEQ ID NO: 3351109 - DNA, 17 bp, Homo sapiens
taattgtacaaaattaa

SEQ ID NO: 3351110 - DNA, 23 bp, Homo sapiens
taattgtacaaaattaagcaaat

SEQ ID NO: 3351111 - DNA, 23 bp, Homo sapiens
taattgtataagtcaagcacatg

SEQ ID NO: 3351112 - DNA, 13 bp, Homo sapiens
taattgtgtaaaa

SEQ ID NO: 3351113 - DNA, 18 bp, Homo sapiens
taattgttgaaattttgc

SEQ ID NO: 3351114 - DNA, 15 bp, Homo sapiens
taattgttgtttctt

SEQ ID NO: 3351115 - DNA, 15 bp, Homo sapiens
taattgtttccaact

SEQ ID NO: 3351116 - DNA, 16 bp, Homo sapiens
taattgttttgcactt

SEQ ID NO: 3351117 - DNA, 18 bp, Homo sapiens
taattgttttttaaagca

SEQ ID NO: 3351118 - DNA, 20 bp, Homo sapiens
taatttaaacaggcccagca

SEQ ID NO: 3351119 - DNA, 15 bp, Homo sapiens
taatttaacaaacta

SEQ ID NO: 3351120 - DNA, 20 bp, Homo sapiens
taatttaagtcattttcatg

SEQ ID NO: 3351121 - DNA, 13 bp, Homo sapiens
taatttaatgaaa

SEQ ID NO: 3351122 - DNA, 21 bp, Homo sapiens
taatttacctaagattacaaa

SEQ ID NO: 3351123 - DNA, 16 bp, Homo sapiens
taatttacttgttttg

SEQ ID NO: 3351124 - DNA, 14 bp, Homo sapiens
taatttagaatggt

SEQ ID NO: 3351125 - DNA, 16 bp, Homo sapiens
taagactcacttacat

SEQ ID NO: 3351126 - DNA, 20 bp, Homo sapiens
taagagaaaattgcactaaa

SEQ ID NO: 3351127 - DNA, 21 bp, Homo sapiens
taagagaaaattgcactaaat

SEQ ID NO: 3351128 - DNA, 18 bp, Homo sapiens
taagagaagtctcattcg

SEQ ID NO: 3351129 - DNA, 22 bp, Homo sapiens
taagagaattatatatttctaa

SEQ ID NO: 3351130 - DNA, 20 bp, Homo sapiens
taagagacagaatgtatctg

SEQ ID NO: 3351131 - DNA, 12 bp, Homo sapiens
taagagagaaat

SEQ ID NO: 3351132 - DNA, 18 bp, Homo sapiens
taagagagaaatctgaaa

SEQ ID NO: 3351133 - DNA, 15 bp, Homo sapiens
taagagatgggacta

SEQ ID NO: 3351134 - DNA, 15 bp, Homo sapiens
taagagatttatctt

SEQ ID NO: 3351135 - DNA, 16 bp, Homo sapiens
taagagatttatcttt

SEQ ID NO: 3351136 - DNA, 18 bp, Homo sapiens
taagagatttatctttat

SEQ ID NO: 3351137 - DNA, 22 bp, Homo sapiens
taagagcaccttcctcacttcc

SEQ ID NO: 3351138 - DNA, 16 bp, Homo sapiens
taagaggatctcctgt

SEQ ID NO: 3351139 - DNA, 18 bp, Homo sapiens
taagagtccaagaatcca

SEQ ID NO: 3351140 - DNA, 14 bp, Homo sapiens
taagagtgctgggc

SEQ ID NO: 3351141 - DNA, 19 bp, Homo sapiens
taagagtgggggagagcag

SEQ ID NO: 3351142 - DNA, 13 bp, Homo sapiens
taagagtgtagaa

SEQ ID NO: 3351143 - DNA, 22 bp, Homo sapiens
taagagtgtagaagcattcctt

SEQ ID NO: 3351144 - DNA, 14 bp, Homo sapiens
taagataaatgtgc

SEQ ID NO: 3351145 - DNA, 17 bp, Homo sapiens
taagataacttactgta

SEQ ID NO: 3351146 - DNA, 18 bp, Homo sapiens
taagataacttactgtat

SEQ ID NO: 3351147 - DNA, 13 bp, Homo sapiens
taagataattata

SEQ ID NO: 3351148 - DNA, 22 bp, Homo sapiens
taagatacaagtttcagacagg

SEQ ID NO: 3351149 - DNA, 23 bp, Homo sapiens
taagatacaagtttcagacaggg

SEQ ID NO: 3351150 - DNA, 17 bp, Homo sapiens
taagatagacttattct

SEQ ID NO: 3351151 - DNA, 15 bp, Homo sapiens
taagatatttgcagt

SEQ ID NO: 3351152 - DNA, 23 bp, Homo sapiens
taagatcctagatcctaagggtc

SEQ ID NO: 3351153 - DNA, 16 bp, Homo sapiens
taagatcttagattct

SEQ ID NO: 3351154 - DNA, 17 bp, Homo sapiens
taagatgagatttgcca

SEQ ID NO: 3351155 - DNA, 21 bp, Homo sapiens
taagatgagatttgccagcac

SEQ ID NO: 3351156 - DNA, 13 bp, Homo sapiens
taagatgctgggt

SEQ ID NO: 3351157 - DNA, 17 bp, Homo sapiens
taagatggattctcaga

SEQ ID NO: 3351158 - DNA, 18 bp, Homo sapiens
taagatggattctcagat

SEQ ID NO: 3351159 - DNA, 14 bp, Homo sapiens
taagatgtgatatt

SEQ ID NO: 3351160 - DNA, 15 bp, Homo sapiens
taagatgtgttctta

SEQ ID NO: 3351161 - DNA, 17 bp, Homo sapiens
taagatgttcactgtgg

SEQ ID NO: 3351162 - DNA, 15 bp, Homo sapiens
taagattaaaggaag

SEQ ID NO: 3351163 - DNA, 18 bp, Homo sapiens
taagattaaaggaaggaa

SEQ ID NO: 3351164 - DNA, 17 bp, Homo sapiens
taagattatagattcta

SEQ ID NO: 3351165 - DNA, 19 bp, Homo sapiens
taagattatagattctaaa

SEQ ID NO: 3351166 - DNA, 20 bp, Homo sapiens
taagattatagattctaaag

SEQ ID NO: 3351167 - DNA, 21 bp, Homo sapiens
taagattatagattctaaaga

SEQ ID NO: 3351168 - DNA, 22 bp, Homo sapiens
taagattatagattctaaagat

SEQ ID NO: 3351169 - DNA, 14 bp, Homo sapiens
taagattccagaga

SEQ ID NO: 3351170 - DNA, 13 bp, Homo sapiens
taagattctgatt

SEQ ID NO: 3351171 - DNA, 14 bp, Homo sapiens
taagattctgattt

SEQ ID NO: 3351172 - DNA, 23 bp, Homo sapiens
taagattcttttaaattagaaaa

SEQ ID NO: 3351173 - DNA, 16 bp, Homo sapiens
taagattgtaaaaata

SEQ ID NO: 3351174 - DNA, 12 bp, Homo sapiens
taagatttaccc

SEQ ID NO: 3351175 - DNA, 12 bp, Homo sapiens
taagattttaca

SEQ ID NO: 3351176 - DNA, 16 bp, Homo sapiens
taagattttacaaaag

SEQ ID NO: 3351177 - DNA, 18 bp, Homo sapiens
taagatttttctcaaagt

SEQ ID NO: 3351178 - DNA, 21 bp, Homo sapiens
taagcaaacaaatattgccaa

SEQ ID NO: 3351179 - DNA, 13 bp, Homo sapiens
taagcaaaggctc

SEQ ID NO: 3351180 - DNA, 15 bp, Homo sapiens
taagcaaataaacag

SEQ ID NO: 3351181 - DNA, 19 bp, Homo sapiens
taagcaaatgttaaaagtt

SEQ ID NO: 3351182 - DNA, 16 bp, Homo sapiens
taagcaaatttcaaaa

SEQ ID NO: 3351183 - DNA, 20 bp, Homo sapiens
taagcaaatttcaaaagaca

SEQ ID NO: 3351184 - DNA, 23 bp, Homo sapiens
taagcaaatttcaaaagacatgt

SEQ ID NO: 3351185 - DNA, 14 bp, Homo sapiens
taagcaacatggct

SEQ ID NO: 3351186 - DNA, 16 bp, Homo sapiens
taagcaacatggcttt

SEQ ID NO: 3351187 - DNA, 13 bp, Homo sapiens
taagcaagagaga

SEQ ID NO: 3351188 - DNA, 13 bp, Homo sapiens
taagcactacata

SEQ ID NO: 3351189 - DNA, 13 bp, Homo sapiens
taagcactcttaa

SEQ ID NO: 3351190 - DNA, 18 bp, Homo sapiens
taagcactcttaaagcaa

SEQ ID NO: 3351191 - DNA, 14 bp, Homo sapiens
taagcactgaaaaa

SEQ ID NO: 3351192 - DNA, 24 bp, Homo sapiens
taagcagagaagggcataaaacag

SEQ ID NO: 3351193 - DNA, 22 bp, Homo sapiens
taagcagatggaatgctgtgtt

SEQ ID NO: 3351194 - DNA, 15 bp, Homo sapiens
taagcagcatggaaa

SEQ ID NO: 3351195 - DNA, 18 bp, Homo sapiens
taagcagctcttgctaat

SEQ ID NO: 3351196 - DNA, 17 bp, Homo sapiens
taagcatactttgtaaa

SEQ ID NO: 3351197 - DNA, 19 bp, Homo sapiens
taagcatactttgtaaata

SEQ ID NO: 3351198 - DNA, 20 bp, Homo sapiens
taagcatatgtgttacttca

SEQ ID NO: 3351199 - DNA, 20 bp, Homo sapiens
taagcattgaaattatagtt

SEQ ID NO: 3351200 - DNA, 19 bp, Homo sapiens
taagcattgtttgcttatt

SEQ ID NO: 3351201 - DNA, 21 bp, Homo sapiens
taagcattgtttgcttattgt

SEQ ID NO: 3351202 - DNA, 16 bp, Homo sapiens
taagccaaagaaacaa

SEQ ID NO: 3351203 - DNA, 20 bp, Homo sapiens
taagccaaagaaatgaacat

SEQ ID NO: 3351204 - DNA, 23 bp, Homo sapiens
taagccaaagaaatgaacattcc

SEQ ID NO: 3351205 - DNA, 16 bp, Homo sapiens
taagccacaagaaatt

SEQ ID NO: 3351206 - DNA, 14 bp, Homo sapiens
taagccacttgaaa

SEQ ID NO: 3351207 - DNA, 15 bp, Homo sapiens
taagccagagcctgg

SEQ ID NO: 3351208 - DNA, 16 bp, Homo sapiens
taagccataggcccag

SEQ ID NO: 3351209 - DNA, 16 bp, Homo sapiens
taagccctgtcgagac

SEQ ID NO: 3351210 - DNA, 20 bp, Homo sapiens
taagccctgtcgagacactt

SEQ ID NO: 3351211 - DNA, 16 bp, Homo sapiens
taagcctaaaagtggg

SEQ ID NO: 3351212 - DNA, 16 bp, Homo sapiens
taagcctcatatttaa

SEQ ID NO: 3351213 - DNA, 20 bp, Homo sapiens
taagcctcatatttaaagac

SEQ ID NO: 3351214 - DNA, 21 bp, Homo sapiens
taagcctccatttagttcttt

SEQ ID NO: 3351215 - DNA, 13 bp, Homo sapiens
taagcctctgctt

SEQ ID NO: 3351216 - DNA, 13 bp, Homo sapiens
taagcctgagcct

SEQ ID NO: 3351217 - DNA, 16 bp, Homo sapiens
taagcctgagccttag

SEQ ID NO: 3351218 - DNA, 14 bp, Homo sapiens
taagccttcaaaac

SEQ ID NO: 3351219 - DNA, 21 bp, Homo sapiens
taagcgaagtctttgccttct

SEQ ID NO: 3351220 - DNA, 23 bp, Homo sapiens
taagcgaatgtgtacaaagtgta

SEQ ID NO: 3351221 - DNA, 14 bp, Homo sapiens
taagctattcagta

SEQ ID NO: 3351222 - DNA, 17 bp, Homo sapiens
taagctggctctgtttg

SEQ ID NO: 3351223 - DNA, 22 bp, Homo sapiens
taagctgtgtctgcccaatgaa

SEQ ID NO: 3351224 - DNA, 14 bp, Homo sapiens
taagctgtgtgcag

SEQ ID NO: 3351225 - DNA, 21 bp, Homo sapiens
taaggaaagcaataaatgaat

SEQ ID NO: 3351226 - DNA, 19 bp, Homo sapiens
taaggaaccttccttcctg

SEQ ID NO: 3351227 - DNA, 18 bp, Homo sapiens
taaggacaaaaatgaact

SEQ ID NO: 3351228 - DNA, 17 bp, Homo sapiens
taaggacgtgtgtaaat

SEQ ID NO: 3351229 - DNA, 16 bp, Homo sapiens
taaggactagatacta

SEQ ID NO: 3351230 - DNA, 22 bp, Homo sapiens
taaggaggaggagggagaagag

SEQ ID NO: 3351231 - DNA, 15 bp, Homo sapiens
taaggataaatcata

SEQ ID NO: 3351232 - DNA, 22 bp, Homo sapiens
taaggataaatcataaagtcag

SEQ ID NO: 3351233 - DNA, 19 bp, Homo sapiens
taaggatatgattaatatt

SEQ ID NO: 3351234 - DNA, 19 bp, Homo sapiens
taaggatgtcacagggcca

SEQ ID NO: 3351235 - DNA, 23 bp, Homo sapiens
taaggcacagtgggagctgagct

SEQ ID NO: 3351236 - DNA, 14 bp, Homo sapiens
taaggcaggcattg

SEQ ID NO: 3351237 - DNA, 17 bp, Homo sapiens
taaggcaggtgggcaga

SEQ ID NO: 3351238 - DNA, 18 bp, Homo sapiens
taaggcaggtgggcagac

SEQ ID NO: 3351239 - DNA, 21 bp, Homo sapiens
taaggcaggtgggcagacagt

SEQ ID NO: 3351240 - DNA, 16 bp, Homo sapiens
taaggccgtgtctctg

SEQ ID NO: 3351241 - DNA, 19 bp, Homo sapiens
taaggcctaggattctaaa

SEQ ID NO: 3351242 - DNA, 20 bp, Homo sapiens
taaggcctaggattctaaaa

SEQ ID NO: 3351243 - DNA, 21 bp, Homo sapiens
taaggcctaggattctaaaat

SEQ ID NO: 3351244 - DNA, 12 bp, Homo sapiens
taaggctctaga

SEQ ID NO: 3351245 - DNA, 19 bp, Homo sapiens
taaggctctatgagtctag

SEQ ID NO: 3351246 - DNA, 22 bp, Homo sapiens
taaggctctatgagtctagatg

SEQ ID NO: 3351247 - DNA, 15 bp, Homo sapiens
taaggctctgagagt

SEQ ID NO: 3351248 - DNA, 19 bp, Homo sapiens
taaggctctgagagtctag

SEQ ID NO: 3351249 - DNA, 13 bp, Homo sapiens
taagggaagaatt

SEQ ID NO: 3351250 - DNA, 12 bp, Homo sapiens
taagggactgtg

SEQ ID NO: 3351251 - DNA, 18 bp, Homo sapiens
taagggagagctgagcca

SEQ ID NO: 3351252 - DNA, 16 bp, Homo sapiens
taagggatttcttagg

SEQ ID NO: 3351253 - DNA, 18 bp, Homo sapiens
taagggcatgccttgtgc

SEQ ID NO: 3351254 - DNA, 20 bp, Homo sapiens
taaactcttcacaaaatctg

SEQ ID NO: 3351255 - DNA, 22 bp, Homo sapiens
taaactgaatattttggaaact

SEQ ID NO: 3351256 - DNA, 14 bp, Homo sapiens
taaactgactttat

SEQ ID NO: 3351257 - DNA, 20 bp, Homo sapiens
taaactgactttttcccccc

SEQ ID NO: 3351258 - DNA, 16 bp, Homo sapiens
taaactgcattagaaa

SEQ ID NO: 3351259 - DNA, 11 bp, Homo sapiens
taaactgccat

SEQ ID NO: 3351260 - DNA, 20 bp, Homo sapiens
taaactggtatgaataattg

SEQ ID NO: 3351261 - DNA, 20 bp, Homo sapiens
taaactgtatcaaatctgta

SEQ ID NO: 3351262 - DNA, 22 bp, Homo sapiens
taaactgtgtggactgtgatgc

SEQ ID NO: 3351263 - DNA, 13 bp, Homo sapiens
taaactgttgctc

SEQ ID NO: 3351264 - DNA, 15 bp, Homo sapiens
taaacttagaggaaa

SEQ ID NO: 3351265 - DNA, 14 bp, Homo sapiens
taaacttcacctac

SEQ ID NO: 3351266 - DNA, 17 bp, Homo sapiens
taaacttccaaagaaag

SEQ ID NO: 3351267 - DNA, 23 bp, Homo sapiens
taaacttctgcaacaagcatgca

SEQ ID NO: 3351268 - DNA, 23 bp, Homo sapiens
taaacttcttttctcttctacat

SEQ ID NO: 3351269 - DNA, 13 bp, Homo sapiens
taaacttgtgaat

SEQ ID NO: 3351270 - DNA, 20 bp, Homo sapiens
taaactttacccaaaaacta

SEQ ID NO: 3351271 - DNA, 13 bp, Homo sapiens
taaactttatttg

SEQ ID NO: 3351272 - DNA, 16 bp, Homo sapiens
taaactttatttgtaa

SEQ ID NO: 3351273 - DNA, 23 bp, Homo sapiens
taaactttatttgtaaaccattg

SEQ ID NO: 3351274 - DNA, 17 bp, Homo sapiens
taaacttttaattcatt

SEQ ID NO: 3351275 - DNA, 17 bp, Homo sapiens
taaacttttatacttgg

SEQ ID NO: 3351276 - DNA, 19 bp, Homo sapiens
taaacttttatacttgggt

SEQ ID NO: 3351277 - DNA, 15 bp, Homo sapiens
taaactttttttcaa

SEQ ID NO: 3351278 - DNA, 18 bp, Homo sapiens
taaactttttttcaatgt

SEQ ID NO: 3351279 - DNA, 16 bp, Homo sapiens
taaactttttttctgt

SEQ ID NO: 3351280 - DNA, 16 bp, Homo sapiens
taaagaaaaatatgat

SEQ ID NO: 3351281 - DNA, 21 bp, Homo sapiens
taaagaaaatgaactgcccac

SEQ ID NO: 3351282 - DNA, 13 bp, Homo sapiens
taaagaaacagct

SEQ ID NO: 3351283 - DNA, 23 bp, Homo sapiens
taaagaaacagctttcaagtgcc

SEQ ID NO: 3351284 - DNA, 23 bp, Homo sapiens
taaagaaaggaaaagaaaacaaa

SEQ ID NO: 3351285 - DNA, 11 bp, Homo sapiens
taaagaaagtg

SEQ ID NO: 3351286 - DNA, 13 bp, Homo sapiens
taaagaaagtgta

SEQ ID NO: 3351287 - DNA, 20 bp, Homo sapiens
taaagaaagtgtatttggaa

SEQ ID NO: 3351288 - DNA, 23 bp, Homo sapiens
taaagaaagtgtatttggaaata

SEQ ID NO: 3351289 - DNA, 16 bp, Homo sapiens
taaagaaattgcaata

SEQ ID NO: 3351290 - DNA, 17 bp, Homo sapiens
taaagaaatttactata

SEQ ID NO: 3351291 - DNA, 18 bp, Homo sapiens
taaagaaatttactatat

SEQ ID NO: 3351292 - DNA, 20 bp, Homo sapiens
taaagaaatttactatatat

SEQ ID NO: 3351293 - DNA, 22 bp, Homo sapiens
taaagaaatttactatatatat

SEQ ID NO: 3351294 - DNA, 20 bp, Homo sapiens
taaagaagagtgacttattt

SEQ ID NO: 3351295 - DNA, 23 bp, Homo sapiens
taaagaagagtgacttattttgt

SEQ ID NO: 3351296 - DNA, 15 bp, Homo sapiens
taaagaataatatgc

SEQ ID NO: 3351297 - DNA, 21 bp, Homo sapiens
taaagacagggaagagcagaa

SEQ ID NO: 3351298 - DNA, 23 bp, Homo sapiens
taaagacaggttacgaagacaaa

SEQ ID NO: 3351299 - DNA, 13 bp, Homo sapiens
taaagaccaaact

SEQ ID NO: 3351300 - DNA, 21 bp, Homo sapiens
taaagaccaatttatgggaga

SEQ ID NO: 3351301 - DNA, 13 bp, Homo sapiens
gttgtttgtaaat

SEQ ID NO: 3351302 - DNA, 18 bp, Homo sapiens
gttgttttgggtgaatct

SEQ ID NO: 3351303 - DNA, 13 bp, Homo sapiens
gtttaaaagaaaa

SEQ ID NO: 3351304 - DNA, 18 bp, Homo sapiens
gtttaaaagaaaaaatga

SEQ ID NO: 3351305 - DNA, 22 bp, Homo sapiens
gtttaaaataaaatgaaaattg

SEQ ID NO: 3351306 - DNA, 16 bp, Homo sapiens
gtttaaactgattcat

SEQ ID NO: 3351307 - DNA, 18 bp, Homo sapiens
gtttaaagaaagtgtatt

SEQ ID NO: 3351308 - DNA, 21 bp, Homo sapiens
gtttaaagaaagtgtatttgg

SEQ ID NO: 3351309 - DNA, 16 bp, Homo sapiens
gtttaaagagaggtta

SEQ ID NO: 3351310 - DNA, 14 bp, Homo sapiens
gtttaaagagtcta

SEQ ID NO: 3351311 - DNA, 20 bp, Homo sapiens
gtttaaagttctgtgtattt

SEQ ID NO: 3351312 - DNA, 12 bp, Homo sapiens
gtttaaatacat

SEQ ID NO: 3351313 - DNA, 14 bp, Homo sapiens
gtttaaatcatgta

SEQ ID NO: 3351314 - DNA, 17 bp, Homo sapiens
gtttaaatcatgtatgt

SEQ ID NO: 3351315 - DNA, 14 bp, Homo sapiens
gtttaacaaatcta

SEQ ID NO: 3351316 - DNA, 16 bp, Homo sapiens
gtttaacaaatctaat

SEQ ID NO: 3351317 - DNA, 23 bp, Homo sapiens
gtttaagaaaaaataacacacat

SEQ ID NO: 3351318 - DNA, 17 bp, Homo sapiens
gtttaagacaccaaata

SEQ ID NO: 3351319 - DNA, 15 bp, Homo sapiens
gtttaatatttaaac

SEQ ID NO: 3351320 - DNA, 15 bp, Homo sapiens
gtttaatgtgaactt

SEQ ID NO: 3351321 - DNA, 18 bp, Homo sapiens
gtttaatgtgaacttgta

SEQ ID NO: 3351322 - DNA, 21 bp, Homo sapiens
gtttaatgtgaacttgtagct

SEQ ID NO: 3351323 - DNA, 18 bp, Homo sapiens
gtttacaagtgtatatca

SEQ ID NO: 3351324 - DNA, 16 bp, Homo sapiens
gtttacactctttgta

SEQ ID NO: 3351325 - DNA, 15 bp, Homo sapiens
gtttacacttcatat

SEQ ID NO: 3351326 - DNA, 17 bp, Homo sapiens
gtttacagacagaagag

SEQ ID NO: 3351327 - DNA, 19 bp, Homo sapiens
gtttacagacagaagagaa

SEQ ID NO: 3351328 - DNA, 23 bp, Homo sapiens
gtttacagcactactctgtgcca

SEQ ID NO: 3351329 - DNA, 17 bp, Homo sapiens
gtttacagggagcctcc

SEQ ID NO: 3351330 - DNA, 23 bp, Homo sapiens
gtttacagggagcctcctgccca

SEQ ID NO: 3351331 - DNA, 21 bp, Homo sapiens
gtttacatttgatgcatgtct

SEQ ID NO: 3351332 - DNA, 20 bp, Homo sapiens
gtttaccatttgtaataaag

SEQ ID NO: 3351333 - DNA, 21 bp, Homo sapiens
gtttaccatttgtaataaagt

SEQ ID NO: 3351334 - DNA, 16 bp, Homo sapiens
gtttaccatttttcat

SEQ ID NO: 3351335 - DNA, 16 bp, Homo sapiens
gtttacctgaataaat

SEQ ID NO: 3351336 - DNA, 22 bp, Homo sapiens
gtttacctgaataaatggtagt

SEQ ID NO: 3351337 - DNA, 14 bp, Homo sapiens
gtttagaagctgag

SEQ ID NO: 3351338 - DNA, 20 bp, Homo sapiens
gtttaggaagaagtggtact

SEQ ID NO: 3351339 - DNA, 14 bp, Homo sapiens
gtttaggctatttg

SEQ ID NO: 3351340 - DNA, 17 bp, Homo sapiens
gtttaggggtgaaggag

SEQ ID NO: 3351341 - DNA, 18 bp, Homo sapiens
gtttagtggctcaacatt

SEQ ID NO: 3351342 - DNA, 13 bp, Homo sapiens
gtttataaatctt

SEQ ID NO: 3351343 - DNA, 16 bp, Homo sapiens
gtttataatctgaaga

SEQ ID NO: 3351344 - DNA, 20 bp, Homo sapiens
gtttatactgtatttctaag

SEQ ID NO: 3351345 - DNA, 23 bp, Homo sapiens
gtttatactgtatttctaagaag

SEQ ID NO: 3351346 - DNA, 20 bp, Homo sapiens
gtttatagagggccaagact

SEQ ID NO: 3351347 - DNA, 20 bp, Homo sapiens
gtttatagcaaacttggaat

SEQ ID NO: 3351348 - DNA, 10 bp, Homo sapiens
gtttatatgg

SEQ ID NO: 3351349 - DNA, 19 bp, Homo sapiens
gtttatatggaagaaagta

SEQ ID NO: 3351350 - DNA, 21 bp, Homo sapiens
gtttatatggaagaaagtaag

SEQ ID NO: 3351351 - DNA, 16 bp, Homo sapiens
gtttatcagatacatc

SEQ ID NO: 3351352 - DNA, 21 bp, Homo sapiens
gtttatcagatacatcactgc

SEQ ID NO: 3351353 - DNA, 12 bp, Homo sapiens
gtttatgaaaat

SEQ ID NO: 3351354 - DNA, 17 bp, Homo sapiens
gtttatgatatttcttg

SEQ ID NO: 3351355 - DNA, 23 bp, Homo sapiens
gtttatggccacatttaatatct

SEQ ID NO: 3351356 - DNA, 15 bp, Homo sapiens
gtttatggcctcagc

SEQ ID NO: 3351357 - DNA, 23 bp, Homo sapiens
gtttatggcctcagctgcctcac

SEQ ID NO: 3351358 - DNA, 18 bp, Homo sapiens
gtttattaacaaattatg

SEQ ID NO: 3351359 - DNA, 18 bp, Homo sapiens
gtttattaatcttagtgt

SEQ ID NO: 3351360 - DNA, 21 bp, Homo sapiens
gtttattaatcttagtgtatg

SEQ ID NO: 3351361 - DNA, 23 bp, Homo sapiens
gtttattaatcttagtgtatgat

SEQ ID NO: 3351362 - DNA, 14 bp, Homo sapiens
gtttattacaattt

SEQ ID NO: 3351363 - DNA, 15 bp, Homo sapiens
gtttattcttctaga

SEQ ID NO: 3351364 - DNA, 16 bp, Homo sapiens
gtttattcttctagag

SEQ ID NO: 3351365 - DNA, 19 bp, Homo sapiens
gtttattcttctagagttc

SEQ ID NO: 3351366 - DNA, 20 bp, Homo sapiens
gtttattcttctagagttca

SEQ ID NO: 3351367 - DNA, 20 bp, Homo sapiens
gtttattggaagtgttcaag

SEQ ID NO: 3351368 - DNA, 16 bp, Homo sapiens
gtttatttcacttgat

SEQ ID NO: 3351369 - DNA, 21 bp, Homo sapiens
gtttatttccaaataaaatga

SEQ ID NO: 3351370 - DNA, 14 bp, Homo sapiens
gtttattttatatt

SEQ ID NO: 3351371 - DNA, 20 bp, Homo sapiens
gtttcaaagatgctgtgagt

SEQ ID NO: 3351372 - DNA, 23 bp, Homo sapiens
gtttcaaggcactctagattcca

SEQ ID NO: 3351373 - DNA, 17 bp, Homo sapiens
gtttcaagttttaaagt

SEQ ID NO: 3351374 - DNA, 15 bp, Homo sapiens
gtttcaatcactgtc

SEQ ID NO: 3351375 - DNA, 19 bp, Homo sapiens
gtttcaatgtgattctaat

SEQ ID NO: 3351376 - DNA, 16 bp, Homo sapiens
gtttcacccttaaccc

SEQ ID NO: 3351377 - DNA, 19 bp, Homo sapiens
gtttcacggtgccaggttt

SEQ ID NO: 3351378 - DNA, 21 bp, Homo sapiens
gtttcagatatatatcatatt

SEQ ID NO: 3351379 - DNA, 10 bp, Homo sapiens
gtttcaggtg

SEQ ID NO: 3351380 - DNA, 15 bp, Homo sapiens
gtttcaggtgacatg

SEQ ID NO: 3351381 - DNA, 12 bp, Homo sapiens
gtttcagtttga

SEQ ID NO: 3351382 - DNA, 23 bp, Homo sapiens
gtttcatgtagccagcagaactg

SEQ ID NO: 3351383 - DNA, 17 bp, Homo sapiens
gtttcatgttagttacc

SEQ ID NO: 3351384 - DNA, 19 bp, Homo sapiens
gtttcattctcctgcctgt

SEQ ID NO: 3351385 - DNA, 20 bp, Homo sapiens
gtttcatttagtcatgtgac

SEQ ID NO: 3351386 - DNA, 16 bp, Homo sapiens
gtttccaacctggagt

SEQ ID NO: 3351387 - DNA, 14 bp, Homo sapiens
gtttccaagctgcg

SEQ ID NO: 3351388 - DNA, 19 bp, Homo sapiens
gtttccagacttccttgag

SEQ ID NO: 3351389 - DNA, 17 bp, Homo sapiens
gtttccagcagaagaca

SEQ ID NO: 3351390 - DNA, 18 bp, Homo sapiens
gtttccatattttttgca

SEQ ID NO: 3351391 - DNA, 15 bp, Homo sapiens
gtttcccataatttt

SEQ ID NO: 3351392 - DNA, 21 bp, Homo sapiens
gtttcccataattttcttcat

SEQ ID NO: 3351393 - DNA, 20 bp, Homo sapiens
gtttcccttgccctttccat

SEQ ID NO: 3351394 - DNA, 17 bp, Homo sapiens
gttcttagtttgcagtt

SEQ ID NO: 3351395 - DNA, 17 bp, Homo sapiens
gttcttatttttataac

SEQ ID NO: 3351396 - DNA, 11 bp, Homo sapiens
gttcttcatga

SEQ ID NO: 3351397 - DNA, 21 bp, Homo sapiens
gttcttctgttctgcagacac

SEQ ID NO: 3351398 - DNA, 12 bp, Homo sapiens
gttcttgctgct

SEQ ID NO: 3351399 - DNA, 16 bp, Homo sapiens
gttcttgctgctagaa

SEQ ID NO: 3351400 - DNA, 18 bp, Homo sapiens
gttcttggtgctctgtgt

SEQ ID NO: 3351401 - DNA, 15 bp, Homo sapiens
gttctttaggagatt

SEQ ID NO: 3351402 - DNA, 16 bp, Homo sapiens
gttctttaggagattt

SEQ ID NO: 3351403 - DNA, 16 bp, Homo sapiens
gttctttcttcctctg

SEQ ID NO: 3351404 - DNA, 18 bp, Homo sapiens
gttctttcttcctctgct

SEQ ID NO: 3351405 - DNA, 22 bp, Homo sapiens
gttctttgagggactgcctctg

SEQ ID NO: 3351406 - DNA, 23 bp, Homo sapiens
gttctttgagggactgcctctgc

SEQ ID NO: 3351407 - DNA, 12 bp, Homo sapiens
gttcttttgcat

SEQ ID NO: 3351408 - DNA, 16 bp, Homo sapiens
gttctttttgtacact

SEQ ID NO: 3351409 - DNA, 21 bp, Homo sapiens
gttgaaaaaatttaaaagtaa

SEQ ID NO: 3351410 - DNA, 20 bp, Homo sapiens
gttgaaaggttttttttcag

SEQ ID NO: 3351411 - DNA, 23 bp, Homo sapiens
gttgaaaggttttttttcagttg

SEQ ID NO: 3351412 - DNA, 20 bp, Homo sapiens
gttgaactttgccaaaaaaa

SEQ ID NO: 3351413 - DNA, 17 bp, Homo sapiens
gttgaatactttttaca

SEQ ID NO: 3351414 - DNA, 17 bp, Homo sapiens
gttgaatatagcctgcc

SEQ ID NO: 3351415 - DNA, 20 bp, Homo sapiens
gttgaatatagcctgcctca

SEQ ID NO: 3351416 - DNA, 20 bp, Homo sapiens
gttgaatctgagctgcaggt

SEQ ID NO: 3351417 - DNA, 15 bp, Homo sapiens
gttgaatgacaacag

SEQ ID NO: 3351418 - DNA, 19 bp, Homo sapiens
gttgaatgacaacagaagc

SEQ ID NO: 3351419 - DNA, 19 bp, Homo sapiens
gttgaatgttgcaatgtga

SEQ ID NO: 3351420 - DNA, 15 bp, Homo sapiens
gttgacaaaattttc

SEQ ID NO: 3351421 - DNA, 16 bp, Homo sapiens
gttgacagcaaaatgt

SEQ ID NO: 3351422 - DNA, 19 bp, Homo sapiens
gtgtaaaaaatggaaaaaa

SEQ ID NO: 3351423 - DNA, 20 bp, Homo sapiens
gtgtaaaaaatggaaaaaaa

SEQ ID NO: 3351424 - DNA, 21 bp, Homo sapiens
gtgtaaaaaatggaaaaaaac

SEQ ID NO: 3351425 - DNA, 12 bp, Homo sapiens
gtgtaaagctgg

SEQ ID NO: 3351426 - DNA, 15 bp, Homo sapiens
gtgtaaagctggccc

SEQ ID NO: 3351427 - DNA, 22 bp, Homo sapiens
gtgtaaatatgtacatttgtct

SEQ ID NO: 3351428 - DNA, 17 bp, Homo sapiens
gtgtaacaattgtgtag

SEQ ID NO: 3351429 - DNA, 15 bp, Homo sapiens
gtgtaacagctgagg

SEQ ID NO: 3351430 - DNA, 21 bp, Homo sapiens
gtgtaacagctgaggtctctt

SEQ ID NO: 3351431 - DNA, 14 bp, Homo sapiens
gtgtaagaaaacaa

SEQ ID NO: 3351432 - DNA, 13 bp, Homo sapiens
gtgtaataaagtg

SEQ ID NO: 3351433 - DNA, 22 bp, Homo sapiens
gtgtaataaagtgttttcagag

SEQ ID NO: 3351434 - DNA, 14 bp, Homo sapiens
gtgtaataagacat

SEQ ID NO: 3351435 - DNA, 17 bp, Homo sapiens
gtgtaatttataaaatt

SEQ ID NO: 3351436 - DNA, 15 bp, Homo sapiens
gtgtacactaacatt

SEQ ID NO: 3351437 - DNA, 14 bp, Homo sapiens
gtgtacatcatgtt

SEQ ID NO: 3351438 - DNA, 17 bp, Homo sapiens
gtgtacatcatgttatt

SEQ ID NO: 3351439 - DNA, 12 bp, Homo sapiens
gtgtacatttta

SEQ ID NO: 3351440 - DNA, 21 bp, Homo sapiens
gtgtacctcctctcagtgttt

SEQ ID NO: 3351441 - DNA, 14 bp, Homo sapiens
gtgtagaacactaa

SEQ ID NO: 3351442 - DNA, 15 bp, Homo sapiens
gtgtagagttaagaa

SEQ ID NO: 3351443 - DNA, 21 bp, Homo sapiens
gtgtagccaggtatggctctg

SEQ ID NO: 3351444 - DNA, 19 bp, Homo sapiens
gtgtagcctaaagggcagg

SEQ ID NO: 3351445 - DNA, 20 bp, Homo sapiens
gtgtagcctaaagggcaggg

SEQ ID NO: 3351446 - DNA, 21 bp, Homo sapiens
gtgtagcctaaagggcagggc

SEQ ID NO: 3351447 - DNA, 22 bp, Homo sapiens
gtgtagcctaaagggcagggcc

SEQ ID NO: 3351448 - DNA, 14 bp, Homo sapiens
gtgtagcctgtgca

SEQ ID NO: 3351449 - DNA, 20 bp, Homo sapiens
gtgtagcctttttgtataaa

SEQ ID NO: 3351450 - DNA, 15 bp, Homo sapiens
gtgtaggggcaggga

SEQ ID NO: 3351451 - DNA, 16 bp, Homo sapiens
gtgtaggggccacctc

SEQ ID NO: 3351452 - DNA, 14 bp, Homo sapiens
gtgtaggttatctt

SEQ ID NO: 3351453 - DNA, 22 bp, Homo sapiens
gtgtagtggaagagcagcctga

SEQ ID NO: 3351454 - DNA, 14 bp, Homo sapiens
gtgtatacatgcca

SEQ ID NO: 3351455 - DNA, 18 bp, Homo sapiens
gtgtatatatgtgtatat

SEQ ID NO: 3351456 - DNA, 16 bp, Homo sapiens
gtgtatattatttggc

SEQ ID NO: 3351457 - DNA, 19 bp, Homo sapiens
gtgtatattatttggcagt

SEQ ID NO: 3351458 - DNA, 17 bp, Homo sapiens
gtgtatatttattcata

SEQ ID NO: 3351459 - DNA, 22 bp, Homo sapiens
gtgtatcaggtcagggacttgg

SEQ ID NO: 3351460 - DNA, 21 bp, Homo sapiens
gtgtatccgactctaagctgt

SEQ ID NO: 3351461 - DNA, 20 bp, Homo sapiens
gtgtatgccacacctggcct

SEQ ID NO: 3351462 - DNA, 20 bp, Homo sapiens
gtgtatgtgtctgctaatgt

SEQ ID NO: 3351463 - DNA, 20 bp, Homo sapiens
gtgtatttaattgtaaactg

SEQ ID NO: 3351464 - DNA, 22 bp, Homo sapiens
gtgtatttaattgtaaactgta

SEQ ID NO: 3351465 - DNA, 17 bp, Homo sapiens
gtgtatttacgctttga

SEQ ID NO: 3351466 - DNA, 20 bp, Homo sapiens
gtgtatttattgaagaaaca

SEQ ID NO: 3351467 - DNA, 19 bp, Homo sapiens
gtgtatttccagtgcaatt

SEQ ID NO: 3351468 - DNA, 19 bp, Homo sapiens
gtgtatttcttatacgctt

SEQ ID NO: 3351469 - DNA, 13 bp, Homo sapiens
gtgtatttgtatt

SEQ ID NO: 3351470 - DNA, 22 bp, Homo sapiens
gtgtatttgtattaataaagca

SEQ ID NO: 3351471 - DNA, 23 bp, Homo sapiens
gtgtatttgtattaataaagcat

SEQ ID NO: 3351472 - DNA, 22 bp, Homo sapiens
gtgtatttttcaggtaggccct

SEQ ID NO: 3351473 - DNA, 19 bp, Homo sapiens
gtgtcaactctttgttatt

SEQ ID NO: 3351474 - DNA, 18 bp, Homo sapiens
gtgtcaagttgtgcttgt

SEQ ID NO: 3351475 - DNA, 14 bp, Homo sapiens
gtgtcacctgaaga

SEQ ID NO: 3351476 - DNA, 22 bp, Homo sapiens
gtgtcacctgaagactcattct

SEQ ID NO: 3351477 - DNA, 23 bp, Homo sapiens
gtgtcactactcacagtctcttt

SEQ ID NO: 3351478 - DNA, 23 bp, Homo sapiens
gtgtcactttttaaaccactgta

SEQ ID NO: 3351479 - DNA, 16 bp, Homo sapiens
gtgtcagaaaccctgg

SEQ ID NO: 3351480 - DNA, 23 bp, Homo sapiens
gtgtcagaaaccctggtctccgt

SEQ ID NO: 3351481 - DNA, 18 bp, Homo sapiens
gtgtcaggtggggcagct

SEQ ID NO: 3351482 - DNA, 20 bp, Homo sapiens
gtgtcatatgactgattact

SEQ ID NO: 3351483 - DNA, 13 bp, Homo sapiens
gtgtcatttcaaa

SEQ ID NO: 3351484 - DNA, 19 bp, Homo sapiens
gtgtcatttccggctgctg

SEQ ID NO: 3351485 - DNA, 22 bp, Homo sapiens
gtgtccagcagctgcgggtctg

SEQ ID NO: 3351486 - DNA, 21 bp, Homo sapiens
gtgtccatgcgctcagggcca

SEQ ID NO: 3351487 - DNA, 17 bp, Homo sapiens
gtgtcccaaggagctga

SEQ ID NO: 3351488 - DNA, 19 bp, Homo sapiens
gtgtcccatgacccacccc

SEQ ID NO: 3351489 - DNA, 21 bp, Homo sapiens
gtgtcccatgacccacccctg

SEQ ID NO: 3351490 - DNA, 22 bp, Homo sapiens
gtgtcccatgacccacccctgt

SEQ ID NO: 3351491 - DNA, 23 bp, Homo sapiens
gtgtcccatgacccacccctgtg

SEQ ID NO: 3351492 - DNA, 19 bp, Homo sapiens
gtgtcccattggtgttgtc

SEQ ID NO: 3351493 - DNA, 21 bp, Homo sapiens
gtgtcccctcactctgtcagc

SEQ ID NO: 3351494 - DNA, 13 bp, Homo sapiens
gtgtcccctccac

SEQ ID NO: 3351495 - DNA, 22 bp, Homo sapiens
gtgtccctggacacagctcttc

SEQ ID NO: 3351496 - DNA, 16 bp, Homo sapiens
gtgtcctgaccaccct

SEQ ID NO: 3351497 - DNA, 18 bp, Homo sapiens
gtgtcctgaccaccctcc

SEQ ID NO: 3351498 - DNA, 12 bp, Homo sapiens
gtgtccttccct

SEQ ID NO: 3351499 - DNA, 15 bp, Homo sapiens
gtgtccttccctgca

SEQ ID NO: 3351500 - DNA, 23 bp, Homo sapiens
gtgtcgctctgctggcctggccg

SEQ ID NO: 3351501 - DNA, 13 bp, Homo sapiens
gtgtcgtctgtga

SEQ ID NO: 3351502 - DNA, 18 bp, Homo sapiens
gtgtcgtctgtgaatgct

SEQ ID NO: 3351503 - DNA, 16 bp, Homo sapiens
gtgtctaagattctag

SEQ ID NO: 3351504 - DNA, 18 bp, Homo sapiens
gtgtctaagattctagat

SEQ ID NO: 3351505 - DNA, 23 bp, Homo sapiens
gtgtctcaatctgatctgagtga

SEQ ID NO: 3351506 - DNA, 22 bp, Homo sapiens
gtgtctccccgtgtcctctccc

SEQ ID NO: 3351507 - DNA, 20 bp, Homo sapiens
gtgtctctcccaccccggcc

SEQ ID NO: 3351508 - DNA, 22 bp, Homo sapiens
gtgtctgactcaggcgcctggc

SEQ ID NO: 3351509 - DNA, 15 bp, Homo sapiens
gtgtctgctaatgta

SEQ ID NO: 3351510 - DNA, 15 bp, Homo sapiens
gtgtctgctcagtaa

SEQ ID NO: 3351511 - DNA, 12 bp, Homo sapiens
gtgtctgtacac

SEQ ID NO: 3351512 - DNA, 14 bp, Homo sapiens
gtgtctgtatttat

SEQ ID NO: 3351513 - DNA, 14 bp, Homo sapiens
gtgtctgtgccatg

SEQ ID NO: 3351514 - DNA, 15 bp, Homo sapiens
gtgtctgtgccatgg

SEQ ID NO: 3351515 - DNA, 15 bp, Homo sapiens
gtgtctgtggggagg

SEQ ID NO: 3351516 - DNA, 20 bp, Homo sapiens
gtgtcttgggcagagctggc

SEQ ID NO: 3351517 - DNA, 22 bp, Homo sapiens
gtgtctttctttggtgcctttc

SEQ ID NO: 3351518 - DNA, 21 bp, Homo sapiens
gtgtgaaaggaagctccactg

SEQ ID NO: 3351519 - DNA, 18 bp, Homo sapiens
gtgtgaaagtcagatgcc

SEQ ID NO: 3351520 - DNA, 20 bp, Homo sapiens
gtgtgaactcaccctgggag

SEQ ID NO: 3351521 - DNA, 23 bp, Homo sapiens
gtgtgaactcaccctgggagcca

SEQ ID NO: 3351522 - DNA, 18 bp, Homo sapiens
gtgtgaatactggaagct

SEQ ID NO: 3351523 - DNA, 22 bp, Homo sapiens
gtgtgacaaggattgctactgt

SEQ ID NO: 3351524 - DNA, 13 bp, Homo sapiens
gtgtgacagggcc

SEQ ID NO: 3351525 - DNA, 12 bp, Homo sapiens
gtgtgactggca

SEQ ID NO: 3351526 - DNA, 16 bp, Homo sapiens
gtgtgagaagtgcctt

SEQ ID NO: 3351527 - DNA, 21 bp, Homo sapiens
gtgtgagaagtgccttctcct

SEQ ID NO: 3351528 - DNA, 12 bp, Homo sapiens
gtgtgagactgg

SEQ ID NO: 3351529 - DNA, 14 bp, Homo sapiens
gtgtgagcgccttg

SEQ ID NO: 3351530 - DNA, 15 bp, Homo sapiens
gtgtgagcgccttgg

SEQ ID NO: 3351531 - DNA, 19 bp, Homo sapiens
gtgtgaggagctgctggct

SEQ ID NO: 3351532 - DNA, 17 bp, Homo sapiens
gtgtgagtaagagctgg

SEQ ID NO: 3351533 - DNA, 20 bp, Homo sapiens
gtgtgagtcaccaagcccag

SEQ ID NO: 3351534 - DNA, 19 bp, Homo sapiens
gtgtgagtggcagccatgc

SEQ ID NO: 3351535 - DNA, 14 bp, Homo sapiens
gtgtgagtgtgaca

SEQ ID NO: 3351536 - DNA, 15 bp, Homo sapiens
gtgtgagtgtgacag

SEQ ID NO: 3351537 - DNA, 21 bp, Homo sapiens
gttattttctttatcattgct

SEQ ID NO: 3351538 - DNA, 23 bp, Homo sapiens
gttattttctttgaaattgttta

SEQ ID NO: 3351539 - DNA, 14 bp, Homo sapiens
gttattttgctttg

SEQ ID NO: 3351540 - DNA, 15 bp, Homo sapiens
gttattttggatata

SEQ ID NO: 3351541 - DNA, 17 bp, Homo sapiens
gttattttggatatatt

SEQ ID NO: 3351542 - DNA, 17 bp, Homo sapiens
gttatttttcaaggaag

SEQ ID NO: 3351543 - DNA, 15 bp, Homo sapiens
gttatttttgtacat

SEQ ID NO: 3351544 - DNA, 22 bp, Homo sapiens
gttatttttgtttcttccaaag

SEQ ID NO: 3351545 - DNA, 16 bp, Homo sapiens
gttattttttaattat

SEQ ID NO: 3351546 - DNA, 21 bp, Homo sapiens
gttattttttaattattattt

SEQ ID NO: 3351547 - DNA, 13 bp, Homo sapiens
gttcaaaacattc

SEQ ID NO: 3351548 - DNA, 17 bp, Homo sapiens
gttcaaaacattccaag

SEQ ID NO: 3351549 - DNA, 23 bp, Homo sapiens
gttcaaagccacattatttctag

SEQ ID NO: 3351550 - DNA, 18 bp, Homo sapiens
gttcaaagtgtatattta

SEQ ID NO: 3351551 - DNA, 21 bp, Homo sapiens
gttcaaagtgtatatttattc

SEQ ID NO: 3351552 - DNA, 23 bp, Homo sapiens
gttcaaagtgtatatttattcat

SEQ ID NO: 3351553 - DNA, 22 bp, Homo sapiens
gttcaaatgcattttgggggtt

SEQ ID NO: 3351554 - DNA, 13 bp, Homo sapiens
gttcaacaaagaa

SEQ ID NO: 3351555 - DNA, 21 bp, Homo sapiens
gtcattgacttcattttatat

SEQ ID NO: 3351556 - DNA, 22 bp, Homo sapiens
gtcattgacttcattttatatt

SEQ ID NO: 3351557 - DNA, 15 bp, Homo sapiens
gtcattgctgctgct

SEQ ID NO: 3351558 - DNA, 20 bp, Homo sapiens
gtcattgtaaacaaactctt

SEQ ID NO: 3351559 - DNA, 22 bp, Homo sapiens
gtcatttgactgtctcactttt

SEQ ID NO: 3351560 - DNA, 17 bp, Homo sapiens
gtcatttgagcagggct

SEQ ID NO: 3351561 - DNA, 19 bp, Homo sapiens
gtcatttgagcagggctca

SEQ ID NO: 3351562 - DNA, 21 bp, Homo sapiens
gtcatttgagcagggctcagc

SEQ ID NO: 3351563 - DNA, 17 bp, Homo sapiens
gtcatttgttgtgatgt

SEQ ID NO: 3351564 - DNA, 21 bp, Homo sapiens
gtcatttgttgtgatgtcttt

SEQ ID NO: 3351565 - DNA, 21 bp, Homo sapiens
gtcattttaactttatcacat

SEQ ID NO: 3351566 - DNA, 21 bp, Homo sapiens
gtcatttttaacagcatgctg

SEQ ID NO: 3351567 - DNA, 17 bp, Homo sapiens
gtccaaaaaaaggaaaa

SEQ ID NO: 3351568 - DNA, 21 bp, Homo sapiens
gtccaaaaaaaggaaaaataa

SEQ ID NO: 3351569 - DNA, 17 bp, Homo sapiens
gtccaaacgtcctcttt

SEQ ID NO: 3351570 - DNA, 16 bp, Homo sapiens
gtccaaaggaggctgg

SEQ ID NO: 3351571 - DNA, 13 bp, Homo sapiens
gtccaaataaaaa

SEQ ID NO: 3351572 - DNA, 21 bp, Homo sapiens
gtggttacagtgcagacaggc

SEQ ID NO: 3351573 - DNA, 12 bp, Homo sapiens
gtggttcctaag

SEQ ID NO: 3351574 - DNA, 17 bp, Homo sapiens
gtggttcctaagggaaa

SEQ ID NO: 3351575 - DNA, 21 bp, Homo sapiens
gtggttcctttgcaccctgta

SEQ ID NO: 3351576 - DNA, 14 bp, Homo sapiens
gtggttctatttta

SEQ ID NO: 3351577 - DNA, 24 bp, Homo sapiens
gtggttcttaaatgtttatactgt

SEQ ID NO: 3351578 - DNA, 17 bp, Homo sapiens
gtggtttgatcatttct

SEQ ID NO: 3351579 - DNA, 16 bp, Homo sapiens
gtggtttgcttgctct

SEQ ID NO: 3351580 - DNA, 23 bp, Homo sapiens
gtggttttagattttctggttct

SEQ ID NO: 3351581 - DNA, 17 bp, Homo sapiens
gtgtaaaaaatggaaaa

SEQ ID NO: 3351582 - DNA, 13 bp, Homo sapiens
gtggaaagcactt

SEQ ID NO: 3351583 - DNA, 16 bp, Homo sapiens
gtggaaagtgaatttg

SEQ ID NO: 3351584 - DNA, 19 bp, Homo sapiens
gtggaaagtgaatttgaat

SEQ ID NO: 3351585 - DNA, 11 bp, Homo sapiens
gtggaaatcct

SEQ ID NO: 3351586 - DNA, 17 bp, Homo sapiens
gtggaacctctgtctca

SEQ ID NO: 3351587 - DNA, 20 bp, Homo sapiens
gtggaacctctgtctcatcc

SEQ ID NO: 3351588 - DNA, 15 bp, Homo sapiens
gtggaagaagggaga

SEQ ID NO: 3351589 - DNA, 18 bp, Homo sapiens
gtggaagaagggagaaga

SEQ ID NO: 3351590 - DNA, 13 bp, Homo sapiens
gtggaagcttcta

SEQ ID NO: 3351591 - DNA, 13 bp, Homo sapiens
gtggaagggctgg

SEQ ID NO: 3351592 - DNA, 14 bp, Homo sapiens
gtggaagggctggg

SEQ ID NO: 3351593 - DNA, 15 bp, Homo sapiens
gtggaagggctgggt

SEQ ID NO: 3351594 - DNA, 20 bp, Homo sapiens
gtggacacaacagcagtctc

SEQ ID NO: 3351595 - DNA, 22 bp, Homo sapiens
gtggacacagatcccactggaa

SEQ ID NO: 3351596 - DNA, 18 bp, Homo sapiens
gtggacacagctcttctc

SEQ ID NO: 3351597 - DNA, 22 bp, Homo sapiens
gtggacacagctcttctccagg

SEQ ID NO: 3351598 - DNA, 20 bp, Homo sapiens
gtggaccaattattgatata

SEQ ID NO: 3351599 - DNA, 19 bp, Homo sapiens
gtggacccagcgggcaggt

SEQ ID NO: 3351600 - DNA, 19 bp, Homo sapiens
gtggaccgtggacaggccc

SEQ ID NO: 3351601 - DNA, 21 bp, Homo sapiens
gtggaccgtggacaggcccag

SEQ ID NO: 3351602 - DNA, 19 bp, Homo sapiens
gtggactaaatatctgtca

SEQ ID NO: 3351603 - DNA, 20 bp, Homo sapiens
gtggactaaatatctgtcat

SEQ ID NO: 3351604 - DNA, 17 bp, Homo sapiens
gtggactctgcacatgt

SEQ ID NO: 3351605 - DNA, 19 bp, Homo sapiens
gtggacttagaaagcaggg

SEQ ID NO: 3351606 - DNA, 20 bp, Homo sapiens
gtggacttagaaagcagggg

SEQ ID NO: 3351607 - DNA, 14 bp, Homo sapiens
gtggagacagtcct

SEQ ID NO: 3351608 - DNA, 11 bp, Homo sapiens
gtggagactgc

SEQ ID NO: 3351609 - DNA, 16 bp, Homo sapiens
gtggagactgcttccc

SEQ ID NO: 3351610 - DNA, 22 bp, Homo sapiens
gtggagagggacagcccactga

SEQ ID NO: 3351611 - DNA, 16 bp, Homo sapiens
gtggagagtggaagga

SEQ ID NO: 3351612 - DNA, 17 bp, Homo sapiens
gtggagcaaaaggcagc

SEQ ID NO: 3351613 - DNA, 14 bp, Homo sapiens
gtggagctcagccc

SEQ ID NO: 3351614 - DNA, 15 bp, Homo sapiens
gtggagctcagcccc

SEQ ID NO: 3351615 - DNA, 13 bp, Homo sapiens
gtggaggaaggat

SEQ ID NO: 3351616 - DNA, 14 bp, Homo sapiens
gtggaggaaggatt

SEQ ID NO: 3351617 - DNA, 15 bp, Homo sapiens
gtggaggaaggattg

SEQ ID NO: 3351618 - DNA, 19 bp, Homo sapiens
gtggaggaaggattgtaaa

SEQ ID NO: 3351619 - DNA, 20 bp, Homo sapiens
gtggaggaaggtgctgagct

SEQ ID NO: 3351620 - DNA, 14 bp, Homo sapiens
gtggaggaggaggg

SEQ ID NO: 3351621 - DNA, 13 bp, Homo sapiens
gtggaggcacttt

SEQ ID NO: 3351622 - DNA, 12 bp, Homo sapiens
gtggaggcctga

SEQ ID NO: 3351623 - DNA, 18 bp, Homo sapiens
gtggaggcctgatgctgc

SEQ ID NO: 3351624 - DNA, 14 bp, Homo sapiens
gtggaggcttcctg

SEQ ID NO: 3351625 - DNA, 17 bp, Homo sapiens
gtggagggggctgggct

SEQ ID NO: 3351626 - DNA, 16 bp, Homo sapiens
gtggaggggtgtggca

SEQ ID NO: 3351627 - DNA, 13 bp, Homo sapiens
gtggagtctgagt

SEQ ID NO: 3351628 - DNA, 16 bp, Homo sapiens
gtggatatttgtataa

SEQ ID NO: 3351629 - DNA, 21 bp, Homo sapiens
gtggatcagagatgcaccacc

SEQ ID NO: 3351630 - DNA, 15 bp, Homo sapiens
gtggatcccctgcgg

SEQ ID NO: 3351631 - DNA, 15 bp, Homo sapiens
gtggatgactgttga

SEQ ID NO: 3351632 - DNA, 16 bp, Homo sapiens
gtggatgaggagacag

SEQ ID NO: 3351633 - DNA, 16 bp, Homo sapiens
gtggatgcctggtggc

SEQ ID NO: 3351634 - DNA, 13 bp, Homo sapiens
gtggatggcccca

SEQ ID NO: 3351635 - DNA, 15 bp, Homo sapiens
gtggatggccccagc

SEQ ID NO: 3351636 - DNA, 16 bp, Homo sapiens
gtggatggccccagca

SEQ ID NO: 3351637 - DNA, 21 bp, Homo sapiens
gtggatgtaattagctctggg

SEQ ID NO: 3351638 - DNA, 22 bp, Homo sapiens
gtggatgtaattagctctgggg

SEQ ID NO: 3351639 - DNA, 19 bp, Homo sapiens
gtggatgtcttccttggag

SEQ ID NO: 3351640 - DNA, 14 bp, Homo sapiens
gtggatgtttttaa

SEQ ID NO: 3351641 - DNA, 23 bp, Homo sapiens
gtggattataaaaaatgtaacat

SEQ ID NO: 3351642 - DNA, 18 bp, Homo sapiens
gtggcaaagtgctgtacc

SEQ ID NO: 3351643 - DNA, 16 bp, Homo sapiens
gtggcaaatataaaac

SEQ ID NO: 3351644 - DNA, 14 bp, Homo sapiens
gtggcaaattaaac

SEQ ID NO: 3351645 - DNA, 17 bp, Homo sapiens
gtggcaagagtgtggag

SEQ ID NO: 3351646 - DNA, 12 bp, Homo sapiens
gtggcacaggcc

SEQ ID NO: 3351647 - DNA, 20 bp, Homo sapiens
gtggcaccagatgcaacctc

SEQ ID NO: 3351648 - DNA, 13 bp, Homo sapiens
gtggcacctcctg

SEQ ID NO: 3351649 - DNA, 14 bp, Homo sapiens
gtggcacctcctga

SEQ ID NO: 3351650 - DNA, 17 bp, Homo sapiens
gtggcacctcctgagaa

SEQ ID NO: 3351651 - DNA, 18 bp, Homo sapiens
gtggcacctcctgagaag

SEQ ID NO: 3351652 - DNA, 16 bp, Homo sapiens
gtggcacctcttccga

SEQ ID NO: 3351653 - DNA, 16 bp, Homo sapiens
gtggcactgagccccc

SEQ ID NO: 3351654 - DNA, 14 bp, Homo sapiens
gtggcagaaaagag

SEQ ID NO: 3351655 - DNA, 9 bp, Homo sapiens
gtggcagag

SEQ ID NO: 3351656 - DNA, 13 bp, Homo sapiens
gtggcagagagag

SEQ ID NO: 3351657 - DNA, 20 bp, Homo sapiens
gtggcagataatcagcctct

SEQ ID NO: 3351658 - DNA, 22 bp, Homo sapiens
gtggcagattttacaaaagatg

SEQ ID NO: 3351659 - DNA, 15 bp, Homo sapiens
gtggcagccatgcct

SEQ ID NO: 3351660 - DNA, 16 bp, Homo sapiens
gtggcagccatgcctc

SEQ ID NO: 3351661 - DNA, 19 bp, Homo sapiens
gtggcagccatgcctcatg

SEQ ID NO: 3351662 - DNA, 21 bp, Homo sapiens
gtggcagctgcggtccaccca

SEQ ID NO: 3351663 - DNA, 22 bp, Homo sapiens
gtggcagctgcggtccacccag

SEQ ID NO: 3351664 - DNA, 23 bp, Homo sapiens
gtggcagctgcggtccacccagg

SEQ ID NO: 3351665 - DNA, 21 bp, Homo sapiens
gtggcaggcacacagcagccc

SEQ ID NO: 3351666 - DNA, 12 bp, Homo sapiens
gtggcagggctc

SEQ ID NO: 3351667 - DNA, 16 bp, Homo sapiens
gtggcagggctcagga

SEQ ID NO: 3351668 - DNA, 16 bp, Homo sapiens
gtggcaggggacagga

SEQ ID NO: 3351669 - DNA, 22 bp, Homo sapiens
gtggcagggggccccgccaggg

SEQ ID NO: 3351670 - DNA, 17 bp, Homo sapiens
gtggcagtaaagagaaa

SEQ ID NO: 3351671 - DNA, 20 bp, Homo sapiens
gtggcagtaaagagaaactt

SEQ ID NO: 3351672 - DNA, 15 bp, Homo sapiens
gtggcagtgggagct

SEQ ID NO: 3351673 - DNA, 18 bp, Homo sapiens
gtggcatctttgccttgg

SEQ ID NO: 3351674 - DNA, 22 bp, Homo sapiens
gtggcatgttcatcgtataaca

SEQ ID NO: 3351675 - DNA, 21 bp, Homo sapiens
gtggcattggggggccgggca

SEQ ID NO: 3351676 - DNA, 23 bp, Homo sapiens
gtggccaactgcaaaaaaagcct

SEQ ID NO: 3351677 - DNA, 16 bp, Homo sapiens
gtggccactttaagag

SEQ ID NO: 3351678 - DNA, 18 bp, Homo sapiens
gtggccagagctggaagg

SEQ ID NO: 3351679 - DNA, 22 bp, Homo sapiens
gtggccagagctggaaggcagg

SEQ ID NO: 3351680 - DNA, 17 bp, Homo sapiens
gtggccagagctgggag

SEQ ID NO: 3351681 - DNA, 11 bp, Homo sapiens
gtggccagccc

SEQ ID NO: 3351682 - DNA, 16 bp, Homo sapiens
gtggccagcccggctg

SEQ ID NO: 3351683 - DNA, 14 bp, Homo sapiens
gtggccagcctgga

SEQ ID NO: 3351684 - DNA, 17 bp, Homo sapiens
gtggccatccctgggcc

SEQ ID NO: 3351685 - DNA, 18 bp, Homo sapiens
gtggccccaccctgggcc

SEQ ID NO: 3351686 - DNA, 21 bp, Homo sapiens
gtggccccaccctgggccctg

SEQ ID NO: 3351687 - DNA, 16 bp, Homo sapiens
gtggccccttttactt

SEQ ID NO: 3351688 - DNA, 16 bp, Homo sapiens
gtggcccgacagcctg

SEQ ID NO: 3351689 - DNA, 16 bp, Homo sapiens
gtggccctgtccctcc

SEQ ID NO: 3351690 - DNA, 23 bp, Homo sapiens
gtggccctgtccctcccacctct

SEQ ID NO: 3351691 - DNA, 17 bp, Homo sapiens
gtggcctcaagagcaca

SEQ ID NO: 3351692 - DNA, 12 bp, Homo sapiens
gtggcctcagaa

SEQ ID NO: 3351693 - DNA, 22 bp, Homo sapiens
gtggcctgctaaggctcctcct

SEQ ID NO: 3351694 - DNA, 12 bp, Homo sapiens
gtggcctgggca

SEQ ID NO: 3351695 - DNA, 14 bp, Homo sapiens
gtggcctgggcaag

SEQ ID NO: 3351696 - DNA, 15 bp, Homo sapiens
gtggcctggtccctg

SEQ ID NO: 3351697 - DNA, 16 bp, Homo sapiens
gtggcctgtggcctgt

SEQ ID NO: 3351698 - DNA, 17 bp, Homo sapiens
gtggcctgtgtccagca

SEQ ID NO: 3351699 - DNA, 21 bp, Homo sapiens
gtggcctgtgtccagcagctg

SEQ ID NO: 3351700 - DNA, 23 bp, Homo sapiens
gtggcctgtgtccagcagctgcg

SEQ ID NO: 3351701 - DNA, 21 bp, Homo sapiens
gtggcctgtttctgcagccct

SEQ ID NO: 3351702 - DNA, 23 bp, Homo sapiens
gtggccttccccttttgcctggc

SEQ ID NO: 3351703 - DNA, 16 bp, Homo sapiens
gtggccttctgctgcc

SEQ ID NO: 3351704 - DNA, 17 bp, Homo sapiens
gtggccttctgctgccc

SEQ ID NO: 3351705 - DNA, 19 bp, Homo sapiens
gtggccttctgctgcccag

SEQ ID NO: 3351706 - DNA, 19 bp, Homo sapiens
gtggccttggccggctgtg

SEQ ID NO: 3351707 - DNA, 22 bp, Homo sapiens
gtggcgccgtctccaggggctg

SEQ ID NO: 3351708 - DNA, 14 bp, Homo sapiens
gtggcggcagggcc

SEQ ID NO: 3351709 - DNA, 17 bp, Homo sapiens
gtggctaggcctttcct

SEQ ID NO: 3351710 - DNA, 14 bp, Homo sapiens
gtggctcatgcctg

SEQ ID NO: 3351711 - DNA, 20 bp, Homo sapiens
gtggctcctatctgtgtttt

SEQ ID NO: 3351712 - DNA, 19 bp, Homo sapiens
gtacaacagaataatgcat

SEQ ID NO: 3351713 - DNA, 16 bp, Homo sapiens
gtacaaggtaattgtt

SEQ ID NO: 3351714 - DNA, 21 bp, Homo sapiens
gtacaagttttgtataaataa

SEQ ID NO: 3351715 - DNA, 18 bp, Homo sapiens
gtacaatcaaaacacact

SEQ ID NO: 3351716 - DNA, 20 bp, Homo sapiens
gtacaatgaactgcttttcc

SEQ ID NO: 3351717 - DNA, 16 bp, Homo sapiens
gtacacacacatacac

SEQ ID NO: 3351718 - DNA, 15 bp, Homo sapiens
gtacacactttattt

SEQ ID NO: 3351719 - DNA, 15 bp, Homo sapiens
gtacacgtgtcctgt

SEQ ID NO: 3351720 - DNA, 17 bp, Homo sapiens
gtacacgtgtcctgtag

SEQ ID NO: 3351721 - DNA, 13 bp, Homo sapiens
gtacactctgctg

SEQ ID NO: 3351722 - DNA, 23 bp, Homo sapiens
gtacactgctgtacccagatgcc

SEQ ID NO: 3351723 - DNA, 13 bp, Homo sapiens
gtacagaaagctg

SEQ ID NO: 3351724 - DNA, 21 bp, Homo sapiens
gtacagagtgtggactctggt

SEQ ID NO: 3351725 - DNA, 14 bp, Homo sapiens
gtacaggagaggca

SEQ ID NO: 3351726 - DNA, 19 bp, Homo sapiens
gtacaggagaggcagcatg

SEQ ID NO: 3351727 - DNA, 16 bp, Homo sapiens
gtacagggttatctgc

SEQ ID NO: 3351728 - DNA, 17 bp, Homo sapiens
gtacagtaggataagcc

SEQ ID NO: 3351729 - DNA, 14 bp, Homo sapiens
gtacagtgaattgt

SEQ ID NO: 3351730 - DNA, 15 bp, Homo sapiens
gtacagtgaattgtc

SEQ ID NO: 3351731 - DNA, 17 bp, Homo sapiens
gtacagtgaattgtctt

SEQ ID NO: 3351732 - DNA, 22 bp, Homo sapiens
gtacagtgaattgtcttttaga

SEQ ID NO: 3351733 - DNA, 14 bp, Homo sapiens
gtacagtgaggagg

SEQ ID NO: 3351734 - DNA, 16 bp, Homo sapiens
gtacagtgtgtaaagt

SEQ ID NO: 3351735 - DNA, 12 bp, Homo sapiens
gtacagtgttac

SEQ ID NO: 3351736 - DNA, 14 bp, Homo sapiens
gtacagttgcagga

SEQ ID NO: 3351737 - DNA, 22 bp, Homo sapiens
gtacataccctggccgccccct

SEQ ID NO: 3351738 - DNA, 16 bp, Homo sapiens
gtacatatgtgctgga

SEQ ID NO: 3351739 - DNA, 19 bp, Homo sapiens
gtacatctggcttatttta

SEQ ID NO: 3351740 - DNA, 22 bp, Homo sapiens
gtacatctggcttattttaatg

SEQ ID NO: 3351741 - DNA, 23 bp, Homo sapiens
gtacatctggcttattttaatgt

SEQ ID NO: 3351742 - DNA, 19 bp, Homo sapiens
gtacatgtgtagcctgtgc

SEQ ID NO: 3351743 - DNA, 21 bp, Homo sapiens
gtacatgttcgggtgtgggtt

SEQ ID NO: 3351744 - DNA, 14 bp, Homo sapiens
gtacattctgccta

SEQ ID NO: 3351745 - DNA, 14 bp, Homo sapiens
gtacatttaaaatt

SEQ ID NO: 3351746 - DNA, 14 bp, Homo sapiens
gtacttttgttgta

SEQ ID NO: 3351747 - DNA, 23 bp, Homo sapiens
gtactttttagtaatttcttttt

SEQ ID NO: 3351748 - DNA, 12 bp, Homo sapiens
gtagaaaaacat

SEQ ID NO: 3351749 - DNA, 16 bp, Homo sapiens
gtagaaaagttgcaga

SEQ ID NO: 3351750 - DNA, 18 bp, Homo sapiens
gtagaaacacagttttga

SEQ ID NO: 3351751 - DNA, 14 bp, Homo sapiens
gtagaaacatttag

SEQ ID NO: 3351752 - DNA, 21 bp, Homo sapiens
gtagaaatatctgaaaatgta

SEQ ID NO: 3351753 - DNA, 23 bp, Homo sapiens
gtagaaattttacaataggtgct

SEQ ID NO: 3351754 - DNA, 21 bp, Homo sapiens
gtagaactcactctgggctgt

SEQ ID NO: 3351755 - DNA, 17 bp, Homo sapiens
gtagaactccaggccct

SEQ ID NO: 3351756 - DNA, 15 bp, Homo sapiens
gtagaagcattcctt

SEQ ID NO: 3351757 - DNA, 19 bp, Homo sapiens
gtagaaggttgacacagtt

SEQ ID NO: 3351758 - DNA, 15 bp, Homo sapiens
gtagaagtttttgta

SEQ ID NO: 3351759 - DNA, 19 bp, Homo sapiens
gtagaagtttttgtactgt

SEQ ID NO: 3351760 - DNA, 22 bp, Homo sapiens
gtagaattaccattaattacat

SEQ ID NO: 3351761 - DNA, 14 bp, Homo sapiens
gtagaattgcattg

SEQ ID NO: 3351762 - DNA, 19 bp, Homo sapiens
gtagacacgctcttctatt

SEQ ID NO: 3351763 - DNA, 14 bp, Homo sapiens
gtagaccaaaataa

SEQ ID NO: 3351764 - DNA, 15 bp, Homo sapiens
gtagaccaaaataaa

SEQ ID NO: 3351765 - DNA, 19 bp, Homo sapiens
gtagaccttgttacttctg

SEQ ID NO: 3351766 - DNA, 23 bp, Homo sapiens
gtagacttctggttgtatttcta

SEQ ID NO: 3351767 - DNA, 11 bp, Homo sapiens
gtagagacagg

SEQ ID NO: 3351768 - DNA, 13 bp, Homo sapiens
gtagagacagggt

SEQ ID NO: 3351769 - DNA, 14 bp, Homo sapiens
gtagagcaaaacta

SEQ ID NO: 3351770 - DNA, 15 bp, Homo sapiens
gtagagccagggtct

SEQ ID NO: 3351771 - DNA, 18 bp, Homo sapiens
gtagagccagggtctcac

SEQ ID NO: 3351772 - DNA, 18 bp, Homo sapiens
gtagaggctccccagggc

SEQ ID NO: 3351773 - DNA, 15 bp, Homo sapiens
gtagagtcatctcca

SEQ ID NO: 3351774 - DNA, 20 bp, Homo sapiens
gtagagtgtagactgtggct

SEQ ID NO: 3351775 - DNA, 15 bp, Homo sapiens
gtagagttaagaagc

SEQ ID NO: 3351776 - DNA, 16 bp, Homo sapiens
gtagagttaagaagct

SEQ ID NO: 3351777 - DNA, 12 bp, Homo sapiens
gtataaagaaca

SEQ ID NO: 3351778 - DNA, 13 bp, Homo sapiens
gtataaagattgt

SEQ ID NO: 3351779 - DNA, 18 bp, Homo sapiens
gtataaagcaactgttat

SEQ ID NO: 3351780 - DNA, 14 bp, Homo sapiens
gtataaataataaa

SEQ ID NO: 3351781 - DNA, 13 bp, Homo sapiens
gtataaataggag

SEQ ID NO: 3351782 - DNA, 17 bp, Homo sapiens
gtataaatgtatataca

SEQ ID NO: 3351783 - DNA, 21 bp, Homo sapiens
gtataaatgtatatacacata

SEQ ID NO: 3351784 - DNA, 20 bp, Homo sapiens
gtataacacaatatgaatac

SEQ ID NO: 3351785 - DNA, 16 bp, Homo sapiens
gtataaccaagtgtgc

SEQ ID NO: 3351786 - DNA, 20 bp, Homo sapiens
gtataacttcttaaaagttg

SEQ ID NO: 3351787 - DNA, 19 bp, Homo sapiens
gtataagtggaggcacttt

SEQ ID NO: 3351788 - DNA, 21 bp, Homo sapiens
gtataagttatttttgtacat

SEQ ID NO: 3351789 - DNA, 22 bp, Homo sapiens
gtataatcttgtagacacttac

SEQ ID NO: 3351790 - DNA, 14 bp, Homo sapiens
gtataatgtttaaa

SEQ ID NO: 3351791 - DNA, 16 bp, Homo sapiens
gtataatgtttaaatc

SEQ ID NO: 3351792 - DNA, 15 bp, Homo sapiens
gtataatgtttatta

SEQ ID NO: 3351793 - DNA, 18 bp, Homo sapiens
gtataatgtttattaaat

SEQ ID NO: 3351794 - DNA, 18 bp, Homo sapiens
gtataattggatttccta

SEQ ID NO: 3351795 - DNA, 13 bp, Homo sapiens
gtataattttaaa

SEQ ID NO: 3351796 - DNA, 15 bp, Homo sapiens
gtatacaaatatatt

SEQ ID NO: 3351797 - DNA, 19 bp, Homo sapiens
gtatacaatatataaaaat

SEQ ID NO: 3351798 - DNA, 21 bp, Homo sapiens
gtatacaatatataaaaatat

SEQ ID NO: 3351799 - DNA, 12 bp, Homo sapiens
gtatacatgcca

SEQ ID NO: 3351800 - DNA, 18 bp, Homo sapiens
gtatacctcatttttcat

SEQ ID NO: 3351801 - DNA, 23 bp, Homo sapiens
gtatactagggagccatttgaga

SEQ ID NO: 3351802 - DNA, 11 bp, Homo sapiens
gtatactgtgt

SEQ ID NO: 3351803 - DNA, 13 bp, Homo sapiens
gtatactgtgtgg

SEQ ID NO: 3351804 - DNA, 16 bp, Homo sapiens
gtatatacacatatac

SEQ ID NO: 3351805 - DNA, 16 bp, Homo sapiens
ggtgggggtggaggct

SEQ ID NO: 3351806 - DNA, 20 bp, Homo sapiens
ggtgggtccaggaaggcagc

SEQ ID NO: 3351807 - DNA, 16 bp, Homo sapiens
ggtgggtggtggggag

SEQ ID NO: 3351808 - DNA, 22 bp, Homo sapiens
ggtgggttgaatatagcctgcc

SEQ ID NO: 3351809 - DNA, 23 bp, Homo sapiens
ggtggtactttattcttgctggg

SEQ ID NO: 3351810 - DNA, 16 bp, Homo sapiens
ggtggtctgttggcag

SEQ ID NO: 3351811 - DNA, 21 bp, Homo sapiens
ggtggtctgttggcaggctgg

SEQ ID NO: 3351812 - DNA, 16 bp, Homo sapiens
ggtggtgacctctgcc

SEQ ID NO: 3351813 - DNA, 15 bp, Homo sapiens
ggtggtggagggggc

SEQ ID NO: 3351814 - DNA, 18 bp, Homo sapiens
ggtggtggagggggctgg

SEQ ID NO: 3351815 - DNA, 13 bp, Homo sapiens
ggtggtggggaca

SEQ ID NO: 3351816 - DNA, 13 bp, Homo sapiens
ggtggtggggagg

SEQ ID NO: 3351817 - DNA, 14 bp, Homo sapiens
ggtgtaaagctggc

SEQ ID NO: 3351818 - DNA, 15 bp, Homo sapiens
ggtgtaaagctggcc

SEQ ID NO: 3351819 - DNA, 22 bp, Homo sapiens
ggtgtaaagctggccctgcctc

SEQ ID NO: 3351820 - DNA, 14 bp, Homo sapiens
ggtgtaataagaca

SEQ ID NO: 3351821 - DNA, 22 bp, Homo sapiens
ggtgtagaacactaattcataa

SEQ ID NO: 3351822 - DNA, 17 bp, Homo sapiens
ggtgtaggggccacctc

SEQ ID NO: 3351823 - DNA, 13 bp, Homo sapiens
ggtgtatttaaac

SEQ ID NO: 3351824 - DNA, 16 bp, Homo sapiens
ggtgtatttaaactat

SEQ ID NO: 3351825 - DNA, 15 bp, Homo sapiens
ggtgtcacttactgt

SEQ ID NO: 3351826 - DNA, 19 bp, Homo sapiens
ggtgtcacttactgtttct

SEQ ID NO: 3351827 - DNA, 17 bp, Homo sapiens
ggtgtcagtatccaggc

SEQ ID NO: 3351828 - DNA, 12 bp, Homo sapiens
ggtgtcctgacc

SEQ ID NO: 3351829 - DNA, 13 bp, Homo sapiens
ggtgtcctgacca

SEQ ID NO: 3351830 - DNA, 17 bp, Homo sapiens
ggtgtcctgaccaccct

SEQ ID NO: 3351831 - DNA, 20 bp, Homo sapiens
ggtgtcctgaccaccctccc

SEQ ID NO: 3351832 - DNA, 20 bp, Homo sapiens
ggtgtcgtctgtgaatgcta

SEQ ID NO: 3351833 - DNA, 20 bp, Homo sapiens
ggtgtgaaagtcagatgccc

SEQ ID NO: 3351834 - DNA, 13 bp, Homo sapiens
ggtgtgaatgcac

SEQ ID NO: 3351835 - DNA, 18 bp, Homo sapiens
ggtgtgagaagtgccttc

SEQ ID NO: 3351836 - DNA, 19 bp, Homo sapiens
ggtgtgagaagtgccttct

SEQ ID NO: 3351837 - DNA, 18 bp, Homo sapiens
ggtgtgagtcaccaagcc

SEQ ID NO: 3351838 - DNA, 13 bp, Homo sapiens
ggtgtgcctgcag

SEQ ID NO: 3351839 - DNA, 14 bp, Homo sapiens
ggtgtgcctgcagc

SEQ ID NO: 3351840 - DNA, 22 bp, Homo sapiens
ggtgtgctgggagctccactct

SEQ ID NO: 3351841 - DNA, 22 bp, Homo sapiens
ggtgtggatgtaattagctctg

SEQ ID NO: 3351842 - DNA, 23 bp, Homo sapiens
ggtgtggatgtaattagctctgg

SEQ ID NO: 3351843 - DNA, 19 bp, Homo sapiens
ggtgtggcctcagccctca

SEQ ID NO: 3351844 - DNA, 16 bp, Homo sapiens
ggtgtgggtggaaggg

SEQ ID NO: 3351845 - DNA, 15 bp, Homo sapiens
ggtgtgtccacagag

SEQ ID NO: 3351846 - DNA, 16 bp, Homo sapiens
ggtgtgtccctggaca

SEQ ID NO: 3351847 - DNA, 17 bp, Homo sapiens
ggtgtgtccctggacac

SEQ ID NO: 3351848 - DNA, 21 bp, Homo sapiens
ggtgtgtccctggacacagct

SEQ ID NO: 3351849 - DNA, 14 bp, Homo sapiens
ggtgtgtgtagcca

SEQ ID NO: 3351850 - DNA, 19 bp, Homo sapiens
ggtgtgttccaactgcccc

SEQ ID NO: 3351851 - DNA, 22 bp, Homo sapiens
ggtgttaggcatgtcccaccca

SEQ ID NO: 3351852 - DNA, 22 bp, Homo sapiens
ggtgttatttggaaccttgttt

SEQ ID NO: 3351853 - DNA, 16 bp, Homo sapiens
ggtgttcctggaagca

SEQ ID NO: 3351854 - DNA, 15 bp, Homo sapiens
ggtgttgtatgcctt

SEQ ID NO: 3351855 - DNA, 14 bp, Homo sapiens
ggtgtttcctctaa

SEQ ID NO: 3351856 - DNA, 19 bp, Homo sapiens
ggtgttttttatgaagtgc

SEQ ID NO: 3351857 - DNA, 16 bp, Homo sapiens
ggttaaaaaaaaaagt

SEQ ID NO: 3351858 - DNA, 13 bp, Homo sapiens
ggttaaaaaggcc

SEQ ID NO: 3351859 - DNA, 16 bp, Homo sapiens
ggttaaagcagacagt

SEQ ID NO: 3351860 - DNA, 21 bp, Homo sapiens
ggttaacaataaagtgacaaa

SEQ ID NO: 3351861 - DNA, 17 bp, Homo sapiens
ggttaatcatatttgaa

SEQ ID NO: 3351862 - DNA, 17 bp, Homo sapiens
ggttaatctttcctgat

SEQ ID NO: 3351863 - DNA, 13 bp, Homo sapiens
ggttacactgtta

SEQ ID NO: 3351864 - DNA, 20 bp, Homo sapiens
ggttacactgttagaacact

SEQ ID NO: 3351865 - DNA, 16 bp, Homo sapiens
ggttacagagacctat

SEQ ID NO: 3351866 - DNA, 18 bp, Homo sapiens
ggttatcaaaaatttcat

SEQ ID NO: 3351867 - DNA, 17 bp, Homo sapiens
ggttatcgaaataacaa

SEQ ID NO: 3351868 - DNA, 14 bp, Homo sapiens
ggttatctctgtgt

SEQ ID NO: 3351869 - DNA, 16 bp, Homo sapiens
ggttatctgcctggcc

SEQ ID NO: 3351870 - DNA, 21 bp, Homo sapiens
ggttatgaaagaatatattta

SEQ ID NO: 3351871 - DNA, 17 bp, Homo sapiens
ggttatgtatcagaaga

SEQ ID NO: 3351872 - DNA, 22 bp, Homo sapiens
ggttatgtgtatgtgccattta

SEQ ID NO: 3351873 - DNA, 15 bp, Homo sapiens
ggttattacttctgt

SEQ ID NO: 3351874 - DNA, 19 bp, Homo sapiens
ggttattagcaaggctggg

SEQ ID NO: 3351875 - DNA, 20 bp, Homo sapiens
ggttattagcaaggctgggt

SEQ ID NO: 3351876 - DNA, 20 bp, Homo sapiens
ggttattgaaaatatgatgt

SEQ ID NO: 3351877 - DNA, 24 bp, Homo sapiens
ggttatttctcaacaaagcacagt

SEQ ID NO: 3351878 - DNA, 23 bp, Homo sapiens
ggttcaagcgattcttctgcttc

SEQ ID NO: 3351879 - DNA, 19 bp, Homo sapiens
ggttcaagtgattctcttg

SEQ ID NO: 3351880 - DNA, 19 bp, Homo sapiens
ggttcagaattaaactttt

SEQ ID NO: 3351881 - DNA, 23 bp, Homo sapiens
ggttcagctactttccatttggt

SEQ ID NO: 3351882 - DNA, 12 bp, Homo sapiens
ggttcaggcccg

SEQ ID NO: 3351883 - DNA, 18 bp, Homo sapiens
ggttcagggttggcccct

SEQ ID NO: 3351884 - DNA, 21 bp, Homo sapiens
ggttcagggttggcccctgcc

SEQ ID NO: 3351885 - DNA, 13 bp, Homo sapiens
ggttcatatttat

SEQ ID NO: 3351886 - DNA, 17 bp, Homo sapiens
ggttcatctgtccatgg

SEQ ID NO: 3351887 - DNA, 17 bp, Homo sapiens
ggttcattattggaatt

SEQ ID NO: 3351888 - DNA, 18 bp, Homo sapiens
ggttcattattggaatta

SEQ ID NO: 3351889 - DNA, 14 bp, Homo sapiens
ggttccatgcctga

SEQ ID NO: 3351890 - DNA, 15 bp, Homo sapiens
gggctagttgggctt

SEQ ID NO: 3351891 - DNA, 13 bp, Homo sapiens
gggctatttctct

SEQ ID NO: 3351892 - DNA, 18 bp, Homo sapiens
gggctatttctctcccca

SEQ ID NO: 3351893 - DNA, 14 bp, Homo sapiens
gggctcacaggcct

SEQ ID NO: 3351894 - DNA, 15 bp, Homo sapiens
gggctcacaggcctc

SEQ ID NO: 3351895 - DNA, 17 bp, Homo sapiens
gggctcacggggcctcc

SEQ ID NO: 3351896 - DNA, 23 bp, Homo sapiens
gggctcacttttcatccttcccc

SEQ ID NO: 3351897 - DNA, 21 bp, Homo sapiens
gggctcagcggggacagctcc

SEQ ID NO: 3351898 - DNA, 21 bp, Homo sapiens
gggctcagggagggagggcgg

SEQ ID NO: 3351899 - DNA, 15 bp, Homo sapiens
gggctcagggctgga

SEQ ID NO: 3351900 - DNA, 16 bp, Homo sapiens
gggctccagcatccag

SEQ ID NO: 3351901 - DNA, 17 bp, Homo sapiens
gggctccatgcctctgg

SEQ ID NO: 3351902 - DNA, 13 bp, Homo sapiens
gggctcccagctc

SEQ ID NO: 3351903 - DNA, 14 bp, Homo sapiens
gggctcccagctcc

SEQ ID NO: 3351904 - DNA, 23 bp, Homo sapiens
gggctcccagctcctttctcctg

SEQ ID NO: 3351905 - DNA, 23 bp, Homo sapiens
gggctcccaggggtctccctggc

SEQ ID NO: 3351906 - DNA, 20 bp, Homo sapiens
gggctccctggcaggatgct

SEQ ID NO: 3351907 - DNA, 22 bp, Homo sapiens
gggctcctgcacttacttgctt

SEQ ID NO: 3351908 - DNA, 14 bp, Homo sapiens
gggctcctgcaggc

SEQ ID NO: 3351909 - DNA, 17 bp, Homo sapiens
gggctcctgccttctgt

SEQ ID NO: 3351910 - DNA, 19 bp, Homo sapiens
gggctcctggctgccaggc

SEQ ID NO: 3351911 - DNA, 20 bp, Homo sapiens
gggctcctggctgccaggcg

SEQ ID NO: 3351912 - DNA, 18 bp, Homo sapiens
gggctcgaggctggtgcc

SEQ ID NO: 3351913 - DNA, 14 bp, Homo sapiens
gggctcgccatgcc

SEQ ID NO: 3351914 - DNA, 13 bp, Homo sapiens
gggctctccaaag

SEQ ID NO: 3351915 - DNA, 18 bp, Homo sapiens
gggctctccaaaggggct

SEQ ID NO: 3351916 - DNA, 23 bp, Homo sapiens
gggctctccaaaggggctgctgg

SEQ ID NO: 3351917 - DNA, 20 bp, Homo sapiens
gggctctgccccagctctgg

SEQ ID NO: 3351918 - DNA, 21 bp, Homo sapiens
gggctctgccccagctctggc

SEQ ID NO: 3351919 - DNA, 15 bp, Homo sapiens
gggctctggagagaa

SEQ ID NO: 3351920 - DNA, 16 bp, Homo sapiens
gggctctggagagaaa

SEQ ID NO: 3351921 - DNA, 19 bp, Homo sapiens
gggctctttctctctgctg

SEQ ID NO: 3351922 - DNA, 20 bp, Homo sapiens
gggctgacacctaccatgct

SEQ ID NO: 3351923 - DNA, 16 bp, Homo sapiens
gggctgagatgagtga

SEQ ID NO: 3351924 - DNA, 11 bp, Homo sapiens
gggctgagggg

SEQ ID NO: 3351925 - DNA, 12 bp, Homo sapiens
gggctgaggggc

SEQ ID NO: 3351926 - DNA, 18 bp, Homo sapiens
gggctgaggggcaacgaa

SEQ ID NO: 3351927 - DNA, 19 bp, Homo sapiens
gggctgagtggggagcagt

SEQ ID NO: 3351928 - DNA, 14 bp, Homo sapiens
gggctgatttacat

SEQ ID NO: 3351929 - DNA, 15 bp, Homo sapiens
gggctgatttacatg

SEQ ID NO: 3351930 - DNA, 14 bp, Homo sapiens
gggctgccctggtg

SEQ ID NO: 3351931 - DNA, 21 bp, Homo sapiens
gggctgccctggtgctgccac

SEQ ID NO: 3351932 - DNA, 12 bp, Homo sapiens
gggctgcctggg

SEQ ID NO: 3351933 - DNA, 14 bp, Homo sapiens
gggctgcctgggct

SEQ ID NO: 3351934 - DNA, 21 bp, Homo sapiens
gggctgcctgggctgttggca

SEQ ID NO: 3351935 - DNA, 17 bp, Homo sapiens
gggctgccttctggcct

SEQ ID NO: 3351936 - DNA, 18 bp, Homo sapiens
gggctgcgggaggccctg

SEQ ID NO: 3351937 - DNA, 19 bp, Homo sapiens
gggctgcgggaggccctgg

SEQ ID NO: 3351938 - DNA, 11 bp, Homo sapiens
gggctgctcct

SEQ ID NO: 3351939 - DNA, 17 bp, Homo sapiens
gggctgcttcctcctgg

SEQ ID NO: 3351940 - DNA, 19 bp, Homo sapiens
gggctgcttcctcctggaa

SEQ ID NO: 3351941 - DNA, 22 bp, Homo sapiens
gggctggagaaagagctgcctg

SEQ ID NO: 3351942 - DNA, 17 bp, Homo sapiens
gggctggagtgcgctct

SEQ ID NO: 3351943 - DNA, 13 bp, Homo sapiens
gggctggcaagca

SEQ ID NO: 3351944 - DNA, 17 bp, Homo sapiens
gggctggccagttggaa

SEQ ID NO: 3351945 - DNA, 15 bp, Homo sapiens
gggctggccttcctg

SEQ ID NO: 3351946 - DNA, 11 bp, Homo sapiens
gggctggctct

SEQ ID NO: 3351947 - DNA, 11 bp, Homo sapiens
gggctggctgg

SEQ ID NO: 3351948 - DNA, 15 bp, Homo sapiens
gggctgggaggaagg

SEQ ID NO: 3351949 - DNA, 23 bp, Homo sapiens
gggctgggccctctttccctgcg

SEQ ID NO: 3351950 - DNA, 19 bp, Homo sapiens
gggctggggacagagggtg

SEQ ID NO: 3351951 - DNA, 13 bp, Homo sapiens
gggctgggtggca

SEQ ID NO: 3351952 - DNA, 18 bp, Homo sapiens
gggctggtagctcaggtg

SEQ ID NO: 3351953 - DNA, 19 bp, Homo sapiens
gggctgtaacgtggcactg

SEQ ID NO: 3351954 - DNA, 12 bp, Homo sapiens
gggctgtgccaa

SEQ ID NO: 3351955 - DNA, 16 bp, Homo sapiens
gggctgtgccaacctg

SEQ ID NO: 3351956 - DNA, 22 bp, Homo sapiens
gggcttcaccagtctgtctact

SEQ ID NO: 3351957 - DNA, 16 bp, Homo sapiens
gggcttcactgtataa

SEQ ID NO: 3351958 - DNA, 17 bp, Homo sapiens
gggcttcagtggcagct

SEQ ID NO: 3351959 - DNA, 19 bp, Homo sapiens
gggcttcagtggcagctgc

SEQ ID NO: 3351960 - DNA, 20 bp, Homo sapiens
gggcttcagtggcagctgct

SEQ ID NO: 3351961 - DNA, 16 bp, Homo sapiens
gggcttctgcaccctc

SEQ ID NO: 3351962 - DNA, 17 bp, Homo sapiens
gggcttctgcaccctcc

SEQ ID NO: 3351963 - DNA, 15 bp, Homo sapiens
gggcttgaagccaaa

SEQ ID NO: 3351964 - DNA, 18 bp, Homo sapiens
gggcttggacttcctggg

SEQ ID NO: 3351965 - DNA, 21 bp, Homo sapiens
gggcttggacttcctggggcc

SEQ ID NO: 3351966 - DNA, 12 bp, Homo sapiens
gggcttggccca

SEQ ID NO: 3351967 - DNA, 13 bp, Homo sapiens
gggcttggcctgc

SEQ ID NO: 3351968 - DNA, 16 bp, Homo sapiens
gggcttggcctgctgt

SEQ ID NO: 3351969 - DNA, 14 bp, Homo sapiens
gggcttggcgtgga

SEQ ID NO: 3351970 - DNA, 20 bp, Homo sapiens
gggcttggcgtggagcaggc

SEQ ID NO: 3351971 - DNA, 13 bp, Homo sapiens
gggcttgtgaaca

SEQ ID NO: 3351972 - DNA, 17 bp, Homo sapiens
gggctttgcaggctctg

SEQ ID NO: 3351973 - DNA, 17 bp, Homo sapiens
gggctttgccttgcagc

SEQ ID NO: 3351974 - DNA, 18 bp, Homo sapiens
gggctttgccttgcagcc

SEQ ID NO: 3351975 - DNA, 19 bp, Homo sapiens
gggcttttctggggcccag

SEQ ID NO: 3351976 - DNA, 22 bp, Homo sapiens
gggcttttctggggcccaggaa

SEQ ID NO: 3351977 - DNA, 15 bp, Homo sapiens
gggcttttgccactc

SEQ ID NO: 3351978 - DNA, 20 bp, Homo sapiens
ggggaaaaaaaatctctcag

SEQ ID NO: 3351979 - DNA, 12 bp, Homo sapiens
ggggaaaaaagc

SEQ ID NO: 3351980 - DNA, 14 bp, Homo sapiens
ggggaacagaccag

SEQ ID NO: 3351981 - DNA, 15 bp, Homo sapiens
ggggaagctgcacat

SEQ ID NO: 3351982 - DNA, 14 bp, Homo sapiens
ggggaaggggcggt

SEQ ID NO: 3351983 - DNA, 23 bp, Homo sapiens
ggggaatgagcccagagaacagc

SEQ ID NO: 3351984 - DNA, 18 bp, Homo sapiens
ggggaatgctcccagctg

SEQ ID NO: 3351985 - DNA, 18 bp, Homo sapiens
ggggaatgtttgcctctg

SEQ ID NO: 3351986 - DNA, 15 bp, Homo sapiens
ggggacaccagagct

SEQ ID NO: 3351987 - DNA, 20 bp, Homo sapiens
ggggacagttggcagagaag

SEQ ID NO: 3351988 - DNA, 16 bp, Homo sapiens
ggggaccttggtctga

SEQ ID NO: 3351989 - DNA, 23 bp, Homo sapiens
ggggactctgagcgggaggcaga

SEQ ID NO: 3351990 - DNA, 24 bp, Homo sapiens
ggggactgggagtcagagccctgg

SEQ ID NO: 3351991 - DNA, 22 bp, Homo sapiens
ggggactgttccaaagccagtg

SEQ ID NO: 3351992 - DNA, 20 bp, Homo sapiens
ggggagaagagccctggaca

SEQ ID NO: 3351993 - DNA, 18 bp, Homo sapiens
ggggagcaggaggccaat

SEQ ID NO: 3351994 - DNA, 14 bp, Homo sapiens
ggggagcccagtga

SEQ ID NO: 3351995 - DNA, 23 bp, Homo sapiens
ggggaggacctgaccctactccc

SEQ ID NO: 3351996 - DNA, 12 bp, Homo sapiens
ggggaggagcct

SEQ ID NO: 3351997 - DNA, 14 bp, Homo sapiens
ggggaggcagccgg

SEQ ID NO: 3351998 - DNA, 15 bp, Homo sapiens
ggggagggattctgg

SEQ ID NO: 3351999 - DNA, 13 bp, Homo sapiens
ggggaggggaagt

SEQ ID NO: 3352000 - DNA, 20 bp, Homo sapiens
ggggaggggcgctggcccag

SEQ ID NO: 3352001 - DNA, 22 bp, Homo sapiens
ggggaggggttgccacaggcct

SEQ ID NO: 3352002 - DNA, 20 bp, Homo sapiens
ggggaggtgggtgtgggtgg

SEQ ID NO: 3352003 - DNA, 21 bp, Homo sapiens
ggggagttgagtcacaagagg

SEQ ID NO: 3352004 - DNA, 22 bp, Homo sapiens
ggggatccccgcctggccagga

SEQ ID NO: 3352005 - DNA, 13 bp, Homo sapiens
ggggatgccttca

SEQ ID NO: 3352006 - DNA, 13 bp, Homo sapiens
ggggattaattag

SEQ ID NO: 3352007 - DNA, 18 bp, Homo sapiens
ggggcaaggtctccttac

SEQ ID NO: 3352008 - DNA, 16 bp, Homo sapiens
ggggcacaccactgcc

SEQ ID NO: 3352009 - DNA, 17 bp, Homo sapiens
ggggcacggactgtcca

SEQ ID NO: 3352010 - DNA, 16 bp, Homo sapiens
ggggcagaggggcagc

SEQ ID NO: 3352011 - DNA, 15 bp, Homo sapiens
ggggcagcccttgct

SEQ ID NO: 3352012 - DNA, 19 bp, Homo sapiens
ggggcagccgctaggagag

SEQ ID NO: 3352013 - DNA, 17 bp, Homo sapiens
ggggcaggactgagtcc

SEQ ID NO: 3352014 - DNA, 17 bp, Homo sapiens
ggggcaggagaggctgg

SEQ ID NO: 3352015 - DNA, 11 bp, Homo sapiens
ggggcaggcct

SEQ ID NO: 3352016 - DNA, 13 bp, Homo sapiens
ggggcaggcctgg

SEQ ID NO: 3352017 - DNA, 14 bp, Homo sapiens
ggggcaggctgggc

SEQ ID NO: 3352018 - DNA, 14 bp, Homo sapiens
ggggcatcctggat

SEQ ID NO: 3352019 - DNA, 17 bp, Homo sapiens
ggggcatggttccttcc

SEQ ID NO: 3352020 - DNA, 21 bp, Homo sapiens
ggggcatggttccttccctgg

SEQ ID NO: 3352021 - DNA, 16 bp, Homo sapiens
ggggccacctcctccc

SEQ ID NO: 3352022 - DNA, 19 bp, Homo sapiens
ggggccacctcctccccct

SEQ ID NO: 3352023 - DNA, 12 bp, Homo sapiens
ggggccagagga

SEQ ID NO: 3352024 - DNA, 14 bp, Homo sapiens
ggggccaggcccag

SEQ ID NO: 3352025 - DNA, 21 bp, Homo sapiens
ggggccataaacggttcctgg

SEQ ID NO: 3352026 - DNA, 22 bp, Homo sapiens
ggggccataaacggttcctggt

SEQ ID NO: 3352027 - DNA, 19 bp, Homo sapiens
ggggccatcacaggatgcc

SEQ ID NO: 3352028 - DNA, 12 bp, Homo sapiens
ggggcccaggaa

SEQ ID NO: 3352029 - DNA, 15 bp, Homo sapiens
ggggccccagatctg

SEQ ID NO: 3352030 - DNA, 21 bp, Homo sapiens
ggggccccagatctgcctggg

SEQ ID NO: 3352031 - DNA, 14 bp, Homo sapiens
ggggccccagggct

SEQ ID NO: 3352032 - DNA, 22 bp, Homo sapiens
ggggccccgggacccacggagc

SEQ ID NO: 3352033 - DNA, 18 bp, Homo sapiens
ggggccccggggctggca

SEQ ID NO: 3352034 - DNA, 10 bp, Homo sapiens
ggggccctgc

SEQ ID NO: 3352035 - DNA, 11 bp, Homo sapiens
ggggccctgct

SEQ ID NO: 3352036 - DNA, 13 bp, Homo sapiens
ggggccctgctac

SEQ ID NO: 3352037 - DNA, 11 bp, Homo sapiens
ggggccctggg

SEQ ID NO: 3352038 - DNA, 13 bp, Homo sapiens
ggggccctgggcc

SEQ ID NO: 3352039 - DNA, 12 bp, Homo sapiens
ggggccctggtc

SEQ ID NO: 3352040 - DNA, 20 bp, Homo sapiens
ggggcccttggggcctggct

SEQ ID NO: 3352041 - DNA, 21 bp, Homo sapiens
ggggcccttggggcctggctt

SEQ ID NO: 3352042 - DNA, 13 bp, Homo sapiens
ggggccgggcaca

SEQ ID NO: 3352043 - DNA, 23 bp, Homo sapiens
ggggccgggcaggtcctgcccat

SEQ ID NO: 3352044 - DNA, 15 bp, Homo sapiens
ggggcctcagtgcca

SEQ ID NO: 3352045 - DNA, 12 bp, Homo sapiens
ggggcctcctcc

SEQ ID NO: 3352046 - DNA, 15 bp, Homo sapiens
ggggcctcctcctag

SEQ ID NO: 3352047 - DNA, 16 bp, Homo sapiens
ggggcctcctcctagg

SEQ ID NO: 3352048 - DNA, 12 bp, Homo sapiens
ggggcctgagag

SEQ ID NO: 3352049 - DNA, 12 bp, Homo sapiens
ggggcctgcaga

SEQ ID NO: 3352050 - DNA, 20 bp, Homo sapiens
ggggcctgcagaaggaaaga

SEQ ID NO: 3352051 - DNA, 21 bp, Homo sapiens
ggggcctgcagaaggaaagaa

SEQ ID NO: 3352052 - DNA, 21 bp, Homo sapiens
ggggcctggcttgctccaggg

SEQ ID NO: 3352053 - DNA, 12 bp, Homo sapiens
ggggcctgtgga

SEQ ID NO: 3352054 - DNA, 23 bp, Homo sapiens
ggggccttagggcactgggctgt

SEQ ID NO: 3352055 - DNA, 20 bp, Homo sapiens
ggggcgccctctctgctcct

SEQ ID NO: 3352056 - DNA, 17 bp, Homo sapiens
ggggcgcctagagcgcg

SEQ ID NO: 3352057 - DNA, 13 bp, Homo sapiens
ggggcgcctggag

SEQ ID NO: 3352058 - DNA, 12 bp, Homo sapiens
ggggcgctcagg

SEQ ID NO: 3352059 - DNA, 13 bp, Homo sapiens
ggggcgctggccc

SEQ ID NO: 3352060 - DNA, 18 bp, Homo sapiens
ggggcgctggcccagccg

SEQ ID NO: 3352061 - DNA, 17 bp, Homo sapiens
ggggcgtgaggtcccag

SEQ ID NO: 3352062 - DNA, 14 bp, Homo sapiens
ggggctacaagagg

SEQ ID NO: 3352063 - DNA, 17 bp, Homo sapiens
ggggctacaagagggaa

SEQ ID NO: 3352064 - DNA, 15 bp, Homo sapiens
ggggctcccagctcc

SEQ ID NO: 3352065 - DNA, 21 bp, Homo sapiens
ggggctcctggtggccttctg

SEQ ID NO: 3352066 - DNA, 21 bp, Homo sapiens
ggggctcctttctccagccag

SEQ ID NO: 3352067 - DNA, 23 bp, Homo sapiens
ggggctctagggttgctggagcc

SEQ ID NO: 3352068 - DNA, 14 bp, Homo sapiens
ggggctctggagag

SEQ ID NO: 3352069 - DNA, 17 bp, Homo sapiens
ggggctctggagagaaa

SEQ ID NO: 3352070 - DNA, 23 bp, Homo sapiens
ggggctgaagttgctctgtaccc

SEQ ID NO: 3352071 - DNA, 14 bp, Homo sapiens
ggggctgaggggca

SEQ ID NO: 3352072 - DNA, 11 bp, Homo sapiens
ggggctgctgg

SEQ ID NO: 3352073 - DNA, 18 bp, Homo sapiens
ggggctgcttcctcctgg

SEQ ID NO: 3352074 - DNA, 19 bp, Homo sapiens
ggggctgcttcctcctgga

SEQ ID NO: 3352075 - DNA, 11 bp, Homo sapiens
ggggctgggct

SEQ ID NO: 3352076 - DNA, 16 bp, Homo sapiens
ggggctgggctcacag

SEQ ID NO: 3352077 - DNA, 12 bp, Homo sapiens
ggggctgggggg

SEQ ID NO: 3352078 - DNA, 21 bp, Homo sapiens
gggttaacttggtcagagcca

SEQ ID NO: 3352079 - DNA, 20 bp, Homo sapiens
gggttatgtgtatgtgccat

SEQ ID NO: 3352080 - DNA, 13 bp, Homo sapiens
gggttcattattg

SEQ ID NO: 3352081 - DNA, 22 bp, Homo sapiens
gggttctaggcatctctgtact

SEQ ID NO: 3352082 - DNA, 15 bp, Homo sapiens
gggttctgctgggac

SEQ ID NO: 3352083 - DNA, 17 bp, Homo sapiens
gggttgaaggcagtctg

SEQ ID NO: 3352084 - DNA, 18 bp, Homo sapiens
gggttgaatatagcctgc

SEQ ID NO: 3352085 - DNA, 20 bp, Homo sapiens
gggttgaatatagcctgcct

SEQ ID NO: 3352086 - DNA, 20 bp, Homo sapiens
gggttgctgtataagttatt

SEQ ID NO: 3352087 - DNA, 19 bp, Homo sapiens
gggttggcccctgcccggc

SEQ ID NO: 3352088 - DNA, 12 bp, Homo sapiens
gggttgggccca

SEQ ID NO: 3352089 - DNA, 14 bp, Homo sapiens
gggttgggcccaga

SEQ ID NO: 3352090 - DNA, 15 bp, Homo sapiens
gggttgggctggtgt

SEQ ID NO: 3352091 - DNA, 14 bp, Homo sapiens
gggttgggggcact

SEQ ID NO: 3352092 - DNA, 20 bp, Homo sapiens
gggtttcaccatgttggcca

SEQ ID NO: 3352093 - DNA, 20 bp, Homo sapiens
gggtttcaccgtgttagcca

SEQ ID NO: 3352094 - DNA, 15 bp, Homo sapiens
gggtttcccttgccc

SEQ ID NO: 3352095 - DNA, 16 bp, Homo sapiens
gggtttcgactggtcc

SEQ ID NO: 3352096 - DNA, 23 bp, Homo sapiens
gggtttcgactggtccagctctg

SEQ ID NO: 3352097 - DNA, 17 bp, Homo sapiens
gggtttctgattgcatc

SEQ ID NO: 3352098 - DNA, 19 bp, Homo sapiens
gggtttggaccccagctgg

SEQ ID NO: 3352099 - DNA, 20 bp, Homo sapiens
gggtttgggcccctcagagc

SEQ ID NO: 3352100 - DNA, 21 bp, Homo sapiens
gggttttgcaataacttctat

SEQ ID NO: 3352101 - DNA, 23 bp, Homo sapiens
gggttttgccatgttggccaggc

SEQ ID NO: 3352102 - DNA, 14 bp, Homo sapiens
gggtttttcttgtg

SEQ ID NO: 3352103 - DNA, 17 bp, Homo sapiens
ggtaaaaatgctgctct

SEQ ID NO: 3352104 - DNA, 19 bp, Homo sapiens
ggtaaaactcactgtgatc

SEQ ID NO: 3352105 - DNA, 13 bp, Homo sapiens
ggtaaaatgtatt

SEQ ID NO: 3352106 - DNA, 15 bp, Homo sapiens
ggtaaaatgtatttt

SEQ ID NO: 3352107 - DNA, 17 bp, Homo sapiens
ggtaaaatgtatttttc

SEQ ID NO: 3352108 - DNA, 13 bp, Homo sapiens
ggtaaatattttc

SEQ ID NO: 3352109 - DNA, 13 bp, Homo sapiens
ggtaaatgatgtg

SEQ ID NO: 3352110 - DNA, 13 bp, Homo sapiens
ggtaaatgtttct

SEQ ID NO: 3352111 - DNA, 21 bp, Homo sapiens
ggtaaatgtttcttttaaaga

SEQ ID NO: 3352112 - DNA, 16 bp, Homo sapiens
ggtaacagaacagctt

SEQ ID NO: 3352113 - DNA, 21 bp, Homo sapiens
ggtaacagaacagcttcaggt

SEQ ID NO: 3352114 - DNA, 20 bp, Homo sapiens
ggtaacaggcagatacagga

SEQ ID NO: 3352115 - DNA, 21 bp, Homo sapiens
ggtaacagttcatgtttgctt

SEQ ID NO: 3352116 - DNA, 16 bp, Homo sapiens
ggtaacttattagaaa

SEQ ID NO: 3352117 - DNA, 14 bp, Homo sapiens
ggtaagaagaaagc

SEQ ID NO: 3352118 - DNA, 16 bp, Homo sapiens
ggtaagcaacatggct

SEQ ID NO: 3352119 - DNA, 15 bp, Homo sapiens
ggtaagccagagcct

SEQ ID NO: 3352120 - DNA, 11 bp, Homo sapiens
ggtaatttttt

SEQ ID NO: 3352121 - DNA, 21 bp, Homo sapiens
ggtaattttttttgttttttg

SEQ ID NO: 3352122 - DNA, 13 bp, Homo sapiens
ggtacaggagagg

SEQ ID NO: 3352123 - DNA, 15 bp, Homo sapiens
ggtacaggagaggca

SEQ ID NO: 3352124 - DNA, 15 bp, Homo sapiens
ggtacagttgcagga

SEQ ID NO: 3352125 - DNA, 17 bp, Homo sapiens
ggtacagttgcaggagc

SEQ ID NO: 3352126 - DNA, 19 bp, Homo sapiens
ggtacagttgcaggagcgt

SEQ ID NO: 3352127 - DNA, 14 bp, Homo sapiens
ggtacatttctctg

SEQ ID NO: 3352128 - DNA, 18 bp, Homo sapiens
ggtacatttctctgagca

SEQ ID NO: 3352129 - DNA, 15 bp, Homo sapiens
ggtaccaatgctgca

SEQ ID NO: 3352130 - DNA, 16 bp, Homo sapiens
ggtacccaattcaatt

SEQ ID NO: 3352131 - DNA, 11 bp, Homo sapiens
ggtacccactg

SEQ ID NO: 3352132 - DNA, 19 bp, Homo sapiens
ggtacccctttctggctct

SEQ ID NO: 3352133 - DNA, 20 bp, Homo sapiens
ggtaccctttggggagcagg

SEQ ID NO: 3352134 - DNA, 22 bp, Homo sapiens
ggtacctcaagccccatttcct

SEQ ID NO: 3352135 - DNA, 13 bp, Homo sapiens
ggtacctgccctc

SEQ ID NO: 3352136 - DNA, 16 bp, Homo sapiens
ggtaccttgtgcccag

SEQ ID NO: 3352137 - DNA, 17 bp, Homo sapiens
ggtaccttgtgcccagg

SEQ ID NO: 3352138 - DNA, 13 bp, Homo sapiens
ggtacggagaaga

SEQ ID NO: 3352139 - DNA, 15 bp, Homo sapiens
ggtactcttgttgag

SEQ ID NO: 3352140 - DNA, 20 bp, Homo sapiens
ggtacttcaggggcacttca

SEQ ID NO: 3352141 - DNA, 17 bp, Homo sapiens
ggtacttgtggacacag

SEQ ID NO: 3352142 - DNA, 23 bp, Homo sapiens
ggtacttttatgatgtatattta

SEQ ID NO: 3352143 - DNA, 20 bp, Homo sapiens
ggtagaaagagatacagagg

SEQ ID NO: 3352144 - DNA, 11 bp, Homo sapiens
ggtagaaatgc

SEQ ID NO: 3352145 - DNA, 16 bp, Homo sapiens
ggtagaatgattaatc

SEQ ID NO: 3352146 - DNA, 17 bp, Homo sapiens
ggtagaatgattaatca

SEQ ID NO: 3352147 - DNA, 19 bp, Homo sapiens
ggtagaccaggatttctaa

SEQ ID NO: 3352148 - DNA, 12 bp, Homo sapiens
ggtagagacccc

SEQ ID NO: 3352149 - DNA, 14 bp, Homo sapiens
ggtagagaccccca

SEQ ID NO: 3352150 - DNA, 18 bp, Homo sapiens
ggtagagacccccaggcc

SEQ ID NO: 3352151 - DNA, 13 bp, Homo sapiens
ggtagaggcctgg

SEQ ID NO: 3352152 - DNA, 14 bp, Homo sapiens
ggtagaggcctggg

SEQ ID NO: 3352153 - DNA, 22 bp, Homo sapiens
ggtcaggatgtaggggttaact

SEQ ID NO: 3352154 - DNA, 18 bp, Homo sapiens
ggtcaggccctggaactc

SEQ ID NO: 3352155 - DNA, 13 bp, Homo sapiens
ggtcaggctccat

SEQ ID NO: 3352156 - DNA, 21 bp, Homo sapiens
ggtcagggacttggacaggag

SEQ ID NO: 3352157 - DNA, 16 bp, Homo sapiens
ggtcagggagtgctgg

SEQ ID NO: 3352158 - DNA, 23 bp, Homo sapiens
ggtcagggagtgctggctcacag

SEQ ID NO: 3352159 - DNA, 15 bp, Homo sapiens
ggtcaggggggagaa

SEQ ID NO: 3352160 - DNA, 17 bp, Homo sapiens
ggtcaggtttaacattt

SEQ ID NO: 3352161 - DNA, 17 bp, Homo sapiens
ggtcagtgcagcagagg

SEQ ID NO: 3352162 - DNA, 16 bp, Homo sapiens
ggtcatgtatgatgag

SEQ ID NO: 3352163 - DNA, 17 bp, Homo sapiens
ggtcattgacctctcag

SEQ ID NO: 3352164 - DNA, 20 bp, Homo sapiens
ggtcattgacctctcagggc

SEQ ID NO: 3352165 - DNA, 17 bp, Homo sapiens
ggtccaaaaaaaggaaa

SEQ ID NO: 3352166 - DNA, 19 bp, Homo sapiens
ggtccaaaaaaaggaaaaa

SEQ ID NO: 3352167 - DNA, 17 bp, Homo sapiens
ggtccaaataaaaacta

SEQ ID NO: 3352168 - DNA, 17 bp, Homo sapiens
ggtccaattagtttcct

SEQ ID NO: 3352169 - DNA, 17 bp, Homo sapiens
ggtccacacctgggcat

SEQ ID NO: 3352170 - DNA, 12 bp, Homo sapiens
ggtccacccagg

SEQ ID NO: 3352171 - DNA, 20 bp, Homo sapiens
ggtccagctctgacatccct

SEQ ID NO: 3352172 - DNA, 22 bp, Homo sapiens
ggtccagctctgacatcccttc

SEQ ID NO: 3352173 - DNA, 23 bp, Homo sapiens
ggtccagctctgacatcccttcc

SEQ ID NO: 3352174 - DNA, 13 bp, Homo sapiens
ggtccagctctgg

SEQ ID NO: 3352175 - DNA, 15 bp, Homo sapiens
ggtccagctggcctg

SEQ ID NO: 3352176 - DNA, 14 bp, Homo sapiens
ggtccaggaaggca

SEQ ID NO: 3352177 - DNA, 12 bp, Homo sapiens
ggtccagggcta

SEQ ID NO: 3352178 - DNA, 12 bp, Homo sapiens
ggtcccacccct

SEQ ID NO: 3352179 - DNA, 22 bp, Homo sapiens
ggtcccacctccagcccgggag

SEQ ID NO: 3352180 - DNA, 14 bp, Homo sapiens
ggtcccagccaccc

SEQ ID NO: 3352181 - DNA, 11 bp, Homo sapiens
ggtcccagtgg

SEQ ID NO: 3352182 - DNA, 18 bp, Homo sapiens
ggtcccagtgggaggggc

SEQ ID NO: 3352183 - DNA, 23 bp, Homo sapiens
ggtcccagtgggaggggcaggct

SEQ ID NO: 3352184 - DNA, 13 bp, Homo sapiens
ggtcccatccagg

SEQ ID NO: 3352185 - DNA, 16 bp, Homo sapiens
ggtcccatccaggcag

SEQ ID NO: 3352186 - DNA, 22 bp, Homo sapiens
ggtccccgagacacaggcacgg

SEQ ID NO: 3352187 - DNA, 19 bp, Homo sapiens
ggtcccctccacatcccag

SEQ ID NO: 3352188 - DNA, 18 bp, Homo sapiens
ggtcccctgcctggaact

SEQ ID NO: 3352189 - DNA, 22 bp, Homo sapiens
ggtcccggttcagacccctgcc

SEQ ID NO: 3352190 - DNA, 20 bp, Homo sapiens
ggtccctcacccccatggcc

SEQ ID NO: 3352191 - DNA, 14 bp, Homo sapiens
ggtccctccacccc

SEQ ID NO: 3352192 - DNA, 21 bp, Homo sapiens
ggtccctccaccccacagaac

SEQ ID NO: 3352193 - DNA, 17 bp, Homo sapiens
ggtccctccccttctct

SEQ ID NO: 3352194 - DNA, 17 bp, Homo sapiens
ggtccctccgcggctgg

SEQ ID NO: 3352195 - DNA, 22 bp, Homo sapiens
ggtccctcgtccacaggggcag

SEQ ID NO: 3352196 - DNA, 19 bp, Homo sapiens
ggtccctggtccctcgtcc

SEQ ID NO: 3352197 - DNA, 12 bp, Homo sapiens
ggtccctgtatg

SEQ ID NO: 3352198 - DNA, 15 bp, Homo sapiens
ggtcccttgaaggaa

SEQ ID NO: 3352199 - DNA, 23 bp, Homo sapiens
ggtcccttgcagctagttttcta

SEQ ID NO: 3352200 - DNA, 16 bp, Homo sapiens
ggtccgcaccagctgc

SEQ ID NO: 3352201 - DNA, 20 bp, Homo sapiens
ggtccgcaccagctgctctg

SEQ ID NO: 3352202 - DNA, 21 bp, Homo sapiens
ggtccgcaccagctgctctgc

SEQ ID NO: 3352203 - DNA, 22 bp, Homo sapiens
ggtccgcaccagctgctctgcc

SEQ ID NO: 3352204 - DNA, 15 bp, Homo sapiens
ggtcctagtaagaag

SEQ ID NO: 3352205 - DNA, 12 bp, Homo sapiens
ggtcctctcagt

SEQ ID NO: 3352206 - DNA, 13 bp, Homo sapiens
ggtcctctggagc

SEQ ID NO: 3352207 - DNA, 19 bp, Homo sapiens
ggtcctcttctgggcctga

SEQ ID NO: 3352208 - DNA, 18 bp, Homo sapiens
ggtcctgaagaattaaga

SEQ ID NO: 3352209 - DNA, 20 bp, Homo sapiens
ggtcctgcccatgtgtcccc

SEQ ID NO: 3352210 - DNA, 11 bp, Homo sapiens
ggtcctgccct

SEQ ID NO: 3352211 - DNA, 17 bp, Homo sapiens
ggtcctggagcagacca

SEQ ID NO: 3352212 - DNA, 15 bp, Homo sapiens
ggtcctggctcctga

SEQ ID NO: 3352213 - DNA, 16 bp, Homo sapiens
ggtcctggctcctgag

SEQ ID NO: 3352214 - DNA, 15 bp, Homo sapiens
ggtcctggggctctg

SEQ ID NO: 3352215 - DNA, 13 bp, Homo sapiens
ggtcctgtggcag

SEQ ID NO: 3352216 - DNA, 16 bp, Homo sapiens
ggtcctgtggcaggca

SEQ ID NO: 3352217 - DNA, 18 bp, Homo sapiens
ggtcctgtggcaggcagc

SEQ ID NO: 3352218 - DNA, 15 bp, Homo sapiens
ggtccttccaggccc

SEQ ID NO: 3352219 - DNA, 16 bp, Homo sapiens
ggtccttttgacactg

SEQ ID NO: 3352220 - DNA, 18 bp, Homo sapiens
ggtccttttgacactgct

SEQ ID NO: 3352221 - DNA, 16 bp, Homo sapiens
ggtcgaggagtaacaa

SEQ ID NO: 3352222 - DNA, 12 bp, Homo sapiens
ggtcgctcctgc

SEQ ID NO: 3352223 - DNA, 14 bp, Homo sapiens
ggtcgggcagccag

SEQ ID NO: 3352224 - DNA, 15 bp, Homo sapiens
ggtcgggcagccagc

SEQ ID NO: 3352225 - DNA, 14 bp, Homo sapiens
ggtctaggacacag

SEQ ID NO: 3352226 - DNA, 15 bp, Homo sapiens
ggtctatgttcccca

SEQ ID NO: 3352227 - DNA, 19 bp, Homo sapiens
ggtctcacagtgttgccca

SEQ ID NO: 3352228 - DNA, 20 bp, Homo sapiens
ggtctcacagtgttgcccag

SEQ ID NO: 3352229 - DNA, 23 bp, Homo sapiens
ggtctcactctgtcgcccagtct

SEQ ID NO: 3352230 - DNA, 22 bp, Homo sapiens
ggtctcaggatatccttatcag

SEQ ID NO: 3352231 - DNA, 18 bp, Homo sapiens
ggtctcaggctggtggga

SEQ ID NO: 3352232 - DNA, 15 bp, Homo sapiens
ggtctccaggggcct

SEQ ID NO: 3352233 - DNA, 13 bp, Homo sapiens
ggtctccctggct

SEQ ID NO: 3352234 - DNA, 17 bp, Homo sapiens
ggtctccctggctccct

SEQ ID NO: 3352235 - DNA, 20 bp, Homo sapiens
ggtctcccttctctacactc

SEQ ID NO: 3352236 - DNA, 14 bp, Homo sapiens
ggtctcctcagggt

SEQ ID NO: 3352237 - DNA, 16 bp, Homo sapiens
ggtctcgatctcctga

SEQ ID NO: 3352238 - DNA, 22 bp, Homo sapiens
ggtctcgctgtcactggctggc

SEQ ID NO: 3352239 - DNA, 20 bp, Homo sapiens
ggtctcgctttgttgcccag

SEQ ID NO: 3352240 - DNA, 19 bp, Homo sapiens
ggtctctctctctctacaa

SEQ ID NO: 3352241 - DNA, 19 bp, Homo sapiens
ggtctctgccggctctttc

SEQ ID NO: 3352242 - DNA, 14 bp, Homo sapiens
ggtctcttctccca

SEQ ID NO: 3352243 - DNA, 16 bp, Homo sapiens
ggtctcttctcccaga

SEQ ID NO: 3352244 - DNA, 12 bp, Homo sapiens
ggtctgaaatgg

SEQ ID NO: 3352245 - DNA, 15 bp, Homo sapiens
ggtctgaaggactgg

SEQ ID NO: 3352246 - DNA, 12 bp, Homo sapiens
ggtctgaatgtt

SEQ ID NO: 3352247 - DNA, 13 bp, Homo sapiens
ggtctgagccctg

SEQ ID NO: 3352248 - DNA, 14 bp, Homo sapiens
ggtctgcaagtcag

SEQ ID NO: 3352249 - DNA, 17 bp, Homo sapiens
ggtctgcaagtcagagg

SEQ ID NO: 3352250 - DNA, 15 bp, Homo sapiens
ggtctgtgctgtgcc

SEQ ID NO: 3352251 - DNA, 20 bp, Homo sapiens
ggtctgtgctgtgcctgcta

SEQ ID NO: 3352252 - DNA, 15 bp, Homo sapiens
ggtctgtgtgaatgt

SEQ ID NO: 3352253 - DNA, 24 bp, Homo sapiens
ggtctgtgtgaatgtgggcactgg

SEQ ID NO: 3352254 - DNA, 18 bp, Homo sapiens
ggtctgtgtgtgttcttc

SEQ ID NO: 3352255 - DNA, 16 bp, Homo sapiens
ggtctgttggcaggct

SEQ ID NO: 3352256 - DNA, 18 bp, Homo sapiens
ggtctgttggcaggctgg

SEQ ID NO: 3352257 - DNA, 15 bp, Homo sapiens
ggtcttccagacctg

SEQ ID NO: 3352258 - DNA, 17 bp, Homo sapiens
ggtcttccagacctgct

SEQ ID NO: 3352259 - DNA, 22 bp, Homo sapiens
ggtcttccctacctcaggcagg

SEQ ID NO: 3352260 - DNA, 21 bp, Homo sapiens
ggtcttgagccagtaatcttt

SEQ ID NO: 3352261 - DNA, 16 bp, Homo sapiens
ggtcttgcagtggctt

SEQ ID NO: 3352262 - DNA, 16 bp, Homo sapiens
ggtcttgggctactgg

SEQ ID NO: 3352263 - DNA, 18 bp, Homo sapiens
ggtcttgggctactggca

SEQ ID NO: 3352264 - DNA, 21 bp, Homo sapiens
ggtcttgggggtcagggggga

SEQ ID NO: 3352265 - DNA, 17 bp, Homo sapiens
ggtctttctctcagtga

SEQ ID NO: 3352266 - DNA, 13 bp, Homo sapiens
ggtctttgtaaga

SEQ ID NO: 3352267 - DNA, 19 bp, Homo sapiens
ggtctttgtaagagtgtag

SEQ ID NO: 3352268 - DNA, 14 bp, Homo sapiens
ggtctttgtatctt

SEQ ID NO: 3352269 - DNA, 21 bp, Homo sapiens
ggtctttgttatgacagtgaa

SEQ ID NO: 3352270 - DNA, 17 bp, Homo sapiens
ggtcttttgacatgtgg

SEQ ID NO: 3352271 - DNA, 21 bp, Homo sapiens
ggtcttttgacatgtggaaag

SEQ ID NO: 3352272 - DNA, 20 bp, Homo sapiens
ggtcttttgtatttttgatt

SEQ ID NO: 3352273 - DNA, 23 bp, Homo sapiens
ggtcttttttcatttcttcctca

SEQ ID NO: 3352274 - DNA, 13 bp, Homo sapiens
ggtgaaagggagc

SEQ ID NO: 3352275 - DNA, 19 bp, Homo sapiens
ggtgaagatgggaacgcag

SEQ ID NO: 3352276 - DNA, 18 bp, Homo sapiens
ggtgaagctatttatctg

SEQ ID NO: 3352277 - DNA, 21 bp, Homo sapiens
ggtgaagctcacttctgggct

SEQ ID NO: 3352278 - DNA, 16 bp, Homo sapiens
ggtgaaggatccagga

SEQ ID NO: 3352279 - DNA, 14 bp, Homo sapiens
ggtgaaggcctggc

SEQ ID NO: 3352280 - DNA, 16 bp, Homo sapiens
ggtgaaggcctggctg

SEQ ID NO: 3352281 - DNA, 18 bp, Homo sapiens
ggtgaaggcctggctgga

SEQ ID NO: 3352282 - DNA, 19 bp, Homo sapiens
ggtgaaggcctggctggaa

SEQ ID NO: 3352283 - DNA, 13 bp, Homo sapiens
ggtgacaagagcc

SEQ ID NO: 3352284 - DNA, 17 bp, Homo sapiens
ggtgacaagagcctgat

SEQ ID NO: 3352285 - DNA, 19 bp, Homo sapiens
ggtgacacattacaaagcc

SEQ ID NO: 3352286 - DNA, 21 bp, Homo sapiens
ggtgacagagtgagactctgt

SEQ ID NO: 3352287 - DNA, 20 bp, Homo sapiens
ggtgacagtcatcatcaggg

SEQ ID NO: 3352288 - DNA, 22 bp, Homo sapiens
ggtgacagtcatcatcagggcc

SEQ ID NO: 3352289 - DNA, 18 bp, Homo sapiens
ggtgacagtgccttctct

SEQ ID NO: 3352290 - DNA, 15 bp, Homo sapiens
ggtgacatttcccaa

SEQ ID NO: 3352291 - DNA, 18 bp, Homo sapiens
ggtgacgcctgccctccc

SEQ ID NO: 3352292 - DNA, 12 bp, Homo sapiens
ggtgacggccct

SEQ ID NO: 3352293 - DNA, 19 bp, Homo sapiens
ggtgacggccctcatctat

SEQ ID NO: 3352294 - DNA, 14 bp, Homo sapiens
ggtgagagagacag

SEQ ID NO: 3352295 - DNA, 16 bp, Homo sapiens
ggtgagaggggaacag

SEQ ID NO: 3352296 - DNA, 17 bp, Homo sapiens
ggtgagagtcaaagctg

SEQ ID NO: 3352297 - DNA, 12 bp, Homo sapiens
ggtgagagtggg

SEQ ID NO: 3352298 - DNA, 17 bp, Homo sapiens
ggtgagagtgggaggga

SEQ ID NO: 3352299 - DNA, 17 bp, Homo sapiens
ggtgagatgctggagaa

SEQ ID NO: 3352300 - DNA, 21 bp, Homo sapiens
ggtgagatgctggagaagaga

SEQ ID NO: 3352301 - DNA, 22 bp, Homo sapiens
ggtgagatgctggagaagagag

SEQ ID NO: 3352302 - DNA, 16 bp, Homo sapiens
ggtgagggttggcgct

SEQ ID NO: 3352303 - DNA, 18 bp, Homo sapiens
ggtgagtcccctactccc

SEQ ID NO: 3352304 - DNA, 20 bp, Homo sapiens
ggtgagtcccctactccctc

SEQ ID NO: 3352305 - DNA, 17 bp, Homo sapiens
ggtgagtcttggcggca

SEQ ID NO: 3352306 - DNA, 23 bp, Homo sapiens
ggtgagtcttggcggcagcagcc

SEQ ID NO: 3352307 - DNA, 19 bp, Homo sapiens
ggtgagtttgagctgcctt

SEQ ID NO: 3352308 - DNA, 12 bp, Homo sapiens
ggtgataagtgg

SEQ ID NO: 3352309 - DNA, 12 bp, Homo sapiens
ggtgatcagtgc

SEQ ID NO: 3352310 - DNA, 18 bp, Homo sapiens
ggtgatccacccacctca

SEQ ID NO: 3352311 - DNA, 24 bp, Homo sapiens
ggtgatccacccacctcagcctcc

SEQ ID NO: 3352312 - DNA, 20 bp, Homo sapiens
ggtgatccgcctacctcagc

SEQ ID NO: 3352313 - DNA, 14 bp, Homo sapiens
ggtgatcctctatt

SEQ ID NO: 3352314 - DNA, 23 bp, Homo sapiens
ggtgatcctctattttgtgatga

SEQ ID NO: 3352315 - DNA, 18 bp, Homo sapiens
ggtgattggaccaggcca

SEQ ID NO: 3352316 - DNA, 18 bp, Homo sapiens
ggtgcaaagttccctact

SEQ ID NO: 3352317 - DNA, 16 bp, Homo sapiens
ggtgcacagtgatttt

SEQ ID NO: 3352318 - DNA, 13 bp, Homo sapiens
ggtgcaggtgggc

SEQ ID NO: 3352319 - DNA, 22 bp, Homo sapiens
ggtgcatacacccccacctcct

SEQ ID NO: 3352320 - DNA, 18 bp, Homo sapiens
ggtgcatagaactgggta

SEQ ID NO: 3352321 - DNA, 23 bp, Homo sapiens
ggtgccaaacaaaaaggttctca

SEQ ID NO: 3352322 - DNA, 14 bp, Homo sapiens
ggtgccaccaccct

SEQ ID NO: 3352323 - DNA, 17 bp, Homo sapiens
ggtgccactccctgagc

SEQ ID NO: 3352324 - DNA, 19 bp, Homo sapiens
ggtgccactttacccacct

SEQ ID NO: 3352325 - DNA, 17 bp, Homo sapiens
ggtgcccaagccagagg

SEQ ID NO: 3352326 - DNA, 18 bp, Homo sapiens
ggtgcccaagccagaggc

SEQ ID NO: 3352327 - DNA, 23 bp, Homo sapiens
ggtgcccaagccagaggctgggt

SEQ ID NO: 3352328 - DNA, 21 bp, Homo sapiens
ggtgcccacaccggggacagg

SEQ ID NO: 3352329 - DNA, 13 bp, Homo sapiens
ggtgccccacagc

SEQ ID NO: 3352330 - DNA, 21 bp, Homo sapiens
ggtgccccacagctacctgag

SEQ ID NO: 3352331 - DNA, 19 bp, Homo sapiens
ggtgccccctcctctccca

SEQ ID NO: 3352332 - DNA, 22 bp, Homo sapiens
ggtgccccctcctctcccatcc

SEQ ID NO: 3352333 - DNA, 13 bp, Homo sapiens
ggtgcctcagact

SEQ ID NO: 3352334 - DNA, 23 bp, Homo sapiens
ggtgcctcagactccgccctcct

SEQ ID NO: 3352335 - DNA, 16 bp, Homo sapiens
ggtgcctccaggtgtg

SEQ ID NO: 3352336 - DNA, 12 bp, Homo sapiens
ggtgcctttcct

SEQ ID NO: 3352337 - DNA, 19 bp, Homo sapiens
ggtgcctttcctgttcagc

SEQ ID NO: 3352338 - DNA, 13 bp, Homo sapiens
ggtgcgtggctgt

SEQ ID NO: 3352339 - DNA, 20 bp, Homo sapiens
ggtgctcaccatgcttccag

SEQ ID NO: 3352340 - DNA, 14 bp, Homo sapiens
ggtgctctggcggc

SEQ ID NO: 3352341 - DNA, 16 bp, Homo sapiens
ggtgctgagcttagcc

SEQ ID NO: 3352342 - DNA, 12 bp, Homo sapiens
ggtgctgatgga

SEQ ID NO: 3352343 - DNA, 23 bp, Homo sapiens
ggtgctgcagatttgatatttgc

SEQ ID NO: 3352344 - DNA, 21 bp, Homo sapiens
ggtgctggaggtgggagcagg

SEQ ID NO: 3352345 - DNA, 22 bp, Homo sapiens
ggtgctggaggtgggagcagga

SEQ ID NO: 3352346 - DNA, 16 bp, Homo sapiens
ggtgctggatattttc

SEQ ID NO: 3352347 - DNA, 15 bp, Homo sapiens
ggtgctgggaggagg

SEQ ID NO: 3352348 - DNA, 17 bp, Homo sapiens
ggtgcttacacatctca

SEQ ID NO: 3352349 - DNA, 18 bp, Homo sapiens
ggtgctttttataaaaag

SEQ ID NO: 3352350 - DNA, 13 bp, Homo sapiens
ggtggaaaatgga

SEQ ID NO: 3352351 - DNA, 21 bp, Homo sapiens
ggtggaaagcgattcactgta

SEQ ID NO: 3352352 - DNA, 19 bp, Homo sapiens
ggtggaagaagggagaaga

SEQ ID NO: 3352353 - DNA, 15 bp, Homo sapiens
ggtggaaggcagaca

SEQ ID NO: 3352354 - DNA, 18 bp, Homo sapiens
ggtggacttagaaagcag

SEQ ID NO: 3352355 - DNA, 15 bp, Homo sapiens
ggtggaggcttcctg

SEQ ID NO: 3352356 - DNA, 16 bp, Homo sapiens
ggtggagggggctggg

SEQ ID NO: 3352357 - DNA, 17 bp, Homo sapiens
ggtggagggggctgggc

SEQ ID NO: 3352358 - DNA, 14 bp, Homo sapiens
gggagctgagctgg

SEQ ID NO: 3352359 - DNA, 17 bp, Homo sapiens
gggagcttccgctttga

SEQ ID NO: 3352360 - DNA, 24 bp, Homo sapiens
gggaggaaatttgaatgggtccat

SEQ ID NO: 3352361 - DNA, 16 bp, Homo sapiens
gggaggacaaaacttc

SEQ ID NO: 3352362 - DNA, 14 bp, Homo sapiens
gggaggagaatgag

SEQ ID NO: 3352363 - DNA, 13 bp, Homo sapiens
gggaggagggaga

SEQ ID NO: 3352364 - DNA, 20 bp, Homo sapiens
gggaggaggtggcagccctg

SEQ ID NO: 3352365 - DNA, 19 bp, Homo sapiens
gggaggatcactggagccc

SEQ ID NO: 3352366 - DNA, 22 bp, Homo sapiens
gggaggatcactggagcccagg

SEQ ID NO: 3352367 - DNA, 22 bp, Homo sapiens
gggaggatgttctgggacacag

SEQ ID NO: 3352368 - DNA, 17 bp, Homo sapiens
gggaggcaagaaaagga

SEQ ID NO: 3352369 - DNA, 18 bp, Homo sapiens
gggaggcaagtgtggggg

SEQ ID NO: 3352370 - DNA, 14 bp, Homo sapiens
gggaggcaccagct

SEQ ID NO: 3352371 - DNA, 20 bp, Homo sapiens
gggaggcagaggttgcagtg

SEQ ID NO: 3352372 - DNA, 17 bp, Homo sapiens
gggaggcatggccctgg

SEQ ID NO: 3352373 - DNA, 16 bp, Homo sapiens
gggaggccaaggcagg

SEQ ID NO: 3352374 - DNA, 13 bp, Homo sapiens
gggaggccccagc

SEQ ID NO: 3352375 - DNA, 16 bp, Homo sapiens
gggaggccctggccct

SEQ ID NO: 3352376 - DNA, 17 bp, Homo sapiens
gggaggccctggccctt

SEQ ID NO: 3352377 - DNA, 23 bp, Homo sapiens
gggaggccctggccctttcccct

SEQ ID NO: 3352378 - DNA, 17 bp, Homo sapiens
gggaggcctaggcgggc

SEQ ID NO: 3352379 - DNA, 18 bp, Homo sapiens
gggaggctgaggcagaag

SEQ ID NO: 3352380 - DNA, 14 bp, Homo sapiens
gggaggctgaggcg

SEQ ID NO: 3352381 - DNA, 12 bp, Homo sapiens
gggaggctgggc

SEQ ID NO: 3352382 - DNA, 16 bp, Homo sapiens
gggagggagcaagccc

SEQ ID NO: 3352383 - DNA, 21 bp, Homo sapiens
gggagggagcaagccctactc

SEQ ID NO: 3352384 - DNA, 22 bp, Homo sapiens
gggagggatgaagggcgagtga

SEQ ID NO: 3352385 - DNA, 21 bp, Homo sapiens
gggagggcggcaggggcctgg

SEQ ID NO: 3352386 - DNA, 22 bp, Homo sapiens
gggagggcggcaggggcctgga

SEQ ID NO: 3352387 - DNA, 21 bp, Homo sapiens
gggaggggcgcgggagggggc

SEQ ID NO: 3352388 - DNA, 21 bp, Homo sapiens
gggagggggttacaaactgca

SEQ ID NO: 3352389 - DNA, 23 bp, Homo sapiens
gggaggggttgccacaggcctcc

SEQ ID NO: 3352390 - DNA, 18 bp, Homo sapiens
gggagggttcccctggcc

SEQ ID NO: 3352391 - DNA, 15 bp, Homo sapiens
gggaggtcactggaa

SEQ ID NO: 3352392 - DNA, 16 bp, Homo sapiens
gggaggtcaggccctg

SEQ ID NO: 3352393 - DNA, 23 bp, Homo sapiens
gggaggttttattctgacttcct

SEQ ID NO: 3352394 - DNA, 14 bp, Homo sapiens
gggagtcagagccc

SEQ ID NO: 3352395 - DNA, 17 bp, Homo sapiens
gggagtcagagccctgg

SEQ ID NO: 3352396 - DNA, 17 bp, Homo sapiens
gggagtccccttttctt

SEQ ID NO: 3352397 - DNA, 15 bp, Homo sapiens
gggagtgctggctca

SEQ ID NO: 3352398 - DNA, 23 bp, Homo sapiens
gggagtgctggctcacagtacag

SEQ ID NO: 3352399 - DNA, 19 bp, Homo sapiens
gggagtgggcacctcagaa

SEQ ID NO: 3352400 - DNA, 22 bp, Homo sapiens
gggagttgtcaagtctctgctg

SEQ ID NO: 3352401 - DNA, 22 bp, Homo sapiens
gggatacaacctccctcttgtt

SEQ ID NO: 3352402 - DNA, 13 bp, Homo sapiens
gggatagaggaaa

SEQ ID NO: 3352403 - DNA, 15 bp, Homo sapiens
gggatataggagagg

SEQ ID NO: 3352404 - DNA, 18 bp, Homo sapiens
gggatatcacttccatga

SEQ ID NO: 3352405 - DNA, 22 bp, Homo sapiens
gggatcacagagacattcctcc

SEQ ID NO: 3352406 - DNA, 13 bp, Homo sapiens
gggatccagccac

SEQ ID NO: 3352407 - DNA, 20 bp, Homo sapiens
gggatccccgcctggccagg

SEQ ID NO: 3352408 - DNA, 17 bp, Homo sapiens
gggatccgactgctttg

SEQ ID NO: 3352409 - DNA, 14 bp, Homo sapiens
gggatctcaggggc

SEQ ID NO: 3352410 - DNA, 20 bp, Homo sapiens
gggatgactaaaatatttat

SEQ ID NO: 3352411 - DNA, 17 bp, Homo sapiens
gggatgactagaggcag

SEQ ID NO: 3352412 - DNA, 13 bp, Homo sapiens
gggatgagaaagg

SEQ ID NO: 3352413 - DNA, 15 bp, Homo sapiens
gggatgagccgctgt

SEQ ID NO: 3352414 - DNA, 18 bp, Homo sapiens
gggatgcggatcctgctg

SEQ ID NO: 3352415 - DNA, 16 bp, Homo sapiens
gggatgctagccccag

SEQ ID NO: 3352416 - DNA, 14 bp, Homo sapiens
gggatgctgggctg

SEQ ID NO: 3352417 - DNA, 15 bp, Homo sapiens
gggatgctgggctgg

SEQ ID NO: 3352418 - DNA, 16 bp, Homo sapiens
gggatggagaaagaag

SEQ ID NO: 3352419 - DNA, 15 bp, Homo sapiens
gggatggaggggagt

SEQ ID NO: 3352420 - DNA, 14 bp, Homo sapiens
gggatgggccaggg

SEQ ID NO: 3352421 - DNA, 22 bp, Homo sapiens
gggatgtcaacagccataataa

SEQ ID NO: 3352422 - DNA, 11 bp, Homo sapiens
gggatgtctta

SEQ ID NO: 3352423 - DNA, 15 bp, Homo sapiens
gggatgtgagcccca

SEQ ID NO: 3352424 - DNA, 14 bp, Homo sapiens
gggatgtgggaggg

SEQ ID NO: 3352425 - DNA, 20 bp, Homo sapiens
gggattacaggcgtgagcca

SEQ ID NO: 3352426 - DNA, 15 bp, Homo sapiens
gggattcaggctgct

SEQ ID NO: 3352427 - DNA, 14 bp, Homo sapiens
gggattcctgaccc

SEQ ID NO: 3352428 - DNA, 16 bp, Homo sapiens
gggattcctgacccag

SEQ ID NO: 3352429 - DNA, 17 bp, Homo sapiens
gggattcctgacccagg

SEQ ID NO: 3352430 - DNA, 22 bp, Homo sapiens
gggattctctattggaggtgag

SEQ ID NO: 3352431 - DNA, 11 bp, Homo sapiens
gggattctggg

SEQ ID NO: 3352432 - DNA, 13 bp, Homo sapiens
gggattgttttgt

SEQ ID NO: 3352433 - DNA, 14 bp, Homo sapiens
gggatttcttaggg

SEQ ID NO: 3352434 - DNA, 17 bp, Homo sapiens
gggcaaaacccaggaca

SEQ ID NO: 3352435 - DNA, 23 bp, Homo sapiens
gggcaaaacccaggacatctcct

SEQ ID NO: 3352436 - DNA, 18 bp, Homo sapiens
gggcaaagccacaaggct

SEQ ID NO: 3352437 - DNA, 20 bp, Homo sapiens
gggcaaagccacaaggctgg

SEQ ID NO: 3352438 - DNA, 13 bp, Homo sapiens
gggcaaagcttgt

SEQ ID NO: 3352439 - DNA, 13 bp, Homo sapiens
gggcaaataatga

SEQ ID NO: 3352440 - DNA, 18 bp, Homo sapiens
gggcaacccccagcctgc

SEQ ID NO: 3352441 - DNA, 23 bp, Homo sapiens
gggcaacgaagaaaaaaaataac

SEQ ID NO: 3352442 - DNA, 20 bp, Homo sapiens
gggcaagaagatcacgctcc

SEQ ID NO: 3352443 - DNA, 21 bp, Homo sapiens
gggcaagaagatcacgctccc

SEQ ID NO: 3352444 - DNA, 14 bp, Homo sapiens
gggcaagaagctgc

SEQ ID NO: 3352445 - DNA, 15 bp, Homo sapiens
gggcaatctctctct

SEQ ID NO: 3352446 - DNA, 15 bp, Homo sapiens
gggcacaccactgcc

SEQ ID NO: 3352447 - DNA, 19 bp, Homo sapiens
gggcacaccactgccctgc

SEQ ID NO: 3352448 - DNA, 20 bp, Homo sapiens
gggcacaccactgccctgcc

SEQ ID NO: 3352449 - DNA, 21 bp, Homo sapiens
gggcacaccactgccctgcct

SEQ ID NO: 3352450 - DNA, 23 bp, Homo sapiens
gggcacaccactgccctgcctgc

SEQ ID NO: 3352451 - DNA, 23 bp, Homo sapiens
gggcacaccgggcactcagaaga

SEQ ID NO: 3352452 - DNA, 15 bp, Homo sapiens
gggcacactctgcca

SEQ ID NO: 3352453 - DNA, 15 bp, Homo sapiens
gggcacagggcacca

SEQ ID NO: 3352454 - DNA, 18 bp, Homo sapiens
gggcacagggcaccagag

SEQ ID NO: 3352455 - DNA, 20 bp, Homo sapiens
gggcacagggcaccagaggc

SEQ ID NO: 3352456 - DNA, 22 bp, Homo sapiens
gggcacatgctgagtctcccaa

SEQ ID NO: 3352457 - DNA, 13 bp, Homo sapiens
gggcaccagaggc

SEQ ID NO: 3352458 - DNA, 16 bp, Homo sapiens
gggcaccagaggccga

SEQ ID NO: 3352459 - DNA, 18 bp, Homo sapiens
gggcaccaggggtttctc

SEQ ID NO: 3352460 - DNA, 13 bp, Homo sapiens
gggcacctcagaa

SEQ ID NO: 3352461 - DNA, 23 bp, Homo sapiens
gggcacctgcttccacccgtctc

SEQ ID NO: 3352462 - DNA, 22 bp, Homo sapiens
gggcacgtcgcccgctgagctg

SEQ ID NO: 3352463 - DNA, 19 bp, Homo sapiens
gggcactcagaagacactg

SEQ ID NO: 3352464 - DNA, 14 bp, Homo sapiens
gggcactgggctgt

SEQ ID NO: 3352465 - DNA, 16 bp, Homo sapiens
gggcactggtggcccg

SEQ ID NO: 3352466 - DNA, 17 bp, Homo sapiens
gggcacttaatttgtaa

SEQ ID NO: 3352467 - DNA, 19 bp, Homo sapiens
gggcagacattatgtaaaa

SEQ ID NO: 3352468 - DNA, 14 bp, Homo sapiens
gggcagactgtgaa

SEQ ID NO: 3352469 - DNA, 16 bp, Homo sapiens
gggcagagccatgggc

SEQ ID NO: 3352470 - DNA, 19 bp, Homo sapiens
gggcagagccatgggcctg

SEQ ID NO: 3352471 - DNA, 13 bp, Homo sapiens
gggcagagccggg

SEQ ID NO: 3352472 - DNA, 14 bp, Homo sapiens
gggcagagccggga

SEQ ID NO: 3352473 - DNA, 16 bp, Homo sapiens
gggcagagctggctct

SEQ ID NO: 3352474 - DNA, 19 bp, Homo sapiens
gggcagagctggctctgag

SEQ ID NO: 3352475 - DNA, 14 bp, Homo sapiens
gggcagagggaatg

SEQ ID NO: 3352476 - DNA, 23 bp, Homo sapiens
gggcagagggaatgttccctgca

SEQ ID NO: 3352477 - DNA, 14 bp, Homo sapiens
gggcagagggctgg

SEQ ID NO: 3352478 - DNA, 12 bp, Homo sapiens
gggcagcaccct

SEQ ID NO: 3352479 - DNA, 13 bp, Homo sapiens
gggcagcaccctc

SEQ ID NO: 3352480 - DNA, 18 bp, Homo sapiens
gggcagcaccctcccccg

SEQ ID NO: 3352481 - DNA, 11 bp, Homo sapiens
gggcagcactc

SEQ ID NO: 3352482 - DNA, 14 bp, Homo sapiens
gggcagcccttgct

SEQ ID NO: 3352483 - DNA, 19 bp, Homo sapiens
gggcagccgctaggagaga

SEQ ID NO: 3352484 - DNA, 20 bp, Homo sapiens
gggcagcgggccaggcccgc

SEQ ID NO: 3352485 - DNA, 21 bp, Homo sapiens
gggcagcgggccaggcccgca

SEQ ID NO: 3352486 - DNA, 12 bp, Homo sapiens
gggcagctgagg

SEQ ID NO: 3352487 - DNA, 17 bp, Homo sapiens
gggcagctgggccccac

SEQ ID NO: 3352488 - DNA, 18 bp, Homo sapiens
gggcaggaaggagagcct

SEQ ID NO: 3352489 - DNA, 14 bp, Homo sapiens
gggcaggagaggct

SEQ ID NO: 3352490 - DNA, 17 bp, Homo sapiens
gggcaggagaggctggg

SEQ ID NO: 3352491 - DNA, 19 bp, Homo sapiens
gggcaggagaggctgggct

SEQ ID NO: 3352492 - DNA, 18 bp, Homo sapiens
gggcaggagggccctacc

SEQ ID NO: 3352493 - DNA, 11 bp, Homo sapiens
gggcaggcctg

SEQ ID NO: 3352494 - DNA, 13 bp, Homo sapiens
gggcaggcctggg

SEQ ID NO: 3352495 - DNA, 19 bp, Homo sapiens
gggcaggcctgggacccag

SEQ ID NO: 3352496 - DNA, 19 bp, Homo sapiens
gggcaggcggtccccatcc

SEQ ID NO: 3352497 - DNA, 12 bp, Homo sapiens
gggcaggctggg

SEQ ID NO: 3352498 - DNA, 16 bp, Homo sapiens
gggcaggctgggccat

SEQ ID NO: 3352499 - DNA, 14 bp, Homo sapiens
gggcagggaaggac

SEQ ID NO: 3352500 - DNA, 15 bp, Homo sapiens
gggcagggaaggaca

SEQ ID NO: 3352501 - DNA, 20 bp, Homo sapiens
gggcagggaaggggaggcag

SEQ ID NO: 3352502 - DNA, 20 bp, Homo sapiens
gggcagggatgggggtggct

SEQ ID NO: 3352503 - DNA, 20 bp, Homo sapiens
gggcagggcatctcctgtgc

SEQ ID NO: 3352504 - DNA, 22 bp, Homo sapiens
gggcaggggtggtggagggggc

SEQ ID NO: 3352505 - DNA, 14 bp, Homo sapiens
gggcagggtgaccc

SEQ ID NO: 3352506 - DNA, 16 bp, Homo sapiens
gggcaggtcctgccca

SEQ ID NO: 3352507 - DNA, 17 bp, Homo sapiens
gggcaggtcctgcccat

SEQ ID NO: 3352508 - DNA, 18 bp, Homo sapiens
gggcaggtcctgcccatg

SEQ ID NO: 3352509 - DNA, 14 bp, Homo sapiens
gggcagtacctggg

SEQ ID NO: 3352510 - DNA, 22 bp, Homo sapiens
gggcagtacctgggaaaggacc

SEQ ID NO: 3352511 - DNA, 12 bp, Homo sapiens
gggcagtgactg

SEQ ID NO: 3352512 - DNA, 16 bp, Homo sapiens
gggcagtgccacccgc

SEQ ID NO: 3352513 - DNA, 24 bp, Homo sapiens
gggcagttctcactcctaggagag

SEQ ID NO: 3352514 - DNA, 13 bp, Homo sapiens
gggcatcaggcac

SEQ ID NO: 3352515 - DNA, 17 bp, Homo sapiens
gggcatccacccagtgc

SEQ ID NO: 3352516 - DNA, 17 bp, Homo sapiens
gggcatcctggatgatt

SEQ ID NO: 3352517 - DNA, 19 bp, Homo sapiens
gggcatctgcccctccccc

SEQ ID NO: 3352518 - DNA, 15 bp, Homo sapiens
gggcatcttctggct

SEQ ID NO: 3352519 - DNA, 17 bp, Homo sapiens
gggcatcttctggcttg

SEQ ID NO: 3352520 - DNA, 16 bp, Homo sapiens
gggcatgccccggcca

SEQ ID NO: 3352521 - DNA, 14 bp, Homo sapiens
gggcatgccttgtg

SEQ ID NO: 3352522 - DNA, 22 bp, Homo sapiens
gggcatggacgttcggggcatg

SEQ ID NO: 3352523 - DNA, 16 bp, Homo sapiens
gggcatggcaggctgg

SEQ ID NO: 3352524 - DNA, 21 bp, Homo sapiens
gggcatggtggctcatgcctg

SEQ ID NO: 3352525 - DNA, 15 bp, Homo sapiens
gggcatgtgtgcctg

SEQ ID NO: 3352526 - DNA, 22 bp, Homo sapiens
gggcatgtgtgcctgtggcaga

SEQ ID NO: 3352527 - DNA, 14 bp, Homo sapiens
gggcattcgggcca

SEQ ID NO: 3352528 - DNA, 16 bp, Homo sapiens
gggcattcgggccaca

SEQ ID NO: 3352529 - DNA, 19 bp, Homo sapiens
gggcattcgggccacaggg

SEQ ID NO: 3352530 - DNA, 14 bp, Homo sapiens
gggcattgggctga

SEQ ID NO: 3352531 - DNA, 22 bp, Homo sapiens
gggccaacttgagggcccagag

SEQ ID NO: 3352532 - DNA, 12 bp, Homo sapiens
gggccacagggc

SEQ ID NO: 3352533 - DNA, 19 bp, Homo sapiens
gggccacagggcgagactc

SEQ ID NO: 3352534 - DNA, 19 bp, Homo sapiens
gggccacatagatgctgat

SEQ ID NO: 3352535 - DNA, 14 bp, Homo sapiens
gggccaccaaagct

SEQ ID NO: 3352536 - DNA, 16 bp, Homo sapiens
gggccacgctccagct

SEQ ID NO: 3352537 - DNA, 18 bp, Homo sapiens
gggccagaaggagggcag

SEQ ID NO: 3352538 - DNA, 22 bp, Homo sapiens
gggccagaaggagggcagagcc

SEQ ID NO: 3352539 - DNA, 16 bp, Homo sapiens
gggccagactggaaga

SEQ ID NO: 3352540 - DNA, 12 bp, Homo sapiens
gggccagaggga

SEQ ID NO: 3352541 - DNA, 22 bp, Homo sapiens
gggccagccaggcgggctcaag

SEQ ID NO: 3352542 - DNA, 19 bp, Homo sapiens
gggccagccctgcagccca

SEQ ID NO: 3352543 - DNA, 11 bp, Homo sapiens
gggccagccta

SEQ ID NO: 3352544 - DNA, 11 bp, Homo sapiens
gggccaggcag

SEQ ID NO: 3352545 - DNA, 20 bp, Homo sapiens
gggccaggcaggtgcctgga

SEQ ID NO: 3352546 - DNA, 15 bp, Homo sapiens
gggccaggccaggac

SEQ ID NO: 3352547 - DNA, 24 bp, Homo sapiens
gggccaggctggtccgagctgagg

SEQ ID NO: 3352548 - DNA, 18 bp, Homo sapiens
gggccagggccctgcaga

SEQ ID NO: 3352549 - DNA, 12 bp, Homo sapiens
gggccagggctg

SEQ ID NO: 3352550 - DNA, 18 bp, Homo sapiens
gggccagtcctcctggga

SEQ ID NO: 3352551 - DNA, 20 bp, Homo sapiens
gggccagtcctcctgggagc

SEQ ID NO: 3352552 - DNA, 21 bp, Homo sapiens
gggccagtcctgcctggccag

SEQ ID NO: 3352553 - DNA, 22 bp, Homo sapiens
gggccagtcctgcctggccagg

SEQ ID NO: 3352554 - DNA, 16 bp, Homo sapiens
gggccagtggggcctg

SEQ ID NO: 3352555 - DNA, 18 bp, Homo sapiens
gggccagtggggcctgtg

SEQ ID NO: 3352556 - DNA, 22 bp, Homo sapiens
gggccataaacggttcctggtg

SEQ ID NO: 3352557 - DNA, 15 bp, Homo sapiens
gggccatcctgcccc

SEQ ID NO: 3352558 - DNA, 24 bp, Homo sapiens
gggccatctgactgccaagccaga

SEQ ID NO: 3352559 - DNA, 12 bp, Homo sapiens
gggccatgaggg

SEQ ID NO: 3352560 - DNA, 14 bp, Homo sapiens
gggccatgctgagg

SEQ ID NO: 3352561 - DNA, 21 bp, Homo sapiens
gggccatgtccaaagaggctg

SEQ ID NO: 3352562 - DNA, 23 bp, Homo sapiens
gggcccaagacagatgccccaga

SEQ ID NO: 3352563 - DNA, 10 bp, Homo sapiens
gggcccacct

SEQ ID NO: 3352564 - DNA, 16 bp, Homo sapiens
gggcccacctggccac

SEQ ID NO: 3352565 - DNA, 19 bp, Homo sapiens
gggcccacctggccacctg

SEQ ID NO: 3352566 - DNA, 11 bp, Homo sapiens
gggcccagaac

SEQ ID NO: 3352567 - DNA, 20 bp, Homo sapiens
gggcccagaactgcccccac

SEQ ID NO: 3352568 - DNA, 21 bp, Homo sapiens
gggcccagaactgcccccact

SEQ ID NO: 3352569 - DNA, 14 bp, Homo sapiens
gggcccagagcagg

SEQ ID NO: 3352570 - DNA, 16 bp, Homo sapiens
gggcccagccaggagc

SEQ ID NO: 3352571 - DNA, 16 bp, Homo sapiens
gggcccagcccagagc

SEQ ID NO: 3352572 - DNA, 20 bp, Homo sapiens
gggcccagcccctccacgtg

SEQ ID NO: 3352573 - DNA, 12 bp, Homo sapiens
gggcccagctgt

SEQ ID NO: 3352574 - DNA, 11 bp, Homo sapiens
gggcccaggaa

SEQ ID NO: 3352575 - DNA, 18 bp, Homo sapiens
gggcccaggaccagctgg

SEQ ID NO: 3352576 - DNA, 13 bp, Homo sapiens
gggccccagatct

SEQ ID NO: 3352577 - DNA, 19 bp, Homo sapiens
gggccccagatctgcctgg

SEQ ID NO: 3352578 - DNA, 21 bp, Homo sapiens
gggccccagatctgcctgggc

SEQ ID NO: 3352579 - DNA, 21 bp, Homo sapiens
gggccccatcctcatccctga

SEQ ID NO: 3352580 - DNA, 22 bp, Homo sapiens
gggccccatcctcatccctgac

SEQ ID NO: 3352581 - DNA, 13 bp, Homo sapiens
gggccccatgctc

SEQ ID NO: 3352582 - DNA, 19 bp, Homo sapiens
gggccccatgctctgcccc

SEQ ID NO: 3352583 - DNA, 15 bp, Homo sapiens
gggccccccagctca

SEQ ID NO: 3352584 - DNA, 23 bp, Homo sapiens
gggccccccagctcaggggcagc

SEQ ID NO: 3352585 - DNA, 15 bp, Homo sapiens
gggccccgccagggc

SEQ ID NO: 3352586 - DNA, 17 bp, Homo sapiens
gggccccgccagggctg

SEQ ID NO: 3352587 - DNA, 20 bp, Homo sapiens
gggccccgccagggctgggg

SEQ ID NO: 3352588 - DNA, 15 bp, Homo sapiens
gggccccgggctgga

SEQ ID NO: 3352589 - DNA, 17 bp, Homo sapiens
gggccccgggctggaga

SEQ ID NO: 3352590 - DNA, 18 bp, Homo sapiens
gggccccgggctggagaa

SEQ ID NO: 3352591 - DNA, 15 bp, Homo sapiens
gggccccggggctgg

SEQ ID NO: 3352592 - DNA, 16 bp, Homo sapiens
gggcccctcagagccc

SEQ ID NO: 3352593 - DNA, 18 bp, Homo sapiens
gggcccctccctctgccc

SEQ ID NO: 3352594 - DNA, 22 bp, Homo sapiens
gggcccctcttattcctctagg

SEQ ID NO: 3352595 - DNA, 12 bp, Homo sapiens
gggcccctggga

SEQ ID NO: 3352596 - DNA, 21 bp, Homo sapiens
gggcccctgggcttggcctgc

SEQ ID NO: 3352597 - DNA, 19 bp, Homo sapiens
gggcccggtggcggcaggg

SEQ ID NO: 3352598 - DNA, 19 bp, Homo sapiens
gggccctccgacagccccc

SEQ ID NO: 3352599 - DNA, 17 bp, Homo sapiens
gggccctctttccctgc

SEQ ID NO: 3352600 - DNA, 9 bp, Homo sapiens
gggccctgc

SEQ ID NO: 3352601 - DNA, 22 bp, Homo sapiens
gggccctgcccctaggatgctg

SEQ ID NO: 3352602 - DNA, 11 bp, Homo sapiens
gggccctgcta

SEQ ID NO: 3352603 - DNA, 11 bp, Homo sapiens
gggccctggca

SEQ ID NO: 3352604 - DNA, 12 bp, Homo sapiens
gggccctgggcc

SEQ ID NO: 3352605 - DNA, 17 bp, Homo sapiens
gggccctgggcctcagt

SEQ ID NO: 3352606 - DNA, 19 bp, Homo sapiens
gggccctggtccttccagg

SEQ ID NO: 3352607 - DNA, 17 bp, Homo sapiens
gggcccttggggcctgg

SEQ ID NO: 3352608 - DNA, 19 bp, Homo sapiens
gggcccttggggcctggct

SEQ ID NO: 3352609 - DNA, 20 bp, Homo sapiens
gggccgaggcccagcgggca

SEQ ID NO: 3352610 - DNA, 14 bp, Homo sapiens
gggccgccacggcc

SEQ ID NO: 3352611 - DNA, 17 bp, Homo sapiens
gggccgccgcctctttc

SEQ ID NO: 3352612 - DNA, 13 bp, Homo sapiens
gggccgggcaggt

SEQ ID NO: 3352613 - DNA, 20 bp, Homo sapiens
gggccgggcaggtcctgccc

SEQ ID NO: 3352614 - DNA, 17 bp, Homo sapiens
gggccggggaagctgcc

SEQ ID NO: 3352615 - DNA, 18 bp, Homo sapiens
gggccggggaagctgcca

SEQ ID NO: 3352616 - DNA, 21 bp, Homo sapiens
gggccggggaagctgccagcc

SEQ ID NO: 3352617 - DNA, 15 bp, Homo sapiens
gggccgtaccccacc

SEQ ID NO: 3352618 - DNA, 22 bp, Homo sapiens
gggccgtaccccaccctcagca

SEQ ID NO: 3352619 - DNA, 20 bp, Homo sapiens
gggcctagatccacacacag

SEQ ID NO: 3352620 - DNA, 23 bp, Homo sapiens
gggcctagatccacacacagagg

SEQ ID NO: 3352621 - DNA, 21 bp, Homo sapiens
gggcctagcgatctctcctgg

SEQ ID NO: 3352622 - DNA, 20 bp, Homo sapiens
gggcctcaaaggcccgctct

SEQ ID NO: 3352623 - DNA, 16 bp, Homo sapiens
gggcctcaaggacttg

SEQ ID NO: 3352624 - DNA, 17 bp, Homo sapiens
gggcctcaggctctgca

SEQ ID NO: 3352625 - DNA, 18 bp, Homo sapiens
gggcctcaggctctgcac

SEQ ID NO: 3352626 - DNA, 13 bp, Homo sapiens
gggcctcagtgcc

SEQ ID NO: 3352627 - DNA, 18 bp, Homo sapiens
gggcctcccataattgct

SEQ ID NO: 3352628 - DNA, 13 bp, Homo sapiens
gggcctcccctcc

SEQ ID NO: 3352629 - DNA, 13 bp, Homo sapiens
gggcctcctgtgt

SEQ ID NO: 3352630 - DNA, 15 bp, Homo sapiens
gggcctcctgtgtgt

SEQ ID NO: 3352631 - DNA, 20 bp, Homo sapiens
gggcctgcatgggggcaccg

SEQ ID NO: 3352632 - DNA, 15 bp, Homo sapiens
gggcctgcccaatgc

SEQ ID NO: 3352633 - DNA, 15 bp, Homo sapiens
gggcctggagcccca

SEQ ID NO: 3352634 - DNA, 17 bp, Homo sapiens
gggcctggcctgagctg

SEQ ID NO: 3352635 - DNA, 22 bp, Homo sapiens
gggcctggcgggatgggccacc

SEQ ID NO: 3352636 - DNA, 17 bp, Homo sapiens
gggcctggcttgctcca

SEQ ID NO: 3352637 - DNA, 22 bp, Homo sapiens
gggcctggcttgctccagggtc

SEQ ID NO: 3352638 - DNA, 14 bp, Homo sapiens
gggcctggggcctg

SEQ ID NO: 3352639 - DNA, 20 bp, Homo sapiens
gggcctgggggcagtgactg

SEQ ID NO: 3352640 - DNA, 22 bp, Homo sapiens
gggcctgggggcagtgactggc

SEQ ID NO: 3352641 - DNA, 16 bp, Homo sapiens
gggcctgtcccccaag

SEQ ID NO: 3352642 - DNA, 17 bp, Homo sapiens
gggcctgtgcagcagcc

SEQ ID NO: 3352643 - DNA, 22 bp, Homo sapiens
gggcctgtggaatgagtgtgca

SEQ ID NO: 3352644 - DNA, 12 bp, Homo sapiens
gggcctgttgcc

SEQ ID NO: 3352645 - DNA, 15 bp, Homo sapiens
gggccttgctgctgc

SEQ ID NO: 3352646 - DNA, 15 bp, Homo sapiens
gggccttggatcgct

SEQ ID NO: 3352647 - DNA, 22 bp, Homo sapiens
gggccttgtaataaatttctaa

SEQ ID NO: 3352648 - DNA, 20 bp, Homo sapiens
gggcgagactccgtctcaaa

SEQ ID NO: 3352649 - DNA, 12 bp, Homo sapiens
gggcgaggcagg

SEQ ID NO: 3352650 - DNA, 18 bp, Homo sapiens
gggcgagttcctcgctct

SEQ ID NO: 3352651 - DNA, 16 bp, Homo sapiens
gggcgcaggcccagtg

SEQ ID NO: 3352652 - DNA, 19 bp, Homo sapiens
gggcgccctctctgctcct

SEQ ID NO: 3352653 - DNA, 16 bp, Homo sapiens
gggcgcgggagggggc

SEQ ID NO: 3352654 - DNA, 22 bp, Homo sapiens
gggcgctcagacggcggccagg

SEQ ID NO: 3352655 - DNA, 18 bp, Homo sapiens
gggcgctggcccagccgg

SEQ ID NO: 3352656 - DNA, 23 bp, Homo sapiens
gggcgctggcccagccggcctct

SEQ ID NO: 3352657 - DNA, 15 bp, Homo sapiens
gggcgctgggaaggg

SEQ ID NO: 3352658 - DNA, 15 bp, Homo sapiens
gggcggacggctgtg

SEQ ID NO: 3352659 - DNA, 15 bp, Homo sapiens
gggcgggaggatgtt

SEQ ID NO: 3352660 - DNA, 15 bp, Homo sapiens
gggcgggcccctcat

SEQ ID NO: 3352661 - DNA, 12 bp, Homo sapiens
gggcggggcagg

SEQ ID NO: 3352662 - DNA, 16 bp, Homo sapiens
gggcggggcaggaatg

SEQ ID NO: 3352663 - DNA, 21 bp, Homo sapiens
gggcggtgagaggggaacaga

SEQ ID NO: 3352664 - DNA, 16 bp, Homo sapiens
gggcgtgaggtcccag

SEQ ID NO: 3352665 - DNA, 14 bp, Homo sapiens
gggcgttgggagcc

SEQ ID NO: 3352666 - DNA, 22 bp, Homo sapiens
gggctaacgggaggctgggcac

SEQ ID NO: 3352667 - DNA, 13 bp, Homo sapiens
gggctaatttaac

SEQ ID NO: 3352668 - DNA, 23 bp, Homo sapiens
gggctaccctaaagggagaagga

SEQ ID NO: 3352669 - DNA, 17 bp, Homo sapiens
gggctactggcagctcc

SEQ ID NO: 3352670 - DNA, 22 bp, Homo sapiens
gggctactggcagctcctctcc

SEQ ID NO: 3352671 - DNA, 17 bp, Homo sapiens
gggctagtgtgagtggc

SEQ ID NO: 3352672 - DNA, 23 bp, Homo sapiens
gggctagtgtgagtggcagccat

SEQ ID NO: 3352673 - DNA, 23 bp, Homo sapiens
ggctcttctcctttcacaacctt

SEQ ID NO: 3352674 - DNA, 12 bp, Homo sapiens
ggctctttcaga

SEQ ID NO: 3352675 - DNA, 14 bp, Homo sapiens
ggctgaaattctcc

SEQ ID NO: 3352676 - DNA, 16 bp, Homo sapiens
ggctgaaattctcctg

SEQ ID NO: 3352677 - DNA, 18 bp, Homo sapiens
ggctgaaattctcctgga

SEQ ID NO: 3352678 - DNA, 22 bp, Homo sapiens
ggctgaaattctcctggaggtc

SEQ ID NO: 3352679 - DNA, 14 bp, Homo sapiens
ggctgaaccctgtg

SEQ ID NO: 3352680 - DNA, 21 bp, Homo sapiens
ggctgaaccctgtgctggtgt

SEQ ID NO: 3352681 - DNA, 22 bp, Homo sapiens
ggctgaaccctgtgctggtgtc

SEQ ID NO: 3352682 - DNA, 19 bp, Homo sapiens
ggctgaagagagggacagg

SEQ ID NO: 3352683 - DNA, 22 bp, Homo sapiens
ggctgacacctaccatgctgct

SEQ ID NO: 3352684 - DNA, 21 bp, Homo sapiens
ggctgacacttcaaggtgaca

SEQ ID NO: 3352685 - DNA, 17 bp, Homo sapiens
ggctgacccagcatctc

SEQ ID NO: 3352686 - DNA, 15 bp, Homo sapiens
ggctgacgtgtgagg

SEQ ID NO: 3352687 - DNA, 19 bp, Homo sapiens
ggctgactagaagggccag

SEQ ID NO: 3352688 - DNA, 22 bp, Homo sapiens
ggctgactagaagggccagtcc

SEQ ID NO: 3352689 - DNA, 17 bp, Homo sapiens
ggctgactctccaggga

SEQ ID NO: 3352690 - DNA, 14 bp, Homo sapiens
ggctgactggccag

SEQ ID NO: 3352691 - DNA, 13 bp, Homo sapiens
ggctgactggggc

SEQ ID NO: 3352692 - DNA, 17 bp, Homo sapiens
ggctgactggggctggg

SEQ ID NO: 3352693 - DNA, 16 bp, Homo sapiens
ggctgacttcatctgg

SEQ ID NO: 3352694 - DNA, 20 bp, Homo sapiens
ggctgacttcatctggggtt

SEQ ID NO: 3352695 - DNA, 21 bp, Homo sapiens
ggctgagactgcgggatggtc

SEQ ID NO: 3352696 - DNA, 16 bp, Homo sapiens
ggctgagccctggcag

SEQ ID NO: 3352697 - DNA, 15 bp, Homo sapiens
ggctgagctctctgt

SEQ ID NO: 3352698 - DNA, 21 bp, Homo sapiens
ggctgaggatttcaagcctgc

SEQ ID NO: 3352699 - DNA, 14 bp, Homo sapiens
ggctgaggcctgga

SEQ ID NO: 3352700 - DNA, 19 bp, Homo sapiens
ggctgaggggcaacgaaga

SEQ ID NO: 3352701 - DNA, 15 bp, Homo sapiens
ggctgaggggcttgg

SEQ ID NO: 3352702 - DNA, 16 bp, Homo sapiens
ggctgaggttcctctg

SEQ ID NO: 3352703 - DNA, 19 bp, Homo sapiens
ggctgaggttcctctgcct

SEQ ID NO: 3352704 - DNA, 19 bp, Homo sapiens
ggctgagtggaatgcaggg

SEQ ID NO: 3352705 - DNA, 19 bp, Homo sapiens
ggctgatggctgcccctgc

SEQ ID NO: 3352706 - DNA, 18 bp, Homo sapiens
ggctgatgtcaatttctg

SEQ ID NO: 3352707 - DNA, 24 bp, Homo sapiens
ggctgatgtcaatttctgtgttgc

SEQ ID NO: 3352708 - DNA, 24 bp, Homo sapiens
ggctgcaaagggtatcaggtgctg

SEQ ID NO: 3352709 - DNA, 13 bp, Homo sapiens
ggctgcacagaag

SEQ ID NO: 3352710 - DNA, 12 bp, Homo sapiens
ggctgcactgca

SEQ ID NO: 3352711 - DNA, 12 bp, Homo sapiens
ggctgcagcatg

SEQ ID NO: 3352712 - DNA, 13 bp, Homo sapiens
ggctgcagggagt

SEQ ID NO: 3352713 - DNA, 17 bp, Homo sapiens
ggctgcagggagtccga

SEQ ID NO: 3352714 - DNA, 23 bp, Homo sapiens
ggctgcccagccccgctcaggcc

SEQ ID NO: 3352715 - DNA, 13 bp, Homo sapiens
ggctgccctgaga

SEQ ID NO: 3352716 - DNA, 14 bp, Homo sapiens
ggctgccctgagaa

SEQ ID NO: 3352717 - DNA, 24 bp, Homo sapiens
ggctgccctgagaagctgctccag

SEQ ID NO: 3352718 - DNA, 11 bp, Homo sapiens
ggctgccctgg

SEQ ID NO: 3352719 - DNA, 14 bp, Homo sapiens
ggctgccctggccc

SEQ ID NO: 3352720 - DNA, 14 bp, Homo sapiens
ggctgccctggtgc

SEQ ID NO: 3352721 - DNA, 12 bp, Homo sapiens
ggctgcctgccg

SEQ ID NO: 3352722 - DNA, 11 bp, Homo sapiens
ggctgcctggg

SEQ ID NO: 3352723 - DNA, 14 bp, Homo sapiens
ggctgcctgggctg

SEQ ID NO: 3352724 - DNA, 15 bp, Homo sapiens
ggctgcctgggctgt

SEQ ID NO: 3352725 - DNA, 16 bp, Homo sapiens
ggctgccttagaacct

SEQ ID NO: 3352726 - DNA, 12 bp, Homo sapiens
ggctgcggcccc

SEQ ID NO: 3352727 - DNA, 14 bp, Homo sapiens
ggctgcggccccct

SEQ ID NO: 3352728 - DNA, 17 bp, Homo sapiens
ggctgcggcgtctgtct

SEQ ID NO: 3352729 - DNA, 16 bp, Homo sapiens
ggctgcgggaggccct

SEQ ID NO: 3352730 - DNA, 18 bp, Homo sapiens
ggctgctcgcccaggaag

SEQ ID NO: 3352731 - DNA, 22 bp, Homo sapiens
ggctgctcgcccaggaaggcct

SEQ ID NO: 3352732 - DNA, 10 bp, Homo sapiens
ggctgctgcc

SEQ ID NO: 3352733 - DNA, 17 bp, Homo sapiens
ggctgctgcccccaccc

SEQ ID NO: 3352734 - DNA, 13 bp, Homo sapiens
ggctgctggggca

SEQ ID NO: 3352735 - DNA, 23 bp, Homo sapiens
ggctgctggggcatgtgtgcctg

SEQ ID NO: 3352736 - DNA, 13 bp, Homo sapiens
ggctgcttcctcc

SEQ ID NO: 3352737 - DNA, 18 bp, Homo sapiens
ggctgcttcctcctggaa

SEQ ID NO: 3352738 - DNA, 19 bp, Homo sapiens
ggctgcttcctcctggaaa

SEQ ID NO: 3352739 - DNA, 15 bp, Homo sapiens
ggctggaagatcctg

SEQ ID NO: 3352740 - DNA, 19 bp, Homo sapiens
ggctggaagatcctgcggg

SEQ ID NO: 3352741 - DNA, 16 bp, Homo sapiens
ggctggacctatgtcc

SEQ ID NO: 3352742 - DNA, 12 bp, Homo sapiens
ggctggactgga

SEQ ID NO: 3352743 - DNA, 18 bp, Homo sapiens
ggctggactggaggtggg

SEQ ID NO: 3352744 - DNA, 21 bp, Homo sapiens
ggctggacttctacctgccct

SEQ ID NO: 3352745 - DNA, 14 bp, Homo sapiens
ggctggaggcccag

SEQ ID NO: 3352746 - DNA, 19 bp, Homo sapiens
ggctggaggcccaggctgg

SEQ ID NO: 3352747 - DNA, 17 bp, Homo sapiens
ggctggagtaatcagat

SEQ ID NO: 3352748 - DNA, 19 bp, Homo sapiens
ggctggagtgcagtggcgt

SEQ ID NO: 3352749 - DNA, 15 bp, Homo sapiens
ggctggatgaaattt

SEQ ID NO: 3352750 - DNA, 13 bp, Homo sapiens
ggctggcaagcag

SEQ ID NO: 3352751 - DNA, 15 bp, Homo sapiens
ggctggcaagcaggg

SEQ ID NO: 3352752 - DNA, 13 bp, Homo sapiens
ggctggcagggct

SEQ ID NO: 3352753 - DNA, 14 bp, Homo sapiens
ggctggccagcaag

SEQ ID NO: 3352754 - DNA, 22 bp, Homo sapiens
ggctggccagtccaggctgccg

SEQ ID NO: 3352755 - DNA, 14 bp, Homo sapiens
ggctggcctgagca

SEQ ID NO: 3352756 - DNA, 21 bp, Homo sapiens
ggctggcgcagccaaggccga

SEQ ID NO: 3352757 - DNA, 21 bp, Homo sapiens
ggctgtggaggcctgatgctg

SEQ ID NO: 3352758 - DNA, 19 bp, Homo sapiens
ggctgttctgcactgaaaa

SEQ ID NO: 3352759 - DNA, 12 bp, Homo sapiens
ggctgttggcac

SEQ ID NO: 3352760 - DNA, 23 bp, Homo sapiens
ggctgttggcactcacagacctg

SEQ ID NO: 3352761 - DNA, 20 bp, Homo sapiens
ggctgttggctgggggcctc

SEQ ID NO: 3352762 - DNA, 14 bp, Homo sapiens
ggctgtttgaggat

SEQ ID NO: 3352763 - DNA, 21 bp, Homo sapiens
ggcttaaaaatacttaataaa

SEQ ID NO: 3352764 - DNA, 14 bp, Homo sapiens
ggcttaataaaaat

SEQ ID NO: 3352765 - DNA, 14 bp, Homo sapiens
ggcttagagagagg

SEQ ID NO: 3352766 - DNA, 19 bp, Homo sapiens
ggcttagtgccacccacct

SEQ ID NO: 3352767 - DNA, 18 bp, Homo sapiens
ggcttatgagatctaatg

SEQ ID NO: 3352768 - DNA, 20 bp, Homo sapiens
ggcttatttattaacaggat

SEQ ID NO: 3352769 - DNA, 18 bp, Homo sapiens
ggcttcaccagtctgtct

SEQ ID NO: 3352770 - DNA, 15 bp, Homo sapiens
ggcttcactgtataa

SEQ ID NO: 3352771 - DNA, 18 bp, Homo sapiens
ggcttcactgtataaata

SEQ ID NO: 3352772 - DNA, 19 bp, Homo sapiens
ggcttcactgtataaatag

SEQ ID NO: 3352773 - DNA, 15 bp, Homo sapiens
ggcttcagtggcagc

SEQ ID NO: 3352774 - DNA, 17 bp, Homo sapiens
ggcttcagtggcagctg

SEQ ID NO: 3352775 - DNA, 19 bp, Homo sapiens
ggcttcagtggcagctgct

SEQ ID NO: 3352776 - DNA, 11 bp, Homo sapiens
ggcttcatttc

SEQ ID NO: 3352777 - DNA, 20 bp, Homo sapiens
ggcttccagcttcaggcacc

SEQ ID NO: 3352778 - DNA, 21 bp, Homo sapiens
ggcttccagcttcaggcacca

SEQ ID NO: 3352779 - DNA, 23 bp, Homo sapiens
ggcttccatcccaaccagtgcca

SEQ ID NO: 3352780 - DNA, 16 bp, Homo sapiens
ggcttcccgctcagcc

SEQ ID NO: 3352781 - DNA, 17 bp, Homo sapiens
ggcttcccgctcagccc

SEQ ID NO: 3352782 - DNA, 19 bp, Homo sapiens
ggcttcccgctcagccctc

SEQ ID NO: 3352783 - DNA, 16 bp, Homo sapiens
ggcttcctcatagtat

SEQ ID NO: 3352784 - DNA, 22 bp, Homo sapiens
ggcttcctccgtccacccaggc

SEQ ID NO: 3352785 - DNA, 22 bp, Homo sapiens
ggcttcctcttccgggcagaaa

SEQ ID NO: 3352786 - DNA, 17 bp, Homo sapiens
ggcttcctgtccactct

SEQ ID NO: 3352787 - DNA, 16 bp, Homo sapiens
ggcttctccgccagcc

SEQ ID NO: 3352788 - DNA, 17 bp, Homo sapiens
ggcttctccgccagcct

SEQ ID NO: 3352789 - DNA, 23 bp, Homo sapiens
ggcttctccgccagcctcctctg

SEQ ID NO: 3352790 - DNA, 15 bp, Homo sapiens
ggcttctcctgaccc

SEQ ID NO: 3352791 - DNA, 16 bp, Homo sapiens
ggcttctcctgaccca

SEQ ID NO: 3352792 - DNA, 13 bp, Homo sapiens
ggcttctgcaccc

SEQ ID NO: 3352793 - DNA, 15 bp, Homo sapiens
ggcttctgcaccctc

SEQ ID NO: 3352794 - DNA, 16 bp, Homo sapiens
ggcttctgcaccctcc

SEQ ID NO: 3352795 - DNA, 18 bp, Homo sapiens
ggcttctgcaccctccac

SEQ ID NO: 3352796 - DNA, 21 bp, Homo sapiens
ggcttctgtgatgagctgatc

SEQ ID NO: 3352797 - DNA, 21 bp, Homo sapiens
ggcttgagaaatatggacact

SEQ ID NO: 3352798 - DNA, 20 bp, Homo sapiens
ggcttgagcccccgcgccca

SEQ ID NO: 3352799 - DNA, 17 bp, Homo sapiens
ggcttggacttcctggg

SEQ ID NO: 3352800 - DNA, 21 bp, Homo sapiens
ggcttggccacaacctgaaag

SEQ ID NO: 3352801 - DNA, 13 bp, Homo sapiens
ggcttggcccagc

SEQ ID NO: 3352802 - DNA, 14 bp, Homo sapiens
ggcttggcctgctg

SEQ ID NO: 3352803 - DNA, 18 bp, Homo sapiens
ggcttggcgtggagcagg

SEQ ID NO: 3352804 - DNA, 22 bp, Homo sapiens
ggcttggggctcacacacctgt

SEQ ID NO: 3352805 - DNA, 15 bp, Homo sapiens
ggcttggggcttcct

SEQ ID NO: 3352806 - DNA, 22 bp, Homo sapiens
ggcttgtctatactccttccct

SEQ ID NO: 3352807 - DNA, 22 bp, Homo sapiens
ggcttgtcttcgctggctccta

SEQ ID NO: 3352808 - DNA, 16 bp, Homo sapiens
ggcttgtgtgtttcac

SEQ ID NO: 3352809 - DNA, 19 bp, Homo sapiens
ggctttaattgtataagtc

SEQ ID NO: 3352810 - DNA, 20 bp, Homo sapiens
ggctttacatactttatcaa

SEQ ID NO: 3352811 - DNA, 22 bp, Homo sapiens
ggctttatgataatagattctc

SEQ ID NO: 3352812 - DNA, 19 bp, Homo sapiens
ggctttcaaagctaaaata

SEQ ID NO: 3352813 - DNA, 22 bp, Homo sapiens
ggctttctccggggtctgtgct

SEQ ID NO: 3352814 - DNA, 15 bp, Homo sapiens
ggctttctcttttct

SEQ ID NO: 3352815 - DNA, 14 bp, Homo sapiens
ggctttctggagag

SEQ ID NO: 3352816 - DNA, 19 bp, Homo sapiens
ggctttctgggtgtgactg

SEQ ID NO: 3352817 - DNA, 16 bp, Homo sapiens
ggctttgcaggctctg

SEQ ID NO: 3352818 - DNA, 12 bp, Homo sapiens
ggctttggattt

SEQ ID NO: 3352819 - DNA, 21 bp, Homo sapiens
ggctttgggaaagcccagact

SEQ ID NO: 3352820 - DNA, 13 bp, Homo sapiens
ggcttttaagaaa

SEQ ID NO: 3352821 - DNA, 19 bp, Homo sapiens
ggcttttcactgctggctg

SEQ ID NO: 3352822 - DNA, 19 bp, Homo sapiens
ggcttttttaaaaaagcaa

SEQ ID NO: 3352823 - DNA, 20 bp, Homo sapiens
gggaaaaaaacttggcactt

SEQ ID NO: 3352824 - DNA, 13 bp, Homo sapiens
gggaaaaaagcac

SEQ ID NO: 3352825 - DNA, 13 bp, Homo sapiens
gggaaaatatttc

SEQ ID NO: 3352826 - DNA, 22 bp, Homo sapiens
gggaaaatgtgaaatctcagaa

SEQ ID NO: 3352827 - DNA, 23 bp, Homo sapiens
gggaaacagagtccaatttaagg

SEQ ID NO: 3352828 - DNA, 14 bp, Homo sapiens
gggaaacttggctc

SEQ ID NO: 3352829 - DNA, 14 bp, Homo sapiens
gggaaagaagaaac

SEQ ID NO: 3352830 - DNA, 18 bp, Homo sapiens
gggaaagccttaaaaata

SEQ ID NO: 3352831 - DNA, 13 bp, Homo sapiens
gggaaagctccac

SEQ ID NO: 3352832 - DNA, 16 bp, Homo sapiens
gggaaaggacccaccc

SEQ ID NO: 3352833 - DNA, 18 bp, Homo sapiens
gggaaagggaggaagata

SEQ ID NO: 3352834 - DNA, 14 bp, Homo sapiens
gcaggagaggctgg

SEQ ID NO: 3352835 - DNA, 14 bp, Homo sapiens
gcaggagattgaga

SEQ ID NO: 3352836 - DNA, 18 bp, Homo sapiens
gcaggagattgagaagga

SEQ ID NO: 3352837 - DNA, 22 bp, Homo sapiens
gcaggagattgagaaggagaga

SEQ ID NO: 3352838 - DNA, 16 bp, Homo sapiens
gcaggagccccgccac

SEQ ID NO: 3352839 - DNA, 18 bp, Homo sapiens
gcaggagccccgccacag

SEQ ID NO: 3352840 - DNA, 22 bp, Homo sapiens
gcaggagcttctgggagatttt

SEQ ID NO: 3352841 - DNA, 16 bp, Homo sapiens
gcaggaggccaataaa

SEQ ID NO: 3352842 - DNA, 17 bp, Homo sapiens
gcaggaggccaataaaa

SEQ ID NO: 3352843 - DNA, 21 bp, Homo sapiens
gcaggaggccaataaaaagtt

SEQ ID NO: 3352844 - DNA, 22 bp, Homo sapiens
gcaggaggccaataaaaagttc

SEQ ID NO: 3352845 - DNA, 22 bp, Homo sapiens
gcaggagggccctacctgattg

SEQ ID NO: 3352846 - DNA, 22 bp, Homo sapiens
gcaggagtctctgccacccact

SEQ ID NO: 3352847 - DNA, 23 bp, Homo sapiens
gcaggagtctctgccacccactc

SEQ ID NO: 3352848 - DNA, 13 bp, Homo sapiens
gcaggagtgctgg

SEQ ID NO: 3352849 - DNA, 21 bp, Homo sapiens
gcaggagtgtcctgcccatgc

SEQ ID NO: 3352850 - DNA, 22 bp, Homo sapiens
gcaggagtgtcctgcccatgcc

SEQ ID NO: 3352851 - DNA, 17 bp, Homo sapiens
gcaggatccgctgccac

SEQ ID NO: 3352852 - DNA, 14 bp, Homo sapiens
gcaggcaagccctt

SEQ ID NO: 3352853 - DNA, 16 bp, Homo sapiens
gcaggcacacagcagc

SEQ ID NO: 3352854 - DNA, 15 bp, Homo sapiens
gcaggcacatggagg

SEQ ID NO: 3352855 - DNA, 19 bp, Homo sapiens
gcaggcacgggtggtcccc

SEQ ID NO: 3352856 - DNA, 16 bp, Homo sapiens
gcaggcagcgccaagc

SEQ ID NO: 3352857 - DNA, 22 bp, Homo sapiens
gcaggcaggaacaaacagggct

SEQ ID NO: 3352858 - DNA, 17 bp, Homo sapiens
gcaggcatagaggcttc

SEQ ID NO: 3352859 - DNA, 22 bp, Homo sapiens
gcaggcatatcaacttgaggcc

SEQ ID NO: 3352860 - DNA, 22 bp, Homo sapiens
gcaggccaagagcagaggcagc

SEQ ID NO: 3352861 - DNA, 24 bp, Homo sapiens
gcaggccaagagcagaggcagcga

SEQ ID NO: 3352862 - DNA, 20 bp, Homo sapiens
gcaggccaagtcaggccctt

SEQ ID NO: 3352863 - DNA, 18 bp, Homo sapiens
gcaggccagatggcccct

SEQ ID NO: 3352864 - DNA, 19 bp, Homo sapiens
gcaggccagatggcccctc

SEQ ID NO: 3352865 - DNA, 15 bp, Homo sapiens
gcaggccctggcctc

SEQ ID NO: 3352866 - DNA, 18 bp, Homo sapiens
gcaggccggaaccacagg

SEQ ID NO: 3352867 - DNA, 22 bp, Homo sapiens
gcaggccggaaccacagggcca

SEQ ID NO: 3352868 - DNA, 13 bp, Homo sapiens
gcaggcctaggtg

SEQ ID NO: 3352869 - DNA, 18 bp, Homo sapiens
gcaggcctgggacccagc

SEQ ID NO: 3352870 - DNA, 19 bp, Homo sapiens
gcaggcctgggacccagct

SEQ ID NO: 3352871 - DNA, 20 bp, Homo sapiens
gcaggcctgggacccagcta

SEQ ID NO: 3352872 - DNA, 18 bp, Homo sapiens
gcaggcgaccgggcctcc

SEQ ID NO: 3352873 - DNA, 22 bp, Homo sapiens
gcaggcggggggggcgcctgga

SEQ ID NO: 3352874 - DNA, 23 bp, Homo sapiens
gcaggcggtccccatccccacca

SEQ ID NO: 3352875 - DNA, 24 bp, Homo sapiens
gcaggcggtccccatccccaccag

SEQ ID NO: 3352876 - DNA, 17 bp, Homo sapiens
gcaggcgtgactcagca

SEQ ID NO: 3352877 - DNA, 22 bp, Homo sapiens
gcaggcgtgactcagcagcctg

SEQ ID NO: 3352878 - DNA, 14 bp, Homo sapiens
gcaggctcactgcc

SEQ ID NO: 3352879 - DNA, 23 bp, Homo sapiens
gcaggctcactgccaggccagcc

SEQ ID NO: 3352880 - DNA, 11 bp, Homo sapiens
gcaggctctgg

SEQ ID NO: 3352881 - DNA, 14 bp, Homo sapiens
gcaggctctgggct

SEQ ID NO: 3352882 - DNA, 15 bp, Homo sapiens
gcaggctctgggctc

SEQ ID NO: 3352883 - DNA, 18 bp, Homo sapiens
gcaggctctgggctcagg

SEQ ID NO: 3352884 - DNA, 17 bp, Homo sapiens
gcaggctgagccactct

SEQ ID NO: 3352885 - DNA, 18 bp, Homo sapiens
gcaggctggcagctctcc

SEQ ID NO: 3352886 - DNA, 23 bp, Homo sapiens
gcaggctggcagctctccagtca

SEQ ID NO: 3352887 - DNA, 14 bp, Homo sapiens
gcaggctggccagt

SEQ ID NO: 3352888 - DNA, 22 bp, Homo sapiens
gcaggctggccagtccaggctg

SEQ ID NO: 3352889 - DNA, 14 bp, Homo sapiens
gcaggctgggccat

SEQ ID NO: 3352890 - DNA, 15 bp, Homo sapiens
gcagggaaagctcca

SEQ ID NO: 3352891 - DNA, 13 bp, Homo sapiens
gcagggaaggaca

SEQ ID NO: 3352892 - DNA, 23 bp, Homo sapiens
gcagggaaggacaggaccctcag

SEQ ID NO: 3352893 - DNA, 14 bp, Homo sapiens
gcagggaaggcctg

SEQ ID NO: 3352894 - DNA, 15 bp, Homo sapiens
gcagggaaggcctga

SEQ ID NO: 3352895 - DNA, 20 bp, Homo sapiens
gcagggaaggggaggcagcc

SEQ ID NO: 3352896 - DNA, 20 bp, Homo sapiens
gcagggaaggtgaagatgaa

SEQ ID NO: 3352897 - DNA, 16 bp, Homo sapiens
gcagggagctcaagcc

SEQ ID NO: 3352898 - DNA, 15 bp, Homo sapiens
gcagggaggggacta

SEQ ID NO: 3352899 - DNA, 22 bp, Homo sapiens
gcagggatgggggtggctggga

SEQ ID NO: 3352900 - DNA, 14 bp, Homo sapiens
gcagggcatctcct

SEQ ID NO: 3352901 - DNA, 19 bp, Homo sapiens
gcagggcatctcctgtgca

SEQ ID NO: 3352902 - DNA, 21 bp, Homo sapiens
gcagggcatctcctgtgcatg

SEQ ID NO: 3352903 - DNA, 22 bp, Homo sapiens
gcagggccaccccactctacct

SEQ ID NO: 3352904 - DNA, 15 bp, Homo sapiens
gcagggccaggctgg

SEQ ID NO: 3352905 - DNA, 24 bp, Homo sapiens
gcagggccatctgactgccaagcc

SEQ ID NO: 3352906 - DNA, 19 bp, Homo sapiens
gcagggcccttggggctgg

SEQ ID NO: 3352907 - DNA, 20 bp, Homo sapiens
gcagggcgggcagagggctg

SEQ ID NO: 3352908 - DNA, 21 bp, Homo sapiens
gcagggcgggcagagggctgg

SEQ ID NO: 3352909 - DNA, 22 bp, Homo sapiens
gcagggcgggcagagggctgga

SEQ ID NO: 3352910 - DNA, 19 bp, Homo sapiens
gcagggctcagcggggaca

SEQ ID NO: 3352911 - DNA, 22 bp, Homo sapiens
gcagggctcagcggggacagct

SEQ ID NO: 3352912 - DNA, 12 bp, Homo sapiens
gcagggctcagg

SEQ ID NO: 3352913 - DNA, 12 bp, Homo sapiens
gcagggctctga

SEQ ID NO: 3352914 - DNA, 18 bp, Homo sapiens
gcaggggagacaggagcc

SEQ ID NO: 3352915 - DNA, 12 bp, Homo sapiens
gcaggggcagga

SEQ ID NO: 3352916 - DNA, 21 bp, Homo sapiens
gcaggggcaggagaggctggg

SEQ ID NO: 3352917 - DNA, 16 bp, Homo sapiens
gcaggggcctggagat

SEQ ID NO: 3352918 - DNA, 16 bp, Homo sapiens
gcaggggctctggaga

SEQ ID NO: 3352919 - DNA, 20 bp, Homo sapiens
gcagggggccccgccagggc

SEQ ID NO: 3352920 - DNA, 18 bp, Homo sapiens
gcaggggggctgtgccaa

SEQ ID NO: 3352921 - DNA, 14 bp, Homo sapiens
gcaggggtccctgc

SEQ ID NO: 3352922 - DNA, 20 bp, Homo sapiens
gcaggggtgacggccctcat

SEQ ID NO: 3352923 - DNA, 17 bp, Homo sapiens
gcaggggtgggggtgga

SEQ ID NO: 3352924 - DNA, 23 bp, Homo sapiens
gcagggtaccctttggggagcag

SEQ ID NO: 3352925 - DNA, 18 bp, Homo sapiens
gcagggtcagtggaagcc

SEQ ID NO: 3352926 - DNA, 18 bp, Homo sapiens
gcagggtgggcagcctat

SEQ ID NO: 3352927 - DNA, 19 bp, Homo sapiens
gcagggtgggcagcctatg

SEQ ID NO: 3352928 - DNA, 22 bp, Homo sapiens
gcaggtgattggaccaggccat

SEQ ID NO: 3352929 - DNA, 15 bp, Homo sapiens
gcaggtgggcactgg

SEQ ID NO: 3352930 - DNA, 19 bp, Homo sapiens
gcaggtgggtgctgccctg

SEQ ID NO: 3352931 - DNA, 22 bp, Homo sapiens
gcaggtggtggcactgagcccc

SEQ ID NO: 3352932 - DNA, 20 bp, Homo sapiens
gcaggtgtcctttcccctct

SEQ ID NO: 3352933 - DNA, 20 bp, Homo sapiens
gcaggtgtggtggctcatgg

SEQ ID NO: 3352934 - DNA, 21 bp, Homo sapiens
gcaggtgtggtggctcatggc

SEQ ID NO: 3352935 - DNA, 20 bp, Homo sapiens
gcaggttccccaagggccct

SEQ ID NO: 3352936 - DNA, 21 bp, Homo sapiens
gcaggttccccaagggccctg

SEQ ID NO: 3352937 - DNA, 19 bp, Homo sapiens
gcaggttctgcctgctttg

SEQ ID NO: 3352938 - DNA, 22 bp, Homo sapiens
gcaggttgaggggctcctggaa

SEQ ID NO: 3352939 - DNA, 21 bp, Homo sapiens
gcaggttggaaggggccttgc

SEQ ID NO: 3352940 - DNA, 18 bp, Homo sapiens
gcaggttggaccccagag

SEQ ID NO: 3352941 - DNA, 16 bp, Homo sapiens
gcagtaaagagaaact

SEQ ID NO: 3352942 - DNA, 18 bp, Homo sapiens
gcagtagatgtgcttctg

SEQ ID NO: 3352943 - DNA, 22 bp, Homo sapiens
gcagtagctttggggaaaggga

SEQ ID NO: 3352944 - DNA, 17 bp, Homo sapiens
gcagtcacatctcttcc

SEQ ID NO: 3352945 - DNA, 23 bp, Homo sapiens
gcagtcactggaggttgaagcca

SEQ ID NO: 3352946 - DNA, 21 bp, Homo sapiens
gcagtcccagtattctcagag

SEQ ID NO: 3352947 - DNA, 20 bp, Homo sapiens
gcagtcccattcatattaag

SEQ ID NO: 3352948 - DNA, 14 bp, Homo sapiens
gcagtccccagccc

SEQ ID NO: 3352949 - DNA, 18 bp, Homo sapiens
gcagtcctggaagccagc

SEQ ID NO: 3352950 - DNA, 20 bp, Homo sapiens
gcagtcctggaagccagctt

SEQ ID NO: 3352951 - DNA, 15 bp, Homo sapiens
gcagtcgcaggatcc

SEQ ID NO: 3352952 - DNA, 23 bp, Homo sapiens
gcagtcgggggctggcctaggag

SEQ ID NO: 3352953 - DNA, 15 bp, Homo sapiens
gcagtcgtcgcacag

SEQ ID NO: 3352954 - DNA, 18 bp, Homo sapiens
gcagtcgtcgcacagtct

SEQ ID NO: 3352955 - DNA, 15 bp, Homo sapiens
gcagtcgtgcctgtg

SEQ ID NO: 3352956 - DNA, 16 bp, Homo sapiens
gcagtcgtgcctgtgt

SEQ ID NO: 3352957 - DNA, 17 bp, Homo sapiens
gcagtcgtgcctgtgtc

SEQ ID NO: 3352958 - DNA, 19 bp, Homo sapiens
gcagtcgtgcctgtgtcca

SEQ ID NO: 3352959 - DNA, 19 bp, Homo sapiens
gcagtctaaaacttcaaaa

SEQ ID NO: 3352960 - DNA, 22 bp, Homo sapiens
gcagtctctatattatgtcttc

SEQ ID NO: 3352961 - DNA, 14 bp, Homo sapiens
ggccttgctgctgc

SEQ ID NO: 3352962 - DNA, 19 bp, Homo sapiens
ggccttgctgctgctgcac

SEQ ID NO: 3352963 - DNA, 21 bp, Homo sapiens
ggccttgctgctgctgcaccc

SEQ ID NO: 3352964 - DNA, 23 bp, Homo sapiens
ggccttgctgctgctgcacccaa

SEQ ID NO: 3352965 - DNA, 22 bp, Homo sapiens
ggccttggcatgggcgcaggcc

SEQ ID NO: 3352966 - DNA, 20 bp, Homo sapiens
ggccttggcttttctagcct

SEQ ID NO: 3352967 - DNA, 13 bp, Homo sapiens
ggcctttcctctc

SEQ ID NO: 3352968 - DNA, 17 bp, Homo sapiens
ggcctttctaataaact

SEQ ID NO: 3352969 - DNA, 23 bp, Homo sapiens
ggcctttgcttatgaatatttat

SEQ ID NO: 3352970 - DNA, 9 bp, Homo sapiens
ggccttttg

SEQ ID NO: 3352971 - DNA, 14 bp, Homo sapiens
ggcgaccgggcctc

SEQ ID NO: 3352972 - DNA, 15 bp, Homo sapiens
ggcgaccgggcctcc

SEQ ID NO: 3352973 - DNA, 11 bp, Homo sapiens
ggcgacctcct

SEQ ID NO: 3352974 - DNA, 15 bp, Homo sapiens
ggcgagaggtgagct

SEQ ID NO: 3352975 - DNA, 17 bp, Homo sapiens
ggcgcagccaaggccga

SEQ ID NO: 3352976 - DNA, 15 bp, Homo sapiens
ggcgcaggcccagtg

SEQ ID NO: 3352977 - DNA, 22 bp, Homo sapiens
ggcgcaggcgaccgggcctccc

SEQ ID NO: 3352978 - DNA, 14 bp, Homo sapiens
ggcgcaggtgggct

SEQ ID NO: 3352979 - DNA, 15 bp, Homo sapiens
ggcgcccacctcccc

SEQ ID NO: 3352980 - DNA, 24 bp, Homo sapiens
ggcgcccacctccccacgccctcc

SEQ ID NO: 3352981 - DNA, 15 bp, Homo sapiens
ggcgccctctctgct

SEQ ID NO: 3352982 - DNA, 15 bp, Homo sapiens
ggcgccctggacttg

SEQ ID NO: 3352983 - DNA, 18 bp, Homo sapiens
ggcgccgggcaccaactc

SEQ ID NO: 3352984 - DNA, 20 bp, Homo sapiens
ggcgccgtctccaggggctg

SEQ ID NO: 3352985 - DNA, 17 bp, Homo sapiens
ggcgcctggagagcgag

SEQ ID NO: 3352986 - DNA, 22 bp, Homo sapiens
ggcgcgcacctgtaatcccagc

SEQ ID NO: 3352987 - DNA, 16 bp, Homo sapiens
ggcgctattacaaata

SEQ ID NO: 3352988 - DNA, 14 bp, Homo sapiens
ggcgctcagacggc

SEQ ID NO: 3352989 - DNA, 20 bp, Homo sapiens
ggcgctcagacggcggccag

SEQ ID NO: 3352990 - DNA, 23 bp, Homo sapiens
ggcgctcagacggcggccaggca

SEQ ID NO: 3352991 - DNA, 15 bp, Homo sapiens
ggcgctcaggaccca

SEQ ID NO: 3352992 - DNA, 19 bp, Homo sapiens
ggcgctcaggacccaggcc

SEQ ID NO: 3352993 - DNA, 20 bp, Homo sapiens
ggcgctcaggacccaggccc

SEQ ID NO: 3352994 - DNA, 21 bp, Homo sapiens
ggcgctcaggacccaggccct

SEQ ID NO: 3352995 - DNA, 16 bp, Homo sapiens
ggcgctggagagtcaa

SEQ ID NO: 3352996 - DNA, 22 bp, Homo sapiens
ggcggaaagcctgtaagcctgc

SEQ ID NO: 3352997 - DNA, 17 bp, Homo sapiens
aaaagaaaaccatttta

SEQ ID NO: 3352998 - DNA, 10 bp, Homo sapiens
aaaagaaaag

SEQ ID NO: 3352999 - DNA, 19 bp, Homo sapiens
aaaagaaaatatacatttg

SEQ ID NO: 3353000 - DNA, 22 bp, Homo sapiens
aaaagaaaatctttataaatgt

SEQ ID NO: 3353001 - DNA, 14 bp, Homo sapiens
aaaagaaacacaag

SEQ ID NO: 3353002 - DNA, 21 bp, Homo sapiens
aaaagaaaggttgcgtttaat

SEQ ID NO: 3353003 - DNA, 21 bp, Homo sapiens
aaaagaaatcaatagttgaat

SEQ ID NO: 3353004 - DNA, 15 bp, Homo sapiens
aaaagaaatcttgtc

SEQ ID NO: 3353005 - DNA, 17 bp, Homo sapiens
aaaagaaatcttgtctt

SEQ ID NO: 3353006 - DNA, 16 bp, Homo sapiens
aaaagaacagtaaaca

SEQ ID NO: 3353007 - DNA, 14 bp, Homo sapiens
aaaagaagcacttt

SEQ ID NO: 3353008 - DNA, 14 bp, Homo sapiens
aaaagaagttactt

SEQ ID NO: 3353009 - DNA, 15 bp, Homo sapiens
aaaagaagttacttt

SEQ ID NO: 3353010 - DNA, 18 bp, Homo sapiens
aaaagaagttactttgta

SEQ ID NO: 3353011 - DNA, 19 bp, Homo sapiens
aaaagaccctgagactcca

SEQ ID NO: 3353012 - DNA, 16 bp, Homo sapiens
aaaagagaaaaaccaa

SEQ ID NO: 3353013 - DNA, 22 bp, Homo sapiens
aaaagagcatggatgcatttca

SEQ ID NO: 3353014 - DNA, 17 bp, Homo sapiens
aaaagagtcttccaatt

SEQ ID NO: 3353015 - DNA, 18 bp, Homo sapiens
aaaagagttttctttagt

SEQ ID NO: 3353016 - DNA, 13 bp, Homo sapiens
aaaagatcgcagt

SEQ ID NO: 3353017 - DNA, 14 bp, Homo sapiens
aaaagattgctgaa

SEQ ID NO: 3353018 - DNA, 23 bp, Homo sapiens
aaaagattgtattactttaatga

SEQ ID NO: 3353019 - DNA, 14 bp, Homo sapiens
aaaagattttaatc

SEQ ID NO: 3353020 - DNA, 17 bp, Homo sapiens
aaaagcacaatcactaa

SEQ ID NO: 3353021 - DNA, 20 bp, Homo sapiens
aaaagcacatacattaaaac

SEQ ID NO: 3353022 - DNA, 17 bp, Homo sapiens
aaaagcacttttgttat

SEQ ID NO: 3353023 - DNA, 15 bp, Homo sapiens
aaaagcataaatgca

SEQ ID NO: 3353024 - DNA, 17 bp, Homo sapiens
aaaagcatgatgggaaa

SEQ ID NO: 3353025 - DNA, 11 bp, Homo sapiens
aaaagcctgct

SEQ ID NO: 3353026 - DNA, 11 bp, Homo sapiens
aaaagccttgt

SEQ ID NO: 3353027 - DNA, 15 bp, Homo sapiens
aaaagcgtctttaag

SEQ ID NO: 3353028 - DNA, 22 bp, Homo sapiens
aaaagctataaagtatatatta

SEQ ID NO: 3353029 - DNA, 17 bp, Homo sapiens
aaaagctattagccagg

SEQ ID NO: 3353030 - DNA, 20 bp, Homo sapiens
aaaagctattagccaggatc

SEQ ID NO: 3353031 - DNA, 18 bp, Homo sapiens
aaaagctcatattttgta

SEQ ID NO: 3353032 - DNA, 14 bp, Homo sapiens
aaaagcttccatga

SEQ ID NO: 3353033 - DNA, 13 bp, Homo sapiens
aaaagcttcttaa

SEQ ID NO: 3353034 - DNA, 15 bp, Homo sapiens
aaaagcttcttaatt

SEQ ID NO: 3353035 - DNA, 16 bp, Homo sapiens
aaaaggaaaagttaaa

SEQ ID NO: 3353036 - DNA, 13 bp, Homo sapiens
aaaaggaaagtca

SEQ ID NO: 3353037 - DNA, 13 bp, Homo sapiens
aaaaggaagacta

SEQ ID NO: 3353038 - DNA, 15 bp, Homo sapiens
aaaaggaagactaga

SEQ ID NO: 3353039 - DNA, 11 bp, Homo sapiens
aaaaggattaa

SEQ ID NO: 3353040 - DNA, 15 bp, Homo sapiens
aaaaggccaaagata

SEQ ID NO: 3353041 - DNA, 15 bp, Homo sapiens
aaaaggcctcttgta

SEQ ID NO: 3353042 - DNA, 15 bp, Homo sapiens
aaaaggcgcatctaa

SEQ ID NO: 3353043 - DNA, 20 bp, Homo sapiens
aaaaggcgcatctaacgcgt

SEQ ID NO: 3353044 - DNA, 16 bp, Homo sapiens
aaaagggagaaaaaga

SEQ ID NO: 3353045 - DNA, 11 bp, Homo sapiens
aaaaggggccc

SEQ ID NO: 3353046 - DNA, 22 bp, Homo sapiens
aaaaggtagcttacctgacaca

SEQ ID NO: 3353047 - DNA, 18 bp, Homo sapiens
aaaaggtataaataataa

SEQ ID NO: 3353048 - DNA, 14 bp, Homo sapiens
aaaaggtataatta

SEQ ID NO: 3353049 - DNA, 18 bp, Homo sapiens
aaaaggtattttgaatac

SEQ ID NO: 3353050 - DNA, 19 bp, Homo sapiens
aaaaggtattttgaatacc

SEQ ID NO: 3353051 - DNA, 15 bp, Homo sapiens
aaaaggttgaataat

SEQ ID NO: 3353052 - DNA, 22 bp, Homo sapiens
aaaagtaatctttaaactggct

SEQ ID NO: 3353053 - DNA, 13 bp, Homo sapiens
aaaagtaattttg

SEQ ID NO: 3353054 - DNA, 16 bp, Homo sapiens
aaaagtaccagcatgt

SEQ ID NO: 3353055 - DNA, 17 bp, Homo sapiens
aaaagtactttaaaaag

SEQ ID NO: 3353056 - DNA, 21 bp, Homo sapiens
aaaagtagtaaattttgtgat

SEQ ID NO: 3353057 - DNA, 14 bp, Homo sapiens
aaaagtatatgtta

SEQ ID NO: 3353058 - DNA, 15 bp, Homo sapiens
aaaagtatatgttag

SEQ ID NO: 3353059 - DNA, 19 bp, Homo sapiens
aaaagtcgttttccaaact

SEQ ID NO: 3353060 - DNA, 21 bp, Homo sapiens
aaaagtctctatttaaattct

SEQ ID NO: 3353061 - DNA, 14 bp, Homo sapiens
aaaagtctgtcttt

SEQ ID NO: 3353062 - DNA, 17 bp, Homo sapiens
aaaagtgaatgaaagat

SEQ ID NO: 3353063 - DNA, 21 bp, Homo sapiens
aaaagtgatcaataaaatgtg

SEQ ID NO: 3353064 - DNA, 17 bp, Homo sapiens
aaaagtgggcttgattc

SEQ ID NO: 3353065 - DNA, 17 bp, Homo sapiens
aaaagtgtattagatgt

SEQ ID NO: 3353066 - DNA, 21 bp, Homo sapiens
aaaagtgtttatttttcatat

SEQ ID NO: 3353067 - DNA, 16 bp, Homo sapiens
aaaagttatttatgct

SEQ ID NO: 3353068 - DNA, 13 bp, Homo sapiens
aaaagttcagagt

SEQ ID NO: 3353069 - DNA, 14 bp, Homo sapiens
aaaagttgaaccat

SEQ ID NO: 3353070 - DNA, 20 bp, Homo sapiens
aaaagttggactaaatgcct

SEQ ID NO: 3353071 - DNA, 18 bp, Homo sapiens
aaaagttgttcaactatt

SEQ ID NO: 3353072 - DNA, 13 bp, Homo sapiens
aaaagtttacaac

SEQ ID NO: 3353073 - DNA, 17 bp, Homo sapiens
aaaagtttacaacataa

SEQ ID NO: 3353074 - DNA, 12 bp, Homo sapiens
aaaagtttcaat

SEQ ID NO: 3353075 - DNA, 20 bp, Homo sapiens
aaaagtttcacgtcttggtg

SEQ ID NO: 3353076 - DNA, 12 bp, Homo sapiens
aaaagtttccat

SEQ ID NO: 3353077 - DNA, 17 bp, Homo sapiens
aaaagtttgaaaagcaa

SEQ ID NO: 3353078 - DNA, 18 bp, Homo sapiens
aaaagtttgaaaagcaat

SEQ ID NO: 3353079 - DNA, 17 bp, Homo sapiens
aaaagttttatttttct

SEQ ID NO: 3353080 - DNA, 20 bp, Homo sapiens
aaaagttttttattatgcat

SEQ ID NO: 3353081 - DNA, 21 bp, Homo sapiens
aaaataaaaacccacaaaaat

SEQ ID NO: 3353082 - DNA, 12 bp, Homo sapiens
aaaataaacatc

SEQ ID NO: 3353083 - DNA, 20 bp, Homo sapiens
aaaataaaccaaaggacatt

SEQ ID NO: 3353084 - DNA, 22 bp, Homo sapiens
aaaataaaccaaatatgttaaa

SEQ ID NO: 3353085 - DNA, 17 bp, Homo sapiens
aaaataaatatatctac

SEQ ID NO: 3353086 - DNA, 11 bp, Homo sapiens
aaaataaatgg

SEQ ID NO: 3353087 - DNA, 15 bp, Homo sapiens
aaaataaatggaaat

SEQ ID NO: 3353088 - DNA, 22 bp, Homo sapiens
aaaataacggtgcttgtgtcac

SEQ ID NO: 3353089 - DNA, 17 bp, Homo sapiens
aaaataactaaaatgta

SEQ ID NO: 3353090 - DNA, 13 bp, Homo sapiens
aaaataactgaac

SEQ ID NO: 3353091 - DNA, 18 bp, Homo sapiens
aaaataacttagactcta

SEQ ID NO: 3353092 - DNA, 16 bp, Homo sapiens
aaaataagaatagaaa

SEQ ID NO: 3353093 - DNA, 20 bp, Homo sapiens
aaaataagacaatagtattt

SEQ ID NO: 3353094 - DNA, 14 bp, Homo sapiens
aaaataagcaggtg

SEQ ID NO: 3353095 - DNA, 14 bp, Homo sapiens
aaaataagtaaata

SEQ ID NO: 3353096 - DNA, 14 bp, Homo sapiens
aaaataatcaagat

SEQ ID NO: 3353097 - DNA, 16 bp, Homo sapiens
aaaataatgtaatgat

SEQ ID NO: 3353098 - DNA, 16 bp, Homo sapiens
aaaataattgatttca

SEQ ID NO: 3353099 - DNA, 20 bp, Homo sapiens
aaaataattttaaacaaagg

SEQ ID NO: 3353100 - DNA, 14 bp, Homo sapiens
aaaatacaataaac

SEQ ID NO: 3353101 - DNA, 15 bp, Homo sapiens
aaaatacaatcctgt

SEQ ID NO: 3353102 - DNA, 21 bp, Homo sapiens
aaaataccagagccttcaagt

SEQ ID NO: 3353103 - DNA, 20 bp, Homo sapiens
aaaatacctattttatatga

SEQ ID NO: 3353104 - DNA, 15 bp, Homo sapiens
aaaatagaagctgta

SEQ ID NO: 3353105 - DNA, 21 bp, Homo sapiens
aaaatagaatgtggccactta

SEQ ID NO: 3353106 - DNA, 13 bp, Homo sapiens
aaaatagacactc

SEQ ID NO: 3353107 - DNA, 13 bp, Homo sapiens
aaaatagcttgta

SEQ ID NO: 3353108 - DNA, 19 bp, Homo sapiens
aaaatagcttgtatagtgt

SEQ ID NO: 3353109 - DNA, 21 bp, Homo sapiens
aaaatagcttgtatagtgtaa

SEQ ID NO: 3353110 - DNA, 15 bp, Homo sapiens
aaaataggatttctt

SEQ ID NO: 3353111 - DNA, 18 bp, Homo sapiens
aaaataggggatatttaa

SEQ ID NO: 3353112 - DNA, 19 bp, Homo sapiens
aaaatagtaaatgctttgt

SEQ ID NO: 3353113 - DNA, 12 bp, Homo sapiens
aaaatagtttgt

SEQ ID NO: 3353114 - DNA, 17 bp, Homo sapiens
aaaatagtttgtttaat

SEQ ID NO: 3353115 - DNA, 14 bp, Homo sapiens
aaaatatacatttg

SEQ ID NO: 3353116 - DNA, 13 bp, Homo sapiens
aaaatatagcaaa

SEQ ID NO: 3353117 - DNA, 13 bp, Homo sapiens
aaaatatatatag

SEQ ID NO: 3353118 - DNA, 15 bp, Homo sapiens
aaaatatatttaatg

SEQ ID NO: 3353119 - DNA, 18 bp, Homo sapiens
aaaatatattttcagtac

SEQ ID NO: 3353120 - DNA, 17 bp, Homo sapiens
aaaatatctatattcta

SEQ ID NO: 3353121 - DNA, 21 bp, Homo sapiens
aaaatatggaacttctaatat

SEQ ID NO: 3353122 - DNA, 16 bp, Homo sapiens
aaaatatgtatcctct

SEQ ID NO: 3353123 - DNA, 20 bp, Homo sapiens
aaaatattcctccaaatctc

SEQ ID NO: 3353124 - DNA, 16 bp, Homo sapiens
aaagattgtattactt

SEQ ID NO: 3353125 - DNA, 20 bp, Homo sapiens
aaagatttaagcacaaactt

SEQ ID NO: 3353126 - DNA, 20 bp, Homo sapiens
aaagatttgtgaactggaag

SEQ ID NO: 3353127 - DNA, 21 bp, Homo sapiens
aaagatttgtgaactggaaga

SEQ ID NO: 3353128 - DNA, 21 bp, Homo sapiens
aaagattttattgtataaaaa

SEQ ID NO: 3353129 - DNA, 14 bp, Homo sapiens
aaagattttgtttt

SEQ ID NO: 3353130 - DNA, 16 bp, Homo sapiens
aaagcaaaagcaaggg

SEQ ID NO: 3353131 - DNA, 21 bp, Homo sapiens
aaagcaaacttaagaaacact

SEQ ID NO: 3353132 - DNA, 18 bp, Homo sapiens
aaagcaaatctacagatc

SEQ ID NO: 3353133 - DNA, 13 bp, Homo sapiens
aaagcaaatgaga

SEQ ID NO: 3353134 - DNA, 15 bp, Homo sapiens
aaagcaagggagaaa

SEQ ID NO: 3353135 - DNA, 17 bp, Homo sapiens
aaagcaagggagaaaag

SEQ ID NO: 3353136 - DNA, 18 bp, Homo sapiens
aaagcaagggagaaaaga

SEQ ID NO: 3353137 - DNA, 23 bp, Homo sapiens
aaagcaagggagaaaagagaaac

SEQ ID NO: 3353138 - DNA, 17 bp, Homo sapiens
aaagcaagggctccagc

SEQ ID NO: 3353139 - DNA, 12 bp, Homo sapiens
aaagcaatattg

SEQ ID NO: 3353140 - DNA, 23 bp, Homo sapiens
aaagcaatgctgatgaatcactg

SEQ ID NO: 3353141 - DNA, 14 bp, Homo sapiens
aaagcaattgccct

SEQ ID NO: 3353142 - DNA, 13 bp, Homo sapiens
aaagcacaagaag

SEQ ID NO: 3353143 - DNA, 21 bp, Homo sapiens
aaagcacagtgttaaatgaaa

SEQ ID NO: 3353144 - DNA, 18 bp, Homo sapiens
aaagcacatacattaaaa

SEQ ID NO: 3353145 - DNA, 18 bp, Homo sapiens
aaagcacatgcttagctt

SEQ ID NO: 3353146 - DNA, 15 bp, Homo sapiens
aaagcactagagaat

SEQ ID NO: 3353147 - DNA, 18 bp, Homo sapiens
aaagcactagagaatgca

SEQ ID NO: 3353148 - DNA, 14 bp, Homo sapiens
aaagcactgacctg

SEQ ID NO: 3353149 - DNA, 21 bp, Homo sapiens
aaagcacttacaccagtttga

SEQ ID NO: 3353150 - DNA, 17 bp, Homo sapiens
aaagcacttactttttt

SEQ ID NO: 3353151 - DNA, 16 bp, Homo sapiens
aaagcactttgcactt

SEQ ID NO: 3353152 - DNA, 13 bp, Homo sapiens
aaagcacttttgt

SEQ ID NO: 3353153 - DNA, 15 bp, Homo sapiens
aaagcacttttgtta

SEQ ID NO: 3353154 - DNA, 23 bp, Homo sapiens
aaagcacttttgttattccatca

SEQ ID NO: 3353155 - DNA, 16 bp, Homo sapiens
aaagcagaattttaat

SEQ ID NO: 3353156 - DNA, 17 bp, Homo sapiens
aaagcagaattttaatg

SEQ ID NO: 3353157 - DNA, 22 bp, Homo sapiens
aaagcagagtggactgcattta

SEQ ID NO: 3353158 - DNA, 19 bp, Homo sapiens
aaagcagcctcattctgag

SEQ ID NO: 3353159 - DNA, 19 bp, Homo sapiens
aaagcagcctgattgaaaa

SEQ ID NO: 3353160 - DNA, 13 bp, Homo sapiens
aaagcagggcagc

SEQ ID NO: 3353161 - DNA, 18 bp, Homo sapiens
aaagcaggggctacaaga

SEQ ID NO: 3353162 - DNA, 22 bp, Homo sapiens
aaagcagtcccattcatattaa

SEQ ID NO: 3353163 - DNA, 18 bp, Homo sapiens
aaagcatcacctcaggcc

SEQ ID NO: 3353164 - DNA, 19 bp, Homo sapiens
aaagcatgatgggaaaata

SEQ ID NO: 3353165 - DNA, 21 bp, Homo sapiens
aaagcatgatgggaaaatatt

SEQ ID NO: 3353166 - DNA, 15 bp, Homo sapiens
aaagcatggacattt

SEQ ID NO: 3353167 - DNA, 15 bp, Homo sapiens
aaagcatttataaat

SEQ ID NO: 3353168 - DNA, 14 bp, Homo sapiens
aaagcatttatcat

SEQ ID NO: 3353169 - DNA, 16 bp, Homo sapiens
aaagccaaacaagcct

SEQ ID NO: 3353170 - DNA, 15 bp, Homo sapiens
aaagccaaagctagg

SEQ ID NO: 3353171 - DNA, 21 bp, Homo sapiens
aaagccaaccttcaaagaaac

SEQ ID NO: 3353172 - DNA, 15 bp, Homo sapiens
aaagccacaaggctg

SEQ ID NO: 3353173 - DNA, 17 bp, Homo sapiens
aaagccacaaggctggc

SEQ ID NO: 3353174 - DNA, 21 bp, Homo sapiens
aaagccacaaggctggccagc

SEQ ID NO: 3353175 - DNA, 20 bp, Homo sapiens
aaagccacattatttctagt

SEQ ID NO: 3353176 - DNA, 14 bp, Homo sapiens
aaagccagggtctc

SEQ ID NO: 3353177 - DNA, 17 bp, Homo sapiens
aaagccatcatgccttg

SEQ ID NO: 3353178 - DNA, 13 bp, Homo sapiens
aaagcccagactt

SEQ ID NO: 3353179 - DNA, 21 bp, Homo sapiens
aaagccctggtaaaagggata

SEQ ID NO: 3353180 - DNA, 18 bp, Homo sapiens
aaagcctgggtgacattt

SEQ ID NO: 3353181 - DNA, 13 bp, Homo sapiens
aaagcctgttccc

SEQ ID NO: 3353182 - DNA, 20 bp, Homo sapiens
aaagccttaaaaatatcctt

SEQ ID NO: 3353183 - DNA, 15 bp, Homo sapiens
aaagccttagggaag

SEQ ID NO: 3353184 - DNA, 19 bp, Homo sapiens
aaagccttagggaagctgg

SEQ ID NO: 3353185 - DNA, 17 bp, Homo sapiens
aaagccttatcaagtgt

SEQ ID NO: 3353186 - DNA, 10 bp, Homo sapiens
aaagccttcc

SEQ ID NO: 3353187 - DNA, 11 bp, Homo sapiens
aaagccttgtg

SEQ ID NO: 3353188 - DNA, 16 bp, Homo sapiens
aaagccttttaaatca

SEQ ID NO: 3353189 - DNA, 19 bp, Homo sapiens
aaagcgagatcccatctct

SEQ ID NO: 3353190 - DNA, 14 bp, Homo sapiens
aaagcggggggagg

SEQ ID NO: 3353191 - DNA, 16 bp, Homo sapiens
aaagcggggggagggt

SEQ ID NO: 3353192 - DNA, 22 bp, Homo sapiens
aaagcggtttaaccacattaat

SEQ ID NO: 3353193 - DNA, 15 bp, Homo sapiens
aaagcgtctttaaga

SEQ ID NO: 3353194 - DNA, 16 bp, Homo sapiens
aaagcgtctttaagag

SEQ ID NO: 3353195 - DNA, 17 bp, Homo sapiens
aaagcgtctttaagaga

SEQ ID NO: 3353196 - DNA, 20 bp, Homo sapiens
aaagcgtctttaagagactc

SEQ ID NO: 3353197 - DNA, 21 bp, Homo sapiens
aaagcgtctttaagagactca

SEQ ID NO: 3353198 - DNA, 16 bp, Homo sapiens
aaagctaaaatatata

SEQ ID NO: 3353199 - DNA, 18 bp, Homo sapiens
aaagctaaaatatataat

SEQ ID NO: 3353200 - DNA, 18 bp, Homo sapiens
aaagctattagccaggat

SEQ ID NO: 3353201 - DNA, 14 bp, Homo sapiens
aaagctcaaatgaa

SEQ ID NO: 3353202 - DNA, 18 bp, Homo sapiens
aaagctcaaatgaaatgt

SEQ ID NO: 3353203 - DNA, 16 bp, Homo sapiens
aaagctcactgctgat

SEQ ID NO: 3353204 - DNA, 14 bp, Homo sapiens
aaagctctagaatc

SEQ ID NO: 3353205 - DNA, 17 bp, Homo sapiens
aaagctcttctttttta

SEQ ID NO: 3353206 - DNA, 14 bp, Homo sapiens
aaagctgaatattt

SEQ ID NO: 3353207 - DNA, 22 bp, Homo sapiens
aaagctgattactgtcaataaa

SEQ ID NO: 3353208 - DNA, 17 bp, Homo sapiens
aaagctgcctgtagtta

SEQ ID NO: 3353209 - DNA, 21 bp, Homo sapiens
aaagctgcctgtagttaggaa

SEQ ID NO: 3353210 - DNA, 17 bp, Homo sapiens
aaagctgctaaatctcc

SEQ ID NO: 3353211 - DNA, 22 bp, Homo sapiens
aaagctgctaaatctcctattt

SEQ ID NO: 3353212 - DNA, 15 bp, Homo sapiens
aaagctggaacattt

SEQ ID NO: 3353213 - DNA, 18 bp, Homo sapiens
aaagctggaacatttgat

SEQ ID NO: 3353214 - DNA, 11 bp, Homo sapiens
aaagctggccc

SEQ ID NO: 3353215 - DNA, 16 bp, Homo sapiens
aaagctgtaaattact

SEQ ID NO: 3353216 - DNA, 23 bp, Homo sapiens
aaagctgtggccagcttgttatt

SEQ ID NO: 3353217 - DNA, 20 bp, Homo sapiens
aaagcttccatgattctatt

SEQ ID NO: 3353218 - DNA, 20 bp, Homo sapiens
aaagcttcttaattaatttg

SEQ ID NO: 3353219 - DNA, 23 bp, Homo sapiens
aaagcttcttaattaatttgatt

SEQ ID NO: 3353220 - DNA, 15 bp, Homo sapiens
aaagcttgtggccaa

SEQ ID NO: 3353221 - DNA, 21 bp, Homo sapiens
aaagctttcctgtttccaggg

SEQ ID NO: 3353222 - DNA, 12 bp, Homo sapiens
aaagctttgcta

SEQ ID NO: 3353223 - DNA, 16 bp, Homo sapiens
aaagctttgctacaaa

SEQ ID NO: 3353224 - DNA, 15 bp, Homo sapiens
aaagcttttagaaat

SEQ ID NO: 3353225 - DNA, 16 bp, Homo sapiens
aaaggaaaaagcacaa

SEQ ID NO: 3353226 - DNA, 15 bp, Homo sapiens
aaaggaaaacctgaa

SEQ ID NO: 3353227 - DNA, 18 bp, Homo sapiens
aaaggaaaacctgaagac

SEQ ID NO: 3353228 - DNA, 22 bp, Homo sapiens
aaaggaaacttcagttgatctt

SEQ ID NO: 3353229 - DNA, 18 bp, Homo sapiens
aaaggaaagctgtgttta

SEQ ID NO: 3353230 - DNA, 23 bp, Homo sapiens
aaaggaaatctcaccccatccca

SEQ ID NO: 3353231 - DNA, 19 bp, Homo sapiens
aaaggaaatttgtttgtat

SEQ ID NO: 3353232 - DNA, 18 bp, Homo sapiens
aaaggaacaaaaattaca

SEQ ID NO: 3353233 - DNA, 23 bp, Homo sapiens
aaaggaacaaaaattacaaagaa

SEQ ID NO: 3353234 - DNA, 19 bp, Homo sapiens
aaaggaacacgtttttaca

SEQ ID NO: 3353235 - DNA, 12 bp, Homo sapiens
aaaggaaggaaa

SEQ ID NO: 3353236 - DNA, 20 bp, Homo sapiens
aaaggaataacctttctgga

SEQ ID NO: 3353237 - DNA, 14 bp, Homo sapiens
aaaggacattatgt

SEQ ID NO: 3353238 - DNA, 15 bp, Homo sapiens
aaaggacccacccat

SEQ ID NO: 3353239 - DNA, 22 bp, Homo sapiens
aaaggactaacataaaatctgt

SEQ ID NO: 3353240 - DNA, 21 bp, Homo sapiens
aaaggatagtatttttatcca

SEQ ID NO: 3353241 - DNA, 16 bp, Homo sapiens
aaaggatatttaagaa

SEQ ID NO: 3353242 - DNA, 15 bp, Homo sapiens
aaaggatctctgaga

SEQ ID NO: 3353243 - DNA, 14 bp, Homo sapiens
aaaggatggtggtt

SEQ ID NO: 3353244 - DNA, 20 bp, Homo sapiens
aaaggatggtggttatttta

SEQ ID NO: 3353245 - DNA, 16 bp, Homo sapiens
aaaggatgttggtgtt

SEQ ID NO: 3353246 - DNA, 18 bp, Homo sapiens
aaaggattttaccaaagc

SEQ ID NO: 3353247 - DNA, 11 bp, Homo sapiens
aaaggcagctg

SEQ ID NO: 3353248 - DNA, 12 bp, Homo sapiens
aaaggcagctgc

SEQ ID NO: 3353249 - DNA, 13 bp, Homo sapiens
aaaggcagttttc

SEQ ID NO: 3353250 - DNA, 14 bp, Homo sapiens
aaatcactttcata

SEQ ID NO: 3353251 - DNA, 21 bp, Homo sapiens
aaatcagaagtcatcttgcta

SEQ ID NO: 3353252 - DNA, 20 bp, Homo sapiens
aaatcagaggagagacggtg

SEQ ID NO: 3353253 - DNA, 19 bp, Homo sapiens
aaatcagtaagaggtgtta

SEQ ID NO: 3353254 - DNA, 16 bp, Homo sapiens
aaatcagtgatctatg

SEQ ID NO: 3353255 - DNA, 13 bp, Homo sapiens
aaatcataaagtc

SEQ ID NO: 3353256 - DNA, 13 bp, Homo sapiens
aaatcatcaaaaa

SEQ ID NO: 3353257 - DNA, 19 bp, Homo sapiens
aaatcatcctgttttctct

SEQ ID NO: 3353258 - DNA, 20 bp, Homo sapiens
aaatcatctgcattcctgat

SEQ ID NO: 3353259 - DNA, 18 bp, Homo sapiens
aaatcatgccagtatttt

SEQ ID NO: 3353260 - DNA, 14 bp, Homo sapiens
aaatcatgtatgtt

SEQ ID NO: 3353261 - DNA, 21 bp, Homo sapiens
aaatcatgtatgttatgatat

SEQ ID NO: 3353262 - DNA, 20 bp, Homo sapiens
aaatccatatcttaaagaaa

SEQ ID NO: 3353263 - DNA, 14 bp, Homo sapiens
aaatccctggatca

SEQ ID NO: 3353264 - DNA, 17 bp, Homo sapiens
aaatccctgtttaatat

SEQ ID NO: 3353265 - DNA, 17 bp, Homo sapiens
aaatcctagacttgaaa

SEQ ID NO: 3353266 - DNA, 19 bp, Homo sapiens
aaatcctagacttgaaagt

SEQ ID NO: 3353267 - DNA, 16 bp, Homo sapiens
aaatcctgccatttaa

SEQ ID NO: 3353268 - DNA, 18 bp, Homo sapiens
aaatcctgccatttaaaa

SEQ ID NO: 3353269 - DNA, 13 bp, Homo sapiens
aaatccttccaaa

SEQ ID NO: 3353270 - DNA, 15 bp, Homo sapiens
aaatcgattggcttt

SEQ ID NO: 3353271 - DNA, 19 bp, Homo sapiens
aaatcgcttatatgtcctt

SEQ ID NO: 3353272 - DNA, 23 bp, Homo sapiens
aaatcggatctggggctctggga

SEQ ID NO: 3353273 - DNA, 21 bp, Homo sapiens
aaatctaaaacaaaatctgaa

SEQ ID NO: 3353274 - DNA, 13 bp, Homo sapiens
aaatctaaaagaa

SEQ ID NO: 3353275 - DNA, 20 bp, Homo sapiens
aaatctaaatttcttttgct

SEQ ID NO: 3353276 - DNA, 17 bp, Homo sapiens
aaatctaatattaaaaa

SEQ ID NO: 3353277 - DNA, 19 bp, Homo sapiens
aaatctaatattaaaaata

SEQ ID NO: 3353278 - DNA, 13 bp, Homo sapiens
aaatctaatctct

SEQ ID NO: 3353279 - DNA, 19 bp, Homo sapiens
aaatctaatctcttattct

SEQ ID NO: 3353280 - DNA, 19 bp, Homo sapiens
aaatctaatgtaagaaaat

SEQ ID NO: 3353281 - DNA, 15 bp, Homo sapiens
aaatctacagatcct

SEQ ID NO: 3353282 - DNA, 22 bp, Homo sapiens
aaatctagtatttcatgctggg

SEQ ID NO: 3353283 - DNA, 16 bp, Homo sapiens
aaatctatttattaat

SEQ ID NO: 3353284 - DNA, 19 bp, Homo sapiens
aaatctatttattaatatt

SEQ ID NO: 3353285 - DNA, 22 bp, Homo sapiens
aaatctatttattaatatttaa

SEQ ID NO: 3353286 - DNA, 17 bp, Homo sapiens
aaatctcaccccatccc

SEQ ID NO: 3353287 - DNA, 18 bp, Homo sapiens
aaatctcccattttggaa

SEQ ID NO: 3353288 - DNA, 13 bp, Homo sapiens
aaatctcctattt

SEQ ID NO: 3353289 - DNA, 19 bp, Homo sapiens
aaatctctcagagccctca

SEQ ID NO: 3353290 - DNA, 18 bp, Homo sapiens
aaatctcttgcttgtcat

SEQ ID NO: 3353291 - DNA, 19 bp, Homo sapiens
aaatctcttgcttgtcatt

SEQ ID NO: 3353292 - DNA, 22 bp, Homo sapiens
aaatctgaagaggcttctcctg

SEQ ID NO: 3353293 - DNA, 19 bp, Homo sapiens
aaatctgccacaaaaacag

SEQ ID NO: 3353294 - DNA, 15 bp, Homo sapiens
aaatctgctgttaac

SEQ ID NO: 3353295 - DNA, 20 bp, Homo sapiens
aaatctggagctggcactgt

SEQ ID NO: 3353296 - DNA, 19 bp, Homo sapiens
aaatctgggtatctttcca

SEQ ID NO: 3353297 - DNA, 22 bp, Homo sapiens
aaatctggtctaatttattaat

SEQ ID NO: 3353298 - DNA, 19 bp, Homo sapiens
aaatctgtaagctctttga

SEQ ID NO: 3353299 - DNA, 15 bp, Homo sapiens
aaatctgtgaattaa

SEQ ID NO: 3353300 - DNA, 22 bp, Homo sapiens
aaatctgtgtatattatttggc

SEQ ID NO: 3353301 - DNA, 20 bp, Homo sapiens
aaatctgttctgggctcttt

SEQ ID NO: 3353302 - DNA, 12 bp, Homo sapiens
aaatcttaaaaa

SEQ ID NO: 3353303 - DNA, 17 bp, Homo sapiens
aaatcttaaaaagttgt

SEQ ID NO: 3353304 - DNA, 16 bp, Homo sapiens
aaatcttaaacaatgt

SEQ ID NO: 3353305 - DNA, 22 bp, Homo sapiens
aaatcttaaacaatgtataaag

SEQ ID NO: 3353306 - DNA, 15 bp, Homo sapiens
aaatcttctccagat

SEQ ID NO: 3353307 - DNA, 13 bp, Homo sapiens
aaatcttgaaatt

SEQ ID NO: 3353308 - DNA, 13 bp, Homo sapiens
aaatcttggaagt

SEQ ID NO: 3353309 - DNA, 23 bp, Homo sapiens
aaatcttggaagtacatgaatac

SEQ ID NO: 3353310 - DNA, 20 bp, Homo sapiens
aaatcttgtgctagaatact

SEQ ID NO: 3353311 - DNA, 13 bp, Homo sapiens
aaatctttaagaa

SEQ ID NO: 3353312 - DNA, 20 bp, Homo sapiens
aaatctttaagaatagttct

SEQ ID NO: 3353313 - DNA, 16 bp, Homo sapiens
aaatctttcttcaaat

SEQ ID NO: 3353314 - DNA, 20 bp, Homo sapiens
aaatctttcttcaaatctcc

SEQ ID NO: 3353315 - DNA, 22 bp, Homo sapiens
aaatcttttaaaaattcaaatg

SEQ ID NO: 3353316 - DNA, 17 bp, Homo sapiens
aaatcttttgaagcata

SEQ ID NO: 3353317 - DNA, 18 bp, Homo sapiens
aaatgaaaacatgtaata

SEQ ID NO: 3353318 - DNA, 12 bp, Homo sapiens
aaatgaaaattg

SEQ ID NO: 3353319 - DNA, 13 bp, Homo sapiens
aaatgaaaattgt

SEQ ID NO: 3353320 - DNA, 13 bp, Homo sapiens
aaatgaaactcaa

SEQ ID NO: 3353321 - DNA, 15 bp, Homo sapiens
aaatgaaagaaaatt

SEQ ID NO: 3353322 - DNA, 20 bp, Homo sapiens
aaatgaaagaaaattgagtt

SEQ ID NO: 3353323 - DNA, 13 bp, Homo sapiens
aaatgaaagctac

SEQ ID NO: 3353324 - DNA, 15 bp, Homo sapiens
aaatgaaagtgactt

SEQ ID NO: 3353325 - DNA, 13 bp, Homo sapiens
aaatgaaatattt

SEQ ID NO: 3353326 - DNA, 22 bp, Homo sapiens
aaatgaaattactacaaaattt

SEQ ID NO: 3353327 - DNA, 12 bp, Homo sapiens
aaatgaaattgt

SEQ ID NO: 3353328 - DNA, 15 bp, Homo sapiens
aaatgaactgcccac

SEQ ID NO: 3353329 - DNA, 18 bp, Homo sapiens
aaatgaagcagctttaaa

SEQ ID NO: 3353330 - DNA, 19 bp, Homo sapiens
aaatgaaggttaggattta

SEQ ID NO: 3353331 - DNA, 14 bp, Homo sapiens
aaatgaataaatcc

SEQ ID NO: 3353332 - DNA, 19 bp, Homo sapiens
aaatgaatattttgataat

SEQ ID NO: 3353333 - DNA, 19 bp, Homo sapiens
aaatgacaaatgtattaat

SEQ ID NO: 3353334 - DNA, 15 bp, Homo sapiens
aaatgaccaatatta

SEQ ID NO: 3353335 - DNA, 20 bp, Homo sapiens
aaatgacctctgtcctccct

SEQ ID NO: 3353336 - DNA, 17 bp, Homo sapiens
aaatgacttatttctgc

SEQ ID NO: 3353337 - DNA, 15 bp, Homo sapiens
aaatgagaagtactt

SEQ ID NO: 3353338 - DNA, 18 bp, Homo sapiens
aaatgagaattttatatt

SEQ ID NO: 3353339 - DNA, 17 bp, Homo sapiens
aaatgagacgaaatgct

SEQ ID NO: 3353340 - DNA, 23 bp, Homo sapiens
aaatgagctcgcatttgtcaatg

SEQ ID NO: 3353341 - DNA, 19 bp, Homo sapiens
aaatgagctctgaaatctt

SEQ ID NO: 3353342 - DNA, 18 bp, Homo sapiens
aaatgagcttgattaaat

SEQ ID NO: 3353343 - DNA, 16 bp, Homo sapiens
aaatgaggacatgttt

SEQ ID NO: 3353344 - DNA, 16 bp, Homo sapiens
aaatgaggtactctcc

SEQ ID NO: 3353345 - DNA, 15 bp, Homo sapiens
aaatgagttgtgaaa

SEQ ID NO: 3353346 - DNA, 19 bp, Homo sapiens
aaatgagttgtgaaagttt

SEQ ID NO: 3353347 - DNA, 22 bp, Homo sapiens
aaatgatgatgtggaagaactt

SEQ ID NO: 3353348 - DNA, 18 bp, Homo sapiens
aaatgattcaaattgctg

SEQ ID NO: 3353349 - DNA, 20 bp, Homo sapiens
aaatgattcaaattgctgct

SEQ ID NO: 3353350 - DNA, 15 bp, Homo sapiens
aaatgattcttagtg

SEQ ID NO: 3353351 - DNA, 14 bp, Homo sapiens
aaatgatttcatat

SEQ ID NO: 3353352 - DNA, 17 bp, Homo sapiens
aaatgatttcatattga

SEQ ID NO: 3353353 - DNA, 17 bp, Homo sapiens
aaatgcaaacacacaaa

SEQ ID NO: 3353354 - DNA, 13 bp, Homo sapiens
aaatgcaaagctg

SEQ ID NO: 3353355 - DNA, 21 bp, Homo sapiens
aaatgcaatctcttttctaca

SEQ ID NO: 3353356 - DNA, 13 bp, Homo sapiens
aaatgcacaattt

SEQ ID NO: 3353357 - DNA, 19 bp, Homo sapiens
aaatgcacatagctatcaa

SEQ ID NO: 3353358 - DNA, 19 bp, Homo sapiens
aaatgcagaaccacaaaca

SEQ ID NO: 3353359 - DNA, 22 bp, Homo sapiens
aaatgcagacaacaccttcctc

SEQ ID NO: 3353360 - DNA, 19 bp, Homo sapiens
aaatgcagtaacattctac

SEQ ID NO: 3353361 - DNA, 20 bp, Homo sapiens
aaatgcatatcctgagccat

SEQ ID NO: 3353362 - DNA, 14 bp, Homo sapiens
aaatgcatgaacaa

SEQ ID NO: 3353363 - DNA, 18 bp, Homo sapiens
aaatgcatgattttgtaa

SEQ ID NO: 3353364 - DNA, 20 bp, Homo sapiens
aaatgcatgattttgtaacc

SEQ ID NO: 3353365 - DNA, 21 bp, Homo sapiens
aaatgcatgattttgtaaccc

SEQ ID NO: 3353366 - DNA, 18 bp, Homo sapiens
aaatgccatagtttgtga

SEQ ID NO: 3353367 - DNA, 22 bp, Homo sapiens
aaatgcctcttaaattatatat

SEQ ID NO: 3353368 - DNA, 15 bp, Homo sapiens
aaatgcggttataaa

SEQ ID NO: 3353369 - DNA, 13 bp, Homo sapiens
aaatgctgcttct

SEQ ID NO: 3353370 - DNA, 19 bp, Homo sapiens
aaatgctttgtgtgattga

SEQ ID NO: 3353371 - DNA, 20 bp, Homo sapiens
aaatgcttttaaatgctctc

SEQ ID NO: 3353372 - DNA, 18 bp, Homo sapiens
aaatgctttttatttctg

SEQ ID NO: 3353373 - DNA, 20 bp, Homo sapiens
aaatgctttttatttctgca

SEQ ID NO: 3353374 - DNA, 12 bp, Homo sapiens
aaatggaaaaaa

SEQ ID NO: 3353375 - DNA, 21 bp, Homo sapiens
aaatggacacaaattttcaag

SEQ ID NO: 3353376 - DNA, 16 bp, Homo sapiens
aaattccttgccccac

SEQ ID NO: 3353377 - DNA, 15 bp, Homo sapiens
aaattctactaagtt

SEQ ID NO: 3353378 - DNA, 22 bp, Homo sapiens
aaattctactaagttattttat

SEQ ID NO: 3353379 - DNA, 22 bp, Homo sapiens
aaattctataggaacatatgaa

SEQ ID NO: 3353380 - DNA, 12 bp, Homo sapiens
aaattctatgtt

SEQ ID NO: 3353381 - DNA, 15 bp, Homo sapiens
aaattctatgttaaa

SEQ ID NO: 3353382 - DNA, 16 bp, Homo sapiens
aaattctatgttaaat

SEQ ID NO: 3353383 - DNA, 20 bp, Homo sapiens
aaattctatgttaaatactg

SEQ ID NO: 3353384 - DNA, 22 bp, Homo sapiens
aaattctatgttaaatactgtg

SEQ ID NO: 3353385 - DNA, 21 bp, Homo sapiens
aaattctattctgatcttatt

SEQ ID NO: 3353386 - DNA, 14 bp, Homo sapiens
aaattctcctggag

SEQ ID NO: 3353387 - DNA, 14 bp, Homo sapiens
aaattctcttcttt

SEQ ID NO: 3353388 - DNA, 16 bp, Homo sapiens
aaattctcttcttttt

SEQ ID NO: 3353389 - DNA, 11 bp, Homo sapiens
aaattctgtgg

SEQ ID NO: 3353390 - DNA, 10 bp, Homo sapiens
aaattctgtt

SEQ ID NO: 3353391 - DNA, 18 bp, Homo sapiens
aaattctgttgttccatt

SEQ ID NO: 3353392 - DNA, 17 bp, Homo sapiens
aaattctttatttctgt

SEQ ID NO: 3353393 - DNA, 23 bp, Homo sapiens
aaattgaaaacacactcaaaaga

SEQ ID NO: 3353394 - DNA, 12 bp, Homo sapiens
aaattgaacttc

SEQ ID NO: 3353395 - DNA, 17 bp, Homo sapiens
aaattgaacttcccaca

SEQ ID NO: 3353396 - DNA, 20 bp, Homo sapiens
aaattgacacaagtggacct

SEQ ID NO: 3353397 - DNA, 19 bp, Homo sapiens
aaattgacatgttgtcaca

SEQ ID NO: 3353398 - DNA, 19 bp, Homo sapiens
aaattgagttgcacttatt

SEQ ID NO: 3353399 - DNA, 13 bp, Homo sapiens
aaattgcaaatct

SEQ ID NO: 3353400 - DNA, 14 bp, Homo sapiens
aaattgcaaatctt

SEQ ID NO: 3353401 - DNA, 19 bp, Homo sapiens
aaattgcaaatcttgaaat

SEQ ID NO: 3353402 - DNA, 13 bp, Homo sapiens
aaattgcactaaa

SEQ ID NO: 3353403 - DNA, 12 bp, Homo sapiens
aaattgcactga

SEQ ID NO: 3353404 - DNA, 23 bp, Homo sapiens
aaattgcatactttgtattttga

SEQ ID NO: 3353405 - DNA, 22 bp, Homo sapiens
aaattgctcctaagcttcaaat

SEQ ID NO: 3353406 - DNA, 14 bp, Homo sapiens
aaattgctccttga

SEQ ID NO: 3353407 - DNA, 13 bp, Homo sapiens
aaattgctctgtg

SEQ ID NO: 3353408 - DNA, 14 bp, Homo sapiens
aaattgctgtgctt

SEQ ID NO: 3353409 - DNA, 23 bp, Homo sapiens
aaattgctgtgctttatggatag

SEQ ID NO: 3353410 - DNA, 18 bp, Homo sapiens
aaattgcttttgttgtga

SEQ ID NO: 3353411 - DNA, 23 bp, Homo sapiens
aaattgcttttgttgtgactttt

SEQ ID NO: 3353412 - DNA, 22 bp, Homo sapiens
aaattggaatggaactactgta

SEQ ID NO: 3353413 - DNA, 15 bp, Homo sapiens
aaattggaattttct

SEQ ID NO: 3353414 - DNA, 23 bp, Homo sapiens
aaattggactttcaaaattaaat

SEQ ID NO: 3353415 - DNA, 22 bp, Homo sapiens
aaattgggacaacagtgctttg

SEQ ID NO: 3353416 - DNA, 22 bp, Homo sapiens
aaattggtgataagtggaaaaa

SEQ ID NO: 3353417 - DNA, 22 bp, Homo sapiens
aaattggttggagaatttaggt

SEQ ID NO: 3353418 - DNA, 12 bp, Homo sapiens
aaattgtacata

SEQ ID NO: 3353419 - DNA, 19 bp, Homo sapiens
aaattgtatacattttgtt

SEQ ID NO: 3353420 - DNA, 22 bp, Homo sapiens
aaattgtatctagtgcagctga

SEQ ID NO: 3353421 - DNA, 15 bp, Homo sapiens
aaattgtatctcagt

SEQ ID NO: 3353422 - DNA, 18 bp, Homo sapiens
aaattgtatctcattact

SEQ ID NO: 3353423 - DNA, 14 bp, Homo sapiens
aaattgtatgaaaa

SEQ ID NO: 3353424 - DNA, 18 bp, Homo sapiens
aaattgtctaaaatgtca

SEQ ID NO: 3353425 - DNA, 22 bp, Homo sapiens
aaattgtctttaaaaactgttt

SEQ ID NO: 3353426 - DNA, 18 bp, Homo sapiens
aaattgtgcataatgctt

SEQ ID NO: 3353427 - DNA, 17 bp, Homo sapiens
aaattgtgcttctcccc

SEQ ID NO: 3353428 - DNA, 22 bp, Homo sapiens
aaattgtgcttctccccagaat

SEQ ID NO: 3353429 - DNA, 16 bp, Homo sapiens
aaattgtgtacacttt

SEQ ID NO: 3353430 - DNA, 13 bp, Homo sapiens
aaattgtttagtg

SEQ ID NO: 3353431 - DNA, 12 bp, Homo sapiens
aaattgtttctt

SEQ ID NO: 3353432 - DNA, 20 bp, Homo sapiens
aaattgtttcttgacaagct

SEQ ID NO: 3353433 - DNA, 22 bp, Homo sapiens
aaattgtttggcttcctcctga

SEQ ID NO: 3353434 - DNA, 12 bp, Homo sapiens
aaatttaaaaaa

SEQ ID NO: 3353435 - DNA, 13 bp, Homo sapiens
aaatttaaaaaat

SEQ ID NO: 3353436 - DNA, 14 bp, Homo sapiens
aaatttaaacatta

SEQ ID NO: 3353437 - DNA, 13 bp, Homo sapiens
aaatttaaagata

SEQ ID NO: 3353438 - DNA, 23 bp, Homo sapiens
aaatttaaagggtgtacttatat

SEQ ID NO: 3353439 - DNA, 12 bp, Homo sapiens
aaatttaacata

SEQ ID NO: 3353440 - DNA, 15 bp, Homo sapiens
aaatttaagcattgt

SEQ ID NO: 3353441 - DNA, 17 bp, Homo sapiens
aaatttaagcattgttt

SEQ ID NO: 3353442 - DNA, 21 bp, Homo sapiens
aaatttaagtgcgtgtgtaga

SEQ ID NO: 3353443 - DNA, 21 bp, Homo sapiens
aaatttaataccagatacctt

SEQ ID NO: 3353444 - DNA, 14 bp, Homo sapiens
aaatttacatttat

SEQ ID NO: 3353445 - DNA, 16 bp, Homo sapiens
aaatttacatttatct

SEQ ID NO: 3353446 - DNA, 13 bp, Homo sapiens
aaatttactatat

SEQ ID NO: 3353447 - DNA, 15 bp, Homo sapiens
aaatttactatatat

SEQ ID NO: 3353448 - DNA, 19 bp, Homo sapiens
aaatttagccctttaaaac

SEQ ID NO: 3353449 - DNA, 20 bp, Homo sapiens
aaatttagccctttaaaacg

SEQ ID NO: 3353450 - DNA, 17 bp, Homo sapiens
aaatttatcaaagcata

SEQ ID NO: 3353451 - DNA, 11 bp, Homo sapiens
aaatttatgca

SEQ ID NO: 3353452 - DNA, 16 bp, Homo sapiens
aaatttatgcatttca

SEQ ID NO: 3353453 - DNA, 16 bp, Homo sapiens
aaatttcaaaagacat

SEQ ID NO: 3353454 - DNA, 19 bp, Homo sapiens
aaatttcaaaagacatgtt

SEQ ID NO: 3353455 - DNA, 18 bp, Homo sapiens
aaatttcactactagatt

SEQ ID NO: 3353456 - DNA, 20 bp, Homo sapiens
aaatttcgcttcttagaaca

SEQ ID NO: 3353457 - DNA, 16 bp, Homo sapiens
aaatttctaagagagc

SEQ ID NO: 3353458 - DNA, 14 bp, Homo sapiens
aaatttctatcatt

SEQ ID NO: 3353459 - DNA, 14 bp, Homo sapiens
aaatttgaagtatt

SEQ ID NO: 3353460 - DNA, 20 bp, Homo sapiens
aaatttgactaattttacat

SEQ ID NO: 3353461 - DNA, 16 bp, Homo sapiens
aaatttgatacttata

SEQ ID NO: 3353462 - DNA, 17 bp, Homo sapiens
aaatttgattgatttga

SEQ ID NO: 3353463 - DNA, 18 bp, Homo sapiens
aaatttgcaactcactga

SEQ ID NO: 3353464 - DNA, 12 bp, Homo sapiens
aaatttgtaagt

SEQ ID NO: 3353465 - DNA, 17 bp, Homo sapiens
aaatttgtaagtttcag

SEQ ID NO: 3353466 - DNA, 20 bp, Homo sapiens
aaatttgtaagtttcaggtg

SEQ ID NO: 3353467 - DNA, 22 bp, Homo sapiens
aaatttgtaagtttcaggtgac

SEQ ID NO: 3353468 - DNA, 20 bp, Homo sapiens
aaatttgtacaggactgtaa

SEQ ID NO: 3353469 - DNA, 21 bp, Homo sapiens
aaatttgtctgaaacatttca

SEQ ID NO: 3353470 - DNA, 16 bp, Homo sapiens
aaatttgtgctgggtt

SEQ ID NO: 3353471 - DNA, 14 bp, Homo sapiens
aaatttgtggttgt

SEQ ID NO: 3353472 - DNA, 17 bp, Homo sapiens
aaatttgtttaattaaa

SEQ ID NO: 3353473 - DNA, 13 bp, Homo sapiens
aaattttaaaaaa

SEQ ID NO: 3353474 - DNA, 14 bp, Homo sapiens
aaattttagaaata

SEQ ID NO: 3353475 - DNA, 17 bp, Homo sapiens
aaattttagtacatttt

SEQ ID NO: 3353476 - DNA, 21 bp, Homo sapiens
aaattttataaaattaagcaa

SEQ ID NO: 3353477 - DNA, 12 bp, Homo sapiens
aaattttatctg

SEQ ID NO: 3353478 - DNA, 16 bp, Homo sapiens
aaattttattttgtgc

SEQ ID NO: 3353479 - DNA, 11 bp, Homo sapiens
aaattttcacc

SEQ ID NO: 3353480 - DNA, 15 bp, Homo sapiens
aaattttctagaaat

SEQ ID NO: 3353481 - DNA, 14 bp, Homo sapiens
aaattttctagact

SEQ ID NO: 3353482 - DNA, 14 bp, Homo sapiens
aaattttcttcagt

SEQ ID NO: 3353483 - DNA, 13 bp, Homo sapiens
aaattttgcaaat

SEQ ID NO: 3353484 - DNA, 16 bp, Homo sapiens
aaattttgcaaatata

SEQ ID NO: 3353485 - DNA, 20 bp, Homo sapiens
aaattttgcaaatataaaca

SEQ ID NO: 3353486 - DNA, 12 bp, Homo sapiens
aaattttggcca

SEQ ID NO: 3353487 - DNA, 18 bp, Homo sapiens
aaattttggccaaagtgt

SEQ ID NO: 3353488 - DNA, 19 bp, Homo sapiens
aaatttttacctttatctt

SEQ ID NO: 3353489 - DNA, 13 bp, Homo sapiens
aaattttttggca

SEQ ID NO: 3353490 - DNA, 13 bp, Homo sapiens
aacaaaaaacaga

SEQ ID NO: 3353491 - DNA, 16 bp, Homo sapiens
aacaaaaaccagcagg

SEQ ID NO: 3353492 - DNA, 14 bp, Homo sapiens
aacaaaaatgccag

SEQ ID NO: 3353493 - DNA, 13 bp, Homo sapiens
aacaaaaattagg

SEQ ID NO: 3353494 - DNA, 20 bp, Homo sapiens
aacaaaaattgtctttatga

SEQ ID NO: 3353495 - DNA, 12 bp, Homo sapiens
aacaaaactgtt

SEQ ID NO: 3353496 - DNA, 14 bp, Homo sapiens
aacaaaactgttct

SEQ ID NO: 3353497 - DNA, 13 bp, Homo sapiens
aacaaaacttaaa

SEQ ID NO: 3353498 - DNA, 12 bp, Homo sapiens
aacaaaatagaa

SEQ ID NO: 3353499 - DNA, 20 bp, Homo sapiens
aacaaaatctcctcttttag

SEQ ID NO: 3353500 - DNA, 13 bp, Homo sapiens
aacaaaatctgaa

SEQ ID NO: 3353501 - DNA, 22 bp, Homo sapiens
aacaaaatttagtttttgttct

SEQ ID NO: 3353502 - DNA, 21 bp, Homo sapiens
aacaaaattttattttgtgct

SEQ ID NO: 3353503 - DNA, 15 bp, Homo sapiens
aacccaagacatcat

SEQ ID NO: 3353504 - DNA, 15 bp, Homo sapiens
aacccaagctcctcc

SEQ ID NO: 3353505 - DNA, 15 bp, Homo sapiens
aacccaagcttagaa

SEQ ID NO: 3353506 - DNA, 17 bp, Homo sapiens
aacccaaggagcacagg

SEQ ID NO: 3353507 - DNA, 20 bp, Homo sapiens
aacccaaggagcacaggtcc

SEQ ID NO: 3353508 - DNA, 21 bp, Homo sapiens
aacccaaggagcacaggtccc

SEQ ID NO: 3353509 - DNA, 14 bp, Homo sapiens
aacccaatccaaat

SEQ ID NO: 3353510 - DNA, 19 bp, Homo sapiens
aacccacaccgtcttcctt

SEQ ID NO: 3353511 - DNA, 18 bp, Homo sapiens
aacccacctctggccctg

SEQ ID NO: 3353512 - DNA, 19 bp, Homo sapiens
aacccacctctggccctgt

SEQ ID NO: 3353513 - DNA, 21 bp, Homo sapiens
aacccacttgtcactgacaca

SEQ ID NO: 3353514 - DNA, 19 bp, Homo sapiens
aacccagacaaccaaaaca

SEQ ID NO: 3353515 - DNA, 22 bp, Homo sapiens
aacccaggacatctcctggcta

SEQ ID NO: 3353516 - DNA, 16 bp, Homo sapiens
aacccaggacgcttct

SEQ ID NO: 3353517 - DNA, 18 bp, Homo sapiens
aacccaggacgcttctga

SEQ ID NO: 3353518 - DNA, 12 bp, Homo sapiens
aacccagggcaa

SEQ ID NO: 3353519 - DNA, 22 bp, Homo sapiens
aacccagggcaacaagcccgtt

SEQ ID NO: 3353520 - DNA, 12 bp, Homo sapiens
aacccagttact

SEQ ID NO: 3353521 - DNA, 15 bp, Homo sapiens
aacccatgagattca

SEQ ID NO: 3353522 - DNA, 17 bp, Homo sapiens
aacccattcactacagg

SEQ ID NO: 3353523 - DNA, 17 bp, Homo sapiens
aaccccaacgcacagga

SEQ ID NO: 3353524 - DNA, 15 bp, Homo sapiens
aaccccagcctgacc

SEQ ID NO: 3353525 - DNA, 21 bp, Homo sapiens
aaccccagcctgacctgagac

SEQ ID NO: 3353526 - DNA, 13 bp, Homo sapiens
aaccccagttctg

SEQ ID NO: 3353527 - DNA, 16 bp, Homo sapiens
aaccccagttctgctc

SEQ ID NO: 3353528 - DNA, 10 bp, Homo sapiens
aacccccacc

SEQ ID NO: 3353529 - DNA, 11 bp, Homo sapiens
aacccccaccc

SEQ ID NO: 3353530 - DNA, 13 bp, Homo sapiens
aacccccacccca

SEQ ID NO: 3353531 - DNA, 15 bp, Homo sapiens
aacccccaccccaca

SEQ ID NO: 3353532 - DNA, 18 bp, Homo sapiens
aacccccaccccacactt

SEQ ID NO: 3353533 - DNA, 16 bp, Homo sapiens
aacccccctcctgctc

SEQ ID NO: 3353534 - DNA, 19 bp, Homo sapiens
aacccccctcctgctcctc

SEQ ID NO: 3353535 - DNA, 22 bp, Homo sapiens
aacccccctcctgctcctccct

SEQ ID NO: 3353536 - DNA, 17 bp, Homo sapiens
aaccccgcggtgctctg

SEQ ID NO: 3353537 - DNA, 19 bp, Homo sapiens
aaccccgcggtgctctggc

SEQ ID NO: 3353538 - DNA, 21 bp, Homo sapiens
aaccccgcggtgctctggcgg

SEQ ID NO: 3353539 - DNA, 22 bp, Homo sapiens
aaccccgcggtgctctggcggc

SEQ ID NO: 3353540 - DNA, 21 bp, Homo sapiens
aacccctcccctccatccctg

SEQ ID NO: 3353541 - DNA, 21 bp, Homo sapiens
aacccctgatgtttgaagagt

SEQ ID NO: 3353542 - DNA, 13 bp, Homo sapiens
aacccctgtaccc

SEQ ID NO: 3353543 - DNA, 21 bp, Homo sapiens
aacccctgtacccagctcctt

SEQ ID NO: 3353544 - DNA, 10 bp, Homo sapiens
aacccctgtg

SEQ ID NO: 3353545 - DNA, 11 bp, Homo sapiens
aacccctgtgt

SEQ ID NO: 3353546 - DNA, 13 bp, Homo sapiens
aacccgaggggcc

SEQ ID NO: 3353547 - DNA, 16 bp, Homo sapiens
aacccggcttcctgtg

SEQ ID NO: 3353548 - DNA, 23 bp, Homo sapiens
aacccgggagcggaggttgcagt

SEQ ID NO: 3353549 - DNA, 15 bp, Homo sapiens
aacccgtctggccca

SEQ ID NO: 3353550 - DNA, 13 bp, Homo sapiens
aaccctagccttg

SEQ ID NO: 3353551 - DNA, 21 bp, Homo sapiens
aaccctatactgtagtattct

SEQ ID NO: 3353552 - DNA, 15 bp, Homo sapiens
aaccctatctcctga

SEQ ID NO: 3353553 - DNA, 19 bp, Homo sapiens
aaccctatctcctgacaga

SEQ ID NO: 3353554 - DNA, 20 bp, Homo sapiens
aaccctattcattagcatta

SEQ ID NO: 3353555 - DNA, 12 bp, Homo sapiens
aaccctcagagc

SEQ ID NO: 3353556 - DNA, 19 bp, Homo sapiens
aaccctcagagccacccct

SEQ ID NO: 3353557 - DNA, 17 bp, Homo sapiens
aaccctcaggggaaaac

SEQ ID NO: 3353558 - DNA, 16 bp, Homo sapiens
aaccctgctttttgac

SEQ ID NO: 3353559 - DNA, 20 bp, Homo sapiens
aaccctggggaaggagccag

SEQ ID NO: 3353560 - DNA, 21 bp, Homo sapiens
aaccctggggaaggagccagt

SEQ ID NO: 3353561 - DNA, 21 bp, Homo sapiens
aaccctgtgctggtgtcctga

SEQ ID NO: 3353562 - DNA, 15 bp, Homo sapiens
aaccctgttttatac

SEQ ID NO: 3353563 - DNA, 16 bp, Homo sapiens
aaccctgttttatact

SEQ ID NO: 3353564 - DNA, 20 bp, Homo sapiens
aaccctgttttatactgtac

SEQ ID NO: 3353565 - DNA, 21 bp, Homo sapiens
aacccttaccccttagcctcc

SEQ ID NO: 3353566 - DNA, 16 bp, Homo sapiens
aacccttgctgcttta

SEQ ID NO: 3353567 - DNA, 15 bp, Homo sapiens
aaccgagcaaagatc

SEQ ID NO: 3353568 - DNA, 17 bp, Homo sapiens
aaccgagcaaagatcaa

SEQ ID NO: 3353569 - DNA, 14 bp, Homo sapiens
aaccgcacagctca

SEQ ID NO: 3353570 - DNA, 18 bp, Homo sapiens
aaccgggagaaggcatga

SEQ ID NO: 3353571 - DNA, 16 bp, Homo sapiens
aaccgtctgttatgct

SEQ ID NO: 3353572 - DNA, 20 bp, Homo sapiens
aacctaaaataattggttct

SEQ ID NO: 3353573 - DNA, 14 bp, Homo sapiens
aacctaattaatat

SEQ ID NO: 3353574 - DNA, 15 bp, Homo sapiens
aacctaccagccaga

SEQ ID NO: 3353575 - DNA, 15 bp, Homo sapiens
aacctactgttcctt

SEQ ID NO: 3353576 - DNA, 15 bp, Homo sapiens
aacctagagaagata

SEQ ID NO: 3353577 - DNA, 20 bp, Homo sapiens
aacctagttaaagaaaggaa

SEQ ID NO: 3353578 - DNA, 16 bp, Homo sapiens
aacctatatgatttat

SEQ ID NO: 3353579 - DNA, 14 bp, Homo sapiens
aacctatccttcca

SEQ ID NO: 3353580 - DNA, 11 bp, Homo sapiens
aacctattttc

SEQ ID NO: 3353581 - DNA, 15 bp, Homo sapiens
aacctcaaagtgact

SEQ ID NO: 3353582 - DNA, 16 bp, Homo sapiens
aacctcaactgcctac

SEQ ID NO: 3353583 - DNA, 12 bp, Homo sapiens
aacctcaccatt

SEQ ID NO: 3353584 - DNA, 23 bp, Homo sapiens
aacctcaccattgtgaagcacct

SEQ ID NO: 3353585 - DNA, 23 bp, Homo sapiens
aacctcactatggtatgctggcc

SEQ ID NO: 3353586 - DNA, 22 bp, Homo sapiens
aacctcactgagaggcctggag

SEQ ID NO: 3353587 - DNA, 22 bp, Homo sapiens
aacctcagacttaccaggaagc

SEQ ID NO: 3353588 - DNA, 18 bp, Homo sapiens
aacctcagagtatcttta

SEQ ID NO: 3353589 - DNA, 21 bp, Homo sapiens
aacctcagctctgggagagga

SEQ ID NO: 3353590 - DNA, 19 bp, Homo sapiens
aacctcagtgtcatttatg

SEQ ID NO: 3353591 - DNA, 14 bp, Homo sapiens
aacctcattcccca

SEQ ID NO: 3353592 - DNA, 16 bp, Homo sapiens
aacctcattgacaaga

SEQ ID NO: 3353593 - DNA, 19 bp, Homo sapiens
aacctcattggccagctca

SEQ ID NO: 3353594 - DNA, 13 bp, Homo sapiens
aacctcccagagg

SEQ ID NO: 3353595 - DNA, 18 bp, Homo sapiens
aacctcccagaggtccag

SEQ ID NO: 3353596 - DNA, 24 bp, Homo sapiens
aacctcccagaggtccagcccatc

SEQ ID NO: 3353597 - DNA, 14 bp, Homo sapiens
aacctccctcttgt

SEQ ID NO: 3353598 - DNA, 16 bp, Homo sapiens
aacctccctcttgttt

SEQ ID NO: 3353599 - DNA, 15 bp, Homo sapiens
aacctcctgtggaac

SEQ ID NO: 3353600 - DNA, 22 bp, Homo sapiens
aacctcctgtggaacccagcag

SEQ ID NO: 3353601 - DNA, 9 bp, Homo sapiens
aacctctgg

SEQ ID NO: 3353602 - DNA, 15 bp, Homo sapiens
aacctctggcccttg

SEQ ID NO: 3353603 - DNA, 18 bp, Homo sapiens
aacctctggcccttggaa

SEQ ID NO: 3353604 - DNA, 17 bp, Homo sapiens
aacctcttctggctcaa

SEQ ID NO: 3353605 - DNA, 14 bp, Homo sapiens
aacctgaaagacaa

SEQ ID NO: 3353606 - DNA, 19 bp, Homo sapiens
aacctgacaaaaaaaaagt

SEQ ID NO: 3353607 - DNA, 18 bp, Homo sapiens
aacctgatgttaaaattc

SEQ ID NO: 3353608 - DNA, 11 bp, Homo sapiens
aacctggaaag

SEQ ID NO: 3353609 - DNA, 20 bp, Homo sapiens
aacctggattttttaaatca

SEQ ID NO: 3353610 - DNA, 17 bp, Homo sapiens
aacctgggattcaggaa

SEQ ID NO: 3353611 - DNA, 18 bp, Homo sapiens
aacctggggtgaatactt

SEQ ID NO: 3353612 - DNA, 21 bp, Homo sapiens
aacctggggtgaatacttatt

SEQ ID NO: 3353613 - DNA, 23 bp, Homo sapiens
aacctggggtgaatacttatttt

SEQ ID NO: 3353614 - DNA, 23 bp, Homo sapiens
aacctggtcacaggactctgcct

SEQ ID NO: 3353615 - DNA, 15 bp, Homo sapiens
aacctggttcatatt

SEQ ID NO: 3353616 - DNA, 22 bp, Homo sapiens
aacctggttcatatttatactt

SEQ ID NO: 3353617 - DNA, 23 bp, Homo sapiens
aacctgtcctaaggaaccttcct

SEQ ID NO: 3353618 - DNA, 15 bp, Homo sapiens
aacctgtctccactg

SEQ ID NO: 3353619 - DNA, 24 bp, Homo sapiens
aacctgtctccactgtgcctttgc

SEQ ID NO: 3353620 - DNA, 14 bp, Homo sapiens
aacctgtgccaggc

SEQ ID NO: 3353621 - DNA, 19 bp, Homo sapiens
aacctgttcttagagtgta

SEQ ID NO: 3353622 - DNA, 12 bp, Homo sapiens
aacctgttttgt

SEQ ID NO: 3353623 - DNA, 19 bp, Homo sapiens
aacctgtttttttttcatt

SEQ ID NO: 3353624 - DNA, 12 bp, Homo sapiens
aaccttaaaaca

SEQ ID NO: 3353625 - DNA, 16 bp, Homo sapiens
aaccttaaaacagctg

SEQ ID NO: 3353626 - DNA, 15 bp, Homo sapiens
aaccttattgtacct

SEQ ID NO: 3353627 - DNA, 16 bp, Homo sapiens
aaccttattgtacctc

SEQ ID NO: 3353628 - DNA, 18 bp, Homo sapiens
aaccttattgtacctctc

SEQ ID NO: 3353629 - DNA, 18 bp, Homo sapiens
aagaaatttattacttgt

SEQ ID NO: 3353630 - DNA, 14 bp, Homo sapiens
aagaacaaacaaaa

SEQ ID NO: 3353631 - DNA, 21 bp, Homo sapiens
aagaacaattgtccatggtct

SEQ ID NO: 3353632 - DNA, 21 bp, Homo sapiens
aagaacacaaagcggggggag

SEQ ID NO: 3353633 - DNA, 15 bp, Homo sapiens
aagaacacagcatgt

SEQ ID NO: 3353634 - DNA, 14 bp, Homo sapiens
aagaacacgaaata

SEQ ID NO: 3353635 - DNA, 20 bp, Homo sapiens
aagaacatcataaaattttt

SEQ ID NO: 3353636 - DNA, 18 bp, Homo sapiens
aagaacatccaaggagaa

SEQ ID NO: 3353637 - DNA, 22 bp, Homo sapiens
aagaacatggacttgtatattt

SEQ ID NO: 3353638 - DNA, 14 bp, Homo sapiens
aagaaccaaaactt

SEQ ID NO: 3353639 - DNA, 17 bp, Homo sapiens
aagaaccaaaacttcca

SEQ ID NO: 3353640 - DNA, 16 bp, Homo sapiens
aagaaccatgcaggaa

SEQ ID NO: 3353641 - DNA, 21 bp, Homo sapiens
aagaaccatgcaggaaggaaa

SEQ ID NO: 3353642 - DNA, 24 bp, Homo sapiens
aagaaccatgcaggaaggaaaact

SEQ ID NO: 3353643 - DNA, 22 bp, Homo sapiens
aagaacgcggtgtgtaacactg

SEQ ID NO: 3353644 - DNA, 22 bp, Homo sapiens
aagaactacccccttttcagct

SEQ ID NO: 3353645 - DNA, 23 bp, Homo sapiens
aagaactatatgtgaatcctctt

SEQ ID NO: 3353646 - DNA, 13 bp, Homo sapiens
aagaactccttat

SEQ ID NO: 3353647 - DNA, 23 bp, Homo sapiens
aagaactgcaggccctggcctcc

SEQ ID NO: 3353648 - DNA, 20 bp, Homo sapiens
aagaactgtgtttcaagttc

SEQ ID NO: 3353649 - DNA, 23 bp, Homo sapiens
aagaacttgatttgcatggattt

SEQ ID NO: 3353650 - DNA, 12 bp, Homo sapiens
aagaacttgttt

SEQ ID NO: 3353651 - DNA, 13 bp, Homo sapiens
aagaacttgttta

SEQ ID NO: 3353652 - DNA, 14 bp, Homo sapiens
aagaagaaaaaggt

SEQ ID NO: 3353653 - DNA, 23 bp, Homo sapiens
aagaagaaactccgaagaaaaga

SEQ ID NO: 3353654 - DNA, 15 bp, Homo sapiens
aagaagaaagactct

SEQ ID NO: 3353655 - DNA, 13 bp, Homo sapiens
aagaagaaagcaa

SEQ ID NO: 3353656 - DNA, 13 bp, Homo sapiens
aagaagaagggca

SEQ ID NO: 3353657 - DNA, 18 bp, Homo sapiens
aagaagacaaatgacaga

SEQ ID NO: 3353658 - DNA, 13 bp, Homo sapiens
aagaagacttttt

SEQ ID NO: 3353659 - DNA, 22 bp, Homo sapiens
aagaagatcacgctccccgcct

SEQ ID NO: 3353660 - DNA, 17 bp, Homo sapiens
aagaagatgttgaagaa

SEQ ID NO: 3353661 - DNA, 17 bp, Homo sapiens
aagaagccacagctctt

SEQ ID NO: 3353662 - DNA, 18 bp, Homo sapiens
aagaagctcgccccacct

SEQ ID NO: 3353663 - DNA, 19 bp, Homo sapiens
aagaagctcgccccacctc

SEQ ID NO: 3353664 - DNA, 20 bp, Homo sapiens
aagaagctcgccccacctcc

SEQ ID NO: 3353665 - DNA, 22 bp, Homo sapiens
aagaagcttctaataaattata

SEQ ID NO: 3353666 - DNA, 17 bp, Homo sapiens
aagaaggaaagaaccga

SEQ ID NO: 3353667 - DNA, 22 bp, Homo sapiens
aagaaggaaagaaccgaagagc

SEQ ID NO: 3353668 - DNA, 14 bp, Homo sapiens
aagaaggaagctgt

SEQ ID NO: 3353669 - DNA, 16 bp, Homo sapiens
aagaagggctggtatt

SEQ ID NO: 3353670 - DNA, 22 bp, Homo sapiens
aagaaggggggtctctggcttt

SEQ ID NO: 3353671 - DNA, 14 bp, Homo sapiens
aagaagtggagaca

SEQ ID NO: 3353672 - DNA, 15 bp, Homo sapiens
aagaagtggagacag

SEQ ID NO: 3353673 - DNA, 16 bp, Homo sapiens
aagaagtggagacagt

SEQ ID NO: 3353674 - DNA, 16 bp, Homo sapiens
aagaagttactttgta

SEQ ID NO: 3353675 - DNA, 17 bp, Homo sapiens
aagaagttcatgtccaa

SEQ ID NO: 3353676 - DNA, 12 bp, Homo sapiens
aagaagtttatt

SEQ ID NO: 3353677 - DNA, 23 bp, Homo sapiens
aagaagttttaaaaagccagttt

SEQ ID NO: 3353678 - DNA, 13 bp, Homo sapiens
aagaataataaaa

SEQ ID NO: 3353679 - DNA, 14 bp, Homo sapiens
aagaataataaaat

SEQ ID NO: 3353680 - DNA, 16 bp, Homo sapiens
aagaataataaaatca

SEQ ID NO: 3353681 - DNA, 21 bp, Homo sapiens
aagaataatatgctgccaaat

SEQ ID NO: 3353682 - DNA, 19 bp, Homo sapiens
aagaataggcattaacaca

SEQ ID NO: 3353683 - DNA, 19 bp, Homo sapiens
aagaatatctgtaatggta

SEQ ID NO: 3353684 - DNA, 20 bp, Homo sapiens
aagaatatctgtaatggtac

SEQ ID NO: 3353685 - DNA, 14 bp, Homo sapiens
aagaatatgacttt

SEQ ID NO: 3353686 - DNA, 22 bp, Homo sapiens
aagaatatttaagaaaagcact

SEQ ID NO: 3353687 - DNA, 23 bp, Homo sapiens
aagaatcagtctatccacagaga

SEQ ID NO: 3353688 - DNA, 21 bp, Homo sapiens
aagaatgcacaagaatggatc

SEQ ID NO: 3353689 - DNA, 14 bp, Homo sapiens
aagaatgcattcaa

SEQ ID NO: 3353690 - DNA, 19 bp, Homo sapiens
aagaatgctggttttccta

SEQ ID NO: 3353691 - DNA, 22 bp, Homo sapiens
aagaatgctggttttcctaaat

SEQ ID NO: 3353692 - DNA, 14 bp, Homo sapiens
aagaatgtctgtac

SEQ ID NO: 3353693 - DNA, 20 bp, Homo sapiens
aagaatgttggtttactttc

SEQ ID NO: 3353694 - DNA, 18 bp, Homo sapiens
aagaattaagatacaaat

SEQ ID NO: 3353695 - DNA, 19 bp, Homo sapiens
aagaattatgtaatatatt

SEQ ID NO: 3353696 - DNA, 21 bp, Homo sapiens
aagaattatgtaatatattgt

SEQ ID NO: 3353697 - DNA, 23 bp, Homo sapiens
aagaattctgtgagaaaaaattt

SEQ ID NO: 3353698 - DNA, 20 bp, Homo sapiens
aagaattgaaaagtttttgt

SEQ ID NO: 3353699 - DNA, 21 bp, Homo sapiens
aagaattgaccatctgctttt

SEQ ID NO: 3353700 - DNA, 15 bp, Homo sapiens
aagaatttagatctt

SEQ ID NO: 3353701 - DNA, 16 bp, Homo sapiens
aagaatttagatctta

SEQ ID NO: 3353702 - DNA, 16 bp, Homo sapiens
aagacaaaagtctgtc

SEQ ID NO: 3353703 - DNA, 22 bp, Homo sapiens
aagacaaaagtctgtctttcct

SEQ ID NO: 3353704 - DNA, 17 bp, Homo sapiens
aagacaaaggttttcct

SEQ ID NO: 3353705 - DNA, 22 bp, Homo sapiens
aagacaaatgacagattctgac

SEQ ID NO: 3353706 - DNA, 23 bp, Homo sapiens
aagacaagtatgaatattactct

SEQ ID NO: 3353707 - DNA, 17 bp, Homo sapiens
aagacaatagtatttct

SEQ ID NO: 3353708 - DNA, 22 bp, Homo sapiens
aagacacaaggtgatttcagac

SEQ ID NO: 3353709 - DNA, 17 bp, Homo sapiens
aagacaccaaatataac

SEQ ID NO: 3353710 - DNA, 13 bp, Homo sapiens
aagacaccagagc

SEQ ID NO: 3353711 - DNA, 15 bp, Homo sapiens
aagacaccagagcag

SEQ ID NO: 3353712 - DNA, 21 bp, Homo sapiens
aagacaccagagcagatgcag

SEQ ID NO: 3353713 - DNA, 22 bp, Homo sapiens
aagacaccagagcagatgcaga

SEQ ID NO: 3353714 - DNA, 22 bp, Homo sapiens
aagacacttcagatctgaggtt

SEQ ID NO: 3353715 - DNA, 20 bp, Homo sapiens
aagacagatgccccagagct

SEQ ID NO: 3353716 - DNA, 16 bp, Homo sapiens
aagacagcatttaaag

SEQ ID NO: 3353717 - DNA, 23 bp, Homo sapiens
aagacaggacagtgcttcagcct

SEQ ID NO: 3353718 - DNA, 22 bp, Homo sapiens
aagacaggatgggggctggcct

SEQ ID NO: 3353719 - DNA, 15 bp, Homo sapiens
aagacagtatttatt

SEQ ID NO: 3353720 - DNA, 19 bp, Homo sapiens
aagacataacgtttttcct

SEQ ID NO: 3353721 - DNA, 22 bp, Homo sapiens
aagacataacgtttttccttta

SEQ ID NO: 3353722 - DNA, 18 bp, Homo sapiens
aagacatagcatccaagt

SEQ ID NO: 3353723 - DNA, 15 bp, Homo sapiens
aagacatatctctaa

SEQ ID NO: 3353724 - DNA, 16 bp, Homo sapiens
aagacatcagtctcca

SEQ ID NO: 3353725 - DNA, 22 bp, Homo sapiens
aagacatcatgtatcgcatatt

SEQ ID NO: 3353726 - DNA, 18 bp, Homo sapiens
aagacatgaatgcacact

SEQ ID NO: 3353727 - DNA, 16 bp, Homo sapiens
aagacatgatttcctt

SEQ ID NO: 3353728 - DNA, 19 bp, Homo sapiens
aagacatgtgaggaggaaa

SEQ ID NO: 3353729 - DNA, 18 bp, Homo sapiens
aagacatgttgtaaatta

SEQ ID NO: 3353730 - DNA, 19 bp, Homo sapiens
aagacatgttgtaaattag

SEQ ID NO: 3353731 - DNA, 21 bp, Homo sapiens
aagacattcttccaaaaagat

SEQ ID NO: 3353732 - DNA, 12 bp, Homo sapiens
aagacatttgta

SEQ ID NO: 3353733 - DNA, 13 bp, Homo sapiens
aagacatttgtat

SEQ ID NO: 3353734 - DNA, 20 bp, Homo sapiens
aagacattttcatgcttcca

SEQ ID NO: 3353735 - DNA, 20 bp, Homo sapiens
aagaccaatttatgggagaa

SEQ ID NO: 3353736 - DNA, 12 bp, Homo sapiens
aagaccagcctg

SEQ ID NO: 3353737 - DNA, 20 bp, Homo sapiens
aagaccagcctggccatcat

SEQ ID NO: 3353738 - DNA, 16 bp, Homo sapiens
aagaccctcttgccca

SEQ ID NO: 3353739 - DNA, 13 bp, Homo sapiens
aagaccctgagac

SEQ ID NO: 3353740 - DNA, 15 bp, Homo sapiens
aagaccgccccccgc

SEQ ID NO: 3353741 - DNA, 22 bp, Homo sapiens
aagaccgtgtcccaaggagctg

SEQ ID NO: 3353742 - DNA, 17 bp, Homo sapiens
aagacctacattccctc

SEQ ID NO: 3353743 - DNA, 22 bp, Homo sapiens
aagacctactgttctaaagctc

SEQ ID NO: 3353744 - DNA, 18 bp, Homo sapiens
aagacctagtgctcttaa

SEQ ID NO: 3353745 - DNA, 17 bp, Homo sapiens
aagacctcacctagaaa

SEQ ID NO: 3353746 - DNA, 21 bp, Homo sapiens
aagaccttctccaaatgagat

SEQ ID NO: 3353747 - DNA, 15 bp, Homo sapiens
aagacgcctgagctc

SEQ ID NO: 3353748 - DNA, 19 bp, Homo sapiens
aagacggttaaatactgtg

SEQ ID NO: 3353749 - DNA, 18 bp, Homo sapiens
aagacgtaataaaattaa

SEQ ID NO: 3353750 - DNA, 18 bp, Homo sapiens
aagacgtttaactgcagt

SEQ ID NO: 3353751 - DNA, 20 bp, Homo sapiens
aagactatatatataaatgt

SEQ ID NO: 3353752 - DNA, 22 bp, Homo sapiens
aagactatatatataaatgtat

SEQ ID NO: 3353753 - DNA, 18 bp, Homo sapiens
aagcagggaaagctccac

SEQ ID NO: 3353754 - DNA, 20 bp, Homo sapiens
aagcagggaaagctccacgg

SEQ ID NO: 3353755 - DNA, 17 bp, Homo sapiens
aagcagggaatttctat

SEQ ID NO: 3353756 - DNA, 12 bp, Homo sapiens
aagcagggcagc

SEQ ID NO: 3353757 - DNA, 22 bp, Homo sapiens
aagcaggggtggggggtgcagg

SEQ ID NO: 3353758 - DNA, 14 bp, Homo sapiens
aagcagggtaccct

SEQ ID NO: 3353759 - DNA, 23 bp, Homo sapiens
aagcagggtaccctttggggagc

SEQ ID NO: 3353760 - DNA, 14 bp, Homo sapiens
aagcaggtgctaca

SEQ ID NO: 3353761 - DNA, 22 bp, Homo sapiens
aagcaggttgaggggctcctgg

SEQ ID NO: 3353762 - DNA, 21 bp, Homo sapiens
aagcagtagaaataatatgca

SEQ ID NO: 3353763 - DNA, 20 bp, Homo sapiens
aagcagtatattagtattat

SEQ ID NO: 3353764 - DNA, 15 bp, Homo sapiens
aagcagtattttggt

SEQ ID NO: 3353765 - DNA, 15 bp, Homo sapiens
aagcagtcccattca

SEQ ID NO: 3353766 - DNA, 18 bp, Homo sapiens
aagcagtcgtgcctgtgt

SEQ ID NO: 3353767 - DNA, 14 bp, Homo sapiens
aagcagtcttgctc

SEQ ID NO: 3353768 - DNA, 12 bp, Homo sapiens
aagcagtgcctc

SEQ ID NO: 3353769 - DNA, 21 bp, Homo sapiens
aagcagtgcctcgaggcaccg

SEQ ID NO: 3353770 - DNA, 13 bp, Homo sapiens
aagcataaggccg

SEQ ID NO: 3353771 - DNA, 22 bp, Homo sapiens
aagcatacatgcaaaaagaaat

SEQ ID NO: 3353772 - DNA, 22 bp, Homo sapiens
aagcatagataatattgtttgg

SEQ ID NO: 3353773 - DNA, 14 bp, Homo sapiens
aagcatagatgttt

SEQ ID NO: 3353774 - DNA, 15 bp, Homo sapiens
aagcatagatgtttt

SEQ ID NO: 3353775 - DNA, 17 bp, Homo sapiens
aagcatagatgttttgg

SEQ ID NO: 3353776 - DNA, 21 bp, Homo sapiens
aagcatatgtgttacttcaag

SEQ ID NO: 3353777 - DNA, 16 bp, Homo sapiens
aagcatcacctcaggc

SEQ ID NO: 3353778 - DNA, 22 bp, Homo sapiens
aagcatcagagatggtaatcta

SEQ ID NO: 3353779 - DNA, 17 bp, Homo sapiens
aagcatccatgtgtgga

SEQ ID NO: 3353780 - DNA, 20 bp, Homo sapiens
aagcatccatgtgtggactc

SEQ ID NO: 3353781 - DNA, 21 bp, Homo sapiens
aagcatcctccacatcctgtg

SEQ ID NO: 3353782 - DNA, 17 bp, Homo sapiens
aagcatctggctctaat

SEQ ID NO: 3353783 - DNA, 19 bp, Homo sapiens
aagcatctggctctaattc

SEQ ID NO: 3353784 - DNA, 21 bp, Homo sapiens
aagcatgacaacttttaaaga

SEQ ID NO: 3353785 - DNA, 19 bp, Homo sapiens
aagcatgatgggaaaatat

SEQ ID NO: 3353786 - DNA, 23 bp, Homo sapiens
aagcatgatgggaaaatatttcc

SEQ ID NO: 3353787 - DNA, 16 bp, Homo sapiens
aagcatgctttgctgc

SEQ ID NO: 3353788 - DNA, 19 bp, Homo sapiens
aagcatgtggcatgttcat

SEQ ID NO: 3353789 - DNA, 15 bp, Homo sapiens
aagcatgtttcatgt

SEQ ID NO: 3353790 - DNA, 18 bp, Homo sapiens
aagcattaacttctctgg

SEQ ID NO: 3353791 - DNA, 16 bp, Homo sapiens
aagcattccttctttg

SEQ ID NO: 3353792 - DNA, 22 bp, Homo sapiens
aagcattccttctttgataatg

SEQ ID NO: 3353793 - DNA, 23 bp, Homo sapiens
aagcattctccccagtgtatgtc

SEQ ID NO: 3353794 - DNA, 14 bp, Homo sapiens
aagcattgaaatta

SEQ ID NO: 3353795 - DNA, 17 bp, Homo sapiens
aagcattgaaattatag

SEQ ID NO: 3353796 - DNA, 13 bp, Homo sapiens
aagcattgcctgg

SEQ ID NO: 3353797 - DNA, 22 bp, Homo sapiens
aagcattgcttttattttgaaa

SEQ ID NO: 3353798 - DNA, 15 bp, Homo sapiens
aagcattgtctctct

SEQ ID NO: 3353799 - DNA, 14 bp, Homo sapiens
aagcattgtttgct

SEQ ID NO: 3353800 - DNA, 14 bp, Homo sapiens
aagcatttgtattt

SEQ ID NO: 3353801 - DNA, 17 bp, Homo sapiens
aagcatttgtattttgt

SEQ ID NO: 3353802 - DNA, 19 bp, Homo sapiens
aagcatttgtattttgtgt

SEQ ID NO: 3353803 - DNA, 17 bp, Homo sapiens
aagccaaaaaccttagc

SEQ ID NO: 3353804 - DNA, 16 bp, Homo sapiens
aagccaaacaaaactg

SEQ ID NO: 3353805 - DNA, 15 bp, Homo sapiens
aagccaaacaagcct

SEQ ID NO: 3353806 - DNA, 18 bp, Homo sapiens
aagccaaacaagccttag

SEQ ID NO: 3353807 - DNA, 14 bp, Homo sapiens
aagccaaactctgc

SEQ ID NO: 3353808 - DNA, 15 bp, Homo sapiens
aagccaaactctgcc

SEQ ID NO: 3353809 - DNA, 12 bp, Homo sapiens
aagccaaagaaa

SEQ ID NO: 3353810 - DNA, 18 bp, Homo sapiens
aagccaaagaaacaagct

SEQ ID NO: 3353811 - DNA, 19 bp, Homo sapiens
aagccaaagaaatgaacat

SEQ ID NO: 3353812 - DNA, 23 bp, Homo sapiens
aagccaaagaaatgaacattcca

SEQ ID NO: 3353813 - DNA, 18 bp, Homo sapiens
aagccaaagctaggcctg

SEQ ID NO: 3353814 - DNA, 20 bp, Homo sapiens
aagccaaagctaggcctggc

SEQ ID NO: 3353815 - DNA, 22 bp, Homo sapiens
aagccaaagctaggcctggcca

SEQ ID NO: 3353816 - DNA, 21 bp, Homo sapiens
aagccaaccttcaaagaaact

SEQ ID NO: 3353817 - DNA, 16 bp, Homo sapiens
aagccaacgacaaagc

SEQ ID NO: 3353818 - DNA, 19 bp, Homo sapiens
aagccaacttgtaaataca

SEQ ID NO: 3353819 - DNA, 14 bp, Homo sapiens
aagccaagggaaag

SEQ ID NO: 3353820 - DNA, 16 bp, Homo sapiens
aagccaagggaaaggg

SEQ ID NO: 3353821 - DNA, 19 bp, Homo sapiens
aagccaagggaacctgtgt

SEQ ID NO: 3353822 - DNA, 15 bp, Homo sapiens
aagccaatcccctcc

SEQ ID NO: 3353823 - DNA, 18 bp, Homo sapiens
aagccacaagaaatttga

SEQ ID NO: 3353824 - DNA, 15 bp, Homo sapiens
aagccacaaggctgg

SEQ ID NO: 3353825 - DNA, 18 bp, Homo sapiens
aagccacaaggctggcca

SEQ ID NO: 3353826 - DNA, 18 bp, Homo sapiens
aagccacaagtcttccag

SEQ ID NO: 3353827 - DNA, 18 bp, Homo sapiens
aagccacattatttctag

SEQ ID NO: 3353828 - DNA, 11 bp, Homo sapiens
aagccacctct

SEQ ID NO: 3353829 - DNA, 13 bp, Homo sapiens
aagccacctctcc

SEQ ID NO: 3353830 - DNA, 12 bp, Homo sapiens
aagccagagcct

SEQ ID NO: 3353831 - DNA, 14 bp, Homo sapiens
aagccagaggctgg

SEQ ID NO: 3353832 - DNA, 17 bp, Homo sapiens
aagccagattctcttga

SEQ ID NO: 3353833 - DNA, 10 bp, Homo sapiens
aagccagcca

SEQ ID NO: 3353834 - DNA, 11 bp, Homo sapiens
aagccagccac

SEQ ID NO: 3353835 - DNA, 12 bp, Homo sapiens
aagccagccaca

SEQ ID NO: 3353836 - DNA, 14 bp, Homo sapiens
aagccagccacaga

SEQ ID NO: 3353837 - DNA, 19 bp, Homo sapiens
aagccagcctgaccttcct

SEQ ID NO: 3353838 - DNA, 19 bp, Homo sapiens
aagccagctctaggcttca

SEQ ID NO: 3353839 - DNA, 21 bp, Homo sapiens
aagccagctgccgaccagagc

SEQ ID NO: 3353840 - DNA, 12 bp, Homo sapiens
aagccagctttc

SEQ ID NO: 3353841 - DNA, 19 bp, Homo sapiens
aagccagggtctctccctc

SEQ ID NO: 3353842 - DNA, 20 bp, Homo sapiens
aagccagggtctctccctca

SEQ ID NO: 3353843 - DNA, 15 bp, Homo sapiens
aagccaggtacagga

SEQ ID NO: 3353844 - DNA, 22 bp, Homo sapiens
aagccaggtacaggagaggcag

SEQ ID NO: 3353845 - DNA, 20 bp, Homo sapiens
aagccagtgaaatgtgaagg

SEQ ID NO: 3353846 - DNA, 23 bp, Homo sapiens
aagccagtttgggtaaaatactt

SEQ ID NO: 3353847 - DNA, 18 bp, Homo sapiens
aagccataattgttctta

SEQ ID NO: 3353848 - DNA, 19 bp, Homo sapiens
aagccatcatatcccctgt

SEQ ID NO: 3353849 - DNA, 21 bp, Homo sapiens
aagccatgtactcaagtacca

SEQ ID NO: 3353850 - DNA, 17 bp, Homo sapiens
aagccattgaccaccca

SEQ ID NO: 3353851 - DNA, 11 bp, Homo sapiens
aagcccagact

SEQ ID NO: 3353852 - DNA, 16 bp, Homo sapiens
aagcccagactttagt

SEQ ID NO: 3353853 - DNA, 17 bp, Homo sapiens
aagcccagtgctgctgt

SEQ ID NO: 3353854 - DNA, 13 bp, Homo sapiens
aagccccagcagc

SEQ ID NO: 3353855 - DNA, 13 bp, Homo sapiens
aagccccagggcc

SEQ ID NO: 3353856 - DNA, 16 bp, Homo sapiens
aagccccagggcctgg

SEQ ID NO: 3353857 - DNA, 16 bp, Homo sapiens
aagcccctcagccctt

SEQ ID NO: 3353858 - DNA, 19 bp, Homo sapiens
aagcccgcctgacagaaac

SEQ ID NO: 3353859 - DNA, 22 bp, Homo sapiens
aagccctactcggatggggcac

SEQ ID NO: 3353860 - DNA, 13 bp, Homo sapiens
aagccctcccagg

SEQ ID NO: 3353861 - DNA, 19 bp, Homo sapiens
aagccctgaggcctgaggc

SEQ ID NO: 3353862 - DNA, 21 bp, Homo sapiens
aagccctgaggcctgaggcct

SEQ ID NO: 3353863 - DNA, 17 bp, Homo sapiens
aagccctgcttttgcat

SEQ ID NO: 3353864 - DNA, 23 bp, Homo sapiens
aagccctggagccaactgctgct

SEQ ID NO: 3353865 - DNA, 19 bp, Homo sapiens
aagccctgtcgagacactt

SEQ ID NO: 3353866 - DNA, 23 bp, Homo sapiens
aagcccttccatgtcgcctctgc

SEQ ID NO: 3353867 - DNA, 16 bp, Homo sapiens
aagccctttttatcag

SEQ ID NO: 3353868 - DNA, 14 bp, Homo sapiens
aagccgactctggc

SEQ ID NO: 3353869 - DNA, 21 bp, Homo sapiens
aagccgactctggccctggcc

SEQ ID NO: 3353870 - DNA, 17 bp, Homo sapiens
aagccgttgacaaggct

SEQ ID NO: 3353871 - DNA, 16 bp, Homo sapiens
aagcctaaatgcctta

SEQ ID NO: 3353872 - DNA, 14 bp, Homo sapiens
aagcctaagaatct

SEQ ID NO: 3353873 - DNA, 17 bp, Homo sapiens
aagcctaagggatcctg

SEQ ID NO: 3353874 - DNA, 14 bp, Homo sapiens
aagcctcatattta

SEQ ID NO: 3353875 - DNA, 19 bp, Homo sapiens
aagcctccaagcctgcctc

SEQ ID NO: 3353876 - DNA, 14 bp, Homo sapiens
aagcctctgctgcc

SEQ ID NO: 3353877 - DNA, 15 bp, Homo sapiens
aagcctctgcttccg

SEQ ID NO: 3353878 - DNA, 14 bp, Homo sapiens
aagcctctggctag

SEQ ID NO: 3353879 - DNA, 11 bp, Homo sapiens
aaggttttttt

SEQ ID NO: 3353880 - DNA, 19 bp, Homo sapiens
aagtaaaggcctcctcccc

SEQ ID NO: 3353881 - DNA, 12 bp, Homo sapiens
aagtaaatgcta

SEQ ID NO: 3353882 - DNA, 22 bp, Homo sapiens
aagtaaccaactgaacgacaaa

SEQ ID NO: 3353883 - DNA, 15 bp, Homo sapiens
aagtaacgcaataaa

SEQ ID NO: 3353884 - DNA, 14 bp, Homo sapiens
aagtaacttaagga

SEQ ID NO: 3353885 - DNA, 18 bp, Homo sapiens
aagtaagaaagtgaagca

SEQ ID NO: 3353886 - DNA, 16 bp, Homo sapiens
aagtaagacttttatt

SEQ ID NO: 3353887 - DNA, 20 bp, Homo sapiens
aagtaagagtactgggagaa

SEQ ID NO: 3353888 - DNA, 15 bp, Homo sapiens
aagtaaggtgcagtt

SEQ ID NO: 3353889 - DNA, 12 bp, Homo sapiens
aagtaagttaat

SEQ ID NO: 3353890 - DNA, 18 bp, Homo sapiens
aagtaatctttaaactgg

SEQ ID NO: 3353891 - DNA, 15 bp, Homo sapiens
aagtaatgtattagt

SEQ ID NO: 3353892 - DNA, 22 bp, Homo sapiens
aagtaattatcgggaacagtgt

SEQ ID NO: 3353893 - DNA, 14 bp, Homo sapiens
aagtaattttgtca

SEQ ID NO: 3353894 - DNA, 12 bp, Homo sapiens
aagtacaatgaa

SEQ ID NO: 3353895 - DNA, 12 bp, Homo sapiens
aagtacatttaa

SEQ ID NO: 3353896 - DNA, 16 bp, Homo sapiens
aagtaccaaagtttta

SEQ ID NO: 3353897 - DNA, 14 bp, Homo sapiens
aagtaccacactga

SEQ ID NO: 3353898 - DNA, 16 bp, Homo sapiens
aagtaccacactgagt

SEQ ID NO: 3353899 - DNA, 16 bp, Homo sapiens
aagtacgttattgttg

SEQ ID NO: 3353900 - DNA, 20 bp, Homo sapiens
aagtactgtaataatacctc

SEQ ID NO: 3353901 - DNA, 22 bp, Homo sapiens
aagtactgtaataatacctcaa

SEQ ID NO: 3353902 - DNA, 13 bp, Homo sapiens
aagtacttaaact

SEQ ID NO: 3353903 - DNA, 20 bp, Homo sapiens
aagtacttaaacttccacaa

SEQ ID NO: 3353904 - DNA, 23 bp, Homo sapiens
aagtacttccacttgtgtatatt

SEQ ID NO: 3353905 - DNA, 20 bp, Homo sapiens
aagtacttctccaccctgct

SEQ ID NO: 3353906 - DNA, 23 bp, Homo sapiens
aagtacttctccaccctgctctc

SEQ ID NO: 3353907 - DNA, 14 bp, Homo sapiens
aagtacttgagtgt

SEQ ID NO: 3353908 - DNA, 21 bp, Homo sapiens
aagtacttgagtgtaatgttt

SEQ ID NO: 3353909 - DNA, 19 bp, Homo sapiens
aagtactttaaaaaggaaa

SEQ ID NO: 3353910 - DNA, 20 bp, Homo sapiens
aagtactttcttataaattt

SEQ ID NO: 3353911 - DNA, 18 bp, Homo sapiens
aagtagaaaagttgcaga

SEQ ID NO: 3353912 - DNA, 23 bp, Homo sapiens
aagtagaaaagttgcagatgtat

SEQ ID NO: 3353913 - DNA, 19 bp, Homo sapiens
aagtagaagtcttagatgt

SEQ ID NO: 3353914 - DNA, 21 bp, Homo sapiens
aagtagaagtcttagatgtat

SEQ ID NO: 3353915 - DNA, 15 bp, Homo sapiens
aagtaggaaaaataa

SEQ ID NO: 3353916 - DNA, 23 bp, Homo sapiens
aagtagttctgtttggtgtgtcc

SEQ ID NO: 3353917 - DNA, 19 bp, Homo sapiens
aagtagttggtttgtatga

SEQ ID NO: 3353918 - DNA, 18 bp, Homo sapiens
aagtataatctttctata

SEQ ID NO: 3353919 - DNA, 22 bp, Homo sapiens
aagtataatgtttattaaatgc

SEQ ID NO: 3353920 - DNA, 12 bp, Homo sapiens
aagtatacagtt

SEQ ID NO: 3353921 - DNA, 14 bp, Homo sapiens
aagtatacttttcc

SEQ ID NO: 3353922 - DNA, 13 bp, Homo sapiens
aagtatagagaga

SEQ ID NO: 3353923 - DNA, 23 bp, Homo sapiens
aagtatagagagaagttcataca

SEQ ID NO: 3353924 - DNA, 18 bp, Homo sapiens
aagtatataaattggctt

SEQ ID NO: 3353925 - DNA, 22 bp, Homo sapiens
aagtatataatttttttatgtt

SEQ ID NO: 3353926 - DNA, 22 bp, Homo sapiens
aagtatatacttttaaattatg

SEQ ID NO: 3353927 - DNA, 16 bp, Homo sapiens
aagtatatatagaatc

SEQ ID NO: 3353928 - DNA, 16 bp, Homo sapiens
aagtatcactctaaaa

SEQ ID NO: 3353929 - DNA, 21 bp, Homo sapiens
aagtatcactctaaaaaacat

SEQ ID NO: 3353930 - DNA, 21 bp, Homo sapiens
aagtatctgggattattcttt

SEQ ID NO: 3353931 - DNA, 21 bp, Homo sapiens
aagtatgcattattaaattgt

SEQ ID NO: 3353932 - DNA, 13 bp, Homo sapiens
aagtatgtaaaca

SEQ ID NO: 3353933 - DNA, 18 bp, Homo sapiens
aagtatgtgtaaaatgtg

SEQ ID NO: 3353934 - DNA, 14 bp, Homo sapiens
aagtatgtttttaa

SEQ ID NO: 3353935 - DNA, 20 bp, Homo sapiens
aagtattagacttctaaata

SEQ ID NO: 3353936 - DNA, 15 bp, Homo sapiens
aagtattatgtctct

SEQ ID NO: 3353937 - DNA, 16 bp, Homo sapiens
aagtattattcaaacc

SEQ ID NO: 3353938 - DNA, 19 bp, Homo sapiens
aagtattcaacaatttcaa

SEQ ID NO: 3353939 - DNA, 13 bp, Homo sapiens
aagtattcataca

SEQ ID NO: 3353940 - DNA, 21 bp, Homo sapiens
aagtattcttatttaatgaaa

SEQ ID NO: 3353941 - DNA, 23 bp, Homo sapiens
aagtattcttatttaatgaaaga

SEQ ID NO: 3353942 - DNA, 14 bp, Homo sapiens
aagtatttatatat

SEQ ID NO: 3353943 - DNA, 15 bp, Homo sapiens
aagtatttatatatt

SEQ ID NO: 3353944 - DNA, 20 bp, Homo sapiens
aagtatttatatatttataa

SEQ ID NO: 3353945 - DNA, 21 bp, Homo sapiens
aagtatttatatatttataac

SEQ ID NO: 3353946 - DNA, 18 bp, Homo sapiens
aagtatttttttaagtta

SEQ ID NO: 3353947 - DNA, 13 bp, Homo sapiens
aagtcaaaaggaa

SEQ ID NO: 3353948 - DNA, 14 bp, Homo sapiens
aagtcaaaaggaac

SEQ ID NO: 3353949 - DNA, 20 bp, Homo sapiens
aagtcaacactatatatttt

SEQ ID NO: 3353950 - DNA, 18 bp, Homo sapiens
aagtcaatcatttctcac

SEQ ID NO: 3353951 - DNA, 22 bp, Homo sapiens
aagtcaatcatttctcactgtg

SEQ ID NO: 3353952 - DNA, 24 bp, Homo sapiens
aagtcacacagtattacttctgct

SEQ ID NO: 3353953 - DNA, 12 bp, Homo sapiens
aagtcacagctg

SEQ ID NO: 3353954 - DNA, 14 bp, Homo sapiens
aagtcacagctgca

SEQ ID NO: 3353955 - DNA, 16 bp, Homo sapiens
aagtcacagctgcagc

SEQ ID NO: 3353956 - DNA, 22 bp, Homo sapiens
aagtcacagctgcagctgggcc

SEQ ID NO: 3353957 - DNA, 23 bp, Homo sapiens
aagtcacagctgcagctgggccc

SEQ ID NO: 3353958 - DNA, 21 bp, Homo sapiens
aagtcactcaattgtttttgt

SEQ ID NO: 3353959 - DNA, 14 bp, Homo sapiens
aagtcactgcacag

SEQ ID NO: 3353960 - DNA, 22 bp, Homo sapiens
aagtcactgcacagtgcatctc

SEQ ID NO: 3353961 - DNA, 18 bp, Homo sapiens
aagtcagaatcagaagat

SEQ ID NO: 3353962 - DNA, 20 bp, Homo sapiens
aagtcagactgctgggactg

SEQ ID NO: 3353963 - DNA, 23 bp, Homo sapiens
aagtcagaggatggccagtgtct

SEQ ID NO: 3353964 - DNA, 20 bp, Homo sapiens
aagtcagatggaaaattcat

SEQ ID NO: 3353965 - DNA, 20 bp, Homo sapiens
aagtcagcgggcccaggcct

SEQ ID NO: 3353966 - DNA, 20 bp, Homo sapiens
aagtcagctccagctttctg

SEQ ID NO: 3353967 - DNA, 20 bp, Homo sapiens
aagtcagctttcagagccag

SEQ ID NO: 3353968 - DNA, 21 bp, Homo sapiens
aagtcaggcccttattttcaa

SEQ ID NO: 3353969 - DNA, 12 bp, Homo sapiens
aagtcagtcacg

SEQ ID NO: 3353970 - DNA, 23 bp, Homo sapiens
aagtcagtccaggatgctaacat

SEQ ID NO: 3353971 - DNA, 20 bp, Homo sapiens
aagtcagttgctcaaaaaga

SEQ ID NO: 3353972 - DNA, 23 bp, Homo sapiens
aagtcatcttgctaccagtattt

SEQ ID NO: 3353973 - DNA, 19 bp, Homo sapiens
aagtcattccttcttttta

SEQ ID NO: 3353974 - DNA, 12 bp, Homo sapiens
aagtcattgttt

SEQ ID NO: 3353975 - DNA, 15 bp, Homo sapiens
aagtcattttcatgt

SEQ ID NO: 3353976 - DNA, 18 bp, Homo sapiens
aagtccgcagaagccctg

SEQ ID NO: 3353977 - DNA, 19 bp, Homo sapiens
aagtcctggctacatccca

SEQ ID NO: 3353978 - DNA, 20 bp, Homo sapiens
aagtccttgacctctataaa

SEQ ID NO: 3353979 - DNA, 13 bp, Homo sapiens
aagtcctttatgt

SEQ ID NO: 3353980 - DNA, 16 bp, Homo sapiens
aagtcctttatgtgga

SEQ ID NO: 3353981 - DNA, 17 bp, Homo sapiens
aagtcgttttccaaact

SEQ ID NO: 3353982 - DNA, 17 bp, Homo sapiens
aagtctaaatatttcct

SEQ ID NO: 3353983 - DNA, 13 bp, Homo sapiens
aagtctagagtct

SEQ ID NO: 3353984 - DNA, 12 bp, Homo sapiens
aagtctattttt

SEQ ID NO: 3353985 - DNA, 21 bp, Homo sapiens
aagtctcataggttaaaaaaa

SEQ ID NO: 3353986 - DNA, 20 bp, Homo sapiens
aagtctcattcgcctttgtc

SEQ ID NO: 3353987 - DNA, 19 bp, Homo sapiens
aagtctcccttctgtttct

SEQ ID NO: 3353988 - DNA, 15 bp, Homo sapiens
aagtctctaattcta

SEQ ID NO: 3353989 - DNA, 14 bp, Homo sapiens
aagtctctatttaa

SEQ ID NO: 3353990 - DNA, 14 bp, Homo sapiens
aagtctctctgtga

SEQ ID NO: 3353991 - DNA, 20 bp, Homo sapiens
aagtctctctgtgaatacaa

SEQ ID NO: 3353992 - DNA, 21 bp, Homo sapiens
aagtctgcaactttaagcagc

SEQ ID NO: 3353993 - DNA, 14 bp, Homo sapiens
aagtctgctgctgt

SEQ ID NO: 3353994 - DNA, 15 bp, Homo sapiens
aagtctgctgctgtg

SEQ ID NO: 3353995 - DNA, 17 bp, Homo sapiens
aagtctgggatgtagaa

SEQ ID NO: 3353996 - DNA, 15 bp, Homo sapiens
aagtctgtctttcct

SEQ ID NO: 3353997 - DNA, 16 bp, Homo sapiens
aagtctgtggactgca

SEQ ID NO: 3353998 - DNA, 17 bp, Homo sapiens
aagtcttagatgtatat

SEQ ID NO: 3353999 - DNA, 18 bp, Homo sapiens
aagtcttagatgtatata

SEQ ID NO: 3354000 - DNA, 18 bp, Homo sapiens
aagtcttccctgatcaag

SEQ ID NO: 3354001 - DNA, 22 bp, Homo sapiens
aagtcttccctgatcaagtcac

SEQ ID NO: 3354002 - DNA, 22 bp, Homo sapiens
aagtcttgggtctgaatttatt

SEQ ID NO: 3354003 - DNA, 17 bp, Homo sapiens
aagtctttgccttctct

SEQ ID NO: 3354004 - DNA, 12 bp, Homo sapiens
aataaaggcagc

SEQ ID NO: 3354005 - DNA, 18 bp, Homo sapiens
aataaaggcagctgcctc

SEQ ID NO: 3354006 - DNA, 15 bp, Homo sapiens
aataaaggcagtttt

SEQ ID NO: 3354007 - DNA, 18 bp, Homo sapiens
aataaaggcagttttcta

SEQ ID NO: 3354008 - DNA, 15 bp, Homo sapiens
aataaagtataatgt

SEQ ID NO: 3354009 - DNA, 14 bp, Homo sapiens
aataaagtatataa

SEQ ID NO: 3354010 - DNA, 18 bp, Homo sapiens
aataaagtgtaacaattg

SEQ ID NO: 3354011 - DNA, 16 bp, Homo sapiens
aataaagtgttttcag

SEQ ID NO: 3354012 - DNA, 19 bp, Homo sapiens
aataaagtgttttcagagc

SEQ ID NO: 3354013 - DNA, 19 bp, Homo sapiens
aataaagttctgagtgttt

SEQ ID NO: 3354014 - DNA, 18 bp, Homo sapiens
aataaagttctgttttct

SEQ ID NO: 3354015 - DNA, 19 bp, Homo sapiens
aataaagttctgttttctg

SEQ ID NO: 3354016 - DNA, 20 bp, Homo sapiens
aataaagttctgttttctgt

SEQ ID NO: 3354017 - DNA, 15 bp, Homo sapiens
aataaagttgcagat

SEQ ID NO: 3354018 - DNA, 16 bp, Homo sapiens
aataaataacacttgt

SEQ ID NO: 3354019 - DNA, 14 bp, Homo sapiens
aataaatcacacat

SEQ ID NO: 3354020 - DNA, 14 bp, Homo sapiens
aataaatctgccat

SEQ ID NO: 3354021 - DNA, 15 bp, Homo sapiens
aataaatctttggaa

SEQ ID NO: 3354022 - DNA, 15 bp, Homo sapiens
aataaatgccctctt

SEQ ID NO: 3354023 - DNA, 12 bp, Homo sapiens
aataaatgtctt

SEQ ID NO: 3354024 - DNA, 16 bp, Homo sapiens
aataaattagttgtta

SEQ ID NO: 3354025 - DNA, 14 bp, Homo sapiens
aataaattgatcct

SEQ ID NO: 3354026 - DNA, 17 bp, Homo sapiens
aataaattgcaacatat

SEQ ID NO: 3354027 - DNA, 16 bp, Homo sapiens
aataaattgctccttg

SEQ ID NO: 3354028 - DNA, 21 bp, Homo sapiens
aataaattgcttactgatatt

SEQ ID NO: 3354029 - DNA, 21 bp, Homo sapiens
aataaattggtgataagtgga

SEQ ID NO: 3354030 - DNA, 22 bp, Homo sapiens
aataaatttcagcatgtgcttt

SEQ ID NO: 3354031 - DNA, 12 bp, Homo sapiens
aataaatttctg

SEQ ID NO: 3354032 - DNA, 21 bp, Homo sapiens
aataaatttggttctaataga

SEQ ID NO: 3354033 - DNA, 13 bp, Homo sapiens
aataacaatgtgc

SEQ ID NO: 3354034 - DNA, 14 bp, Homo sapiens
aataacaatgttaa

SEQ ID NO: 3354035 - DNA, 15 bp, Homo sapiens
aataacaatgttaag

SEQ ID NO: 3354036 - DNA, 20 bp, Homo sapiens
aataacacacatataaacat

SEQ ID NO: 3354037 - DNA, 13 bp, Homo sapiens
aataacacttgtc

SEQ ID NO: 3354038 - DNA, 13 bp, Homo sapiens
aataacagctcct

SEQ ID NO: 3354039 - DNA, 19 bp, Homo sapiens
aataacatgtaattaagta

SEQ ID NO: 3354040 - DNA, 22 bp, Homo sapiens
aataacatgtaattaagtacta

SEQ ID NO: 3354041 - DNA, 14 bp, Homo sapiens
aataaccacttaaa

SEQ ID NO: 3354042 - DNA, 16 bp, Homo sapiens
aataacccagttactt

SEQ ID NO: 3354043 - DNA, 13 bp, Homo sapiens
aataacctctggc

SEQ ID NO: 3354044 - DNA, 19 bp, Homo sapiens
aataacctctggcccttgg

SEQ ID NO: 3354045 - DNA, 19 bp, Homo sapiens
aataaccttccatacattt

SEQ ID NO: 3354046 - DNA, 15 bp, Homo sapiens
aataactaaaaggta

SEQ ID NO: 3354047 - DNA, 13 bp, Homo sapiens
aataactaaaatg

SEQ ID NO: 3354048 - DNA, 19 bp, Homo sapiens
aataactctgtggcattat

SEQ ID NO: 3354049 - DNA, 17 bp, Homo sapiens
aataactgaaccaaatt

SEQ ID NO: 3354050 - DNA, 16 bp, Homo sapiens
aataactgaatttgga

SEQ ID NO: 3354051 - DNA, 21 bp, Homo sapiens
aataactggaacaaattattt

SEQ ID NO: 3354052 - DNA, 21 bp, Homo sapiens
aataacttcagtcctgctcca

SEQ ID NO: 3354053 - DNA, 18 bp, Homo sapiens
aataacttctatatttta

SEQ ID NO: 3354054 - DNA, 20 bp, Homo sapiens
aataacttctatattttaat

SEQ ID NO: 3354055 - DNA, 14 bp, Homo sapiens
aataagaatgattt

SEQ ID NO: 3354056 - DNA, 17 bp, Homo sapiens
aataagacataacgttt

SEQ ID NO: 3354057 - DNA, 23 bp, Homo sapiens
aataagcaggtggatctatttca

SEQ ID NO: 3354058 - DNA, 14 bp, Homo sapiens
aataagctctagtt

SEQ ID NO: 3354059 - DNA, 23 bp, Homo sapiens
aataagctttctctcagaaatgc

SEQ ID NO: 3354060 - DNA, 16 bp, Homo sapiens
aataaggaagagggct

SEQ ID NO: 3354061 - DNA, 15 bp, Homo sapiens
aataaggaggaggag

SEQ ID NO: 3354062 - DNA, 20 bp, Homo sapiens
aataaggaggaggagggaga

SEQ ID NO: 3354063 - DNA, 18 bp, Homo sapiens
aataaggtcaagggaaaa

SEQ ID NO: 3354064 - DNA, 13 bp, Homo sapiens
aataagtttcata

SEQ ID NO: 3354065 - DNA, 14 bp, Homo sapiens
aataagtttgaacc

SEQ ID NO: 3354066 - DNA, 13 bp, Homo sapiens
aataataaaatca

SEQ ID NO: 3354067 - DNA, 16 bp, Homo sapiens
aataataaatgccctc

SEQ ID NO: 3354068 - DNA, 11 bp, Homo sapiens
aataataatta

SEQ ID NO: 3354069 - DNA, 21 bp, Homo sapiens
aataataattatccagagttt

SEQ ID NO: 3354070 - DNA, 20 bp, Homo sapiens
aataatacctcaatgtttga

SEQ ID NO: 3354071 - DNA, 18 bp, Homo sapiens
aataatagggaaaatacc

SEQ ID NO: 3354072 - DNA, 13 bp, Homo sapiens
aataatatgattt

SEQ ID NO: 3354073 - DNA, 13 bp, Homo sapiens
aataatatgcatt

SEQ ID NO: 3354074 - DNA, 15 bp, Homo sapiens
aataatatgcattgt

SEQ ID NO: 3354075 - DNA, 14 bp, Homo sapiens
aataatattgttgt

SEQ ID NO: 3354076 - DNA, 13 bp, Homo sapiens
aataatattgttt

SEQ ID NO: 3354077 - DNA, 21 bp, Homo sapiens
aataatattgtttttctttct

SEQ ID NO: 3354078 - DNA, 14 bp, Homo sapiens
aataatatttcaag

SEQ ID NO: 3354079 - DNA, 17 bp, Homo sapiens
aataatatttcaagtgc

SEQ ID NO: 3354080 - DNA, 17 bp, Homo sapiens
aataatcaagattttag

SEQ ID NO: 3354081 - DNA, 20 bp, Homo sapiens
aataatcacgctttcctgaa

SEQ ID NO: 3354082 - DNA, 19 bp, Homo sapiens
aataatccagtattgctga

SEQ ID NO: 3354083 - DNA, 15 bp, Homo sapiens
aataatctatgatga

SEQ ID NO: 3354084 - DNA, 19 bp, Homo sapiens
aataatgaataaactgaat

SEQ ID NO: 3354085 - DNA, 19 bp, Homo sapiens
aataatgctacaattttaa

SEQ ID NO: 3354086 - DNA, 12 bp, Homo sapiens
aataatggaaac

SEQ ID NO: 3354087 - DNA, 16 bp, Homo sapiens
aataatggaaacatta

SEQ ID NO: 3354088 - DNA, 12 bp, Homo sapiens
aataatgtattg

SEQ ID NO: 3354089 - DNA, 13 bp, Homo sapiens
aataattaaataa

SEQ ID NO: 3354090 - DNA, 17 bp, Homo sapiens
aataattaaataaatga

SEQ ID NO: 3354091 - DNA, 21 bp, Homo sapiens
aataattgatcaaattcattt

SEQ ID NO: 3354092 - DNA, 14 bp, Homo sapiens
aataattggttctt

SEQ ID NO: 3354093 - DNA, 13 bp, Homo sapiens
aataattgtttcc

SEQ ID NO: 3354094 - DNA, 22 bp, Homo sapiens
aataatttcccaattaggaagt

SEQ ID NO: 3354095 - DNA, 17 bp, Homo sapiens
aataattttaaataacc

SEQ ID NO: 3354096 - DNA, 22 bp, Homo sapiens
aataattttattagaataattt

SEQ ID NO: 3354097 - DNA, 13 bp, Homo sapiens
aatacaaaacttc

SEQ ID NO: 3354098 - DNA, 17 bp, Homo sapiens
aatacaaagtaaataca

SEQ ID NO: 3354099 - DNA, 17 bp, Homo sapiens
aatacaaagttagagaa

SEQ ID NO: 3354100 - DNA, 17 bp, Homo sapiens
aatacaaatagattttt

SEQ ID NO: 3354101 - DNA, 12 bp, Homo sapiens
aatacaaatgga

SEQ ID NO: 3354102 - DNA, 19 bp, Homo sapiens
aatacaatcctgtttataa

SEQ ID NO: 3354103 - DNA, 16 bp, Homo sapiens
aatacaattaaaggtc

SEQ ID NO: 3354104 - DNA, 17 bp, Homo sapiens
aatacacaagtaaacat

SEQ ID NO: 3354105 - DNA, 13 bp, Homo sapiens
aatacacagtact

SEQ ID NO: 3354106 - DNA, 16 bp, Homo sapiens
aatacacatttcacat

SEQ ID NO: 3354107 - DNA, 20 bp, Homo sapiens
aatacacttcttttgaacat

SEQ ID NO: 3354108 - DNA, 19 bp, Homo sapiens
aatacacttttttccaaag

SEQ ID NO: 3354109 - DNA, 13 bp, Homo sapiens
aatacagacacta

SEQ ID NO: 3354110 - DNA, 15 bp, Homo sapiens
aatacagacactaag

SEQ ID NO: 3354111 - DNA, 21 bp, Homo sapiens
aatacagtaagctgctctatt

SEQ ID NO: 3354112 - DNA, 13 bp, Homo sapiens
aatacataaatag

SEQ ID NO: 3354113 - DNA, 17 bp, Homo sapiens
aatacatgagaaagatg

SEQ ID NO: 3354114 - DNA, 13 bp, Homo sapiens
aatacatgcatct

SEQ ID NO: 3354115 - DNA, 18 bp, Homo sapiens
aatacatgccacatcaaa

SEQ ID NO: 3354116 - DNA, 14 bp, Homo sapiens
aatacatgctgcta

SEQ ID NO: 3354117 - DNA, 16 bp, Homo sapiens
aatacatttaaaactt

SEQ ID NO: 3354118 - DNA, 17 bp, Homo sapiens
aatacatttaaaactta

SEQ ID NO: 3354119 - DNA, 19 bp, Homo sapiens
aataccacatcaaataaga

SEQ ID NO: 3354120 - DNA, 21 bp, Homo sapiens
aataccacatcaaataagaaa

SEQ ID NO: 3354121 - DNA, 20 bp, Homo sapiens
aataccacctcgagatgggt

SEQ ID NO: 3354122 - DNA, 17 bp, Homo sapiens
aataccacttacctcaa

SEQ ID NO: 3354123 - DNA, 13 bp, Homo sapiens
aataccagagcct

SEQ ID NO: 3354124 - DNA, 13 bp, Homo sapiens
aataccaggattt

SEQ ID NO: 3354125 - DNA, 20 bp, Homo sapiens
aataccattaaaactgcttt

SEQ ID NO: 3354126 - DNA, 20 bp, Homo sapiens
aataccattttttaaggaaa

SEQ ID NO: 3354127 - DNA, 23 bp, Homo sapiens
aataccattttttaaggaaacaa

SEQ ID NO: 3354128 - DNA, 15 bp, Homo sapiens
aatacctcatgttta

SEQ ID NO: 3354129 - DNA, 19 bp, Homo sapiens
aatacctcatgtttatgaa

SEQ ID NO: 3354130 - DNA, 13 bp, Homo sapiens
aatacctctgtgt

SEQ ID NO: 3354131 - DNA, 20 bp, Homo sapiens
aatctgctcactttaaacct

SEQ ID NO: 3354132 - DNA, 21 bp, Homo sapiens
aatctggaaggcccctcccag

SEQ ID NO: 3354133 - DNA, 15 bp, Homo sapiens
aatctggactcctct

SEQ ID NO: 3354134 - DNA, 21 bp, Homo sapiens
aatctggatgcctcattatgt

SEQ ID NO: 3354135 - DNA, 19 bp, Homo sapiens
aatctggtaatggtgtccc

SEQ ID NO: 3354136 - DNA, 20 bp, Homo sapiens
aatctggtcttgttagaaaa

SEQ ID NO: 3354137 - DNA, 18 bp, Homo sapiens
aatctgtaagctctttga

SEQ ID NO: 3354138 - DNA, 12 bp, Homo sapiens
aatctgtacatt

SEQ ID NO: 3354139 - DNA, 14 bp, Homo sapiens
aatctgtacatttt

SEQ ID NO: 3354140 - DNA, 22 bp, Homo sapiens
aatctgtacattttgttgtaaa

SEQ ID NO: 3354141 - DNA, 16 bp, Homo sapiens
aatctgtatatgttgt

SEQ ID NO: 3354142 - DNA, 22 bp, Homo sapiens
aatctgtatatgttgtaataaa

SEQ ID NO: 3354143 - DNA, 23 bp, Homo sapiens
aatctgtatatgttgtaataaaa

SEQ ID NO: 3354144 - DNA, 12 bp, Homo sapiens
aatctgtcaaaa

SEQ ID NO: 3354145 - DNA, 14 bp, Homo sapiens
aatctgtcaaaaca

SEQ ID NO: 3354146 - DNA, 16 bp, Homo sapiens
aatctgtcaaaacact

SEQ ID NO: 3354147 - DNA, 16 bp, Homo sapiens
aatctgtgaattaaaa

SEQ ID NO: 3354148 - DNA, 12 bp, Homo sapiens
aatctgtgatga

SEQ ID NO: 3354149 - DNA, 19 bp, Homo sapiens
aatctgtgggtctgggagt

SEQ ID NO: 3354150 - DNA, 20 bp, Homo sapiens
aatctgtgtatattatttgg

SEQ ID NO: 3354151 - DNA, 20 bp, Homo sapiens
aatctgtgtgaaactttcat

SEQ ID NO: 3354152 - DNA, 15 bp, Homo sapiens
aatctgtgtgtatat

SEQ ID NO: 3354153 - DNA, 16 bp, Homo sapiens
aatctgtgtgtatatt

SEQ ID NO: 3354154 - DNA, 21 bp, Homo sapiens
aatctgttgttccaaatgtgt

SEQ ID NO: 3354155 - DNA, 17 bp, Homo sapiens
aatcttaaaaagttgtt

SEQ ID NO: 3354156 - DNA, 13 bp, Homo sapiens
aatcttaaacaat

SEQ ID NO: 3354157 - DNA, 16 bp, Homo sapiens
aatcttaaacaatgta

SEQ ID NO: 3354158 - DNA, 17 bp, Homo sapiens
aatcttaaacaatgtat

SEQ ID NO: 3354159 - DNA, 20 bp, Homo sapiens
aatcttaccagatgctactg

SEQ ID NO: 3354160 - DNA, 21 bp, Homo sapiens
aatcttagtgtatgattactg

SEQ ID NO: 3354161 - DNA, 15 bp, Homo sapiens
aatcttatagttcta

SEQ ID NO: 3354162 - DNA, 20 bp, Homo sapiens
aatcttcagttttatcttta

SEQ ID NO: 3354163 - DNA, 21 bp, Homo sapiens
aatcttgaggaataaatgcct

SEQ ID NO: 3354164 - DNA, 12 bp, Homo sapiens
aatcttggaagt

SEQ ID NO: 3354165 - DNA, 17 bp, Homo sapiens
aatcttgggtgggtgaa

SEQ ID NO: 3354166 - DNA, 14 bp, Homo sapiens
aatcttgtgctaga

SEQ ID NO: 3354167 - DNA, 13 bp, Homo sapiens
aatcttgttttga

SEQ ID NO: 3354168 - DNA, 14 bp, Homo sapiens
aatctttaataaca

SEQ ID NO: 3354169 - DNA, 21 bp, Homo sapiens
aatctttcagcactcagaaaa

SEQ ID NO: 3354170 - DNA, 11 bp, Homo sapiens
aatctttccag

SEQ ID NO: 3354171 - DNA, 17 bp, Homo sapiens
aatctttctttacctga

SEQ ID NO: 3354172 - DNA, 19 bp, Homo sapiens
aatctttctttacctgaga

SEQ ID NO: 3354173 - DNA, 21 bp, Homo sapiens
aatctttctttacctgagacc

SEQ ID NO: 3354174 - DNA, 12 bp, Homo sapiens
aatctttgctgt

SEQ ID NO: 3354175 - DNA, 12 bp, Homo sapiens
aatcttttacaa

SEQ ID NO: 3354176 - DNA, 14 bp, Homo sapiens
aatcttttcttatt

SEQ ID NO: 3354177 - DNA, 18 bp, Homo sapiens
aatctttttaaaaatgat

SEQ ID NO: 3354178 - DNA, 14 bp, Homo sapiens
aatgaaaaattctc

SEQ ID NO: 3354179 - DNA, 21 bp, Homo sapiens
aatgaaaaatttaagcattgt

SEQ ID NO: 3354180 - DNA, 19 bp, Homo sapiens
aatgaaaacattttatttt

SEQ ID NO: 3354181 - DNA, 18 bp, Homo sapiens
aatgaaaactctttgctg

SEQ ID NO: 3354182 - DNA, 19 bp, Homo sapiens
aatgaaaagtcgttttcca

SEQ ID NO: 3354183 - DNA, 17 bp, Homo sapiens
aatgaaaataactgaac

SEQ ID NO: 3354184 - DNA, 13 bp, Homo sapiens
aatgaaaatgaat

SEQ ID NO: 3354185 - DNA, 13 bp, Homo sapiens
aatgaaaattgta

SEQ ID NO: 3354186 - DNA, 19 bp, Homo sapiens
aatgaaacaaataatcaca

SEQ ID NO: 3354187 - DNA, 17 bp, Homo sapiens
aatgaaacattttgtca

SEQ ID NO: 3354188 - DNA, 16 bp, Homo sapiens
aatgaaagaaaattga

SEQ ID NO: 3354189 - DNA, 16 bp, Homo sapiens
aatgaaagactgtaca

SEQ ID NO: 3354190 - DNA, 16 bp, Homo sapiens
aatgaaagattaaaca

SEQ ID NO: 3354191 - DNA, 20 bp, Homo sapiens
aatgaaagattaaacagatg

SEQ ID NO: 3354192 - DNA, 22 bp, Homo sapiens
aatgaaagcatgtggcatgttc

SEQ ID NO: 3354193 - DNA, 18 bp, Homo sapiens
aatgaaagctactcatag

SEQ ID NO: 3354194 - DNA, 16 bp, Homo sapiens
aatgaaagctgttcct

SEQ ID NO: 3354195 - DNA, 21 bp, Homo sapiens
aatgaaagggaaagtcagctt

SEQ ID NO: 3354196 - DNA, 14 bp, Homo sapiens
aatgaaatgtatgc

SEQ ID NO: 3354197 - DNA, 14 bp, Homo sapiens
aatgaaatgtatgt

SEQ ID NO: 3354198 - DNA, 22 bp, Homo sapiens
aatgaaattaacacaaaggaag

SEQ ID NO: 3354199 - DNA, 23 bp, Homo sapiens
aatgaaattactacaaaatttga

SEQ ID NO: 3354200 - DNA, 14 bp, Homo sapiens
aatgaactgaagtt

SEQ ID NO: 3354201 - DNA, 14 bp, Homo sapiens
aatgaactgcccac

SEQ ID NO: 3354202 - DNA, 15 bp, Homo sapiens
aatgaacttgttact

SEQ ID NO: 3354203 - DNA, 15 bp, Homo sapiens
aatgaagaaggaagc

SEQ ID NO: 3354204 - DNA, 19 bp, Homo sapiens
aatgaagcagctttaaaca

SEQ ID NO: 3354205 - DNA, 14 bp, Homo sapiens
aatgaagcagtatt

SEQ ID NO: 3354206 - DNA, 16 bp, Homo sapiens
aatgaagcagtatttt

SEQ ID NO: 3354207 - DNA, 19 bp, Homo sapiens
aatgaagctttatacgtgt

SEQ ID NO: 3354208 - DNA, 15 bp, Homo sapiens
aatgaataaactgaa

SEQ ID NO: 3354209 - DNA, 14 bp, Homo sapiens
aatgaataaatcca

SEQ ID NO: 3354210 - DNA, 15 bp, Homo sapiens
aatgaataataatta

SEQ ID NO: 3354211 - DNA, 21 bp, Homo sapiens
aatgaataataattatccaga

SEQ ID NO: 3354212 - DNA, 15 bp, Homo sapiens
aatgaatattgaagt

SEQ ID NO: 3354213 - DNA, 17 bp, Homo sapiens
aatgaatattttgataa

SEQ ID NO: 3354214 - DNA, 14 bp, Homo sapiens
aatgaatgaaacat

SEQ ID NO: 3354215 - DNA, 17 bp, Homo sapiens
aatgaattaaataaacc

SEQ ID NO: 3354216 - DNA, 15 bp, Homo sapiens
aatgaattaaatatt

SEQ ID NO: 3354217 - DNA, 15 bp, Homo sapiens
aatgaattataacag

SEQ ID NO: 3354218 - DNA, 22 bp, Homo sapiens
aatgaattataacagttatatt

SEQ ID NO: 3354219 - DNA, 18 bp, Homo sapiens
aatgaattcctatatacc

SEQ ID NO: 3354220 - DNA, 12 bp, Homo sapiens
aatgaatttgtc

SEQ ID NO: 3354221 - DNA, 19 bp, Homo sapiens
aatgaatttgtcgcaaaga

SEQ ID NO: 3354222 - DNA, 17 bp, Homo sapiens
aatgaatttttatgata

SEQ ID NO: 3354223 - DNA, 12 bp, Homo sapiens
aatgacaacact

SEQ ID NO: 3354224 - DNA, 21 bp, Homo sapiens
aatgacaacagaaaaacaatc

SEQ ID NO: 3354225 - DNA, 16 bp, Homo sapiens
aatgacaacagaagct

SEQ ID NO: 3354226 - DNA, 18 bp, Homo sapiens
aatgacatcttcaaagct

SEQ ID NO: 3354227 - DNA, 14 bp, Homo sapiens
aatgaccaatatta

SEQ ID NO: 3354228 - DNA, 23 bp, Homo sapiens
aatgactaattagggtacattta

SEQ ID NO: 3354229 - DNA, 16 bp, Homo sapiens
aatgactataaacatt

SEQ ID NO: 3354230 - DNA, 17 bp, Homo sapiens
aatgactataaacatta

SEQ ID NO: 3354231 - DNA, 15 bp, Homo sapiens
aatgactatataatt

SEQ ID NO: 3354232 - DNA, 21 bp, Homo sapiens
aatgactccaccttctcacct

SEQ ID NO: 3354233 - DNA, 16 bp, Homo sapiens
aatgactccactgttt

SEQ ID NO: 3354234 - DNA, 21 bp, Homo sapiens
aatgactctttctgaaggaag

SEQ ID NO: 3354235 - DNA, 21 bp, Homo sapiens
aatgacttatttctgctctgg

SEQ ID NO: 3354236 - DNA, 17 bp, Homo sapiens
aatgagaggttcctaag

SEQ ID NO: 3354237 - DNA, 16 bp, Homo sapiens
aatgagattgaatttc

SEQ ID NO: 3354238 - DNA, 14 bp, Homo sapiens
aatgagcacctcca

SEQ ID NO: 3354239 - DNA, 18 bp, Homo sapiens
aatgagcttgattaaatc

SEQ ID NO: 3354240 - DNA, 19 bp, Homo sapiens
aatgagcttgattaaatca

SEQ ID NO: 3354241 - DNA, 19 bp, Homo sapiens
aatgaggaaaattcttaaa

SEQ ID NO: 3354242 - DNA, 14 bp, Homo sapiens
aatgaggacatgtt

SEQ ID NO: 3354243 - DNA, 16 bp, Homo sapiens
aatgaggacatgtttt

SEQ ID NO: 3354244 - DNA, 18 bp, Homo sapiens
aatgagggccaagaaaga

SEQ ID NO: 3354245 - DNA, 18 bp, Homo sapiens
aatgaggtcagagcctgc

SEQ ID NO: 3354246 - DNA, 16 bp, Homo sapiens
aatgaggtctgaaatg

SEQ ID NO: 3354247 - DNA, 19 bp, Homo sapiens
aatgaggtctgaaatggag

SEQ ID NO: 3354248 - DNA, 14 bp, Homo sapiens
aatgagtatttggt

SEQ ID NO: 3354249 - DNA, 14 bp, Homo sapiens
aatgagttgtgaaa

SEQ ID NO: 3354250 - DNA, 18 bp, Homo sapiens
aatgataagtaaatgcta

SEQ ID NO: 3354251 - DNA, 17 bp, Homo sapiens
aatgatagcccagaaca

SEQ ID NO: 3354252 - DNA, 14 bp, Homo sapiens
aatgatcaaaacat

SEQ ID NO: 3354253 - DNA, 12 bp, Homo sapiens
aatgatcaaatt

SEQ ID NO: 3354254 - DNA, 15 bp, Homo sapiens
aatgatcaaattttg

SEQ ID NO: 3354255 - DNA, 16 bp, Homo sapiens
aatgatcataagtcta

SEQ ID NO: 3354256 - DNA, 20 bp, Homo sapiens
aatgatccccaagtgtgaac

SEQ ID NO: 3354257 - DNA, 17 bp, Homo sapiens
aatgatcgaaaaaataa

SEQ ID NO: 3354258 - DNA, 19 bp, Homo sapiens
aattatgcactaaatatga

SEQ ID NO: 3354259 - DNA, 21 bp, Homo sapiens
aattatgggaataattgcttt

SEQ ID NO: 3354260 - DNA, 22 bp, Homo sapiens
aattatgggaataattgctttt

SEQ ID NO: 3354261 - DNA, 19 bp, Homo sapiens
aattatgtaatatattgta

SEQ ID NO: 3354262 - DNA, 15 bp, Homo sapiens
aattatgtatgttta

SEQ ID NO: 3354263 - DNA, 11 bp, Homo sapiens
aattatgtgac

SEQ ID NO: 3354264 - DNA, 19 bp, Homo sapiens
aattatgttttaaacacat

SEQ ID NO: 3354265 - DNA, 13 bp, Homo sapiens
aattattattctt

SEQ ID NO: 3354266 - DNA, 21 bp, Homo sapiens
aattattattcttcataacaa

SEQ ID NO: 3354267 - DNA, 11 bp, Homo sapiens
aattattattt

SEQ ID NO: 3354268 - DNA, 21 bp, Homo sapiens
aattattatttatatatgtat

SEQ ID NO: 3354269 - DNA, 16 bp, Homo sapiens
aattattatttgtgtt

SEQ ID NO: 3354270 - DNA, 18 bp, Homo sapiens
aattattatttgtgtttt

SEQ ID NO: 3354271 - DNA, 16 bp, Homo sapiens
aattattctgattctt

SEQ ID NO: 3354272 - DNA, 14 bp, Homo sapiens
aattattgatatat

SEQ ID NO: 3354273 - DNA, 15 bp, Homo sapiens
aattattgatatata

SEQ ID NO: 3354274 - DNA, 17 bp, Homo sapiens
aattattgatatatatt

SEQ ID NO: 3354275 - DNA, 17 bp, Homo sapiens
aattatttaaataaaat

SEQ ID NO: 3354276 - DNA, 14 bp, Homo sapiens
aattatttaataaa

SEQ ID NO: 3354277 - DNA, 11 bp, Homo sapiens
aattatttctg

SEQ ID NO: 3354278 - DNA, 17 bp, Homo sapiens
aattatttcttaattat

SEQ ID NO: 3354279 - DNA, 19 bp, Homo sapiens
aattatttgtgtaatagaa

SEQ ID NO: 3354280 - DNA, 17 bp, Homo sapiens
aattattttaaaatatt

SEQ ID NO: 3354281 - DNA, 18 bp, Homo sapiens
aattattttaaaatattt

SEQ ID NO: 3354282 - DNA, 19 bp, Homo sapiens
aattattttaaaatattta

SEQ ID NO: 3354283 - DNA, 21 bp, Homo sapiens
aattattttaaaatatttaaa

SEQ ID NO: 3354284 - DNA, 16 bp, Homo sapiens
aattattttgaatgtc

SEQ ID NO: 3354285 - DNA, 20 bp, Homo sapiens
aattattttgaatgtcacaa

SEQ ID NO: 3354286 - DNA, 18 bp, Homo sapiens
aattattttggattttgt

SEQ ID NO: 3354287 - DNA, 20 bp, Homo sapiens
aattattttggtacttttat

SEQ ID NO: 3354288 - DNA, 16 bp, Homo sapiens
aattcaaaaagtgttt

SEQ ID NO: 3354289 - DNA, 13 bp, Homo sapiens
aattcaaagcatg

SEQ ID NO: 3354290 - DNA, 19 bp, Homo sapiens
aattcaaagcatggacatt

SEQ ID NO: 3354291 - DNA, 21 bp, Homo sapiens
aattcaaccactgtaaaatga

SEQ ID NO: 3354292 - DNA, 16 bp, Homo sapiens
aattcaaggaatttct

SEQ ID NO: 3354293 - DNA, 23 bp, Homo sapiens
aattcaaggaatttcttaacttc

SEQ ID NO: 3354294 - DNA, 17 bp, Homo sapiens
aattcaattgtaaattg

SEQ ID NO: 3354295 - DNA, 19 bp, Homo sapiens
aattcacaaacttttatac

SEQ ID NO: 3354296 - DNA, 14 bp, Homo sapiens
aattcaccaaagta

SEQ ID NO: 3354297 - DNA, 17 bp, Homo sapiens
aattcaccaaagtattt

SEQ ID NO: 3354298 - DNA, 15 bp, Homo sapiens
aattcagcactgatt

SEQ ID NO: 3354299 - DNA, 20 bp, Homo sapiens
aattcagcactgatttcaca

SEQ ID NO: 3354300 - DNA, 22 bp, Homo sapiens
aattcagcctactgcctcggat

SEQ ID NO: 3354301 - DNA, 13 bp, Homo sapiens
aattcagctcagc

SEQ ID NO: 3354302 - DNA, 16 bp, Homo sapiens
aattcagtttttgtat

SEQ ID NO: 3354303 - DNA, 14 bp, Homo sapiens
aattcattggctcc

SEQ ID NO: 3354304 - DNA, 12 bp, Homo sapiens
aattcatttcta

SEQ ID NO: 3354305 - DNA, 13 bp, Homo sapiens
aattcatttctaa

SEQ ID NO: 3354306 - DNA, 15 bp, Homo sapiens
aattcatttgtattg

SEQ ID NO: 3354307 - DNA, 17 bp, Homo sapiens
aattcattttcatcact

SEQ ID NO: 3354308 - DNA, 17 bp, Homo sapiens
aattccaattatatgag

SEQ ID NO: 3354309 - DNA, 21 bp, Homo sapiens
aattccactggacttgagctt

SEQ ID NO: 3354310 - DNA, 17 bp, Homo sapiens
aattccatatgctccag

SEQ ID NO: 3354311 - DNA, 16 bp, Homo sapiens
aattcccattttgcaa

SEQ ID NO: 3354312 - DNA, 22 bp, Homo sapiens
aattccctatcttttagtttta

SEQ ID NO: 3354313 - DNA, 13 bp, Homo sapiens
aattccgtcacca

SEQ ID NO: 3354314 - DNA, 18 bp, Homo sapiens
aattcctacaacttaatg

SEQ ID NO: 3354315 - DNA, 12 bp, Homo sapiens
aattcctatgaa

SEQ ID NO: 3354316 - DNA, 16 bp, Homo sapiens
aattccttgccccaca

SEQ ID NO: 3354317 - DNA, 18 bp, Homo sapiens
aattccttgccccacagt

SEQ ID NO: 3354318 - DNA, 23 bp, Homo sapiens
aattccttgccccacagttgtgt

SEQ ID NO: 3354319 - DNA, 15 bp, Homo sapiens
aattcgcccgagctg

SEQ ID NO: 3354320 - DNA, 23 bp, Homo sapiens
aattcgcccgagctgtttatgtt

SEQ ID NO: 3354321 - DNA, 19 bp, Homo sapiens
aattctaagttatttactt

SEQ ID NO: 3354322 - DNA, 12 bp, Homo sapiens
aattctaattgt

SEQ ID NO: 3354323 - DNA, 14 bp, Homo sapiens
aattctaattgtca

SEQ ID NO: 3354324 - DNA, 15 bp, Homo sapiens
aattctacattgtca

SEQ ID NO: 3354325 - DNA, 19 bp, Homo sapiens
aattctactaagttatttt

SEQ ID NO: 3354326 - DNA, 14 bp, Homo sapiens
aattctactttgag

SEQ ID NO: 3354327 - DNA, 17 bp, Homo sapiens
aattctatgttaaatac

SEQ ID NO: 3354328 - DNA, 19 bp, Homo sapiens
aattctatgttaaatactg

SEQ ID NO: 3354329 - DNA, 20 bp, Homo sapiens
aattctatgttaaatactgt

SEQ ID NO: 3354330 - DNA, 19 bp, Homo sapiens
aattctcagaatctcaaat

SEQ ID NO: 3354331 - DNA, 16 bp, Homo sapiens
aattctcctgataaaa

SEQ ID NO: 3354332 - DNA, 19 bp, Homo sapiens
aattctcctgcctcagcct

SEQ ID NO: 3354333 - DNA, 23 bp, Homo sapiens
aattctctccccctatttattga

SEQ ID NO: 3354334 - DNA, 19 bp, Homo sapiens
aattctcttctttttcttt

SEQ ID NO: 3354335 - DNA, 19 bp, Homo sapiens
aattctgagacatgtgtca

SEQ ID NO: 3354336 - DNA, 23 bp, Homo sapiens
aattctgattctggctttaagcc

SEQ ID NO: 3354337 - DNA, 20 bp, Homo sapiens
aattctgcaactagccaagg

SEQ ID NO: 3354338 - DNA, 21 bp, Homo sapiens
aattctgcaactagccaaggc

SEQ ID NO: 3354339 - DNA, 12 bp, Homo sapiens
aattctgtacat

SEQ ID NO: 3354340 - DNA, 16 bp, Homo sapiens
aattctgtgccttgtt

SEQ ID NO: 3354341 - DNA, 21 bp, Homo sapiens
aattctgtttttaatgctatt

SEQ ID NO: 3354342 - DNA, 22 bp, Homo sapiens
aattcttacactgcctgtatac

SEQ ID NO: 3354343 - DNA, 23 bp, Homo sapiens
aattcttacactgcctgtatact

SEQ ID NO: 3354344 - DNA, 17 bp, Homo sapiens
aattcttcacctttgta

SEQ ID NO: 3354345 - DNA, 14 bp, Homo sapiens
aattcttgtatatt

SEQ ID NO: 3354346 - DNA, 20 bp, Homo sapiens
aattcttgtatattatggaa

SEQ ID NO: 3354347 - DNA, 14 bp, Homo sapiens
aattctttgttctg

SEQ ID NO: 3354348 - DNA, 18 bp, Homo sapiens
aattcttttttaaatttt

SEQ ID NO: 3354349 - DNA, 14 bp, Homo sapiens
aattgaacttccca

SEQ ID NO: 3354350 - DNA, 20 bp, Homo sapiens
aattgaagtttcaagtttta

SEQ ID NO: 3354351 - DNA, 21 bp, Homo sapiens
aattgaatgtcaatatgagat

SEQ ID NO: 3354352 - DNA, 20 bp, Homo sapiens
aattgacatgttgtcacatt

SEQ ID NO: 3354353 - DNA, 17 bp, Homo sapiens
aattgaccatctgcttt

SEQ ID NO: 3354354 - DNA, 19 bp, Homo sapiens
aattgaggtttggaagagt

SEQ ID NO: 3354355 - DNA, 18 bp, Homo sapiens
aattgagttgcacttatt

SEQ ID NO: 3354356 - DNA, 22 bp, Homo sapiens
aattgatcataggtatttcaaa

SEQ ID NO: 3354357 - DNA, 16 bp, Homo sapiens
aattgatgtatatgtt

SEQ ID NO: 3354358 - DNA, 23 bp, Homo sapiens
aattgatgtatatgtttatatac

SEQ ID NO: 3354359 - DNA, 13 bp, Homo sapiens
aattgatgtgttt

SEQ ID NO: 3354360 - DNA, 11 bp, Homo sapiens
aattgattgtc

SEQ ID NO: 3354361 - DNA, 15 bp, Homo sapiens
aattgatttcaagac

SEQ ID NO: 3354362 - DNA, 14 bp, Homo sapiens
aattgatttgcatt

SEQ ID NO: 3354363 - DNA, 22 bp, Homo sapiens
aattgatttgcattgaacacaa

SEQ ID NO: 3354364 - DNA, 23 bp, Homo sapiens
aattgatttgcattgaacacaaa

SEQ ID NO: 3354365 - DNA, 23 bp, Homo sapiens
aattgatttttctcttcattttt

SEQ ID NO: 3354366 - DNA, 14 bp, Homo sapiens
aattgcaaatcttg

SEQ ID NO: 3354367 - DNA, 13 bp, Homo sapiens
aattgcactaaat

SEQ ID NO: 3354368 - DNA, 15 bp, Homo sapiens
aattgcactctaaaa

SEQ ID NO: 3354369 - DNA, 13 bp, Homo sapiens
aattgcactgaag

SEQ ID NO: 3354370 - DNA, 16 bp, Homo sapiens
aattgcactgaagttt

SEQ ID NO: 3354371 - DNA, 18 bp, Homo sapiens
aattgcactgaagttttt

SEQ ID NO: 3354372 - DNA, 21 bp, Homo sapiens
aattgcactgaagtttttgaa

SEQ ID NO: 3354373 - DNA, 14 bp, Homo sapiens
aattgccaaagctg

SEQ ID NO: 3354374 - DNA, 22 bp, Homo sapiens
aattgccattttattaaacatt

SEQ ID NO: 3354375 - DNA, 15 bp, Homo sapiens
aattgcctttaaaac

SEQ ID NO: 3354376 - DNA, 14 bp, Homo sapiens
aattgcctttttct

SEQ ID NO: 3354377 - DNA, 21 bp, Homo sapiens
aattgctatgttactattttc

SEQ ID NO: 3354378 - DNA, 19 bp, Homo sapiens
aattgctcctaactccacc

SEQ ID NO: 3354379 - DNA, 20 bp, Homo sapiens
aattgctcctaagcttcaaa

SEQ ID NO: 3354380 - DNA, 15 bp, Homo sapiens
aattgctctgtgtat

SEQ ID NO: 3354381 - DNA, 21 bp, Homo sapiens
aattgctctgtgtatatctct

SEQ ID NO: 3354382 - DNA, 20 bp, Homo sapiens
aattgcttacatttttacaa

SEQ ID NO: 3354383 - DNA, 15 bp, Homo sapiens
aattgctttgccaaa

SEQ ID NO: 3354384 - DNA, 16 bp, Homo sapiens
acaaggattgaaaatt

SEQ ID NO: 3354385 - DNA, 17 bp, Homo sapiens
acaaggattgctactgt

SEQ ID NO: 3354386 - DNA, 15 bp, Homo sapiens
acaaggctggccagc

SEQ ID NO: 3354387 - DNA, 16 bp, Homo sapiens
acaagggaaggacaga

SEQ ID NO: 3354388 - DNA, 16 bp, Homo sapiens
acaagggattctggga

SEQ ID NO: 3354389 - DNA, 14 bp, Homo sapiens
acaaggtaattgtt

SEQ ID NO: 3354390 - DNA, 15 bp, Homo sapiens
acaaggtaattgttt

SEQ ID NO: 3354391 - DNA, 22 bp, Homo sapiens
acaaggtaattgttttttaaag

SEQ ID NO: 3354392 - DNA, 21 bp, Homo sapiens
acaaggtacccctttctggct

SEQ ID NO: 3354393 - DNA, 15 bp, Homo sapiens
acaagtaaaactgtg

SEQ ID NO: 3354394 - DNA, 16 bp, Homo sapiens
acaagtaaaactgtgg

SEQ ID NO: 3354395 - DNA, 13 bp, Homo sapiens
acaagtaagaaaa

SEQ ID NO: 3354396 - DNA, 20 bp, Homo sapiens
acaagtactatctgttcccc

SEQ ID NO: 3354397 - DNA, 16 bp, Homo sapiens
acaagtatacttatat

SEQ ID NO: 3354398 - DNA, 18 bp, Homo sapiens
acaagtatatacttttaa

SEQ ID NO: 3354399 - DNA, 17 bp, Homo sapiens
acaagtcacagctgcag

SEQ ID NO: 3354400 - DNA, 21 bp, Homo sapiens
acaagtcctggatgttgtgtg

SEQ ID NO: 3354401 - DNA, 13 bp, Homo sapiens
acaagtcttccag

SEQ ID NO: 3354402 - DNA, 19 bp, Homo sapiens
acaagtgagacaaaaagca

SEQ ID NO: 3354403 - DNA, 21 bp, Homo sapiens
acaagtgagacaaaaagcact

SEQ ID NO: 3354404 - DNA, 19 bp, Homo sapiens
acaagtgccctccaggctt

SEQ ID NO: 3354405 - DNA, 17 bp, Homo sapiens
acaagtggatgttttta

SEQ ID NO: 3354406 - DNA, 11 bp, Homo sapiens
acaagttatta

SEQ ID NO: 3354407 - DNA, 13 bp, Homo sapiens
acaagttccctgg

SEQ ID NO: 3354408 - DNA, 17 bp, Homo sapiens
acaagttgcgacggaga

SEQ ID NO: 3354409 - DNA, 18 bp, Homo sapiens
acaagttgcttttacctg

SEQ ID NO: 3354410 - DNA, 16 bp, Homo sapiens
acaagtttcagacagg

SEQ ID NO: 3354411 - DNA, 13 bp, Homo sapiens
acaagttttgtat

SEQ ID NO: 3354412 - DNA, 22 bp, Homo sapiens
acaagtttttctgtcaagaaga

SEQ ID NO: 3354413 - DNA, 13 bp, Homo sapiens
acaataaacagga

SEQ ID NO: 3354414 - DNA, 15 bp, Homo sapiens
acaataaacataaca

SEQ ID NO: 3354415 - DNA, 12 bp, Homo sapiens
acaataaacctc

SEQ ID NO: 3354416 - DNA, 13 bp, Homo sapiens
acaataaactggt

SEQ ID NO: 3354417 - DNA, 15 bp, Homo sapiens
acaataaatgtgctt

SEQ ID NO: 3354418 - DNA, 13 bp, Homo sapiens
acaataacccagt

SEQ ID NO: 3354419 - DNA, 15 bp, Homo sapiens
acaataacccagtta

SEQ ID NO: 3354420 - DNA, 16 bp, Homo sapiens
acaataacccagttac

SEQ ID NO: 3354421 - DNA, 17 bp, Homo sapiens
acaataactactgtgtt

SEQ ID NO: 3354422 - DNA, 18 bp, Homo sapiens
acaataatattgttgtat

SEQ ID NO: 3354423 - DNA, 22 bp, Homo sapiens
acaataatattgttgtataatt

SEQ ID NO: 3354424 - DNA, 13 bp, Homo sapiens
acaataatatttc

SEQ ID NO: 3354425 - DNA, 16 bp, Homo sapiens
acaatacaaatggatt

SEQ ID NO: 3354426 - DNA, 19 bp, Homo sapiens
acaatacctacaataaact

SEQ ID NO: 3354427 - DNA, 20 bp, Homo sapiens
acaatacctacaataaactg

SEQ ID NO: 3354428 - DNA, 19 bp, Homo sapiens
acaatagctttaccctcag

SEQ ID NO: 3354429 - DNA, 20 bp, Homo sapiens
acaatagctttaccctcagg

SEQ ID NO: 3354430 - DNA, 22 bp, Homo sapiens
acaatagggctgataatgtaat

SEQ ID NO: 3354431 - DNA, 18 bp, Homo sapiens
acaataggtctttctctc

SEQ ID NO: 3354432 - DNA, 13 bp, Homo sapiens
acaatagtatttc

SEQ ID NO: 3354433 - DNA, 14 bp, Homo sapiens
acaatagtcagaaa

SEQ ID NO: 3354434 - DNA, 16 bp, Homo sapiens
acaatagtcagaaaac

SEQ ID NO: 3354435 - DNA, 10 bp, Homo sapiens
acaatatata

SEQ ID NO: 3354436 - DNA, 15 bp, Homo sapiens
acaatatataaaaat

SEQ ID NO: 3354437 - DNA, 17 bp, Homo sapiens
acaatatataaaaatat

SEQ ID NO: 3354438 - DNA, 13 bp, Homo sapiens
acaatatatagaa

SEQ ID NO: 3354439 - DNA, 18 bp, Homo sapiens
acaatatatagaattgta

SEQ ID NO: 3354440 - DNA, 15 bp, Homo sapiens
acaatatcatatcat

SEQ ID NO: 3354441 - DNA, 14 bp, Homo sapiens
acaatatgtatgct

SEQ ID NO: 3354442 - DNA, 14 bp, Homo sapiens
acaatatgtgagtg

SEQ ID NO: 3354443 - DNA, 18 bp, Homo sapiens
acaatattttattctagg

SEQ ID NO: 3354444 - DNA, 17 bp, Homo sapiens
acaatcactaaacttta

SEQ ID NO: 3354445 - DNA, 16 bp, Homo sapiens
acaatcagtcccctcc

SEQ ID NO: 3354446 - DNA, 18 bp, Homo sapiens
acaatcagtcccctccca

SEQ ID NO: 3354447 - DNA, 20 bp, Homo sapiens
acaatcagtcccctcccatc

SEQ ID NO: 3354448 - DNA, 22 bp, Homo sapiens
acaatcagtcccctcccatctg

SEQ ID NO: 3354449 - DNA, 17 bp, Homo sapiens
acaatcagttatacagt

SEQ ID NO: 3354450 - DNA, 18 bp, Homo sapiens
acaatcatgaaatatgca

SEQ ID NO: 3354451 - DNA, 22 bp, Homo sapiens
acaatcatgaacagctctgaga

SEQ ID NO: 3354452 - DNA, 20 bp, Homo sapiens
acaatcatgagtcagacatt

SEQ ID NO: 3354453 - DNA, 18 bp, Homo sapiens
acaatcccaatctttcta

SEQ ID NO: 3354454 - DNA, 22 bp, Homo sapiens
acaatcctttgagttatagttt

SEQ ID NO: 3354455 - DNA, 22 bp, Homo sapiens
acaatctaacaataatatttca

SEQ ID NO: 3354456 - DNA, 18 bp, Homo sapiens
acaatctggaagaaaaaa

SEQ ID NO: 3354457 - DNA, 12 bp, Homo sapiens
acaatctttatt

SEQ ID NO: 3354458 - DNA, 13 bp, Homo sapiens
acaatctttgctg

SEQ ID NO: 3354459 - DNA, 14 bp, Homo sapiens
acaatgaactgctt

SEQ ID NO: 3354460 - DNA, 18 bp, Homo sapiens
acaatgaactgcttttcc

SEQ ID NO: 3354461 - DNA, 14 bp, Homo sapiens
acaatgaatgtata

SEQ ID NO: 3354462 - DNA, 17 bp, Homo sapiens
acaatgatgatgataat

SEQ ID NO: 3354463 - DNA, 19 bp, Homo sapiens
acaatgatgatgataatga

SEQ ID NO: 3354464 - DNA, 12 bp, Homo sapiens
acaatgcaaaac

SEQ ID NO: 3354465 - DNA, 16 bp, Homo sapiens
acaatgcaaaaccttt

SEQ ID NO: 3354466 - DNA, 22 bp, Homo sapiens
acaatgcagcaaggccctgctg

SEQ ID NO: 3354467 - DNA, 12 bp, Homo sapiens
acaatggcagct

SEQ ID NO: 3354468 - DNA, 12 bp, Homo sapiens
acaatgtaaagt

SEQ ID NO: 3354469 - DNA, 16 bp, Homo sapiens
acaatgtataaagatt

SEQ ID NO: 3354470 - DNA, 19 bp, Homo sapiens
acaatgtataaagattgta

SEQ ID NO: 3354471 - DNA, 20 bp, Homo sapiens
acaatgtatgtgaaagtgta

SEQ ID NO: 3354472 - DNA, 15 bp, Homo sapiens
acaatgtcagtattt

SEQ ID NO: 3354473 - DNA, 18 bp, Homo sapiens
acaatgtcagtatttcag

SEQ ID NO: 3354474 - DNA, 22 bp, Homo sapiens
acaatgtcgagtatattattat

SEQ ID NO: 3354475 - DNA, 17 bp, Homo sapiens
acaatgtgaactttatt

SEQ ID NO: 3354476 - DNA, 22 bp, Homo sapiens
acaatgtgaactttattaaata

SEQ ID NO: 3354477 - DNA, 11 bp, Homo sapiens
acaatgtgaat

SEQ ID NO: 3354478 - DNA, 16 bp, Homo sapiens
acaatgttgtccaaca

SEQ ID NO: 3354479 - DNA, 20 bp, Homo sapiens
acaatgttgtccaacaataa

SEQ ID NO: 3354480 - DNA, 21 bp, Homo sapiens
acaatgttgtccaacaataaa

SEQ ID NO: 3354481 - DNA, 18 bp, Homo sapiens
acaattaaaccgcatgtg

SEQ ID NO: 3354482 - DNA, 22 bp, Homo sapiens
acaattattccaaaccaaattt

SEQ ID NO: 3354483 - DNA, 22 bp, Homo sapiens
acaattcctagataaaaagatg

SEQ ID NO: 3354484 - DNA, 13 bp, Homo sapiens
acaattgaagtaa

SEQ ID NO: 3354485 - DNA, 13 bp, Homo sapiens
acaattgggagct

SEQ ID NO: 3354486 - DNA, 15 bp, Homo sapiens
acaattggtaaaact

SEQ ID NO: 3354487 - DNA, 22 bp, Homo sapiens
acaattggtaaaactcactgtg

SEQ ID NO: 3354488 - DNA, 19 bp, Homo sapiens
acaattgtccatggtctca

SEQ ID NO: 3354489 - DNA, 22 bp, Homo sapiens
acaattgtgggcataaactgtt

SEQ ID NO: 3354490 - DNA, 17 bp, Homo sapiens
acaattgtgtagccttt

SEQ ID NO: 3354491 - DNA, 18 bp, Homo sapiens
acaatttatgaattgaat

SEQ ID NO: 3354492 - DNA, 14 bp, Homo sapiens
acaatttattctga

SEQ ID NO: 3354493 - DNA, 16 bp, Homo sapiens
acaatttcctttatat

SEQ ID NO: 3354494 - DNA, 17 bp, Homo sapiens
acaatttcctttatatt

SEQ ID NO: 3354495 - DNA, 23 bp, Homo sapiens
acaatttcctttatatttagtga

SEQ ID NO: 3354496 - DNA, 17 bp, Homo sapiens
acaatttgtattacttt

SEQ ID NO: 3354497 - DNA, 13 bp, Homo sapiens
acaatttgttaat

SEQ ID NO: 3354498 - DNA, 16 bp, Homo sapiens
acaattttttttttcc

SEQ ID NO: 3354499 - DNA, 19 bp, Homo sapiens
acacaaaactccgccccca

SEQ ID NO: 3354500 - DNA, 13 bp, Homo sapiens
acacaaacaggaa

SEQ ID NO: 3354501 - DNA, 22 bp, Homo sapiens
acacaaaccacaactgacacag

SEQ ID NO: 3354502 - DNA, 14 bp, Homo sapiens
acacaaactgtaaa

SEQ ID NO: 3354503 - DNA, 20 bp, Homo sapiens
acacaaaggtggaataaaca

SEQ ID NO: 3354504 - DNA, 13 bp, Homo sapiens
acacaaattttca

SEQ ID NO: 3354505 - DNA, 17 bp, Homo sapiens
acacaagcaacaaacct

SEQ ID NO: 3354506 - DNA, 15 bp, Homo sapiens
acacaaggtgatttc

SEQ ID NO: 3354507 - DNA, 17 bp, Homo sapiens
acacaaggtgatttcag

SEQ ID NO: 3354508 - DNA, 13 bp, Homo sapiens
acacaagtaaaca

SEQ ID NO: 3354509 - DNA, 18 bp, Homo sapiens
acacaataggtctttctc

SEQ ID NO: 3354510 - DNA, 12 bp, Homo sapiens
acacaatatgta

SEQ ID NO: 3354511 - DNA, 12 bp, Homo sapiens
acagaaacaaaa

SEQ ID NO: 3354512 - DNA, 17 bp, Homo sapiens
acagaaacaaaaacact

SEQ ID NO: 3354513 - DNA, 17 bp, Homo sapiens
acagaaaccagaaaagc

SEQ ID NO: 3354514 - DNA, 15 bp, Homo sapiens
acagaaaccttttta

SEQ ID NO: 3354515 - DNA, 18 bp, Homo sapiens
acagaaacgcatccagca

SEQ ID NO: 3354516 - DNA, 16 bp, Homo sapiens
acagaaacgtgttaaa

SEQ ID NO: 3354517 - DNA, 13 bp, Homo sapiens
acagaaagctgcc

SEQ ID NO: 3354518 - DNA, 19 bp, Homo sapiens
acagaaatataataaaatg

SEQ ID NO: 3354519 - DNA, 17 bp, Homo sapiens
acagaaatggaaagcag

SEQ ID NO: 3354520 - DNA, 19 bp, Homo sapiens
acagaaatggggaattctc

SEQ ID NO: 3354521 - DNA, 14 bp, Homo sapiens
acagaaatgtgtca

SEQ ID NO: 3354522 - DNA, 12 bp, Homo sapiens
acagaacagctt

SEQ ID NO: 3354523 - DNA, 13 bp, Homo sapiens
acagaacagcttc

SEQ ID NO: 3354524 - DNA, 15 bp, Homo sapiens
acagaacagcttcag

SEQ ID NO: 3354525 - DNA, 16 bp, Homo sapiens
acagaacagcttcagg

SEQ ID NO: 3354526 - DNA, 14 bp, Homo sapiens
acagaacagggtca

SEQ ID NO: 3354527 - DNA, 17 bp, Homo sapiens
acagaaccttcaaccca

SEQ ID NO: 3354528 - DNA, 13 bp, Homo sapiens
acagaactaaatg

SEQ ID NO: 3354529 - DNA, 17 bp, Homo sapiens
acagaactaaatgttct

SEQ ID NO: 3354530 - DNA, 17 bp, Homo sapiens
acagaacttcagaaaga

SEQ ID NO: 3354531 - DNA, 18 bp, Homo sapiens
acagaacttcagaaagac

SEQ ID NO: 3354532 - DNA, 20 bp, Homo sapiens
acagaacttcagaaagactt

SEQ ID NO: 3354533 - DNA, 20 bp, Homo sapiens
acagaacttgaatgtgtcag

SEQ ID NO: 3354534 - DNA, 23 bp, Homo sapiens
acagaagcatttgtattttgtgt

SEQ ID NO: 3354535 - DNA, 15 bp, Homo sapiens
acagaataaagcagc

SEQ ID NO: 3354536 - DNA, 19 bp, Homo sapiens
acagaataaagcagcctga

SEQ ID NO: 3354537 - DNA, 11 bp, Homo sapiens
acagaataatc

SEQ ID NO: 3354538 - DNA, 19 bp, Homo sapiens
acagaatcttgttttgaaa

SEQ ID NO: 3354539 - DNA, 22 bp, Homo sapiens
acagaatggctatcaaaagaaa

SEQ ID NO: 3354540 - DNA, 20 bp, Homo sapiens
acagaatgttttactgtgaa

SEQ ID NO: 3354541 - DNA, 14 bp, Homo sapiens
acagaattttggaa

SEQ ID NO: 3354542 - DNA, 20 bp, Homo sapiens
acagacaaacttgatttctt

SEQ ID NO: 3354543 - DNA, 13 bp, Homo sapiens
acagacaagcagc

SEQ ID NO: 3354544 - DNA, 15 bp, Homo sapiens
acagacacaatatgt

SEQ ID NO: 3354545 - DNA, 13 bp, Homo sapiens
acagacacacaca

SEQ ID NO: 3354546 - DNA, 18 bp, Homo sapiens
acagacacacacacgcac

SEQ ID NO: 3354547 - DNA, 17 bp, Homo sapiens
acagacacacagcctca

SEQ ID NO: 3354548 - DNA, 12 bp, Homo sapiens
acagacagaaga

SEQ ID NO: 3354549 - DNA, 16 bp, Homo sapiens
acagacagacacacac

SEQ ID NO: 3354550 - DNA, 19 bp, Homo sapiens
acagaccacctttcacaaa

SEQ ID NO: 3354551 - DNA, 13 bp, Homo sapiens
acagacccaggtc

SEQ ID NO: 3354552 - DNA, 15 bp, Homo sapiens
acagacccaggtctt

SEQ ID NO: 3354553 - DNA, 16 bp, Homo sapiens
acagacccaggtcttc

SEQ ID NO: 3354554 - DNA, 18 bp, Homo sapiens
acagacccaggtcttcca

SEQ ID NO: 3354555 - DNA, 19 bp, Homo sapiens
acagacccaggtcttccag

SEQ ID NO: 3354556 - DNA, 14 bp, Homo sapiens
acagacccctggga

SEQ ID NO: 3354557 - DNA, 17 bp, Homo sapiens
acagacctgctttttga

SEQ ID NO: 3354558 - DNA, 20 bp, Homo sapiens
acagacctggagcccctggg

SEQ ID NO: 3354559 - DNA, 15 bp, Homo sapiens
acagactggcaataa

SEQ ID NO: 3354560 - DNA, 16 bp, Homo sapiens
acagactggcaataaa

SEQ ID NO: 3354561 - DNA, 15 bp, Homo sapiens
acagacttctccaga

SEQ ID NO: 3354562 - DNA, 23 bp, Homo sapiens
acagacttctggaaggctggctg

SEQ ID NO: 3354563 - DNA, 16 bp, Homo sapiens
acagacttgagaactt

SEQ ID NO: 3354564 - DNA, 14 bp, Homo sapiens
acagagaaaagcag

SEQ ID NO: 3354565 - DNA, 21 bp, Homo sapiens
acagagaaagggtaatttcct

SEQ ID NO: 3354566 - DNA, 16 bp, Homo sapiens
acagagaagggaagaa

SEQ ID NO: 3354567 - DNA, 20 bp, Homo sapiens
acagagaagtttgtagccag

SEQ ID NO: 3354568 - DNA, 18 bp, Homo sapiens
acagagacaagtaatttc

SEQ ID NO: 3354569 - DNA, 17 bp, Homo sapiens
acagagacattcctccg

SEQ ID NO: 3354570 - DNA, 18 bp, Homo sapiens
acagagacgcaggaatgg

SEQ ID NO: 3354571 - DNA, 11 bp, Homo sapiens
acagagactca

SEQ ID NO: 3354572 - DNA, 21 bp, Homo sapiens
acagagactcagatgaggaca

SEQ ID NO: 3354573 - DNA, 20 bp, Homo sapiens
acagagagacagacttgaga

SEQ ID NO: 3354574 - DNA, 16 bp, Homo sapiens
acagagaggagaaaca

SEQ ID NO: 3354575 - DNA, 20 bp, Homo sapiens
acagagaggagaaacacatc

SEQ ID NO: 3354576 - DNA, 21 bp, Homo sapiens
acagagagggcaccatcacaa

SEQ ID NO: 3354577 - DNA, 19 bp, Homo sapiens
acagagcacatttgtcagt

SEQ ID NO: 3354578 - DNA, 17 bp, Homo sapiens
acagagcaggggctcca

SEQ ID NO: 3354579 - DNA, 16 bp, Homo sapiens
acagagcgcccctccc

SEQ ID NO: 3354580 - DNA, 20 bp, Homo sapiens
acagagcgtccttccccctg

SEQ ID NO: 3354581 - DNA, 15 bp, Homo sapiens
acagagctctccagc

SEQ ID NO: 3354582 - DNA, 18 bp, Homo sapiens
acagagctctccagctcc

SEQ ID NO: 3354583 - DNA, 23 bp, Homo sapiens
acagaggccatgggcctcctgtg

SEQ ID NO: 3354584 - DNA, 24 bp, Homo sapiens
acagaggtagtctcactgcttgaa

SEQ ID NO: 3354585 - DNA, 19 bp, Homo sapiens
acagaggtattaaaactaa

SEQ ID NO: 3354586 - DNA, 19 bp, Homo sapiens
acagagtccaatttaagga

SEQ ID NO: 3354587 - DNA, 12 bp, Homo sapiens
acagagtctcac

SEQ ID NO: 3354588 - DNA, 17 bp, Homo sapiens
acagagtctcactgttg

SEQ ID NO: 3354589 - DNA, 23 bp, Homo sapiens
acagagtctcactgttgcccagg

SEQ ID NO: 3354590 - DNA, 15 bp, Homo sapiens
acagagtgagactct

SEQ ID NO: 3354591 - DNA, 21 bp, Homo sapiens
acagagtggcctccctgctgt

SEQ ID NO: 3354592 - DNA, 19 bp, Homo sapiens
acagagtgggccccgggct

SEQ ID NO: 3354593 - DNA, 18 bp, Homo sapiens
acagagtggtctttctgg

SEQ ID NO: 3354594 - DNA, 21 bp, Homo sapiens
acagagttcacaggaggccag

SEQ ID NO: 3354595 - DNA, 18 bp, Homo sapiens
acagagttttcactctta

SEQ ID NO: 3354596 - DNA, 22 bp, Homo sapiens
acagataacattaggttgtcct

SEQ ID NO: 3354597 - DNA, 15 bp, Homo sapiens
acagataagcaagag

SEQ ID NO: 3354598 - DNA, 18 bp, Homo sapiens
acagataagcaagagaga

SEQ ID NO: 3354599 - DNA, 14 bp, Homo sapiens
acagataattcatt

SEQ ID NO: 3354600 - DNA, 18 bp, Homo sapiens
acagataattcatttgta

SEQ ID NO: 3354601 - DNA, 19 bp, Homo sapiens
acagataattcatttgtat

SEQ ID NO: 3354602 - DNA, 20 bp, Homo sapiens
acagatagatatatgctctg

SEQ ID NO: 3354603 - DNA, 14 bp, Homo sapiens
acagatcagaacat

SEQ ID NO: 3354604 - DNA, 23 bp, Homo sapiens
acagatcccactggaagatcccc

SEQ ID NO: 3354605 - DNA, 18 bp, Homo sapiens
acagatcctttttccatc

SEQ ID NO: 3354606 - DNA, 13 bp, Homo sapiens
acagatgaaaatt

SEQ ID NO: 3354607 - DNA, 17 bp, Homo sapiens
acagatgaccataattt

SEQ ID NO: 3354608 - DNA, 20 bp, Homo sapiens
acagatgcaatgtgctactg

SEQ ID NO: 3354609 - DNA, 14 bp, Homo sapiens
acagatgccccaga

SEQ ID NO: 3354610 - DNA, 18 bp, Homo sapiens
acagatgccccagagctg

SEQ ID NO: 3354611 - DNA, 18 bp, Homo sapiens
acagatgccttttttgta

SEQ ID NO: 3354612 - DNA, 20 bp, Homo sapiens
acagatgtcagcttcccagc

SEQ ID NO: 3354613 - DNA, 15 bp, Homo sapiens
acagatgtctctggg

SEQ ID NO: 3354614 - DNA, 18 bp, Homo sapiens
acagatgtctctggggca

SEQ ID NO: 3354615 - DNA, 16 bp, Homo sapiens
acagatgtgaaatgaa

SEQ ID NO: 3354616 - DNA, 19 bp, Homo sapiens
acagattcaggccagccca

SEQ ID NO: 3354617 - DNA, 20 bp, Homo sapiens
acagattcaggccagcccag

SEQ ID NO: 3354618 - DNA, 22 bp, Homo sapiens
acagattcaggccagcccagcc

SEQ ID NO: 3354619 - DNA, 14 bp, Homo sapiens
acagattctgacat

SEQ ID NO: 3354620 - DNA, 14 bp, Homo sapiens
acagattgcctcct

SEQ ID NO: 3354621 - DNA, 16 bp, Homo sapiens
acagattgcctcctta

SEQ ID NO: 3354622 - DNA, 13 bp, Homo sapiens
acagattgtttct

SEQ ID NO: 3354623 - DNA, 23 bp, Homo sapiens
acagattgtttctatacaaatat

SEQ ID NO: 3354624 - DNA, 17 bp, Homo sapiens
acagatttcatacctca

SEQ ID NO: 3354625 - DNA, 14 bp, Homo sapiens
acagattttaccta

SEQ ID NO: 3354626 - DNA, 22 bp, Homo sapiens
acagattttggggttgtgttgt

SEQ ID NO: 3354627 - DNA, 22 bp, Homo sapiens
acagcaaacaggtgctaatttg

SEQ ID NO: 3354628 - DNA, 14 bp, Homo sapiens
acagcaagaaataa

SEQ ID NO: 3354629 - DNA, 21 bp, Homo sapiens
acagcaagtagataaatattt

SEQ ID NO: 3354630 - DNA, 19 bp, Homo sapiens
acagcaattcctcaggcta

SEQ ID NO: 3354631 - DNA, 18 bp, Homo sapiens
acagcacaccagccgctg

SEQ ID NO: 3354632 - DNA, 16 bp, Homo sapiens
acagcacagctccctg

SEQ ID NO: 3354633 - DNA, 18 bp, Homo sapiens
acagcacagctccctgcc

SEQ ID NO: 3354634 - DNA, 15 bp, Homo sapiens
acagcacatgctggc

SEQ ID NO: 3354635 - DNA, 17 bp, Homo sapiens
acagcacatgctggcca

SEQ ID NO: 3354636 - DNA, 14 bp, Homo sapiens
acagcactactctg

SEQ ID NO: 3354637 - DNA, 23 bp, Homo sapiens
acatatcagcaggagtaataaat

SEQ ID NO: 3354638 - DNA, 15 bp, Homo sapiens
acatatctttattaa

SEQ ID NO: 3354639 - DNA, 17 bp, Homo sapiens
acatatgcaccttgtgt

SEQ ID NO: 3354640 - DNA, 18 bp, Homo sapiens
acatatgcaccttgtgtc

SEQ ID NO: 3354641 - DNA, 23 bp, Homo sapiens
acatatggactctgcacatgaat

SEQ ID NO: 3354642 - DNA, 16 bp, Homo sapiens
acatatgtagaaacat

SEQ ID NO: 3354643 - DNA, 18 bp, Homo sapiens
acatatgtagaaacattt

SEQ ID NO: 3354644 - DNA, 20 bp, Homo sapiens
acatatgtagaaacatttag

SEQ ID NO: 3354645 - DNA, 17 bp, Homo sapiens
acatatgtagactatat

SEQ ID NO: 3354646 - DNA, 18 bp, Homo sapiens
acatattaggaaaatatg

SEQ ID NO: 3354647 - DNA, 21 bp, Homo sapiens
acatattatgcctgaatgact

SEQ ID NO: 3354648 - DNA, 23 bp, Homo sapiens
acatattgttagggtcagccatt

SEQ ID NO: 3354649 - DNA, 23 bp, Homo sapiens
acatatttcattttaacatgatt

SEQ ID NO: 3354650 - DNA, 13 bp, Homo sapiens
acatcaaaccttt

SEQ ID NO: 3354651 - DNA, 17 bp, Homo sapiens
acatcaaataaatttct

SEQ ID NO: 3354652 - DNA, 13 bp, Homo sapiens
acatcaaataaga

SEQ ID NO: 3354653 - DNA, 18 bp, Homo sapiens
acatcaaataagaaataa

SEQ ID NO: 3354654 - DNA, 15 bp, Homo sapiens
acatcaatcctggta

SEQ ID NO: 3354655 - DNA, 15 bp, Homo sapiens
acatcaatgttcatt

SEQ ID NO: 3354656 - DNA, 20 bp, Homo sapiens
acatcaatgttcattgtaat

SEQ ID NO: 3354657 - DNA, 22 bp, Homo sapiens
acatcactgcttgatgaagcaa

SEQ ID NO: 3354658 - DNA, 16 bp, Homo sapiens
acatcacttgtacaaa

SEQ ID NO: 3354659 - DNA, 20 bp, Homo sapiens
acatcataaaatttttatat

SEQ ID NO: 3354660 - DNA, 18 bp, Homo sapiens
acatcataattacattcc

SEQ ID NO: 3354661 - DNA, 15 bp, Homo sapiens
acatcatgaatttta

SEQ ID NO: 3354662 - DNA, 14 bp, Homo sapiens
acatccaaggagaa

SEQ ID NO: 3354663 - DNA, 21 bp, Homo sapiens
acatccatgtcctatgtgtga

SEQ ID NO: 3354664 - DNA, 18 bp, Homo sapiens
acatccatgtttgtaaaa

SEQ ID NO: 3354665 - DNA, 20 bp, Homo sapiens
acatccatgtttgtaaaact

SEQ ID NO: 3354666 - DNA, 13 bp, Homo sapiens
acatccattccca

SEQ ID NO: 3354667 - DNA, 17 bp, Homo sapiens
acatccattcccaagaa

SEQ ID NO: 3354668 - DNA, 18 bp, Homo sapiens
acatccattcccaagaaa

SEQ ID NO: 3354669 - DNA, 21 bp, Homo sapiens
acatccattcccaagaaatgc

SEQ ID NO: 3354670 - DNA, 13 bp, Homo sapiens
acatcccagcctg

SEQ ID NO: 3354671 - DNA, 18 bp, Homo sapiens
acatcccggcctcttcca

SEQ ID NO: 3354672 - DNA, 12 bp, Homo sapiens
acatcccttcct

SEQ ID NO: 3354673 - DNA, 14 bp, Homo sapiens
acatcccttcctgg

SEQ ID NO: 3354674 - DNA, 15 bp, Homo sapiens
acatcccttcctgga

SEQ ID NO: 3354675 - DNA, 18 bp, Homo sapiens
acatcccttcctggaaac

SEQ ID NO: 3354676 - DNA, 16 bp, Homo sapiens
acatccgccttttgta

SEQ ID NO: 3354677 - DNA, 18 bp, Homo sapiens
acatccgccttttgtata

SEQ ID NO: 3354678 - DNA, 14 bp, Homo sapiens
acatcctccgtcca

SEQ ID NO: 3354679 - DNA, 13 bp, Homo sapiens
acatcctcctccc

SEQ ID NO: 3354680 - DNA, 18 bp, Homo sapiens
acatcctttgcagggcag

SEQ ID NO: 3354681 - DNA, 23 bp, Homo sapiens
acatcctttgcagggcagcccca

SEQ ID NO: 3354682 - DNA, 14 bp, Homo sapiens
acatcgatatgtat

SEQ ID NO: 3354683 - DNA, 16 bp, Homo sapiens
acatcgatatgtatat

SEQ ID NO: 3354684 - DNA, 21 bp, Homo sapiens
acatcgccaaggactgactga

SEQ ID NO: 3354685 - DNA, 18 bp, Homo sapiens
acatcgtgggtcactaca

SEQ ID NO: 3354686 - DNA, 18 bp, Homo sapiens
acatctaataagtatata

SEQ ID NO: 3354687 - DNA, 12 bp, Homo sapiens
acatctcagacc

SEQ ID NO: 3354688 - DNA, 14 bp, Homo sapiens
acatctcctggcta

SEQ ID NO: 3354689 - DNA, 21 bp, Homo sapiens
acatctcctggctaagcctct

SEQ ID NO: 3354690 - DNA, 21 bp, Homo sapiens
acatctctccccaaccctagg

SEQ ID NO: 3354691 - DNA, 13 bp, Homo sapiens
acatctcttcctc

SEQ ID NO: 3354692 - DNA, 18 bp, Homo sapiens
acatctgacctggcatct

SEQ ID NO: 3354693 - DNA, 14 bp, Homo sapiens
acatctgccagacc

SEQ ID NO: 3354694 - DNA, 15 bp, Homo sapiens
acatctgccagacct

SEQ ID NO: 3354695 - DNA, 11 bp, Homo sapiens
acatctgcctt

SEQ ID NO: 3354696 - DNA, 12 bp, Homo sapiens
acatctgcctta

SEQ ID NO: 3354697 - DNA, 23 bp, Homo sapiens
acatctgccttaaaaccaaagag

SEQ ID NO: 3354698 - DNA, 21 bp, Homo sapiens
acatctgtgatgactggttgt

SEQ ID NO: 3354699 - DNA, 16 bp, Homo sapiens
acatctgttttaaatt

SEQ ID NO: 3354700 - DNA, 17 bp, Homo sapiens
acatctgttttaaattt

SEQ ID NO: 3354701 - DNA, 18 bp, Homo sapiens
acatcttctgtgaaatat

SEQ ID NO: 3354702 - DNA, 15 bp, Homo sapiens
acatcttgctctgct

SEQ ID NO: 3354703 - DNA, 16 bp, Homo sapiens
acatcttgctctgctg

SEQ ID NO: 3354704 - DNA, 21 bp, Homo sapiens
acatcttgctctgctgacaga

SEQ ID NO: 3354705 - DNA, 20 bp, Homo sapiens
acatctttaacttagtattt

SEQ ID NO: 3354706 - DNA, 13 bp, Homo sapiens
acatctttaagta

SEQ ID NO: 3354707 - DNA, 17 bp, Homo sapiens
acatctttatctgttct

SEQ ID NO: 3354708 - DNA, 20 bp, Homo sapiens
acatctttcctcaagtatct

SEQ ID NO: 3354709 - DNA, 23 bp, Homo sapiens
acatgaaaattttaaaaatacat

SEQ ID NO: 3354710 - DNA, 18 bp, Homo sapiens
acatgaaacctacacact

SEQ ID NO: 3354711 - DNA, 13 bp, Homo sapiens
acatgaagaagct

SEQ ID NO: 3354712 - DNA, 15 bp, Homo sapiens
acatgaatacaaatt

SEQ ID NO: 3354713 - DNA, 21 bp, Homo sapiens
acatgaatcccacccacatgt

SEQ ID NO: 3354714 - DNA, 12 bp, Homo sapiens
acatgacactga

SEQ ID NO: 3354715 - DNA, 22 bp, Homo sapiens
acatgacgccagataaaatgtt

SEQ ID NO: 3354716 - DNA, 23 bp, Homo sapiens
acatgacgccagataaaatgttc

SEQ ID NO: 3354717 - DNA, 14 bp, Homo sapiens
acatgactgggcct

SEQ ID NO: 3354718 - DNA, 15 bp, Homo sapiens
acatgactgggcctc

SEQ ID NO: 3354719 - DNA, 21 bp, Homo sapiens
acatgaggacatgatggagcg

SEQ ID NO: 3354720 - DNA, 19 bp, Homo sapiens
acatgaggccatctcagga

SEQ ID NO: 3354721 - DNA, 21 bp, Homo sapiens
acatgaggccatctcaggaga

SEQ ID NO: 3354722 - DNA, 22 bp, Homo sapiens
acatgagttattcataaagaga

SEQ ID NO: 3354723 - DNA, 20 bp, Homo sapiens
acatgatctgtttttcacca

SEQ ID NO: 3354724 - DNA, 17 bp, Homo sapiens
acatgatcttctttata

SEQ ID NO: 3354725 - DNA, 16 bp, Homo sapiens
acatgatttccttgaa

SEQ ID NO: 3354726 - DNA, 15 bp, Homo sapiens
acatgcaaaaagaaa

SEQ ID NO: 3354727 - DNA, 15 bp, Homo sapiens
acatgcaacccgaag

SEQ ID NO: 3354728 - DNA, 20 bp, Homo sapiens
acatgcaaggcactgtacta

SEQ ID NO: 3354729 - DNA, 19 bp, Homo sapiens
acatgcaataaaatttaaa

SEQ ID NO: 3354730 - DNA, 17 bp, Homo sapiens
acatgcactatgaggaa

SEQ ID NO: 3354731 - DNA, 18 bp, Homo sapiens
acatgcagcccatgccca

SEQ ID NO: 3354732 - DNA, 22 bp, Homo sapiens
acatgcagcccatgcccacctg

SEQ ID NO: 3354733 - DNA, 15 bp, Homo sapiens
acatgcagttcatta

SEQ ID NO: 3354734 - DNA, 15 bp, Homo sapiens
acatgcattgttggc

SEQ ID NO: 3354735 - DNA, 17 bp, Homo sapiens
acatgcattgttggcta

SEQ ID NO: 3354736 - DNA, 18 bp, Homo sapiens
acatgcattgttggctat

SEQ ID NO: 3354737 - DNA, 22 bp, Homo sapiens
acatgcattgttggctatttga

SEQ ID NO: 3354738 - DNA, 12 bp, Homo sapiens
acatgcatttga

SEQ ID NO: 3354739 - DNA, 15 bp, Homo sapiens
acatgcctgccccaa

SEQ ID NO: 3354740 - DNA, 21 bp, Homo sapiens
acatgcctgccccaaacaaat

SEQ ID NO: 3354741 - DNA, 16 bp, Homo sapiens
acatgctgtgctcttt

SEQ ID NO: 3354742 - DNA, 21 bp, Homo sapiens
acatgctgtgctctttgaaga

SEQ ID NO: 3354743 - DNA, 14 bp, Homo sapiens
acatgcttgaataa

SEQ ID NO: 3354744 - DNA, 21 bp, Homo sapiens
acatgcttttctgccactcca

SEQ ID NO: 3354745 - DNA, 18 bp, Homo sapiens
acatggaataacatgtaa

SEQ ID NO: 3354746 - DNA, 20 bp, Homo sapiens
acatggaataacatgtaatt

SEQ ID NO: 3354747 - DNA, 23 bp, Homo sapiens
acatggacccaagataaaagaat

SEQ ID NO: 3354748 - DNA, 23 bp, Homo sapiens
acatggacttgtatatttgtaca

SEQ ID NO: 3354749 - DNA, 21 bp, Homo sapiens
acatggagactcctgccctgt

SEQ ID NO: 3354750 - DNA, 19 bp, Homo sapiens
acatggagccccctctgcc

SEQ ID NO: 3354751 - DNA, 16 bp, Homo sapiens
acatggaggttctaag

SEQ ID NO: 3354752 - DNA, 19 bp, Homo sapiens
acatggaggttctaaggcc

SEQ ID NO: 3354753 - DNA, 15 bp, Homo sapiens
acatggagtatatgt

SEQ ID NO: 3354754 - DNA, 15 bp, Homo sapiens
acatggatacttcct

SEQ ID NO: 3354755 - DNA, 19 bp, Homo sapiens
acatggatacttcctgggt

SEQ ID NO: 3354756 - DNA, 18 bp, Homo sapiens
acatggatgcgaggacca

SEQ ID NO: 3354757 - DNA, 19 bp, Homo sapiens
acatggatgcgaggaccac

SEQ ID NO: 3354758 - DNA, 21 bp, Homo sapiens
acatggcccctccccctgcca

SEQ ID NO: 3354759 - DNA, 22 bp, Homo sapiens
acatggcccctccccctgccag

SEQ ID NO: 3354760 - DNA, 19 bp, Homo sapiens
acatggctctggactctaa

SEQ ID NO: 3354761 - DNA, 22 bp, Homo sapiens
acatggctctggactctaaaga

SEQ ID NO: 3354762 - DNA, 12 bp, Homo sapiens
accagttaattt

SEQ ID NO: 3354763 - DNA, 14 bp, Homo sapiens
accagttaattttt

SEQ ID NO: 3354764 - DNA, 16 bp, Homo sapiens
accagttaatttttcc

SEQ ID NO: 3354765 - DNA, 16 bp, Homo sapiens
accagttctcatgggt

SEQ ID NO: 3354766 - DNA, 21 bp, Homo sapiens
accagttctcatgggtggcac

SEQ ID NO: 3354767 - DNA, 20 bp, Homo sapiens
accagttgccctagcccaga

SEQ ID NO: 3354768 - DNA, 19 bp, Homo sapiens
accataatcttagagacaa

SEQ ID NO: 3354769 - DNA, 22 bp, Homo sapiens
accataatgtactgatttcagt

SEQ ID NO: 3354770 - DNA, 18 bp, Homo sapiens
accataatgttacattat

SEQ ID NO: 3354771 - DNA, 20 bp, Homo sapiens
accataccactttgacacgc

SEQ ID NO: 3354772 - DNA, 19 bp, Homo sapiens
accatactcatttctaaaa

SEQ ID NO: 3354773 - DNA, 15 bp, Homo sapiens
accatactgagggac

SEQ ID NO: 3354774 - DNA, 18 bp, Homo sapiens
accatagcgctgctctta

SEQ ID NO: 3354775 - DNA, 15 bp, Homo sapiens
accatagctacatca

SEQ ID NO: 3354776 - DNA, 12 bp, Homo sapiens
accatatgaatt

SEQ ID NO: 3354777 - DNA, 13 bp, Homo sapiens
accatatgatact

SEQ ID NO: 3354778 - DNA, 16 bp, Homo sapiens
accatatttactcttt

SEQ ID NO: 3354779 - DNA, 21 bp, Homo sapiens
accatattttattgtattttg

SEQ ID NO: 3354780 - DNA, 22 bp, Homo sapiens
accatattttattgtattttga

SEQ ID NO: 3354781 - DNA, 15 bp, Homo sapiens
accatcaccaccgcc

SEQ ID NO: 3354782 - DNA, 16 bp, Homo sapiens
accatcaccaccgcct

SEQ ID NO: 3354783 - DNA, 18 bp, Homo sapiens
accatcaccaccgcctct

SEQ ID NO: 3354784 - DNA, 14 bp, Homo sapiens
accatcatgtctgg

SEQ ID NO: 3354785 - DNA, 13 bp, Homo sapiens
accatccctgcca

SEQ ID NO: 3354786 - DNA, 19 bp, Homo sapiens
accatcctggccaacatga

SEQ ID NO: 3354787 - DNA, 13 bp, Homo sapiens
accatcctggctg

SEQ ID NO: 3354788 - DNA, 14 bp, Homo sapiens
accatcctggctgc

SEQ ID NO: 3354789 - DNA, 15 bp, Homo sapiens
accatcgctttattg

SEQ ID NO: 3354790 - DNA, 13 bp, Homo sapiens
accatctaatagc

SEQ ID NO: 3354791 - DNA, 18 bp, Homo sapiens
accatcttcataatttgc

SEQ ID NO: 3354792 - DNA, 18 bp, Homo sapiens
accatgaacagaaaacat

SEQ ID NO: 3354793 - DNA, 23 bp, Homo sapiens
accatgaacagaaaacattctga

SEQ ID NO: 3354794 - DNA, 18 bp, Homo sapiens
accatgaagtaaattatg

SEQ ID NO: 3354795 - DNA, 23 bp, Homo sapiens
accatgagaataagagaaagaaa

SEQ ID NO: 3354796 - DNA, 15 bp, Homo sapiens
accatgcaggaagga

SEQ ID NO: 3354797 - DNA, 19 bp, Homo sapiens
accatgcctcactaatttt

SEQ ID NO: 3354798 - DNA, 19 bp, Homo sapiens
accatgctcatctgctggt

SEQ ID NO: 3354799 - DNA, 22 bp, Homo sapiens
accatgctgctttttggcacag

SEQ ID NO: 3354800 - DNA, 17 bp, Homo sapiens
accatggttaagagtcc

SEQ ID NO: 3354801 - DNA, 20 bp, Homo sapiens
accatgtacctaatccaaat

SEQ ID NO: 3354802 - DNA, 19 bp, Homo sapiens
accatgtctctaagccaac

SEQ ID NO: 3354803 - DNA, 16 bp, Homo sapiens
accatgtgagctcttc

SEQ ID NO: 3354804 - DNA, 15 bp, Homo sapiens
accatgtgtcacttg

SEQ ID NO: 3354805 - DNA, 19 bp, Homo sapiens
accatgtgtcacttgtgct

SEQ ID NO: 3354806 - DNA, 21 bp, Homo sapiens
accatgtgtcacttgtgcttt

SEQ ID NO: 3354807 - DNA, 12 bp, Homo sapiens
accatgttcatt

SEQ ID NO: 3354808 - DNA, 18 bp, Homo sapiens
accatgttcattataatc

SEQ ID NO: 3354809 - DNA, 20 bp, Homo sapiens
accattaagtcatgtgtgaa

SEQ ID NO: 3354810 - DNA, 16 bp, Homo sapiens
accattaattacatac

SEQ ID NO: 3354811 - DNA, 17 bp, Homo sapiens
accattaattacataca

SEQ ID NO: 3354812 - DNA, 14 bp, Homo sapiens
accattagcataat

SEQ ID NO: 3354813 - DNA, 14 bp, Homo sapiens
accattatacttta

SEQ ID NO: 3354814 - DNA, 15 bp, Homo sapiens
accattccccatggg

SEQ ID NO: 3354815 - DNA, 13 bp, Homo sapiens
accattcctgcct

SEQ ID NO: 3354816 - DNA, 23 bp, Homo sapiens
accattgagctagcgatttcaga

SEQ ID NO: 3354817 - DNA, 21 bp, Homo sapiens
accattgtcttgttctgtgat

SEQ ID NO: 3354818 - DNA, 18 bp, Homo sapiens
accattgtgaagcaccta

SEQ ID NO: 3354819 - DNA, 12 bp, Homo sapiens
accatttataat

SEQ ID NO: 3354820 - DNA, 13 bp, Homo sapiens
accatttatacaa

SEQ ID NO: 3354821 - DNA, 18 bp, Homo sapiens
accatttatgaaggtttg

SEQ ID NO: 3354822 - DNA, 14 bp, Homo sapiens
accatttcagagag

SEQ ID NO: 3354823 - DNA, 22 bp, Homo sapiens
accatttcctcagcttatctct

SEQ ID NO: 3354824 - DNA, 13 bp, Homo sapiens
accatttgtaata

SEQ ID NO: 3354825 - DNA, 14 bp, Homo sapiens
accatttgtaataa

SEQ ID NO: 3354826 - DNA, 20 bp, Homo sapiens
accattttagttcctttatt

SEQ ID NO: 3354827 - DNA, 22 bp, Homo sapiens
accattttagttcctttattta

SEQ ID NO: 3354828 - DNA, 17 bp, Homo sapiens
accattttcccatcatc

SEQ ID NO: 3354829 - DNA, 22 bp, Homo sapiens
accattttggggtacccactgc

SEQ ID NO: 3354830 - DNA, 15 bp, Homo sapiens
accatttttgttact

SEQ ID NO: 3354831 - DNA, 12 bp, Homo sapiens
acccaaaacacg

SEQ ID NO: 3354832 - DNA, 14 bp, Homo sapiens
acccaaaagagaaa

SEQ ID NO: 3354833 - DNA, 15 bp, Homo sapiens
acccaaaagagaaaa

SEQ ID NO: 3354834 - DNA, 17 bp, Homo sapiens
acccaaagcatggacta

SEQ ID NO: 3354835 - DNA, 17 bp, Homo sapiens
acccaaagcggtccctg

SEQ ID NO: 3354836 - DNA, 15 bp, Homo sapiens
acccaacccaaacca

SEQ ID NO: 3354837 - DNA, 17 bp, Homo sapiens
acccaaccctatctcct

SEQ ID NO: 3354838 - DNA, 22 bp, Homo sapiens
acccaagccctgaggcctgagg

SEQ ID NO: 3354839 - DNA, 23 bp, Homo sapiens
acccaagccctgaggcctgaggc

SEQ ID NO: 3354840 - DNA, 20 bp, Homo sapiens
acccaagcctgctggctgcg

SEQ ID NO: 3354841 - DNA, 17 bp, Homo sapiens
acccaaggaaaactgca

SEQ ID NO: 3354842 - DNA, 16 bp, Homo sapiens
acccaaggagcacagg

SEQ ID NO: 3354843 - DNA, 22 bp, Homo sapiens
acccaaggagcacaggtcccac

SEQ ID NO: 3354844 - DNA, 13 bp, Homo sapiens
acccaatccaaat

SEQ ID NO: 3354845 - DNA, 18 bp, Homo sapiens
acccacaccgtcttcctt

SEQ ID NO: 3354846 - DNA, 17 bp, Homo sapiens
acccacccatcttcctg

SEQ ID NO: 3354847 - DNA, 17 bp, Homo sapiens
acccaccccacctgcag

SEQ ID NO: 3354848 - DNA, 23 bp, Homo sapiens
acccaccccacctgcagggctgc

SEQ ID NO: 3354849 - DNA, 12 bp, Homo sapiens
acccacccctgc

SEQ ID NO: 3354850 - DNA, 14 bp, Homo sapiens
acccacccctgtgc

SEQ ID NO: 3354851 - DNA, 15 bp, Homo sapiens
acccaccctcctttc

SEQ ID NO: 3354852 - DNA, 15 bp, Homo sapiens
acccaccctgtgcca

SEQ ID NO: 3354853 - DNA, 22 bp, Homo sapiens
acccaccctgtgccatcaccat

SEQ ID NO: 3354854 - DNA, 20 bp, Homo sapiens
acccaccgatggagccccca

SEQ ID NO: 3354855 - DNA, 22 bp, Homo sapiens
acccaccgatggagcccccaga

SEQ ID NO: 3354856 - DNA, 17 bp, Homo sapiens
acccaccgtccgccctg

SEQ ID NO: 3354857 - DNA, 19 bp, Homo sapiens
acccaccgtccgccctgct

SEQ ID NO: 3354858 - DNA, 14 bp, Homo sapiens
acccacctcagcct

SEQ ID NO: 3354859 - DNA, 15 bp, Homo sapiens
acccacctccaccca

SEQ ID NO: 3354860 - DNA, 19 bp, Homo sapiens
acccacctccacccagccc

SEQ ID NO: 3354861 - DNA, 20 bp, Homo sapiens
acccacctccacccagcccc

SEQ ID NO: 3354862 - DNA, 21 bp, Homo sapiens
acccacctctggccctgtgta

SEQ ID NO: 3354863 - DNA, 21 bp, Homo sapiens
acccacctttgccacaaagct

SEQ ID NO: 3354864 - DNA, 21 bp, Homo sapiens
acccacgttctcacacccacc

SEQ ID NO: 3354865 - DNA, 17 bp, Homo sapiens
acccactcaccagggtc

SEQ ID NO: 3354866 - DNA, 15 bp, Homo sapiens
acccactcaggattg

SEQ ID NO: 3354867 - DNA, 14 bp, Homo sapiens
acccactgctctgg

SEQ ID NO: 3354868 - DNA, 15 bp, Homo sapiens
acccactgctctggt

SEQ ID NO: 3354869 - DNA, 17 bp, Homo sapiens
acccactgtcaggcctc

SEQ ID NO: 3354870 - DNA, 22 bp, Homo sapiens
acccactgtcaggcctctgagc

SEQ ID NO: 3354871 - DNA, 22 bp, Homo sapiens
acccacttgtcactgacacaaa

SEQ ID NO: 3354872 - DNA, 21 bp, Homo sapiens
acccagaatggagcctgctct

SEQ ID NO: 3354873 - DNA, 17 bp, Homo sapiens
acccagaccccaggctg

SEQ ID NO: 3354874 - DNA, 20 bp, Homo sapiens
acccagactggaatgcagtg

SEQ ID NO: 3354875 - DNA, 24 bp, Homo sapiens
acccagagcaccccctgctccacc

SEQ ID NO: 3354876 - DNA, 20 bp, Homo sapiens
acccagagtggagtctgagt

SEQ ID NO: 3354877 - DNA, 11 bp, Homo sapiens
acccagatgcc

SEQ ID NO: 3354878 - DNA, 21 bp, Homo sapiens
acccagatggaaaaataacaa

SEQ ID NO: 3354879 - DNA, 14 bp, Homo sapiens
acccagattttatt

SEQ ID NO: 3354880 - DNA, 15 bp, Homo sapiens
acccagcagttctgt

SEQ ID NO: 3354881 - DNA, 20 bp, Homo sapiens
acccagcatctcccagcaag

SEQ ID NO: 3354882 - DNA, 16 bp, Homo sapiens
acccagcccacttctg

SEQ ID NO: 3354883 - DNA, 13 bp, Homo sapiens
acccagcccctgg

SEQ ID NO: 3354884 - DNA, 16 bp, Homo sapiens
acccagccccttgaga

SEQ ID NO: 3354885 - DNA, 17 bp, Homo sapiens
acccagccccttgagaa

SEQ ID NO: 3354886 - DNA, 12 bp, Homo sapiens
acccagcctcag

SEQ ID NO: 3354887 - DNA, 23 bp, Homo sapiens
acccagcctcagtcctcccctca

SEQ ID NO: 3354888 - DNA, 18 bp, Homo sapiens
accctgccttatcttgca

SEQ ID NO: 3354889 - DNA, 20 bp, Homo sapiens
accctgcgaaggggccctgg

SEQ ID NO: 3354890 - DNA, 14 bp, Homo sapiens
accctgctcctcct

SEQ ID NO: 3354891 - DNA, 18 bp, Homo sapiens
accctgctcctcctgccc

SEQ ID NO: 3354892 - DNA, 14 bp, Homo sapiens
accctgctgccttc

SEQ ID NO: 3354893 - DNA, 18 bp, Homo sapiens
accctggaattcagcacc

SEQ ID NO: 3354894 - DNA, 23 bp, Homo sapiens
accctggcactataatgtaagct

SEQ ID NO: 3354895 - DNA, 15 bp, Homo sapiens
accctggcattatgt

SEQ ID NO: 3354896 - DNA, 19 bp, Homo sapiens
accctggccgccccctgcc

SEQ ID NO: 3354897 - DNA, 11 bp, Homo sapiens
accctggcctg

SEQ ID NO: 3354898 - DNA, 20 bp, Homo sapiens
accctggggacccccacgat

SEQ ID NO: 3354899 - DNA, 16 bp, Homo sapiens
accctggggagaaagt

SEQ ID NO: 3354900 - DNA, 14 bp, Homo sapiens
accctgggtgccat

SEQ ID NO: 3354901 - DNA, 20 bp, Homo sapiens
accctgggtgggctctgtgc

SEQ ID NO: 3354902 - DNA, 17 bp, Homo sapiens
accctgtacctcatccc

SEQ ID NO: 3354903 - DNA, 14 bp, Homo sapiens
accctgtcccccag

SEQ ID NO: 3354904 - DNA, 19 bp, Homo sapiens
accctgtcccccagctctg

SEQ ID NO: 3354905 - DNA, 22 bp, Homo sapiens
accctgtcccccagctctggtg

SEQ ID NO: 3354906 - DNA, 21 bp, Homo sapiens
accctgtctcttaaagaaaaa

SEQ ID NO: 3354907 - DNA, 23 bp, Homo sapiens
accctgtcttctgggcacagtgg

SEQ ID NO: 3354908 - DNA, 19 bp, Homo sapiens
accctgtgacatggtgcct

SEQ ID NO: 3354909 - DNA, 19 bp, Homo sapiens
accctgtgctggtgtcctg

SEQ ID NO: 3354910 - DNA, 14 bp, Homo sapiens
accctgtggccctg

SEQ ID NO: 3354911 - DNA, 17 bp, Homo sapiens
accctgtggccctggct

SEQ ID NO: 3354912 - DNA, 17 bp, Homo sapiens
acccttaacccaaggag

SEQ ID NO: 3354913 - DNA, 22 bp, Homo sapiens
acccttactggcttacctcctc

SEQ ID NO: 3354914 - DNA, 13 bp, Homo sapiens
acccttaggatgg

SEQ ID NO: 3354915 - DNA, 19 bp, Homo sapiens
acccttattgctgtcctgg

SEQ ID NO: 3354916 - DNA, 21 bp, Homo sapiens
acccttcacaccccaggccct

SEQ ID NO: 3354917 - DNA, 21 bp, Homo sapiens
acccttcacataccctccccc

SEQ ID NO: 3354918 - DNA, 12 bp, Homo sapiens
acccttcagacc

SEQ ID NO: 3354919 - DNA, 17 bp, Homo sapiens
acccttcagaccccagt

SEQ ID NO: 3354920 - DNA, 13 bp, Homo sapiens
acccttcccaatc

SEQ ID NO: 3354921 - DNA, 20 bp, Homo sapiens
acccttcccaatcagcactg

SEQ ID NO: 3354922 - DNA, 21 bp, Homo sapiens
acccttcccaatcagcactga

SEQ ID NO: 3354923 - DNA, 22 bp, Homo sapiens
acccttcccaatcagcactgaa

SEQ ID NO: 3354924 - DNA, 11 bp, Homo sapiens
acccttccttc

SEQ ID NO: 3354925 - DNA, 16 bp, Homo sapiens
acccttctttcctctt

SEQ ID NO: 3354926 - DNA, 20 bp, Homo sapiens
acccttctttcctcttcccc

SEQ ID NO: 3354927 - DNA, 22 bp, Homo sapiens
acccttgattttgccccctgag

SEQ ID NO: 3354928 - DNA, 21 bp, Homo sapiens
acccttgcaccgtcctcagca

SEQ ID NO: 3354929 - DNA, 14 bp, Homo sapiens
acccttgctttcct

SEQ ID NO: 3354930 - DNA, 19 bp, Homo sapiens
acccttgctttcctgggcc

SEQ ID NO: 3354931 - DNA, 17 bp, Homo sapiens
acccttggcctgtctca

SEQ ID NO: 3354932 - DNA, 21 bp, Homo sapiens
accctttaagatatccatctt

SEQ ID NO: 3354933 - DNA, 16 bp, Homo sapiens
accctttattctcact

SEQ ID NO: 3354934 - DNA, 19 bp, Homo sapiens
accctttccggcacactgc

SEQ ID NO: 3354935 - DNA, 21 bp, Homo sapiens
accctttccggcacactgcca

SEQ ID NO: 3354936 - DNA, 22 bp, Homo sapiens
accctttccggcacactgccaa

SEQ ID NO: 3354937 - DNA, 23 bp, Homo sapiens
accctttccggcacactgccaaa

SEQ ID NO: 3354938 - DNA, 21 bp, Homo sapiens
accctttggtttttttcttct

SEQ ID NO: 3354939 - DNA, 17 bp, Homo sapiens
accctttgtttcttgtt

SEQ ID NO: 3354940 - DNA, 15 bp, Homo sapiens
accgacaggccctgg

SEQ ID NO: 3354941 - DNA, 17 bp, Homo sapiens
accgagcaaagatcaaa

SEQ ID NO: 3354942 - DNA, 21 bp, Homo sapiens
accgagtctcttctccactgg

SEQ ID NO: 3354943 - DNA, 12 bp, Homo sapiens
accgcacagctc

SEQ ID NO: 3354944 - DNA, 18 bp, Homo sapiens
accgcacagctcaggagg

SEQ ID NO: 3354945 - DNA, 23 bp, Homo sapiens
accgcagtcgtcgcacagtctct

SEQ ID NO: 3354946 - DNA, 16 bp, Homo sapiens
accgccacgtcccagc

SEQ ID NO: 3354947 - DNA, 11 bp, Homo sapiens
accgcccatca

SEQ ID NO: 3354948 - DNA, 14 bp, Homo sapiens
accgcccccacccc

SEQ ID NO: 3354949 - DNA, 21 bp, Homo sapiens
accgcccccaccccttcccca

SEQ ID NO: 3354950 - DNA, 12 bp, Homo sapiens
accgccccctcc

SEQ ID NO: 3354951 - DNA, 12 bp, Homo sapiens
accgccctgggc

SEQ ID NO: 3354952 - DNA, 16 bp, Homo sapiens
accgccctgggctgga

SEQ ID NO: 3354953 - DNA, 12 bp, Homo sapiens
accgcctctggc

SEQ ID NO: 3354954 - DNA, 19 bp, Homo sapiens
accgcctctggccgccacc

SEQ ID NO: 3354955 - DNA, 17 bp, Homo sapiens
accgctcacctagagcc

SEQ ID NO: 3354956 - DNA, 14 bp, Homo sapiens
accgctgccagcac

SEQ ID NO: 3354957 - DNA, 19 bp, Homo sapiens
accgctgccagcacagagc

SEQ ID NO: 3354958 - DNA, 19 bp, Homo sapiens
accgcttcacccctgcact

SEQ ID NO: 3354959 - DNA, 20 bp, Homo sapiens
accgcttcacccctgcactt

SEQ ID NO: 3354960 - DNA, 17 bp, Homo sapiens
accgcttctgccttttc

SEQ ID NO: 3354961 - DNA, 15 bp, Homo sapiens
accggaaggaggcca

SEQ ID NO: 3354962 - DNA, 22 bp, Homo sapiens
accggaaggaggccaaccagcc

SEQ ID NO: 3354963 - DNA, 15 bp, Homo sapiens
accggcccctggcag

SEQ ID NO: 3354964 - DNA, 21 bp, Homo sapiens
accggcccctggcagcacagc

SEQ ID NO: 3354965 - DNA, 13 bp, Homo sapiens
accgggacccgag

SEQ ID NO: 3354966 - DNA, 16 bp, Homo sapiens
accgggcactcagaag

SEQ ID NO: 3354967 - DNA, 11 bp, Homo sapiens
accgggtgaaa

SEQ ID NO: 3354968 - DNA, 14 bp, Homo sapiens
accgggtgggcctg

SEQ ID NO: 3354969 - DNA, 15 bp, Homo sapiens
accgggtgggcctgg

SEQ ID NO: 3354970 - DNA, 15 bp, Homo sapiens
accggtcagtgcctt

SEQ ID NO: 3354971 - DNA, 16 bp, Homo sapiens
accggtcagtgccttt

SEQ ID NO: 3354972 - DNA, 14 bp, Homo sapiens
accggtccagctgg

SEQ ID NO: 3354973 - DNA, 16 bp, Homo sapiens
accggtccagctggcc

SEQ ID NO: 3354974 - DNA, 18 bp, Homo sapiens
accggtccagctggcctg

SEQ ID NO: 3354975 - DNA, 17 bp, Homo sapiens
accgtaataattattat

SEQ ID NO: 3354976 - DNA, 14 bp, Homo sapiens
accgtactctcaca

SEQ ID NO: 3354977 - DNA, 19 bp, Homo sapiens
accgtactgcttggaagaa

SEQ ID NO: 3354978 - DNA, 17 bp, Homo sapiens
accgtcacactcttcag

SEQ ID NO: 3354979 - DNA, 17 bp, Homo sapiens
accgtcctcacccctgt

SEQ ID NO: 3354980 - DNA, 21 bp, Homo sapiens
accgtcctcacccctgtcctc

SEQ ID NO: 3354981 - DNA, 16 bp, Homo sapiens
accgtcgggggctgag

SEQ ID NO: 3354982 - DNA, 13 bp, Homo sapiens
accgtggacaggc

SEQ ID NO: 3354983 - DNA, 14 bp, Homo sapiens
accgtggacaggcc

SEQ ID NO: 3354984 - DNA, 16 bp, Homo sapiens
accgtggacaggccca

SEQ ID NO: 3354985 - DNA, 18 bp, Homo sapiens
accgtggaggaggaaggc

SEQ ID NO: 3354986 - DNA, 17 bp, Homo sapiens
accgtgtctgtctggca

SEQ ID NO: 3354987 - DNA, 20 bp, Homo sapiens
accgtgttagccaggatggt

SEQ ID NO: 3354988 - DNA, 18 bp, Homo sapiens
accgtttccaagctgcgg

SEQ ID NO: 3354989 - DNA, 22 bp, Homo sapiens
acctaaaaggaaatctcacccc

SEQ ID NO: 3354990 - DNA, 14 bp, Homo sapiens
acctaaaagtatta

SEQ ID NO: 3354991 - DNA, 20 bp, Homo sapiens
acctaaaggtgtatttaaac

SEQ ID NO: 3354992 - DNA, 11 bp, Homo sapiens
acctaacattc

SEQ ID NO: 3354993 - DNA, 12 bp, Homo sapiens
acctaacattcg

SEQ ID NO: 3354994 - DNA, 13 bp, Homo sapiens
acctaagtactgt

SEQ ID NO: 3354995 - DNA, 18 bp, Homo sapiens
acctaagtgacatttgta

SEQ ID NO: 3354996 - DNA, 11 bp, Homo sapiens
acctaatccaa

SEQ ID NO: 3354997 - DNA, 22 bp, Homo sapiens
acctaatgtctcactgttctgc

SEQ ID NO: 3354998 - DNA, 19 bp, Homo sapiens
acctaatgtttatgagcca

SEQ ID NO: 3354999 - DNA, 18 bp, Homo sapiens
acctacaataaactggta

SEQ ID NO: 3355000 - DNA, 16 bp, Homo sapiens
acctacacactgtcat

SEQ ID NO: 3355001 - DNA, 11 bp, Homo sapiens
acctacagttt

SEQ ID NO: 3355002 - DNA, 17 bp, Homo sapiens
acctacagttttaactg

SEQ ID NO: 3355003 - DNA, 21 bp, Homo sapiens
acctacataggcaaattggaa

SEQ ID NO: 3355004 - DNA, 18 bp, Homo sapiens
acctacatgctgaaaaat

SEQ ID NO: 3355005 - DNA, 17 bp, Homo sapiens
acctaccacagtgtctg

SEQ ID NO: 3355006 - DNA, 19 bp, Homo sapiens
acctaccacagtgtctgta

SEQ ID NO: 3355007 - DNA, 16 bp, Homo sapiens
acctaccatgctgctt

SEQ ID NO: 3355008 - DNA, 22 bp, Homo sapiens
acctacgagggaggaacacctg

SEQ ID NO: 3355009 - DNA, 15 bp, Homo sapiens
acctactatgtgctg

SEQ ID NO: 3355010 - DNA, 20 bp, Homo sapiens
acctagaagaagctatgtca

SEQ ID NO: 3355011 - DNA, 15 bp, Homo sapiens
acctagagccagacc

SEQ ID NO: 3355012 - DNA, 13 bp, Homo sapiens
acctagcaattcc

SEQ ID NO: 3355013 - DNA, 14 bp, Homo sapiens
acctagcagggaag

SEQ ID NO: 3355014 - DNA, 12 bp, Homo sapiens
acgcaggaatgg

SEQ ID NO: 3355015 - DNA, 14 bp, Homo sapiens
acgcaggaccagtt

SEQ ID NO: 3355016 - DNA, 21 bp, Homo sapiens
acgcaggagaatcactgcagc

SEQ ID NO: 3355017 - DNA, 21 bp, Homo sapiens
acgcagtccgcccaggtcccc

SEQ ID NO: 3355018 - DNA, 22 bp, Homo sapiens
acgcatacacacatgccctcct

SEQ ID NO: 3355019 - DNA, 23 bp, Homo sapiens
acgcatacacacatgccctcctg

SEQ ID NO: 3355020 - DNA, 14 bp, Homo sapiens
acgcatccagcaag

SEQ ID NO: 3355021 - DNA, 18 bp, Homo sapiens
acgcatggtcaaccctca

SEQ ID NO: 3355022 - DNA, 13 bp, Homo sapiens
acgccaccattcc

SEQ ID NO: 3355023 - DNA, 14 bp, Homo sapiens
acgccactgcactc

SEQ ID NO: 3355024 - DNA, 21 bp, Homo sapiens
acgccactgcactccagcctg

SEQ ID NO: 3355025 - DNA, 22 bp, Homo sapiens
acgccactgcactccagcctgg

SEQ ID NO: 3355026 - DNA, 23 bp, Homo sapiens
acgccactgcactccagcctggg

SEQ ID NO: 3355027 - DNA, 22 bp, Homo sapiens
acgccagtctcccaggccccct

SEQ ID NO: 3355028 - DNA, 12 bp, Homo sapiens
acgccccagccc

SEQ ID NO: 3355029 - DNA, 13 bp, Homo sapiens
acgcccctgtggc

SEQ ID NO: 3355030 - DNA, 14 bp, Homo sapiens
acgcccctgtggcc

SEQ ID NO: 3355031 - DNA, 17 bp, Homo sapiens
acgcccctgtggccaac

SEQ ID NO: 3355032 - DNA, 22 bp, Homo sapiens
acgcccctgtggccaactgcaa

SEQ ID NO: 3355033 - DNA, 16 bp, Homo sapiens
acgcccgtcctgcctg

SEQ ID NO: 3355034 - DNA, 21 bp, Homo sapiens
acgccctactccactgccctg

SEQ ID NO: 3355035 - DNA, 18 bp, Homo sapiens
acgccctcccctcccctg

SEQ ID NO: 3355036 - DNA, 23 bp, Homo sapiens
acgccctcccctcccctgctgca

SEQ ID NO: 3355037 - DNA, 14 bp, Homo sapiens
acgccctccctctc

SEQ ID NO: 3355038 - DNA, 18 bp, Homo sapiens
acgccctccctctcccag

SEQ ID NO: 3355039 - DNA, 21 bp, Homo sapiens
acgccctttcctcctcaggca

SEQ ID NO: 3355040 - DNA, 15 bp, Homo sapiens
acgcctcctggccag

SEQ ID NO: 3355041 - DNA, 18 bp, Homo sapiens
acgcctcttgttcatgtc

SEQ ID NO: 3355042 - DNA, 20 bp, Homo sapiens
acgcctgtaatcccagcact

SEQ ID NO: 3355043 - DNA, 17 bp, Homo sapiens
acgccttccaggtcagg

SEQ ID NO: 3355044 - DNA, 17 bp, Homo sapiens
acgccttcccctcagcc

SEQ ID NO: 3355045 - DNA, 16 bp, Homo sapiens
acgcgcgcgcacacac

SEQ ID NO: 3355046 - DNA, 20 bp, Homo sapiens
acgcgtatctaggctttggt

SEQ ID NO: 3355047 - DNA, 15 bp, Homo sapiens
acgcgtctcctgttt

SEQ ID NO: 3355048 - DNA, 19 bp, Homo sapiens
acgctactataaagagaag

SEQ ID NO: 3355049 - DNA, 14 bp, Homo sapiens
acgctccagctgcc

SEQ ID NO: 3355050 - DNA, 17 bp, Homo sapiens
acgctccagctgccccg

SEQ ID NO: 3355051 - DNA, 18 bp, Homo sapiens
acgctccccgcctgttcc

SEQ ID NO: 3355052 - DNA, 20 bp, Homo sapiens
acgctccccgcctgttcccc

SEQ ID NO: 3355053 - DNA, 21 bp, Homo sapiens
acgctcgcgggcagcgggcca

SEQ ID NO: 3355054 - DNA, 11 bp, Homo sapiens
acgctctctgg

SEQ ID NO: 3355055 - DNA, 12 bp, Homo sapiens
acgctcttagct

SEQ ID NO: 3355056 - DNA, 17 bp, Homo sapiens
acgctgcacttgacacc

SEQ ID NO: 3355057 - DNA, 15 bp, Homo sapiens
acgctggagtgcagt

SEQ ID NO: 3355058 - DNA, 17 bp, Homo sapiens
acgctggagtgcagtga

SEQ ID NO: 3355059 - DNA, 20 bp, Homo sapiens
acgctgtcctctcgagccca

SEQ ID NO: 3355060 - DNA, 18 bp, Homo sapiens
acgcttctgaatgctgct

SEQ ID NO: 3355061 - DNA, 22 bp, Homo sapiens
acgcttctgaatgctgctactt

SEQ ID NO: 3355062 - DNA, 22 bp, Homo sapiens
acgcttgtagaactcactctgg

SEQ ID NO: 3355063 - DNA, 23 bp, Homo sapiens
acgcttgtagaactcactctggg

SEQ ID NO: 3355064 - DNA, 11 bp, Homo sapiens
acgctttgatt

SEQ ID NO: 3355065 - DNA, 15 bp, Homo sapiens
acggaaagtgctgtc

SEQ ID NO: 3355066 - DNA, 15 bp, Homo sapiens
acggaatagttggct

SEQ ID NO: 3355067 - DNA, 14 bp, Homo sapiens
acggacaataaacc

SEQ ID NO: 3355068 - DNA, 15 bp, Homo sapiens
acggacaataaacct

SEQ ID NO: 3355069 - DNA, 14 bp, Homo sapiens
acggaccactcgag

SEQ ID NO: 3355070 - DNA, 12 bp, Homo sapiens
acggagagaaaa

SEQ ID NO: 3355071 - DNA, 15 bp, Homo sapiens
acggagcccagccct

SEQ ID NO: 3355072 - DNA, 21 bp, Homo sapiens
acggagccccaggcctctgtg

SEQ ID NO: 3355073 - DNA, 11 bp, Homo sapiens
acggagccctc

SEQ ID NO: 3355074 - DNA, 12 bp, Homo sapiens
acggagccctcc

SEQ ID NO: 3355075 - DNA, 18 bp, Homo sapiens
acggagggtccagactgt

SEQ ID NO: 3355076 - DNA, 21 bp, Homo sapiens
acggagtcccaccttggctgc

SEQ ID NO: 3355077 - DNA, 12 bp, Homo sapiens
acggagtggggg

SEQ ID NO: 3355078 - DNA, 22 bp, Homo sapiens
acggagtggggggacagagact

SEQ ID NO: 3355079 - DNA, 20 bp, Homo sapiens
acggcagaaaacagagcctg

SEQ ID NO: 3355080 - DNA, 17 bp, Homo sapiens
acggcaggctcactgcc

SEQ ID NO: 3355081 - DNA, 18 bp, Homo sapiens
acggccgctccaggggtg

SEQ ID NO: 3355082 - DNA, 15 bp, Homo sapiens
acggcctgatgctcc

SEQ ID NO: 3355083 - DNA, 19 bp, Homo sapiens
acggcctgatgctccctcc

SEQ ID NO: 3355084 - DNA, 21 bp, Homo sapiens
acggccttcaactgaaaagac

SEQ ID NO: 3355085 - DNA, 17 bp, Homo sapiens
acggcggccaggcacag

SEQ ID NO: 3355086 - DNA, 19 bp, Homo sapiens
acggcggccaggcacaggg

SEQ ID NO: 3355087 - DNA, 23 bp, Homo sapiens
acggcgtggtgtgtccctggaca

SEQ ID NO: 3355088 - DNA, 19 bp, Homo sapiens
acggcgttgtacctgtagg

SEQ ID NO: 3355089 - DNA, 13 bp, Homo sapiens
acggcgttttttt

SEQ ID NO: 3355090 - DNA, 15 bp, Homo sapiens
acggctaagaggctg

SEQ ID NO: 3355091 - DNA, 16 bp, Homo sapiens
acggctaagaggctgc

SEQ ID NO: 3355092 - DNA, 17 bp, Homo sapiens
acggctaagaggctgct

SEQ ID NO: 3355093 - DNA, 16 bp, Homo sapiens
acggctcactgcagcc

SEQ ID NO: 3355094 - DNA, 20 bp, Homo sapiens
acggctgtggaccgtggaca

SEQ ID NO: 3355095 - DNA, 22 bp, Homo sapiens
acggcttcctataacttcttcc

SEQ ID NO: 3355096 - DNA, 13 bp, Homo sapiens
acgggaaaggaaa

SEQ ID NO: 3355097 - DNA, 17 bp, Homo sapiens
acgggaagtttagagag

SEQ ID NO: 3355098 - DNA, 13 bp, Homo sapiens
acgggaggcccca

SEQ ID NO: 3355099 - DNA, 15 bp, Homo sapiens
acgggcagcctgggc

SEQ ID NO: 3355100 - DNA, 12 bp, Homo sapiens
acgggcaggggt

SEQ ID NO: 3355101 - DNA, 14 bp, Homo sapiens
acggggcagtcaga

SEQ ID NO: 3355102 - DNA, 11 bp, Homo sapiens
acggggcctcc

SEQ ID NO: 3355103 - DNA, 14 bp, Homo sapiens
acggggtccttcaa

SEQ ID NO: 3355104 - DNA, 14 bp, Homo sapiens
acgggtggtccccg

SEQ ID NO: 3355105 - DNA, 15 bp, Homo sapiens
acggtcaggtttaac

SEQ ID NO: 3355106 - DNA, 17 bp, Homo sapiens
acggtcaggtttaacat

SEQ ID NO: 3355107 - DNA, 20 bp, Homo sapiens
acggtcaggtttaacatttg

SEQ ID NO: 3355108 - DNA, 14 bp, Homo sapiens
acggtgcccaagcc

SEQ ID NO: 3355109 - DNA, 19 bp, Homo sapiens
acggtgcgtggctgtggca

SEQ ID NO: 3355110 - DNA, 18 bp, Homo sapiens
acggtgggcatttgtgag

SEQ ID NO: 3355111 - DNA, 21 bp, Homo sapiens
acggttttttattattgtggt

SEQ ID NO: 3355112 - DNA, 20 bp, Homo sapiens
acgtaaacttcagtgtccca

SEQ ID NO: 3355113 - DNA, 16 bp, Homo sapiens
acgtaagactttttgg

SEQ ID NO: 3355114 - DNA, 14 bp, Homo sapiens
acgtactgtctgat

SEQ ID NO: 3355115 - DNA, 24 bp, Homo sapiens
acgtagcttctaccatgaacagaa

SEQ ID NO: 3355116 - DNA, 18 bp, Homo sapiens
acgtatgcaagtctgtga

SEQ ID NO: 3355117 - DNA, 21 bp, Homo sapiens
acgtatttatatttggaaaga

SEQ ID NO: 3355118 - DNA, 22 bp, Homo sapiens
acgtatttatatttggaaagag

SEQ ID NO: 3355119 - DNA, 17 bp, Homo sapiens
acgtcaagtctccttcc

SEQ ID NO: 3355120 - DNA, 16 bp, Homo sapiens
acgtcctatctccccc

SEQ ID NO: 3355121 - DNA, 20 bp, Homo sapiens
acgtctgaagcttgactccc

SEQ ID NO: 3355122 - DNA, 14 bp, Homo sapiens
acgtctgacaggca

SEQ ID NO: 3355123 - DNA, 15 bp, Homo sapiens
acgtctgacaggcaa

SEQ ID NO: 3355124 - DNA, 23 bp, Homo sapiens
acgtctgacaggcaatgctggct

SEQ ID NO: 3355125 - DNA, 12 bp, Homo sapiens
acgtctgccagg

SEQ ID NO: 3355126 - DNA, 14 bp, Homo sapiens
acgtctgccaggcc

SEQ ID NO: 3355127 - DNA, 17 bp, Homo sapiens
acgtctgccaggcccat

SEQ ID NO: 3355128 - DNA, 18 bp, Homo sapiens
acgtctgccaggcccatc

SEQ ID NO: 3355129 - DNA, 13 bp, Homo sapiens
acgtctgtcttca

SEQ ID NO: 3355130 - DNA, 19 bp, Homo sapiens
acgtctgtcttcacagctc

SEQ ID NO: 3355131 - DNA, 21 bp, Homo sapiens
acgtcttagagccttttatct

SEQ ID NO: 3355132 - DNA, 12 bp, Homo sapiens
acgtcttctaaa

SEQ ID NO: 3355133 - DNA, 17 bp, Homo sapiens
acgtgacagtgcctggg

SEQ ID NO: 3355134 - DNA, 14 bp, Homo sapiens
acgtgagagaaaga

SEQ ID NO: 3355135 - DNA, 15 bp, Homo sapiens
acgtgagagaaagag

SEQ ID NO: 3355136 - DNA, 19 bp, Homo sapiens
acgtgagagaaagagagaa

SEQ ID NO: 3355137 - DNA, 23 bp, Homo sapiens
acgtgcacctgtactcaggaggc

SEQ ID NO: 3355138 - DNA, 19 bp, Homo sapiens
acgtgccttttgcacccct

SEQ ID NO: 3355139 - DNA, 22 bp, Homo sapiens
acgtggagcggggtatgaagag

SEQ ID NO: 3355140 - DNA, 20 bp, Homo sapiens
actctgctatttctcttgct

SEQ ID NO: 3355141 - DNA, 21 bp, Homo sapiens
actctgctgaatgtaaaagaa

SEQ ID NO: 3355142 - DNA, 14 bp, Homo sapiens
actctgctgcttag

SEQ ID NO: 3355143 - DNA, 16 bp, Homo sapiens
actctgcttctctgac

SEQ ID NO: 3355144 - DNA, 20 bp, Homo sapiens
actctgcttctctgacttct

SEQ ID NO: 3355145 - DNA, 17 bp, Homo sapiens
actctggatatttgcac

SEQ ID NO: 3355146 - DNA, 14 bp, Homo sapiens
actctggcaaagct

SEQ ID NO: 3355147 - DNA, 23 bp, Homo sapiens
actctggcaaagcttttagaaat

SEQ ID NO: 3355148 - DNA, 16 bp, Homo sapiens
actctggccctggccc

SEQ ID NO: 3355149 - DNA, 19 bp, Homo sapiens
actctgggaaataagagag

SEQ ID NO: 3355150 - DNA, 19 bp, Homo sapiens
actctggtggcacaggagt

SEQ ID NO: 3355151 - DNA, 17 bp, Homo sapiens
actctggtgttctattg

SEQ ID NO: 3355152 - DNA, 15 bp, Homo sapiens
actctgtaaaaacac

SEQ ID NO: 3355153 - DNA, 16 bp, Homo sapiens
actctgtaacatcact

SEQ ID NO: 3355154 - DNA, 15 bp, Homo sapiens
actctgtcagccagc

SEQ ID NO: 3355155 - DNA, 21 bp, Homo sapiens
actctgtcagccagccgccct

SEQ ID NO: 3355156 - DNA, 11 bp, Homo sapiens
actctgtccag

SEQ ID NO: 3355157 - DNA, 13 bp, Homo sapiens
actctgtccaggc

SEQ ID NO: 3355158 - DNA, 23 bp, Homo sapiens
actctgtccaggccactgtggcc

SEQ ID NO: 3355159 - DNA, 22 bp, Homo sapiens
actctgtccctgtccttccctg

SEQ ID NO: 3355160 - DNA, 16 bp, Homo sapiens
actctgtcttaaatga

SEQ ID NO: 3355161 - DNA, 16 bp, Homo sapiens
actctgtggggccttg

SEQ ID NO: 3355162 - DNA, 21 bp, Homo sapiens
actctgtgtcaggtggggcag

SEQ ID NO: 3355163 - DNA, 18 bp, Homo sapiens
actctgtgtgtgtatgag

SEQ ID NO: 3355164 - DNA, 13 bp, Homo sapiens
actctgtgtttaa

SEQ ID NO: 3355165 - DNA, 14 bp, Homo sapiens
actctgtgtttaaa

SEQ ID NO: 3355166 - DNA, 12 bp, Homo sapiens
actcttaaagca

SEQ ID NO: 3355167 - DNA, 14 bp, Homo sapiens
actcttaatcaaat

SEQ ID NO: 3355168 - DNA, 13 bp, Homo sapiens
actcttaatctgt

SEQ ID NO: 3355169 - DNA, 19 bp, Homo sapiens
actcttaggatatttgagt

SEQ ID NO: 3355170 - DNA, 12 bp, Homo sapiens
actcttatctca

SEQ ID NO: 3355171 - DNA, 17 bp, Homo sapiens
actcttcacaaaatctg

SEQ ID NO: 3355172 - DNA, 13 bp, Homo sapiens
actcttcactgtt

SEQ ID NO: 3355173 - DNA, 20 bp, Homo sapiens
actcttcagtgactcctgct

SEQ ID NO: 3355174 - DNA, 15 bp, Homo sapiens
actcttcagtgcaaa

SEQ ID NO: 3355175 - DNA, 20 bp, Homo sapiens
actcttctcggctcaggctc

SEQ ID NO: 3355176 - DNA, 21 bp, Homo sapiens
actcttgaagaggaggccgcc

SEQ ID NO: 3355177 - DNA, 14 bp, Homo sapiens
actcttgacctcag

SEQ ID NO: 3355178 - DNA, 10 bp, Homo sapiens
actcttgatg

SEQ ID NO: 3355179 - DNA, 14 bp, Homo sapiens
actcttgatgtgaa

SEQ ID NO: 3355180 - DNA, 14 bp, Homo sapiens
actctttagagcag

SEQ ID NO: 3355181 - DNA, 19 bp, Homo sapiens
actctttctgaaggaagag

SEQ ID NO: 3355182 - DNA, 18 bp, Homo sapiens
actcttttccttcccttt

SEQ ID NO: 3355183 - DNA, 19 bp, Homo sapiens
actctttttctaaagtgtt

SEQ ID NO: 3355184 - DNA, 20 bp, Homo sapiens
actgaaaaggttcttcatcc

SEQ ID NO: 3355185 - DNA, 16 bp, Homo sapiens
actgaaaatctaatat

SEQ ID NO: 3355186 - DNA, 16 bp, Homo sapiens
actgaaaatgtaaatt

SEQ ID NO: 3355187 - DNA, 13 bp, Homo sapiens
actgaaacagatt

SEQ ID NO: 3355188 - DNA, 13 bp, Homo sapiens
actgaaaccaaaa

SEQ ID NO: 3355189 - DNA, 17 bp, Homo sapiens
actgaaaccaaaacata

SEQ ID NO: 3355190 - DNA, 13 bp, Homo sapiens
actgaaacctctg

SEQ ID NO: 3355191 - DNA, 14 bp, Homo sapiens
actgaaacctctgc

SEQ ID NO: 3355192 - DNA, 20 bp, Homo sapiens
actgaaaggcagaactcaga

SEQ ID NO: 3355193 - DNA, 19 bp, Homo sapiens
actgaacaccattgaaggc

SEQ ID NO: 3355194 - DNA, 20 bp, Homo sapiens
actgaacaccattgaaggct

SEQ ID NO: 3355195 - DNA, 20 bp, Homo sapiens
actgaacatttgctttgttt

SEQ ID NO: 3355196 - DNA, 12 bp, Homo sapiens
actgaaccaaat

SEQ ID NO: 3355197 - DNA, 20 bp, Homo sapiens
actgaaccaaattgcactga

SEQ ID NO: 3355198 - DNA, 21 bp, Homo sapiens
actgaagaaatctttccagtt

SEQ ID NO: 3355199 - DNA, 14 bp, Homo sapiens
actgaagcagcctc

SEQ ID NO: 3355200 - DNA, 17 bp, Homo sapiens
actgaagccaaatgaaa

SEQ ID NO: 3355201 - DNA, 14 bp, Homo sapiens
actgaagcctgcag

SEQ ID NO: 3355202 - DNA, 22 bp, Homo sapiens
actgaaggaaaaacacaagcaa

SEQ ID NO: 3355203 - DNA, 13 bp, Homo sapiens
actgaaggaaaag

SEQ ID NO: 3355204 - DNA, 23 bp, Homo sapiens
actgaaggaaaagcaagaaacag

SEQ ID NO: 3355205 - DNA, 13 bp, Homo sapiens
actgaaggggcac

SEQ ID NO: 3355206 - DNA, 16 bp, Homo sapiens
actgaaggggcacacc

SEQ ID NO: 3355207 - DNA, 21 bp, Homo sapiens
actgaagttaacagagacaga

SEQ ID NO: 3355208 - DNA, 15 bp, Homo sapiens
actgaagtttttgaa

SEQ ID NO: 3355209 - DNA, 16 bp, Homo sapiens
actgaagtttttgaaa

SEQ ID NO: 3355210 - DNA, 21 bp, Homo sapiens
actgaatatttatatttcact

SEQ ID NO: 3355211 - DNA, 20 bp, Homo sapiens
actgaatattttggaaactg

SEQ ID NO: 3355212 - DNA, 21 bp, Homo sapiens
actgaatgaagcagtattttg

SEQ ID NO: 3355213 - DNA, 20 bp, Homo sapiens
actgaatgaggtcagcatgt

SEQ ID NO: 3355214 - DNA, 11 bp, Homo sapiens
actgaatgcag

SEQ ID NO: 3355215 - DNA, 15 bp, Homo sapiens
actgaatttgtactt

SEQ ID NO: 3355216 - DNA, 19 bp, Homo sapiens
actgaattttgggacttct

SEQ ID NO: 3355217 - DNA, 17 bp, Homo sapiens
actgacacaaaggaagt

SEQ ID NO: 3355218 - DNA, 13 bp, Homo sapiens
actgacacaggaa

SEQ ID NO: 3355219 - DNA, 20 bp, Homo sapiens
actgacacaggaaaccaaca

SEQ ID NO: 3355220 - DNA, 18 bp, Homo sapiens
actgacagcctcccaccc

SEQ ID NO: 3355221 - DNA, 12 bp, Homo sapiens
actgacatgtgg

SEQ ID NO: 3355222 - DNA, 23 bp, Homo sapiens
actgacattgttggccaaagcca

SEQ ID NO: 3355223 - DNA, 14 bp, Homo sapiens
actgaccccctccc

SEQ ID NO: 3355224 - DNA, 16 bp, Homo sapiens
actgaccccctcccct

SEQ ID NO: 3355225 - DNA, 15 bp, Homo sapiens
actgacccttccaga

SEQ ID NO: 3355226 - DNA, 21 bp, Homo sapiens
actgacctgtcatgcccccct

SEQ ID NO: 3355227 - DNA, 15 bp, Homo sapiens
actgactttatcctc

SEQ ID NO: 3355228 - DNA, 23 bp, Homo sapiens
actgactttgcttgctttgaagt

SEQ ID NO: 3355229 - DNA, 16 bp, Homo sapiens
actgactttttccccc

SEQ ID NO: 3355230 - DNA, 17 bp, Homo sapiens
actgactttttcccccc

SEQ ID NO: 3355231 - DNA, 12 bp, Homo sapiens
actgagaacttt

SEQ ID NO: 3355232 - DNA, 16 bp, Homo sapiens
actgagacacgatgcc

SEQ ID NO: 3355233 - DNA, 13 bp, Homo sapiens
actgagatttctt

SEQ ID NO: 3355234 - DNA, 14 bp, Homo sapiens
actgagatttctta

SEQ ID NO: 3355235 - DNA, 17 bp, Homo sapiens
actgagatttcttaaat

SEQ ID NO: 3355236 - DNA, 12 bp, Homo sapiens
actgagcagccg

SEQ ID NO: 3355237 - DNA, 18 bp, Homo sapiens
actgagcagccgccagct

SEQ ID NO: 3355238 - DNA, 13 bp, Homo sapiens
actgagccccacc

SEQ ID NO: 3355239 - DNA, 15 bp, Homo sapiens
actgagcccccccaa

SEQ ID NO: 3355240 - DNA, 20 bp, Homo sapiens
actgagccccgcagacctcc

SEQ ID NO: 3355241 - DNA, 12 bp, Homo sapiens
actgagcctggc

SEQ ID NO: 3355242 - DNA, 14 bp, Homo sapiens
actgagccttgtaa

SEQ ID NO: 3355243 - DNA, 19 bp, Homo sapiens
actgaggaatttcacctgt

SEQ ID NO: 3355244 - DNA, 16 bp, Homo sapiens
actgaggaattttctt

SEQ ID NO: 3355245 - DNA, 20 bp, Homo sapiens
actgaggaattttctttgtg

SEQ ID NO: 3355246 - DNA, 21 bp, Homo sapiens
actgaggcctaaaagtaaaca

SEQ ID NO: 3355247 - DNA, 19 bp, Homo sapiens
actgaggcttagagagagg

SEQ ID NO: 3355248 - DNA, 21 bp, Homo sapiens
actgagggaccaactgggccc

SEQ ID NO: 3355249 - DNA, 22 bp, Homo sapiens
actgagggaccaactgggccca

SEQ ID NO: 3355250 - DNA, 17 bp, Homo sapiens
actgaggtataaagaca

SEQ ID NO: 3355251 - DNA, 17 bp, Homo sapiens
actgagtaccaggggct

SEQ ID NO: 3355252 - DNA, 18 bp, Homo sapiens
actgagtcccctccagga

SEQ ID NO: 3355253 - DNA, 16 bp, Homo sapiens
actgataagactgttt

SEQ ID NO: 3355254 - DNA, 16 bp, Homo sapiens
actgatagtgtccaaa

SEQ ID NO: 3355255 - DNA, 17 bp, Homo sapiens
actgatagtgtccaaat

SEQ ID NO: 3355256 - DNA, 16 bp, Homo sapiens
actgatatattttaca

SEQ ID NO: 3355257 - DNA, 17 bp, Homo sapiens
actgatctctactacca

SEQ ID NO: 3355258 - DNA, 12 bp, Homo sapiens
actgatgcaagg

SEQ ID NO: 3355259 - DNA, 21 bp, Homo sapiens
actgatggaccgggtgggcct

SEQ ID NO: 3355260 - DNA, 12 bp, Homo sapiens
actgatgggcaa

SEQ ID NO: 3355261 - DNA, 20 bp, Homo sapiens
actgatgttactagcctctc

SEQ ID NO: 3355262 - DNA, 17 bp, Homo sapiens
actgatgttttagcatt

SEQ ID NO: 3355263 - DNA, 15 bp, Homo sapiens
actgattatgaaatg

SEQ ID NO: 3355264 - DNA, 20 bp, Homo sapiens
actgattgttttagagacta

SEQ ID NO: 3355265 - DNA, 21 bp, Homo sapiens
actgattgttttagagactat

SEQ ID NO: 3355266 - DNA, 15 bp, Homo sapiens
actgatttcagagtg

SEQ ID NO: 3355267 - DNA, 17 bp, Homo sapiens
acttaatactaccttga

SEQ ID NO: 3355268 - DNA, 19 bp, Homo sapiens
acttaatactaccttgaaa

SEQ ID NO: 3355269 - DNA, 19 bp, Homo sapiens
acttaatactcaaatgagt

SEQ ID NO: 3355270 - DNA, 22 bp, Homo sapiens
acttaatggctgttgagggcca

SEQ ID NO: 3355271 - DNA, 13 bp, Homo sapiens
acttaatttgtaa

SEQ ID NO: 3355272 - DNA, 18 bp, Homo sapiens
acttaatttgtaaacttc

SEQ ID NO: 3355273 - DNA, 21 bp, Homo sapiens
acttacaaaaatgggaaaaat

SEQ ID NO: 3355274 - DNA, 24 bp, Homo sapiens
acttacaccagtttgactgtgcta

SEQ ID NO: 3355275 - DNA, 15 bp, Homo sapiens
acttacacttggagc

SEQ ID NO: 3355276 - DNA, 17 bp, Homo sapiens
acttacactttatgcac

SEQ ID NO: 3355277 - DNA, 22 bp, Homo sapiens
acttacagagcgtggctgtgct

SEQ ID NO: 3355278 - DNA, 15 bp, Homo sapiens
acttacatcttctgt

SEQ ID NO: 3355279 - DNA, 14 bp, Homo sapiens
acttaccatttgct

SEQ ID NO: 3355280 - DNA, 19 bp, Homo sapiens
acttacctaaacagatata

SEQ ID NO: 3355281 - DNA, 17 bp, Homo sapiens
acttacctagatttaca

SEQ ID NO: 3355282 - DNA, 13 bp, Homo sapiens
acttactataatt

SEQ ID NO: 3355283 - DNA, 12 bp, Homo sapiens
acttactatttt

SEQ ID NO: 3355284 - DNA, 13 bp, Homo sapiens
acttactctaaga

SEQ ID NO: 3355285 - DNA, 21 bp, Homo sapiens
acttactgggtaggtgattct

SEQ ID NO: 3355286 - DNA, 17 bp, Homo sapiens
acttactgtatatgtat

SEQ ID NO: 3355287 - DNA, 13 bp, Homo sapiens
acttactgtttct

SEQ ID NO: 3355288 - DNA, 19 bp, Homo sapiens
acttacttgatgattttta

SEQ ID NO: 3355289 - DNA, 14 bp, Homo sapiens
acttacttgcttat

SEQ ID NO: 3355290 - DNA, 19 bp, Homo sapiens
acttagaaagcaggggcta

SEQ ID NO: 3355291 - DNA, 15 bp, Homo sapiens
acttagaggaaaatg

SEQ ID NO: 3355292 - DNA, 16 bp, Homo sapiens
acttagcatgcacaaa

SEQ ID NO: 3355293 - DNA, 22 bp, Homo sapiens
acttagccagttcaaagtgtat

SEQ ID NO: 3355294 - DNA, 21 bp, Homo sapiens
acttagccgcaccctgcacct

SEQ ID NO: 3355295 - DNA, 21 bp, Homo sapiens
acttagccgtccatggcacca

SEQ ID NO: 3355296 - DNA, 16 bp, Homo sapiens
acttagctgtactata

SEQ ID NO: 3355297 - DNA, 23 bp, Homo sapiens
acttaggttattttgctttggtt

SEQ ID NO: 3355298 - DNA, 19 bp, Homo sapiens
acttatagttaatattttg

SEQ ID NO: 3355299 - DNA, 19 bp, Homo sapiens
acttatatagcacctttca

SEQ ID NO: 3355300 - DNA, 15 bp, Homo sapiens
acttatatttcccta

SEQ ID NO: 3355301 - DNA, 19 bp, Homo sapiens
acttatattttcgtatgaa

SEQ ID NO: 3355302 - DNA, 15 bp, Homo sapiens
acttatcaacactat

SEQ ID NO: 3355303 - DNA, 18 bp, Homo sapiens
acttatccatctttgaac

SEQ ID NO: 3355304 - DNA, 19 bp, Homo sapiens
acttatcctaaaacaaata

SEQ ID NO: 3355305 - DNA, 21 bp, Homo sapiens
acttatctagaaagaaaagac

SEQ ID NO: 3355306 - DNA, 19 bp, Homo sapiens
acttatgctagtttattgg

SEQ ID NO: 3355307 - DNA, 12 bp, Homo sapiens
acttatgtactt

SEQ ID NO: 3355308 - DNA, 14 bp, Homo sapiens
acttatgtacttga

SEQ ID NO: 3355309 - DNA, 13 bp, Homo sapiens
acttatgtagata

SEQ ID NO: 3355310 - DNA, 15 bp, Homo sapiens
acttatgtagatatt

SEQ ID NO: 3355311 - DNA, 20 bp, Homo sapiens
acttatgtagatatttggct

SEQ ID NO: 3355312 - DNA, 20 bp, Homo sapiens
acttattacaatttgttcat

SEQ ID NO: 3355313 - DNA, 21 bp, Homo sapiens
acttattggaactctgcttga

SEQ ID NO: 3355314 - DNA, 15 bp, Homo sapiens
acttatttaaaaata

SEQ ID NO: 3355315 - DNA, 17 bp, Homo sapiens
acttatttatgaacctg

SEQ ID NO: 3355316 - DNA, 14 bp, Homo sapiens
acttatttcactat

SEQ ID NO: 3355317 - DNA, 12 bp, Homo sapiens
acttatttctgc

SEQ ID NO: 3355318 - DNA, 20 bp, Homo sapiens
acttattttcagtgcatcat

SEQ ID NO: 3355319 - DNA, 21 bp, Homo sapiens
acttattttcagtgcatcatt

SEQ ID NO: 3355320 - DNA, 15 bp, Homo sapiens
acttattttctctgt

SEQ ID NO: 3355321 - DNA, 21 bp, Homo sapiens
acttattttgtcttattctta

SEQ ID NO: 3355322 - DNA, 24 bp, Homo sapiens
acttcaagtaatacgttttgacat

SEQ ID NO: 3355323 - DNA, 16 bp, Homo sapiens
acttcaagttaaagtg

SEQ ID NO: 3355324 - DNA, 19 bp, Homo sapiens
acttcaatgggctcttcca

SEQ ID NO: 3355325 - DNA, 22 bp, Homo sapiens
acttcaatgggctcttccaaca

SEQ ID NO: 3355326 - DNA, 19 bp, Homo sapiens
acttcaatgtgtcatttcc

SEQ ID NO: 3355327 - DNA, 18 bp, Homo sapiens
acttcacagctggaccct

SEQ ID NO: 3355328 - DNA, 21 bp, Homo sapiens
acttcacagctggaccctgct

SEQ ID NO: 3355329 - DNA, 16 bp, Homo sapiens
acttcacgcccttggc

SEQ ID NO: 3355330 - DNA, 20 bp, Homo sapiens
acttcagagagctggtagtt

SEQ ID NO: 3355331 - DNA, 13 bp, Homo sapiens
acttcagctctgt

SEQ ID NO: 3355332 - DNA, 15 bp, Homo sapiens
acttcagctgcctga

SEQ ID NO: 3355333 - DNA, 20 bp, Homo sapiens
acttcagctgcctgaaacag

SEQ ID NO: 3355334 - DNA, 16 bp, Homo sapiens
acttcaggaacaagta

SEQ ID NO: 3355335 - DNA, 17 bp, Homo sapiens
acttcaggaacaagtaa

SEQ ID NO: 3355336 - DNA, 14 bp, Homo sapiens
acttcaggctcttc

SEQ ID NO: 3355337 - DNA, 16 bp, Homo sapiens
acttcaggctcttctc

SEQ ID NO: 3355338 - DNA, 23 bp, Homo sapiens
acttcagggcagggctctgatat

SEQ ID NO: 3355339 - DNA, 19 bp, Homo sapiens
acttcagtcctgctccaga

SEQ ID NO: 3355340 - DNA, 18 bp, Homo sapiens
acttcagtcttgcctagg

SEQ ID NO: 3355341 - DNA, 19 bp, Homo sapiens
acttcagttttatttttgc

SEQ ID NO: 3355342 - DNA, 14 bp, Homo sapiens
acttcatatagcat

SEQ ID NO: 3355343 - DNA, 14 bp, Homo sapiens
acttcatattgctg

SEQ ID NO: 3355344 - DNA, 22 bp, Homo sapiens
acttcatattgctgagagaaat

SEQ ID NO: 3355345 - DNA, 17 bp, Homo sapiens
acttcattctgcagggt

SEQ ID NO: 3355346 - DNA, 15 bp, Homo sapiens
acttcattgtccctc

SEQ ID NO: 3355347 - DNA, 17 bp, Homo sapiens
acttcatttggtgctgg

SEQ ID NO: 3355348 - DNA, 17 bp, Homo sapiens
acttcattttatattta

SEQ ID NO: 3355349 - DNA, 19 bp, Homo sapiens
acttcattttatatttaaa

SEQ ID NO: 3355350 - DNA, 22 bp, Homo sapiens
acttcattttatatttaaaaaa

SEQ ID NO: 3355351 - DNA, 22 bp, Homo sapiens
acttcattttttaaaaaatctg

SEQ ID NO: 3355352 - DNA, 20 bp, Homo sapiens
acttccaaacctgacagatg

SEQ ID NO: 3355353 - DNA, 16 bp, Homo sapiens
acttccaaagaaagtt

SEQ ID NO: 3355354 - DNA, 17 bp, Homo sapiens
acttccaaagaaagttc

SEQ ID NO: 3355355 - DNA, 18 bp, Homo sapiens
acttccacacaattattt

SEQ ID NO: 3355356 - DNA, 13 bp, Homo sapiens
acttccacatttt

SEQ ID NO: 3355357 - DNA, 14 bp, Homo sapiens
acttccacattttt

SEQ ID NO: 3355358 - DNA, 20 bp, Homo sapiens
acttccacatttttgcacag

SEQ ID NO: 3355359 - DNA, 16 bp, Homo sapiens
acttccaggggaacct

SEQ ID NO: 3355360 - DNA, 20 bp, Homo sapiens
acttccaggtgttactgtaa

SEQ ID NO: 3355361 - DNA, 21 bp, Homo sapiens
acttccaggtgttactgtaat

SEQ ID NO: 3355362 - DNA, 17 bp, Homo sapiens
acttccataatctggac

SEQ ID NO: 3355363 - DNA, 16 bp, Homo sapiens
acttccatacagctct

SEQ ID NO: 3355364 - DNA, 19 bp, Homo sapiens
acttccataggacatactg

SEQ ID NO: 3355365 - DNA, 17 bp, Homo sapiens
acttcccgtctcagaat

SEQ ID NO: 3355366 - DNA, 12 bp, Homo sapiens
acttccctcagg

SEQ ID NO: 3355367 - DNA, 13 bp, Homo sapiens
acttccctcaggc

SEQ ID NO: 3355368 - DNA, 22 bp, Homo sapiens
acttccctgattgacctgctcc

SEQ ID NO: 3355369 - DNA, 13 bp, Homo sapiens
acttccgctgagg

SEQ ID NO: 3355370 - DNA, 14 bp, Homo sapiens
acttcctacagagc

SEQ ID NO: 3355371 - DNA, 17 bp, Homo sapiens
acttcctcctccccact

SEQ ID NO: 3355372 - DNA, 20 bp, Homo sapiens
acttcctcctgatggccaag

SEQ ID NO: 3355373 - DNA, 14 bp, Homo sapiens
acttcctgctacag

SEQ ID NO: 3355374 - DNA, 14 bp, Homo sapiens
acttccttgagaca

SEQ ID NO: 3355375 - DNA, 18 bp, Homo sapiens
acttcctttgtgtttata

SEQ ID NO: 3355376 - DNA, 19 bp, Homo sapiens
acttcctttgtgtttatat

SEQ ID NO: 3355377 - DNA, 19 bp, Homo sapiens
acttcgactcaggatccag

SEQ ID NO: 3355378 - DNA, 17 bp, Homo sapiens
acttcgggctgtgtaaa

SEQ ID NO: 3355379 - DNA, 18 bp, Homo sapiens
acttcgtcttctaatttc

SEQ ID NO: 3355380 - DNA, 20 bp, Homo sapiens
acttcgttttggttaagttg

SEQ ID NO: 3355381 - DNA, 17 bp, Homo sapiens
acttctaaatgcatatc

SEQ ID NO: 3355382 - DNA, 16 bp, Homo sapiens
acttctaactccactg

SEQ ID NO: 3355383 - DNA, 11 bp, Homo sapiens
acttctaatat

SEQ ID NO: 3355384 - DNA, 15 bp, Homo sapiens
acttctaatatattt

SEQ ID NO: 3355385 - DNA, 23 bp, Homo sapiens
acttctatattttaatagaaata

SEQ ID NO: 3355386 - DNA, 15 bp, Homo sapiens
acttctcatcttaaa

SEQ ID NO: 3355387 - DNA, 15 bp, Homo sapiens
acttctccaccctgc

SEQ ID NO: 3355388 - DNA, 16 bp, Homo sapiens
acttctccaccctgct

SEQ ID NO: 3355389 - DNA, 18 bp, Homo sapiens
acttctccaccctgctct

SEQ ID NO: 3355390 - DNA, 17 bp, Homo sapiens
acttctctgatcaaaat

SEQ ID NO: 3355391 - DNA, 20 bp, Homo sapiens
acttctctggaaagggggga

SEQ ID NO: 3355392 - DNA, 18 bp, Homo sapiens
acttctgaagactgagaa

SEQ ID NO: 3355393 - DNA, 17 bp, Homo sapiens
agaaaggcctgcacaca

SEQ ID NO: 3355394 - DNA, 22 bp, Homo sapiens
agaaagtacttctccaccctgc

SEQ ID NO: 3355395 - DNA, 15 bp, Homo sapiens
agaaagtagaggcat

SEQ ID NO: 3355396 - DNA, 17 bp, Homo sapiens
agaaagtcaccaggact

SEQ ID NO: 3355397 - DNA, 20 bp, Homo sapiens
agaaagtcgaattaatagct

SEQ ID NO: 3355398 - DNA, 21 bp, Homo sapiens
agaaagtcgaattaatagctt

SEQ ID NO: 3355399 - DNA, 15 bp, Homo sapiens
agaaagtgaagcaaa

SEQ ID NO: 3355400 - DNA, 23 bp, Homo sapiens
agaaagtgaagcaaatcagaaac

SEQ ID NO: 3355401 - DNA, 19 bp, Homo sapiens
agaaagtgcctgacacact

SEQ ID NO: 3355402 - DNA, 18 bp, Homo sapiens
agaaagtgggaggtcagg

SEQ ID NO: 3355403 - DNA, 11 bp, Homo sapiens
agaaagtgtat

SEQ ID NO: 3355404 - DNA, 16 bp, Homo sapiens
agaaagtgtgagcaaa

SEQ ID NO: 3355405 - DNA, 17 bp, Homo sapiens
agaaagtgtgagcaaac

SEQ ID NO: 3355406 - DNA, 22 bp, Homo sapiens
agaaagttctgtgtaaacagaa

SEQ ID NO: 3355407 - DNA, 13 bp, Homo sapiens
agaaagtttagaa

SEQ ID NO: 3355408 - DNA, 21 bp, Homo sapiens
agaaagtttgtaaaaatatac

SEQ ID NO: 3355409 - DNA, 12 bp, Homo sapiens
agaaataaaaat

SEQ ID NO: 3355410 - DNA, 13 bp, Homo sapiens
agaaataaaagtg

SEQ ID NO: 3355411 - DNA, 23 bp, Homo sapiens
agaaataaaagtgaatgaaagat

SEQ ID NO: 3355412 - DNA, 21 bp, Homo sapiens
agaaataaagtttgcttagaa

SEQ ID NO: 3355413 - DNA, 15 bp, Homo sapiens
agaaataatatgcat

SEQ ID NO: 3355414 - DNA, 16 bp, Homo sapiens
agaaataatatgcatt

SEQ ID NO: 3355415 - DNA, 19 bp, Homo sapiens
agaaataatgctacaattt

SEQ ID NO: 3355416 - DNA, 20 bp, Homo sapiens
agaaataatgctacaatttt

SEQ ID NO: 3355417 - DNA, 19 bp, Homo sapiens
agaaatacaattctacatt

SEQ ID NO: 3355418 - DNA, 13 bp, Homo sapiens
agaaatagacaaa

SEQ ID NO: 3355419 - DNA, 16 bp, Homo sapiens
agaaatataacacatt

SEQ ID NO: 3355420 - DNA, 17 bp, Homo sapiens
agaaatataacacattt

SEQ ID NO: 3355421 - DNA, 16 bp, Homo sapiens
agaaatatgattttat

SEQ ID NO: 3355422 - DNA, 21 bp, Homo sapiens
agaaatatgcacaatagcagt

SEQ ID NO: 3355423 - DNA, 16 bp, Homo sapiens
agaaatatggaactta

SEQ ID NO: 3355424 - DNA, 17 bp, Homo sapiens
agaaatatggaacttac

SEQ ID NO: 3355425 - DNA, 22 bp, Homo sapiens
agaaatatggaacttacattgt

SEQ ID NO: 3355426 - DNA, 15 bp, Homo sapiens
agaaatatgtggttt

SEQ ID NO: 3355427 - DNA, 18 bp, Homo sapiens
agaaatattccaaatgtc

SEQ ID NO: 3355428 - DNA, 15 bp, Homo sapiens
agaaatcaatagttg

SEQ ID NO: 3355429 - DNA, 16 bp, Homo sapiens
agaaatcattgtagaa

SEQ ID NO: 3355430 - DNA, 17 bp, Homo sapiens
agaaatcattgtagaaa

SEQ ID NO: 3355431 - DNA, 13 bp, Homo sapiens
agaaatctgaaaa

SEQ ID NO: 3355432 - DNA, 11 bp, Homo sapiens
agaaatgaaat

SEQ ID NO: 3355433 - DNA, 13 bp, Homo sapiens
agaaatgaaatag

SEQ ID NO: 3355434 - DNA, 19 bp, Homo sapiens
agaaatgaataatttccca

SEQ ID NO: 3355435 - DNA, 14 bp, Homo sapiens
agaaatgactaatt

SEQ ID NO: 3355436 - DNA, 22 bp, Homo sapiens
agaaatgattcaaattgctgct

SEQ ID NO: 3355437 - DNA, 20 bp, Homo sapiens
agaaatgggacttaactcct

SEQ ID NO: 3355438 - DNA, 21 bp, Homo sapiens
agaaatggggaattctctaat

SEQ ID NO: 3355439 - DNA, 13 bp, Homo sapiens
agaaatgtaaact

SEQ ID NO: 3355440 - DNA, 22 bp, Homo sapiens
agaaatgttgagtctgtactaa

SEQ ID NO: 3355441 - DNA, 17 bp, Homo sapiens
agaaattagctgtgtga

SEQ ID NO: 3355442 - DNA, 17 bp, Homo sapiens
agaaattatttaataaa

SEQ ID NO: 3355443 - DNA, 18 bp, Homo sapiens
agaaattcgtgtgttttt

SEQ ID NO: 3355444 - DNA, 13 bp, Homo sapiens
agaaattctcttt

SEQ ID NO: 3355445 - DNA, 15 bp, Homo sapiens
agaaattctgttaaa

SEQ ID NO: 3355446 - DNA, 17 bp, Homo sapiens
agaaattgcatttcctg

SEQ ID NO: 3355447 - DNA, 20 bp, Homo sapiens
agaaattgcatttcctgaca

SEQ ID NO: 3355448 - DNA, 19 bp, Homo sapiens
agaaattggaacagaatgt

SEQ ID NO: 3355449 - DNA, 11 bp, Homo sapiens
agaaatttaac

SEQ ID NO: 3355450 - DNA, 16 bp, Homo sapiens
agaaatttactatata

SEQ ID NO: 3355451 - DNA, 17 bp, Homo sapiens
agaaatttactatatat

SEQ ID NO: 3355452 - DNA, 19 bp, Homo sapiens
agaaatttatgaagcagat

SEQ ID NO: 3355453 - DNA, 16 bp, Homo sapiens
agaaatttgatttcta

SEQ ID NO: 3355454 - DNA, 16 bp, Homo sapiens
agaaatttgcaactca

SEQ ID NO: 3355455 - DNA, 20 bp, Homo sapiens
agaaatttgcaactcactga

SEQ ID NO: 3355456 - DNA, 11 bp, Homo sapiens
agaaattttca

SEQ ID NO: 3355457 - DNA, 12 bp, Homo sapiens
agaaattttcaa

SEQ ID NO: 3355458 - DNA, 13 bp, Homo sapiens
agaaatttttatt

SEQ ID NO: 3355459 - DNA, 22 bp, Homo sapiens
agaaatttttatttttctaagg

SEQ ID NO: 3355460 - DNA, 17 bp, Homo sapiens
agaaatttttcagatgc

SEQ ID NO: 3355461 - DNA, 21 bp, Homo sapiens
agaaatttttcagatgcttct

SEQ ID NO: 3355462 - DNA, 12 bp, Homo sapiens
agaacaaacaaa

SEQ ID NO: 3355463 - DNA, 16 bp, Homo sapiens
agaacaaacaaaactt

SEQ ID NO: 3355464 - DNA, 14 bp, Homo sapiens
agaacaaagctgtt

SEQ ID NO: 3355465 - DNA, 16 bp, Homo sapiens
agaacaaagctgttaa

SEQ ID NO: 3355466 - DNA, 17 bp, Homo sapiens
agaacaaagctgttaaa

SEQ ID NO: 3355467 - DNA, 20 bp, Homo sapiens
agaacaaagctgttaaactg

SEQ ID NO: 3355468 - DNA, 14 bp, Homo sapiens
agaacaaaggacag

SEQ ID NO: 3355469 - DNA, 19 bp, Homo sapiens
agaacaagagtttgttctg

SEQ ID NO: 3355470 - DNA, 22 bp, Homo sapiens
agaacaagcccaaatttaattt

SEQ ID NO: 3355471 - DNA, 22 bp, Homo sapiens
agaacaagtcacagctgcagct

SEQ ID NO: 3355472 - DNA, 23 bp, Homo sapiens
agaacaagtcacagctgcagctg

SEQ ID NO: 3355473 - DNA, 19 bp, Homo sapiens
agaacaagtgcctcctgga

SEQ ID NO: 3355474 - DNA, 13 bp, Homo sapiens
agaacaattgtcc

SEQ ID NO: 3355475 - DNA, 22 bp, Homo sapiens
agaacacaaagcggggggaggg

SEQ ID NO: 3355476 - DNA, 13 bp, Homo sapiens
agaacacagcatg

SEQ ID NO: 3355477 - DNA, 15 bp, Homo sapiens
agaacacagcatgtg

SEQ ID NO: 3355478 - DNA, 18 bp, Homo sapiens
agaacacagcatgtgcca

SEQ ID NO: 3355479 - DNA, 21 bp, Homo sapiens
agaacacagcatgtgccaaga

SEQ ID NO: 3355480 - DNA, 20 bp, Homo sapiens
agaacactaactcaccagcc

SEQ ID NO: 3355481 - DNA, 14 bp, Homo sapiens
agaacactaattca

SEQ ID NO: 3355482 - DNA, 16 bp, Homo sapiens
agaacactaattcata

SEQ ID NO: 3355483 - DNA, 17 bp, Homo sapiens
agaacactattttcaga

SEQ ID NO: 3355484 - DNA, 18 bp, Homo sapiens
agaacactattttcagaa

SEQ ID NO: 3355485 - DNA, 22 bp, Homo sapiens
agaacactattttcagaatctg

SEQ ID NO: 3355486 - DNA, 13 bp, Homo sapiens
agaacagcttcag

SEQ ID NO: 3355487 - DNA, 22 bp, Homo sapiens
agaacaggaggtgtgaatgcac

SEQ ID NO: 3355488 - DNA, 22 bp, Homo sapiens
agaacagtggaaactatgtgtt

SEQ ID NO: 3355489 - DNA, 22 bp, Homo sapiens
agaacagtggttgcctgggggc

SEQ ID NO: 3355490 - DNA, 15 bp, Homo sapiens
agaacatccaaggag

SEQ ID NO: 3355491 - DNA, 18 bp, Homo sapiens
agaacatccaaggagaaa

SEQ ID NO: 3355492 - DNA, 20 bp, Homo sapiens
agaacatctgtataccctct

SEQ ID NO: 3355493 - DNA, 23 bp, Homo sapiens
agaacatctttgacactctgcag

SEQ ID NO: 3355494 - DNA, 17 bp, Homo sapiens
agaacattcagctctgg

SEQ ID NO: 3355495 - DNA, 18 bp, Homo sapiens
agaacattcagctctgga

SEQ ID NO: 3355496 - DNA, 20 bp, Homo sapiens
agaacattcagctctggaga

SEQ ID NO: 3355497 - DNA, 11 bp, Homo sapiens
agaacattgta

SEQ ID NO: 3355498 - DNA, 13 bp, Homo sapiens
agaacattttaat

SEQ ID NO: 3355499 - DNA, 17 bp, Homo sapiens
agaaccaaagctcaaat

SEQ ID NO: 3355500 - DNA, 18 bp, Homo sapiens
agaaccaaatctggaagc

SEQ ID NO: 3355501 - DNA, 19 bp, Homo sapiens
agaaccacacttgaaacct

SEQ ID NO: 3355502 - DNA, 16 bp, Homo sapiens
agaaccaccaaaatta

SEQ ID NO: 3355503 - DNA, 16 bp, Homo sapiens
agaaccaccactgcct

SEQ ID NO: 3355504 - DNA, 14 bp, Homo sapiens
agaaccacttcctg

SEQ ID NO: 3355505 - DNA, 20 bp, Homo sapiens
agaaccacttcctgctacag

SEQ ID NO: 3355506 - DNA, 22 bp, Homo sapiens
agaaccacttcctgctacagga

SEQ ID NO: 3355507 - DNA, 18 bp, Homo sapiens
agaaccagccgtatttta

SEQ ID NO: 3355508 - DNA, 22 bp, Homo sapiens
agaaccagccgtattttacatg

SEQ ID NO: 3355509 - DNA, 14 bp, Homo sapiens
agaaccagtctcct

SEQ ID NO: 3355510 - DNA, 15 bp, Homo sapiens
agaaccatgcaggaa

SEQ ID NO: 3355511 - DNA, 18 bp, Homo sapiens
agaacccagggctctgcc

SEQ ID NO: 3355512 - DNA, 21 bp, Homo sapiens
agaacccagggctctgcccca

SEQ ID NO: 3355513 - DNA, 22 bp, Homo sapiens
agaacccagggctctgccccag

SEQ ID NO: 3355514 - DNA, 15 bp, Homo sapiens
agaaccgagcaaaga

SEQ ID NO: 3355515 - DNA, 19 bp, Homo sapiens
agaacctactgttcctttc

SEQ ID NO: 3355516 - DNA, 21 bp, Homo sapiens
agaacctcaggcttccttggc

SEQ ID NO: 3355517 - DNA, 16 bp, Homo sapiens
agaacctgggctgtgc

SEQ ID NO: 3355518 - DNA, 22 bp, Homo sapiens
agaacgaacacaagaaaaagat

SEQ ID NO: 3355519 - DNA, 15 bp, Homo sapiens
agaacgccagtctcc

SEQ ID NO: 3355520 - DNA, 20 bp, Homo sapiens
agaacgcggtgtgtaacact

SEQ ID NO: 3355521 - DNA, 23 bp, Homo sapiens
agaacggtttttggatctggcat

SEQ ID NO: 3355522 - DNA, 23 bp, Homo sapiens
agaacgtattttaaaagccacat

SEQ ID NO: 3355523 - DNA, 12 bp, Homo sapiens
agaactaaatgt

SEQ ID NO: 3355524 - DNA, 15 bp, Homo sapiens
agaactaaatgttct

SEQ ID NO: 3355525 - DNA, 16 bp, Homo sapiens
agaactactaaagtgc

SEQ ID NO: 3355526 - DNA, 16 bp, Homo sapiens
agaactactaaggaaa

SEQ ID NO: 3355527 - DNA, 17 bp, Homo sapiens
agaactagccaaaccag

SEQ ID NO: 3355528 - DNA, 19 bp, Homo sapiens
agaactagccaaaccagga

SEQ ID NO: 3355529 - DNA, 16 bp, Homo sapiens
agaactatatgtgaat

SEQ ID NO: 3355530 - DNA, 20 bp, Homo sapiens
agaactcctccaaagcatgt

SEQ ID NO: 3355531 - DNA, 18 bp, Homo sapiens
agaactccttattttgta

SEQ ID NO: 3355532 - DNA, 19 bp, Homo sapiens
agaactccttattttgtat

SEQ ID NO: 3355533 - DNA, 21 bp, Homo sapiens
agaactccttattttgtatta

SEQ ID NO: 3355534 - DNA, 20 bp, Homo sapiens
agaactcgcgctcagtaaac

SEQ ID NO: 3355535 - DNA, 21 bp, Homo sapiens
agaactcgcgctcagtaaacg

SEQ ID NO: 3355536 - DNA, 16 bp, Homo sapiens
agaactctctggaagc

SEQ ID NO: 3355537 - DNA, 20 bp, Homo sapiens
agaactctgggctgccatgt

SEQ ID NO: 3355538 - DNA, 21 bp, Homo sapiens
agaactgaaataaaaaattat

SEQ ID NO: 3355539 - DNA, 15 bp, Homo sapiens
agaactgcagggcct

SEQ ID NO: 3355540 - DNA, 16 bp, Homo sapiens
agaactgcatggacct

SEQ ID NO: 3355541 - DNA, 14 bp, Homo sapiens
agaactgccattat

SEQ ID NO: 3355542 - DNA, 16 bp, Homo sapiens
agaactgcccccactg

SEQ ID NO: 3355543 - DNA, 15 bp, Homo sapiens
agaactgggtaaatg

SEQ ID NO: 3355544 - DNA, 20 bp, Homo sapiens
agaactgggtaaatgcaaag

SEQ ID NO: 3355545 - DNA, 18 bp, Homo sapiens
agaacttcagaaagactt

SEQ ID NO: 3355546 - DNA, 15 bp, Homo sapiens
agaacttgtttacaa

SEQ ID NO: 3355547 - DNA, 10 bp, Homo sapiens
agaacttttt

SEQ ID NO: 3355548 - DNA, 15 bp, Homo sapiens
agaacttttttaaat

SEQ ID NO: 3355549 - DNA, 19 bp, Homo sapiens
agaacttttttaaataaac

SEQ ID NO: 3355550 - DNA, 16 bp, Homo sapiens
agaagaaaattctcct

SEQ ID NO: 3355551 - DNA, 17 bp, Homo sapiens
agaagaaaattctcctg

SEQ ID NO: 3355552 - DNA, 14 bp, Homo sapiens
agaagaaagactct

SEQ ID NO: 3355553 - DNA, 12 bp, Homo sapiens
agaagaaagatg

SEQ ID NO: 3355554 - DNA, 13 bp, Homo sapiens
agaagaaagatgt

SEQ ID NO: 3355555 - DNA, 12 bp, Homo sapiens
agaagaaagcaa

SEQ ID NO: 3355556 - DNA, 14 bp, Homo sapiens
agaagaaataaata

SEQ ID NO: 3355557 - DNA, 12 bp, Homo sapiens
agaagaacagta

SEQ ID NO: 3355558 - DNA, 21 bp, Homo sapiens
agaagaacttgcatggagcag

SEQ ID NO: 3355559 - DNA, 18 bp, Homo sapiens
agaagaagaaggagagca

SEQ ID NO: 3355560 - DNA, 14 bp, Homo sapiens
agaagaaggagagc

SEQ ID NO: 3355561 - DNA, 15 bp, Homo sapiens
agaagacaccagagc

SEQ ID NO: 3355562 - DNA, 17 bp, Homo sapiens
agaagacaccagagcag

SEQ ID NO: 3355563 - DNA, 21 bp, Homo sapiens
agaagacactgatgggcaacc

SEQ ID NO: 3355564 - DNA, 12 bp, Homo sapiens
agaagacactgc

SEQ ID NO: 3355565 - DNA, 15 bp, Homo sapiens
agaagacatgaacca

SEQ ID NO: 3355566 - DNA, 14 bp, Homo sapiens
agaagacatggaga

SEQ ID NO: 3355567 - DNA, 21 bp, Homo sapiens
agaagaccacaaaaattgact

SEQ ID NO: 3355568 - DNA, 20 bp, Homo sapiens
agaagagaggagaggagaga

SEQ ID NO: 3355569 - DNA, 22 bp, Homo sapiens
agaagagaggagaggagagagg

SEQ ID NO: 3355570 - DNA, 15 bp, Homo sapiens
agaagagaggggaag

SEQ ID NO: 3355571 - DNA, 19 bp, Homo sapiens
agaagaggcatcctgcctg

SEQ ID NO: 3355572 - DNA, 15 bp, Homo sapiens
agaagagggtgtgtt

SEQ ID NO: 3355573 - DNA, 19 bp, Homo sapiens
agaagagttttagagaaaa

SEQ ID NO: 3355574 - DNA, 19 bp, Homo sapiens
agaagataacattttcaat

SEQ ID NO: 3355575 - DNA, 22 bp, Homo sapiens
agaagataattgttgaaatttt

SEQ ID NO: 3355576 - DNA, 23 bp, Homo sapiens
agaagatcacgctccccgcctgt

SEQ ID NO: 3355577 - DNA, 17 bp, Homo sapiens
agaagcagccataaaac

SEQ ID NO: 3355578 - DNA, 16 bp, Homo sapiens
agaagcatattttgct

SEQ ID NO: 3355579 - DNA, 18 bp, Homo sapiens
agaagcattaacttctct

SEQ ID NO: 3355580 - DNA, 21 bp, Homo sapiens
agaagcattaacttctctgga

SEQ ID NO: 3355581 - DNA, 13 bp, Homo sapiens
agaagcattcctt

SEQ ID NO: 3355582 - DNA, 17 bp, Homo sapiens
agaagcattccttcttt

SEQ ID NO: 3355583 - DNA, 23 bp, Homo sapiens
agaagcattccttctttgataat

SEQ ID NO: 3355584 - DNA, 10 bp, Homo sapiens
agaagcattt

SEQ ID NO: 3355585 - DNA, 15 bp, Homo sapiens
agaagccaagggaaa

SEQ ID NO: 3355586 - DNA, 12 bp, Homo sapiens
agaagccagcca

SEQ ID NO: 3355587 - DNA, 20 bp, Homo sapiens
agaagccatgtactcaagta

SEQ ID NO: 3355588 - DNA, 21 bp, Homo sapiens
agaagcccaatattataattt

SEQ ID NO: 3355589 - DNA, 20 bp, Homo sapiens
agaagcccgtgtgagaagtg

SEQ ID NO: 3355590 - DNA, 18 bp, Homo sapiens
agaagccctgcagagcac

SEQ ID NO: 3355591 - DNA, 21 bp, Homo sapiens
agaagccgagagccttttgtg

SEQ ID NO: 3355592 - DNA, 16 bp, Homo sapiens
agaagcctctggctag

SEQ ID NO: 3355593 - DNA, 12 bp, Homo sapiens
agaagcctgagg

SEQ ID NO: 3355594 - DNA, 14 bp, Homo sapiens
agaagcctgaggct

SEQ ID NO: 3355595 - DNA, 17 bp, Homo sapiens
agaagccttcagctcca

SEQ ID NO: 3355596 - DNA, 18 bp, Homo sapiens
agaagccttcagctccag

SEQ ID NO: 3355597 - DNA, 19 bp, Homo sapiens
agaagccttcagctccagg

SEQ ID NO: 3355598 - DNA, 18 bp, Homo sapiens
agaagcgtttttaacctg

SEQ ID NO: 3355599 - DNA, 21 bp, Homo sapiens
agaagctatgtcaagaggctg

SEQ ID NO: 3355600 - DNA, 15 bp, Homo sapiens
agaagctcgccccac

SEQ ID NO: 3355601 - DNA, 22 bp, Homo sapiens
agaagctgctccaggcctgcag

SEQ ID NO: 3355602 - DNA, 15 bp, Homo sapiens
agaagctggacttct

SEQ ID NO: 3355603 - DNA, 18 bp, Homo sapiens
agaagctgttgtacattt

SEQ ID NO: 3355604 - DNA, 22 bp, Homo sapiens
agaagctgttgtacatttatga

SEQ ID NO: 3355605 - DNA, 12 bp, Homo sapiens
agaagcttctaa

SEQ ID NO: 3355606 - DNA, 13 bp, Homo sapiens
agaaggaaagaag

SEQ ID NO: 3355607 - DNA, 17 bp, Homo sapiens
agaaggaaattgagatt

SEQ ID NO: 3355608 - DNA, 12 bp, Homo sapiens
agaaggagggca

SEQ ID NO: 3355609 - DNA, 11 bp, Homo sapiens
agaaggcaaaa

SEQ ID NO: 3355610 - DNA, 15 bp, Homo sapiens
agaaggcaaaaatgt

SEQ ID NO: 3355611 - DNA, 18 bp, Homo sapiens
agaaggcatttgcagggt

SEQ ID NO: 3355612 - DNA, 22 bp, Homo sapiens
agaaggcctcttgtgctcacgc

SEQ ID NO: 3355613 - DNA, 13 bp, Homo sapiens
agaaggcgaggag

SEQ ID NO: 3355614 - DNA, 19 bp, Homo sapiens
agaagggaagaaggggcca

SEQ ID NO: 3355615 - DNA, 16 bp, Homo sapiens
agaagggaatcctcct

SEQ ID NO: 3355616 - DNA, 18 bp, Homo sapiens
agaagggaatcctcctcc

SEQ ID NO: 3355617 - DNA, 16 bp, Homo sapiens
agaagggagaagaaag

SEQ ID NO: 3355618 - DNA, 19 bp, Homo sapiens
agaagggctctttctctct

SEQ ID NO: 3355619 - DNA, 21 bp, Homo sapiens
agaagggggccctgctacctg

SEQ ID NO: 3355620 - DNA, 20 bp, Homo sapiens
agaagggttttccaccctgg

SEQ ID NO: 3355621 - DNA, 22 bp, Homo sapiens
agaagggttttccaccctggaa

SEQ ID NO: 3355622 - DNA, 23 bp, Homo sapiens
agaagggttttccaccctggaat

SEQ ID NO: 3355623 - DNA, 17 bp, Homo sapiens
agaaggttgacacagtt

SEQ ID NO: 3355624 - DNA, 23 bp, Homo sapiens
agaagtaagtttatccaaatctt

SEQ ID NO: 3355625 - DNA, 19 bp, Homo sapiens
agaagtagattaagagcca

SEQ ID NO: 3355626 - DNA, 21 bp, Homo sapiens
agaagtaggcatgagggatca

SEQ ID NO: 3355627 - DNA, 14 bp, Homo sapiens
agaagtcacacagt

SEQ ID NO: 3355628 - DNA, 18 bp, Homo sapiens
agaagtcactcaattgtt

SEQ ID NO: 3355629 - DNA, 13 bp, Homo sapiens
agaagtctcattc

SEQ ID NO: 3355630 - DNA, 15 bp, Homo sapiens
agaagtgaagaatgc

SEQ ID NO: 3355631 - DNA, 16 bp, Homo sapiens
agaagtgaatgctggg

SEQ ID NO: 3355632 - DNA, 19 bp, Homo sapiens
agaagtgaatgctgggact

SEQ ID NO: 3355633 - DNA, 12 bp, Homo sapiens
agaagtgccttc

SEQ ID NO: 3355634 - DNA, 13 bp, Homo sapiens
agaagtgccttct

SEQ ID NO: 3355635 - DNA, 22 bp, Homo sapiens
agaagtgtggggattttcactg

SEQ ID NO: 3355636 - DNA, 15 bp, Homo sapiens
agaagttactttgta

SEQ ID NO: 3355637 - DNA, 16 bp, Homo sapiens
agaagttactttgtaa

SEQ ID NO: 3355638 - DNA, 23 bp, Homo sapiens
agaagttactttgtaatttttgg

SEQ ID NO: 3355639 - DNA, 20 bp, Homo sapiens
agaagttgtttgaggcaaat

SEQ ID NO: 3355640 - DNA, 14 bp, Homo sapiens
agaagtttcccttc

SEQ ID NO: 3355641 - DNA, 15 bp, Homo sapiens
agaagtttgtccatt

SEQ ID NO: 3355642 - DNA, 19 bp, Homo sapiens
agaagtttgtccatttgta

SEQ ID NO: 3355643 - DNA, 11 bp, Homo sapiens
agaagtttttg

SEQ ID NO: 3355644 - DNA, 12 bp, Homo sapiens
agaagtttttgt

SEQ ID NO: 3355645 - DNA, 15 bp, Homo sapiens
agactgtgctctctg

SEQ ID NO: 3355646 - DNA, 23 bp, Homo sapiens
agactgtgctctctgtggtgcct

SEQ ID NO: 3355647 - DNA, 20 bp, Homo sapiens
agactgttgtgatcttgcat

SEQ ID NO: 3355648 - DNA, 16 bp, Homo sapiens
agactgttttactgtt

SEQ ID NO: 3355649 - DNA, 19 bp, Homo sapiens
agactgttttactgtttta

SEQ ID NO: 3355650 - DNA, 21 bp, Homo sapiens
agactgttttactgttttaat

SEQ ID NO: 3355651 - DNA, 15 bp, Homo sapiens
agacttaccaggaag

SEQ ID NO: 3355652 - DNA, 14 bp, Homo sapiens
agacttactctaag

SEQ ID NO: 3355653 - DNA, 18 bp, Homo sapiens
agacttactctaagatct

SEQ ID NO: 3355654 - DNA, 19 bp, Homo sapiens
agacttactttactcattt

SEQ ID NO: 3355655 - DNA, 21 bp, Homo sapiens
agacttactttactcattttt

SEQ ID NO: 3355656 - DNA, 18 bp, Homo sapiens
agacttagtatattttct

SEQ ID NO: 3355657 - DNA, 14 bp, Homo sapiens
agacttattctttt

SEQ ID NO: 3355658 - DNA, 19 bp, Homo sapiens
agacttccaaacctgacag

SEQ ID NO: 3355659 - DNA, 14 bp, Homo sapiens
agacttcccagctt

SEQ ID NO: 3355660 - DNA, 22 bp, Homo sapiens
agacttcggggaagatacactg

SEQ ID NO: 3355661 - DNA, 18 bp, Homo sapiens
agacttctggaaggctgg

SEQ ID NO: 3355662 - DNA, 19 bp, Homo sapiens
agacttctggaaggctggc

SEQ ID NO: 3355663 - DNA, 20 bp, Homo sapiens
agacttctggaaggctggct

SEQ ID NO: 3355664 - DNA, 23 bp, Homo sapiens
agacttctggaaggctggctgag

SEQ ID NO: 3355665 - DNA, 22 bp, Homo sapiens
agacttctggttgtatttctat

SEQ ID NO: 3355666 - DNA, 15 bp, Homo sapiens
agacttgaaagtttt

SEQ ID NO: 3355667 - DNA, 19 bp, Homo sapiens
agacttgaaagttttccag

SEQ ID NO: 3355668 - DNA, 15 bp, Homo sapiens
agacttgaagcacag

SEQ ID NO: 3355669 - DNA, 12 bp, Homo sapiens
agacttgccaac

SEQ ID NO: 3355670 - DNA, 19 bp, Homo sapiens
agacttggcaacagaagca

SEQ ID NO: 3355671 - DNA, 17 bp, Homo sapiens
agacttgtgctcaagga

SEQ ID NO: 3355672 - DNA, 16 bp, Homo sapiens
agactttagtgccctg

SEQ ID NO: 3355673 - DNA, 16 bp, Homo sapiens
agactttatgtagttt

SEQ ID NO: 3355674 - DNA, 18 bp, Homo sapiens
agacttttattaataaaa

SEQ ID NO: 3355675 - DNA, 13 bp, Homo sapiens
agacttttgtaca

SEQ ID NO: 3355676 - DNA, 13 bp, Homo sapiens
agactttttggtg

SEQ ID NO: 3355677 - DNA, 16 bp, Homo sapiens
agagaaaaaaaaaata

SEQ ID NO: 3355678 - DNA, 18 bp, Homo sapiens
agagaaaatgatgagttt

SEQ ID NO: 3355679 - DNA, 13 bp, Homo sapiens
agagaaacagttg

SEQ ID NO: 3355680 - DNA, 17 bp, Homo sapiens
agagaaaccgtcctctt

SEQ ID NO: 3355681 - DNA, 20 bp, Homo sapiens
agagaaaccgtcctcttttt

SEQ ID NO: 3355682 - DNA, 23 bp, Homo sapiens
agagaaaccgtcctctttttcca

SEQ ID NO: 3355683 - DNA, 16 bp, Homo sapiens
agagaaagaaaatgaa

SEQ ID NO: 3355684 - DNA, 17 bp, Homo sapiens
agagaaagagagaagcc

SEQ ID NO: 3355685 - DNA, 18 bp, Homo sapiens
agagaaagcacgtgtctc

SEQ ID NO: 3355686 - DNA, 14 bp, Homo sapiens
agagaaatatggaa

SEQ ID NO: 3355687 - DNA, 14 bp, Homo sapiens
agagaaatctgaaa

SEQ ID NO: 3355688 - DNA, 13 bp, Homo sapiens
agagaaatggcaa

SEQ ID NO: 3355689 - DNA, 17 bp, Homo sapiens
agagaaattctgttaaa

SEQ ID NO: 3355690 - DNA, 22 bp, Homo sapiens
agagaaatttttatttttgaac

SEQ ID NO: 3355691 - DNA, 20 bp, Homo sapiens
agagaaccgagcaaagatca

SEQ ID NO: 3355692 - DNA, 23 bp, Homo sapiens
agagaacctcaggtacggagaag

SEQ ID NO: 3355693 - DNA, 19 bp, Homo sapiens
agagaactactaaggaaaa

SEQ ID NO: 3355694 - DNA, 22 bp, Homo sapiens
agagaactcgcgctcagtaaac

SEQ ID NO: 3355695 - DNA, 17 bp, Homo sapiens
agagaagagggcccagc

SEQ ID NO: 3355696 - DNA, 18 bp, Homo sapiens
agagaagagggcccagcc

SEQ ID NO: 3355697 - DNA, 20 bp, Homo sapiens
agagaagataatgttcttta

SEQ ID NO: 3355698 - DNA, 20 bp, Homo sapiens
agagaagataattgttgaaa

SEQ ID NO: 3355699 - DNA, 14 bp, Homo sapiens
agagaagccagcca

SEQ ID NO: 3355700 - DNA, 15 bp, Homo sapiens
agagaagccagccac

SEQ ID NO: 3355701 - DNA, 16 bp, Homo sapiens
agagaagccagccaca

SEQ ID NO: 3355702 - DNA, 19 bp, Homo sapiens
agagaagccagccacagac

SEQ ID NO: 3355703 - DNA, 15 bp, Homo sapiens
agagaagctggactt

SEQ ID NO: 3355704 - DNA, 14 bp, Homo sapiens
agagaaggcagcag

SEQ ID NO: 3355705 - DNA, 13 bp, Homo sapiens
agagaaggcctct

SEQ ID NO: 3355706 - DNA, 18 bp, Homo sapiens
agagaagttctcaaagtt

SEQ ID NO: 3355707 - DNA, 17 bp, Homo sapiens
agagaagtttgtagcca

SEQ ID NO: 3355708 - DNA, 20 bp, Homo sapiens
agagaagtttgtagccaggt

SEQ ID NO: 3355709 - DNA, 17 bp, Homo sapiens
agagaatatatttttga

SEQ ID NO: 3355710 - DNA, 10 bp, Homo sapiens
agagaatgag

SEQ ID NO: 3355711 - DNA, 23 bp, Homo sapiens
agagaatgataggcttttgttct

SEQ ID NO: 3355712 - DNA, 20 bp, Homo sapiens
agagaatggctgggtcaggg

SEQ ID NO: 3355713 - DNA, 12 bp, Homo sapiens
agagaattaaaa

SEQ ID NO: 3355714 - DNA, 14 bp, Homo sapiens
agagaattggctca

SEQ ID NO: 3355715 - DNA, 22 bp, Homo sapiens
agagaatttctaccatttcaga

SEQ ID NO: 3355716 - DNA, 19 bp, Homo sapiens
agagacaagtaatttcagt

SEQ ID NO: 3355717 - DNA, 20 bp, Homo sapiens
agagacaagtaatttcagtg

SEQ ID NO: 3355718 - DNA, 17 bp, Homo sapiens
agagacacatacagagt

SEQ ID NO: 3355719 - DNA, 13 bp, Homo sapiens
agagacagaagca

SEQ ID NO: 3355720 - DNA, 20 bp, Homo sapiens
agagacagaagcaggctgga

SEQ ID NO: 3355721 - DNA, 18 bp, Homo sapiens
agagacagacttgagaac

SEQ ID NO: 3355722 - DNA, 14 bp, Homo sapiens
agagacagcccagg

SEQ ID NO: 3355723 - DNA, 15 bp, Homo sapiens
agagacagcccagga

SEQ ID NO: 3355724 - DNA, 18 bp, Homo sapiens
agagacaggcccaagaga

SEQ ID NO: 3355725 - DNA, 12 bp, Homo sapiens
agagacccccag

SEQ ID NO: 3355726 - DNA, 19 bp, Homo sapiens
agagaccccgcacccggct

SEQ ID NO: 3355727 - DNA, 20 bp, Homo sapiens
agagaccgtcgggggctgag

SEQ ID NO: 3355728 - DNA, 15 bp, Homo sapiens
agagacctacctcag

SEQ ID NO: 3355729 - DNA, 20 bp, Homo sapiens
agagacctacctcaggttgc

SEQ ID NO: 3355730 - DNA, 19 bp, Homo sapiens
agagacctcatcaggatga

SEQ ID NO: 3355731 - DNA, 16 bp, Homo sapiens
agagacctgaagtgtg

SEQ ID NO: 3355732 - DNA, 16 bp, Homo sapiens
agagacgcaggaatgg

SEQ ID NO: 3355733 - DNA, 22 bp, Homo sapiens
agagacggcagaaaacagagcc

SEQ ID NO: 3355734 - DNA, 23 bp, Homo sapiens
agagacggcagaaaacagagcct

SEQ ID NO: 3355735 - DNA, 18 bp, Homo sapiens
agagactatggagcctgg

SEQ ID NO: 3355736 - DNA, 15 bp, Homo sapiens
agagactcagatgag

SEQ ID NO: 3355737 - DNA, 16 bp, Homo sapiens
agagactgagcagccg

SEQ ID NO: 3355738 - DNA, 17 bp, Homo sapiens
agagactgagcagccgc

SEQ ID NO: 3355739 - DNA, 15 bp, Homo sapiens
agagactgtagattg

SEQ ID NO: 3355740 - DNA, 19 bp, Homo sapiens
agagacttaaaggacagga

SEQ ID NO: 3355741 - DNA, 14 bp, Homo sapiens
agagagaaaaagat

SEQ ID NO: 3355742 - DNA, 14 bp, Homo sapiens
agagagaaaataaa

SEQ ID NO: 3355743 - DNA, 13 bp, Homo sapiens
agagagaaagaga

SEQ ID NO: 3355744 - DNA, 14 bp, Homo sapiens
agagagaaagagag

SEQ ID NO: 3355745 - DNA, 16 bp, Homo sapiens
agagagaaagccaggc

SEQ ID NO: 3355746 - DNA, 12 bp, Homo sapiens
agagagaaatct

SEQ ID NO: 3355747 - DNA, 12 bp, Homo sapiens
agagagaagcca

SEQ ID NO: 3355748 - DNA, 15 bp, Homo sapiens
agagagaagccagcc

SEQ ID NO: 3355749 - DNA, 16 bp, Homo sapiens
agagagaccacttttc

SEQ ID NO: 3355750 - DNA, 21 bp, Homo sapiens
agagagaccccgcacccggct

SEQ ID NO: 3355751 - DNA, 12 bp, Homo sapiens
agagagagaaaa

SEQ ID NO: 3355752 - DNA, 14 bp, Homo sapiens
agagagagaaagag

SEQ ID NO: 3355753 - DNA, 10 bp, Homo sapiens
agagagagag

SEQ ID NO: 3355754 - DNA, 11 bp, Homo sapiens
agagagagaga

SEQ ID NO: 3355755 - DNA, 14 bp, Homo sapiens
agagagagagaaaa

SEQ ID NO: 3355756 - DNA, 14 bp, Homo sapiens
agagagagagaaat

SEQ ID NO: 3355757 - DNA, 15 bp, Homo sapiens
agagagagagagaaa

SEQ ID NO: 3355758 - DNA, 15 bp, Homo sapiens
agagagagagagaga

SEQ ID NO: 3355759 - DNA, 22 bp, Homo sapiens
agagagaggaggcagccccctc

SEQ ID NO: 3355760 - DNA, 11 bp, Homo sapiens
agagagctggt

SEQ ID NO: 3355761 - DNA, 17 bp, Homo sapiens
agagagcttagcctgga

SEQ ID NO: 3355762 - DNA, 19 bp, Homo sapiens
agagaggaaggagattcca

SEQ ID NO: 3355763 - DNA, 15 bp, Homo sapiens
agagaggcagagagc

SEQ ID NO: 3355764 - DNA, 19 bp, Homo sapiens
agagaggcccgcccgccca

SEQ ID NO: 3355765 - DNA, 20 bp, Homo sapiens
agagaggccttttggaatgt

SEQ ID NO: 3355766 - DNA, 13 bp, Homo sapiens
agagagggcccag

SEQ ID NO: 3355767 - DNA, 20 bp, Homo sapiens
agagaggggctgctctccag

SEQ ID NO: 3355768 - DNA, 20 bp, Homo sapiens
agagagggtggtgacctctg

SEQ ID NO: 3355769 - DNA, 18 bp, Homo sapiens
agagagtcccactgcctc

SEQ ID NO: 3355770 - DNA, 23 bp, Homo sapiens
agagagtcccactgcctcaggtt

SEQ ID NO: 3355771 - DNA, 22 bp, Homo sapiens
agagagtggaaattacccactg

SEQ ID NO: 3355772 - DNA, 21 bp, Homo sapiens
agatccagactgtaagatgtt

SEQ ID NO: 3355773 - DNA, 22 bp, Homo sapiens
agatccagactgtaagatgttg

SEQ ID NO: 3355774 - DNA, 19 bp, Homo sapiens
agatccatttccattgctt

SEQ ID NO: 3355775 - DNA, 13 bp, Homo sapiens
agatccatttgcc

SEQ ID NO: 3355776 - DNA, 18 bp, Homo sapiens
agatccatttgcctttct

SEQ ID NO: 3355777 - DNA, 17 bp, Homo sapiens
agatcccctctcctgcc

SEQ ID NO: 3355778 - DNA, 16 bp, Homo sapiens
agatcccttaagaagt

SEQ ID NO: 3355779 - DNA, 18 bp, Homo sapiens
agatcctagatcctaagg

SEQ ID NO: 3355780 - DNA, 13 bp, Homo sapiens
agatcctggagtg

SEQ ID NO: 3355781 - DNA, 24 bp, Homo sapiens
agatcctggagtgatatgatccag

SEQ ID NO: 3355782 - DNA, 23 bp, Homo sapiens
agatccttcacaggcagtgcatg

SEQ ID NO: 3355783 - DNA, 14 bp, Homo sapiens
agatcctttcaaaa

SEQ ID NO: 3355784 - DNA, 18 bp, Homo sapiens
agatcctttttccatcat

SEQ ID NO: 3355785 - DNA, 23 bp, Homo sapiens
agatcctttttccatcattttac

SEQ ID NO: 3355786 - DNA, 14 bp, Homo sapiens
agatcgcagtttgc

SEQ ID NO: 3355787 - DNA, 18 bp, Homo sapiens
agatcgctcactgttgtg

SEQ ID NO: 3355788 - DNA, 17 bp, Homo sapiens
agatcgcttgagcccag

SEQ ID NO: 3355789 - DNA, 14 bp, Homo sapiens
agatcgtgtattga

SEQ ID NO: 3355790 - DNA, 16 bp, Homo sapiens
agatcgttagtatcta

SEQ ID NO: 3355791 - DNA, 15 bp, Homo sapiens
agatctaatgtgaaa

SEQ ID NO: 3355792 - DNA, 14 bp, Homo sapiens
agatctacaggaca

SEQ ID NO: 3355793 - DNA, 22 bp, Homo sapiens
agatctacaggacaaagggagg

SEQ ID NO: 3355794 - DNA, 22 bp, Homo sapiens
agatctcggtttgccaaaattc

SEQ ID NO: 3355795 - DNA, 16 bp, Homo sapiens
agatctgatggtgagc

SEQ ID NO: 3355796 - DNA, 17 bp, Homo sapiens
agatctgcctgggcctg

SEQ ID NO: 3355797 - DNA, 18 bp, Homo sapiens
agatctgcctgggcctgt

SEQ ID NO: 3355798 - DNA, 19 bp, Homo sapiens
agatctgcctgggcctgtg

SEQ ID NO: 3355799 - DNA, 23 bp, Homo sapiens
agatctgcctgggcctgtgcagc

SEQ ID NO: 3355800 - DNA, 12 bp, Homo sapiens
agatctggtttt

SEQ ID NO: 3355801 - DNA, 22 bp, Homo sapiens
agatctgttttgtggtttggaa

SEQ ID NO: 3355802 - DNA, 13 bp, Homo sapiens
agatcttatattg

SEQ ID NO: 3355803 - DNA, 15 bp, Homo sapiens
agatcttatattggt

SEQ ID NO: 3355804 - DNA, 12 bp, Homo sapiens
agatctttcaga

SEQ ID NO: 3355805 - DNA, 21 bp, Homo sapiens
agatctttcagaaatataaca

SEQ ID NO: 3355806 - DNA, 21 bp, Homo sapiens
agatctttcaggaaagacgga

SEQ ID NO: 3355807 - DNA, 12 bp, Homo sapiens
agatctttgcta

SEQ ID NO: 3355808 - DNA, 23 bp, Homo sapiens
agatgaaagcagggaatttctat

SEQ ID NO: 3355809 - DNA, 22 bp, Homo sapiens
agatgaactctgaactttggag

SEQ ID NO: 3355810 - DNA, 17 bp, Homo sapiens
agatgaagagtgagagg

SEQ ID NO: 3355811 - DNA, 19 bp, Homo sapiens
agatgaagttttacattgt

SEQ ID NO: 3355812 - DNA, 17 bp, Homo sapiens
agatgaatgtcctgaaa

SEQ ID NO: 3355813 - DNA, 20 bp, Homo sapiens
agatgacacgcgctctccac

SEQ ID NO: 3355814 - DNA, 15 bp, Homo sapiens
agatgaccagggatg

SEQ ID NO: 3355815 - DNA, 19 bp, Homo sapiens
agatgaccagggatgctgg

SEQ ID NO: 3355816 - DNA, 15 bp, Homo sapiens
agatgaccttttgga

SEQ ID NO: 3355817 - DNA, 15 bp, Homo sapiens
agatgactgagtcct

SEQ ID NO: 3355818 - DNA, 17 bp, Homo sapiens
agatgactttgcagatg

SEQ ID NO: 3355819 - DNA, 20 bp, Homo sapiens
agatgactttgcagatggaa

SEQ ID NO: 3355820 - DNA, 23 bp, Homo sapiens
agatgactttgcagatggaaaga

SEQ ID NO: 3355821 - DNA, 20 bp, Homo sapiens
agatgagaaatgatgaaaag

SEQ ID NO: 3355822 - DNA, 16 bp, Homo sapiens
agatgagaacaaagct

SEQ ID NO: 3355823 - DNA, 21 bp, Homo sapiens
agatgagatttgccagcacag

SEQ ID NO: 3355824 - DNA, 20 bp, Homo sapiens
agatgaggagtaaaattcag

SEQ ID NO: 3355825 - DNA, 21 bp, Homo sapiens
agatgaggtcagttgtgtttt

SEQ ID NO: 3355826 - DNA, 20 bp, Homo sapiens
agatgattaaataagattct

SEQ ID NO: 3355827 - DNA, 15 bp, Homo sapiens
agatgattatatatt

SEQ ID NO: 3355828 - DNA, 13 bp, Homo sapiens
agatgcaagatat

SEQ ID NO: 3355829 - DNA, 18 bp, Homo sapiens
agatgcaaggaccaggac

SEQ ID NO: 3355830 - DNA, 22 bp, Homo sapiens
agatgcactatatgtttacaca

SEQ ID NO: 3355831 - DNA, 23 bp, Homo sapiens
agatgcacttaagttagcctcca

SEQ ID NO: 3355832 - DNA, 12 bp, Homo sapiens
agatgcagagag

SEQ ID NO: 3355833 - DNA, 13 bp, Homo sapiens
agatgcagagagc

SEQ ID NO: 3355834 - DNA, 20 bp, Homo sapiens
agatgcaggttggaaggggc

SEQ ID NO: 3355835 - DNA, 17 bp, Homo sapiens
agatgcatcgggaaaga

SEQ ID NO: 3355836 - DNA, 17 bp, Homo sapiens
agatgccagcccttcag

SEQ ID NO: 3355837 - DNA, 23 bp, Homo sapiens
agatgcctacaaccatccctgcc

SEQ ID NO: 3355838 - DNA, 22 bp, Homo sapiens
agatgcgagcgctatcttcaca

SEQ ID NO: 3355839 - DNA, 23 bp, Homo sapiens
agatgctactggacttgaatggt

SEQ ID NO: 3355840 - DNA, 15 bp, Homo sapiens
agatgctagaactcc

SEQ ID NO: 3355841 - DNA, 19 bp, Homo sapiens
agatgctagaactcccttt

SEQ ID NO: 3355842 - DNA, 21 bp, Homo sapiens
agatgctagaactccctttca

SEQ ID NO: 3355843 - DNA, 19 bp, Homo sapiens
agatgctccaagattctag

SEQ ID NO: 3355844 - DNA, 21 bp, Homo sapiens
agatgctccaagattctagat

SEQ ID NO: 3355845 - DNA, 15 bp, Homo sapiens
agatgctgactggca

SEQ ID NO: 3355846 - DNA, 16 bp, Homo sapiens
agatgctggagaagag

SEQ ID NO: 3355847 - DNA, 17 bp, Homo sapiens
agatgctggagaagaga

SEQ ID NO: 3355848 - DNA, 20 bp, Homo sapiens
agatgctggagaagagagga

SEQ ID NO: 3355849 - DNA, 22 bp, Homo sapiens
agatgctggagaagagaggaga

SEQ ID NO: 3355850 - DNA, 13 bp, Homo sapiens
agatgctgggttg

SEQ ID NO: 3355851 - DNA, 15 bp, Homo sapiens
agatgctggttttct

SEQ ID NO: 3355852 - DNA, 16 bp, Homo sapiens
agatgctgtagtaact

SEQ ID NO: 3355853 - DNA, 19 bp, Homo sapiens
agatgctgtagtaactgcc

SEQ ID NO: 3355854 - DNA, 12 bp, Homo sapiens
agatgcttctgg

SEQ ID NO: 3355855 - DNA, 15 bp, Homo sapiens
agatgcttctgggag

SEQ ID NO: 3355856 - DNA, 16 bp, Homo sapiens
agatggaaaaataaca

SEQ ID NO: 3355857 - DNA, 22 bp, Homo sapiens
agatggaaagaggtgaaaatga

SEQ ID NO: 3355858 - DNA, 13 bp, Homo sapiens
agatggaatgctg

SEQ ID NO: 3355859 - DNA, 23 bp, Homo sapiens
agatggacagttcacaccctgca

SEQ ID NO: 3355860 - DNA, 14 bp, Homo sapiens
agatggagcccata

SEQ ID NO: 3355861 - DNA, 22 bp, Homo sapiens
agatggagcccataggccaccc

SEQ ID NO: 3355862 - DNA, 22 bp, Homo sapiens
agatggagggcttggcccagcg

SEQ ID NO: 3355863 - DNA, 18 bp, Homo sapiens
agatggaggttctcagag

SEQ ID NO: 3355864 - DNA, 13 bp, Homo sapiens
agatggagtttct

SEQ ID NO: 3355865 - DNA, 15 bp, Homo sapiens
agatggatgtaaagt

SEQ ID NO: 3355866 - DNA, 15 bp, Homo sapiens
agatggattctcaga

SEQ ID NO: 3355867 - DNA, 22 bp, Homo sapiens
agatggcaagagggtgacagct

SEQ ID NO: 3355868 - DNA, 15 bp, Homo sapiens
agatggcccctccac

SEQ ID NO: 3355869 - DNA, 14 bp, Homo sapiens
agatggcctgaagc

SEQ ID NO: 3355870 - DNA, 15 bp, Homo sapiens
agatggcctttgctt

SEQ ID NO: 3355871 - DNA, 20 bp, Homo sapiens
agatggctgtgcctctgcct

SEQ ID NO: 3355872 - DNA, 22 bp, Homo sapiens
agatggctgtgcctctgcctgt

SEQ ID NO: 3355873 - DNA, 19 bp, Homo sapiens
agatgggaggaaagagagc

SEQ ID NO: 3355874 - DNA, 18 bp, Homo sapiens
agatgggccttttcttga

SEQ ID NO: 3355875 - DNA, 16 bp, Homo sapiens
agatgggcttgttttc

SEQ ID NO: 3355876 - DNA, 19 bp, Homo sapiens
agatgggcttgttttcttg

SEQ ID NO: 3355877 - DNA, 16 bp, Homo sapiens
agatgggggcaagaag

SEQ ID NO: 3355878 - DNA, 17 bp, Homo sapiens
agatgggggcaagaaga

SEQ ID NO: 3355879 - DNA, 20 bp, Homo sapiens
agatggtaatctacagctca

SEQ ID NO: 3355880 - DNA, 19 bp, Homo sapiens
agatggtatatttggtact

SEQ ID NO: 3355881 - DNA, 14 bp, Homo sapiens
agatggtggcagta

SEQ ID NO: 3355882 - DNA, 16 bp, Homo sapiens
agatggttacactgtt

SEQ ID NO: 3355883 - DNA, 17 bp, Homo sapiens
agatgtatccttccaat

SEQ ID NO: 3355884 - DNA, 20 bp, Homo sapiens
agatgtcagccgagccgggc

SEQ ID NO: 3355885 - DNA, 18 bp, Homo sapiens
agatgtcagcttcccagc

SEQ ID NO: 3355886 - DNA, 15 bp, Homo sapiens
agatgtcatcagagc

SEQ ID NO: 3355887 - DNA, 22 bp, Homo sapiens
agatgtccctttcttggccagt

SEQ ID NO: 3355888 - DNA, 21 bp, Homo sapiens
agatgtctatgtagctgaaaa

SEQ ID NO: 3355889 - DNA, 15 bp, Homo sapiens
agatgtctctggggc

SEQ ID NO: 3355890 - DNA, 17 bp, Homo sapiens
agatgtcttctgcctgt

SEQ ID NO: 3355891 - DNA, 13 bp, Homo sapiens
agatgtcttggaa

SEQ ID NO: 3355892 - DNA, 14 bp, Homo sapiens
agatgtcttggaac

SEQ ID NO: 3355893 - DNA, 18 bp, Homo sapiens
agatgtcttggaacattg

SEQ ID NO: 3355894 - DNA, 15 bp, Homo sapiens
agatgtctttaggca

SEQ ID NO: 3355895 - DNA, 17 bp, Homo sapiens
agatgtgaaaatatact

SEQ ID NO: 3355896 - DNA, 15 bp, Homo sapiens
agatgtgatattcta

SEQ ID NO: 3355897 - DNA, 16 bp, Homo sapiens
agcaggcacatggagg

SEQ ID NO: 3355898 - DNA, 19 bp, Homo sapiens
agcaggcacgggtggtccc

SEQ ID NO: 3355899 - DNA, 14 bp, Homo sapiens
agcaggccggaacc

SEQ ID NO: 3355900 - DNA, 19 bp, Homo sapiens
agcaggccggaaccacagg

SEQ ID NO: 3355901 - DNA, 20 bp, Homo sapiens
agcaggccggaaccacaggg

SEQ ID NO: 3355902 - DNA, 21 bp, Homo sapiens
agcaggcggtggggagagatg

SEQ ID NO: 3355903 - DNA, 14 bp, Homo sapiens
agcaggctggcagc

SEQ ID NO: 3355904 - DNA, 22 bp, Homo sapiens
agcaggctggcagctctccagt

SEQ ID NO: 3355905 - DNA, 24 bp, Homo sapiens
agcaggctggcagctctccagtca

SEQ ID NO: 3355906 - DNA, 14 bp, Homo sapiens
agcagggaaacagc

SEQ ID NO: 3355907 - DNA, 16 bp, Homo sapiens
agcagggaaagctcca

SEQ ID NO: 3355908 - DNA, 19 bp, Homo sapiens
agcagggaaagctccacgg

SEQ ID NO: 3355909 - DNA, 21 bp, Homo sapiens
agcagggaaagctccacggtg

SEQ ID NO: 3355910 - DNA, 16 bp, Homo sapiens
agcagggaaggcctga

SEQ ID NO: 3355911 - DNA, 16 bp, Homo sapiens
agcagggaatttctat

SEQ ID NO: 3355912 - DNA, 19 bp, Homo sapiens
agcagggattaacctctgc

SEQ ID NO: 3355913 - DNA, 14 bp, Homo sapiens
agcagggctcagcg

SEQ ID NO: 3355914 - DNA, 19 bp, Homo sapiens
agcaggggctacaagaggg

SEQ ID NO: 3355915 - DNA, 23 bp, Homo sapiens
agcagggggagaaacccttcaca

SEQ ID NO: 3355916 - DNA, 18 bp, Homo sapiens
agcaggggggctgtgcca

SEQ ID NO: 3355917 - DNA, 20 bp, Homo sapiens
agcaggggggctgtgccaac

SEQ ID NO: 3355918 - DNA, 21 bp, Homo sapiens
agcaggggtgtgatgtaccag

SEQ ID NO: 3355919 - DNA, 22 bp, Homo sapiens
agcagggtaccctttggggagc

SEQ ID NO: 3355920 - DNA, 16 bp, Homo sapiens
agcaggtgtcctttcc

SEQ ID NO: 3355921 - DNA, 14 bp, Homo sapiens
agcaggtgtggtgg

SEQ ID NO: 3355922 - DNA, 16 bp, Homo sapiens
agcaggtgtggtggct

SEQ ID NO: 3355923 - DNA, 18 bp, Homo sapiens
agcaggtgtggtggctca

SEQ ID NO: 3355924 - DNA, 19 bp, Homo sapiens
agcaggtgtggtggctcat

SEQ ID NO: 3355925 - DNA, 15 bp, Homo sapiens
agcaggttccccaag

SEQ ID NO: 3355926 - DNA, 14 bp, Homo sapiens
agcaggttctaggc

SEQ ID NO: 3355927 - DNA, 15 bp, Homo sapiens
agcaggttctaggct

SEQ ID NO: 3355928 - DNA, 20 bp, Homo sapiens
agcaggttgaggggctcctg

SEQ ID NO: 3355929 - DNA, 17 bp, Homo sapiens
agcaggtttttctcctc

SEQ ID NO: 3355930 - DNA, 15 bp, Homo sapiens
agcagtatatgttaa

SEQ ID NO: 3355931 - DNA, 15 bp, Homo sapiens
agcagtatattagta

SEQ ID NO: 3355932 - DNA, 16 bp, Homo sapiens
agcagtatattagtat

SEQ ID NO: 3355933 - DNA, 18 bp, Homo sapiens
agcagtcagggtgggaag

SEQ ID NO: 3355934 - DNA, 20 bp, Homo sapiens
agcagtcccagtattctcag

SEQ ID NO: 3355935 - DNA, 23 bp, Homo sapiens
agcagtcccagtattctcagagc

SEQ ID NO: 3355936 - DNA, 20 bp, Homo sapiens
agcagtcccattcatattaa

SEQ ID NO: 3355937 - DNA, 19 bp, Homo sapiens
agcagtcctgcctcagcct

SEQ ID NO: 3355938 - DNA, 19 bp, Homo sapiens
agcagtcgtgcctgtgtcc

SEQ ID NO: 3355939 - DNA, 19 bp, Homo sapiens
agcagtgcctcgaggcacc

SEQ ID NO: 3355940 - DNA, 16 bp, Homo sapiens
agcagtggctggtcca

SEQ ID NO: 3355941 - DNA, 17 bp, Homo sapiens
agcagtggctggtccag

SEQ ID NO: 3355942 - DNA, 15 bp, Homo sapiens
agcagtgtcatcaga

SEQ ID NO: 3355943 - DNA, 17 bp, Homo sapiens
agcagtgtcttccataa

SEQ ID NO: 3355944 - DNA, 22 bp, Homo sapiens
agcagtgtcttccataatgtat

SEQ ID NO: 3355945 - DNA, 21 bp, Homo sapiens
agcagtgttccccatctgggt

SEQ ID NO: 3355946 - DNA, 22 bp, Homo sapiens
agcagttactccctacactgat

SEQ ID NO: 3355947 - DNA, 14 bp, Homo sapiens
agcagttccggatt

SEQ ID NO: 3355948 - DNA, 15 bp, Homo sapiens
agcagttgacatcca

SEQ ID NO: 3355949 - DNA, 13 bp, Homo sapiens
agcagtttattat

SEQ ID NO: 3355950 - DNA, 17 bp, Homo sapiens
agcagttttcaagtcaa

SEQ ID NO: 3355951 - DNA, 16 bp, Homo sapiens
agcagttttcccctgg

SEQ ID NO: 3355952 - DNA, 20 bp, Homo sapiens
agcagttttcccctggcctc

SEQ ID NO: 3355953 - DNA, 21 bp, Homo sapiens
agcataaaaacattttaaaaa

SEQ ID NO: 3355954 - DNA, 19 bp, Homo sapiens
agcataaataaaactgaat

SEQ ID NO: 3355955 - DNA, 14 bp, Homo sapiens
agcataaatgcaaa

SEQ ID NO: 3355956 - DNA, 16 bp, Homo sapiens
agcataactgtagctc

SEQ ID NO: 3355957 - DNA, 24 bp, Homo sapiens
agcataaggccggacgcatctcaa

SEQ ID NO: 3355958 - DNA, 17 bp, Homo sapiens
agcataagtttctggga

SEQ ID NO: 3355959 - DNA, 15 bp, Homo sapiens
agcatacttctagga

SEQ ID NO: 3355960 - DNA, 17 bp, Homo sapiens
agcatactttgtaaata

SEQ ID NO: 3355961 - DNA, 22 bp, Homo sapiens
agcatagcagaggggccaggcc

SEQ ID NO: 3355962 - DNA, 23 bp, Homo sapiens
agcatagcagaggggccaggccc

SEQ ID NO: 3355963 - DNA, 15 bp, Homo sapiens
agcatatgtgttact

SEQ ID NO: 3355964 - DNA, 20 bp, Homo sapiens
agcatatgtgttacttcaag

SEQ ID NO: 3355965 - DNA, 21 bp, Homo sapiens
agcatattcttttctgcaaaa

SEQ ID NO: 3355966 - DNA, 16 bp, Homo sapiens
agcatattttgctggt

SEQ ID NO: 3355967 - DNA, 14 bp, Homo sapiens
agcatcacctcagg

SEQ ID NO: 3355968 - DNA, 19 bp, Homo sapiens
agcatcacctcaggccagg

SEQ ID NO: 3355969 - DNA, 20 bp, Homo sapiens
agcatcactccccaaggaag

SEQ ID NO: 3355970 - DNA, 20 bp, Homo sapiens
agcatccagttggcttttta

SEQ ID NO: 3355971 - DNA, 13 bp, Homo sapiens
agcatcccggagg

SEQ ID NO: 3355972 - DNA, 19 bp, Homo sapiens
agcatcccggaggaaatct

SEQ ID NO: 3355973 - DNA, 17 bp, Homo sapiens
agcatccctcagcctgt

SEQ ID NO: 3355974 - DNA, 21 bp, Homo sapiens
agcatccctggagcaggagcc

SEQ ID NO: 3355975 - DNA, 21 bp, Homo sapiens
agcatccgcaggtgctggtcc

SEQ ID NO: 3355976 - DNA, 13 bp, Homo sapiens
agcatcctccaca

SEQ ID NO: 3355977 - DNA, 20 bp, Homo sapiens
agcatcctccacatcctgtg

SEQ ID NO: 3355978 - DNA, 21 bp, Homo sapiens
agcatcctccacatcctgtgt

SEQ ID NO: 3355979 - DNA, 16 bp, Homo sapiens
agcatcctgagccccg

SEQ ID NO: 3355980 - DNA, 19 bp, Homo sapiens
agcatcctgagccccgccc

SEQ ID NO: 3355981 - DNA, 13 bp, Homo sapiens
agcatcctggcac

SEQ ID NO: 3355982 - DNA, 21 bp, Homo sapiens
agcatcgggagcacccagagc

SEQ ID NO: 3355983 - DNA, 22 bp, Homo sapiens
agcatctaagttataagactct

SEQ ID NO: 3355984 - DNA, 15 bp, Homo sapiens
agcatctatctcatc

SEQ ID NO: 3355985 - DNA, 17 bp, Homo sapiens
agcatctcccagcaaga

SEQ ID NO: 3355986 - DNA, 13 bp, Homo sapiens
agcatctgctaat

SEQ ID NO: 3355987 - DNA, 15 bp, Homo sapiens
agcatgaataaaaca

SEQ ID NO: 3355988 - DNA, 21 bp, Homo sapiens
agcatgacaacttttaaagaa

SEQ ID NO: 3355989 - DNA, 14 bp, Homo sapiens
agcatgatgggaaa

SEQ ID NO: 3355990 - DNA, 13 bp, Homo sapiens
agcatgcacaaag

SEQ ID NO: 3355991 - DNA, 19 bp, Homo sapiens
agcatgcacaaagtgtatt

SEQ ID NO: 3355992 - DNA, 20 bp, Homo sapiens
agcatgcagaggaggtgaga

SEQ ID NO: 3355993 - DNA, 16 bp, Homo sapiens
agcatgccccttggct

SEQ ID NO: 3355994 - DNA, 21 bp, Homo sapiens
agcatgctgctttttgtactt

SEQ ID NO: 3355995 - DNA, 16 bp, Homo sapiens
agcatgcttcccagag

SEQ ID NO: 3355996 - DNA, 17 bp, Homo sapiens
agcatgcttcccagagg

SEQ ID NO: 3355997 - DNA, 14 bp, Homo sapiens
agcatgcttgggct

SEQ ID NO: 3355998 - DNA, 15 bp, Homo sapiens
agcatgcttgggctg

SEQ ID NO: 3355999 - DNA, 16 bp, Homo sapiens
agcatgcttgggctga

SEQ ID NO: 3356000 - DNA, 17 bp, Homo sapiens
agcatgcttgggctgac

SEQ ID NO: 3356001 - DNA, 21 bp, Homo sapiens
agcatgcttgggctgacccag

SEQ ID NO: 3356002 - DNA, 18 bp, Homo sapiens
agcatgctttgctgctat

SEQ ID NO: 3356003 - DNA, 20 bp, Homo sapiens
agcatggaaaaatggttgat

SEQ ID NO: 3356004 - DNA, 11 bp, Homo sapiens
agcatggatgc

SEQ ID NO: 3356005 - DNA, 17 bp, Homo sapiens
agcatggatgcatttca

SEQ ID NO: 3356006 - DNA, 19 bp, Homo sapiens
agcatggcatagccccggc

SEQ ID NO: 3356007 - DNA, 16 bp, Homo sapiens
agcatgggtccaagag

SEQ ID NO: 3356008 - DNA, 19 bp, Homo sapiens
agcatggtgttttcattcc

SEQ ID NO: 3356009 - DNA, 20 bp, Homo sapiens
agcatggtgttttcattccc

SEQ ID NO: 3356010 - DNA, 19 bp, Homo sapiens
agcatgtctattcagcttc

SEQ ID NO: 3356011 - DNA, 14 bp, Homo sapiens
agcatgtgccaaga

SEQ ID NO: 3356012 - DNA, 18 bp, Homo sapiens
agcatgtggcatgttcat

SEQ ID NO: 3356013 - DNA, 19 bp, Homo sapiens
agcatgtgtatttccagtg

SEQ ID NO: 3356014 - DNA, 20 bp, Homo sapiens
agcatgttgagccaggcctg

SEQ ID NO: 3356015 - DNA, 17 bp, Homo sapiens
agcatgttgctgaggag

SEQ ID NO: 3356016 - DNA, 18 bp, Homo sapiens
agcatgttgctgaggagt

SEQ ID NO: 3356017 - DNA, 18 bp, Homo sapiens
agcatgtttcatgttttg

SEQ ID NO: 3356018 - DNA, 14 bp, Homo sapiens
agcatgtttgctga

SEQ ID NO: 3356019 - DNA, 15 bp, Homo sapiens
agcatgttttgtata

SEQ ID NO: 3356020 - DNA, 16 bp, Homo sapiens
agcatgttttgtatac

SEQ ID NO: 3356021 - DNA, 14 bp, Homo sapiens
agcattaactaatc

SEQ ID NO: 3356022 - DNA, 22 bp, Homo sapiens
agccagccacagacccctggga

SEQ ID NO: 3356023 - DNA, 15 bp, Homo sapiens
agccagccgccctgg

SEQ ID NO: 3356024 - DNA, 16 bp, Homo sapiens
agccagccgccctggg

SEQ ID NO: 3356025 - DNA, 22 bp, Homo sapiens
agccagccgccctgggctgtct

SEQ ID NO: 3356026 - DNA, 18 bp, Homo sapiens
agccagccggtgcctggc

SEQ ID NO: 3356027 - DNA, 11 bp, Homo sapiens
agccagcctga

SEQ ID NO: 3356028 - DNA, 20 bp, Homo sapiens
agccagcctgggactcccag

SEQ ID NO: 3356029 - DNA, 15 bp, Homo sapiens
agccagctcacagtg

SEQ ID NO: 3356030 - DNA, 21 bp, Homo sapiens
agccagctcacagtgctgtgt

SEQ ID NO: 3356031 - DNA, 23 bp, Homo sapiens
agccagctcacagtgctgtgtgc

SEQ ID NO: 3356032 - DNA, 19 bp, Homo sapiens
agccagctccctctattta

SEQ ID NO: 3356033 - DNA, 16 bp, Homo sapiens
agccagctctgcatta

SEQ ID NO: 3356034 - DNA, 20 bp, Homo sapiens
agccagctgcagctgggctg

SEQ ID NO: 3356035 - DNA, 16 bp, Homo sapiens
agccagctgccgacca

SEQ ID NO: 3356036 - DNA, 15 bp, Homo sapiens
agccagctgcttttt

SEQ ID NO: 3356037 - DNA, 13 bp, Homo sapiens
agccagctttccc

SEQ ID NO: 3356038 - DNA, 20 bp, Homo sapiens
agccaggaagtacttccacc

SEQ ID NO: 3356039 - DNA, 15 bp, Homo sapiens
agccaggatcatggt

SEQ ID NO: 3356040 - DNA, 23 bp, Homo sapiens
agccaggatcatggtgtaataag

SEQ ID NO: 3356041 - DNA, 19 bp, Homo sapiens
agccaggatgcccagatga

SEQ ID NO: 3356042 - DNA, 22 bp, Homo sapiens
agccaggcaacttcagtcctgg

SEQ ID NO: 3356043 - DNA, 14 bp, Homo sapiens
agccaggcgggctc

SEQ ID NO: 3356044 - DNA, 15 bp, Homo sapiens
agccaggctcaggcc

SEQ ID NO: 3356045 - DNA, 21 bp, Homo sapiens
agccaggctgctaacctggaa

SEQ ID NO: 3356046 - DNA, 22 bp, Homo sapiens
agccagggggactagcccctgt

SEQ ID NO: 3356047 - DNA, 22 bp, Homo sapiens
agccagggtctctccctcaggt

SEQ ID NO: 3356048 - DNA, 19 bp, Homo sapiens
agccaggtacaggagaggc

SEQ ID NO: 3356049 - DNA, 20 bp, Homo sapiens
agccaggtacaggagaggca

SEQ ID NO: 3356050 - DNA, 14 bp, Homo sapiens
agccagtaacttat

SEQ ID NO: 3356051 - DNA, 16 bp, Homo sapiens
agccagtgaaacactt

SEQ ID NO: 3356052 - DNA, 13 bp, Homo sapiens
agccagtgaagga

SEQ ID NO: 3356053 - DNA, 12 bp, Homo sapiens
agccagtgactt

SEQ ID NO: 3356054 - DNA, 14 bp, Homo sapiens
agccagtgactttt

SEQ ID NO: 3356055 - DNA, 16 bp, Homo sapiens
agccagtgagggcagt

SEQ ID NO: 3356056 - DNA, 14 bp, Homo sapiens
agccagtgccattc

SEQ ID NO: 3356057 - DNA, 19 bp, Homo sapiens
agccagttggtggggccag

SEQ ID NO: 3356058 - DNA, 20 bp, Homo sapiens
agccagttggtggggccagg

SEQ ID NO: 3356059 - DNA, 17 bp, Homo sapiens
agccagttgtcctatgg

SEQ ID NO: 3356060 - DNA, 21 bp, Homo sapiens
agccagtttgccggatacaaa

SEQ ID NO: 3356061 - DNA, 16 bp, Homo sapiens
agccagttttcatttt

SEQ ID NO: 3356062 - DNA, 12 bp, Homo sapiens
agccataataat

SEQ ID NO: 3356063 - DNA, 14 bp, Homo sapiens
agccataataataa

SEQ ID NO: 3356064 - DNA, 12 bp, Homo sapiens
agccataatttt

SEQ ID NO: 3356065 - DNA, 21 bp, Homo sapiens
agccatataagtttgaaggaa

SEQ ID NO: 3356066 - DNA, 16 bp, Homo sapiens
agccatcaaaatgctt

SEQ ID NO: 3356067 - DNA, 20 bp, Homo sapiens
agccatccctttttttacat

SEQ ID NO: 3356068 - DNA, 21 bp, Homo sapiens
agccatccctttttttacatt

SEQ ID NO: 3356069 - DNA, 16 bp, Homo sapiens
agccatcgtcctggga

SEQ ID NO: 3356070 - DNA, 19 bp, Homo sapiens
agccatcgtcctgggactc

SEQ ID NO: 3356071 - DNA, 22 bp, Homo sapiens
agccatcgtcctgggactcgga

SEQ ID NO: 3356072 - DNA, 23 bp, Homo sapiens
agccatctaatgcttgtttatga

SEQ ID NO: 3356073 - DNA, 18 bp, Homo sapiens
agccatctgcccaggggt

SEQ ID NO: 3356074 - DNA, 18 bp, Homo sapiens
agccatgataactgcaat

SEQ ID NO: 3356075 - DNA, 19 bp, Homo sapiens
agccatgatttgtcccagc

SEQ ID NO: 3356076 - DNA, 14 bp, Homo sapiens
agccatgcccagga

SEQ ID NO: 3356077 - DNA, 16 bp, Homo sapiens
agccatgcgccccctc

SEQ ID NO: 3356078 - DNA, 23 bp, Homo sapiens
agccatgcgccccctccgccctg

SEQ ID NO: 3356079 - DNA, 12 bp, Homo sapiens
agccatggctca

SEQ ID NO: 3356080 - DNA, 20 bp, Homo sapiens
agccatggctcaggcaagcc

SEQ ID NO: 3356081 - DNA, 21 bp, Homo sapiens
agccatggctcaggcaagccc

SEQ ID NO: 3356082 - DNA, 14 bp, Homo sapiens
agccatgggcctgg

SEQ ID NO: 3356083 - DNA, 15 bp, Homo sapiens
agccatgggcctggg

SEQ ID NO: 3356084 - DNA, 17 bp, Homo sapiens
agccatgggcctgggcc

SEQ ID NO: 3356085 - DNA, 22 bp, Homo sapiens
agccatgtataaccaagtgtgc

SEQ ID NO: 3356086 - DNA, 21 bp, Homo sapiens
agccatgtccaagttcttcac

SEQ ID NO: 3356087 - DNA, 14 bp, Homo sapiens
agccattaaatgaa

SEQ ID NO: 3356088 - DNA, 20 bp, Homo sapiens
agccattcctggtacccagc

SEQ ID NO: 3356089 - DNA, 19 bp, Homo sapiens
agccattgcggccccagga

SEQ ID NO: 3356090 - DNA, 15 bp, Homo sapiens
agccattttgtgaat

SEQ ID NO: 3356091 - DNA, 16 bp, Homo sapiens
agccattttgtgaatg

SEQ ID NO: 3356092 - DNA, 15 bp, Homo sapiens
agcccaaaacccagg

SEQ ID NO: 3356093 - DNA, 20 bp, Homo sapiens
agcccaaaggggacaggcct

SEQ ID NO: 3356094 - DNA, 19 bp, Homo sapiens
agcccaagaggtctgagcc

SEQ ID NO: 3356095 - DNA, 20 bp, Homo sapiens
agcccaagttatctttccct

SEQ ID NO: 3356096 - DNA, 16 bp, Homo sapiens
agcccaatattataat

SEQ ID NO: 3356097 - DNA, 20 bp, Homo sapiens
agcccaatattataattttt

SEQ ID NO: 3356098 - DNA, 16 bp, Homo sapiens
agcccacaaagcctta

SEQ ID NO: 3356099 - DNA, 21 bp, Homo sapiens
agcccacactatgcacagagc

SEQ ID NO: 3356100 - DNA, 16 bp, Homo sapiens
agcccaccctgctgcc

SEQ ID NO: 3356101 - DNA, 12 bp, Homo sapiens
agcccacctgca

SEQ ID NO: 3356102 - DNA, 13 bp, Homo sapiens
agcccacctgcac

SEQ ID NO: 3356103 - DNA, 17 bp, Homo sapiens
agcccacctgcacccag

SEQ ID NO: 3356104 - DNA, 14 bp, Homo sapiens
agcccacttctgcc

SEQ ID NO: 3356105 - DNA, 22 bp, Homo sapiens
agcccacttctgccatattctg

SEQ ID NO: 3356106 - DNA, 19 bp, Homo sapiens
agcccagaacaaaaagaaa

SEQ ID NO: 3356107 - DNA, 15 bp, Homo sapiens
agcccagactttagt

SEQ ID NO: 3356108 - DNA, 21 bp, Homo sapiens
agcccagactttagtgccctg

SEQ ID NO: 3356109 - DNA, 11 bp, Homo sapiens
agcccagagaa

SEQ ID NO: 3356110 - DNA, 15 bp, Homo sapiens
agcccagagccacct

SEQ ID NO: 3356111 - DNA, 16 bp, Homo sapiens
agcccagagccacctg

SEQ ID NO: 3356112 - DNA, 17 bp, Homo sapiens
agcccagagcctggctg

SEQ ID NO: 3356113 - DNA, 20 bp, Homo sapiens
agcccagaggtaacagaaca

SEQ ID NO: 3356114 - DNA, 14 bp, Homo sapiens
agcccagccaggcc

SEQ ID NO: 3356115 - DNA, 21 bp, Homo sapiens
agcccagccattaccatggag

SEQ ID NO: 3356116 - DNA, 15 bp, Homo sapiens
agcccagccctgttc

SEQ ID NO: 3356117 - DNA, 17 bp, Homo sapiens
agcccagccctgttctg

SEQ ID NO: 3356118 - DNA, 14 bp, Homo sapiens
agcccagcctggga

SEQ ID NO: 3356119 - DNA, 16 bp, Homo sapiens
agcccagcctgggagc

SEQ ID NO: 3356120 - DNA, 14 bp, Homo sapiens
agcccagctgcctg

SEQ ID NO: 3356121 - DNA, 17 bp, Homo sapiens
agcccagctgcctggag

SEQ ID NO: 3356122 - DNA, 23 bp, Homo sapiens
agcccagcttggccctttccttc

SEQ ID NO: 3356123 - DNA, 16 bp, Homo sapiens
agcccaggagagagaa

SEQ ID NO: 3356124 - DNA, 18 bp, Homo sapiens
agcccaggagagagaaag

SEQ ID NO: 3356125 - DNA, 19 bp, Homo sapiens
agcccaggcatctccttgg

SEQ ID NO: 3356126 - DNA, 14 bp, Homo sapiens
agcccagggcctgc

SEQ ID NO: 3356127 - DNA, 15 bp, Homo sapiens
agcccagggcctgca

SEQ ID NO: 3356128 - DNA, 14 bp, Homo sapiens
agcccagggctcct

SEQ ID NO: 3356129 - DNA, 16 bp, Homo sapiens
agcccagtgctgctgt

SEQ ID NO: 3356130 - DNA, 15 bp, Homo sapiens
agcccatactcagcc

SEQ ID NO: 3356131 - DNA, 24 bp, Homo sapiens
agcccataggccaccccctatcct

SEQ ID NO: 3356132 - DNA, 19 bp, Homo sapiens
agcccatccatagtaactg

SEQ ID NO: 3356133 - DNA, 23 bp, Homo sapiens
agcccatccattaggccagcaac

SEQ ID NO: 3356134 - DNA, 13 bp, Homo sapiens
agcccatccctgc

SEQ ID NO: 3356135 - DNA, 18 bp, Homo sapiens
agcccatccttccctttg

SEQ ID NO: 3356136 - DNA, 11 bp, Homo sapiens
agcccatgccc

SEQ ID NO: 3356137 - DNA, 15 bp, Homo sapiens
agcccatggccccca

SEQ ID NO: 3356138 - DNA, 20 bp, Homo sapiens
agcccatggcccccaataaa

SEQ ID NO: 3356139 - DNA, 22 bp, Homo sapiens
agcccatggcccccaataaagg

SEQ ID NO: 3356140 - DNA, 23 bp, Homo sapiens
agcccatggcccccaataaaggc

SEQ ID NO: 3356141 - DNA, 13 bp, Homo sapiens
agcccatttcaat

SEQ ID NO: 3356142 - DNA, 20 bp, Homo sapiens
agccccaacgggaaaggaaa

SEQ ID NO: 3356143 - DNA, 19 bp, Homo sapiens
agccccaagtcctgaagag

SEQ ID NO: 3356144 - DNA, 14 bp, Homo sapiens
agccccacacagct

SEQ ID NO: 3356145 - DNA, 15 bp, Homo sapiens
agccccacacggagg

SEQ ID NO: 3356146 - DNA, 12 bp, Homo sapiens
agccccacccag

SEQ ID NO: 3356147 - DNA, 13 bp, Homo sapiens
agccccacccagg

SEQ ID NO: 3356148 - DNA, 18 bp, Homo sapiens
aggcaggagaatggtgtg

SEQ ID NO: 3356149 - DNA, 14 bp, Homo sapiens
aggcaggcattgag

SEQ ID NO: 3356150 - DNA, 15 bp, Homo sapiens
aggcaggccagatgg

SEQ ID NO: 3356151 - DNA, 14 bp, Homo sapiens
aggcaggctttctg

SEQ ID NO: 3356152 - DNA, 22 bp, Homo sapiens
aggcagggaaaggctctgaaag

SEQ ID NO: 3356153 - DNA, 16 bp, Homo sapiens
aggcagggcaaatgac

SEQ ID NO: 3356154 - DNA, 18 bp, Homo sapiens
aggcagggcaaatgacat

SEQ ID NO: 3356155 - DNA, 24 bp, Homo sapiens
aggcagggcaaatgacatgcactg

SEQ ID NO: 3356156 - DNA, 15 bp, Homo sapiens
aggcagggcagaggg

SEQ ID NO: 3356157 - DNA, 12 bp, Homo sapiens
aggcagggccct

SEQ ID NO: 3356158 - DNA, 15 bp, Homo sapiens
aggcaggggtggggg

SEQ ID NO: 3356159 - DNA, 20 bp, Homo sapiens
aggcaggggtgggggtggag

SEQ ID NO: 3356160 - DNA, 22 bp, Homo sapiens
aggcaggggtgggggtggaggc

SEQ ID NO: 3356161 - DNA, 19 bp, Homo sapiens
aggcagggtctcactctgt

SEQ ID NO: 3356162 - DNA, 20 bp, Homo sapiens
aggcagggtctcactctgtc

SEQ ID NO: 3356163 - DNA, 14 bp, Homo sapiens
aggcaggtagccag

SEQ ID NO: 3356164 - DNA, 16 bp, Homo sapiens
aggcaggtagccaggg

SEQ ID NO: 3356165 - DNA, 14 bp, Homo sapiens
aggcaggtccaggg

SEQ ID NO: 3356166 - DNA, 20 bp, Homo sapiens
aggcaggtgcctccaggtgt

SEQ ID NO: 3356167 - DNA, 13 bp, Homo sapiens
aggcaggtgcctg

SEQ ID NO: 3356168 - DNA, 15 bp, Homo sapiens
aggcaggtgggcaga

SEQ ID NO: 3356169 - DNA, 17 bp, Homo sapiens
aggcagtagatgtgctt

SEQ ID NO: 3356170 - DNA, 23 bp, Homo sapiens
aggcagtcgggggctggcctagg

SEQ ID NO: 3356171 - DNA, 16 bp, Homo sapiens
aggcagtctgaaccct

SEQ ID NO: 3356172 - DNA, 15 bp, Homo sapiens
aggcagtgcatgtga

SEQ ID NO: 3356173 - DNA, 19 bp, Homo sapiens
aggcagtgcatgtgaagca

SEQ ID NO: 3356174 - DNA, 22 bp, Homo sapiens
aggcagtgcatgtgaagcatgc

SEQ ID NO: 3356175 - DNA, 17 bp, Homo sapiens
aggcagtggcaggggag

SEQ ID NO: 3356176 - DNA, 13 bp, Homo sapiens
aggcagttttcta

SEQ ID NO: 3356177 - DNA, 22 bp, Homo sapiens
aggcatagaggcttctccgcca

SEQ ID NO: 3356178 - DNA, 18 bp, Homo sapiens
aggcataggcctgggtgc

SEQ ID NO: 3356179 - DNA, 19 bp, Homo sapiens
aggcatcagtccctatgta

SEQ ID NO: 3356180 - DNA, 13 bp, Homo sapiens
aggcatcccaggg

SEQ ID NO: 3356181 - DNA, 23 bp, Homo sapiens
aggcatcccaggggaccacacct

SEQ ID NO: 3356182 - DNA, 13 bp, Homo sapiens
aggcatcctgcct

SEQ ID NO: 3356183 - DNA, 14 bp, Homo sapiens
aggcatcctgcctg

SEQ ID NO: 3356184 - DNA, 16 bp, Homo sapiens
aggcatcctgcctggg

SEQ ID NO: 3356185 - DNA, 13 bp, Homo sapiens
aggcatctccctt

SEQ ID NO: 3356186 - DNA, 21 bp, Homo sapiens
aggcatctctgtactttgctt

SEQ ID NO: 3356187 - DNA, 23 bp, Homo sapiens
aggcatgagccactgagcctggc

SEQ ID NO: 3356188 - DNA, 17 bp, Homo sapiens
aggcatgcctctgatat

SEQ ID NO: 3356189 - DNA, 18 bp, Homo sapiens
aggcatgcctctgatatg

SEQ ID NO: 3356190 - DNA, 23 bp, Homo sapiens
aggcatgcctctgatatgggact

SEQ ID NO: 3356191 - DNA, 19 bp, Homo sapiens
aggcatgcttctcaccgtg

SEQ ID NO: 3356192 - DNA, 14 bp, Homo sapiens
aggcatggccctgg

SEQ ID NO: 3356193 - DNA, 21 bp, Homo sapiens
aggcatggctcagatcggcca

SEQ ID NO: 3356194 - DNA, 21 bp, Homo sapiens
aggcatgggtgcaaggaaaat

SEQ ID NO: 3356195 - DNA, 21 bp, Homo sapiens
aggcatggtcccttaaggcac

SEQ ID NO: 3356196 - DNA, 23 bp, Homo sapiens
aggcatggtcccttaaggcacag

SEQ ID NO: 3356197 - DNA, 17 bp, Homo sapiens
aggcatgtaggaccctg

SEQ ID NO: 3356198 - DNA, 19 bp, Homo sapiens
aggcattaatgtttctatc

SEQ ID NO: 3356199 - DNA, 20 bp, Homo sapiens
aggcattacttgctttcaat

SEQ ID NO: 3356200 - DNA, 22 bp, Homo sapiens
aggcattacttgctttcaattg

SEQ ID NO: 3356201 - DNA, 17 bp, Homo sapiens
aggcattcggggaagct

SEQ ID NO: 3356202 - DNA, 20 bp, Homo sapiens
aggcatttaggccatgggac

SEQ ID NO: 3356203 - DNA, 12 bp, Homo sapiens
aggcatttccta

SEQ ID NO: 3356204 - DNA, 20 bp, Homo sapiens
aggcatttctatcacatatt

SEQ ID NO: 3356205 - DNA, 18 bp, Homo sapiens
aggcatttgcagggtcct

SEQ ID NO: 3356206 - DNA, 12 bp, Homo sapiens
aggccaaactgc

SEQ ID NO: 3356207 - DNA, 16 bp, Homo sapiens
aggccaaaggctggtg

SEQ ID NO: 3356208 - DNA, 17 bp, Homo sapiens
aggccaaatgcacaagc

SEQ ID NO: 3356209 - DNA, 14 bp, Homo sapiens
aggccaacagcacc

SEQ ID NO: 3356210 - DNA, 18 bp, Homo sapiens
aggccaagagcagaggca

SEQ ID NO: 3356211 - DNA, 14 bp, Homo sapiens
aggccaaggcaggt

SEQ ID NO: 3356212 - DNA, 23 bp, Homo sapiens
aggccaagtccgcagaagccctg

SEQ ID NO: 3356213 - DNA, 23 bp, Homo sapiens
aggccaataaaaagttcagagtt

SEQ ID NO: 3356214 - DNA, 22 bp, Homo sapiens
aggccacaccatctcctttcag

SEQ ID NO: 3356215 - DNA, 11 bp, Homo sapiens
aggccacagcc

SEQ ID NO: 3356216 - DNA, 15 bp, Homo sapiens
aggccacagccgcct

SEQ ID NO: 3356217 - DNA, 18 bp, Homo sapiens
aggccacatacctctctg

SEQ ID NO: 3356218 - DNA, 21 bp, Homo sapiens
aggccacatacctctctgaga

SEQ ID NO: 3356219 - DNA, 23 bp, Homo sapiens
aggccaccccctatcctctgagt

SEQ ID NO: 3356220 - DNA, 13 bp, Homo sapiens
aggccacctctcc

SEQ ID NO: 3356221 - DNA, 16 bp, Homo sapiens
aggccacctctccaag

SEQ ID NO: 3356222 - DNA, 18 bp, Homo sapiens
aggccacctctccaaggg

SEQ ID NO: 3356223 - DNA, 20 bp, Homo sapiens
aggccactgtggccagagct

SEQ ID NO: 3356224 - DNA, 23 bp, Homo sapiens
aggccactgtggccagagctgga

SEQ ID NO: 3356225 - DNA, 18 bp, Homo sapiens
aggccagaggcccccagc

SEQ ID NO: 3356226 - DNA, 14 bp, Homo sapiens
aggccagagggagt

SEQ ID NO: 3356227 - DNA, 19 bp, Homo sapiens
aggccagagtggcctggcc

SEQ ID NO: 3356228 - DNA, 12 bp, Homo sapiens
aggccagcaacg

SEQ ID NO: 3356229 - DNA, 19 bp, Homo sapiens
aggccagcccagccaggcc

SEQ ID NO: 3356230 - DNA, 10 bp, Homo sapiens
aggccagcct

SEQ ID NO: 3356231 - DNA, 23 bp, Homo sapiens
aggccagcctccgagagggagag

SEQ ID NO: 3356232 - DNA, 19 bp, Homo sapiens
aggccagctgccccagcca

SEQ ID NO: 3356233 - DNA, 15 bp, Homo sapiens
aggccaggaccacac

SEQ ID NO: 3356234 - DNA, 16 bp, Homo sapiens
aggccaggaccacaca

SEQ ID NO: 3356235 - DNA, 18 bp, Homo sapiens
aggccaggaccacacagt

SEQ ID NO: 3356236 - DNA, 17 bp, Homo sapiens
aggccaggacgtctggg

SEQ ID NO: 3356237 - DNA, 16 bp, Homo sapiens
aggccagtggaagaaa

SEQ ID NO: 3356238 - DNA, 16 bp, Homo sapiens
aggccatctcaggaga

SEQ ID NO: 3356239 - DNA, 18 bp, Homo sapiens
aggccatctcaggagatg

SEQ ID NO: 3356240 - DNA, 19 bp, Homo sapiens
aggccatctcaggagatgg

SEQ ID NO: 3356241 - DNA, 13 bp, Homo sapiens
aggccatgaaaaa

SEQ ID NO: 3356242 - DNA, 16 bp, Homo sapiens
aggccatgatggcctt

SEQ ID NO: 3356243 - DNA, 14 bp, Homo sapiens
aggccatgggcctc

SEQ ID NO: 3356244 - DNA, 21 bp, Homo sapiens
aggcccaagagcagagtctgg

SEQ ID NO: 3356245 - DNA, 17 bp, Homo sapiens
aggcccaaggtcccctc

SEQ ID NO: 3356246 - DNA, 20 bp, Homo sapiens
aggcccaaggtcccctccac

SEQ ID NO: 3356247 - DNA, 10 bp, Homo sapiens
aggcccacca

SEQ ID NO: 3356248 - DNA, 12 bp, Homo sapiens
aggcccagaagg

SEQ ID NO: 3356249 - DNA, 17 bp, Homo sapiens
aggcccagaagggtagc

SEQ ID NO: 3356250 - DNA, 18 bp, Homo sapiens
aggcccagcattgctggt

SEQ ID NO: 3356251 - DNA, 19 bp, Homo sapiens
aggcccagcattgctggtt

SEQ ID NO: 3356252 - DNA, 21 bp, Homo sapiens
aggcccagcattgctggttct

SEQ ID NO: 3356253 - DNA, 15 bp, Homo sapiens
aggcccagcccctag

SEQ ID NO: 3356254 - DNA, 17 bp, Homo sapiens
aggcccagcgcggccag

SEQ ID NO: 3356255 - DNA, 19 bp, Homo sapiens
aggcccagcgggcagatgg

SEQ ID NO: 3356256 - DNA, 21 bp, Homo sapiens
aggcccaggatatttctgaga

SEQ ID NO: 3356257 - DNA, 17 bp, Homo sapiens
aggcccaggctgggaac

SEQ ID NO: 3356258 - DNA, 22 bp, Homo sapiens
aggcccagggagggaagtgtga

SEQ ID NO: 3356259 - DNA, 12 bp, Homo sapiens
aggcccatctca

SEQ ID NO: 3356260 - DNA, 19 bp, Homo sapiens
aggcccatctcaggtgcca

SEQ ID NO: 3356261 - DNA, 21 bp, Homo sapiens
aggccccaaaggaaaaagcac

SEQ ID NO: 3356262 - DNA, 14 bp, Homo sapiens
aggccccactgatg

SEQ ID NO: 3356263 - DNA, 21 bp, Homo sapiens
aggccccactgatgctgttct

SEQ ID NO: 3356264 - DNA, 18 bp, Homo sapiens
aggccccagaggccctgg

SEQ ID NO: 3356265 - DNA, 20 bp, Homo sapiens
aggccccagaggccctggag

SEQ ID NO: 3356266 - DNA, 14 bp, Homo sapiens
aggccccagctctg

SEQ ID NO: 3356267 - DNA, 18 bp, Homo sapiens
aggcccccacttgcctct

SEQ ID NO: 3356268 - DNA, 23 bp, Homo sapiens
aggcccccagcccagggctcctg

SEQ ID NO: 3356269 - DNA, 16 bp, Homo sapiens
aggccccctgcatcta

SEQ ID NO: 3356270 - DNA, 13 bp, Homo sapiens
aggcccctgagga

SEQ ID NO: 3356271 - DNA, 17 bp, Homo sapiens
aggcccctgaggactgg

SEQ ID NO: 3356272 - DNA, 18 bp, Homo sapiens
aggcccctgccaccctgg

SEQ ID NO: 3356273 - DNA, 19 bp, Homo sapiens
agggctcagcggggacagc

SEQ ID NO: 3356274 - DNA, 20 bp, Homo sapiens
agggctcagcggggacagct

SEQ ID NO: 3356275 - DNA, 13 bp, Homo sapiens
agggctcaggatt

SEQ ID NO: 3356276 - DNA, 24 bp, Homo sapiens
agggctcaggatttcgtgggtctg

SEQ ID NO: 3356277 - DNA, 15 bp, Homo sapiens
agggctccagcatcc

SEQ ID NO: 3356278 - DNA, 18 bp, Homo sapiens
agggctccagcatccagc

SEQ ID NO: 3356279 - DNA, 21 bp, Homo sapiens
agggctccagcatccagcctg

SEQ ID NO: 3356280 - DNA, 22 bp, Homo sapiens
agggctcccaggggtctccctg

SEQ ID NO: 3356281 - DNA, 15 bp, Homo sapiens
agggctcctcccagc

SEQ ID NO: 3356282 - DNA, 11 bp, Homo sapiens
agggctcctgc

SEQ ID NO: 3356283 - DNA, 12 bp, Homo sapiens
agggctcctgcc

SEQ ID NO: 3356284 - DNA, 18 bp, Homo sapiens
agggctcgaggggtgggc

SEQ ID NO: 3356285 - DNA, 16 bp, Homo sapiens
agggctctgccccagt

SEQ ID NO: 3356286 - DNA, 16 bp, Homo sapiens
agggctgacctgcctc

SEQ ID NO: 3356287 - DNA, 19 bp, Homo sapiens
agggctgatggaggaaaaa

SEQ ID NO: 3356288 - DNA, 13 bp, Homo sapiens
agggctgccctga

SEQ ID NO: 3356289 - DNA, 15 bp, Homo sapiens
agggctgccctgaga

SEQ ID NO: 3356290 - DNA, 16 bp, Homo sapiens
agggctgccctgagaa

SEQ ID NO: 3356291 - DNA, 19 bp, Homo sapiens
agggctggaggcccaggct

SEQ ID NO: 3356292 - DNA, 19 bp, Homo sapiens
agggctggagtgcgctctt

SEQ ID NO: 3356293 - DNA, 18 bp, Homo sapiens
agggctggccccagggca

SEQ ID NO: 3356294 - DNA, 22 bp, Homo sapiens
agggctggccccagggcaccct

SEQ ID NO: 3356295 - DNA, 12 bp, Homo sapiens
agggctggctct

SEQ ID NO: 3356296 - DNA, 13 bp, Homo sapiens
agggctggctctg

SEQ ID NO: 3356297 - DNA, 20 bp, Homo sapiens
agggctggctggcctcaccc

SEQ ID NO: 3356298 - DNA, 15 bp, Homo sapiens
aggggaaaactgtta

SEQ ID NO: 3356299 - DNA, 21 bp, Homo sapiens
aggggaaaccagtgtagcctt

SEQ ID NO: 3356300 - DNA, 23 bp, Homo sapiens
aggggaaaccagtgtagccttgc

SEQ ID NO: 3356301 - DNA, 17 bp, Homo sapiens
aggggaaagacttccat

SEQ ID NO: 3356302 - DNA, 20 bp, Homo sapiens
aggggaaagacttccatcta

SEQ ID NO: 3356303 - DNA, 13 bp, Homo sapiens
aggggaatgtttg

SEQ ID NO: 3356304 - DNA, 22 bp, Homo sapiens
aggggacaagggatttgaggtg

SEQ ID NO: 3356305 - DNA, 18 bp, Homo sapiens
aggggacaggcctcacct

SEQ ID NO: 3356306 - DNA, 19 bp, Homo sapiens
aggggacaggcctcacctc

SEQ ID NO: 3356307 - DNA, 14 bp, Homo sapiens
aggggacatcgcca

SEQ ID NO: 3356308 - DNA, 21 bp, Homo sapiens
aggggacattttctggattct

SEQ ID NO: 3356309 - DNA, 22 bp, Homo sapiens
aggggactcagccctgaggtga

SEQ ID NO: 3356310 - DNA, 20 bp, Homo sapiens
aggggactgggggactggga

SEQ ID NO: 3356311 - DNA, 15 bp, Homo sapiens
aggggagaaactgaa

SEQ ID NO: 3356312 - DNA, 16 bp, Homo sapiens
aggggagacaggagcc

SEQ ID NO: 3356313 - DNA, 15 bp, Homo sapiens
aggggaggaaaaaag

SEQ ID NO: 3356314 - DNA, 20 bp, Homo sapiens
aggggaggaaaaaagaacca

SEQ ID NO: 3356315 - DNA, 16 bp, Homo sapiens
aggggagttgtgtctg

SEQ ID NO: 3356316 - DNA, 13 bp, Homo sapiens
aggggatatttaa

SEQ ID NO: 3356317 - DNA, 14 bp, Homo sapiens
aggggatatttaag

SEQ ID NO: 3356318 - DNA, 21 bp, Homo sapiens
aggggatatttaaggtagctt

SEQ ID NO: 3356319 - DNA, 15 bp, Homo sapiens
aggggatccagccac

SEQ ID NO: 3356320 - DNA, 19 bp, Homo sapiens
aggggatgaggggcttcct

SEQ ID NO: 3356321 - DNA, 15 bp, Homo sapiens
aggggatgggtgtgg

SEQ ID NO: 3356322 - DNA, 16 bp, Homo sapiens
aggggatgggtgtgga

SEQ ID NO: 3356323 - DNA, 19 bp, Homo sapiens
aggggcaggagaggctggg

SEQ ID NO: 3356324 - DNA, 12 bp, Homo sapiens
aggggcaggcct

SEQ ID NO: 3356325 - DNA, 18 bp, Homo sapiens
aggggcaggcctgggacc

SEQ ID NO: 3356326 - DNA, 16 bp, Homo sapiens
aggggcagggaaggac

SEQ ID NO: 3356327 - DNA, 14 bp, Homo sapiens
aggggcatctgccc

SEQ ID NO: 3356328 - DNA, 21 bp, Homo sapiens
aggggcatctgcccctccccc

SEQ ID NO: 3356329 - DNA, 13 bp, Homo sapiens
aggggccacctcc

SEQ ID NO: 3356330 - DNA, 14 bp, Homo sapiens
aggggccacctcct

SEQ ID NO: 3356331 - DNA, 21 bp, Homo sapiens
aggggccacctcctccccctg

SEQ ID NO: 3356332 - DNA, 13 bp, Homo sapiens
aggggccaggccc

SEQ ID NO: 3356333 - DNA, 18 bp, Homo sapiens
aggggcccaagccccatc

SEQ ID NO: 3356334 - DNA, 20 bp, Homo sapiens
aggggcccaagccccatctc

SEQ ID NO: 3356335 - DNA, 17 bp, Homo sapiens
aggggccccggggctgg

SEQ ID NO: 3356336 - DNA, 20 bp, Homo sapiens
aggggcccctgcttctccag

SEQ ID NO: 3356337 - DNA, 22 bp, Homo sapiens
aggggcccggtggcggcagggc

SEQ ID NO: 3356338 - DNA, 12 bp, Homo sapiens
aggggccctggt

SEQ ID NO: 3356339 - DNA, 19 bp, Homo sapiens
aggggcccttgggacagcc

SEQ ID NO: 3356340 - DNA, 21 bp, Homo sapiens
aggggcccttgggacagccag

SEQ ID NO: 3356341 - DNA, 23 bp, Homo sapiens
aggggcccttgggacagccagag

SEQ ID NO: 3356342 - DNA, 12 bp, Homo sapiens
aggggcctgcag

SEQ ID NO: 3356343 - DNA, 15 bp, Homo sapiens
aggggcctgcagaag

SEQ ID NO: 3356344 - DNA, 16 bp, Homo sapiens
aggggcctgcagaagg

SEQ ID NO: 3356345 - DNA, 14 bp, Homo sapiens
aggggcctggagat

SEQ ID NO: 3356346 - DNA, 15 bp, Homo sapiens
aggggcctggcagcc

SEQ ID NO: 3356347 - DNA, 23 bp, Homo sapiens
aggggcctggcagccgtgccttc

SEQ ID NO: 3356348 - DNA, 14 bp, Homo sapiens
aggggcgcccacct

SEQ ID NO: 3356349 - DNA, 16 bp, Homo sapiens
aggggcgcccacctcc

SEQ ID NO: 3356350 - DNA, 16 bp, Homo sapiens
aggggcgcgggagggg

SEQ ID NO: 3356351 - DNA, 15 bp, Homo sapiens
aggggcgctggccca

SEQ ID NO: 3356352 - DNA, 21 bp, Homo sapiens
aggggcgctggcccagccggc

SEQ ID NO: 3356353 - DNA, 22 bp, Homo sapiens
aggggcgctggcccagccggcc

SEQ ID NO: 3356354 - DNA, 14 bp, Homo sapiens
aggggcggcaggag

SEQ ID NO: 3356355 - DNA, 17 bp, Homo sapiens
aggggcggcaggaggga

SEQ ID NO: 3356356 - DNA, 18 bp, Homo sapiens
aggggcggcaggagggag

SEQ ID NO: 3356357 - DNA, 22 bp, Homo sapiens
aggggctctcagctcagcgcca

SEQ ID NO: 3356358 - DNA, 11 bp, Homo sapiens
aggggctctgc

SEQ ID NO: 3356359 - DNA, 17 bp, Homo sapiens
aggggctctggagagaa

SEQ ID NO: 3356360 - DNA, 21 bp, Homo sapiens
aggggctctggagagaaacaa

SEQ ID NO: 3356361 - DNA, 20 bp, Homo sapiens
aggggctgactctccaggga

SEQ ID NO: 3356362 - DNA, 22 bp, Homo sapiens
aggggctgactctccagggagc

SEQ ID NO: 3356363 - DNA, 11 bp, Homo sapiens
aggggctgctg

SEQ ID NO: 3356364 - DNA, 16 bp, Homo sapiens
aggggctgcttcctcc

SEQ ID NO: 3356365 - DNA, 21 bp, Homo sapiens
aggggctgcttcctcctggaa

SEQ ID NO: 3356366 - DNA, 23 bp, Homo sapiens
aggggctggccttcctgccctac

SEQ ID NO: 3356367 - DNA, 21 bp, Homo sapiens
aggggctgggctccctgatga

SEQ ID NO: 3356368 - DNA, 13 bp, Homo sapiens
aggggctggggca

SEQ ID NO: 3356369 - DNA, 18 bp, Homo sapiens
agggggacggggctcagc

SEQ ID NO: 3356370 - DNA, 15 bp, Homo sapiens
agggggaggggaagt

SEQ ID NO: 3356371 - DNA, 20 bp, Homo sapiens
agggggatccgactgctttg

SEQ ID NO: 3356372 - DNA, 20 bp, Homo sapiens
agggggcccatccctgccca

SEQ ID NO: 3356373 - DNA, 18 bp, Homo sapiens
agggggcgctcaggaccc

SEQ ID NO: 3356374 - DNA, 22 bp, Homo sapiens
agggggctgggctcacaggcct

SEQ ID NO: 3356375 - DNA, 16 bp, Homo sapiens
agggggcttgaagcca

SEQ ID NO: 3356376 - DNA, 13 bp, Homo sapiens
aggggggagctgg

SEQ ID NO: 3356377 - DNA, 16 bp, Homo sapiens
aggggggctgtgccaa

SEQ ID NO: 3356378 - DNA, 20 bp, Homo sapiens
aggggggttgcagtggagag

SEQ ID NO: 3356379 - DNA, 22 bp, Homo sapiens
agggggtccgtggtagaggcct

SEQ ID NO: 3356380 - DNA, 15 bp, Homo sapiens
agggggtggaggggt

SEQ ID NO: 3356381 - DNA, 19 bp, Homo sapiens
agggggtgtcatctgagga

SEQ ID NO: 3356382 - DNA, 21 bp, Homo sapiens
aggggtatcatgtatggtgat

SEQ ID NO: 3356383 - DNA, 20 bp, Homo sapiens
aggggtcagtgcagcagagg

SEQ ID NO: 3356384 - DNA, 19 bp, Homo sapiens
aggggtcccagccaccccg

SEQ ID NO: 3356385 - DNA, 14 bp, Homo sapiens
aggggtccctgcta

SEQ ID NO: 3356386 - DNA, 16 bp, Homo sapiens
aggggtctccctggct

SEQ ID NO: 3356387 - DNA, 17 bp, Homo sapiens
aggggtctccctggctc

SEQ ID NO: 3356388 - DNA, 19 bp, Homo sapiens
aggggtctccctggctccc

SEQ ID NO: 3356389 - DNA, 22 bp, Homo sapiens
aggggtgcacccactcaccagg

SEQ ID NO: 3356390 - DNA, 23 bp, Homo sapiens
aggggtgccccctcctctcccat

SEQ ID NO: 3356391 - DNA, 17 bp, Homo sapiens
aggggtggagactgctt

SEQ ID NO: 3356392 - DNA, 16 bp, Homo sapiens
aggggtggagtttctg

SEQ ID NO: 3356393 - DNA, 17 bp, Homo sapiens
aggggtggagtttctga

SEQ ID NO: 3356394 - DNA, 13 bp, Homo sapiens
aggggtgggctgg

SEQ ID NO: 3356395 - DNA, 14 bp, Homo sapiens
aggggtgggctggt

SEQ ID NO: 3356396 - DNA, 21 bp, Homo sapiens
aggggtgggtcagaacatgtt

SEQ ID NO: 3356397 - DNA, 20 bp, Homo sapiens
aggggtgggttcctcttccc

SEQ ID NO: 3356398 - DNA, 21 bp, Homo sapiens
aggggtgggttcctcttcccc

SEQ ID NO: 3356399 - DNA, 14 bp, Homo sapiens
aggtgtgggggctg

SEQ ID NO: 3356400 - DNA, 18 bp, Homo sapiens
aggtgtgggggctgcagc

SEQ ID NO: 3356401 - DNA, 12 bp, Homo sapiens
aggtgtggtggc

SEQ ID NO: 3356402 - DNA, 17 bp, Homo sapiens
aggtgtggtggctcatg

SEQ ID NO: 3356403 - DNA, 17 bp, Homo sapiens
aggtgttaacattccaa

SEQ ID NO: 3356404 - DNA, 18 bp, Homo sapiens
aggtgttaacattccaag

SEQ ID NO: 3356405 - DNA, 18 bp, Homo sapiens
aggtgttcccaggctgcc

SEQ ID NO: 3356406 - DNA, 12 bp, Homo sapiens
aggtgttgccaa

SEQ ID NO: 3356407 - DNA, 21 bp, Homo sapiens
aggtgttgccaaatatgtcct

SEQ ID NO: 3356408 - DNA, 18 bp, Homo sapiens
aggtgttggttttggggg

SEQ ID NO: 3356409 - DNA, 17 bp, Homo sapiens
aggtgtttaaagagagg

SEQ ID NO: 3356410 - DNA, 18 bp, Homo sapiens
aggtgtttaaagagaggt

SEQ ID NO: 3356411 - DNA, 20 bp, Homo sapiens
aggttaaggtgggtccagga

SEQ ID NO: 3356412 - DNA, 22 bp, Homo sapiens
aggttaattccaattatatgag

SEQ ID NO: 3356413 - DNA, 15 bp, Homo sapiens
aggttacaagcctgc

SEQ ID NO: 3356414 - DNA, 16 bp, Homo sapiens
aggttacgaagacaaa

SEQ ID NO: 3356415 - DNA, 18 bp, Homo sapiens
aggttaggatttaacagt

SEQ ID NO: 3356416 - DNA, 18 bp, Homo sapiens
aggttatacaataaccca

SEQ ID NO: 3356417 - DNA, 20 bp, Homo sapiens
aggttatacaataacccagt

SEQ ID NO: 3356418 - DNA, 19 bp, Homo sapiens
aggttatcgaaataacaat

SEQ ID NO: 3356419 - DNA, 14 bp, Homo sapiens
aggttatctgcctg

SEQ ID NO: 3356420 - DNA, 22 bp, Homo sapiens
aggttatctgcctggcctggct

SEQ ID NO: 3356421 - DNA, 23 bp, Homo sapiens
aggttatctgcctggcctggctc

SEQ ID NO: 3356422 - DNA, 22 bp, Homo sapiens
aggttatctttttaaaaactct

SEQ ID NO: 3356423 - DNA, 16 bp, Homo sapiens
aggttatgttcatttt

SEQ ID NO: 3356424 - DNA, 21 bp, Homo sapiens
aggttatgttcatttttcaaa

SEQ ID NO: 3356425 - DNA, 16 bp, Homo sapiens
aggttattgcaataaa

SEQ ID NO: 3356426 - DNA, 23 bp, Homo sapiens
aggttattttctttatcattgct

SEQ ID NO: 3356427 - DNA, 13 bp, Homo sapiens
aggttattttgct

SEQ ID NO: 3356428 - DNA, 14 bp, Homo sapiens
aggttattttgctt

SEQ ID NO: 3356429 - DNA, 16 bp, Homo sapiens
aggttattttgctttg

SEQ ID NO: 3356430 - DNA, 18 bp, Homo sapiens
aggttcacactcagaaag

SEQ ID NO: 3356431 - DNA, 18 bp, Homo sapiens
aggttccaactgtatata

SEQ ID NO: 3356432 - DNA, 18 bp, Homo sapiens
aggttccccaagggccct

SEQ ID NO: 3356433 - DNA, 23 bp, Homo sapiens
aggttccccaagggccctggcac

SEQ ID NO: 3356434 - DNA, 17 bp, Homo sapiens
aggttcccccagcaagc

SEQ ID NO: 3356435 - DNA, 17 bp, Homo sapiens
aggttcctctgcctgcc

SEQ ID NO: 3356436 - DNA, 18 bp, Homo sapiens
aggttcctctgcctgccc

SEQ ID NO: 3356437 - DNA, 19 bp, Homo sapiens
aggttctaaagttctaaga

SEQ ID NO: 3356438 - DNA, 14 bp, Homo sapiens
aggttctaacccta

SEQ ID NO: 3356439 - DNA, 15 bp, Homo sapiens
aggttctcagagcca

SEQ ID NO: 3356440 - DNA, 18 bp, Homo sapiens
aggttctcagagccaagt

SEQ ID NO: 3356441 - DNA, 20 bp, Homo sapiens
aggttctccgttagctcctg

SEQ ID NO: 3356442 - DNA, 21 bp, Homo sapiens
aggttctccgttagctcctgt

SEQ ID NO: 3356443 - DNA, 14 bp, Homo sapiens
aggttctggttcca

SEQ ID NO: 3356444 - DNA, 17 bp, Homo sapiens
aggttcttaaaaaggaa

SEQ ID NO: 3356445 - DNA, 14 bp, Homo sapiens
aggttcttttccat

SEQ ID NO: 3356446 - DNA, 14 bp, Homo sapiens
aggttgaagcacca

SEQ ID NO: 3356447 - DNA, 12 bp, Homo sapiens
aggttgaagcca

SEQ ID NO: 3356448 - DNA, 15 bp, Homo sapiens
aggttgaataatata

SEQ ID NO: 3356449 - DNA, 18 bp, Homo sapiens
aggttgcagggagccgag

SEQ ID NO: 3356450 - DNA, 14 bp, Homo sapiens
aggttgcagtgagc

SEQ ID NO: 3356451 - DNA, 12 bp, Homo sapiens
aggttgcctgaa

SEQ ID NO: 3356452 - DNA, 17 bp, Homo sapiens
aggttgctggttgctgt

SEQ ID NO: 3356453 - DNA, 17 bp, Homo sapiens
aggttggaccccagaga

SEQ ID NO: 3356454 - DNA, 16 bp, Homo sapiens
aggttggcaccccagc

SEQ ID NO: 3356455 - DNA, 16 bp, Homo sapiens
aggttggggtgtacta

SEQ ID NO: 3356456 - DNA, 19 bp, Homo sapiens
aggttggggtgtactagtt

SEQ ID NO: 3356457 - DNA, 14 bp, Homo sapiens
aggttggtgaattt

SEQ ID NO: 3356458 - DNA, 14 bp, Homo sapiens
aggttggtgactga

SEQ ID NO: 3356459 - DNA, 20 bp, Homo sapiens
aggttggtgactgaaacatt

SEQ ID NO: 3356460 - DNA, 20 bp, Homo sapiens
aggttgtctgaagtcactgc

SEQ ID NO: 3356461 - DNA, 15 bp, Homo sapiens
aggtttaaagagtct

SEQ ID NO: 3356462 - DNA, 16 bp, Homo sapiens
aggtttaacatttgcc

SEQ ID NO: 3356463 - DNA, 17 bp, Homo sapiens
aggtttcaaagatgctg

SEQ ID NO: 3356464 - DNA, 16 bp, Homo sapiens
aggtttccattctgca

SEQ ID NO: 3356465 - DNA, 19 bp, Homo sapiens
aggtttccttttggaacat

SEQ ID NO: 3356466 - DNA, 23 bp, Homo sapiens
aggtttccttttggaacatttct

SEQ ID NO: 3356467 - DNA, 22 bp, Homo sapiens
aggtttggggagggggaagaga

SEQ ID NO: 3356468 - DNA, 19 bp, Homo sapiens
aggtttggtgcaaagtatt

SEQ ID NO: 3356469 - DNA, 23 bp, Homo sapiens
aggtttgtcgggcaccagccagc

SEQ ID NO: 3356470 - DNA, 15 bp, Homo sapiens
aggtttgtgttttct

SEQ ID NO: 3356471 - DNA, 16 bp, Homo sapiens
aggttttaggttctaa

SEQ ID NO: 3356472 - DNA, 19 bp, Homo sapiens
aggttttaggttctaaagt

SEQ ID NO: 3356473 - DNA, 22 bp, Homo sapiens
aggttttctctaacttctcaag

SEQ ID NO: 3356474 - DNA, 13 bp, Homo sapiens
aggttttgtattt

SEQ ID NO: 3356475 - DNA, 17 bp, Homo sapiens
aggttttgttgttttat

SEQ ID NO: 3356476 - DNA, 15 bp, Homo sapiens
aggtttttattagta

SEQ ID NO: 3356477 - DNA, 16 bp, Homo sapiens
aggttttttttcagtt

SEQ ID NO: 3356478 - DNA, 13 bp, Homo sapiens
agtaaaacacatt

SEQ ID NO: 3356479 - DNA, 16 bp, Homo sapiens
agtaaaaccttgttct

SEQ ID NO: 3356480 - DNA, 18 bp, Homo sapiens
agtaaaaccttgttctat

SEQ ID NO: 3356481 - DNA, 19 bp, Homo sapiens
agtaaaaccttgttctatt

SEQ ID NO: 3356482 - DNA, 22 bp, Homo sapiens
agtaaaagccttattctaaggt

SEQ ID NO: 3356483 - DNA, 15 bp, Homo sapiens
agtaaaagtcataaa

SEQ ID NO: 3356484 - DNA, 21 bp, Homo sapiens
agtaaaattatcctctttgta

SEQ ID NO: 3356485 - DNA, 15 bp, Homo sapiens
agtaaaattgtttca

SEQ ID NO: 3356486 - DNA, 19 bp, Homo sapiens
agtaaacgggaacatgccc

SEQ ID NO: 3356487 - DNA, 14 bp, Homo sapiens
agtaaactatttat

SEQ ID NO: 3356488 - DNA, 14 bp, Homo sapiens
agtaaactttttgt

SEQ ID NO: 3356489 - DNA, 13 bp, Homo sapiens
agtaaagagaaac

SEQ ID NO: 3356490 - DNA, 22 bp, Homo sapiens
agtaaagagaaactttgtgcta

SEQ ID NO: 3356491 - DNA, 23 bp, Homo sapiens
agtaaagccattaaatgaatatt

SEQ ID NO: 3356492 - DNA, 16 bp, Homo sapiens
agtaaaggcaaactta

SEQ ID NO: 3356493 - DNA, 16 bp, Homo sapiens
agtaaataaactgttt

SEQ ID NO: 3356494 - DNA, 17 bp, Homo sapiens
agtaaataaactgttta

SEQ ID NO: 3356495 - DNA, 18 bp, Homo sapiens
agtaaatacaagactgtt

SEQ ID NO: 3356496 - DNA, 13 bp, Homo sapiens
agtaaatctcttt

SEQ ID NO: 3356497 - DNA, 15 bp, Homo sapiens
agtaaatcttttaca

SEQ ID NO: 3356498 - DNA, 22 bp, Homo sapiens
agtaaatgctaggttaattcca

SEQ ID NO: 3356499 - DNA, 19 bp, Homo sapiens
agtaacaatgaagataaaa

SEQ ID NO: 3356500 - DNA, 18 bp, Homo sapiens
agtaacatgcatacttta

SEQ ID NO: 3356501 - DNA, 17 bp, Homo sapiens
agtaacgcgtcttcctg

SEQ ID NO: 3356502 - DNA, 15 bp, Homo sapiens
agtaactaattttgt

SEQ ID NO: 3356503 - DNA, 12 bp, Homo sapiens
agtaactcattt

SEQ ID NO: 3356504 - DNA, 22 bp, Homo sapiens
agtaactcatttgttaaaatta

SEQ ID NO: 3356505 - DNA, 14 bp, Homo sapiens
agtaactgacatga

SEQ ID NO: 3356506 - DNA, 11 bp, Homo sapiens
agtaactgttt

SEQ ID NO: 3356507 - DNA, 14 bp, Homo sapiens
agtaacttaatact

SEQ ID NO: 3356508 - DNA, 17 bp, Homo sapiens
agtaacttcttatggaa

SEQ ID NO: 3356509 - DNA, 19 bp, Homo sapiens
agtaacttcttatggaatt

SEQ ID NO: 3356510 - DNA, 15 bp, Homo sapiens
agtaacttggctttc

SEQ ID NO: 3356511 - DNA, 14 bp, Homo sapiens
agtaactttatgtg

SEQ ID NO: 3356512 - DNA, 17 bp, Homo sapiens
agtaactttatgtgtaa

SEQ ID NO: 3356513 - DNA, 21 bp, Homo sapiens
agtaagaataccacatcaaat

SEQ ID NO: 3356514 - DNA, 23 bp, Homo sapiens
agtaagaataccacatcaaataa

SEQ ID NO: 3356515 - DNA, 19 bp, Homo sapiens
agtaagagctaagttctaa

SEQ ID NO: 3356516 - DNA, 12 bp, Homo sapiens
agtaagagctgg

SEQ ID NO: 3356517 - DNA, 14 bp, Homo sapiens
agtaagaggtgtta

SEQ ID NO: 3356518 - DNA, 14 bp, Homo sapiens
agtaaggtgcagtt

SEQ ID NO: 3356519 - DNA, 17 bp, Homo sapiens
agtaagtaccactcagg

SEQ ID NO: 3356520 - DNA, 19 bp, Homo sapiens
agtaagtaccactcaggcc

SEQ ID NO: 3356521 - DNA, 20 bp, Homo sapiens
agtaagtaccactcaggcca

SEQ ID NO: 3356522 - DNA, 23 bp, Homo sapiens
agtaagtggggttgcaaccactg

SEQ ID NO: 3356523 - DNA, 17 bp, Homo sapiens
agtaagtgtgtcttcct

SEQ ID NO: 3356524 - DNA, 23 bp, Homo sapiens
agtaagtgtgtcttcctagaatt

SEQ ID NO: 3356525 - DNA, 15 bp, Homo sapiens
agtctcttttcttta

SEQ ID NO: 3356526 - DNA, 16 bp, Homo sapiens
agtctgaacagctgta

SEQ ID NO: 3356527 - DNA, 18 bp, Homo sapiens
agtctgaacagctgtaat

SEQ ID NO: 3356528 - DNA, 11 bp, Homo sapiens
agtctgaagat

SEQ ID NO: 3356529 - DNA, 17 bp, Homo sapiens
agtctgagcccccggct

SEQ ID NO: 3356530 - DNA, 16 bp, Homo sapiens
agtctgagtcctgtct

SEQ ID NO: 3356531 - DNA, 19 bp, Homo sapiens
agtctgagtcctgtctctg

SEQ ID NO: 3356532 - DNA, 15 bp, Homo sapiens
agtctgagtctgagt

SEQ ID NO: 3356533 - DNA, 23 bp, Homo sapiens
agtctgcaactttaagcagctct

SEQ ID NO: 3356534 - DNA, 12 bp, Homo sapiens
agtctgccaact

SEQ ID NO: 3356535 - DNA, 23 bp, Homo sapiens
agtctgcccacgcagaggacgca

SEQ ID NO: 3356536 - DNA, 13 bp, Homo sapiens
agtctggaaagtg

SEQ ID NO: 3356537 - DNA, 20 bp, Homo sapiens
agtctggaaagtgatgtcag

SEQ ID NO: 3356538 - DNA, 18 bp, Homo sapiens
agtctggaatgcagtggt

SEQ ID NO: 3356539 - DNA, 13 bp, Homo sapiens
agtctggagtggg

SEQ ID NO: 3356540 - DNA, 18 bp, Homo sapiens
agtctggagtgggcagag

SEQ ID NO: 3356541 - DNA, 15 bp, Homo sapiens
agtctggcctgggcg

SEQ ID NO: 3356542 - DNA, 14 bp, Homo sapiens
agtctggctttacc

SEQ ID NO: 3356543 - DNA, 21 bp, Homo sapiens
agtctggctttacctttttgt

SEQ ID NO: 3356544 - DNA, 14 bp, Homo sapiens
agtctgggacacaa

SEQ ID NO: 3356545 - DNA, 17 bp, Homo sapiens
agtctgggcctctgact

SEQ ID NO: 3356546 - DNA, 16 bp, Homo sapiens
agtctgggctgccggg

SEQ ID NO: 3356547 - DNA, 15 bp, Homo sapiens
agtctggtttctaga

SEQ ID NO: 3356548 - DNA, 14 bp, Homo sapiens
agtctgtacctcaa

SEQ ID NO: 3356549 - DNA, 20 bp, Homo sapiens
agtctgtacctcaaatgaat

SEQ ID NO: 3356550 - DNA, 21 bp, Homo sapiens
agtctgtacctcaaatgaatt

SEQ ID NO: 3356551 - DNA, 22 bp, Homo sapiens
agtctgtactaaacagtaagat

SEQ ID NO: 3356552 - DNA, 15 bp, Homo sapiens
agtctgtcatcctct

SEQ ID NO: 3356553 - DNA, 18 bp, Homo sapiens
agtctgtcatcctctgga

SEQ ID NO: 3356554 - DNA, 15 bp, Homo sapiens
agtctgtcctgtgac

SEQ ID NO: 3356555 - DNA, 13 bp, Homo sapiens
agtctgtctactg

SEQ ID NO: 3356556 - DNA, 17 bp, Homo sapiens
agtctgtctcaaaagaa

SEQ ID NO: 3356557 - DNA, 14 bp, Homo sapiens
agtctgtggatcag

SEQ ID NO: 3356558 - DNA, 12 bp, Homo sapiens
agtctgtgtgaa

SEQ ID NO: 3356559 - DNA, 21 bp, Homo sapiens
agtctgtgtgatgaactttct

SEQ ID NO: 3356560 - DNA, 22 bp, Homo sapiens
agtctgtgtgatgaactttctc

SEQ ID NO: 3356561 - DNA, 18 bp, Homo sapiens
agtctgtgtgggactgta

SEQ ID NO: 3356562 - DNA, 22 bp, Homo sapiens
agtctgtgtgggactgtacaca

SEQ ID NO: 3356563 - DNA, 12 bp, Homo sapiens
agtcttaacaaa

SEQ ID NO: 3356564 - DNA, 14 bp, Homo sapiens
agtcttagatgtat

SEQ ID NO: 3356565 - DNA, 22 bp, Homo sapiens
agtcttatttccaagtaagagt

SEQ ID NO: 3356566 - DNA, 12 bp, Homo sapiens
agtcttcctgac

SEQ ID NO: 3356567 - DNA, 15 bp, Homo sapiens
agtcttcctgacact

SEQ ID NO: 3356568 - DNA, 16 bp, Homo sapiens
agtcttcctgacactt

SEQ ID NO: 3356569 - DNA, 12 bp, Homo sapiens
agtcttctcata

SEQ ID NO: 3356570 - DNA, 13 bp, Homo sapiens
agtcttctcatag

SEQ ID NO: 3356571 - DNA, 21 bp, Homo sapiens
agtcttctcatagcattaact

SEQ ID NO: 3356572 - DNA, 17 bp, Homo sapiens
agtcttctgacaaactg

SEQ ID NO: 3356573 - DNA, 19 bp, Homo sapiens
agtcttctgacaaactgtg

SEQ ID NO: 3356574 - DNA, 14 bp, Homo sapiens
agtcttctgggctg

SEQ ID NO: 3356575 - DNA, 22 bp, Homo sapiens
agtcttctgggctgcgggaggc

SEQ ID NO: 3356576 - DNA, 15 bp, Homo sapiens
agtcttggcggcagc

SEQ ID NO: 3356577 - DNA, 16 bp, Homo sapiens
agtcttgggcctggcc

SEQ ID NO: 3356578 - DNA, 23 bp, Homo sapiens
agtcttggtttctctctacagtg

SEQ ID NO: 3356579 - DNA, 19 bp, Homo sapiens
agtctttaaaggcccagcc

SEQ ID NO: 3356580 - DNA, 18 bp, Homo sapiens
agtctttagctatctgtt

SEQ ID NO: 3356581 - DNA, 20 bp, Homo sapiens
agtctttcttagtgcctgtg

SEQ ID NO: 3356582 - DNA, 21 bp, Homo sapiens
agtctttgaagctgaaaatat

SEQ ID NO: 3356583 - DNA, 22 bp, Homo sapiens
agtctttgccagtcattcagca

SEQ ID NO: 3356584 - DNA, 14 bp, Homo sapiens
agtctttgccttct

SEQ ID NO: 3356585 - DNA, 16 bp, Homo sapiens
agtctttggttctaag

SEQ ID NO: 3356586 - DNA, 21 bp, Homo sapiens
agtcttttgcatgtcgcacaa

SEQ ID NO: 3356587 - DNA, 23 bp, Homo sapiens
agtcttttgcatgtcgcacaatg

SEQ ID NO: 3356588 - DNA, 13 bp, Homo sapiens
agtctttttctgt

SEQ ID NO: 3356589 - DNA, 14 bp, Homo sapiens
agtctttttctgtt

SEQ ID NO: 3356590 - DNA, 17 bp, Homo sapiens
agtctttttctgttgta

SEQ ID NO: 3356591 - DNA, 19 bp, Homo sapiens
agtctttttctgttgtaac

SEQ ID NO: 3356592 - DNA, 17 bp, Homo sapiens
agtgaaaaatatgttga

SEQ ID NO: 3356593 - DNA, 15 bp, Homo sapiens
agtgaaaattctgtt

SEQ ID NO: 3356594 - DNA, 18 bp, Homo sapiens
agtgaaaattctgttggt

SEQ ID NO: 3356595 - DNA, 23 bp, Homo sapiens
agtgaaaattctgttggtgccac

SEQ ID NO: 3356596 - DNA, 17 bp, Homo sapiens
agtgaaaccatgactgt

SEQ ID NO: 3356597 - DNA, 20 bp, Homo sapiens
agtgaaacctttagggcagc

SEQ ID NO: 3356598 - DNA, 18 bp, Homo sapiens
agtgaaagggctatggca

SEQ ID NO: 3356599 - DNA, 16 bp, Homo sapiens
agtgaaccacaggttt

SEQ ID NO: 3356600 - DNA, 23 bp, Homo sapiens
agtgaacttacacttggagcccg

SEQ ID NO: 3356601 - DNA, 13 bp, Homo sapiens
agtgaagaggggc

SEQ ID NO: 3356602 - DNA, 16 bp, Homo sapiens
agtgaagaggggcagc

SEQ ID NO: 3356603 - DNA, 19 bp, Homo sapiens
agtgaagaggggcagccct

SEQ ID NO: 3356604 - DNA, 23 bp, Homo sapiens
agtgaagatggtttcaattcaga

SEQ ID NO: 3356605 - DNA, 23 bp, Homo sapiens
agtgaagggaagagacagcccag

SEQ ID NO: 3356606 - DNA, 23 bp, Homo sapiens
agtgaaggtctttgttatgacag

SEQ ID NO: 3356607 - DNA, 21 bp, Homo sapiens
agtgaagtcatgacctccagg

SEQ ID NO: 3356608 - DNA, 17 bp, Homo sapiens
agtgaataaatgtcttg

SEQ ID NO: 3356609 - DNA, 16 bp, Homo sapiens
agtgaatactgctaca

SEQ ID NO: 3356610 - DNA, 21 bp, Homo sapiens
agtgaatacttactataattt

SEQ ID NO: 3356611 - DNA, 22 bp, Homo sapiens
agtgaatacttactataatttg

SEQ ID NO: 3356612 - DNA, 14 bp, Homo sapiens
agtgaatattgctt

SEQ ID NO: 3356613 - DNA, 17 bp, Homo sapiens
agtgaatcctctgttta

SEQ ID NO: 3356614 - DNA, 16 bp, Homo sapiens
agtgaatctaaggata

SEQ ID NO: 3356615 - DNA, 15 bp, Homo sapiens
agtgaatgctgggac

SEQ ID NO: 3356616 - DNA, 12 bp, Homo sapiens
agtgaattgaag

SEQ ID NO: 3356617 - DNA, 14 bp, Homo sapiens
agtgaattgtcttt

SEQ ID NO: 3356618 - DNA, 15 bp, Homo sapiens
agtgaatttgaatga

SEQ ID NO: 3356619 - DNA, 19 bp, Homo sapiens
agtgaatttgggctgctgt

SEQ ID NO: 3356620 - DNA, 14 bp, Homo sapiens
agtgacaaaagctc

SEQ ID NO: 3356621 - DNA, 17 bp, Homo sapiens
agtgacaaagactcctc

SEQ ID NO: 3356622 - DNA, 13 bp, Homo sapiens
agtgacacaatct

SEQ ID NO: 3356623 - DNA, 13 bp, Homo sapiens
agtgacacagcag

SEQ ID NO: 3356624 - DNA, 18 bp, Homo sapiens
agtgacacagcagcttca

SEQ ID NO: 3356625 - DNA, 18 bp, Homo sapiens
agtgacacttcagagagc

SEQ ID NO: 3356626 - DNA, 21 bp, Homo sapiens
agtgacagaccacatctttat

SEQ ID NO: 3356627 - DNA, 16 bp, Homo sapiens
agtgacagaggcagcc

SEQ ID NO: 3356628 - DNA, 21 bp, Homo sapiens
agtgacatcaaagcctggcct

SEQ ID NO: 3356629 - DNA, 19 bp, Homo sapiens
agtgaccacttattctgta

SEQ ID NO: 3356630 - DNA, 14 bp, Homo sapiens
agtgaccttttctt

SEQ ID NO: 3356631 - DNA, 17 bp, Homo sapiens
agtgaccttttcttcat

SEQ ID NO: 3356632 - DNA, 18 bp, Homo sapiens
agtgaccttttcttcatt

SEQ ID NO: 3356633 - DNA, 16 bp, Homo sapiens
agtgactccaagaaca

SEQ ID NO: 3356634 - DNA, 17 bp, Homo sapiens
agtgactgaaaccattt

SEQ ID NO: 3356635 - DNA, 18 bp, Homo sapiens
agtgactgaaaccatttt

SEQ ID NO: 3356636 - DNA, 22 bp, Homo sapiens
agtgactgaaaccattttccca

SEQ ID NO: 3356637 - DNA, 15 bp, Homo sapiens
agtgactgttgtacc

SEQ ID NO: 3356638 - DNA, 17 bp, Homo sapiens
agtgactgtttggctta

SEQ ID NO: 3356639 - DNA, 23 bp, Homo sapiens
agtgactgtttggcttataaaca

SEQ ID NO: 3356640 - DNA, 17 bp, Homo sapiens
agtgacttggccccaga

SEQ ID NO: 3356641 - DNA, 21 bp, Homo sapiens
agtgacttggccccagacgca

SEQ ID NO: 3356642 - DNA, 18 bp, Homo sapiens
agtgacttgtgtcccatg

SEQ ID NO: 3356643 - DNA, 14 bp, Homo sapiens
agtgactttgtata

SEQ ID NO: 3356644 - DNA, 20 bp, Homo sapiens
agtgactttgtatagagaat

SEQ ID NO: 3356645 - DNA, 16 bp, Homo sapiens
agtgactttttctgag

SEQ ID NO: 3356646 - DNA, 19 bp, Homo sapiens
agtgactttttctgagctt

SEQ ID NO: 3356647 - DNA, 14 bp, Homo sapiens
agtgagaaaaagct

SEQ ID NO: 3356648 - DNA, 22 bp, Homo sapiens
agtgagaaaaagctcctgtcct

SEQ ID NO: 3356649 - DNA, 16 bp, Homo sapiens
agtgagacaaaatttt

SEQ ID NO: 3356650 - DNA, 13 bp, Homo sapiens
agtgagacagaag

SEQ ID NO: 3356651 - DNA, 16 bp, Homo sapiens
agtgtgagtaagagct

SEQ ID NO: 3356652 - DNA, 17 bp, Homo sapiens
agtgtgagtaagagctg

SEQ ID NO: 3356653 - DNA, 19 bp, Homo sapiens
agtgtgagtaagagctggt

SEQ ID NO: 3356654 - DNA, 15 bp, Homo sapiens
agtgtgagtggcagc

SEQ ID NO: 3356655 - DNA, 16 bp, Homo sapiens
agtgtgagtggcagcc

SEQ ID NO: 3356656 - DNA, 22 bp, Homo sapiens
agtgtgcacgagtgggaaggac

SEQ ID NO: 3356657 - DNA, 18 bp, Homo sapiens
agtgtgcatggaggccct

SEQ ID NO: 3356658 - DNA, 16 bp, Homo sapiens
agtgtgcccttctctt

SEQ ID NO: 3356659 - DNA, 23 bp, Homo sapiens
agtgtggaaaaatagctctgtgt

SEQ ID NO: 3356660 - DNA, 14 bp, Homo sapiens
agtgtggactctgg

SEQ ID NO: 3356661 - DNA, 16 bp, Homo sapiens
agtgtgggcttgacca

SEQ ID NO: 3356662 - DNA, 21 bp, Homo sapiens
agtgtggtagggacttaaaaa

SEQ ID NO: 3356663 - DNA, 16 bp, Homo sapiens
agtgtggtgtgtttgc

SEQ ID NO: 3356664 - DNA, 21 bp, Homo sapiens
agtgtgtaaggtatatgtttt

SEQ ID NO: 3356665 - DNA, 18 bp, Homo sapiens
agtgtgtatatattttgt

SEQ ID NO: 3356666 - DNA, 16 bp, Homo sapiens
agtgtgtattgttccc

SEQ ID NO: 3356667 - DNA, 17 bp, Homo sapiens
agtgtgtgtgcagagtc

SEQ ID NO: 3356668 - DNA, 12 bp, Homo sapiens
agtgtgttctga

SEQ ID NO: 3356669 - DNA, 13 bp, Homo sapiens
agtgtgttctgat

SEQ ID NO: 3356670 - DNA, 22 bp, Homo sapiens
agtgttactgcctataatctta

SEQ ID NO: 3356671 - DNA, 14 bp, Homo sapiens
agtgttagagaaat

SEQ ID NO: 3356672 - DNA, 23 bp, Homo sapiens
agtgttatcagtcataactaaat

SEQ ID NO: 3356673 - DNA, 20 bp, Homo sapiens
agtgttatttttcaaggaag

SEQ ID NO: 3356674 - DNA, 16 bp, Homo sapiens
agtgttcaaaatacta

SEQ ID NO: 3356675 - DNA, 17 bp, Homo sapiens
agtgttcaagaaataaa

SEQ ID NO: 3356676 - DNA, 17 bp, Homo sapiens
agtgttcatttgaaaga

SEQ ID NO: 3356677 - DNA, 18 bp, Homo sapiens
agtgttcattttagtgac

SEQ ID NO: 3356678 - DNA, 23 bp, Homo sapiens
agtgttccgaagatgctgtagta

SEQ ID NO: 3356679 - DNA, 21 bp, Homo sapiens
agtgttcctttttaaatgtga

SEQ ID NO: 3356680 - DNA, 23 bp, Homo sapiens
agtgttcctttttaaatgtgaat

SEQ ID NO: 3356681 - DNA, 13 bp, Homo sapiens
agtgttctgtcta

SEQ ID NO: 3356682 - DNA, 17 bp, Homo sapiens
agtgttgaaaatgttca

SEQ ID NO: 3356683 - DNA, 20 bp, Homo sapiens
agtgttgattgccaaattga

SEQ ID NO: 3356684 - DNA, 21 bp, Homo sapiens
agtgttgattgccaaattgac

SEQ ID NO: 3356685 - DNA, 15 bp, Homo sapiens
agtgttgtttgtaaa

SEQ ID NO: 3356686 - DNA, 18 bp, Homo sapiens
agtgttgtttgtaaataa

SEQ ID NO: 3356687 - DNA, 15 bp, Homo sapiens
agtgtttatttttca

SEQ ID NO: 3356688 - DNA, 17 bp, Homo sapiens
agtgtttatttttcata

SEQ ID NO: 3356689 - DNA, 22 bp, Homo sapiens
agtgtttatttttcatattgtg

SEQ ID NO: 3356690 - DNA, 12 bp, Homo sapiens
agtgtttctgtt

SEQ ID NO: 3356691 - DNA, 21 bp, Homo sapiens
agtgtttctgttattaacaaa

SEQ ID NO: 3356692 - DNA, 19 bp, Homo sapiens
agtgtttgtgtctgactca

SEQ ID NO: 3356693 - DNA, 14 bp, Homo sapiens
agtgttttaaattc

SEQ ID NO: 3356694 - DNA, 17 bp, Homo sapiens
agtgttttaaattctga

SEQ ID NO: 3356695 - DNA, 19 bp, Homo sapiens
agtgttttaaattctgaga

SEQ ID NO: 3356696 - DNA, 20 bp, Homo sapiens
agtgttttaagataaattat

SEQ ID NO: 3356697 - DNA, 16 bp, Homo sapiens
agtgttttctcagaac

SEQ ID NO: 3356698 - DNA, 15 bp, Homo sapiens
agtgttttctgggat

SEQ ID NO: 3356699 - DNA, 14 bp, Homo sapiens
agtgttttggactc

SEQ ID NO: 3356700 - DNA, 21 bp, Homo sapiens
agtgtttttgaaacccacagt

SEQ ID NO: 3356701 - DNA, 22 bp, Homo sapiens
agttaaaagtaaaattgtttca

SEQ ID NO: 3356702 - DNA, 23 bp, Homo sapiens
agttaaagagcagcctggctaac

SEQ ID NO: 3356703 - DNA, 16 bp, Homo sapiens
agttaacaaggaatgc

SEQ ID NO: 3356704 - DNA, 23 bp, Homo sapiens
agttaacaaggaatgcctgtgcc

SEQ ID NO: 3356705 - DNA, 21 bp, Homo sapiens
agttaacattaacatctatta

SEQ ID NO: 3356706 - DNA, 14 bp, Homo sapiens
agttaactttcaga

SEQ ID NO: 3356707 - DNA, 12 bp, Homo sapiens
agttaagaagct

SEQ ID NO: 3356708 - DNA, 18 bp, Homo sapiens
agttaagaagctgttgta

SEQ ID NO: 3356709 - DNA, 20 bp, Homo sapiens
agttaagaagctgttgtaca

SEQ ID NO: 3356710 - DNA, 22 bp, Homo sapiens
agttaagaagctgttgtacatt

SEQ ID NO: 3356711 - DNA, 20 bp, Homo sapiens
agttaagacatgatttcctt

SEQ ID NO: 3356712 - DNA, 19 bp, Homo sapiens
agttaataacagctccttt

SEQ ID NO: 3356713 - DNA, 21 bp, Homo sapiens
agttaatatatcccagaaatt

SEQ ID NO: 3356714 - DNA, 14 bp, Homo sapiens
agttaatattttgt

SEQ ID NO: 3356715 - DNA, 21 bp, Homo sapiens
agttaatattttgttcttatt

SEQ ID NO: 3356716 - DNA, 14 bp, Homo sapiens
agttaatgagccat

SEQ ID NO: 3356717 - DNA, 17 bp, Homo sapiens
agttaatgatggcagag

SEQ ID NO: 3356718 - DNA, 20 bp, Homo sapiens
agttaatgatggttgatggg

SEQ ID NO: 3356719 - DNA, 17 bp, Homo sapiens
agttaatgtatataaaa

SEQ ID NO: 3356720 - DNA, 19 bp, Homo sapiens
agttaatgtatataaaaat

SEQ ID NO: 3356721 - DNA, 20 bp, Homo sapiens
agttaatgtatataaaaatg

SEQ ID NO: 3356722 - DNA, 21 bp, Homo sapiens
agttaattatgtgcatattaa

SEQ ID NO: 3356723 - DNA, 17 bp, Homo sapiens
agttaatttttccaact

SEQ ID NO: 3356724 - DNA, 19 bp, Homo sapiens
agttacaattacatctcta

SEQ ID NO: 3356725 - DNA, 20 bp, Homo sapiens
agttacaattacatctctaa

SEQ ID NO: 3356726 - DNA, 14 bp, Homo sapiens
agttacagttctgt

SEQ ID NO: 3356727 - DNA, 15 bp, Homo sapiens
agttacagttctgtg

SEQ ID NO: 3356728 - DNA, 16 bp, Homo sapiens
agttacattaatgtta

SEQ ID NO: 3356729 - DNA, 20 bp, Homo sapiens
agttaccttatagttactgt

SEQ ID NO: 3356730 - DNA, 21 bp, Homo sapiens
agttaccttatagttactgtg

SEQ ID NO: 3356731 - DNA, 22 bp, Homo sapiens
agttaccttatagttactgtgt

SEQ ID NO: 3356732 - DNA, 17 bp, Homo sapiens
agttactaggtaacttc

SEQ ID NO: 3356733 - DNA, 19 bp, Homo sapiens
agttactccctacactgat

SEQ ID NO: 3356734 - DNA, 11 bp, Homo sapiens
agttactgtgt

SEQ ID NO: 3356735 - DNA, 15 bp, Homo sapiens
agttactgtgtaatt

SEQ ID NO: 3356736 - DNA, 19 bp, Homo sapiens
agttactgtgtaattagtg

SEQ ID NO: 3356737 - DNA, 17 bp, Homo sapiens
agttacttgtctgaggc

SEQ ID NO: 3356738 - DNA, 18 bp, Homo sapiens
agttacttgtctgaggcc

SEQ ID NO: 3356739 - DNA, 15 bp, Homo sapiens
agttactttgtaatt

SEQ ID NO: 3356740 - DNA, 16 bp, Homo sapiens
agttactttgtaattt

SEQ ID NO: 3356741 - DNA, 21 bp, Homo sapiens
agttagaaggaggttctaata

SEQ ID NO: 3356742 - DNA, 17 bp, Homo sapiens
agttagagaatatattt

SEQ ID NO: 3356743 - DNA, 12 bp, Homo sapiens
agttaggaaata

SEQ ID NO: 3356744 - DNA, 15 bp, Homo sapiens
agttaggaaataaaa

SEQ ID NO: 3356745 - DNA, 14 bp, Homo sapiens
agttaggggcctta

SEQ ID NO: 3356746 - DNA, 20 bp, Homo sapiens
agttagtggattactgccat

SEQ ID NO: 3356747 - DNA, 22 bp, Homo sapiens
agttataacagatgtgaaaata

SEQ ID NO: 3356748 - DNA, 19 bp, Homo sapiens
agttatacagttataaaat

SEQ ID NO: 3356749 - DNA, 16 bp, Homo sapiens
agttatagtttcagat

SEQ ID NO: 3356750 - DNA, 16 bp, Homo sapiens
agttatagtttgcttt

SEQ ID NO: 3356751 - DNA, 22 bp, Homo sapiens
agttatattagtgaagatggtt

SEQ ID NO: 3356752 - DNA, 15 bp, Homo sapiens
agttatcatgaattt

SEQ ID NO: 3356753 - DNA, 16 bp, Homo sapiens
agttatcctttgtgag

SEQ ID NO: 3356754 - DNA, 14 bp, Homo sapiens
agttatcttagctg

SEQ ID NO: 3356755 - DNA, 21 bp, Homo sapiens
agttatggcctatacactatt

SEQ ID NO: 3356756 - DNA, 14 bp, Homo sapiens
agttatgtgaatga

SEQ ID NO: 3356757 - DNA, 14 bp, Homo sapiens
agttatgttaaaat

SEQ ID NO: 3356758 - DNA, 20 bp, Homo sapiens
agttattaactttaatgttt

SEQ ID NO: 3356759 - DNA, 20 bp, Homo sapiens
agttattacatgtaatttga

SEQ ID NO: 3356760 - DNA, 13 bp, Homo sapiens
agttattcaaatt

SEQ ID NO: 3356761 - DNA, 15 bp, Homo sapiens
agttattcataaaga

SEQ ID NO: 3356762 - DNA, 18 bp, Homo sapiens
agttattcataaagagaa

SEQ ID NO: 3356763 - DNA, 19 bp, Homo sapiens
agttattcatattctgttg

SEQ ID NO: 3356764 - DNA, 18 bp, Homo sapiens
agttattccttgatcatt

SEQ ID NO: 3356765 - DNA, 19 bp, Homo sapiens
agttattgaatcttaattt

SEQ ID NO: 3356766 - DNA, 12 bp, Homo sapiens
agttattgtaca

SEQ ID NO: 3356767 - DNA, 13 bp, Homo sapiens
agttattgtacag

SEQ ID NO: 3356768 - DNA, 22 bp, Homo sapiens
agttattgtacagctgtttaag

SEQ ID NO: 3356769 - DNA, 14 bp, Homo sapiens
agttatttactttt

SEQ ID NO: 3356770 - DNA, 18 bp, Homo sapiens
agttatttacttttacca

SEQ ID NO: 3356771 - DNA, 21 bp, Homo sapiens
agttattttatgacatgaaaa

SEQ ID NO: 3356772 - DNA, 18 bp, Homo sapiens
agttattttggatatatt

SEQ ID NO: 3356773 - DNA, 15 bp, Homo sapiens
agttatttttgtaca

SEQ ID NO: 3356774 - DNA, 17 bp, Homo sapiens
agttatttttgtacatg

SEQ ID NO: 3356775 - DNA, 18 bp, Homo sapiens
agttatttttgtacatgt

SEQ ID NO: 3356776 - DNA, 12 bp, Homo sapiens
ataaagagaaaa

SEQ ID NO: 3356777 - DNA, 14 bp, Homo sapiens
ataaagagaaaatg

SEQ ID NO: 3356778 - DNA, 22 bp, Homo sapiens
ataaagataacccttattccat

SEQ ID NO: 3356779 - DNA, 14 bp, Homo sapiens
ataaagatatatag

SEQ ID NO: 3356780 - DNA, 21 bp, Homo sapiens
ataaagatatatagagatgca

SEQ ID NO: 3356781 - DNA, 16 bp, Homo sapiens
ataaagatattgttca

SEQ ID NO: 3356782 - DNA, 12 bp, Homo sapiens
ataaagatgagt

SEQ ID NO: 3356783 - DNA, 19 bp, Homo sapiens
ataaagatgatctactcag

SEQ ID NO: 3356784 - DNA, 20 bp, Homo sapiens
ataaagatgatctactcaga

SEQ ID NO: 3356785 - DNA, 23 bp, Homo sapiens
ataaagatgatctactcagaaat

SEQ ID NO: 3356786 - DNA, 18 bp, Homo sapiens
ataaagattatataaaga

SEQ ID NO: 3356787 - DNA, 20 bp, Homo sapiens
ataaagattatataaagacc

SEQ ID NO: 3356788 - DNA, 14 bp, Homo sapiens
ataaagattgtact

SEQ ID NO: 3356789 - DNA, 14 bp, Homo sapiens
ataaagcacagctg

SEQ ID NO: 3356790 - DNA, 22 bp, Homo sapiens
ataaagcagcctcattctgagg

SEQ ID NO: 3356791 - DNA, 21 bp, Homo sapiens
ataaagcataagtatacagtt

SEQ ID NO: 3356792 - DNA, 11 bp, Homo sapiens
ataaagcattc

SEQ ID NO: 3356793 - DNA, 16 bp, Homo sapiens
ataaagcattctttaa

SEQ ID NO: 3356794 - DNA, 21 bp, Homo sapiens
ataaagcctcaaggttttagg

SEQ ID NO: 3356795 - DNA, 16 bp, Homo sapiens
ataaagcttttggaag

SEQ ID NO: 3356796 - DNA, 15 bp, Homo sapiens
ataaaggataactct

SEQ ID NO: 3356797 - DNA, 14 bp, Homo sapiens
ataaaggatgtgat

SEQ ID NO: 3356798 - DNA, 18 bp, Homo sapiens
ataaaggcagctgcctct

SEQ ID NO: 3356799 - DNA, 21 bp, Homo sapiens
ataaaggcagctgcctctgct

SEQ ID NO: 3356800 - DNA, 18 bp, Homo sapiens
ataaaggcagttttctaa

SEQ ID NO: 3356801 - DNA, 19 bp, Homo sapiens
ataaaggccccaaatacca

SEQ ID NO: 3356802 - DNA, 13 bp, Homo sapiens
ataaagggaagaa

SEQ ID NO: 3356803 - DNA, 13 bp, Homo sapiens
ataaagtatatat

SEQ ID NO: 3356804 - DNA, 19 bp, Homo sapiens
ataaagtattgtctaccag

SEQ ID NO: 3356805 - DNA, 14 bp, Homo sapiens
ataaagtgccttct

SEQ ID NO: 3356806 - DNA, 14 bp, Homo sapiens
ataaagtgtaacaa

SEQ ID NO: 3356807 - DNA, 17 bp, Homo sapiens
ataaagtgttttcagag

SEQ ID NO: 3356808 - DNA, 15 bp, Homo sapiens
ataaataaaactgaa

SEQ ID NO: 3356809 - DNA, 19 bp, Homo sapiens
ataaataaaattcatttct

SEQ ID NO: 3356810 - DNA, 13 bp, Homo sapiens
ataaataaatatt

SEQ ID NO: 3356811 - DNA, 21 bp, Homo sapiens
ataaatagctatatccatgta

SEQ ID NO: 3356812 - DNA, 15 bp, Homo sapiens
ataaatataagcctt

SEQ ID NO: 3356813 - DNA, 23 bp, Homo sapiens
ataaatatataaaaagaaaagat

SEQ ID NO: 3356814 - DNA, 21 bp, Homo sapiens
ataaatatatataaagaatat

SEQ ID NO: 3356815 - DNA, 15 bp, Homo sapiens
ataaatatatatgat

SEQ ID NO: 3356816 - DNA, 13 bp, Homo sapiens
ataaatatatcta

SEQ ID NO: 3356817 - DNA, 17 bp, Homo sapiens
ataaatatatttaactt

SEQ ID NO: 3356818 - DNA, 22 bp, Homo sapiens
ataaatatttggtaattctgtg

SEQ ID NO: 3356819 - DNA, 18 bp, Homo sapiens
ataaatatttttggggca

SEQ ID NO: 3356820 - DNA, 20 bp, Homo sapiens
ataaatatttttggggcatc

SEQ ID NO: 3356821 - DNA, 14 bp, Homo sapiens
ataaatcaatgtca

SEQ ID NO: 3356822 - DNA, 20 bp, Homo sapiens
ataaatcagagagcaaggca

SEQ ID NO: 3356823 - DNA, 15 bp, Homo sapiens
ataaatcagtatttt

SEQ ID NO: 3356824 - DNA, 18 bp, Homo sapiens
ataaatcataaagtcagt

SEQ ID NO: 3356825 - DNA, 14 bp, Homo sapiens
ataaatcatattga

SEQ ID NO: 3356826 - DNA, 21 bp, Homo sapiens
ataaatcatattgatgaaaag

SEQ ID NO: 3356827 - DNA, 18 bp, Homo sapiens
ataaatccagttctacta

SEQ ID NO: 3356828 - DNA, 13 bp, Homo sapiens
ataaatcttaaaa

SEQ ID NO: 3356829 - DNA, 15 bp, Homo sapiens
ataaatctttggaaa

SEQ ID NO: 3356830 - DNA, 14 bp, Homo sapiens
ataaatgaataaat

SEQ ID NO: 3356831 - DNA, 14 bp, Homo sapiens
ataaatgcctttat

SEQ ID NO: 3356832 - DNA, 16 bp, Homo sapiens
ataaatgcctttatat

SEQ ID NO: 3356833 - DNA, 14 bp, Homo sapiens
ataaatggaaatca

SEQ ID NO: 3356834 - DNA, 16 bp, Homo sapiens
ataaatggctggtttt

SEQ ID NO: 3356835 - DNA, 13 bp, Homo sapiens
ataaatggtttct

SEQ ID NO: 3356836 - DNA, 15 bp, Homo sapiens
ataaatgtatataca

SEQ ID NO: 3356837 - DNA, 17 bp, Homo sapiens
ataaatgtatatacaca

SEQ ID NO: 3356838 - DNA, 20 bp, Homo sapiens
ataaatgtatatacacatat

SEQ ID NO: 3356839 - DNA, 22 bp, Homo sapiens
ataaatgtattcaaataccaat

SEQ ID NO: 3356840 - DNA, 13 bp, Homo sapiens
ataaatgtgttcc

SEQ ID NO: 3356841 - DNA, 12 bp, Homo sapiens
ataaatgtttgt

SEQ ID NO: 3356842 - DNA, 11 bp, Homo sapiens
ataaattattt

SEQ ID NO: 3356843 - DNA, 18 bp, Homo sapiens
ataaattcctaaactccc

SEQ ID NO: 3356844 - DNA, 20 bp, Homo sapiens
ataaattctactaagttatt

SEQ ID NO: 3356845 - DNA, 17 bp, Homo sapiens
ataaattgcataaagca

SEQ ID NO: 3356846 - DNA, 13 bp, Homo sapiens
ataaattgctcct

SEQ ID NO: 3356847 - DNA, 16 bp, Homo sapiens
ataaattgctccttga

SEQ ID NO: 3356848 - DNA, 18 bp, Homo sapiens
ataaattggtgataagtg

SEQ ID NO: 3356849 - DNA, 19 bp, Homo sapiens
ataaattggtgataagtgg

SEQ ID NO: 3356850 - DNA, 22 bp, Homo sapiens
ataaattggtgataagtggaaa

SEQ ID NO: 3356851 - DNA, 17 bp, Homo sapiens
ataaattgtctttaaaa

SEQ ID NO: 3356852 - DNA, 21 bp, Homo sapiens
ataaattgtctttaaaaactg

SEQ ID NO: 3356853 - DNA, 22 bp, Homo sapiens
ataaattgtctttaaaaactgt

SEQ ID NO: 3356854 - DNA, 14 bp, Homo sapiens
ataaattgtttagt

SEQ ID NO: 3356855 - DNA, 22 bp, Homo sapiens
ataaattgtttagtggaaaata

SEQ ID NO: 3356856 - DNA, 20 bp, Homo sapiens
ataaattgtttggcttcctc

SEQ ID NO: 3356857 - DNA, 20 bp, Homo sapiens
ataaatttggttctaataga

SEQ ID NO: 3356858 - DNA, 13 bp, Homo sapiens
ataacaagaaaat

SEQ ID NO: 3356859 - DNA, 15 bp, Homo sapiens
ataacaatatataga

SEQ ID NO: 3356860 - DNA, 16 bp, Homo sapiens
ataacaatgtgctctc

SEQ ID NO: 3356861 - DNA, 22 bp, Homo sapiens
ataacaatgttaaggaaactct

SEQ ID NO: 3356862 - DNA, 11 bp, Homo sapiens
ataacacacat

SEQ ID NO: 3356863 - DNA, 13 bp, Homo sapiens
ataacacagagag

SEQ ID NO: 3356864 - DNA, 22 bp, Homo sapiens
ataacacagagagacagacttg

SEQ ID NO: 3356865 - DNA, 13 bp, Homo sapiens
ataacacattttt

SEQ ID NO: 3356866 - DNA, 23 bp, Homo sapiens
ataacactataaaggttgacaat

SEQ ID NO: 3356867 - DNA, 14 bp, Homo sapiens
ataacacttgtcag

SEQ ID NO: 3356868 - DNA, 16 bp, Homo sapiens
ataacagatcctttca

SEQ ID NO: 3356869 - DNA, 17 bp, Homo sapiens
ataacagatgtgaaaat

SEQ ID NO: 3356870 - DNA, 14 bp, Homo sapiens
ataacagctccttt

SEQ ID NO: 3356871 - DNA, 17 bp, Homo sapiens
ataacagctcctttatt

SEQ ID NO: 3356872 - DNA, 20 bp, Homo sapiens
ataacagtgcatattccttt

SEQ ID NO: 3356873 - DNA, 23 bp, Homo sapiens
ataacagtgccattgtctttata

SEQ ID NO: 3356874 - DNA, 19 bp, Homo sapiens
ataacagttatatttttgt

SEQ ID NO: 3356875 - DNA, 23 bp, Homo sapiens
ataacataacctcagagtatctt

SEQ ID NO: 3356876 - DNA, 18 bp, Homo sapiens
ataacatctttattgaaa

SEQ ID NO: 3356877 - DNA, 15 bp, Homo sapiens
ataacatgtaaaatc

SEQ ID NO: 3356878 - DNA, 13 bp, Homo sapiens
ataacatgtaatt

SEQ ID NO: 3356879 - DNA, 18 bp, Homo sapiens
ataacatgtaattaagta

SEQ ID NO: 3356880 - DNA, 11 bp, Homo sapiens
ataacattttc

SEQ ID NO: 3356881 - DNA, 14 bp, Homo sapiens
ataaccaagtgtgc

SEQ ID NO: 3356882 - DNA, 19 bp, Homo sapiens
ataaccaagtgtgctcttt

SEQ ID NO: 3356883 - DNA, 23 bp, Homo sapiens
ataaccacaaagcacagtttgaa

SEQ ID NO: 3356884 - DNA, 15 bp, Homo sapiens
ataacccacttgtca

SEQ ID NO: 3356885 - DNA, 18 bp, Homo sapiens
ataaccccattctttgct

SEQ ID NO: 3356886 - DNA, 15 bp, Homo sapiens
ataaccctaacacac

SEQ ID NO: 3356887 - DNA, 15 bp, Homo sapiens
ataacctagttaaag

SEQ ID NO: 3356888 - DNA, 20 bp, Homo sapiens
ataacctagttaaagaaagg

SEQ ID NO: 3356889 - DNA, 21 bp, Homo sapiens
ataacctcagagtatctttac

SEQ ID NO: 3356890 - DNA, 11 bp, Homo sapiens
ataacctctgg

SEQ ID NO: 3356891 - DNA, 17 bp, Homo sapiens
ataacctctggcccttg

SEQ ID NO: 3356892 - DNA, 19 bp, Homo sapiens
ataacctctggcccttgga

SEQ ID NO: 3356893 - DNA, 22 bp, Homo sapiens
ataacctgtctcacctggactt

SEQ ID NO: 3356894 - DNA, 13 bp, Homo sapiens
ataacgccccaga

SEQ ID NO: 3356895 - DNA, 21 bp, Homo sapiens
ataacgccccagataccagcc

SEQ ID NO: 3356896 - DNA, 13 bp, Homo sapiens
ataacgtttttcc

SEQ ID NO: 3356897 - DNA, 17 bp, Homo sapiens
ataacgtttttccttta

SEQ ID NO: 3356898 - DNA, 18 bp, Homo sapiens
ataacgtttttcctttaa

SEQ ID NO: 3356899 - DNA, 16 bp, Homo sapiens
ataactaaatttgata

SEQ ID NO: 3356900 - DNA, 19 bp, Homo sapiens
ataactaaatttgatactt

SEQ ID NO: 3356901 - DNA, 21 bp, Homo sapiens
ataactaaatttgatacttat

SEQ ID NO: 3356902 - DNA, 14 bp, Homo sapiens
atacttgactctaa

SEQ ID NO: 3356903 - DNA, 17 bp, Homo sapiens
atacttgccttctgata

SEQ ID NO: 3356904 - DNA, 23 bp, Homo sapiens
atacttgggtaagtcccccaggg

SEQ ID NO: 3356905 - DNA, 17 bp, Homo sapiens
atacttgtggttttcaa

SEQ ID NO: 3356906 - DNA, 19 bp, Homo sapiens
atacttgtggttttcaaat

SEQ ID NO: 3356907 - DNA, 17 bp, Homo sapiens
atacttgttccagatgg

SEQ ID NO: 3356908 - DNA, 13 bp, Homo sapiens
atactttatatct

SEQ ID NO: 3356909 - DNA, 15 bp, Homo sapiens
atactttatcaatgt

SEQ ID NO: 3356910 - DNA, 15 bp, Homo sapiens
atactttatttctga

SEQ ID NO: 3356911 - DNA, 20 bp, Homo sapiens
atactttcggagaaattctc

SEQ ID NO: 3356912 - DNA, 21 bp, Homo sapiens
atactttcggagaaattctct

SEQ ID NO: 3356913 - DNA, 15 bp, Homo sapiens
atactttctctctag

SEQ ID NO: 3356914 - DNA, 18 bp, Homo sapiens
atactttgcaatccaaat

SEQ ID NO: 3356915 - DNA, 13 bp, Homo sapiens
atactttgtattt

SEQ ID NO: 3356916 - DNA, 17 bp, Homo sapiens
atactttgtattttgat

SEQ ID NO: 3356917 - DNA, 13 bp, Homo sapiens
atactttgtctga

SEQ ID NO: 3356918 - DNA, 16 bp, Homo sapiens
atactttgtggaccaa

SEQ ID NO: 3356919 - DNA, 24 bp, Homo sapiens
atactttgtggaccaattattgat

SEQ ID NO: 3356920 - DNA, 19 bp, Homo sapiens
atacttttcccctgttaaa

SEQ ID NO: 3356921 - DNA, 20 bp, Homo sapiens
atacttttcccctgttaaac

SEQ ID NO: 3356922 - DNA, 11 bp, Homo sapiens
atacttttgca

SEQ ID NO: 3356923 - DNA, 13 bp, Homo sapiens
atactttttacaa

SEQ ID NO: 3356924 - DNA, 15 bp, Homo sapiens
atactttttttcaca

SEQ ID NO: 3356925 - DNA, 21 bp, Homo sapiens
atacttttttttctttaaaaa

SEQ ID NO: 3356926 - DNA, 10 bp, Homo sapiens
atagaaaaat

SEQ ID NO: 3356927 - DNA, 23 bp, Homo sapiens
atagaaaaattcagcaaaccatt

SEQ ID NO: 3356928 - DNA, 12 bp, Homo sapiens
atagaaaaggaa

SEQ ID NO: 3356929 - DNA, 22 bp, Homo sapiens
atagaaaaggaagacagcattt

SEQ ID NO: 3356930 - DNA, 21 bp, Homo sapiens
atagaaaagtagacaatcatt

SEQ ID NO: 3356931 - DNA, 11 bp, Homo sapiens
atagaaacatg

SEQ ID NO: 3356932 - DNA, 13 bp, Homo sapiens
atagaaacatgac

SEQ ID NO: 3356933 - DNA, 16 bp, Homo sapiens
atagaaacatgacact

SEQ ID NO: 3356934 - DNA, 12 bp, Homo sapiens
atagaaaggaac

SEQ ID NO: 3356935 - DNA, 13 bp, Homo sapiens
atagaaaggaaca

SEQ ID NO: 3356936 - DNA, 19 bp, Homo sapiens
atagaaagttgatattcaa

SEQ ID NO: 3356937 - DNA, 20 bp, Homo sapiens
atagaaagttgatattcaac

SEQ ID NO: 3356938 - DNA, 22 bp, Homo sapiens
atagaaataaaggatgtgattg

SEQ ID NO: 3356939 - DNA, 14 bp, Homo sapiens
atagaaataaattc

SEQ ID NO: 3356940 - DNA, 19 bp, Homo sapiens
atagaaataagtggttatt

SEQ ID NO: 3356941 - DNA, 20 bp, Homo sapiens
atagaaatatagccaaaaat

SEQ ID NO: 3356942 - DNA, 20 bp, Homo sapiens
atagaaatggaaattttgct

SEQ ID NO: 3356943 - DNA, 21 bp, Homo sapiens
atagaactcagttttaactag

SEQ ID NO: 3356944 - DNA, 16 bp, Homo sapiens
atagaactgggtaaat

SEQ ID NO: 3356945 - DNA, 13 bp, Homo sapiens
atagaagctgtag

SEQ ID NO: 3356946 - DNA, 16 bp, Homo sapiens
atagaagctgtagtag

SEQ ID NO: 3356947 - DNA, 17 bp, Homo sapiens
atagaaggaatttgtac

SEQ ID NO: 3356948 - DNA, 18 bp, Homo sapiens
atagaaggaatttgtact

SEQ ID NO: 3356949 - DNA, 21 bp, Homo sapiens
atagaaggaatttgtacttct

SEQ ID NO: 3356950 - DNA, 12 bp, Homo sapiens
atagaataaagg

SEQ ID NO: 3356951 - DNA, 17 bp, Homo sapiens
atagaataaaggcagtt

SEQ ID NO: 3356952 - DNA, 19 bp, Homo sapiens
atagaatataattatcgga

SEQ ID NO: 3356953 - DNA, 12 bp, Homo sapiens
atagaatattta

SEQ ID NO: 3356954 - DNA, 19 bp, Homo sapiens
atagaatatttattacctc

SEQ ID NO: 3356955 - DNA, 16 bp, Homo sapiens
atagaatgttactttg

SEQ ID NO: 3356956 - DNA, 14 bp, Homo sapiens
atagaatttccaat

SEQ ID NO: 3356957 - DNA, 19 bp, Homo sapiens
atagacaaatagaaaatgg

SEQ ID NO: 3356958 - DNA, 20 bp, Homo sapiens
atagacagtaacggtgttta

SEQ ID NO: 3356959 - DNA, 20 bp, Homo sapiens
atagacagtatatttatagt

SEQ ID NO: 3356960 - DNA, 18 bp, Homo sapiens
atagactggaaaaaatga

SEQ ID NO: 3356961 - DNA, 14 bp, Homo sapiens
atagagaataaggc

SEQ ID NO: 3356962 - DNA, 15 bp, Homo sapiens
atagagatgcattca

SEQ ID NO: 3356963 - DNA, 15 bp, Homo sapiens
atagagcaaaattga

SEQ ID NO: 3356964 - DNA, 15 bp, Homo sapiens
atagagccctggcca

SEQ ID NO: 3356965 - DNA, 18 bp, Homo sapiens
atagagcttttaaaaatg

SEQ ID NO: 3356966 - DNA, 12 bp, Homo sapiens
atagaggaagaa

SEQ ID NO: 3356967 - DNA, 22 bp, Homo sapiens
atagaggcttctccgccagcct

SEQ ID NO: 3356968 - DNA, 23 bp, Homo sapiens
atagaggcttctccgccagcctc

SEQ ID NO: 3356969 - DNA, 19 bp, Homo sapiens
atagaggtatattggaaga

SEQ ID NO: 3356970 - DNA, 15 bp, Homo sapiens
atagagtatatgcac

SEQ ID NO: 3356971 - DNA, 15 bp, Homo sapiens
atagagtttgctatt

SEQ ID NO: 3356972 - DNA, 19 bp, Homo sapiens
atagagtttggtgtcaact

SEQ ID NO: 3356973 - DNA, 21 bp, Homo sapiens
atagataccctacgctgtcca

SEQ ID NO: 3356974 - DNA, 14 bp, Homo sapiens
atagatataatgaa

SEQ ID NO: 3356975 - DNA, 21 bp, Homo sapiens
atagatcttctgaaatgaaac

SEQ ID NO: 3356976 - DNA, 16 bp, Homo sapiens
atagatgcaagatatt

SEQ ID NO: 3356977 - DNA, 19 bp, Homo sapiens
atagatgtccctttcttgg

SEQ ID NO: 3356978 - DNA, 23 bp, Homo sapiens
atagatgtccctttcttggccag

SEQ ID NO: 3356979 - DNA, 18 bp, Homo sapiens
atagatgtctaggtactt

SEQ ID NO: 3356980 - DNA, 22 bp, Homo sapiens
atagatgttttggtagattaaa

SEQ ID NO: 3356981 - DNA, 23 bp, Homo sapiens
atagatgttttggtagattaaat

SEQ ID NO: 3356982 - DNA, 19 bp, Homo sapiens
atagattaatggcactgat

SEQ ID NO: 3356983 - DNA, 21 bp, Homo sapiens
atagattagaaaaattcctaa

SEQ ID NO: 3356984 - DNA, 19 bp, Homo sapiens
atagattctcttgtataag

SEQ ID NO: 3356985 - DNA, 13 bp, Homo sapiens
atagatttggaat

SEQ ID NO: 3356986 - DNA, 18 bp, Homo sapiens
atagcaacaacaattggt

SEQ ID NO: 3356987 - DNA, 19 bp, Homo sapiens
atagcaacaacaattggta

SEQ ID NO: 3356988 - DNA, 21 bp, Homo sapiens
atagcaagatattgatcaaat

SEQ ID NO: 3356989 - DNA, 12 bp, Homo sapiens
atagcactttga

SEQ ID NO: 3356990 - DNA, 13 bp, Homo sapiens
atagcagaggggc

SEQ ID NO: 3356991 - DNA, 23 bp, Homo sapiens
atagcagaggggccaggcccagg

SEQ ID NO: 3356992 - DNA, 21 bp, Homo sapiens
atagcagagtccttattcttc

SEQ ID NO: 3356993 - DNA, 19 bp, Homo sapiens
atagcagatctgttttgtg

SEQ ID NO: 3356994 - DNA, 19 bp, Homo sapiens
atagcagcaaaaatataaa

SEQ ID NO: 3356995 - DNA, 17 bp, Homo sapiens
atagcagccagttcaaa

SEQ ID NO: 3356996 - DNA, 22 bp, Homo sapiens
atagcagtatatgttaatttgt

SEQ ID NO: 3356997 - DNA, 18 bp, Homo sapiens
atagcagttataacagat

SEQ ID NO: 3356998 - DNA, 17 bp, Homo sapiens
atagcattgataatctt

SEQ ID NO: 3356999 - DNA, 19 bp, Homo sapiens
atagcattgataatcttca

SEQ ID NO: 3357000 - DNA, 22 bp, Homo sapiens
atagccaactgctaatgcaaat

SEQ ID NO: 3357001 - DNA, 16 bp, Homo sapiens
atagccacatttggaa

SEQ ID NO: 3357002 - DNA, 16 bp, Homo sapiens
atagccagagaggagc

SEQ ID NO: 3357003 - DNA, 17 bp, Homo sapiens
atagcctccacggagag

SEQ ID NO: 3357004 - DNA, 20 bp, Homo sapiens
atagcgggttactttcacat

SEQ ID NO: 3357005 - DNA, 20 bp, Homo sapiens
atagcgtgggttatcagtta

SEQ ID NO: 3357006 - DNA, 23 bp, Homo sapiens
atagctaacattttaaataaaag

SEQ ID NO: 3357007 - DNA, 16 bp, Homo sapiens
atagctaactgtaaat

SEQ ID NO: 3357008 - DNA, 17 bp, Homo sapiens
atagctaactgtaaatc

SEQ ID NO: 3357009 - DNA, 16 bp, Homo sapiens
atagctacaggaagca

SEQ ID NO: 3357010 - DNA, 14 bp, Homo sapiens
atagctacccaaaa

SEQ ID NO: 3357011 - DNA, 22 bp, Homo sapiens
atagctattactgtctggtttt

SEQ ID NO: 3357012 - DNA, 19 bp, Homo sapiens
atagctcaggtgtccctgc

SEQ ID NO: 3357013 - DNA, 22 bp, Homo sapiens
atagctcaggtgtccctgcact

SEQ ID NO: 3357014 - DNA, 22 bp, Homo sapiens
atagctcagtttatccaaggtg

SEQ ID NO: 3357015 - DNA, 23 bp, Homo sapiens
atagctccccgcttctgcctgca

SEQ ID NO: 3357016 - DNA, 14 bp, Homo sapiens
atagctcctctccc

SEQ ID NO: 3357017 - DNA, 12 bp, Homo sapiens
atagctctgggg

SEQ ID NO: 3357018 - DNA, 12 bp, Homo sapiens
atagctgggact

SEQ ID NO: 3357019 - DNA, 22 bp, Homo sapiens
atagctgtacttcttgaatata

SEQ ID NO: 3357020 - DNA, 21 bp, Homo sapiens
atagctttattttttaagtat

SEQ ID NO: 3357021 - DNA, 23 bp, Homo sapiens
atagctttattttttaagtattt

SEQ ID NO: 3357022 - DNA, 13 bp, Homo sapiens
ataggaattcatc

SEQ ID NO: 3357023 - DNA, 22 bp, Homo sapiens
ataggagaagaggcatcctgcc

SEQ ID NO: 3357024 - DNA, 12 bp, Homo sapiens
ataggagactgc

SEQ ID NO: 3357025 - DNA, 23 bp, Homo sapiens
ataggagagattgggagaaatca

SEQ ID NO: 3357026 - DNA, 14 bp, Homo sapiens
ataggagaggatga

SEQ ID NO: 3357027 - DNA, 20 bp, Homo sapiens
atatgaacatattgttgaaa

SEQ ID NO: 3357028 - DNA, 21 bp, Homo sapiens
atatgaacctattttcatttg

SEQ ID NO: 3357029 - DNA, 23 bp, Homo sapiens
atatgaacctattttcatttgta

SEQ ID NO: 3357030 - DNA, 14 bp, Homo sapiens
atatgaattgtaca

SEQ ID NO: 3357031 - DNA, 17 bp, Homo sapiens
atatgacacaaaggtgg

SEQ ID NO: 3357032 - DNA, 16 bp, Homo sapiens
atatgacggaagaaca

SEQ ID NO: 3357033 - DNA, 23 bp, Homo sapiens
atatgacggaagaacatagaact

SEQ ID NO: 3357034 - DNA, 22 bp, Homo sapiens
atatgagcttccttctgtgaaa

SEQ ID NO: 3357035 - DNA, 16 bp, Homo sapiens
atatgaggagacattc

SEQ ID NO: 3357036 - DNA, 14 bp, Homo sapiens
atatgagtatacaa

SEQ ID NO: 3357037 - DNA, 17 bp, Homo sapiens
atatgagtatacaatat

SEQ ID NO: 3357038 - DNA, 13 bp, Homo sapiens
atatgataaaaca

SEQ ID NO: 3357039 - DNA, 14 bp, Homo sapiens
atatgattatacaa

SEQ ID NO: 3357040 - DNA, 14 bp, Homo sapiens
atatgatttatagt

SEQ ID NO: 3357041 - DNA, 15 bp, Homo sapiens
atatgatttatatta

SEQ ID NO: 3357042 - DNA, 17 bp, Homo sapiens
atatgatttcactagaa

SEQ ID NO: 3357043 - DNA, 17 bp, Homo sapiens
atatgattttttaaaag

SEQ ID NO: 3357044 - DNA, 19 bp, Homo sapiens
atatgattttttaaaagaa

SEQ ID NO: 3357045 - DNA, 17 bp, Homo sapiens
atatgcaagcagctttt

SEQ ID NO: 3357046 - DNA, 15 bp, Homo sapiens
atatgcacaatagca

SEQ ID NO: 3357047 - DNA, 21 bp, Homo sapiens
atatgcaccttgtgtctgtac

SEQ ID NO: 3357048 - DNA, 21 bp, Homo sapiens
atatgcatctggcccaggaat

SEQ ID NO: 3357049 - DNA, 21 bp, Homo sapiens
atatgccctcaagtaaaagaa

SEQ ID NO: 3357050 - DNA, 15 bp, Homo sapiens
atatgctaatttggg

SEQ ID NO: 3357051 - DNA, 17 bp, Homo sapiens
atatgctaatttgggga

SEQ ID NO: 3357052 - DNA, 22 bp, Homo sapiens
atatgctccaggatctttgact

SEQ ID NO: 3357053 - DNA, 23 bp, Homo sapiens
atatgctctgcttttagttcata

SEQ ID NO: 3357054 - DNA, 18 bp, Homo sapiens
atatgcttaaaataagca

SEQ ID NO: 3357055 - DNA, 14 bp, Homo sapiens
atatgcttatacac

SEQ ID NO: 3357056 - DNA, 20 bp, Homo sapiens
atatgctttattaatgtttt

SEQ ID NO: 3357057 - DNA, 12 bp, Homo sapiens
atatggaacctt

SEQ ID NO: 3357058 - DNA, 16 bp, Homo sapiens
atatggactctgcaca

SEQ ID NO: 3357059 - DNA, 23 bp, Homo sapiens
atatggattttctattgttactc

SEQ ID NO: 3357060 - DNA, 13 bp, Homo sapiens
atatggcaagaaa

SEQ ID NO: 3357061 - DNA, 17 bp, Homo sapiens
atatggcaagaaagctg

SEQ ID NO: 3357062 - DNA, 15 bp, Homo sapiens
atatggcccagcctt

SEQ ID NO: 3357063 - DNA, 20 bp, Homo sapiens
atatgggtttataattttct

SEQ ID NO: 3357064 - DNA, 17 bp, Homo sapiens
atatgtacaattgtggg

SEQ ID NO: 3357065 - DNA, 14 bp, Homo sapiens
atatgtacataaat

SEQ ID NO: 3357066 - DNA, 14 bp, Homo sapiens
atatgtacatgaga

SEQ ID NO: 3357067 - DNA, 14 bp, Homo sapiens
atatgtaccatgta

SEQ ID NO: 3357068 - DNA, 17 bp, Homo sapiens
atatgtagactatatac

SEQ ID NO: 3357069 - DNA, 21 bp, Homo sapiens
atatgtagactatatacatgt

SEQ ID NO: 3357070 - DNA, 21 bp, Homo sapiens
atatgtatatatatatatgca

SEQ ID NO: 3357071 - DNA, 22 bp, Homo sapiens
atatgtatatcattctacagaa

SEQ ID NO: 3357072 - DNA, 10 bp, Homo sapiens
atatgtatgc

SEQ ID NO: 3357073 - DNA, 14 bp, Homo sapiens
atatgtatgctttt

SEQ ID NO: 3357074 - DNA, 22 bp, Homo sapiens
atatgtattatttataattcct

SEQ ID NO: 3357075 - DNA, 23 bp, Homo sapiens
atatgtattatttataattccta

SEQ ID NO: 3357076 - DNA, 16 bp, Homo sapiens
atatgtattcccttgt

SEQ ID NO: 3357077 - DNA, 19 bp, Homo sapiens
atatgtattcccttgtatt

SEQ ID NO: 3357078 - DNA, 21 bp, Homo sapiens
atatgtattgtaaacatgtgt

SEQ ID NO: 3357079 - DNA, 14 bp, Homo sapiens
atatgtcaagccat

SEQ ID NO: 3357080 - DNA, 18 bp, Homo sapiens
atatgtccttgggttgct

SEQ ID NO: 3357081 - DNA, 15 bp, Homo sapiens
atatgtctgataatg

SEQ ID NO: 3357082 - DNA, 21 bp, Homo sapiens
atatgtgacactgcagcagaa

SEQ ID NO: 3357083 - DNA, 18 bp, Homo sapiens
atatgtgtatatatacat

SEQ ID NO: 3357084 - DNA, 21 bp, Homo sapiens
atatgtgtatatatacataca

SEQ ID NO: 3357085 - DNA, 20 bp, Homo sapiens
atatgtgtgtgtatgtttgc

SEQ ID NO: 3357086 - DNA, 16 bp, Homo sapiens
atatgttaatttgtgt

SEQ ID NO: 3357087 - DNA, 15 bp, Homo sapiens
atatgttgaatactt

SEQ ID NO: 3357088 - DNA, 13 bp, Homo sapiens
atatgtttacaca

SEQ ID NO: 3357089 - DNA, 16 bp, Homo sapiens
atatgtttacacaatt

SEQ ID NO: 3357090 - DNA, 15 bp, Homo sapiens
atatgtttatatact

SEQ ID NO: 3357091 - DNA, 20 bp, Homo sapiens
atatgtttccttgtttatca

SEQ ID NO: 3357092 - DNA, 17 bp, Homo sapiens
atattaaaaaacttcat

SEQ ID NO: 3357093 - DNA, 24 bp, Homo sapiens
atattaaaaaacttcatgtaattt

SEQ ID NO: 3357094 - DNA, 17 bp, Homo sapiens
atattaaaattacagat

SEQ ID NO: 3357095 - DNA, 18 bp, Homo sapiens
atattaaaattacagatg

SEQ ID NO: 3357096 - DNA, 15 bp, Homo sapiens
atattaaaattccaa

SEQ ID NO: 3357097 - DNA, 21 bp, Homo sapiens
atattaaaattccaaattcat

SEQ ID NO: 3357098 - DNA, 22 bp, Homo sapiens
atattaaaattccaaattcatg

SEQ ID NO: 3357099 - DNA, 18 bp, Homo sapiens
atattaaataaatgtgca

SEQ ID NO: 3357100 - DNA, 12 bp, Homo sapiens
atattaaataca

SEQ ID NO: 3357101 - DNA, 14 bp, Homo sapiens
atattaaattctca

SEQ ID NO: 3357102 - DNA, 19 bp, Homo sapiens
atattaaattctcaaagtt

SEQ ID NO: 3357103 - DNA, 17 bp, Homo sapiens
atattaagaaagactat

SEQ ID NO: 3357104 - DNA, 22 bp, Homo sapiens
atattaagaaagactatctaaa

SEQ ID NO: 3357105 - DNA, 13 bp, Homo sapiens
atattaagacagt

SEQ ID NO: 3357106 - DNA, 13 bp, Homo sapiens
atattaagcactt

SEQ ID NO: 3357107 - DNA, 15 bp, Homo sapiens
atattaagcacttta

SEQ ID NO: 3357108 - DNA, 17 bp, Homo sapiens
atattaataaaacttta

SEQ ID NO: 3357109 - DNA, 12 bp, Homo sapiens
atattaatcaaa

SEQ ID NO: 3357110 - DNA, 19 bp, Homo sapiens
atattaatcaaaattgtct

SEQ ID NO: 3357111 - DNA, 22 bp, Homo sapiens
atattaatcaccttctttgtaa

SEQ ID NO: 3357112 - DNA, 12 bp, Homo sapiens
atattaatgtac

SEQ ID NO: 3357113 - DNA, 18 bp, Homo sapiens
atattaatgtacttgttt

SEQ ID NO: 3357114 - DNA, 16 bp, Homo sapiens
atattacacatttgta

SEQ ID NO: 3357115 - DNA, 19 bp, Homo sapiens
atattaccaaaaaagtatt

SEQ ID NO: 3357116 - DNA, 15 bp, Homo sapiens
atattacctcaaatt

SEQ ID NO: 3357117 - DNA, 23 bp, Homo sapiens
atattactctcaaaatctttgta

SEQ ID NO: 3357118 - DNA, 14 bp, Homo sapiens
atattactgacatt

SEQ ID NO: 3357119 - DNA, 16 bp, Homo sapiens
atattactgacatttc

SEQ ID NO: 3357120 - DNA, 13 bp, Homo sapiens
atattactgtctt

SEQ ID NO: 3357121 - DNA, 20 bp, Homo sapiens
atattactgtctttattctt

SEQ ID NO: 3357122 - DNA, 21 bp, Homo sapiens
atattactgtctttattctta

SEQ ID NO: 3357123 - DNA, 19 bp, Homo sapiens
atattactgtcttttctat

SEQ ID NO: 3357124 - DNA, 22 bp, Homo sapiens
atattactgtcttttctattaa

SEQ ID NO: 3357125 - DNA, 18 bp, Homo sapiens
atattactgttgcattta

SEQ ID NO: 3357126 - DNA, 20 bp, Homo sapiens
atattactgttgcatttact

SEQ ID NO: 3357127 - DNA, 21 bp, Homo sapiens
atattactgtttatttctgtt

SEQ ID NO: 3357128 - DNA, 14 bp, Homo sapiens
atattactttatca

SEQ ID NO: 3357129 - DNA, 16 bp, Homo sapiens
atattactttatcact

SEQ ID NO: 3357130 - DNA, 17 bp, Homo sapiens
atattactttatcactt

SEQ ID NO: 3357131 - DNA, 15 bp, Homo sapiens
atattaggaaaatat

SEQ ID NO: 3357132 - DNA, 22 bp, Homo sapiens
atattaggatctgcaaacaatg

SEQ ID NO: 3357133 - DNA, 19 bp, Homo sapiens
atattaggggggaaagtca

SEQ ID NO: 3357134 - DNA, 16 bp, Homo sapiens
atattagtgattctga

SEQ ID NO: 3357135 - DNA, 17 bp, Homo sapiens
atattataacttaaaaa

SEQ ID NO: 3357136 - DNA, 17 bp, Homo sapiens
atattataagggagagc

SEQ ID NO: 3357137 - DNA, 22 bp, Homo sapiens
atattataagggagagctgagc

SEQ ID NO: 3357138 - DNA, 12 bp, Homo sapiens
atattatgtctt

SEQ ID NO: 3357139 - DNA, 14 bp, Homo sapiens
atattatgtcttct

SEQ ID NO: 3357140 - DNA, 13 bp, Homo sapiens
atattatgtgaag

SEQ ID NO: 3357141 - DNA, 16 bp, Homo sapiens
atattattatatatat

SEQ ID NO: 3357142 - DNA, 13 bp, Homo sapiens
atattattgtaag

SEQ ID NO: 3357143 - DNA, 14 bp, Homo sapiens
atattatttggcag

SEQ ID NO: 3357144 - DNA, 19 bp, Homo sapiens
atattatttggcagtttgg

SEQ ID NO: 3357145 - DNA, 15 bp, Homo sapiens
atattcacatgttct

SEQ ID NO: 3357146 - DNA, 19 bp, Homo sapiens
atattcaggagttggaatg

SEQ ID NO: 3357147 - DNA, 19 bp, Homo sapiens
atattcagggtaaatagga

SEQ ID NO: 3357148 - DNA, 18 bp, Homo sapiens
atattcatgcttcttcct

SEQ ID NO: 3357149 - DNA, 19 bp, Homo sapiens
atattcatgtaaacaaaat

SEQ ID NO: 3357150 - DNA, 22 bp, Homo sapiens
atattcatgtaaacaaaattta

SEQ ID NO: 3357151 - DNA, 15 bp, Homo sapiens
atattccagatcttt

SEQ ID NO: 3357152 - DNA, 17 bp, Homo sapiens
atattccagatctttca

SEQ ID NO: 3357153 - DNA, 23 bp, Homo sapiens
atccaaaatgtgtatttcttata

SEQ ID NO: 3357154 - DNA, 21 bp, Homo sapiens
atccaaacatgtatttatgta

SEQ ID NO: 3357155 - DNA, 20 bp, Homo sapiens
atccaaacttggatttttga

SEQ ID NO: 3357156 - DNA, 20 bp, Homo sapiens
atccaaagaacttgatttgc

SEQ ID NO: 3357157 - DNA, 23 bp, Homo sapiens
atccaaagaacttgatttgcatg

SEQ ID NO: 3357158 - DNA, 23 bp, Homo sapiens
atccaaagactgtactggccagt

SEQ ID NO: 3357159 - DNA, 14 bp, Homo sapiens
atccaaataaagat

SEQ ID NO: 3357160 - DNA, 12 bp, Homo sapiens
atccaaatctag

SEQ ID NO: 3357161 - DNA, 21 bp, Homo sapiens
atccaaatcttgaatttctgc

SEQ ID NO: 3357162 - DNA, 15 bp, Homo sapiens
atccaacacaactat

SEQ ID NO: 3357163 - DNA, 18 bp, Homo sapiens
atccaactaatgccttac

SEQ ID NO: 3357164 - DNA, 14 bp, Homo sapiens
atccaagcctccac

SEQ ID NO: 3357165 - DNA, 16 bp, Homo sapiens
atccaagcctccacag

SEQ ID NO: 3357166 - DNA, 21 bp, Homo sapiens
atccaagcctccacagcgagg

SEQ ID NO: 3357167 - DNA, 15 bp, Homo sapiens
atccaagctccctgc

SEQ ID NO: 3357168 - DNA, 17 bp, Homo sapiens
atccaagctccctgccc

SEQ ID NO: 3357169 - DNA, 19 bp, Homo sapiens
atccaagctccctgcccca

SEQ ID NO: 3357170 - DNA, 21 bp, Homo sapiens
atccaagctggtcccactcag

SEQ ID NO: 3357171 - DNA, 20 bp, Homo sapiens
atccaaggcagggaaaggaa

SEQ ID NO: 3357172 - DNA, 14 bp, Homo sapiens
atccaagtaccaat

SEQ ID NO: 3357173 - DNA, 20 bp, Homo sapiens
atccaagtaccaatgctgtt

SEQ ID NO: 3357174 - DNA, 15 bp, Homo sapiens
atccaataatcagaa

SEQ ID NO: 3357175 - DNA, 15 bp, Homo sapiens
atccacacacagagg

SEQ ID NO: 3357176 - DNA, 17 bp, Homo sapiens
atccacagagagtccca

SEQ ID NO: 3357177 - DNA, 21 bp, Homo sapiens
atccacagagagtcccactgc

SEQ ID NO: 3357178 - DNA, 15 bp, Homo sapiens
atccacccagtgctg

SEQ ID NO: 3357179 - DNA, 18 bp, Homo sapiens
atccacccagtgctgcca

SEQ ID NO: 3357180 - DNA, 22 bp, Homo sapiens
atccacccagtgctgccatgcc

SEQ ID NO: 3357181 - DNA, 21 bp, Homo sapiens
atccacccgggggagcccagt

SEQ ID NO: 3357182 - DNA, 23 bp, Homo sapiens
atccacccgggggagcccagtga

SEQ ID NO: 3357183 - DNA, 14 bp, Homo sapiens
atccacctcggagc

SEQ ID NO: 3357184 - DNA, 19 bp, Homo sapiens
atccacctcggagcatggt

SEQ ID NO: 3357185 - DNA, 13 bp, Homo sapiens
atccacctgtctc

SEQ ID NO: 3357186 - DNA, 21 bp, Homo sapiens
atccacctgtctcagcctccc

SEQ ID NO: 3357187 - DNA, 22 bp, Homo sapiens
atccactctaccctcccacccc

SEQ ID NO: 3357188 - DNA, 23 bp, Homo sapiens
atccactctaccctcccaccccc

SEQ ID NO: 3357189 - DNA, 21 bp, Homo sapiens
atccactgtgccatgtgccag

SEQ ID NO: 3357190 - DNA, 13 bp, Homo sapiens
atccagaaagaaa

SEQ ID NO: 3357191 - DNA, 14 bp, Homo sapiens
atccagaaagaaaa

SEQ ID NO: 3357192 - DNA, 18 bp, Homo sapiens
atccagacatcatgaatt

SEQ ID NO: 3357193 - DNA, 15 bp, Homo sapiens
atccagacccggctg

SEQ ID NO: 3357194 - DNA, 12 bp, Homo sapiens
atccagactgta

SEQ ID NO: 3357195 - DNA, 11 bp, Homo sapiens
atccagagcag

SEQ ID NO: 3357196 - DNA, 14 bp, Homo sapiens
atccagagcagagt

SEQ ID NO: 3357197 - DNA, 22 bp, Homo sapiens
atccagagtttagaggaaaaaa

SEQ ID NO: 3357198 - DNA, 11 bp, Homo sapiens
atccagccact

SEQ ID NO: 3357199 - DNA, 13 bp, Homo sapiens
atccagcctgtgt

SEQ ID NO: 3357200 - DNA, 11 bp, Homo sapiens
atccagctccc

SEQ ID NO: 3357201 - DNA, 15 bp, Homo sapiens
atccagctccctaga

SEQ ID NO: 3357202 - DNA, 17 bp, Homo sapiens
atccagctccctagact

SEQ ID NO: 3357203 - DNA, 21 bp, Homo sapiens
atccagctccctagactgcat

SEQ ID NO: 3357204 - DNA, 23 bp, Homo sapiens
atccaggtcatgcagttcctggc

SEQ ID NO: 3357205 - DNA, 15 bp, Homo sapiens
atccaggttcagctt

SEQ ID NO: 3357206 - DNA, 16 bp, Homo sapiens
atccagtaggatccag

SEQ ID NO: 3357207 - DNA, 20 bp, Homo sapiens
atccagtattgctgatttta

SEQ ID NO: 3357208 - DNA, 21 bp, Homo sapiens
atccagtgatccttacaagtt

SEQ ID NO: 3357209 - DNA, 19 bp, Homo sapiens
atccagttataagaagaag

SEQ ID NO: 3357210 - DNA, 16 bp, Homo sapiens
atccataccagctcgc

SEQ ID NO: 3357211 - DNA, 16 bp, Homo sapiens
atccatagtagtatga

SEQ ID NO: 3357212 - DNA, 18 bp, Homo sapiens
atccatattgagtcaaat

SEQ ID NO: 3357213 - DNA, 16 bp, Homo sapiens
atccatccatctccag

SEQ ID NO: 3357214 - DNA, 22 bp, Homo sapiens
atccatgacaggcctgaagata

SEQ ID NO: 3357215 - DNA, 22 bp, Homo sapiens
atccatgacctagttttccatg

SEQ ID NO: 3357216 - DNA, 12 bp, Homo sapiens
atccatgtactg

SEQ ID NO: 3357217 - DNA, 18 bp, Homo sapiens
atccatgtactgtagttt

SEQ ID NO: 3357218 - DNA, 22 bp, Homo sapiens
atccatgtactgtagtttttct

SEQ ID NO: 3357219 - DNA, 20 bp, Homo sapiens
atccatgtgattaatgtttt

SEQ ID NO: 3357220 - DNA, 22 bp, Homo sapiens
atccatgtgattaatgttttca

SEQ ID NO: 3357221 - DNA, 20 bp, Homo sapiens
atccatgttagtttttactt

SEQ ID NO: 3357222 - DNA, 22 bp, Homo sapiens
atccattcacaagcctcctgta

SEQ ID NO: 3357223 - DNA, 13 bp, Homo sapiens
atccatttcccct

SEQ ID NO: 3357224 - DNA, 18 bp, Homo sapiens
atccatttcccctccttc

SEQ ID NO: 3357225 - DNA, 16 bp, Homo sapiens
atccatttgcctttct

SEQ ID NO: 3357226 - DNA, 15 bp, Homo sapiens
atcccaacagccatg

SEQ ID NO: 3357227 - DNA, 19 bp, Homo sapiens
atcccaaccagtgccaagg

SEQ ID NO: 3357228 - DNA, 20 bp, Homo sapiens
atcccaaccagtgccaagga

SEQ ID NO: 3357229 - DNA, 21 bp, Homo sapiens
atcccaatcaaagaattacag

SEQ ID NO: 3357230 - DNA, 14 bp, Homo sapiens
atcccaatctttct

SEQ ID NO: 3357231 - DNA, 17 bp, Homo sapiens
atcccaatctttctata

SEQ ID NO: 3357232 - DNA, 18 bp, Homo sapiens
atcccaatctttctatat

SEQ ID NO: 3357233 - DNA, 15 bp, Homo sapiens
atcccaattctgtcc

SEQ ID NO: 3357234 - DNA, 16 bp, Homo sapiens
atcccaattctgtccc

SEQ ID NO: 3357235 - DNA, 12 bp, Homo sapiens
atcccacacagg

SEQ ID NO: 3357236 - DNA, 13 bp, Homo sapiens
atcccacatccaa

SEQ ID NO: 3357237 - DNA, 16 bp, Homo sapiens
atcccacctagcccag

SEQ ID NO: 3357238 - DNA, 18 bp, Homo sapiens
atcccacctagcccagga

SEQ ID NO: 3357239 - DNA, 18 bp, Homo sapiens
atcccacctccatcccag

SEQ ID NO: 3357240 - DNA, 21 bp, Homo sapiens
atcccagcacctgcctcctcg

SEQ ID NO: 3357241 - DNA, 17 bp, Homo sapiens
atcccagcactttggga

SEQ ID NO: 3357242 - DNA, 15 bp, Homo sapiens
atcccagcagcccaa

SEQ ID NO: 3357243 - DNA, 18 bp, Homo sapiens
atcccagcagcccaagct

SEQ ID NO: 3357244 - DNA, 14 bp, Homo sapiens
atcccagccggcca

SEQ ID NO: 3357245 - DNA, 22 bp, Homo sapiens
atcccagccggccaatggaaac

SEQ ID NO: 3357246 - DNA, 24 bp, Homo sapiens
atcccagccggccaatggaaacct

SEQ ID NO: 3357247 - DNA, 13 bp, Homo sapiens
atcccagggctgg

SEQ ID NO: 3357248 - DNA, 16 bp, Homo sapiens
atcccagggctggctc

SEQ ID NO: 3357249 - DNA, 23 bp, Homo sapiens
atcccaggggaccacacctccct

SEQ ID NO: 3357250 - DNA, 16 bp, Homo sapiens
atcccatgagcctcag

SEQ ID NO: 3357251 - DNA, 18 bp, Homo sapiens
atcccatgagcctcagca

SEQ ID NO: 3357252 - DNA, 19 bp, Homo sapiens
atcccatgagcctcagcat

SEQ ID NO: 3357253 - DNA, 14 bp, Homo sapiens
atcccattcacttc

SEQ ID NO: 3357254 - DNA, 16 bp, Homo sapiens
atccccaagtgtgaac

SEQ ID NO: 3357255 - DNA, 17 bp, Homo sapiens
atccccaatcagctcct

SEQ ID NO: 3357256 - DNA, 13 bp, Homo sapiens
atccccaccccac

SEQ ID NO: 3357257 - DNA, 19 bp, Homo sapiens
atccccactgggaccaacc

SEQ ID NO: 3357258 - DNA, 15 bp, Homo sapiens
atccccatcctccag

SEQ ID NO: 3357259 - DNA, 15 bp, Homo sapiens
atccccatctccctg

SEQ ID NO: 3357260 - DNA, 18 bp, Homo sapiens
atccccatctccctgcct

SEQ ID NO: 3357261 - DNA, 14 bp, Homo sapiens
atcccccaggagaa

SEQ ID NO: 3357262 - DNA, 12 bp, Homo sapiens
atcccccaggga

SEQ ID NO: 3357263 - DNA, 20 bp, Homo sapiens
atccccccatcttgcttccc

SEQ ID NO: 3357264 - DNA, 14 bp, Homo sapiens
atcccctccttggg

SEQ ID NO: 3357265 - DNA, 15 bp, Homo sapiens
atcccctccttgggc

SEQ ID NO: 3357266 - DNA, 23 bp, Homo sapiens
atcccctcgtcctgtcccagagg

SEQ ID NO: 3357267 - DNA, 15 bp, Homo sapiens
atcccggaggaaatc

SEQ ID NO: 3357268 - DNA, 15 bp, Homo sapiens
atcccggcctcttcc

SEQ ID NO: 3357269 - DNA, 18 bp, Homo sapiens
atccctaatgtgtgccat

SEQ ID NO: 3357270 - DNA, 14 bp, Homo sapiens
atccctacatgtat

SEQ ID NO: 3357271 - DNA, 15 bp, Homo sapiens
atccctacatgtatt

SEQ ID NO: 3357272 - DNA, 17 bp, Homo sapiens
atccctatgggattcag

SEQ ID NO: 3357273 - DNA, 16 bp, Homo sapiens
atccctcaccttctga

SEQ ID NO: 3357274 - DNA, 16 bp, Homo sapiens
atccctccccagttca

SEQ ID NO: 3357275 - DNA, 13 bp, Homo sapiens
atccctccctccc

SEQ ID NO: 3357276 - DNA, 17 bp, Homo sapiens
atccctcgatattttta

SEQ ID NO: 3357277 - DNA, 20 bp, Homo sapiens
atccctcgatatttttaaag

SEQ ID NO: 3357278 - DNA, 18 bp, Homo sapiens
atccctcggaagccgtct

SEQ ID NO: 3357279 - DNA, 16 bp, Homo sapiens
atctggggctctggga

SEQ ID NO: 3357280 - DNA, 19 bp, Homo sapiens
atctgggttcactgcaacc

SEQ ID NO: 3357281 - DNA, 14 bp, Homo sapiens
atctggtgcctcct

SEQ ID NO: 3357282 - DNA, 12 bp, Homo sapiens
atctgtaatgat

SEQ ID NO: 3357283 - DNA, 18 bp, Homo sapiens
atctgtaatggtactgac

SEQ ID NO: 3357284 - DNA, 15 bp, Homo sapiens
atctgtacgtaagaa

SEQ ID NO: 3357285 - DNA, 14 bp, Homo sapiens
atctgtagggctgg

SEQ ID NO: 3357286 - DNA, 18 bp, Homo sapiens
atctgtataccctctgtt

SEQ ID NO: 3357287 - DNA, 22 bp, Homo sapiens
atctgtatataagttgctgtgt

SEQ ID NO: 3357288 - DNA, 15 bp, Homo sapiens
atctgtatttattat

SEQ ID NO: 3357289 - DNA, 15 bp, Homo sapiens
atctgtcaaaacact

SEQ ID NO: 3357290 - DNA, 22 bp, Homo sapiens
atctgtcaaaacactgtggaac

SEQ ID NO: 3357291 - DNA, 15 bp, Homo sapiens
atctgtcactgacct

SEQ ID NO: 3357292 - DNA, 15 bp, Homo sapiens
atctgtcattatatt

SEQ ID NO: 3357293 - DNA, 22 bp, Homo sapiens
atctgtcatttgagcagggctc

SEQ ID NO: 3357294 - DNA, 21 bp, Homo sapiens
atctgtccaaaggaggctggc

SEQ ID NO: 3357295 - DNA, 23 bp, Homo sapiens
atctgtccaaaggaggctggcag

SEQ ID NO: 3357296 - DNA, 17 bp, Homo sapiens
atctgtccatggccttt

SEQ ID NO: 3357297 - DNA, 20 bp, Homo sapiens
atctgtctcccagttatgaa

SEQ ID NO: 3357298 - DNA, 16 bp, Homo sapiens
atctgtctggtggccc

SEQ ID NO: 3357299 - DNA, 20 bp, Homo sapiens
atctgtgaagaaagaggtta

SEQ ID NO: 3357300 - DNA, 16 bp, Homo sapiens
atctgtgaattcagat

SEQ ID NO: 3357301 - DNA, 15 bp, Homo sapiens
atctgtgcaaacagt

SEQ ID NO: 3357302 - DNA, 21 bp, Homo sapiens
atctgtgccatagaacaagat

SEQ ID NO: 3357303 - DNA, 12 bp, Homo sapiens
atctgtgcccca

SEQ ID NO: 3357304 - DNA, 16 bp, Homo sapiens
atctgtgcgtgaaaca

SEQ ID NO: 3357305 - DNA, 18 bp, Homo sapiens
atctgtgcgtgaaacaca

SEQ ID NO: 3357306 - DNA, 19 bp, Homo sapiens
atctgtgcgtgaaacacac

SEQ ID NO: 3357307 - DNA, 13 bp, Homo sapiens
atctgtggagctg

SEQ ID NO: 3357308 - DNA, 14 bp, Homo sapiens
atctgtggagctgc

SEQ ID NO: 3357309 - DNA, 19 bp, Homo sapiens
atctgtggagctgccacag

SEQ ID NO: 3357310 - DNA, 21 bp, Homo sapiens
atctgtggagctgccacagag

SEQ ID NO: 3357311 - DNA, 22 bp, Homo sapiens
atctgtgggcatggtcaaaggc

SEQ ID NO: 3357312 - DNA, 15 bp, Homo sapiens
atctgtgtgtatatt

SEQ ID NO: 3357313 - DNA, 18 bp, Homo sapiens
atctgtgtttttgaaata

SEQ ID NO: 3357314 - DNA, 18 bp, Homo sapiens
atctgttaggttggggat

SEQ ID NO: 3357315 - DNA, 14 bp, Homo sapiens
atctgttgttccaa

SEQ ID NO: 3357316 - DNA, 22 bp, Homo sapiens
atctgtttcaggtttccattct

SEQ ID NO: 3357317 - DNA, 14 bp, Homo sapiens
atctgttttaaatt

SEQ ID NO: 3357318 - DNA, 17 bp, Homo sapiens
atctgttttgaaggcaa

SEQ ID NO: 3357319 - DNA, 21 bp, Homo sapiens
atctgttttgtggtttggaat

SEQ ID NO: 3357320 - DNA, 22 bp, Homo sapiens
atctgttttgtggtttggaata

SEQ ID NO: 3357321 - DNA, 13 bp, Homo sapiens
atcttaaacaatg

SEQ ID NO: 3357322 - DNA, 14 bp, Homo sapiens
atcttaaacaatgt

SEQ ID NO: 3357323 - DNA, 15 bp, Homo sapiens
atcttaaacaatgta

SEQ ID NO: 3357324 - DNA, 20 bp, Homo sapiens
atcttaaacaatgtataaag

SEQ ID NO: 3357325 - DNA, 22 bp, Homo sapiens
atcttaaacataataaatcaca

SEQ ID NO: 3357326 - DNA, 22 bp, Homo sapiens
atcttaattctttgttctgttt

SEQ ID NO: 3357327 - DNA, 15 bp, Homo sapiens
atcttacaagatatt

SEQ ID NO: 3357328 - DNA, 15 bp, Homo sapiens
atcttacaatattga

SEQ ID NO: 3357329 - DNA, 14 bp, Homo sapiens
atcttacagaaaat

SEQ ID NO: 3357330 - DNA, 15 bp, Homo sapiens
atcttacagaaaata

SEQ ID NO: 3357331 - DNA, 18 bp, Homo sapiens
atcttacctgtaaagtct

SEQ ID NO: 3357332 - DNA, 18 bp, Homo sapiens
atcttagatgtttcacac

SEQ ID NO: 3357333 - DNA, 18 bp, Homo sapiens
atcttagattctctgtgt

SEQ ID NO: 3357334 - DNA, 20 bp, Homo sapiens
atcttagattctctgtgtct

SEQ ID NO: 3357335 - DNA, 15 bp, Homo sapiens
atcttagctggatat

SEQ ID NO: 3357336 - DNA, 16 bp, Homo sapiens
atcttagctggatata

SEQ ID NO: 3357337 - DNA, 14 bp, Homo sapiens
atcttagtttggat

SEQ ID NO: 3357338 - DNA, 22 bp, Homo sapiens
atcttagtttggattcttatgt

SEQ ID NO: 3357339 - DNA, 14 bp, Homo sapiens
atcttatacaacag

SEQ ID NO: 3357340 - DNA, 15 bp, Homo sapiens
atcttatagttctag

SEQ ID NO: 3357341 - DNA, 15 bp, Homo sapiens
atcttatattggttt

SEQ ID NO: 3357342 - DNA, 20 bp, Homo sapiens
atcttatattggtttgcaca

SEQ ID NO: 3357343 - DNA, 21 bp, Homo sapiens
atcttatattggtttgcacaa

SEQ ID NO: 3357344 - DNA, 19 bp, Homo sapiens
atcttcaaactttcacttt

SEQ ID NO: 3357345 - DNA, 19 bp, Homo sapiens
atcttcaaagcttgaagat

SEQ ID NO: 3357346 - DNA, 12 bp, Homo sapiens
atcttcacatag

SEQ ID NO: 3357347 - DNA, 16 bp, Homo sapiens
atcttcagaactgccc

SEQ ID NO: 3357348 - DNA, 18 bp, Homo sapiens
atcttcagaactgccctt

SEQ ID NO: 3357349 - DNA, 21 bp, Homo sapiens
atcttcagaactgcccttgct

SEQ ID NO: 3357350 - DNA, 20 bp, Homo sapiens
atcttcagttttatctttaa

SEQ ID NO: 3357351 - DNA, 13 bp, Homo sapiens
atcttccacctgt

SEQ ID NO: 3357352 - DNA, 20 bp, Homo sapiens
atcttccacctgtgccctca

SEQ ID NO: 3357353 - DNA, 16 bp, Homo sapiens
atcttccatatttgga

SEQ ID NO: 3357354 - DNA, 17 bp, Homo sapiens
atcttccatatttggaa

SEQ ID NO: 3357355 - DNA, 21 bp, Homo sapiens
atcttccctagagggttcctg

SEQ ID NO: 3357356 - DNA, 14 bp, Homo sapiens
atcttccctctccc

SEQ ID NO: 3357357 - DNA, 13 bp, Homo sapiens
atcttctaaatgg

SEQ ID NO: 3357358 - DNA, 20 bp, Homo sapiens
atcttctccccacagcctct

SEQ ID NO: 3357359 - DNA, 17 bp, Homo sapiens
atcttctctttgacaat

SEQ ID NO: 3357360 - DNA, 14 bp, Homo sapiens
atcttctgccttct

SEQ ID NO: 3357361 - DNA, 11 bp, Homo sapiens
atcttctggat

SEQ ID NO: 3357362 - DNA, 12 bp, Homo sapiens
atcttctggatt

SEQ ID NO: 3357363 - DNA, 15 bp, Homo sapiens
atcttctgtgaaata

SEQ ID NO: 3357364 - DNA, 19 bp, Homo sapiens
atcttctgtgaaatataat

SEQ ID NO: 3357365 - DNA, 13 bp, Homo sapiens
atcttcttcaaat

SEQ ID NO: 3357366 - DNA, 21 bp, Homo sapiens
atcttcttcaaatacaaagta

SEQ ID NO: 3357367 - DNA, 22 bp, Homo sapiens
atcttcttcaaatacaaagtaa

SEQ ID NO: 3357368 - DNA, 17 bp, Homo sapiens
atcttctttataattct

SEQ ID NO: 3357369 - DNA, 12 bp, Homo sapiens
atcttgaaatta

SEQ ID NO: 3357370 - DNA, 21 bp, Homo sapiens
atcttgaaattaagaaggcaa

SEQ ID NO: 3357371 - DNA, 14 bp, Homo sapiens
atcttgaagggccc

SEQ ID NO: 3357372 - DNA, 15 bp, Homo sapiens
atcttgaagggccca

SEQ ID NO: 3357373 - DNA, 16 bp, Homo sapiens
atcttgaagggcccag

SEQ ID NO: 3357374 - DNA, 12 bp, Homo sapiens
atcttgaatgtg

SEQ ID NO: 3357375 - DNA, 21 bp, Homo sapiens
atcttgaatgtggtctcagga

SEQ ID NO: 3357376 - DNA, 22 bp, Homo sapiens
atcttgaggaataaatgccttt

SEQ ID NO: 3357377 - DNA, 16 bp, Homo sapiens
atcttgccacatttct

SEQ ID NO: 3357378 - DNA, 18 bp, Homo sapiens
atcttgccacatttctga

SEQ ID NO: 3357379 - DNA, 16 bp, Homo sapiens
atcttgcgaatccaag

SEQ ID NO: 3357380 - DNA, 21 bp, Homo sapiens
atcttgcgaatccaagctccc

SEQ ID NO: 3357381 - DNA, 14 bp, Homo sapiens
atcttgctaccagt

SEQ ID NO: 3357382 - DNA, 17 bp, Homo sapiens
atcttgctctgctgaca

SEQ ID NO: 3357383 - DNA, 19 bp, Homo sapiens
atcttgctctgctgacaga

SEQ ID NO: 3357384 - DNA, 14 bp, Homo sapiens
atcttgcttcccta

SEQ ID NO: 3357385 - DNA, 13 bp, Homo sapiens
atcttggctatgt

SEQ ID NO: 3357386 - DNA, 21 bp, Homo sapiens
atcttggctatgtaattcttg

SEQ ID NO: 3357387 - DNA, 22 bp, Homo sapiens
atcttggctatgtaattcttgt

SEQ ID NO: 3357388 - DNA, 13 bp, Homo sapiens
atcttgggactgg

SEQ ID NO: 3357389 - DNA, 20 bp, Homo sapiens
atcttgggggggtggccgct

SEQ ID NO: 3357390 - DNA, 22 bp, Homo sapiens
atcttggtactactagatgtct

SEQ ID NO: 3357391 - DNA, 19 bp, Homo sapiens
atcttgtgctagaatactt

SEQ ID NO: 3357392 - DNA, 17 bp, Homo sapiens
atcttgtgttgtccttt

SEQ ID NO: 3357393 - DNA, 17 bp, Homo sapiens
atcttgttcaggaaaag

SEQ ID NO: 3357394 - DNA, 17 bp, Homo sapiens
atctttaagcagagaag

SEQ ID NO: 3357395 - DNA, 16 bp, Homo sapiens
atctttatacagattt

SEQ ID NO: 3357396 - DNA, 20 bp, Homo sapiens
atctttatactgggtttcaa

SEQ ID NO: 3357397 - DNA, 22 bp, Homo sapiens
atctttatagaaggaatttgta

SEQ ID NO: 3357398 - DNA, 11 bp, Homo sapiens
atctttatgct

SEQ ID NO: 3357399 - DNA, 14 bp, Homo sapiens
atctttatgctgta

SEQ ID NO: 3357400 - DNA, 18 bp, Homo sapiens
atctttatgctgtatttt

SEQ ID NO: 3357401 - DNA, 16 bp, Homo sapiens
atctttattgaaattc

SEQ ID NO: 3357402 - DNA, 14 bp, Homo sapiens
atctttcacttgaa

SEQ ID NO: 3357403 - DNA, 16 bp, Homo sapiens
atctttcagaaatata

SEQ ID NO: 3357404 - DNA, 12 bp, Homo sapiens
atctttcaggaa

SEQ ID NO: 3357405 - DNA, 12 bp, Homo sapiens
atgagcctcagc

SEQ ID NO: 3357406 - DNA, 15 bp, Homo sapiens
atgagcctcagcatc

SEQ ID NO: 3357407 - DNA, 16 bp, Homo sapiens
atgagcctcagcatcc

SEQ ID NO: 3357408 - DNA, 17 bp, Homo sapiens
atgagcctcagcatcct

SEQ ID NO: 3357409 - DNA, 10 bp, Homo sapiens
atgagcctgc

SEQ ID NO: 3357410 - DNA, 14 bp, Homo sapiens
atgagcctgcccgc

SEQ ID NO: 3357411 - DNA, 18 bp, Homo sapiens
atgagcctgcccgctgca

SEQ ID NO: 3357412 - DNA, 15 bp, Homo sapiens
atgagctaaaaatat

SEQ ID NO: 3357413 - DNA, 22 bp, Homo sapiens
atgagctcgcatttgtcaatga

SEQ ID NO: 3357414 - DNA, 19 bp, Homo sapiens
atgagctctgaaatcttcc

SEQ ID NO: 3357415 - DNA, 17 bp, Homo sapiens
atgagctgatctgcgga

SEQ ID NO: 3357416 - DNA, 15 bp, Homo sapiens
atgagcttgattaaa

SEQ ID NO: 3357417 - DNA, 13 bp, Homo sapiens
atgagctttcttt

SEQ ID NO: 3357418 - DNA, 15 bp, Homo sapiens
atgaggaaaagaaaa

SEQ ID NO: 3357419 - DNA, 21 bp, Homo sapiens
atgaggaggatgtccctgggc

SEQ ID NO: 3357420 - DNA, 24 bp, Homo sapiens
atgaggaggatgtccctgggccag

SEQ ID NO: 3357421 - DNA, 20 bp, Homo sapiens
atgaggcaacctgattgtaa

SEQ ID NO: 3357422 - DNA, 15 bp, Homo sapiens
atgaggcacttctgt

SEQ ID NO: 3357423 - DNA, 17 bp, Homo sapiens
atgaggccatctcagga

SEQ ID NO: 3357424 - DNA, 20 bp, Homo sapiens
atgaggccatctcaggagat

SEQ ID NO: 3357425 - DNA, 18 bp, Homo sapiens
atgagggacagggtcttt

SEQ ID NO: 3357426 - DNA, 22 bp, Homo sapiens
atgagggagggggcgctcagga

SEQ ID NO: 3357427 - DNA, 22 bp, Homo sapiens
atgaggggaaagggagaagggt

SEQ ID NO: 3357428 - DNA, 19 bp, Homo sapiens
atgaggggacattttggtg

SEQ ID NO: 3357429 - DNA, 21 bp, Homo sapiens
atgaggggcttcctgggtcct

SEQ ID NO: 3357430 - DNA, 14 bp, Homo sapiens
atgagggtgtttcc

SEQ ID NO: 3357431 - DNA, 18 bp, Homo sapiens
atgaggtcaccaggggag

SEQ ID NO: 3357432 - DNA, 18 bp, Homo sapiens
atgaggtcagagcctgca

SEQ ID NO: 3357433 - DNA, 20 bp, Homo sapiens
atgaggtcagagcctgcagt

SEQ ID NO: 3357434 - DNA, 17 bp, Homo sapiens
atgaggtctgaaatgga

SEQ ID NO: 3357435 - DNA, 13 bp, Homo sapiens
atgaggtgggagg

SEQ ID NO: 3357436 - DNA, 22 bp, Homo sapiens
atgaggttcaactgttgattgc

SEQ ID NO: 3357437 - DNA, 16 bp, Homo sapiens
atgaggttctgagacc

SEQ ID NO: 3357438 - DNA, 17 bp, Homo sapiens
atgagtaacatttgctg

SEQ ID NO: 3357439 - DNA, 18 bp, Homo sapiens
atgagtaactattattat

SEQ ID NO: 3357440 - DNA, 14 bp, Homo sapiens
atgagtatttggta

SEQ ID NO: 3357441 - DNA, 20 bp, Homo sapiens
atgagtcagacatttggtat

SEQ ID NO: 3357442 - DNA, 19 bp, Homo sapiens
atgagtccttgatttcaaa

SEQ ID NO: 3357443 - DNA, 21 bp, Homo sapiens
atgagtccttgatttcaaagt

SEQ ID NO: 3357444 - DNA, 17 bp, Homo sapiens
atgagtctagatgttta

SEQ ID NO: 3357445 - DNA, 22 bp, Homo sapiens
atgagtttgccctggtttcact

SEQ ID NO: 3357446 - DNA, 14 bp, Homo sapiens
atgagtttgcttat

SEQ ID NO: 3357447 - DNA, 18 bp, Homo sapiens
atgataatcccaccaccc

SEQ ID NO: 3357448 - DNA, 13 bp, Homo sapiens
atgatacaatgaa

SEQ ID NO: 3357449 - DNA, 20 bp, Homo sapiens
atgataccacctttactgtg

SEQ ID NO: 3357450 - DNA, 20 bp, Homo sapiens
atgatactctcagattttaa

SEQ ID NO: 3357451 - DNA, 17 bp, Homo sapiens
atgatactgattatgaa

SEQ ID NO: 3357452 - DNA, 17 bp, Homo sapiens
atgatagtaagaaaagt

SEQ ID NO: 3357453 - DNA, 15 bp, Homo sapiens
atgatagttgaatgt

SEQ ID NO: 3357454 - DNA, 13 bp, Homo sapiens
atgatatgtaaac

SEQ ID NO: 3357455 - DNA, 13 bp, Homo sapiens
atgatcaaaacat

SEQ ID NO: 3357456 - DNA, 14 bp, Homo sapiens
atgatcaaattttg

SEQ ID NO: 3357457 - DNA, 22 bp, Homo sapiens
atgatcactaatactaattcat

SEQ ID NO: 3357458 - DNA, 21 bp, Homo sapiens
atgatcagcatctgtgatggg

SEQ ID NO: 3357459 - DNA, 20 bp, Homo sapiens
atgatcagctgtttgtcata

SEQ ID NO: 3357460 - DNA, 13 bp, Homo sapiens
atgatcagtgttg

SEQ ID NO: 3357461 - DNA, 20 bp, Homo sapiens
atgatcagtgttgttgctct

SEQ ID NO: 3357462 - DNA, 17 bp, Homo sapiens
atgatcataaaagtgat

SEQ ID NO: 3357463 - DNA, 21 bp, Homo sapiens
atgatccatgagtttgccctg

SEQ ID NO: 3357464 - DNA, 22 bp, Homo sapiens
atgatccatgagtttgccctgg

SEQ ID NO: 3357465 - DNA, 18 bp, Homo sapiens
atgatccttttttgtcat

SEQ ID NO: 3357466 - DNA, 22 bp, Homo sapiens
atgatcgaaaaaataattattt

SEQ ID NO: 3357467 - DNA, 13 bp, Homo sapiens
atgatctattgct

SEQ ID NO: 3357468 - DNA, 23 bp, Homo sapiens
atgatctcggatgaccaaaccag

SEQ ID NO: 3357469 - DNA, 23 bp, Homo sapiens
atgatctctccacggtagcactt

SEQ ID NO: 3357470 - DNA, 19 bp, Homo sapiens
atgatctgcctctaaaagc

SEQ ID NO: 3357471 - DNA, 15 bp, Homo sapiens
atgatgaaactgtca

SEQ ID NO: 3357472 - DNA, 19 bp, Homo sapiens
atgatgaaggtaattaaag

SEQ ID NO: 3357473 - DNA, 12 bp, Homo sapiens
atgatgaatgag

SEQ ID NO: 3357474 - DNA, 17 bp, Homo sapiens
atgatgacaaaaaatgt

SEQ ID NO: 3357475 - DNA, 19 bp, Homo sapiens
atgatgagaatttctaaaa

SEQ ID NO: 3357476 - DNA, 14 bp, Homo sapiens
atgatgcatacagt

SEQ ID NO: 3357477 - DNA, 16 bp, Homo sapiens
atgatgccctgctcca

SEQ ID NO: 3357478 - DNA, 15 bp, Homo sapiens
atgatgctgtgacaa

SEQ ID NO: 3357479 - DNA, 17 bp, Homo sapiens
atgatggagcgcacctg

SEQ ID NO: 3357480 - DNA, 17 bp, Homo sapiens
atgatggatggcagact

SEQ ID NO: 3357481 - DNA, 19 bp, Homo sapiens
atgatggcaattttgtaac

SEQ ID NO: 3357482 - DNA, 16 bp, Homo sapiens
atgatgggaaaatatt

SEQ ID NO: 3357483 - DNA, 18 bp, Homo sapiens
atgatgggaaaatatttc

SEQ ID NO: 3357484 - DNA, 11 bp, Homo sapiens
atgatggtgag

SEQ ID NO: 3357485 - DNA, 13 bp, Homo sapiens
atgatgtaattga

SEQ ID NO: 3357486 - DNA, 18 bp, Homo sapiens
atgatgtacagattcttt

SEQ ID NO: 3357487 - DNA, 14 bp, Homo sapiens
atgatgtccagaag

SEQ ID NO: 3357488 - DNA, 23 bp, Homo sapiens
atgatgtccagaagaatattcag

SEQ ID NO: 3357489 - DNA, 20 bp, Homo sapiens
atgatgtggtgcctgaggtc

SEQ ID NO: 3357490 - DNA, 17 bp, Homo sapiens
atgattaaataagattc

SEQ ID NO: 3357491 - DNA, 20 bp, Homo sapiens
atgattaaataagattctaa

SEQ ID NO: 3357492 - DNA, 21 bp, Homo sapiens
atgattaaattttagtacatt

SEQ ID NO: 3357493 - DNA, 12 bp, Homo sapiens
atgattaatcaa

SEQ ID NO: 3357494 - DNA, 14 bp, Homo sapiens
atgattaatgtgta

SEQ ID NO: 3357495 - DNA, 15 bp, Homo sapiens
atgattactggcctt

SEQ ID NO: 3357496 - DNA, 19 bp, Homo sapiens
atgattactggcctttttc

SEQ ID NO: 3357497 - DNA, 23 bp, Homo sapiens
atgattagcagaagaaaggaaca

SEQ ID NO: 3357498 - DNA, 12 bp, Homo sapiens
atgattatacaa

SEQ ID NO: 3357499 - DNA, 21 bp, Homo sapiens
atgattatacaaaagagcatg

SEQ ID NO: 3357500 - DNA, 23 bp, Homo sapiens
atgattatacaaaagagcatgga

SEQ ID NO: 3357501 - DNA, 23 bp, Homo sapiens
atgattcacatgctaaagccagg

SEQ ID NO: 3357502 - DNA, 17 bp, Homo sapiens
atgattcagaaattgga

SEQ ID NO: 3357503 - DNA, 18 bp, Homo sapiens
atgattcctggacatcac

SEQ ID NO: 3357504 - DNA, 18 bp, Homo sapiens
atgattccttgagcattt

SEQ ID NO: 3357505 - DNA, 22 bp, Homo sapiens
atgattctatttatatgtacat

SEQ ID NO: 3357506 - DNA, 16 bp, Homo sapiens
atgattctctgagtgg

SEQ ID NO: 3357507 - DNA, 16 bp, Homo sapiens
atgattgtactttgaa

SEQ ID NO: 3357508 - DNA, 16 bp, Homo sapiens
atgatttaataaaata

SEQ ID NO: 3357509 - DNA, 13 bp, Homo sapiens
atgatttatagtt

SEQ ID NO: 3357510 - DNA, 15 bp, Homo sapiens
atgatttatagtttg

SEQ ID NO: 3357511 - DNA, 20 bp, Homo sapiens
atgatttcactagaaaagct

SEQ ID NO: 3357512 - DNA, 21 bp, Homo sapiens
atgatttcactagaaaagctg

SEQ ID NO: 3357513 - DNA, 20 bp, Homo sapiens
atgatttcatgctatctctg

SEQ ID NO: 3357514 - DNA, 15 bp, Homo sapiens
atgatttccttgaat

SEQ ID NO: 3357515 - DNA, 16 bp, Homo sapiens
atgatttccttgaatg

SEQ ID NO: 3357516 - DNA, 19 bp, Homo sapiens
atgatttccttgaatgtgg

SEQ ID NO: 3357517 - DNA, 14 bp, Homo sapiens
atgatttgttttga

SEQ ID NO: 3357518 - DNA, 19 bp, Homo sapiens
atgatttgttttgaatttt

SEQ ID NO: 3357519 - DNA, 18 bp, Homo sapiens
atgatttttaacttttta

SEQ ID NO: 3357520 - DNA, 13 bp, Homo sapiens
atgatttttagat

SEQ ID NO: 3357521 - DNA, 19 bp, Homo sapiens
atgattttttaaaagaaat

SEQ ID NO: 3357522 - DNA, 17 bp, Homo sapiens
atgatttttttttcata

SEQ ID NO: 3357523 - DNA, 12 bp, Homo sapiens
atgcaaaaagaa

SEQ ID NO: 3357524 - DNA, 12 bp, Homo sapiens
atgcaaaattgt

SEQ ID NO: 3357525 - DNA, 23 bp, Homo sapiens
atgcaaaattgttttcacttgta

SEQ ID NO: 3357526 - DNA, 21 bp, Homo sapiens
atgcaaacaagaaacgtgtca

SEQ ID NO: 3357527 - DNA, 22 bp, Homo sapiens
atgcaaagctgaagaccatgga

SEQ ID NO: 3357528 - DNA, 14 bp, Homo sapiens
atgcaaagttctgt

SEQ ID NO: 3357529 - DNA, 15 bp, Homo sapiens
atgcaaattaaaaca

SEQ ID NO: 3357530 - DNA, 20 bp, Homo sapiens
atgcaacacgcatggtcaac

SEQ ID NO: 3357531 - DNA, 23 bp, Homo sapiens
atggcaagaaagctggtaaacta

SEQ ID NO: 3357532 - DNA, 23 bp, Homo sapiens
atggcaagggggtgtcatctgag

SEQ ID NO: 3357533 - DNA, 16 bp, Homo sapiens
atggcaattttgtaac

SEQ ID NO: 3357534 - DNA, 14 bp, Homo sapiens
atggcacaatgaat

SEQ ID NO: 3357535 - DNA, 22 bp, Homo sapiens
atggcaccaacgggaccccctg

SEQ ID NO: 3357536 - DNA, 14 bp, Homo sapiens
atggcaccagcccc

SEQ ID NO: 3357537 - DNA, 22 bp, Homo sapiens
atggcaccagccccctggatgg

SEQ ID NO: 3357538 - DNA, 17 bp, Homo sapiens
atggcaccttcagactt

SEQ ID NO: 3357539 - DNA, 21 bp, Homo sapiens
atggcaccttcagactttgct

SEQ ID NO: 3357540 - DNA, 22 bp, Homo sapiens
atggcacttagctatcagaaga

SEQ ID NO: 3357541 - DNA, 13 bp, Homo sapiens
atggcagaagaca

SEQ ID NO: 3357542 - DNA, 21 bp, Homo sapiens
atggcagaagacaccagagca

SEQ ID NO: 3357543 - DNA, 22 bp, Homo sapiens
atggcagaagacaccagagcag

SEQ ID NO: 3357544 - DNA, 24 bp, Homo sapiens
atggcagaagacaccagagcagat

SEQ ID NO: 3357545 - DNA, 20 bp, Homo sapiens
atggcagagtttgtgtgttg

SEQ ID NO: 3357546 - DNA, 15 bp, Homo sapiens
atggcagctagtgcc

SEQ ID NO: 3357547 - DNA, 16 bp, Homo sapiens
atggcataacctgtct

SEQ ID NO: 3357548 - DNA, 18 bp, Homo sapiens
atggcatcaaccaccatg

SEQ ID NO: 3357549 - DNA, 20 bp, Homo sapiens
atggcatcaaccaccatgga

SEQ ID NO: 3357550 - DNA, 19 bp, Homo sapiens
atggcattgcactgcttat

SEQ ID NO: 3357551 - DNA, 13 bp, Homo sapiens
atggccaagagca

SEQ ID NO: 3357552 - DNA, 15 bp, Homo sapiens
atggccaagagcatc

SEQ ID NO: 3357553 - DNA, 15 bp, Homo sapiens
atggccacatttaat

SEQ ID NO: 3357554 - DNA, 22 bp, Homo sapiens
atggccagacgtggtggctcac

SEQ ID NO: 3357555 - DNA, 18 bp, Homo sapiens
atggccaggatcctctcc

SEQ ID NO: 3357556 - DNA, 22 bp, Homo sapiens
atggccaggtggccactccaga

SEQ ID NO: 3357557 - DNA, 15 bp, Homo sapiens
atggccccagcacag

SEQ ID NO: 3357558 - DNA, 13 bp, Homo sapiens
atggcccccaata

SEQ ID NO: 3357559 - DNA, 18 bp, Homo sapiens
atggcccccaataaaggc

SEQ ID NO: 3357560 - DNA, 19 bp, Homo sapiens
atggcccccaataaaggca

SEQ ID NO: 3357561 - DNA, 21 bp, Homo sapiens
atggcccccaataaaggcagc

SEQ ID NO: 3357562 - DNA, 16 bp, Homo sapiens
atggcccccaggggca

SEQ ID NO: 3357563 - DNA, 19 bp, Homo sapiens
atggcccccaggggcagga

SEQ ID NO: 3357564 - DNA, 21 bp, Homo sapiens
atggcccggatgctgcttccg

SEQ ID NO: 3357565 - DNA, 19 bp, Homo sapiens
atggccctagaactgtgcc

SEQ ID NO: 3357566 - DNA, 21 bp, Homo sapiens
atggcctattatattaaaata

SEQ ID NO: 3357567 - DNA, 14 bp, Homo sapiens
atggcctcagctgc

SEQ ID NO: 3357568 - DNA, 15 bp, Homo sapiens
atggcctcagctgcc

SEQ ID NO: 3357569 - DNA, 16 bp, Homo sapiens
atggcctcagctgcct

SEQ ID NO: 3357570 - DNA, 17 bp, Homo sapiens
atggcctcagctgcctc

SEQ ID NO: 3357571 - DNA, 13 bp, Homo sapiens
atggcctcatgtg

SEQ ID NO: 3357572 - DNA, 19 bp, Homo sapiens
atggcctcatgtggctgga

SEQ ID NO: 3357573 - DNA, 20 bp, Homo sapiens
atggcctcgcctccccaccc

SEQ ID NO: 3357574 - DNA, 20 bp, Homo sapiens
atggcctgccttgaagccac

SEQ ID NO: 3357575 - DNA, 14 bp, Homo sapiens
atggcctttctaat

SEQ ID NO: 3357576 - DNA, 13 bp, Homo sapiens
atggcctttgctt

SEQ ID NO: 3357577 - DNA, 18 bp, Homo sapiens
atggcgcgggaggcacca

SEQ ID NO: 3357578 - DNA, 23 bp, Homo sapiens
atggcgcgggaggcaccagctct

SEQ ID NO: 3357579 - DNA, 20 bp, Homo sapiens
atggcgttttgtctgtgttg

SEQ ID NO: 3357580 - DNA, 16 bp, Homo sapiens
atggctaataaactgt

SEQ ID NO: 3357581 - DNA, 18 bp, Homo sapiens
atggctaataaactgtat

SEQ ID NO: 3357582 - DNA, 20 bp, Homo sapiens
atggctaataaactgtatta

SEQ ID NO: 3357583 - DNA, 16 bp, Homo sapiens
atggctagtactgtat

SEQ ID NO: 3357584 - DNA, 14 bp, Homo sapiens
atggctatatggca

SEQ ID NO: 3357585 - DNA, 19 bp, Homo sapiens
atggctcagagcttgaaga

SEQ ID NO: 3357586 - DNA, 21 bp, Homo sapiens
atggctcagagcttgaagatt

SEQ ID NO: 3357587 - DNA, 16 bp, Homo sapiens
atggctcaggcaagcc

SEQ ID NO: 3357588 - DNA, 20 bp, Homo sapiens
atggctcaggcaagcccctc

SEQ ID NO: 3357589 - DNA, 15 bp, Homo sapiens
atggctccagaaatg

SEQ ID NO: 3357590 - DNA, 23 bp, Homo sapiens
atggctcccctttttcttcctca

SEQ ID NO: 3357591 - DNA, 18 bp, Homo sapiens
atggctgatttatttcta

SEQ ID NO: 3357592 - DNA, 12 bp, Homo sapiens
atggctgcccag

SEQ ID NO: 3357593 - DNA, 15 bp, Homo sapiens
atggctgcccaggag

SEQ ID NO: 3357594 - DNA, 15 bp, Homo sapiens
atggctgctagattt

SEQ ID NO: 3357595 - DNA, 15 bp, Homo sapiens
atggctgctgttgct

SEQ ID NO: 3357596 - DNA, 16 bp, Homo sapiens
atggctggccactgca

SEQ ID NO: 3357597 - DNA, 19 bp, Homo sapiens
atggctgtgcctctgcctg

SEQ ID NO: 3357598 - DNA, 23 bp, Homo sapiens
atggcttaaaaatacttaataaa

SEQ ID NO: 3357599 - DNA, 16 bp, Homo sapiens
atggcttaatgtttat

SEQ ID NO: 3357600 - DNA, 20 bp, Homo sapiens
atggcttcggacaaaatatc

SEQ ID NO: 3357601 - DNA, 14 bp, Homo sapiens
atggcttctaacaa

SEQ ID NO: 3357602 - DNA, 19 bp, Homo sapiens
atggcttgtgaactgctgg

SEQ ID NO: 3357603 - DNA, 15 bp, Homo sapiens
atggctttcaaagct

SEQ ID NO: 3357604 - DNA, 17 bp, Homo sapiens
atggctttgtgattcaa

SEQ ID NO: 3357605 - DNA, 18 bp, Homo sapiens
atgggaaagccacctctc

SEQ ID NO: 3357606 - DNA, 17 bp, Homo sapiens
atgggaacaattgaagt

SEQ ID NO: 3357607 - DNA, 16 bp, Homo sapiens
atgggaataattgctt

SEQ ID NO: 3357608 - DNA, 21 bp, Homo sapiens
atgggactggagtccctgtga

SEQ ID NO: 3357609 - DNA, 23 bp, Homo sapiens
atgggagagtagatggtgaaatt

SEQ ID NO: 3357610 - DNA, 16 bp, Homo sapiens
atgggagatggtcagt

SEQ ID NO: 3357611 - DNA, 12 bp, Homo sapiens
atgggagccagc

SEQ ID NO: 3357612 - DNA, 20 bp, Homo sapiens
atgggagccagctgcttttt

SEQ ID NO: 3357613 - DNA, 18 bp, Homo sapiens
atgggaggaaagagagca

SEQ ID NO: 3357614 - DNA, 13 bp, Homo sapiens
atgggagtgggca

SEQ ID NO: 3357615 - DNA, 15 bp, Homo sapiens
atgggagtgggcacc

SEQ ID NO: 3357616 - DNA, 16 bp, Homo sapiens
atgggagtgggcacct

SEQ ID NO: 3357617 - DNA, 21 bp, Homo sapiens
atgggatacaacctccctctt

SEQ ID NO: 3357618 - DNA, 23 bp, Homo sapiens
atgggattcagtgcttcttaaag

SEQ ID NO: 3357619 - DNA, 15 bp, Homo sapiens
atgggcaaagcttgt

SEQ ID NO: 3357620 - DNA, 19 bp, Homo sapiens
atgggcaacccccagcctg

SEQ ID NO: 3357621 - DNA, 14 bp, Homo sapiens
atgggcattgacaa

SEQ ID NO: 3357622 - DNA, 16 bp, Homo sapiens
atgggcattgggctga

SEQ ID NO: 3357623 - DNA, 19 bp, Homo sapiens
atgggcattgggctgacac

SEQ ID NO: 3357624 - DNA, 12 bp, Homo sapiens
atgggccagcct

SEQ ID NO: 3357625 - DNA, 13 bp, Homo sapiens
atgggccagccta

SEQ ID NO: 3357626 - DNA, 14 bp, Homo sapiens
atgggccagcctag

SEQ ID NO: 3357627 - DNA, 16 bp, Homo sapiens
atgggccagcctagcc

SEQ ID NO: 3357628 - DNA, 17 bp, Homo sapiens
atgggccagcctagccc

SEQ ID NO: 3357629 - DNA, 20 bp, Homo sapiens
atgggccccgccttcctggg

SEQ ID NO: 3357630 - DNA, 15 bp, Homo sapiens
atgggccttgctttg

SEQ ID NO: 3357631 - DNA, 18 bp, Homo sapiens
atgggccttttagaaacc

SEQ ID NO: 3357632 - DNA, 14 bp, Homo sapiens
atgggccttttctt

SEQ ID NO: 3357633 - DNA, 20 bp, Homo sapiens
atgggccttttcttgaataa

SEQ ID NO: 3357634 - DNA, 18 bp, Homo sapiens
atgggcgcaggcccagtg

SEQ ID NO: 3357635 - DNA, 19 bp, Homo sapiens
atgggcgcaggcccagtga

SEQ ID NO: 3357636 - DNA, 22 bp, Homo sapiens
atgggcggaagtacttccctca

SEQ ID NO: 3357637 - DNA, 21 bp, Homo sapiens
atgggctagtgtgagtggcag

SEQ ID NO: 3357638 - DNA, 23 bp, Homo sapiens
atgggctagtgtgagtggcagcc

SEQ ID NO: 3357639 - DNA, 14 bp, Homo sapiens
atgggctcttcact

SEQ ID NO: 3357640 - DNA, 14 bp, Homo sapiens
atgggctcttccaa

SEQ ID NO: 3357641 - DNA, 16 bp, Homo sapiens
atggggagaggaactc

SEQ ID NO: 3357642 - DNA, 11 bp, Homo sapiens
atggggaggga

SEQ ID NO: 3357643 - DNA, 15 bp, Homo sapiens
atggggattaattag

SEQ ID NO: 3357644 - DNA, 14 bp, Homo sapiens
atggggctcccagc

SEQ ID NO: 3357645 - DNA, 16 bp, Homo sapiens
atgggggatgggccag

SEQ ID NO: 3357646 - DNA, 19 bp, Homo sapiens
atgggggtagcagctggac

SEQ ID NO: 3357647 - DNA, 17 bp, Homo sapiens
atgggtccaagagacat

SEQ ID NO: 3357648 - DNA, 15 bp, Homo sapiens
atgggtgctggtcct

SEQ ID NO: 3357649 - DNA, 14 bp, Homo sapiens
atgggttgcatttg

SEQ ID NO: 3357650 - DNA, 15 bp, Homo sapiens
atggtaactgctttc

SEQ ID NO: 3357651 - DNA, 13 bp, Homo sapiens
atggtaagagaaa

SEQ ID NO: 3357652 - DNA, 18 bp, Homo sapiens
atggtacatgtcttccat

SEQ ID NO: 3357653 - DNA, 20 bp, Homo sapiens
atggtaccagccctggggct

SEQ ID NO: 3357654 - DNA, 13 bp, Homo sapiens
atggtactattta

SEQ ID NO: 3357655 - DNA, 21 bp, Homo sapiens
atggtactgactttgcttgct

SEQ ID NO: 3357656 - DNA, 18 bp, Homo sapiens
atggtatcaaaattacat

SEQ ID NO: 3357657 - DNA, 17 bp, Homo sapiens
atgtctgtttttgtatc

SEQ ID NO: 3357658 - DNA, 20 bp, Homo sapiens
atgtcttcatttcattgtat

SEQ ID NO: 3357659 - DNA, 22 bp, Homo sapiens
atgtcttccatgtatcttttga

SEQ ID NO: 3357660 - DNA, 15 bp, Homo sapiens
atgtcttctagctgc

SEQ ID NO: 3357661 - DNA, 12 bp, Homo sapiens
atgtcttctgcc

SEQ ID NO: 3357662 - DNA, 14 bp, Homo sapiens
atgtcttctgcctg

SEQ ID NO: 3357663 - DNA, 17 bp, Homo sapiens
atgtcttctgcctgtta

SEQ ID NO: 3357664 - DNA, 19 bp, Homo sapiens
atgtcttctgcctgttata

SEQ ID NO: 3357665 - DNA, 17 bp, Homo sapiens
atgtcttgtacatgtgt

SEQ ID NO: 3357666 - DNA, 22 bp, Homo sapiens
atgtctttactggacctgaaat

SEQ ID NO: 3357667 - DNA, 23 bp, Homo sapiens
atgtctttactggacctgaaatt

SEQ ID NO: 3357668 - DNA, 22 bp, Homo sapiens
atgtctttaggcagcagctttt

SEQ ID NO: 3357669 - DNA, 18 bp, Homo sapiens
atgtctttccaaattatt

SEQ ID NO: 3357670 - DNA, 19 bp, Homo sapiens
atgtctttccaaattattt

SEQ ID NO: 3357671 - DNA, 21 bp, Homo sapiens
atgtctttccaaattatttct

SEQ ID NO: 3357672 - DNA, 13 bp, Homo sapiens
atgtcttttaaaa

SEQ ID NO: 3357673 - DNA, 18 bp, Homo sapiens
atgtcttttagaagatag

SEQ ID NO: 3357674 - DNA, 17 bp, Homo sapiens
atgtcttttatatttgt

SEQ ID NO: 3357675 - DNA, 22 bp, Homo sapiens
atgtcttttatatttgtatcga

SEQ ID NO: 3357676 - DNA, 16 bp, Homo sapiens
atgtcttttgaatatt

SEQ ID NO: 3357677 - DNA, 12 bp, Homo sapiens
atgtgaaaaaaa

SEQ ID NO: 3357678 - DNA, 14 bp, Homo sapiens
atgtgaaaagtatc

SEQ ID NO: 3357679 - DNA, 18 bp, Homo sapiens
atgtgaaaataaagcaga

SEQ ID NO: 3357680 - DNA, 19 bp, Homo sapiens
atgtgaaaataaagcagaa

SEQ ID NO: 3357681 - DNA, 13 bp, Homo sapiens
atgtgaaaatcat

SEQ ID NO: 3357682 - DNA, 13 bp, Homo sapiens
atgtgaaacactt

SEQ ID NO: 3357683 - DNA, 15 bp, Homo sapiens
atgtgaaaccttttt

SEQ ID NO: 3357684 - DNA, 18 bp, Homo sapiens
atgtgaaaccttttttaa

SEQ ID NO: 3357685 - DNA, 20 bp, Homo sapiens
atgtgaaaccttttttaaga

SEQ ID NO: 3357686 - DNA, 22 bp, Homo sapiens
atgtgaaaccttttttaagatt

SEQ ID NO: 3357687 - DNA, 19 bp, Homo sapiens
atgtgaacagcataagttt

SEQ ID NO: 3357688 - DNA, 12 bp, Homo sapiens
atgtgaacttgt

SEQ ID NO: 3357689 - DNA, 18 bp, Homo sapiens
atgtgaacttgtagctgt

SEQ ID NO: 3357690 - DNA, 20 bp, Homo sapiens
atgtgaacttgtagctgtaa

SEQ ID NO: 3357691 - DNA, 21 bp, Homo sapiens
atgtgaagacattttttgcta

SEQ ID NO: 3357692 - DNA, 20 bp, Homo sapiens
atgtgaagataatttgcata

SEQ ID NO: 3357693 - DNA, 14 bp, Homo sapiens
atgtgaagcatgct

SEQ ID NO: 3357694 - DNA, 20 bp, Homo sapiens
atgtgaagcatgctttgctg

SEQ ID NO: 3357695 - DNA, 22 bp, Homo sapiens
atgtgaagcatgctttgctgct

SEQ ID NO: 3357696 - DNA, 16 bp, Homo sapiens
atgtgacaataatatt

SEQ ID NO: 3357697 - DNA, 11 bp, Homo sapiens
atgtgacacat

SEQ ID NO: 3357698 - DNA, 18 bp, Homo sapiens
atgtgacacctaactctt

SEQ ID NO: 3357699 - DNA, 16 bp, Homo sapiens
atgtgacaggtaaact

SEQ ID NO: 3357700 - DNA, 17 bp, Homo sapiens
atgtgacccaccagtgc

SEQ ID NO: 3357701 - DNA, 14 bp, Homo sapiens
atgtgacttttctg

SEQ ID NO: 3357702 - DNA, 20 bp, Homo sapiens
atgtgacttttctgattaat

SEQ ID NO: 3357703 - DNA, 21 bp, Homo sapiens
atgtgactttttttggtataa

SEQ ID NO: 3357704 - DNA, 13 bp, Homo sapiens
atgtgagccccag

SEQ ID NO: 3357705 - DNA, 17 bp, Homo sapiens
atgtgagcctcgtgtca

SEQ ID NO: 3357706 - DNA, 21 bp, Homo sapiens
atgtgaggaagaactacagct

SEQ ID NO: 3357707 - DNA, 16 bp, Homo sapiens
atgtgaggaggaaaag

SEQ ID NO: 3357708 - DNA, 19 bp, Homo sapiens
atgtgaggaggaaaaggaa

SEQ ID NO: 3357709 - DNA, 18 bp, Homo sapiens
atgtgagtgccttttgca

SEQ ID NO: 3357710 - DNA, 20 bp, Homo sapiens
atgtgagtgccttttgcaga

SEQ ID NO: 3357711 - DNA, 15 bp, Homo sapiens
atgtgatacattttt

SEQ ID NO: 3357712 - DNA, 21 bp, Homo sapiens
atgtgatacattttttaagct

SEQ ID NO: 3357713 - DNA, 22 bp, Homo sapiens
atgtgatacattttttaagctt

SEQ ID NO: 3357714 - DNA, 15 bp, Homo sapiens
atgtgatatataagt

SEQ ID NO: 3357715 - DNA, 23 bp, Homo sapiens
atgtgatatataagtgtacatat

SEQ ID NO: 3357716 - DNA, 17 bp, Homo sapiens
atgtgatcaactgttca

SEQ ID NO: 3357717 - DNA, 18 bp, Homo sapiens
atgtgatcacgcctggct

SEQ ID NO: 3357718 - DNA, 14 bp, Homo sapiens
atgtgatgatgtaa

SEQ ID NO: 3357719 - DNA, 19 bp, Homo sapiens
atgtgatggatggcacaat

SEQ ID NO: 3357720 - DNA, 23 bp, Homo sapiens
atgtgatggatggcacaatgaat

SEQ ID NO: 3357721 - DNA, 15 bp, Homo sapiens
atgtgattacaaggc

SEQ ID NO: 3357722 - DNA, 22 bp, Homo sapiens
atgtgattgtggaatggagatt

SEQ ID NO: 3357723 - DNA, 11 bp, Homo sapiens
atgtgattttt

SEQ ID NO: 3357724 - DNA, 20 bp, Homo sapiens
atgtgatttttgtaatatgt

SEQ ID NO: 3357725 - DNA, 20 bp, Homo sapiens
atgtgcaagcgacgacagat

SEQ ID NO: 3357726 - DNA, 22 bp, Homo sapiens
atgtgcactgtcactttgctct

SEQ ID NO: 3357727 - DNA, 19 bp, Homo sapiens
atgtgcaggtttgttacat

SEQ ID NO: 3357728 - DNA, 13 bp, Homo sapiens
atgtgcccctggc

SEQ ID NO: 3357729 - DNA, 14 bp, Homo sapiens
atgtgcccctggcc

SEQ ID NO: 3357730 - DNA, 15 bp, Homo sapiens
atgtgcccctggccc

SEQ ID NO: 3357731 - DNA, 20 bp, Homo sapiens
atgtgcccctggcccatctc

SEQ ID NO: 3357732 - DNA, 17 bp, Homo sapiens
atgtgcctgcaccagga

SEQ ID NO: 3357733 - DNA, 22 bp, Homo sapiens
atgtgctataatctgtttttac

SEQ ID NO: 3357734 - DNA, 15 bp, Homo sapiens
atgtgctatacacac

SEQ ID NO: 3357735 - DNA, 18 bp, Homo sapiens
atgtgctatactgcatac

SEQ ID NO: 3357736 - DNA, 18 bp, Homo sapiens
atgtgctatataaatatg

SEQ ID NO: 3357737 - DNA, 12 bp, Homo sapiens
atgtgctgatca

SEQ ID NO: 3357738 - DNA, 19 bp, Homo sapiens
atgtggaaagtgaatttga

SEQ ID NO: 3357739 - DNA, 16 bp, Homo sapiens
atgtggaactgtagga

SEQ ID NO: 3357740 - DNA, 12 bp, Homo sapiens
atgtggaagagc

SEQ ID NO: 3357741 - DNA, 14 bp, Homo sapiens
atgtggaagagcat

SEQ ID NO: 3357742 - DNA, 18 bp, Homo sapiens
atgtggaatggattatag

SEQ ID NO: 3357743 - DNA, 15 bp, Homo sapiens
atgtggactaaatat

SEQ ID NO: 3357744 - DNA, 16 bp, Homo sapiens
atgtggactaaatatc

SEQ ID NO: 3357745 - DNA, 22 bp, Homo sapiens
atgtggcattggggggccgggc

SEQ ID NO: 3357746 - DNA, 19 bp, Homo sapiens
atgtggccacttatttcac

SEQ ID NO: 3357747 - DNA, 14 bp, Homo sapiens
atgtggccccaccc

SEQ ID NO: 3357748 - DNA, 20 bp, Homo sapiens
atgtggcccctgaacaagaa

SEQ ID NO: 3357749 - DNA, 19 bp, Homo sapiens
atgtggcctgtggcctgtg

SEQ ID NO: 3357750 - DNA, 20 bp, Homo sapiens
atgtggctgaaaatgcaaag

SEQ ID NO: 3357751 - DNA, 22 bp, Homo sapiens
atgtggcttttttaaaaaagca

SEQ ID NO: 3357752 - DNA, 13 bp, Homo sapiens
atgtgggcactgg

SEQ ID NO: 3357753 - DNA, 18 bp, Homo sapiens
atgtgggcactggcccag

SEQ ID NO: 3357754 - DNA, 20 bp, Homo sapiens
atgtgggctagttgggcttc

SEQ ID NO: 3357755 - DNA, 13 bp, Homo sapiens
atgtggtctcagg

SEQ ID NO: 3357756 - DNA, 14 bp, Homo sapiens
atgtggtctcagga

SEQ ID NO: 3357757 - DNA, 18 bp, Homo sapiens
atgtggtggcacaggccc

SEQ ID NO: 3357758 - DNA, 15 bp, Homo sapiens
atgtggttacacact

SEQ ID NO: 3357759 - DNA, 15 bp, Homo sapiens
atgtggttcttcaaa

SEQ ID NO: 3357760 - DNA, 13 bp, Homo sapiens
atgtgtaagtatt

SEQ ID NO: 3357761 - DNA, 14 bp, Homo sapiens
atgtgtaagtattc

SEQ ID NO: 3357762 - DNA, 14 bp, Homo sapiens
atgtgtacagtgaa

SEQ ID NO: 3357763 - DNA, 23 bp, Homo sapiens
atgtgtacagtgaattgtctttt

SEQ ID NO: 3357764 - DNA, 22 bp, Homo sapiens
atgtgtacatggcagagtttgt

SEQ ID NO: 3357765 - DNA, 13 bp, Homo sapiens
atgtgtagggctg

SEQ ID NO: 3357766 - DNA, 13 bp, Homo sapiens
atgtgtataaatt

SEQ ID NO: 3357767 - DNA, 18 bp, Homo sapiens
atgtgtatgtgtggtttc

SEQ ID NO: 3357768 - DNA, 14 bp, Homo sapiens
atgtgtatttatac

SEQ ID NO: 3357769 - DNA, 20 bp, Homo sapiens
atgtgtcaatgtaaagccaa

SEQ ID NO: 3357770 - DNA, 15 bp, Homo sapiens
atgtgtcacttgtgc

SEQ ID NO: 3357771 - DNA, 18 bp, Homo sapiens
atgtgtcccctcactctg

SEQ ID NO: 3357772 - DNA, 19 bp, Homo sapiens
atgtgtcccctcactctgt

SEQ ID NO: 3357773 - DNA, 22 bp, Homo sapiens
atgtgtcccctcactctgtcag

SEQ ID NO: 3357774 - DNA, 18 bp, Homo sapiens
atgtgtcctcagggagca

SEQ ID NO: 3357775 - DNA, 16 bp, Homo sapiens
atgtgtctgtatttca

SEQ ID NO: 3357776 - DNA, 19 bp, Homo sapiens
atgtgtctttatagatgta

SEQ ID NO: 3357777 - DNA, 14 bp, Homo sapiens
atgtgtctttctaa

SEQ ID NO: 3357778 - DNA, 22 bp, Homo sapiens
atgtgtgagctttttttaaata

SEQ ID NO: 3357779 - DNA, 12 bp, Homo sapiens
atgtgtgcatgt

SEQ ID NO: 3357780 - DNA, 11 bp, Homo sapiens
atgtgtgccat

SEQ ID NO: 3357781 - DNA, 18 bp, Homo sapiens
atgtgtgccatagagttt

SEQ ID NO: 3357782 - DNA, 16 bp, Homo sapiens
atgtgtgcctgtggca

SEQ ID NO: 3357783 - DNA, 13 bp, Homo sapiens
attaagaatgttg

SEQ ID NO: 3357784 - DNA, 17 bp, Homo sapiens
attaagatacaaattaa

SEQ ID NO: 3357785 - DNA, 20 bp, Homo sapiens
attaagatggattctcagat

SEQ ID NO: 3357786 - DNA, 24 bp, Homo sapiens
attaagatggattctcagatattt

SEQ ID NO: 3357787 - DNA, 16 bp, Homo sapiens
attaagatttccaagt

SEQ ID NO: 3357788 - DNA, 20 bp, Homo sapiens
attaagcttttgtctgtagg

SEQ ID NO: 3357789 - DNA, 15 bp, Homo sapiens
attaaggcagtatga

SEQ ID NO: 3357790 - DNA, 18 bp, Homo sapiens
attaaggggaagaatgaa

SEQ ID NO: 3357791 - DNA, 17 bp, Homo sapiens
attaaggtgatgtgatt

SEQ ID NO: 3357792 - DNA, 18 bp, Homo sapiens
attaagtactatgtatca

SEQ ID NO: 3357793 - DNA, 22 bp, Homo sapiens
attaagtatctgggattattct

SEQ ID NO: 3357794 - DNA, 16 bp, Homo sapiens
attaagtcatgtgtga

SEQ ID NO: 3357795 - DNA, 21 bp, Homo sapiens
attaagtctgggatgtagaac

SEQ ID NO: 3357796 - DNA, 22 bp, Homo sapiens
attaagttacaattacatctct

SEQ ID NO: 3357797 - DNA, 12 bp, Homo sapiens
attaataaaaag

SEQ ID NO: 3357798 - DNA, 17 bp, Homo sapiens
attaataaagcattctt

SEQ ID NO: 3357799 - DNA, 12 bp, Homo sapiens
attaataatctt

SEQ ID NO: 3357800 - DNA, 13 bp, Homo sapiens
attaataatctta

SEQ ID NO: 3357801 - DNA, 16 bp, Homo sapiens
attaatactaaaatat

SEQ ID NO: 3357802 - DNA, 21 bp, Homo sapiens
attaatactctatttttacat

SEQ ID NO: 3357803 - DNA, 16 bp, Homo sapiens
attaatacttcatttg

SEQ ID NO: 3357804 - DNA, 18 bp, Homo sapiens
attaatagcttttattgt

SEQ ID NO: 3357805 - DNA, 19 bp, Homo sapiens
attaatagcttttattgta

SEQ ID NO: 3357806 - DNA, 20 bp, Homo sapiens
attaatatatgtattattta

SEQ ID NO: 3357807 - DNA, 13 bp, Homo sapiens
attaatatattaa

SEQ ID NO: 3357808 - DNA, 14 bp, Homo sapiens
attaatatattaaa

SEQ ID NO: 3357809 - DNA, 13 bp, Homo sapiens
attaatatgagtt

SEQ ID NO: 3357810 - DNA, 15 bp, Homo sapiens
attaatattattatg

SEQ ID NO: 3357811 - DNA, 20 bp, Homo sapiens
attaatattattatgaattt

SEQ ID NO: 3357812 - DNA, 12 bp, Homo sapiens
attaatatttaa

SEQ ID NO: 3357813 - DNA, 13 bp, Homo sapiens
attaatcaaaggc

SEQ ID NO: 3357814 - DNA, 15 bp, Homo sapiens
attaatcaccttctt

SEQ ID NO: 3357815 - DNA, 16 bp, Homo sapiens
attaatcaccttcttt

SEQ ID NO: 3357816 - DNA, 21 bp, Homo sapiens
attaatcatttgatttaaaca

SEQ ID NO: 3357817 - DNA, 14 bp, Homo sapiens
attaatctaaaaaa

SEQ ID NO: 3357818 - DNA, 23 bp, Homo sapiens
attaatctttctttacctgagac

SEQ ID NO: 3357819 - DNA, 21 bp, Homo sapiens
attaatgattaaagactgtga

SEQ ID NO: 3357820 - DNA, 14 bp, Homo sapiens
attaatggcactga

SEQ ID NO: 3357821 - DNA, 13 bp, Homo sapiens
attaatgttaatt

SEQ ID NO: 3357822 - DNA, 18 bp, Homo sapiens
attaatgttaattcagca

SEQ ID NO: 3357823 - DNA, 20 bp, Homo sapiens
attaatgtttctatctgatt

SEQ ID NO: 3357824 - DNA, 17 bp, Homo sapiens
attaatgtttcttaaat

SEQ ID NO: 3357825 - DNA, 20 bp, Homo sapiens
attaatgtttcttaaatgga

SEQ ID NO: 3357826 - DNA, 15 bp, Homo sapiens
attaatgttttcaaa

SEQ ID NO: 3357827 - DNA, 17 bp, Homo sapiens
attaatgttttcattat

SEQ ID NO: 3357828 - DNA, 15 bp, Homo sapiens
attaatgttttgtac

SEQ ID NO: 3357829 - DNA, 13 bp, Homo sapiens
attaattaattaa

SEQ ID NO: 3357830 - DNA, 14 bp, Homo sapiens
attaattaattaaa

SEQ ID NO: 3357831 - DNA, 18 bp, Homo sapiens
attaattacatacagatt

SEQ ID NO: 3357832 - DNA, 21 bp, Homo sapiens
attaattatgaagattatgat

SEQ ID NO: 3357833 - DNA, 14 bp, Homo sapiens
attaattctataag

SEQ ID NO: 3357834 - DNA, 16 bp, Homo sapiens
attaattcttcacctg

SEQ ID NO: 3357835 - DNA, 14 bp, Homo sapiens
attaattgtcatta

SEQ ID NO: 3357836 - DNA, 19 bp, Homo sapiens
attaattgttttgcacttt

SEQ ID NO: 3357837 - DNA, 12 bp, Homo sapiens
attaatttgaaa

SEQ ID NO: 3357838 - DNA, 13 bp, Homo sapiens
attaatttgaaac

SEQ ID NO: 3357839 - DNA, 15 bp, Homo sapiens
attaatttgaaacca

SEQ ID NO: 3357840 - DNA, 21 bp, Homo sapiens
attaatttgaaaccaggacat

SEQ ID NO: 3357841 - DNA, 22 bp, Homo sapiens
attaatttgaaaccaggacatt

SEQ ID NO: 3357842 - DNA, 17 bp, Homo sapiens
attaatttgattaacaa

SEQ ID NO: 3357843 - DNA, 18 bp, Homo sapiens
attaatttgattaacaaa

SEQ ID NO: 3357844 - DNA, 15 bp, Homo sapiens
attaattttgtgcat

SEQ ID NO: 3357845 - DNA, 18 bp, Homo sapiens
attaattttgtgcattct

SEQ ID NO: 3357846 - DNA, 24 bp, Homo sapiens
attaattttgtgcattctttggta

SEQ ID NO: 3357847 - DNA, 10 bp, Homo sapiens
attacaaaga

SEQ ID NO: 3357848 - DNA, 21 bp, Homo sapiens
attacaaagaaccatgcagga

SEQ ID NO: 3357849 - DNA, 10 bp, Homo sapiens
attacaaata

SEQ ID NO: 3357850 - DNA, 23 bp, Homo sapiens
attacaaatcagaagtcatcttg

SEQ ID NO: 3357851 - DNA, 21 bp, Homo sapiens
attacaaatggtgaatggatt

SEQ ID NO: 3357852 - DNA, 15 bp, Homo sapiens
attacaacagtgaga

SEQ ID NO: 3357853 - DNA, 15 bp, Homo sapiens
attacaatggaaaca

SEQ ID NO: 3357854 - DNA, 15 bp, Homo sapiens
attacaattttatct

SEQ ID NO: 3357855 - DNA, 14 bp, Homo sapiens
attacacccaaaga

SEQ ID NO: 3357856 - DNA, 18 bp, Homo sapiens
attacactgtatttgtat

SEQ ID NO: 3357857 - DNA, 15 bp, Homo sapiens
attacagaaactgat

SEQ ID NO: 3357858 - DNA, 18 bp, Homo sapiens
attacagagaggagaaac

SEQ ID NO: 3357859 - DNA, 17 bp, Homo sapiens
attacagaggaagttat

SEQ ID NO: 3357860 - DNA, 21 bp, Homo sapiens
attacagatgggcaaattaag

SEQ ID NO: 3357861 - DNA, 21 bp, Homo sapiens
attacaggaatgaagaactgt

SEQ ID NO: 3357862 - DNA, 22 bp, Homo sapiens
attacataatttagttgtttct

SEQ ID NO: 3357863 - DNA, 13 bp, Homo sapiens
attacatacagat

SEQ ID NO: 3357864 - DNA, 21 bp, Homo sapiens
attacatacagattttaccta

SEQ ID NO: 3357865 - DNA, 14 bp, Homo sapiens
attacatctaatgc

SEQ ID NO: 3357866 - DNA, 19 bp, Homo sapiens
attacatctctaattttgg

SEQ ID NO: 3357867 - DNA, 14 bp, Homo sapiens
attacattcctaac

SEQ ID NO: 3357868 - DNA, 21 bp, Homo sapiens
attacattcctaactagaatt

SEQ ID NO: 3357869 - DNA, 22 bp, Homo sapiens
attacattcctaactagaatta

SEQ ID NO: 3357870 - DNA, 19 bp, Homo sapiens
attacattgctttttcttg

SEQ ID NO: 3357871 - DNA, 11 bp, Homo sapiens
attacatttaa

SEQ ID NO: 3357872 - DNA, 23 bp, Homo sapiens
attacattttattaagctttttg

SEQ ID NO: 3357873 - DNA, 19 bp, Homo sapiens
attaccaaaaaagtatttt

SEQ ID NO: 3357874 - DNA, 12 bp, Homo sapiens
attaccaaaata

SEQ ID NO: 3357875 - DNA, 16 bp, Homo sapiens
attaccagacaaaaaa

SEQ ID NO: 3357876 - DNA, 15 bp, Homo sapiens
attaccattaattac

SEQ ID NO: 3357877 - DNA, 13 bp, Homo sapiens
attaccccctcct

SEQ ID NO: 3357878 - DNA, 18 bp, Homo sapiens
attaccccctccttcaga

SEQ ID NO: 3357879 - DNA, 21 bp, Homo sapiens
attaccccctccttcagacac

SEQ ID NO: 3357880 - DNA, 17 bp, Homo sapiens
attaccctctgcagaac

SEQ ID NO: 3357881 - DNA, 13 bp, Homo sapiens
attaccttactgt

SEQ ID NO: 3357882 - DNA, 13 bp, Homo sapiens
attactaaattgt

SEQ ID NO: 3357883 - DNA, 21 bp, Homo sapiens
attactacaaaatttgaaatt

SEQ ID NO: 3357884 - DNA, 21 bp, Homo sapiens
attactattccctttgacttc

SEQ ID NO: 3357885 - DNA, 17 bp, Homo sapiens
attactcagcacagaga

SEQ ID NO: 3357886 - DNA, 13 bp, Homo sapiens
attactcaggttt

SEQ ID NO: 3357887 - DNA, 20 bp, Homo sapiens
attactgccattcacttcat

SEQ ID NO: 3357888 - DNA, 17 bp, Homo sapiens
attactggcctttttca

SEQ ID NO: 3357889 - DNA, 22 bp, Homo sapiens
attactggcctttttcatttat

SEQ ID NO: 3357890 - DNA, 15 bp, Homo sapiens
attactgggccttag

SEQ ID NO: 3357891 - DNA, 15 bp, Homo sapiens
attactggtccaaaa

SEQ ID NO: 3357892 - DNA, 13 bp, Homo sapiens
attactgtcaata

SEQ ID NO: 3357893 - DNA, 15 bp, Homo sapiens
attactgtcaataaa

SEQ ID NO: 3357894 - DNA, 13 bp, Homo sapiens
attactgtcttta

SEQ ID NO: 3357895 - DNA, 20 bp, Homo sapiens
attactgtctttattcttat

SEQ ID NO: 3357896 - DNA, 13 bp, Homo sapiens
attactgtgtaaa

SEQ ID NO: 3357897 - DNA, 14 bp, Homo sapiens
attactgttccaga

SEQ ID NO: 3357898 - DNA, 14 bp, Homo sapiens
attactgttgcatt

SEQ ID NO: 3357899 - DNA, 19 bp, Homo sapiens
attactgttgcatttactt

SEQ ID NO: 3357900 - DNA, 16 bp, Homo sapiens
attactgtttgttctc

SEQ ID NO: 3357901 - DNA, 21 bp, Homo sapiens
attactgtttgttctcttatt

SEQ ID NO: 3357902 - DNA, 15 bp, Homo sapiens
attacttatttttga

SEQ ID NO: 3357903 - DNA, 17 bp, Homo sapiens
attacttatttttgaca

SEQ ID NO: 3357904 - DNA, 16 bp, Homo sapiens
attacttctgtttggg

SEQ ID NO: 3357905 - DNA, 22 bp, Homo sapiens
attacttgctttcaattgacaa

SEQ ID NO: 3357906 - DNA, 14 bp, Homo sapiens
attactttaatgat

SEQ ID NO: 3357907 - DNA, 17 bp, Homo sapiens
attactttctctgtagt

SEQ ID NO: 3357908 - DNA, 21 bp, Homo sapiens
attactttggggctaatttaa

SEQ ID NO: 3357909 - DNA, 12 bp, Homo sapiens
attacttttaaa

SEQ ID NO: 3357910 - DNA, 18 bp, Homo sapiens
attcgtggcatgttttga

SEQ ID NO: 3357911 - DNA, 23 bp, Homo sapiens
attcgtggtgatcaattaaatgt

SEQ ID NO: 3357912 - DNA, 16 bp, Homo sapiens
attcgtgtgttttttt

SEQ ID NO: 3357913 - DNA, 14 bp, Homo sapiens
attctaaaaccatt

SEQ ID NO: 3357914 - DNA, 15 bp, Homo sapiens
attctaaagattcta

SEQ ID NO: 3357915 - DNA, 17 bp, Homo sapiens
attctaaagattctata

SEQ ID NO: 3357916 - DNA, 15 bp, Homo sapiens
attctaaatgaatgt

SEQ ID NO: 3357917 - DNA, 20 bp, Homo sapiens
attctaagccagttttcatt

SEQ ID NO: 3357918 - DNA, 21 bp, Homo sapiens
attctaagccagttttcattt

SEQ ID NO: 3357919 - DNA, 18 bp, Homo sapiens
attctaagttatttactt

SEQ ID NO: 3357920 - DNA, 18 bp, Homo sapiens
attctaatgtcttcattt

SEQ ID NO: 3357921 - DNA, 12 bp, Homo sapiens
attctaattaaa

SEQ ID NO: 3357922 - DNA, 17 bp, Homo sapiens
attctaattgtcagtga

SEQ ID NO: 3357923 - DNA, 20 bp, Homo sapiens
attctacagaataatccagt

SEQ ID NO: 3357924 - DNA, 14 bp, Homo sapiens
attctactaagtta

SEQ ID NO: 3357925 - DNA, 22 bp, Homo sapiens
attctactagcaggcaatgctg

SEQ ID NO: 3357926 - DNA, 15 bp, Homo sapiens
attctactcttgtca

SEQ ID NO: 3357927 - DNA, 15 bp, Homo sapiens
attctagctaatgta

SEQ ID NO: 3357928 - DNA, 18 bp, Homo sapiens
attctagctaatgtaata

SEQ ID NO: 3357929 - DNA, 16 bp, Homo sapiens
attctaggcatcccag

SEQ ID NO: 3357930 - DNA, 20 bp, Homo sapiens
attctagggtttcttaaata

SEQ ID NO: 3357931 - DNA, 23 bp, Homo sapiens
attctagggtttcttaaatatat

SEQ ID NO: 3357932 - DNA, 16 bp, Homo sapiens
attctagttttgtcaa

SEQ ID NO: 3357933 - DNA, 14 bp, Homo sapiens
attctataaaactc

SEQ ID NO: 3357934 - DNA, 14 bp, Homo sapiens
attctatagttcta

SEQ ID NO: 3357935 - DNA, 16 bp, Homo sapiens
attctatagttctaga

SEQ ID NO: 3357936 - DNA, 13 bp, Homo sapiens
attctatatgaat

SEQ ID NO: 3357937 - DNA, 19 bp, Homo sapiens
attctatatgaatttaaat

SEQ ID NO: 3357938 - DNA, 21 bp, Homo sapiens
attctatggccattactaaca

SEQ ID NO: 3357939 - DNA, 13 bp, Homo sapiens
attctatgtatgt

SEQ ID NO: 3357940 - DNA, 19 bp, Homo sapiens
attctatgttaaatactgt

SEQ ID NO: 3357941 - DNA, 15 bp, Homo sapiens
attctattaaagtgc

SEQ ID NO: 3357942 - DNA, 13 bp, Homo sapiens
attctattatata

SEQ ID NO: 3357943 - DNA, 22 bp, Homo sapiens
attctattgcagttatagaaaa

SEQ ID NO: 3357944 - DNA, 15 bp, Homo sapiens
attctatttgctggg

SEQ ID NO: 3357945 - DNA, 19 bp, Homo sapiens
attctcaaagtttcctaat

SEQ ID NO: 3357946 - DNA, 17 bp, Homo sapiens
attctcaaagttttatt

SEQ ID NO: 3357947 - DNA, 21 bp, Homo sapiens
attctcaccaatcgctcccca

SEQ ID NO: 3357948 - DNA, 17 bp, Homo sapiens
attctcagagcatgtgt

SEQ ID NO: 3357949 - DNA, 16 bp, Homo sapiens
attctcagatatttat

SEQ ID NO: 3357950 - DNA, 14 bp, Homo sapiens
attctcatgcctca

SEQ ID NO: 3357951 - DNA, 20 bp, Homo sapiens
attctcatgcctcagcctct

SEQ ID NO: 3357952 - DNA, 19 bp, Homo sapiens
attctcctgcctcagcctc

SEQ ID NO: 3357953 - DNA, 23 bp, Homo sapiens
attctcctgcctcagcctcccaa

SEQ ID NO: 3357954 - DNA, 22 bp, Homo sapiens
attctcctgcctgtagcagtga

SEQ ID NO: 3357955 - DNA, 11 bp, Homo sapiens
attctcctgga

SEQ ID NO: 3357956 - DNA, 13 bp, Homo sapiens
attctctatttat

SEQ ID NO: 3357957 - DNA, 17 bp, Homo sapiens
attctctatttgaatta

SEQ ID NO: 3357958 - DNA, 13 bp, Homo sapiens
attctctgagtgg

SEQ ID NO: 3357959 - DNA, 22 bp, Homo sapiens
attctctgtgtctaagattcta

SEQ ID NO: 3357960 - DNA, 14 bp, Homo sapiens
attctcttgaataa

SEQ ID NO: 3357961 - DNA, 14 bp, Homo sapiens
attctctttcaaag

SEQ ID NO: 3357962 - DNA, 16 bp, Homo sapiens
attctgaaaccacagt

SEQ ID NO: 3357963 - DNA, 18 bp, Homo sapiens
attctgaaaccacagttt

SEQ ID NO: 3357964 - DNA, 21 bp, Homo sapiens
attctgaaaccacagtttcat

SEQ ID NO: 3357965 - DNA, 22 bp, Homo sapiens
attctgaaatttttttcctaag

SEQ ID NO: 3357966 - DNA, 23 bp, Homo sapiens
attctgaattaattaatttggag

SEQ ID NO: 3357967 - DNA, 20 bp, Homo sapiens
attctgaccacccttctcat

SEQ ID NO: 3357968 - DNA, 20 bp, Homo sapiens
attctgactcggtttctcca

SEQ ID NO: 3357969 - DNA, 19 bp, Homo sapiens
attctgagacatgtgtcaa

SEQ ID NO: 3357970 - DNA, 14 bp, Homo sapiens
attctgagccttga

SEQ ID NO: 3357971 - DNA, 17 bp, Homo sapiens
attctgaggccctgccc

SEQ ID NO: 3357972 - DNA, 13 bp, Homo sapiens
attctgattccac

SEQ ID NO: 3357973 - DNA, 23 bp, Homo sapiens
attctgatttcagtttttcattt

SEQ ID NO: 3357974 - DNA, 20 bp, Homo sapiens
attctgatttgtattaaaat

SEQ ID NO: 3357975 - DNA, 21 bp, Homo sapiens
attctgcctagagtgtagcct

SEQ ID NO: 3357976 - DNA, 15 bp, Homo sapiens
attctgcctgcccag

SEQ ID NO: 3357977 - DNA, 19 bp, Homo sapiens
attctgcctgcccaggccc

SEQ ID NO: 3357978 - DNA, 18 bp, Homo sapiens
attctgctcacatatctg

SEQ ID NO: 3357979 - DNA, 10 bp, Homo sapiens
attctgggaa

SEQ ID NO: 3357980 - DNA, 22 bp, Homo sapiens
attctgggaagcttgagcctcc

SEQ ID NO: 3357981 - DNA, 21 bp, Homo sapiens
attctgggaggcaagaaaagg

SEQ ID NO: 3357982 - DNA, 22 bp, Homo sapiens
attctgggaggcaagaaaagga

SEQ ID NO: 3357983 - DNA, 19 bp, Homo sapiens
attctggttccagggtccc

SEQ ID NO: 3357984 - DNA, 23 bp, Homo sapiens
attctggttccagggtccctctg

SEQ ID NO: 3357985 - DNA, 14 bp, Homo sapiens
attctgtaaaatgt

SEQ ID NO: 3357986 - DNA, 12 bp, Homo sapiens
attctgtaaatg

SEQ ID NO: 3357987 - DNA, 20 bp, Homo sapiens
attctgtacatagcctatat

SEQ ID NO: 3357988 - DNA, 18 bp, Homo sapiens
attctgtgaccaaaatac

SEQ ID NO: 3357989 - DNA, 20 bp, Homo sapiens
attctgtgaccaaaatacct

SEQ ID NO: 3357990 - DNA, 21 bp, Homo sapiens
attctgtgaccaaaatacctt

SEQ ID NO: 3357991 - DNA, 17 bp, Homo sapiens
attctgtgtgttttcat

SEQ ID NO: 3357992 - DNA, 21 bp, Homo sapiens
attctgtgtgttttcataata

SEQ ID NO: 3357993 - DNA, 20 bp, Homo sapiens
attctgttgcatagactagt

SEQ ID NO: 3357994 - DNA, 13 bp, Homo sapiens
attctgttggaag

SEQ ID NO: 3357995 - DNA, 19 bp, Homo sapiens
attctgttggccagtgtga

SEQ ID NO: 3357996 - DNA, 23 bp, Homo sapiens
attctgttgttccattttatgca

SEQ ID NO: 3357997 - DNA, 19 bp, Homo sapiens
attctgtttttaatgctat

SEQ ID NO: 3357998 - DNA, 20 bp, Homo sapiens
attcttaaaatatatttcag

SEQ ID NO: 3357999 - DNA, 22 bp, Homo sapiens
attcttaagggaacttccacat

SEQ ID NO: 3358000 - DNA, 21 bp, Homo sapiens
attcttaagtcttttgtctga

SEQ ID NO: 3358001 - DNA, 18 bp, Homo sapiens
attcttacaattgcactg

SEQ ID NO: 3358002 - DNA, 22 bp, Homo sapiens
attcttacaattgcactgctgt

SEQ ID NO: 3358003 - DNA, 20 bp, Homo sapiens
attcttacactgcctgtata

SEQ ID NO: 3358004 - DNA, 14 bp, Homo sapiens
attcttattaattc

SEQ ID NO: 3358005 - DNA, 13 bp, Homo sapiens
attcttatttaat

SEQ ID NO: 3358006 - DNA, 16 bp, Homo sapiens
attcttatttttccta

SEQ ID NO: 3358007 - DNA, 17 bp, Homo sapiens
attcttcacctgttatg

SEQ ID NO: 3358008 - DNA, 17 bp, Homo sapiens
attcttcacctttgtaa

SEQ ID NO: 3358009 - DNA, 12 bp, Homo sapiens
attcttcctagt

SEQ ID NO: 3358010 - DNA, 17 bp, Homo sapiens
attcttcctagttttct

SEQ ID NO: 3358011 - DNA, 19 bp, Homo sapiens
attcttctcataaatcttt

SEQ ID NO: 3358012 - DNA, 13 bp, Homo sapiens
attcttctgaact

SEQ ID NO: 3358013 - DNA, 11 bp, Homo sapiens
attcttctgct

SEQ ID NO: 3358014 - DNA, 14 bp, Homo sapiens
attcttctgcttca

SEQ ID NO: 3358015 - DNA, 20 bp, Homo sapiens
attcttctgcttcagcctcc

SEQ ID NO: 3358016 - DNA, 20 bp, Homo sapiens
attcttctggtgctactcca

SEQ ID NO: 3358017 - DNA, 22 bp, Homo sapiens
attcttctggtgctactccatg

SEQ ID NO: 3358018 - DNA, 20 bp, Homo sapiens
attcttgctgggcatacttt

SEQ ID NO: 3358019 - DNA, 17 bp, Homo sapiens
attcttgtcacaataaa

SEQ ID NO: 3358020 - DNA, 18 bp, Homo sapiens
attcttgtcacaataaat

SEQ ID NO: 3358021 - DNA, 16 bp, Homo sapiens
attcttgttttacatt

SEQ ID NO: 3358022 - DNA, 15 bp, Homo sapiens
attctttaatagaag

SEQ ID NO: 3358023 - DNA, 18 bp, Homo sapiens
attctttactattaaaat

SEQ ID NO: 3358024 - DNA, 17 bp, Homo sapiens
attctttatttctgtca

SEQ ID NO: 3358025 - DNA, 21 bp, Homo sapiens
attctttatttctgtcattca

SEQ ID NO: 3358026 - DNA, 20 bp, Homo sapiens
attctttctattttcacaat

SEQ ID NO: 3358027 - DNA, 14 bp, Homo sapiens
attctttgaaaaca

SEQ ID NO: 3358028 - DNA, 19 bp, Homo sapiens
attctttgcttgaacacag

SEQ ID NO: 3358029 - DNA, 13 bp, Homo sapiens
attctttggtaat

SEQ ID NO: 3358030 - DNA, 17 bp, Homo sapiens
attctttggtaattttt

SEQ ID NO: 3358031 - DNA, 17 bp, Homo sapiens
attctttggttgtgaat

SEQ ID NO: 3358032 - DNA, 16 bp, Homo sapiens
attctttgttctgttt

SEQ ID NO: 3358033 - DNA, 19 bp, Homo sapiens
attcttttaaattagaaaa

SEQ ID NO: 3358034 - DNA, 23 bp, Homo sapiens
attcttttaaattagaaaatatt

SEQ ID NO: 3358035 - DNA, 19 bp, Homo sapiens
attgtttctttaagaaagt

SEQ ID NO: 3358036 - DNA, 15 bp, Homo sapiens
attgtttgctgctat

SEQ ID NO: 3358037 - DNA, 13 bp, Homo sapiens
attgtttgcttat

SEQ ID NO: 3358038 - DNA, 16 bp, Homo sapiens
attgtttgcttattgt

SEQ ID NO: 3358039 - DNA, 20 bp, Homo sapiens
attgtttggcttcctcctga

SEQ ID NO: 3358040 - DNA, 18 bp, Homo sapiens
attgtttggtaaatgttt

SEQ ID NO: 3358041 - DNA, 20 bp, Homo sapiens
attgtttgtctgtcttcata

SEQ ID NO: 3358042 - DNA, 19 bp, Homo sapiens
attgttttagagactatgg

SEQ ID NO: 3358043 - DNA, 10 bp, Homo sapiens
attgttttca

SEQ ID NO: 3358044 - DNA, 17 bp, Homo sapiens
attgttttcacttgtat

SEQ ID NO: 3358045 - DNA, 17 bp, Homo sapiens
attgttttcagtgtaca

SEQ ID NO: 3358046 - DNA, 20 bp, Homo sapiens
attgttttcttttacagact

SEQ ID NO: 3358047 - DNA, 14 bp, Homo sapiens
attgttttgaatat

SEQ ID NO: 3358048 - DNA, 15 bp, Homo sapiens
attgttttgcacttt

SEQ ID NO: 3358049 - DNA, 13 bp, Homo sapiens
attgtttttgtat

SEQ ID NO: 3358050 - DNA, 15 bp, Homo sapiens
attgtttttgtattt

SEQ ID NO: 3358051 - DNA, 16 bp, Homo sapiens
attgttttttaaagca

SEQ ID NO: 3358052 - DNA, 17 bp, Homo sapiens
atttaaaaaataaataa

SEQ ID NO: 3358053 - DNA, 18 bp, Homo sapiens
atttaaaaaattatggaa

SEQ ID NO: 3358054 - DNA, 21 bp, Homo sapiens
atttaaaaagctcactgctga

SEQ ID NO: 3358055 - DNA, 22 bp, Homo sapiens
atttaaaaagctcactgctgat

SEQ ID NO: 3358056 - DNA, 18 bp, Homo sapiens
atttaaaaatatttttgg

SEQ ID NO: 3358057 - DNA, 17 bp, Homo sapiens
atttaaaacagacactg

SEQ ID NO: 3358058 - DNA, 14 bp, Homo sapiens
atttaaaagcctgc

SEQ ID NO: 3358059 - DNA, 13 bp, Homo sapiens
atttaaaatgatt

SEQ ID NO: 3358060 - DNA, 16 bp, Homo sapiens
atttaaaatgattaga

SEQ ID NO: 3358061 - DNA, 11 bp, Homo sapiens
atttaaaatta

SEQ ID NO: 3358062 - DNA, 14 bp, Homo sapiens
atttaaaattaagt

SEQ ID NO: 3358063 - DNA, 21 bp, Homo sapiens
atttaaaattaagtagaacaa

SEQ ID NO: 3358064 - DNA, 17 bp, Homo sapiens
atttaaaattgctatgt

SEQ ID NO: 3358065 - DNA, 21 bp, Homo sapiens
atttaaaattgctatgttact

SEQ ID NO: 3358066 - DNA, 16 bp, Homo sapiens
atttaaacagcagtgt

SEQ ID NO: 3358067 - DNA, 20 bp, Homo sapiens
atttaaacagcagtgttccc

SEQ ID NO: 3358068 - DNA, 15 bp, Homo sapiens
atttaaacaggccca

SEQ ID NO: 3358069 - DNA, 19 bp, Homo sapiens
atttaaacaggcccagcat

SEQ ID NO: 3358070 - DNA, 17 bp, Homo sapiens
atttaaactatgataaa

SEQ ID NO: 3358071 - DNA, 22 bp, Homo sapiens
atttaaactatgataaattatg

SEQ ID NO: 3358072 - DNA, 19 bp, Homo sapiens
atttaaagaaaataaacac

SEQ ID NO: 3358073 - DNA, 21 bp, Homo sapiens
atttaaagacagggaagagca

SEQ ID NO: 3358074 - DNA, 13 bp, Homo sapiens
atttaaagatatt

SEQ ID NO: 3358075 - DNA, 19 bp, Homo sapiens
atttaaagatattgttcaa

SEQ ID NO: 3358076 - DNA, 15 bp, Homo sapiens
atttaaagcctcctc

SEQ ID NO: 3358077 - DNA, 19 bp, Homo sapiens
atttaaagttgtataaaaa

SEQ ID NO: 3358078 - DNA, 18 bp, Homo sapiens
atttaaatccttgtgtaa

SEQ ID NO: 3358079 - DNA, 16 bp, Homo sapiens
atttaaattctttttt

SEQ ID NO: 3358080 - DNA, 17 bp, Homo sapiens
atttaaatttaaagata

SEQ ID NO: 3358081 - DNA, 12 bp, Homo sapiens
atttaaatttga

SEQ ID NO: 3358082 - DNA, 14 bp, Homo sapiens
atttaaatttgatt

SEQ ID NO: 3358083 - DNA, 19 bp, Homo sapiens
atttaaatttgatttccat

SEQ ID NO: 3358084 - DNA, 22 bp, Homo sapiens
atttaaatttgatttccatctt

SEQ ID NO: 3358085 - DNA, 13 bp, Homo sapiens
atttaacaaacta

SEQ ID NO: 3358086 - DNA, 15 bp, Homo sapiens
atttaacaaactaaa

SEQ ID NO: 3358087 - DNA, 22 bp, Homo sapiens
atttaacagctgaattatctat

SEQ ID NO: 3358088 - DNA, 18 bp, Homo sapiens
atttaacagtcatttaaa

SEQ ID NO: 3358089 - DNA, 22 bp, Homo sapiens
atttaacatgcaacccgaaggt

SEQ ID NO: 3358090 - DNA, 15 bp, Homo sapiens
atttaacattattta

SEQ ID NO: 3358091 - DNA, 16 bp, Homo sapiens
atttaacctatttcca

SEQ ID NO: 3358092 - DNA, 20 bp, Homo sapiens
atttaacttaacattctgta

SEQ ID NO: 3358093 - DNA, 21 bp, Homo sapiens
atttaacttaacattctgtaa

SEQ ID NO: 3358094 - DNA, 20 bp, Homo sapiens
atttaagaaaagcacttttg

SEQ ID NO: 3358095 - DNA, 21 bp, Homo sapiens
atttaagaaaatacaataaac

SEQ ID NO: 3358096 - DNA, 15 bp, Homo sapiens
atttaagacactgaa

SEQ ID NO: 3358097 - DNA, 22 bp, Homo sapiens
atttaagccttataaaccaatc

SEQ ID NO: 3358098 - DNA, 17 bp, Homo sapiens
atttaagctgtaaatta

SEQ ID NO: 3358099 - DNA, 23 bp, Homo sapiens
atttaagggggaaaaagtgtcaa

SEQ ID NO: 3358100 - DNA, 16 bp, Homo sapiens
atttaagtgtatttaa

SEQ ID NO: 3358101 - DNA, 19 bp, Homo sapiens
atttaagttcatattccat

SEQ ID NO: 3358102 - DNA, 20 bp, Homo sapiens
atttaagtttcaaacttact

SEQ ID NO: 3358103 - DNA, 15 bp, Homo sapiens
atttaataaagatga

SEQ ID NO: 3358104 - DNA, 19 bp, Homo sapiens
atttaataacattacctta

SEQ ID NO: 3358105 - DNA, 23 bp, Homo sapiens
atttaataacattaccttactgt

SEQ ID NO: 3358106 - DNA, 22 bp, Homo sapiens
atttaatatctggcactgttaa

SEQ ID NO: 3358107 - DNA, 15 bp, Homo sapiens
atttaatatcttcag

SEQ ID NO: 3358108 - DNA, 21 bp, Homo sapiens
atttaatcacagtcatcttta

SEQ ID NO: 3358109 - DNA, 20 bp, Homo sapiens
atttaatccagttataagaa

SEQ ID NO: 3358110 - DNA, 15 bp, Homo sapiens
atttaatccattttt

SEQ ID NO: 3358111 - DNA, 21 bp, Homo sapiens
atttaatgaaagactgtacaa

SEQ ID NO: 3358112 - DNA, 13 bp, Homo sapiens
atttaatgctgcc

SEQ ID NO: 3358113 - DNA, 14 bp, Homo sapiens
atttaatgctgcct

SEQ ID NO: 3358114 - DNA, 14 bp, Homo sapiens
atttaattacctta

SEQ ID NO: 3358115 - DNA, 12 bp, Homo sapiens
atttaattatta

SEQ ID NO: 3358116 - DNA, 13 bp, Homo sapiens
atttaattattaa

SEQ ID NO: 3358117 - DNA, 15 bp, Homo sapiens
atttaattctttcta

SEQ ID NO: 3358118 - DNA, 12 bp, Homo sapiens
atttaatttcca

SEQ ID NO: 3358119 - DNA, 19 bp, Homo sapiens
atttaatttttttgagaca

SEQ ID NO: 3358120 - DNA, 13 bp, Homo sapiens
atttacaccacac

SEQ ID NO: 3358121 - DNA, 14 bp, Homo sapiens
atttacactgccat

SEQ ID NO: 3358122 - DNA, 19 bp, Homo sapiens
atttacagtctctttcttc

SEQ ID NO: 3358123 - DNA, 20 bp, Homo sapiens
atttacagtgaaaatgtaag

SEQ ID NO: 3358124 - DNA, 23 bp, Homo sapiens
atttacagtgaaaatgtaagctg

SEQ ID NO: 3358125 - DNA, 15 bp, Homo sapiens
atttacatgtatggt

SEQ ID NO: 3358126 - DNA, 12 bp, Homo sapiens
atttacatttta

SEQ ID NO: 3358127 - DNA, 13 bp, Homo sapiens
atttacattttat

SEQ ID NO: 3358128 - DNA, 14 bp, Homo sapiens
atttacattttata

SEQ ID NO: 3358129 - DNA, 21 bp, Homo sapiens
atttaccgttgcttgaaatta

SEQ ID NO: 3358130 - DNA, 15 bp, Homo sapiens
atttacctaagatta

SEQ ID NO: 3358131 - DNA, 18 bp, Homo sapiens
atttacctaagattacaa

SEQ ID NO: 3358132 - DNA, 19 bp, Homo sapiens
atttaccttttaagacatt

SEQ ID NO: 3358133 - DNA, 15 bp, Homo sapiens
atttactaaacatat

SEQ ID NO: 3358134 - DNA, 22 bp, Homo sapiens
atttactaaacatatgatttca

SEQ ID NO: 3358135 - DNA, 22 bp, Homo sapiens
atttactaagccacaagaaatt

SEQ ID NO: 3358136 - DNA, 23 bp, Homo sapiens
atttactaagccacaagaaattt

SEQ ID NO: 3358137 - DNA, 16 bp, Homo sapiens
atttactctttgcaaa

SEQ ID NO: 3358138 - DNA, 13 bp, Homo sapiens
atttactgagctt

SEQ ID NO: 3358139 - DNA, 20 bp, Homo sapiens
atttactgagcttctctgtg

SEQ ID NO: 3358140 - DNA, 21 bp, Homo sapiens
atttactgagcttctctgtga

SEQ ID NO: 3358141 - DNA, 17 bp, Homo sapiens
atttactgtactaatta

SEQ ID NO: 3358142 - DNA, 12 bp, Homo sapiens
atttacttgttt

SEQ ID NO: 3358143 - DNA, 23 bp, Homo sapiens
atttacttgttttggatggcttg

SEQ ID NO: 3358144 - DNA, 18 bp, Homo sapiens
atttagaaaaaagtttac

SEQ ID NO: 3358145 - DNA, 21 bp, Homo sapiens
atttagaaaagtgaattgaag

SEQ ID NO: 3358146 - DNA, 21 bp, Homo sapiens
atttagaaaatagagctttta

SEQ ID NO: 3358147 - DNA, 15 bp, Homo sapiens
atttagaaatataat

SEQ ID NO: 3358148 - DNA, 14 bp, Homo sapiens
atttagaactgtat

SEQ ID NO: 3358149 - DNA, 18 bp, Homo sapiens
atttagacaacctgaaat

SEQ ID NO: 3358150 - DNA, 20 bp, Homo sapiens
atttagagaactgtggccgt

SEQ ID NO: 3358151 - DNA, 22 bp, Homo sapiens
atttagagatgctgtaacttaa

SEQ ID NO: 3358152 - DNA, 23 bp, Homo sapiens
atttagataatttgaaaaagttc

SEQ ID NO: 3358153 - DNA, 16 bp, Homo sapiens
atttagatcttatatt

SEQ ID NO: 3358154 - DNA, 22 bp, Homo sapiens
atttagctaaacggattccaaa

SEQ ID NO: 3358155 - DNA, 17 bp, Homo sapiens
atttagggtactaaatt

SEQ ID NO: 3358156 - DNA, 19 bp, Homo sapiens
atttaggtttttattagta

SEQ ID NO: 3358157 - DNA, 18 bp, Homo sapiens
atttagttgaaaaatcta

SEQ ID NO: 3358158 - DNA, 14 bp, Homo sapiens
atttagtttcagta

SEQ ID NO: 3358159 - DNA, 20 bp, Homo sapiens
atttagtttcagtagattgc

SEQ ID NO: 3358160 - DNA, 19 bp, Homo sapiens
atttagtttttgttcttaa

SEQ ID NO: 3358161 - DNA, 21 bp, Homo sapiens
atttctttctttgcaccaaag

SEQ ID NO: 3358162 - DNA, 13 bp, Homo sapiens
atttcttttcctt

SEQ ID NO: 3358163 - DNA, 19 bp, Homo sapiens
atttctttttaattatttt

SEQ ID NO: 3358164 - DNA, 14 bp, Homo sapiens
atttgaaaaatata

SEQ ID NO: 3358165 - DNA, 15 bp, Homo sapiens
atttgaaaaatataa

SEQ ID NO: 3358166 - DNA, 18 bp, Homo sapiens
atttgaaaataattgttc

SEQ ID NO: 3358167 - DNA, 18 bp, Homo sapiens
atttgaaaccaggacatt

SEQ ID NO: 3358168 - DNA, 19 bp, Homo sapiens
atttgaaatactaaaagca

SEQ ID NO: 3358169 - DNA, 21 bp, Homo sapiens
atttgaaatactaaaagcaaa

SEQ ID NO: 3358170 - DNA, 23 bp, Homo sapiens
atttgaagctgcagtgagctgtg

SEQ ID NO: 3358171 - DNA, 17 bp, Homo sapiens
atttgaagtgtacctgt

SEQ ID NO: 3358172 - DNA, 17 bp, Homo sapiens
atttgaatatcattaaa

SEQ ID NO: 3358173 - DNA, 11 bp, Homo sapiens
atttgaatgaa

SEQ ID NO: 3358174 - DNA, 15 bp, Homo sapiens
atttgaatgaaaaat

SEQ ID NO: 3358175 - DNA, 16 bp, Homo sapiens
atttgaatgactgctg

SEQ ID NO: 3358176 - DNA, 18 bp, Homo sapiens
atttgaattatcagcaaa

SEQ ID NO: 3358177 - DNA, 20 bp, Homo sapiens
atttgaattttaaatctaaa

SEQ ID NO: 3358178 - DNA, 23 bp, Homo sapiens
atttgacaaaatttgttgaaatt

SEQ ID NO: 3358179 - DNA, 12 bp, Homo sapiens
atttgactaatt

SEQ ID NO: 3358180 - DNA, 13 bp, Homo sapiens
atttgactaattt

SEQ ID NO: 3358181 - DNA, 15 bp, Homo sapiens
atttgactaatttta

SEQ ID NO: 3358182 - DNA, 13 bp, Homo sapiens
atttgactattct

SEQ ID NO: 3358183 - DNA, 13 bp, Homo sapiens
atttgacttgaat

SEQ ID NO: 3358184 - DNA, 14 bp, Homo sapiens
atttgagagaagcc

SEQ ID NO: 3358185 - DNA, 22 bp, Homo sapiens
atttgaggacaaccattccaga

SEQ ID NO: 3358186 - DNA, 23 bp, Homo sapiens
atttgaggagtgttaagattgca

SEQ ID NO: 3358187 - DNA, 14 bp, Homo sapiens
atttgaggctcaga

SEQ ID NO: 3358188 - DNA, 20 bp, Homo sapiens
atttgagggcccagccagga

SEQ ID NO: 3358189 - DNA, 20 bp, Homo sapiens
atttgagttaacctttaaga

SEQ ID NO: 3358190 - DNA, 12 bp, Homo sapiens
atttgatactta

SEQ ID NO: 3358191 - DNA, 19 bp, Homo sapiens
atttgatacttatattttc

SEQ ID NO: 3358192 - DNA, 18 bp, Homo sapiens
atttgatagaaaggaaca

SEQ ID NO: 3358193 - DNA, 15 bp, Homo sapiens
atttgatatttgcat

SEQ ID NO: 3358194 - DNA, 16 bp, Homo sapiens
atttgatatttggtta

SEQ ID NO: 3358195 - DNA, 18 bp, Homo sapiens
atttgatatttttccatt

SEQ ID NO: 3358196 - DNA, 15 bp, Homo sapiens
atttgatgaaagctg

SEQ ID NO: 3358197 - DNA, 21 bp, Homo sapiens
atttgatgagttaactgtgaa

SEQ ID NO: 3358198 - DNA, 22 bp, Homo sapiens
atttgatgagttaactgtgaaa

SEQ ID NO: 3358199 - DNA, 14 bp, Homo sapiens
atttgatgctaaat

SEQ ID NO: 3358200 - DNA, 16 bp, Homo sapiens
atttgatgctggagag

SEQ ID NO: 3358201 - DNA, 17 bp, Homo sapiens
atttgatggtatttctt

SEQ ID NO: 3358202 - DNA, 19 bp, Homo sapiens
atttgatggtatttctttc

SEQ ID NO: 3358203 - DNA, 15 bp, Homo sapiens
atttgatgtgacttt

SEQ ID NO: 3358204 - DNA, 14 bp, Homo sapiens
atttgattaacaaa

SEQ ID NO: 3358205 - DNA, 13 bp, Homo sapiens
atttgattcgtat

SEQ ID NO: 3358206 - DNA, 18 bp, Homo sapiens
atttgattcgtatgatca

SEQ ID NO: 3358207 - DNA, 14 bp, Homo sapiens
atttgatttaaaca

SEQ ID NO: 3358208 - DNA, 18 bp, Homo sapiens
atttgatttttgtctcaa

SEQ ID NO: 3358209 - DNA, 21 bp, Homo sapiens
atttgcaacaggggaggaaaa

SEQ ID NO: 3358210 - DNA, 23 bp, Homo sapiens
atttgcaacaggggaggaaaaaa

SEQ ID NO: 3358211 - DNA, 19 bp, Homo sapiens
atttgcaaccatcagaatt

SEQ ID NO: 3358212 - DNA, 21 bp, Homo sapiens
atttgcaatattcctttgggc

SEQ ID NO: 3358213 - DNA, 11 bp, Homo sapiens
atttgcacagt

SEQ ID NO: 3358214 - DNA, 23 bp, Homo sapiens
atttgcacctctgttcatttcac

SEQ ID NO: 3358215 - DNA, 19 bp, Homo sapiens
atttgcacttatgtacttg

SEQ ID NO: 3358216 - DNA, 23 bp, Homo sapiens
atttgcagataattctggaccag

SEQ ID NO: 3358217 - DNA, 14 bp, Homo sapiens
atttgcagggtcct

SEQ ID NO: 3358218 - DNA, 22 bp, Homo sapiens
atttgcatggctccagaaatgt

SEQ ID NO: 3358219 - DNA, 19 bp, Homo sapiens
atttgcattaaattcacaa

SEQ ID NO: 3358220 - DNA, 22 bp, Homo sapiens
atttgcattgaacacaaactgt

SEQ ID NO: 3358221 - DNA, 19 bp, Homo sapiens
atttgcattgaggaaatat

SEQ ID NO: 3358222 - DNA, 15 bp, Homo sapiens
atttgccatgggctt

SEQ ID NO: 3358223 - DNA, 19 bp, Homo sapiens
atttgccatgggcttcact

SEQ ID NO: 3358224 - DNA, 20 bp, Homo sapiens
atttgcccatttacactttt

SEQ ID NO: 3358225 - DNA, 14 bp, Homo sapiens
atttgccttgcaga

SEQ ID NO: 3358226 - DNA, 17 bp, Homo sapiens
atttgccttgcagaact

SEQ ID NO: 3358227 - DNA, 18 bp, Homo sapiens
atttgccttgcagaactg

SEQ ID NO: 3358228 - DNA, 19 bp, Homo sapiens
atttgccttgcagaactgc

SEQ ID NO: 3358229 - DNA, 21 bp, Homo sapiens
atttgccttgcagaactgcca

SEQ ID NO: 3358230 - DNA, 22 bp, Homo sapiens
atttgccttgcagaactgccat

SEQ ID NO: 3358231 - DNA, 15 bp, Homo sapiens
atttgccttgctgga

SEQ ID NO: 3358232 - DNA, 14 bp, Homo sapiens
atttgcctttaaaa

SEQ ID NO: 3358233 - DNA, 23 bp, Homo sapiens
atttgcctttaaaaaaaaaagtt

SEQ ID NO: 3358234 - DNA, 18 bp, Homo sapiens
atttgctaatcaaagcca

SEQ ID NO: 3358235 - DNA, 23 bp, Homo sapiens
atttgctctttgacaactaaaat

SEQ ID NO: 3358236 - DNA, 23 bp, Homo sapiens
atttgctgacaaccattaaagtc

SEQ ID NO: 3358237 - DNA, 12 bp, Homo sapiens
atttgcttttca

SEQ ID NO: 3358238 - DNA, 13 bp, Homo sapiens
atttggaaagaga

SEQ ID NO: 3358239 - DNA, 15 bp, Homo sapiens
atttggaaataaagt

SEQ ID NO: 3358240 - DNA, 16 bp, Homo sapiens
atttggaaccttgttt

SEQ ID NO: 3358241 - DNA, 21 bp, Homo sapiens
atttggaagaaaaaaatcttc

SEQ ID NO: 3358242 - DNA, 11 bp, Homo sapiens
atttggagact

SEQ ID NO: 3358243 - DNA, 17 bp, Homo sapiens
atttggagactctgtgg

SEQ ID NO: 3358244 - DNA, 19 bp, Homo sapiens
atttggagggaagctcttg

SEQ ID NO: 3358245 - DNA, 20 bp, Homo sapiens
atttggatttaaaagcctgc

SEQ ID NO: 3358246 - DNA, 19 bp, Homo sapiens
atttggctcacttgcctta

SEQ ID NO: 3358247 - DNA, 20 bp, Homo sapiens
atttggctgggctacaattt

SEQ ID NO: 3358248 - DNA, 18 bp, Homo sapiens
atttgggaagtgaagact

SEQ ID NO: 3358249 - DNA, 19 bp, Homo sapiens
atttgggagacatgtgaca

SEQ ID NO: 3358250 - DNA, 21 bp, Homo sapiens
atttggggtataggtctcatc

SEQ ID NO: 3358251 - DNA, 22 bp, Homo sapiens
atttggtgggagttatatcagt

SEQ ID NO: 3358252 - DNA, 17 bp, Homo sapiens
atttggtgttcctggaa

SEQ ID NO: 3358253 - DNA, 19 bp, Homo sapiens
atttggtgttcctggaagc

SEQ ID NO: 3358254 - DNA, 21 bp, Homo sapiens
atttggttcattaattctata

SEQ ID NO: 3358255 - DNA, 14 bp, Homo sapiens
atttggtttctaga

SEQ ID NO: 3358256 - DNA, 16 bp, Homo sapiens
atttggtttctagatc

SEQ ID NO: 3358257 - DNA, 22 bp, Homo sapiens
atttgtaaaaacagcattgctt

SEQ ID NO: 3358258 - DNA, 14 bp, Homo sapiens
atttgtaaaccatt

SEQ ID NO: 3358259 - DNA, 16 bp, Homo sapiens
atttgtaaacttctga

SEQ ID NO: 3358260 - DNA, 21 bp, Homo sapiens
atttgtaaacttctgaagact

SEQ ID NO: 3358261 - DNA, 20 bp, Homo sapiens
atttgtaacctcagctctgg

SEQ ID NO: 3358262 - DNA, 14 bp, Homo sapiens
atttgtaataaagt

SEQ ID NO: 3358263 - DNA, 20 bp, Homo sapiens
atttgtaattgcttacattt

SEQ ID NO: 3358264 - DNA, 12 bp, Homo sapiens
atttgtaatttt

SEQ ID NO: 3358265 - DNA, 20 bp, Homo sapiens
atttgtacaaggtaattgtt

SEQ ID NO: 3358266 - DNA, 20 bp, Homo sapiens
atttgtacaggactgtaaag

SEQ ID NO: 3358267 - DNA, 21 bp, Homo sapiens
atttgtacatagttatttatt

SEQ ID NO: 3358268 - DNA, 19 bp, Homo sapiens
atttgtacttcttattgca

SEQ ID NO: 3358269 - DNA, 20 bp, Homo sapiens
atttgtacttcttattgcaa

SEQ ID NO: 3358270 - DNA, 16 bp, Homo sapiens
atttgtagatttatcc

SEQ ID NO: 3358271 - DNA, 11 bp, Homo sapiens
atttgtagcat

SEQ ID NO: 3358272 - DNA, 22 bp, Homo sapiens
atttgtatattacacatttgta

SEQ ID NO: 3358273 - DNA, 23 bp, Homo sapiens
atttgtatattgtggatgtgttc

SEQ ID NO: 3358274 - DNA, 19 bp, Homo sapiens
atttgtatctctgaagcat

SEQ ID NO: 3358275 - DNA, 22 bp, Homo sapiens
atttgtatctctgaagcatgtt

SEQ ID NO: 3358276 - DNA, 14 bp, Homo sapiens
atttgtattaataa

SEQ ID NO: 3358277 - DNA, 15 bp, Homo sapiens
atttgtattaataaa

SEQ ID NO: 3358278 - DNA, 19 bp, Homo sapiens
atttgtattaataaagcat

SEQ ID NO: 3358279 - DNA, 23 bp, Homo sapiens
atttgtattactttctctgtagt

SEQ ID NO: 3358280 - DNA, 22 bp, Homo sapiens
atttgtattttgcttaaaattt

SEQ ID NO: 3358281 - DNA, 16 bp, Homo sapiens
atttgtcacagaaatc

SEQ ID NO: 3358282 - DNA, 21 bp, Homo sapiens
atttgtcacagaaatcagagg

SEQ ID NO: 3358283 - DNA, 19 bp, Homo sapiens
atttgtcatgctgggattt

SEQ ID NO: 3358284 - DNA, 15 bp, Homo sapiens
atttgtcccagcctg

SEQ ID NO: 3358285 - DNA, 19 bp, Homo sapiens
atttgtcccagcctggggc

SEQ ID NO: 3358286 - DNA, 19 bp, Homo sapiens
caaaacgcatggagtgtgt

SEQ ID NO: 3358287 - DNA, 16 bp, Homo sapiens
caaaactagaattgtt

SEQ ID NO: 3358288 - DNA, 18 bp, Homo sapiens
caaaactccgcccccagc

SEQ ID NO: 3358289 - DNA, 16 bp, Homo sapiens
caaaactcctgtcttt

SEQ ID NO: 3358290 - DNA, 16 bp, Homo sapiens
caaaactgtaaataaa

SEQ ID NO: 3358291 - DNA, 13 bp, Homo sapiens
caaaacttaacat

SEQ ID NO: 3358292 - DNA, 19 bp, Homo sapiens
caaaacttccaaggccctg

SEQ ID NO: 3358293 - DNA, 15 bp, Homo sapiens
caaaacttcttgtca

SEQ ID NO: 3358294 - DNA, 19 bp, Homo sapiens
caaaacttcttgtcagaca

SEQ ID NO: 3358295 - DNA, 17 bp, Homo sapiens
caaaactttaaacctgt

SEQ ID NO: 3358296 - DNA, 15 bp, Homo sapiens
caaaagacatgttgt

SEQ ID NO: 3358297 - DNA, 16 bp, Homo sapiens
caaaagacatgttgta

SEQ ID NO: 3358298 - DNA, 19 bp, Homo sapiens
caaaagatgctcttctgtg

SEQ ID NO: 3358299 - DNA, 16 bp, Homo sapiens
caaaagattgctgaaa

SEQ ID NO: 3358300 - DNA, 14 bp, Homo sapiens
caaaagcaagactg

SEQ ID NO: 3358301 - DNA, 19 bp, Homo sapiens
caaaagcatttatcattct

SEQ ID NO: 3358302 - DNA, 20 bp, Homo sapiens
caaaagccttgtgtatattt

SEQ ID NO: 3358303 - DNA, 22 bp, Homo sapiens
caaaagccttgtgtatatttgt

SEQ ID NO: 3358304 - DNA, 19 bp, Homo sapiens
caaaagctagacagatccc

SEQ ID NO: 3358305 - DNA, 15 bp, Homo sapiens
caaaaggaacaaaaa

SEQ ID NO: 3358306 - DNA, 15 bp, Homo sapiens
caaaaggaatgaact

SEQ ID NO: 3358307 - DNA, 23 bp, Homo sapiens
caaaaggatggtggttattttaa

SEQ ID NO: 3358308 - DNA, 11 bp, Homo sapiens
caaaaggcagc

SEQ ID NO: 3358309 - DNA, 22 bp, Homo sapiens
caaaaggcagctcacccctggg

SEQ ID NO: 3358310 - DNA, 16 bp, Homo sapiens
caaaaggctgagaagg

SEQ ID NO: 3358311 - DNA, 16 bp, Homo sapiens
caaaagtctgtctttc

SEQ ID NO: 3358312 - DNA, 14 bp, Homo sapiens
caaaagttccaaga

SEQ ID NO: 3358313 - DNA, 22 bp, Homo sapiens
caaaataaggaagagggctgag

SEQ ID NO: 3358314 - DNA, 18 bp, Homo sapiens
caaaataattttaagaaa

SEQ ID NO: 3358315 - DNA, 22 bp, Homo sapiens
caaaataattttaagaaatcaa

SEQ ID NO: 3358316 - DNA, 18 bp, Homo sapiens
caaaatacagcactttga

SEQ ID NO: 3358317 - DNA, 14 bp, Homo sapiens
caaaataccagagc

SEQ ID NO: 3358318 - DNA, 16 bp, Homo sapiens
caaaataccagagcct

SEQ ID NO: 3358319 - DNA, 15 bp, Homo sapiens
caaaatagcatttgt

SEQ ID NO: 3358320 - DNA, 16 bp, Homo sapiens
caaaatagcatttgtt

SEQ ID NO: 3358321 - DNA, 20 bp, Homo sapiens
caaaataggatttcttaaat

SEQ ID NO: 3358322 - DNA, 22 bp, Homo sapiens
caaaataggatttcttaaattt

SEQ ID NO: 3358323 - DNA, 14 bp, Homo sapiens
caaaatatacaaaa

SEQ ID NO: 3358324 - DNA, 15 bp, Homo sapiens
caaaatatgcccctt

SEQ ID NO: 3358325 - DNA, 21 bp, Homo sapiens
caaaatatgccccttcttggg

SEQ ID NO: 3358326 - DNA, 16 bp, Homo sapiens
caaaatatgtttaaaa

SEQ ID NO: 3358327 - DNA, 15 bp, Homo sapiens
caaaatatttcccat

SEQ ID NO: 3358328 - DNA, 16 bp, Homo sapiens
caaaatattttttgca

SEQ ID NO: 3358329 - DNA, 20 bp, Homo sapiens
caaaatcctgaactttctcc

SEQ ID NO: 3358330 - DNA, 21 bp, Homo sapiens
caaaatcgatgcagtgcttcc

SEQ ID NO: 3358331 - DNA, 18 bp, Homo sapiens
caaaatctgaactctcaa

SEQ ID NO: 3358332 - DNA, 22 bp, Homo sapiens
caaaatgaatgcaaaattgttt

SEQ ID NO: 3358333 - DNA, 14 bp, Homo sapiens
caaaatgacaatga

SEQ ID NO: 3358334 - DNA, 13 bp, Homo sapiens
caaaatgtctgta

SEQ ID NO: 3358335 - DNA, 22 bp, Homo sapiens
caaaatgtctgtagctcctcaa

SEQ ID NO: 3358336 - DNA, 14 bp, Homo sapiens
caaaatgtgtattt

SEQ ID NO: 3358337 - DNA, 16 bp, Homo sapiens
caaaatgttgaagaaa

SEQ ID NO: 3358338 - DNA, 17 bp, Homo sapiens
caaaatgttggtcattt

SEQ ID NO: 3358339 - DNA, 17 bp, Homo sapiens
caaaattcaaagcatgg

SEQ ID NO: 3358340 - DNA, 19 bp, Homo sapiens
caaaattcatttctaatta

SEQ ID NO: 3358341 - DNA, 20 bp, Homo sapiens
caaaattcttatttttccta

SEQ ID NO: 3358342 - DNA, 16 bp, Homo sapiens
caaaattgttttcact

SEQ ID NO: 3358343 - DNA, 15 bp, Homo sapiens
caaaatttccagtac

SEQ ID NO: 3358344 - DNA, 19 bp, Homo sapiens
caaaatttccagtaccttt

SEQ ID NO: 3358345 - DNA, 14 bp, Homo sapiens
caaaatttgaaatt

SEQ ID NO: 3358346 - DNA, 14 bp, Homo sapiens
caaaatttgactaa

SEQ ID NO: 3358347 - DNA, 16 bp, Homo sapiens
caaaattttaaaaaag

SEQ ID NO: 3358348 - DNA, 14 bp, Homo sapiens
caaaattttatttt

SEQ ID NO: 3358349 - DNA, 16 bp, Homo sapiens
caaaattttattttgt

SEQ ID NO: 3358350 - DNA, 22 bp, Homo sapiens
caaaattttctcattttctttt

SEQ ID NO: 3358351 - DNA, 20 bp, Homo sapiens
caaacaaaaaggttctcagg

SEQ ID NO: 3358352 - DNA, 13 bp, Homo sapiens
caaacaaaactta

SEQ ID NO: 3358353 - DNA, 23 bp, Homo sapiens
caaacaaccattttttgttctgt

SEQ ID NO: 3358354 - DNA, 14 bp, Homo sapiens
caaacaacctgccc

SEQ ID NO: 3358355 - DNA, 13 bp, Homo sapiens
caaacaagaaacg

SEQ ID NO: 3358356 - DNA, 19 bp, Homo sapiens
caaacaatcccaatctttc

SEQ ID NO: 3358357 - DNA, 14 bp, Homo sapiens
caaacaatgaagaa

SEQ ID NO: 3358358 - DNA, 14 bp, Homo sapiens
caaacacctcccag

SEQ ID NO: 3358359 - DNA, 15 bp, Homo sapiens
caaacacctcccagg

SEQ ID NO: 3358360 - DNA, 15 bp, Homo sapiens
caaacaggaacaatc

SEQ ID NO: 3358361 - DNA, 15 bp, Homo sapiens
caaacagtaacgtgt

SEQ ID NO: 3358362 - DNA, 19 bp, Homo sapiens
caaacagtaggttggcagt

SEQ ID NO: 3358363 - DNA, 12 bp, Homo sapiens
caaacatagccc

SEQ ID NO: 3358364 - DNA, 16 bp, Homo sapiens
caaacatagcccctgc

SEQ ID NO: 3358365 - DNA, 19 bp, Homo sapiens
caaacatggatacttcctg

SEQ ID NO: 3358366 - DNA, 14 bp, Homo sapiens
caaacatgtattta

SEQ ID NO: 3358367 - DNA, 11 bp, Homo sapiens
caaacattgtg

SEQ ID NO: 3358368 - DNA, 15 bp, Homo sapiens
caaaccaacatcttt

SEQ ID NO: 3358369 - DNA, 15 bp, Homo sapiens
caaaccacaactgac

SEQ ID NO: 3358370 - DNA, 12 bp, Homo sapiens
caaaccagcctt

SEQ ID NO: 3358371 - DNA, 14 bp, Homo sapiens
caaaccaggaccct

SEQ ID NO: 3358372 - DNA, 17 bp, Homo sapiens
caaaccatgagaatttg

SEQ ID NO: 3358373 - DNA, 16 bp, Homo sapiens
caaacccagtctcaga

SEQ ID NO: 3358374 - DNA, 17 bp, Homo sapiens
caaacccagtctcagac

SEQ ID NO: 3358375 - DNA, 18 bp, Homo sapiens
caaaccccacttcccctc

SEQ ID NO: 3358376 - DNA, 23 bp, Homo sapiens
caaaccccctccttacgctttgt

SEQ ID NO: 3358377 - DNA, 16 bp, Homo sapiens
caaaccccctttgtgc

SEQ ID NO: 3358378 - DNA, 15 bp, Homo sapiens
caaaccctagccttg

SEQ ID NO: 3358379 - DNA, 18 bp, Homo sapiens
caaaccctagccttgctt

SEQ ID NO: 3358380 - DNA, 15 bp, Homo sapiens
caaacccttaactga

SEQ ID NO: 3358381 - DNA, 16 bp, Homo sapiens
caaacccttaactgac

SEQ ID NO: 3358382 - DNA, 17 bp, Homo sapiens
caaacccttaactgaca

SEQ ID NO: 3358383 - DNA, 22 bp, Homo sapiens
caaacccttgctttcctgggcc

SEQ ID NO: 3358384 - DNA, 15 bp, Homo sapiens
caaacctaccaaaat

SEQ ID NO: 3358385 - DNA, 19 bp, Homo sapiens
caaacctgacccctgctca

SEQ ID NO: 3358386 - DNA, 20 bp, Homo sapiens
caaacctgacccctgctcag

SEQ ID NO: 3358387 - DNA, 20 bp, Homo sapiens
caaaccttaaaacagctgtt

SEQ ID NO: 3358388 - DNA, 15 bp, Homo sapiens
caaacctttgagtag

SEQ ID NO: 3358389 - DNA, 22 bp, Homo sapiens
caaacgccctttcctcctcagg

SEQ ID NO: 3358390 - DNA, 17 bp, Homo sapiens
caaacgcctcccctgcc

SEQ ID NO: 3358391 - DNA, 23 bp, Homo sapiens
caaacgctaaagagcccttgcct

SEQ ID NO: 3358392 - DNA, 16 bp, Homo sapiens
caaactaaaagacatt

SEQ ID NO: 3358393 - DNA, 16 bp, Homo sapiens
caaactaaaggtgcac

SEQ ID NO: 3358394 - DNA, 18 bp, Homo sapiens
caaactacagaataatgt

SEQ ID NO: 3358395 - DNA, 16 bp, Homo sapiens
caaactacatgtaatc

SEQ ID NO: 3358396 - DNA, 14 bp, Homo sapiens
caaactacctctgg

SEQ ID NO: 3358397 - DNA, 22 bp, Homo sapiens
caaactactgaatgaagcagta

SEQ ID NO: 3358398 - DNA, 18 bp, Homo sapiens
caaactcactgctcaaga

SEQ ID NO: 3358399 - DNA, 19 bp, Homo sapiens
caaactcactgctcaagaa

SEQ ID NO: 3358400 - DNA, 14 bp, Homo sapiens
caaactcattgcag

SEQ ID NO: 3358401 - DNA, 20 bp, Homo sapiens
caaactcattgcagcagata

SEQ ID NO: 3358402 - DNA, 16 bp, Homo sapiens
caaactctgccagcca

SEQ ID NO: 3358403 - DNA, 17 bp, Homo sapiens
caaactcttgacctcag

SEQ ID NO: 3358404 - DNA, 23 bp, Homo sapiens
caaactgaagcagcctctcccca

SEQ ID NO: 3358405 - DNA, 17 bp, Homo sapiens
caaactgaggaatttca

SEQ ID NO: 3358406 - DNA, 20 bp, Homo sapiens
caaactgcaatagagactgt

SEQ ID NO: 3358407 - DNA, 12 bp, Homo sapiens
caaactggagtc

SEQ ID NO: 3358408 - DNA, 23 bp, Homo sapiens
caaactggagtctggagtgggca

SEQ ID NO: 3358409 - DNA, 16 bp, Homo sapiens
caaactggggcctcca

SEQ ID NO: 3358410 - DNA, 16 bp, Homo sapiens
caaactggtattctgt

SEQ ID NO: 3358411 - DNA, 20 bp, Homo sapiens
caaactgttctgagaaggtg

SEQ ID NO: 3358412 - DNA, 15 bp, Homo sapiens
caaattttcaagttt

SEQ ID NO: 3358413 - DNA, 16 bp, Homo sapiens
caaattttcagaaggt

SEQ ID NO: 3358414 - DNA, 19 bp, Homo sapiens
caaattttgagttgccaca

SEQ ID NO: 3358415 - DNA, 15 bp, Homo sapiens
caaattttggccaaa

SEQ ID NO: 3358416 - DNA, 21 bp, Homo sapiens
caaattttggcgaatctcaaa

SEQ ID NO: 3358417 - DNA, 20 bp, Homo sapiens
caaatttttctcagtttgta

SEQ ID NO: 3358418 - DNA, 17 bp, Homo sapiens
caacaaagattgagaag

SEQ ID NO: 3358419 - DNA, 19 bp, Homo sapiens
caacaaagccaacagtcaa

SEQ ID NO: 3358420 - DNA, 15 bp, Homo sapiens
caacaacaattggta

SEQ ID NO: 3358421 - DNA, 18 bp, Homo sapiens
caacaacgtgagagaaag

SEQ ID NO: 3358422 - DNA, 19 bp, Homo sapiens
caacaacgtgagagaaaga

SEQ ID NO: 3358423 - DNA, 23 bp, Homo sapiens
caacaacgtgagagaaagagaga

SEQ ID NO: 3358424 - DNA, 13 bp, Homo sapiens
caacaagatttcc

SEQ ID NO: 3358425 - DNA, 16 bp, Homo sapiens
caacaagtgctcctga

SEQ ID NO: 3358426 - DNA, 16 bp, Homo sapiens
caacaataaaattttt

SEQ ID NO: 3358427 - DNA, 20 bp, Homo sapiens
caacaataaacaggaatttt

SEQ ID NO: 3358428 - DNA, 12 bp, Homo sapiens
caacaatccttt

SEQ ID NO: 3358429 - DNA, 18 bp, Homo sapiens
caacaatttatgaattga

SEQ ID NO: 3358430 - DNA, 13 bp, Homo sapiens
caacaatttcaat

SEQ ID NO: 3358431 - DNA, 14 bp, Homo sapiens
caacacagaggcag

SEQ ID NO: 3358432 - DNA, 14 bp, Homo sapiens
caacaccacagaca

SEQ ID NO: 3358433 - DNA, 17 bp, Homo sapiens
caacaccacagacacac

SEQ ID NO: 3358434 - DNA, 18 bp, Homo sapiens
caacaccacagacacaca

SEQ ID NO: 3358435 - DNA, 19 bp, Homo sapiens
caacaccacagacacacac

SEQ ID NO: 3358436 - DNA, 20 bp, Homo sapiens
caacaccacagacacacaca

SEQ ID NO: 3358437 - DNA, 14 bp, Homo sapiens
caacaccttcctcc

SEQ ID NO: 3358438 - DNA, 19 bp, Homo sapiens
caacaccttcctcctgcag

SEQ ID NO: 3358439 - DNA, 20 bp, Homo sapiens
caacacgcatggtcaaccct

SEQ ID NO: 3358440 - DNA, 17 bp, Homo sapiens
caacactatatatttta

SEQ ID NO: 3358441 - DNA, 12 bp, Homo sapiens
caacactccagg

SEQ ID NO: 3358442 - DNA, 15 bp, Homo sapiens
caacactccaggccc

SEQ ID NO: 3358443 - DNA, 15 bp, Homo sapiens
caacactgtgccctg

SEQ ID NO: 3358444 - DNA, 17 bp, Homo sapiens
caacactgtgccctggt

SEQ ID NO: 3358445 - DNA, 18 bp, Homo sapiens
caacactgtgccctggtg

SEQ ID NO: 3358446 - DNA, 22 bp, Homo sapiens
caacactgtgccctggtggaga

SEQ ID NO: 3358447 - DNA, 19 bp, Homo sapiens
caacacttaatagcaacag

SEQ ID NO: 3358448 - DNA, 16 bp, Homo sapiens
caacacttcattttca

SEQ ID NO: 3358449 - DNA, 21 bp, Homo sapiens
caacacttgcaggggtccctg

SEQ ID NO: 3358450 - DNA, 15 bp, Homo sapiens
caacactttgagcat

SEQ ID NO: 3358451 - DNA, 20 bp, Homo sapiens
caacactttgagcattttta

SEQ ID NO: 3358452 - DNA, 14 bp, Homo sapiens
caacagaaaaacaa

SEQ ID NO: 3358453 - DNA, 12 bp, Homo sapiens
caacagaagcag

SEQ ID NO: 3358454 - DNA, 23 bp, Homo sapiens
caacagaagcatttgtattttgt

SEQ ID NO: 3358455 - DNA, 14 bp, Homo sapiens
caacagaataaagc

SEQ ID NO: 3358456 - DNA, 16 bp, Homo sapiens
caacagaataaagcag

SEQ ID NO: 3358457 - DNA, 18 bp, Homo sapiens
caacagaataaagcagcc

SEQ ID NO: 3358458 - DNA, 21 bp, Homo sapiens
caacagaataaagcagcctga

SEQ ID NO: 3358459 - DNA, 16 bp, Homo sapiens
caacagagagaaaaag

SEQ ID NO: 3358460 - DNA, 19 bp, Homo sapiens
caacagagtgagaccctgt

SEQ ID NO: 3358461 - DNA, 17 bp, Homo sapiens
caacagcaaacaggtgc

SEQ ID NO: 3358462 - DNA, 17 bp, Homo sapiens
caacagcaaatcacgac

SEQ ID NO: 3358463 - DNA, 15 bp, Homo sapiens
caacagcaagaaata

SEQ ID NO: 3358464 - DNA, 22 bp, Homo sapiens
caacagcactggctctctccag

SEQ ID NO: 3358465 - DNA, 21 bp, Homo sapiens
caacagcccaggcatctcctt

SEQ ID NO: 3358466 - DNA, 23 bp, Homo sapiens
caacagcccaggcatctccttgg

SEQ ID NO: 3358467 - DNA, 14 bp, Homo sapiens
caacagctgaagca

SEQ ID NO: 3358468 - DNA, 20 bp, Homo sapiens
caacaggagtcagtctcttt

SEQ ID NO: 3358469 - DNA, 16 bp, Homo sapiens
caacaggcccagggag

SEQ ID NO: 3358470 - DNA, 20 bp, Homo sapiens
caacaggggaggaaaaaaga

SEQ ID NO: 3358471 - DNA, 21 bp, Homo sapiens
caacaggggaggaaaaaagaa

SEQ ID NO: 3358472 - DNA, 12 bp, Homo sapiens
caacagtgagtc

SEQ ID NO: 3358473 - DNA, 16 bp, Homo sapiens
caacataacccacttg

SEQ ID NO: 3358474 - DNA, 17 bp, Homo sapiens
caacataacccacttgt

SEQ ID NO: 3358475 - DNA, 16 bp, Homo sapiens
caacataatctagttt

SEQ ID NO: 3358476 - DNA, 23 bp, Homo sapiens
caacatagtaagaccccatctct

SEQ ID NO: 3358477 - DNA, 13 bp, Homo sapiens
caacatcaatgtt

SEQ ID NO: 3358478 - DNA, 22 bp, Homo sapiens
caacatcaatgttcattgtaat

SEQ ID NO: 3358479 - DNA, 15 bp, Homo sapiens
caacatcctgccagc

SEQ ID NO: 3358480 - DNA, 18 bp, Homo sapiens
caacatcctgccagcccc

SEQ ID NO: 3358481 - DNA, 18 bp, Homo sapiens
caacatgagtgtattttt

SEQ ID NO: 3358482 - DNA, 12 bp, Homo sapiens
caacatggcttt

SEQ ID NO: 3358483 - DNA, 15 bp, Homo sapiens
caacatggtaattca

SEQ ID NO: 3358484 - DNA, 20 bp, Homo sapiens
caacatgtagctgagtttaa

SEQ ID NO: 3358485 - DNA, 23 bp, Homo sapiens
caacatttacagtccttcaaaat

SEQ ID NO: 3358486 - DNA, 18 bp, Homo sapiens
caaccaagtcatgtgcat

SEQ ID NO: 3358487 - DNA, 13 bp, Homo sapiens
caaccacagagaa

SEQ ID NO: 3358488 - DNA, 14 bp, Homo sapiens
caaccaccatggat

SEQ ID NO: 3358489 - DNA, 16 bp, Homo sapiens
caaccagaattgtcct

SEQ ID NO: 3358490 - DNA, 17 bp, Homo sapiens
caaccagaattgtcctc

SEQ ID NO: 3358491 - DNA, 18 bp, Homo sapiens
caaccagatttattttaa

SEQ ID NO: 3358492 - DNA, 22 bp, Homo sapiens
caaccagcccgacagtgccatc

SEQ ID NO: 3358493 - DNA, 15 bp, Homo sapiens
caaccagctaagaaa

SEQ ID NO: 3358494 - DNA, 17 bp, Homo sapiens
caaccagctaagaaaag

SEQ ID NO: 3358495 - DNA, 12 bp, Homo sapiens
caaccagtgcca

SEQ ID NO: 3358496 - DNA, 13 bp, Homo sapiens
caaccatcgcttt

SEQ ID NO: 3358497 - DNA, 18 bp, Homo sapiens
caaccatgagaccactgt

SEQ ID NO: 3358498 - DNA, 23 bp, Homo sapiens
caaccatgagaccactgttatca

SEQ ID NO: 3358499 - DNA, 22 bp, Homo sapiens
caaccattccagactgcttcca

SEQ ID NO: 3358500 - DNA, 20 bp, Homo sapiens
caaccattttttgttctgtg

SEQ ID NO: 3358501 - DNA, 21 bp, Homo sapiens
caacccacaccgtcttccttc

SEQ ID NO: 3358502 - DNA, 14 bp, Homo sapiens
caacccacctctgg

SEQ ID NO: 3358503 - DNA, 15 bp, Homo sapiens
caacccacctctggc

SEQ ID NO: 3358504 - DNA, 22 bp, Homo sapiens
caacccagccgtcgtctccctc

SEQ ID NO: 3358505 - DNA, 19 bp, Homo sapiens
caacccagtgggtctggga

SEQ ID NO: 3358506 - DNA, 14 bp, Homo sapiens
caaccccagttctg

SEQ ID NO: 3358507 - DNA, 20 bp, Homo sapiens
caaccccagttctgctcctc

SEQ ID NO: 3358508 - DNA, 18 bp, Homo sapiens
caacccccaccccacact

SEQ ID NO: 3358509 - DNA, 20 bp, Homo sapiens
caacccccgccacctcaggg

SEQ ID NO: 3358510 - DNA, 18 bp, Homo sapiens
caaccccgcggtgctctg

SEQ ID NO: 3358511 - DNA, 19 bp, Homo sapiens
caaccccgcggtgctctgg

SEQ ID NO: 3358512 - DNA, 22 bp, Homo sapiens
caacccctcccctccatccctg

SEQ ID NO: 3358513 - DNA, 12 bp, Homo sapiens
caacccctgtac

SEQ ID NO: 3358514 - DNA, 13 bp, Homo sapiens
caacccctgtacc

SEQ ID NO: 3358515 - DNA, 14 bp, Homo sapiens
caacccctgtaccc

SEQ ID NO: 3358516 - DNA, 20 bp, Homo sapiens
caacccctgtacccagctcc

SEQ ID NO: 3358517 - DNA, 22 bp, Homo sapiens
caacccctgtacccagctcctt

SEQ ID NO: 3358518 - DNA, 16 bp, Homo sapiens
caaccccttcgctcct

SEQ ID NO: 3358519 - DNA, 19 bp, Homo sapiens
caaccccttcgctcctgtg

SEQ ID NO: 3358520 - DNA, 22 bp, Homo sapiens
caaccccttcgctcctgtgtct

SEQ ID NO: 3358521 - DNA, 21 bp, Homo sapiens
caacccgtctggcccaccagg

SEQ ID NO: 3358522 - DNA, 18 bp, Homo sapiens
caaccctaggttccctgt

SEQ ID NO: 3358523 - DNA, 22 bp, Homo sapiens
caaccctaggttccctgttctt

SEQ ID NO: 3358524 - DNA, 19 bp, Homo sapiens
caaccctggcattatgtcc

SEQ ID NO: 3358525 - DNA, 16 bp, Homo sapiens
caaccctggggaagga

SEQ ID NO: 3358526 - DNA, 22 bp, Homo sapiens
caaccctggggaaggagccagt

SEQ ID NO: 3358527 - DNA, 19 bp, Homo sapiens
caaccctgttttatactgt

SEQ ID NO: 3358528 - DNA, 19 bp, Homo sapiens
caacccttaccccttagcc

SEQ ID NO: 3358529 - DNA, 22 bp, Homo sapiens
caacccttaccccttagcctcc

SEQ ID NO: 3358530 - DNA, 20 bp, Homo sapiens
caaccgacagctcttacttt

SEQ ID NO: 3358531 - DNA, 18 bp, Homo sapiens
caaccgacaggccctggc

SEQ ID NO: 3358532 - DNA, 14 bp, Homo sapiens
caacctcagaggca

SEQ ID NO: 3358533 - DNA, 19 bp, Homo sapiens
caacctcagggctcccagg

SEQ ID NO: 3358534 - DNA, 19 bp, Homo sapiens
caacctccctcttgttttg

SEQ ID NO: 3358535 - DNA, 20 bp, Homo sapiens
caacctccctcttgttttgt

SEQ ID NO: 3358536 - DNA, 14 bp, Homo sapiens
caacctcctgggct

SEQ ID NO: 3358537 - DNA, 14 bp, Homo sapiens
caagctgagtttcc

SEQ ID NO: 3358538 - DNA, 16 bp, Homo sapiens
caagctgagtttccta

SEQ ID NO: 3358539 - DNA, 23 bp, Homo sapiens
caagctgagtttcctatgggaac

SEQ ID NO: 3358540 - DNA, 14 bp, Homo sapiens
caagctgcctctgg

SEQ ID NO: 3358541 - DNA, 16 bp, Homo sapiens
caagctgcctctgggc

SEQ ID NO: 3358542 - DNA, 17 bp, Homo sapiens
caagctgcctctgggcc

SEQ ID NO: 3358543 - DNA, 12 bp, Homo sapiens
caagctgcgggc

SEQ ID NO: 3358544 - DNA, 21 bp, Homo sapiens
caagctgcgggctccctggca

SEQ ID NO: 3358545 - DNA, 22 bp, Homo sapiens
caagctgcgggctccctggcag

SEQ ID NO: 3358546 - DNA, 11 bp, Homo sapiens
caagctggcct

SEQ ID NO: 3358547 - DNA, 19 bp, Homo sapiens
caagctggtcccactcagt

SEQ ID NO: 3358548 - DNA, 19 bp, Homo sapiens
caagctggtggcctctgca

SEQ ID NO: 3358549 - DNA, 13 bp, Homo sapiens
caagctgtccctg

SEQ ID NO: 3358550 - DNA, 14 bp, Homo sapiens
caagctgtccctgc

SEQ ID NO: 3358551 - DNA, 20 bp, Homo sapiens
caagctgtccctgcagggcc

SEQ ID NO: 3358552 - DNA, 21 bp, Homo sapiens
caagctgtccctgcagggcca

SEQ ID NO: 3358553 - DNA, 15 bp, Homo sapiens
caagcttaatagccc

SEQ ID NO: 3358554 - DNA, 13 bp, Homo sapiens
caagctttaaatt

SEQ ID NO: 3358555 - DNA, 14 bp, Homo sapiens
caagctttaaatta

SEQ ID NO: 3358556 - DNA, 15 bp, Homo sapiens
caaggaaaaacaggt

SEQ ID NO: 3358557 - DNA, 20 bp, Homo sapiens
caaggaaagggggtcccagt

SEQ ID NO: 3358558 - DNA, 20 bp, Homo sapiens
caaggaaatacccttctttt

SEQ ID NO: 3358559 - DNA, 16 bp, Homo sapiens
caaggaatttcttaac

SEQ ID NO: 3358560 - DNA, 23 bp, Homo sapiens
caaggaatttcttaacttcttgc

SEQ ID NO: 3358561 - DNA, 14 bp, Homo sapiens
caaggaccaggact

SEQ ID NO: 3358562 - DNA, 21 bp, Homo sapiens
caaggaccaggactccctcct

SEQ ID NO: 3358563 - DNA, 22 bp, Homo sapiens
caaggactgcagggactgccag

SEQ ID NO: 3358564 - DNA, 18 bp, Homo sapiens
caaggacttgaaagcatc

SEQ ID NO: 3358565 - DNA, 20 bp, Homo sapiens
caaggacttgaaagcatcca

SEQ ID NO: 3358566 - DNA, 18 bp, Homo sapiens
caaggagaaacagagaca

SEQ ID NO: 3358567 - DNA, 19 bp, Homo sapiens
caaggagaaacagagacag

SEQ ID NO: 3358568 - DNA, 20 bp, Homo sapiens
caaggagaaacagagacagg

SEQ ID NO: 3358569 - DNA, 16 bp, Homo sapiens
caaggagaccaagtcc

SEQ ID NO: 3358570 - DNA, 21 bp, Homo sapiens
caaggagcaaacactgaaata

SEQ ID NO: 3358571 - DNA, 18 bp, Homo sapiens
caaggagcacaggtccca

SEQ ID NO: 3358572 - DNA, 22 bp, Homo sapiens
caaggagcacaggtcccacctc

SEQ ID NO: 3358573 - DNA, 12 bp, Homo sapiens
caaggaggcctg

SEQ ID NO: 3358574 - DNA, 22 bp, Homo sapiens
caaggaggcctggggaggccct

SEQ ID NO: 3358575 - DNA, 17 bp, Homo sapiens
caaggaggtagagaggg

SEQ ID NO: 3358576 - DNA, 16 bp, Homo sapiens
caaggagtcagacatt

SEQ ID NO: 3358577 - DNA, 24 bp, Homo sapiens
caaggagtttgagaccagcttagc

SEQ ID NO: 3358578 - DNA, 13 bp, Homo sapiens
caaggatcctctc

SEQ ID NO: 3358579 - DNA, 14 bp, Homo sapiens
caaggatcctctcc

SEQ ID NO: 3358580 - DNA, 21 bp, Homo sapiens
caaggatcctctccactccat

SEQ ID NO: 3358581 - DNA, 15 bp, Homo sapiens
caaggattacagaaa

SEQ ID NO: 3358582 - DNA, 19 bp, Homo sapiens
caaggattacagaaactga

SEQ ID NO: 3358583 - DNA, 14 bp, Homo sapiens
caaggattgaaaat

SEQ ID NO: 3358584 - DNA, 15 bp, Homo sapiens
caaggattgaaaatt

SEQ ID NO: 3358585 - DNA, 19 bp, Homo sapiens
caaggattgctactgtcct

SEQ ID NO: 3358586 - DNA, 20 bp, Homo sapiens
caaggattgctactgtccta

SEQ ID NO: 3358587 - DNA, 15 bp, Homo sapiens
caaggcactctagat

SEQ ID NO: 3358588 - DNA, 16 bp, Homo sapiens
caaggcactctagatt

SEQ ID NO: 3358589 - DNA, 17 bp, Homo sapiens
caaggcactctagattc

SEQ ID NO: 3358590 - DNA, 19 bp, Homo sapiens
caaggcactctagattcca

SEQ ID NO: 3358591 - DNA, 13 bp, Homo sapiens
caaggcagcctcc

SEQ ID NO: 3358592 - DNA, 14 bp, Homo sapiens
caaggcagcctcca

SEQ ID NO: 3358593 - DNA, 17 bp, Homo sapiens
caaggcagcctccagag

SEQ ID NO: 3358594 - DNA, 18 bp, Homo sapiens
caaggcagcctccagagc

SEQ ID NO: 3358595 - DNA, 19 bp, Homo sapiens
caaggcagcctccagagcc

SEQ ID NO: 3358596 - DNA, 22 bp, Homo sapiens
caaggcagcctccagagccagc

SEQ ID NO: 3358597 - DNA, 23 bp, Homo sapiens
caaggcaggtagatcgcttgagc

SEQ ID NO: 3358598 - DNA, 18 bp, Homo sapiens
caaggcaggttggatggg

SEQ ID NO: 3358599 - DNA, 21 bp, Homo sapiens
caaggccagagtggcctggcc

SEQ ID NO: 3358600 - DNA, 13 bp, Homo sapiens
caaggccctgctg

SEQ ID NO: 3358601 - DNA, 13 bp, Homo sapiens
caaggccctgctt

SEQ ID NO: 3358602 - DNA, 19 bp, Homo sapiens
caaggccgaagctctggct

SEQ ID NO: 3358603 - DNA, 21 bp, Homo sapiens
caaggccgaagctctggctga

SEQ ID NO: 3358604 - DNA, 20 bp, Homo sapiens
caaggccgagcgttcccagc

SEQ ID NO: 3358605 - DNA, 12 bp, Homo sapiens
caaggccttaag

SEQ ID NO: 3358606 - DNA, 18 bp, Homo sapiens
caaggctaacatcccact

SEQ ID NO: 3358607 - DNA, 21 bp, Homo sapiens
caaggctgaccaagagagaaa

SEQ ID NO: 3358608 - DNA, 22 bp, Homo sapiens
caaggctgagacagtgaatttg

SEQ ID NO: 3358609 - DNA, 21 bp, Homo sapiens
caagggaaaggggtgctttta

SEQ ID NO: 3358610 - DNA, 15 bp, Homo sapiens
caagggaacctgtgt

SEQ ID NO: 3358611 - DNA, 17 bp, Homo sapiens
caagggaagaaacactc

SEQ ID NO: 3358612 - DNA, 10 bp, Homo sapiens
caagggagaa

SEQ ID NO: 3358613 - DNA, 14 bp, Homo sapiens
caagggagagacct

SEQ ID NO: 3358614 - DNA, 22 bp, Homo sapiens
caagggatctgccattgggacc

SEQ ID NO: 3358615 - DNA, 12 bp, Homo sapiens
caagggattctg

SEQ ID NO: 3358616 - DNA, 13 bp, Homo sapiens
caagggattctgg

SEQ ID NO: 3358617 - DNA, 17 bp, Homo sapiens
caagggattctgggaag

SEQ ID NO: 3358618 - DNA, 14 bp, Homo sapiens
caagggcagaaagt

SEQ ID NO: 3358619 - DNA, 23 bp, Homo sapiens
caagggcatcaggcactggtggc

SEQ ID NO: 3358620 - DNA, 13 bp, Homo sapiens
caagggccctggc

SEQ ID NO: 3358621 - DNA, 14 bp, Homo sapiens
caagggccctggca

SEQ ID NO: 3358622 - DNA, 15 bp, Homo sapiens
caagggccctggcac

SEQ ID NO: 3358623 - DNA, 14 bp, Homo sapiens
caagggctccagca

SEQ ID NO: 3358624 - DNA, 18 bp, Homo sapiens
caagggcttctgcaccct

SEQ ID NO: 3358625 - DNA, 21 bp, Homo sapiens
caaggggaatgtttgcctctg

SEQ ID NO: 3358626 - DNA, 13 bp, Homo sapiens
caagggggcccaa

SEQ ID NO: 3358627 - DNA, 23 bp, Homo sapiens
caagggtcattatgggttaggca

SEQ ID NO: 3358628 - DNA, 23 bp, Homo sapiens
caagggtttcgactggtccagct

SEQ ID NO: 3358629 - DNA, 14 bp, Homo sapiens
caaggtataataag

SEQ ID NO: 3358630 - DNA, 20 bp, Homo sapiens
caaggtatacacccagttct

SEQ ID NO: 3358631 - DNA, 23 bp, Homo sapiens
caaggtccactccctgctccacg

SEQ ID NO: 3358632 - DNA, 23 bp, Homo sapiens
caaggtccattattttgtattct

SEQ ID NO: 3358633 - DNA, 14 bp, Homo sapiens
caaggtcccctcca

SEQ ID NO: 3358634 - DNA, 17 bp, Homo sapiens
caaggtcccctccacat

SEQ ID NO: 3358635 - DNA, 14 bp, Homo sapiens
caaggtcctgctca

SEQ ID NO: 3358636 - DNA, 21 bp, Homo sapiens
caaggtctccttactctgagc

SEQ ID NO: 3358637 - DNA, 22 bp, Homo sapiens
caaggtctccttactctgagcc

SEQ ID NO: 3358638 - DNA, 15 bp, Homo sapiens
caaggtgatttcaga

SEQ ID NO: 3358639 - DNA, 20 bp, Homo sapiens
caaggtgccaccaccctgcc

SEQ ID NO: 3358640 - DNA, 21 bp, Homo sapiens
caaggtgctgatgtcaaagtg

SEQ ID NO: 3358641 - DNA, 12 bp, Homo sapiens
caaggtgggctg

SEQ ID NO: 3358642 - DNA, 18 bp, Homo sapiens
caaggtgggctgagccct

SEQ ID NO: 3358643 - DNA, 20 bp, Homo sapiens
caaggtgggctgagccctgg

SEQ ID NO: 3358644 - DNA, 22 bp, Homo sapiens
caaggttggcaccccagctacc

SEQ ID NO: 3358645 - DNA, 15 bp, Homo sapiens
caagtaaaagaaaag

SEQ ID NO: 3358646 - DNA, 16 bp, Homo sapiens
caagtaccaaagtttt

SEQ ID NO: 3358647 - DNA, 18 bp, Homo sapiens
caagtaccaatgctgttg

SEQ ID NO: 3358648 - DNA, 17 bp, Homo sapiens
caagtactatctgttcc

SEQ ID NO: 3358649 - DNA, 15 bp, Homo sapiens
caagtagctttccac

SEQ ID NO: 3358650 - DNA, 17 bp, Homo sapiens
caagtagctttccacat

SEQ ID NO: 3358651 - DNA, 20 bp, Homo sapiens
caagtataattttttgtaat

SEQ ID NO: 3358652 - DNA, 22 bp, Homo sapiens
caagtatatacttttaaattat

SEQ ID NO: 3358653 - DNA, 23 bp, Homo sapiens
caagtatatacttttaaattatg

SEQ ID NO: 3358654 - DNA, 19 bp, Homo sapiens
caagtatatgtgaaaaaaa

SEQ ID NO: 3358655 - DNA, 17 bp, Homo sapiens
caagtatcttctatttt

SEQ ID NO: 3358656 - DNA, 14 bp, Homo sapiens
caagtatgaatatt

SEQ ID NO: 3358657 - DNA, 19 bp, Homo sapiens
caagtatttgggaagtgaa

SEQ ID NO: 3358658 - DNA, 16 bp, Homo sapiens
caagtattttatattt

SEQ ID NO: 3358659 - DNA, 15 bp, Homo sapiens
caagtcaaattaata

SEQ ID NO: 3358660 - DNA, 14 bp, Homo sapiens
caagtcaatcattt

SEQ ID NO: 3358661 - DNA, 20 bp, Homo sapiens
caagtcacagctgcagctgg

SEQ ID NO: 3358662 - DNA, 20 bp, Homo sapiens
cacaacagaataaagcagcc

SEQ ID NO: 3358663 - DNA, 17 bp, Homo sapiens
cacaacagcagtctcct

SEQ ID NO: 3358664 - DNA, 16 bp, Homo sapiens
cacaaccagccaggca

SEQ ID NO: 3358665 - DNA, 17 bp, Homo sapiens
cacaacctctctgatct

SEQ ID NO: 3358666 - DNA, 18 bp, Homo sapiens
cacaacctctctgatctt

SEQ ID NO: 3358667 - DNA, 17 bp, Homo sapiens
cacaaccttctgtggct

SEQ ID NO: 3358668 - DNA, 12 bp, Homo sapiens
cacaactgacac

SEQ ID NO: 3358669 - DNA, 13 bp, Homo sapiens
cacaactgacaca

SEQ ID NO: 3358670 - DNA, 21 bp, Homo sapiens
cacaactgcaataacttctga

SEQ ID NO: 3358671 - DNA, 23 bp, Homo sapiens
cacaactgcaataacttctgacc

SEQ ID NO: 3358672 - DNA, 19 bp, Homo sapiens
cacaactgtgtgattaaaa

SEQ ID NO: 3358673 - DNA, 22 bp, Homo sapiens
cacaactgtgtgattaaaaggt

SEQ ID NO: 3358674 - DNA, 15 bp, Homo sapiens
cacaacttgggttct

SEQ ID NO: 3358675 - DNA, 12 bp, Homo sapiens
cacaagaaattt

SEQ ID NO: 3358676 - DNA, 18 bp, Homo sapiens
cacaagatggaatttatc

SEQ ID NO: 3358677 - DNA, 22 bp, Homo sapiens
cacaagatggaatttatcaaac

SEQ ID NO: 3358678 - DNA, 22 bp, Homo sapiens
cacaagcaaaaaaaaaaaaaag

SEQ ID NO: 3358679 - DNA, 21 bp, Homo sapiens
cacaagccacaagtcttccag

SEQ ID NO: 3358680 - DNA, 12 bp, Homo sapiens
cacaagcctcct

SEQ ID NO: 3358681 - DNA, 14 bp, Homo sapiens
cacaagcctcctgt

SEQ ID NO: 3358682 - DNA, 15 bp, Homo sapiens
cacaagcctcctgta

SEQ ID NO: 3358683 - DNA, 20 bp, Homo sapiens
cacaaggaaaatagtttagg

SEQ ID NO: 3358684 - DNA, 19 bp, Homo sapiens
cacaaggctgaccaagaga

SEQ ID NO: 3358685 - DNA, 15 bp, Homo sapiens
cacaaggctggccag

SEQ ID NO: 3358686 - DNA, 14 bp, Homo sapiens
cacaaggtataata

SEQ ID NO: 3358687 - DNA, 20 bp, Homo sapiens
cacaaggtataataaggaaa

SEQ ID NO: 3358688 - DNA, 15 bp, Homo sapiens
cacaaggtccactcc

SEQ ID NO: 3358689 - DNA, 20 bp, Homo sapiens
cacaaggtccactccctgct

SEQ ID NO: 3358690 - DNA, 22 bp, Homo sapiens
cacaaggtccactccctgctcc

SEQ ID NO: 3358691 - DNA, 23 bp, Homo sapiens
cacaaggtccactccctgctcca

SEQ ID NO: 3358692 - DNA, 16 bp, Homo sapiens
cacaagtcctgtgaat

SEQ ID NO: 3358693 - DNA, 13 bp, Homo sapiens
cacaagtcttcca

SEQ ID NO: 3358694 - DNA, 14 bp, Homo sapiens
cacaagtcttccag

SEQ ID NO: 3358695 - DNA, 21 bp, Homo sapiens
cacaagtgccctccaggcttt

SEQ ID NO: 3358696 - DNA, 19 bp, Homo sapiens
cacaagttccctggagaaa

SEQ ID NO: 3358697 - DNA, 18 bp, Homo sapiens
cacaataaaaatgtttaa

SEQ ID NO: 3358698 - DNA, 11 bp, Homo sapiens
cacaataaaca

SEQ ID NO: 3358699 - DNA, 21 bp, Homo sapiens
cacaatacctacaataaactg

SEQ ID NO: 3358700 - DNA, 14 bp, Homo sapiens
cacaataggtcttt

SEQ ID NO: 3358701 - DNA, 21 bp, Homo sapiens
cacaatattcaatcaaaattt

SEQ ID NO: 3358702 - DNA, 17 bp, Homo sapiens
cacaatcactaaacttt

SEQ ID NO: 3358703 - DNA, 13 bp, Homo sapiens
cacaatcccacct

SEQ ID NO: 3358704 - DNA, 23 bp, Homo sapiens
cacaatcctaacacattatcggg

SEQ ID NO: 3358705 - DNA, 21 bp, Homo sapiens
cacaatcctccaagaatttga

SEQ ID NO: 3358706 - DNA, 15 bp, Homo sapiens
cacaatgaatgtata

SEQ ID NO: 3358707 - DNA, 18 bp, Homo sapiens
cacaatgtcagtatttca

SEQ ID NO: 3358708 - DNA, 10 bp, Homo sapiens
cacacaaaca

SEQ ID NO: 3358709 - DNA, 18 bp, Homo sapiens
cacacaaaccttctgcct

SEQ ID NO: 3358710 - DNA, 16 bp, Homo sapiens
cacacaacgtaaaaat

SEQ ID NO: 3358711 - DNA, 18 bp, Homo sapiens
cacacaagaagaagggca

SEQ ID NO: 3358712 - DNA, 16 bp, Homo sapiens
cacacaagggaaggac

SEQ ID NO: 3358713 - DNA, 9 bp, Homo sapiens
cacacacac

SEQ ID NO: 3358714 - DNA, 13 bp, Homo sapiens
cacacacacacaa

SEQ ID NO: 3358715 - DNA, 14 bp, Homo sapiens
cacacacacacaca

SEQ ID NO: 3358716 - DNA, 15 bp, Homo sapiens
cacacacacacacac

SEQ ID NO: 3358717 - DNA, 14 bp, Homo sapiens
cacacacacagctg

SEQ ID NO: 3358718 - DNA, 12 bp, Homo sapiens
cacacacacatg

SEQ ID NO: 3358719 - DNA, 14 bp, Homo sapiens
cacacacacatgct

SEQ ID NO: 3358720 - DNA, 14 bp, Homo sapiens
cacacacacgcacg

SEQ ID NO: 3358721 - DNA, 18 bp, Homo sapiens
cacacacatgctaggatg

SEQ ID NO: 3358722 - DNA, 11 bp, Homo sapiens
cacacacctgt

SEQ ID NO: 3358723 - DNA, 21 bp, Homo sapiens
cacacacgatgcatttaataa

SEQ ID NO: 3358724 - DNA, 15 bp, Homo sapiens
cacacacgcacgcac

SEQ ID NO: 3358725 - DNA, 16 bp, Homo sapiens
cacacacgcacgcaca

SEQ ID NO: 3358726 - DNA, 17 bp, Homo sapiens
cacacacgcacgcacac

SEQ ID NO: 3358727 - DNA, 19 bp, Homo sapiens
cacacacgcacgcacacac

SEQ ID NO: 3358728 - DNA, 15 bp, Homo sapiens
cacacacgcacggct

SEQ ID NO: 3358729 - DNA, 18 bp, Homo sapiens
cacacacgcacggcttcc

SEQ ID NO: 3358730 - DNA, 19 bp, Homo sapiens
cacacacgctttcttatgc

SEQ ID NO: 3358731 - DNA, 14 bp, Homo sapiens
cacacactttggct

SEQ ID NO: 3358732 - DNA, 12 bp, Homo sapiens
cacacagaaata

SEQ ID NO: 3358733 - DNA, 16 bp, Homo sapiens
cacacagaaatatata

SEQ ID NO: 3358734 - DNA, 22 bp, Homo sapiens
cacacagaaatatatatacata

SEQ ID NO: 3358735 - DNA, 14 bp, Homo sapiens
cacacagaccacca

SEQ ID NO: 3358736 - DNA, 21 bp, Homo sapiens
cacacagaggctgcctctccc

SEQ ID NO: 3358737 - DNA, 15 bp, Homo sapiens
cacacagagtggtct

SEQ ID NO: 3358738 - DNA, 18 bp, Homo sapiens
cacacagatacacacaca

SEQ ID NO: 3358739 - DNA, 12 bp, Homo sapiens
cacacagcagcc

SEQ ID NO: 3358740 - DNA, 23 bp, Homo sapiens
cacacagcagccccccagcacta

SEQ ID NO: 3358741 - DNA, 14 bp, Homo sapiens
cacacagctctgtc

SEQ ID NO: 3358742 - DNA, 20 bp, Homo sapiens
cacacagctctgtcctggga

SEQ ID NO: 3358743 - DNA, 15 bp, Homo sapiens
cacacagctgagcac

SEQ ID NO: 3358744 - DNA, 14 bp, Homo sapiens
cacacagctgggca

SEQ ID NO: 3358745 - DNA, 22 bp, Homo sapiens
cacacaggggtggagtttctga

SEQ ID NO: 3358746 - DNA, 23 bp, Homo sapiens
cacacagtattacttctgctaca

SEQ ID NO: 3358747 - DNA, 13 bp, Homo sapiens
cacacagtcccca

SEQ ID NO: 3358748 - DNA, 15 bp, Homo sapiens
cacacagtccccaga

SEQ ID NO: 3358749 - DNA, 18 bp, Homo sapiens
cacacagtccccagactc

SEQ ID NO: 3358750 - DNA, 20 bp, Homo sapiens
cacacatacgtgcacagggt

SEQ ID NO: 3358751 - DNA, 22 bp, Homo sapiens
cacacatagattaatggcactg

SEQ ID NO: 3358752 - DNA, 23 bp, Homo sapiens
cacacatagattaatggcactga

SEQ ID NO: 3358753 - DNA, 21 bp, Homo sapiens
cacacatataaacatcacaca

SEQ ID NO: 3358754 - DNA, 14 bp, Homo sapiens
cacacatccacccc

SEQ ID NO: 3358755 - DNA, 14 bp, Homo sapiens
cacacatgcacaca

SEQ ID NO: 3358756 - DNA, 15 bp, Homo sapiens
cacacatgccctcct

SEQ ID NO: 3358757 - DNA, 15 bp, Homo sapiens
cacaccactgccctg

SEQ ID NO: 3358758 - DNA, 20 bp, Homo sapiens
cacaccactgccctgcctgc

SEQ ID NO: 3358759 - DNA, 19 bp, Homo sapiens
cacaccagccgctgcaggg

SEQ ID NO: 3358760 - DNA, 13 bp, Homo sapiens
cacaccaggctgt

SEQ ID NO: 3358761 - DNA, 14 bp, Homo sapiens
cacaccaggctgtg

SEQ ID NO: 3358762 - DNA, 20 bp, Homo sapiens
cacaccaggctgtgggcctc

SEQ ID NO: 3358763 - DNA, 21 bp, Homo sapiens
cacaccaggctgtgggcctca

SEQ ID NO: 3358764 - DNA, 13 bp, Homo sapiens
cacacccaatgct

SEQ ID NO: 3358765 - DNA, 12 bp, Homo sapiens
cacacccagcct

SEQ ID NO: 3358766 - DNA, 13 bp, Homo sapiens
cacacccagcctc

SEQ ID NO: 3358767 - DNA, 18 bp, Homo sapiens
cacacccagcctcagtcc

SEQ ID NO: 3358768 - DNA, 14 bp, Homo sapiens
cacaccccacaccc

SEQ ID NO: 3358769 - DNA, 18 bp, Homo sapiens
cacaccctcactctgcca

SEQ ID NO: 3358770 - DNA, 20 bp, Homo sapiens
cacaccctcactctgccagg

SEQ ID NO: 3358771 - DNA, 21 bp, Homo sapiens
cacaccctgaggtcagggagt

SEQ ID NO: 3358772 - DNA, 15 bp, Homo sapiens
cacaccctgcaaggc

SEQ ID NO: 3358773 - DNA, 13 bp, Homo sapiens
cacaccctgcccc

SEQ ID NO: 3358774 - DNA, 19 bp, Homo sapiens
cacaccctgcccctgcaaa

SEQ ID NO: 3358775 - DNA, 20 bp, Homo sapiens
cacaccctgcccctgcaaag

SEQ ID NO: 3358776 - DNA, 21 bp, Homo sapiens
cacaccctgtactgttctgtg

SEQ ID NO: 3358777 - DNA, 14 bp, Homo sapiens
cacaccctgtttta

SEQ ID NO: 3358778 - DNA, 15 bp, Homo sapiens
cacaccgtcttcctt

SEQ ID NO: 3358779 - DNA, 20 bp, Homo sapiens
cacacctggccttaaagagg

SEQ ID NO: 3358780 - DNA, 16 bp, Homo sapiens
cacacctgtagcactt

SEQ ID NO: 3358781 - DNA, 14 bp, Homo sapiens
cacaccttccaggg

SEQ ID NO: 3358782 - DNA, 16 bp, Homo sapiens
cacaccttccagggcc

SEQ ID NO: 3358783 - DNA, 17 bp, Homo sapiens
cacaccttccagggccc

SEQ ID NO: 3358784 - DNA, 18 bp, Homo sapiens
cacacgatgcatttaata

SEQ ID NO: 3358785 - DNA, 14 bp, Homo sapiens
cacacgcacgcaca

SEQ ID NO: 3358786 - DNA, 17 bp, Homo sapiens
cacacgcacgcacacac

SEQ ID NO: 3358787 - DNA, 19 bp, Homo sapiens
cacacgcgcgcgcacacac

SEQ ID NO: 3358788 - DNA, 17 bp, Homo sapiens
cacacggactcccgggc

SEQ ID NO: 3358789 - DNA, 19 bp, Homo sapiens
caccagccgccccagcccc

SEQ ID NO: 3358790 - DNA, 20 bp, Homo sapiens
caccagccgccccagcccct

SEQ ID NO: 3358791 - DNA, 16 bp, Homo sapiens
caccagccgctgcagg

SEQ ID NO: 3358792 - DNA, 23 bp, Homo sapiens
caccagccgctgcagggctccca

SEQ ID NO: 3358793 - DNA, 19 bp, Homo sapiens
caccagcgtttgaggggct

SEQ ID NO: 3358794 - DNA, 14 bp, Homo sapiens
caccagctatctgt

SEQ ID NO: 3358795 - DNA, 11 bp, Homo sapiens
caccagctcgt

SEQ ID NO: 3358796 - DNA, 22 bp, Homo sapiens
caccagctcgtttttcagcacc

SEQ ID NO: 3358797 - DNA, 23 bp, Homo sapiens
caccagctcgtttttcagcaccc

SEQ ID NO: 3358798 - DNA, 15 bp, Homo sapiens
caccagctctgtggc

SEQ ID NO: 3358799 - DNA, 18 bp, Homo sapiens
caccagctctgtggcctg

SEQ ID NO: 3358800 - DNA, 21 bp, Homo sapiens
caccagctctgtggcctgtgt

SEQ ID NO: 3358801 - DNA, 22 bp, Homo sapiens
caccagctctgtggcctgtgtc

SEQ ID NO: 3358802 - DNA, 11 bp, Homo sapiens
caccagctgct

SEQ ID NO: 3358803 - DNA, 12 bp, Homo sapiens
caccagctgctc

SEQ ID NO: 3358804 - DNA, 13 bp, Homo sapiens
caccagctgctct

SEQ ID NO: 3358805 - DNA, 18 bp, Homo sapiens
caccagctgctctgcccc

SEQ ID NO: 3358806 - DNA, 19 bp, Homo sapiens
caccagctgctctgcccct

SEQ ID NO: 3358807 - DNA, 19 bp, Homo sapiens
caccaggacttggggtcag

SEQ ID NO: 3358808 - DNA, 16 bp, Homo sapiens
caccaggagaaccact

SEQ ID NO: 3358809 - DNA, 19 bp, Homo sapiens
caccaggagaaccactaca

SEQ ID NO: 3358810 - DNA, 14 bp, Homo sapiens
caccaggagacaga

SEQ ID NO: 3358811 - DNA, 23 bp, Homo sapiens
caccaggcgctaattcaaggaat

SEQ ID NO: 3358812 - DNA, 18 bp, Homo sapiens
caccaggctggcgcagcc

SEQ ID NO: 3358813 - DNA, 15 bp, Homo sapiens
caccaggctgtgggc

SEQ ID NO: 3358814 - DNA, 18 bp, Homo sapiens
caccaggctgtgggcctc

SEQ ID NO: 3358815 - DNA, 23 bp, Homo sapiens
caccagggcattcgggccacagg

SEQ ID NO: 3358816 - DNA, 15 bp, Homo sapiens
caccaggggaggagc

SEQ ID NO: 3358817 - DNA, 17 bp, Homo sapiens
caccaggggaggagcct

SEQ ID NO: 3358818 - DNA, 23 bp, Homo sapiens
caccaggggtgctcacctctgcc

SEQ ID NO: 3358819 - DNA, 23 bp, Homo sapiens
caccagggtccgcaccagctgct

SEQ ID NO: 3358820 - DNA, 24 bp, Homo sapiens
caccagggtccgcaccagctgctc

SEQ ID NO: 3358821 - DNA, 20 bp, Homo sapiens
caccagtctgtctactgtgg

SEQ ID NO: 3358822 - DNA, 12 bp, Homo sapiens
caccagtgcctt

SEQ ID NO: 3358823 - DNA, 17 bp, Homo sapiens
caccagtggcctcgtgg

SEQ ID NO: 3358824 - DNA, 20 bp, Homo sapiens
caccagttctcatgggtggc

SEQ ID NO: 3358825 - DNA, 16 bp, Homo sapiens
caccatagtttacaat

SEQ ID NO: 3358826 - DNA, 15 bp, Homo sapiens
caccatatgaattgt

SEQ ID NO: 3358827 - DNA, 18 bp, Homo sapiens
caccatatgaattgtaca

SEQ ID NO: 3358828 - DNA, 19 bp, Homo sapiens
caccatatgaattgtacag

SEQ ID NO: 3358829 - DNA, 15 bp, Homo sapiens
caccatcaccaccgc

SEQ ID NO: 3358830 - DNA, 15 bp, Homo sapiens
caccatcatgtctgg

SEQ ID NO: 3358831 - DNA, 17 bp, Homo sapiens
caccatcatgtctggct

SEQ ID NO: 3358832 - DNA, 21 bp, Homo sapiens
caccatcctgcagcctcctcc

SEQ ID NO: 3358833 - DNA, 12 bp, Homo sapiens
caccatctcttc

SEQ ID NO: 3358834 - DNA, 19 bp, Homo sapiens
caccatctcttcattcaaa

SEQ ID NO: 3358835 - DNA, 12 bp, Homo sapiens
caccatctttta

SEQ ID NO: 3358836 - DNA, 14 bp, Homo sapiens
caccatgcttccag

SEQ ID NO: 3358837 - DNA, 22 bp, Homo sapiens
caccatgtgccatctgtacata

SEQ ID NO: 3358838 - DNA, 14 bp, Homo sapiens
caccatgtgggcac

SEQ ID NO: 3358839 - DNA, 12 bp, Homo sapiens
caccattcctgc

SEQ ID NO: 3358840 - DNA, 18 bp, Homo sapiens
caccattctcctgcctca

SEQ ID NO: 3358841 - DNA, 23 bp, Homo sapiens
caccattctcctgcctcaccctc

SEQ ID NO: 3358842 - DNA, 24 bp, Homo sapiens
caccattctcctgcctcaccctcc

SEQ ID NO: 3358843 - DNA, 16 bp, Homo sapiens
caccattgaaggctta

SEQ ID NO: 3358844 - DNA, 18 bp, Homo sapiens
caccatttctgtcactca

SEQ ID NO: 3358845 - DNA, 12 bp, Homo sapiens
cacccaaaacac

SEQ ID NO: 3358846 - DNA, 13 bp, Homo sapiens
cacccaaaacacg

SEQ ID NO: 3358847 - DNA, 22 bp, Homo sapiens
cacccaaagaggtatttatctt

SEQ ID NO: 3358848 - DNA, 17 bp, Homo sapiens
cacccaaagcatggact

SEQ ID NO: 3358849 - DNA, 23 bp, Homo sapiens
cacccaaccctatctcctgacag

SEQ ID NO: 3358850 - DNA, 21 bp, Homo sapiens
cacccaatcaagggaagaagg

SEQ ID NO: 3358851 - DNA, 17 bp, Homo sapiens
cacccaatgctgctcca

SEQ ID NO: 3358852 - DNA, 18 bp, Homo sapiens
cacccacaatcccaccta

SEQ ID NO: 3358853 - DNA, 12 bp, Homo sapiens
cacccaccccac

SEQ ID NO: 3358854 - DNA, 16 bp, Homo sapiens
cacccaccccacagac

SEQ ID NO: 3358855 - DNA, 19 bp, Homo sapiens
cacccaccccacgcccgca

SEQ ID NO: 3358856 - DNA, 14 bp, Homo sapiens
cacccacccctgca

SEQ ID NO: 3358857 - DNA, 16 bp, Homo sapiens
cacccacccctgcaca

SEQ ID NO: 3358858 - DNA, 24 bp, Homo sapiens
cacccacccgccgcctcccacggc

SEQ ID NO: 3358859 - DNA, 13 bp, Homo sapiens
cacccaccctgtg

SEQ ID NO: 3358860 - DNA, 16 bp, Homo sapiens
cacccacctcagcctc

SEQ ID NO: 3358861 - DNA, 18 bp, Homo sapiens
cacccacctccacccagc

SEQ ID NO: 3358862 - DNA, 19 bp, Homo sapiens
cacccacgcatacacacat

SEQ ID NO: 3358863 - DNA, 13 bp, Homo sapiens
cacccactcacca

SEQ ID NO: 3358864 - DNA, 15 bp, Homo sapiens
cacccactcaccagg

SEQ ID NO: 3358865 - DNA, 20 bp, Homo sapiens
cacccagactggaatgcagt

SEQ ID NO: 3358866 - DNA, 15 bp, Homo sapiens
cacccagagcacccc

SEQ ID NO: 3358867 - DNA, 17 bp, Homo sapiens
cacccagagcaccccct

SEQ ID NO: 3358868 - DNA, 16 bp, Homo sapiens
cacccagcccacttct

SEQ ID NO: 3358869 - DNA, 11 bp, Homo sapiens
cacccagcccc

SEQ ID NO: 3358870 - DNA, 11 bp, Homo sapiens
cacccagcctc

SEQ ID NO: 3358871 - DNA, 13 bp, Homo sapiens
cacccagcctcag

SEQ ID NO: 3358872 - DNA, 12 bp, Homo sapiens
cacccagctcca

SEQ ID NO: 3358873 - DNA, 16 bp, Homo sapiens
cacccaggagccccga

SEQ ID NO: 3358874 - DNA, 18 bp, Homo sapiens
cacccaggctgcactgca

SEQ ID NO: 3358875 - DNA, 19 bp, Homo sapiens
cacccaggctgcactgcag

SEQ ID NO: 3358876 - DNA, 20 bp, Homo sapiens
cacccaggctggagtgcagt

SEQ ID NO: 3358877 - DNA, 14 bp, Homo sapiens
cacccagtgctgcc

SEQ ID NO: 3358878 - DNA, 19 bp, Homo sapiens
cacccagtgctgccatgcc

SEQ ID NO: 3358879 - DNA, 22 bp, Homo sapiens
cacccagtgctgccatgccact

SEQ ID NO: 3358880 - DNA, 14 bp, Homo sapiens
cacccatcttcctg

SEQ ID NO: 3358881 - DNA, 15 bp, Homo sapiens
cacccatcttcctgc

SEQ ID NO: 3358882 - DNA, 20 bp, Homo sapiens
cacccatcttcctgctgctg

SEQ ID NO: 3358883 - DNA, 21 bp, Homo sapiens
cacccattcccccatgtggct

SEQ ID NO: 3358884 - DNA, 18 bp, Homo sapiens
caccccaaagctttcctg

SEQ ID NO: 3358885 - DNA, 22 bp, Homo sapiens
caccccaagtagtctgctcaca

SEQ ID NO: 3358886 - DNA, 18 bp, Homo sapiens
caccccacaccccagccc

SEQ ID NO: 3358887 - DNA, 12 bp, Homo sapiens
caccccacactt

SEQ ID NO: 3358888 - DNA, 17 bp, Homo sapiens
caccccacagactccgg

SEQ ID NO: 3358889 - DNA, 19 bp, Homo sapiens
caccccacagactccggcc

SEQ ID NO: 3358890 - DNA, 14 bp, Homo sapiens
caccccacctgcag

SEQ ID NO: 3358891 - DNA, 15 bp, Homo sapiens
caccccactctacct

SEQ ID NO: 3358892 - DNA, 16 bp, Homo sapiens
caccccactctacctc

SEQ ID NO: 3358893 - DNA, 20 bp, Homo sapiens
caccccactctacctcctta

SEQ ID NO: 3358894 - DNA, 11 bp, Homo sapiens
caccccagccc

SEQ ID NO: 3358895 - DNA, 12 bp, Homo sapiens
caccccagccca

SEQ ID NO: 3358896 - DNA, 12 bp, Homo sapiens
caccccatgcca

SEQ ID NO: 3358897 - DNA, 15 bp, Homo sapiens
caccccatgccaaag

SEQ ID NO: 3358898 - DNA, 21 bp, Homo sapiens
cacccccacaagctgtccctg

SEQ ID NO: 3358899 - DNA, 11 bp, Homo sapiens
cacccccaccc

SEQ ID NO: 3358900 - DNA, 14 bp, Homo sapiens
cacccccacccacc

SEQ ID NO: 3358901 - DNA, 17 bp, Homo sapiens
cacccccacccccagct

SEQ ID NO: 3358902 - DNA, 12 bp, Homo sapiens
cacccccagcca

SEQ ID NO: 3358903 - DNA, 13 bp, Homo sapiens
cacccccagctca

SEQ ID NO: 3358904 - DNA, 14 bp, Homo sapiens
cacccccagctcaa

SEQ ID NO: 3358905 - DNA, 13 bp, Homo sapiens
cacccccatccct

SEQ ID NO: 3358906 - DNA, 19 bp, Homo sapiens
cacccccatcttccacctg

SEQ ID NO: 3358907 - DNA, 20 bp, Homo sapiens
cacccccatcttccacctgt

SEQ ID NO: 3358908 - DNA, 18 bp, Homo sapiens
caccccctcacccctcca

SEQ ID NO: 3358909 - DNA, 14 bp, Homo sapiens
caccccctcctggc

SEQ ID NO: 3358910 - DNA, 20 bp, Homo sapiens
caccccctcctggcaatcaa

SEQ ID NO: 3358911 - DNA, 15 bp, Homo sapiens
caccccctgcccaca

SEQ ID NO: 3358912 - DNA, 14 bp, Homo sapiens
caccccctttcctg

SEQ ID NO: 3358913 - DNA, 14 bp, Homo sapiens
caccccggcaggcc

SEQ ID NO: 3358914 - DNA, 18 bp, Homo sapiens
caccccggcaggccctgc

SEQ ID NO: 3358915 - DNA, 19 bp, Homo sapiens
caccccggcaggccctgca

SEQ ID NO: 3358916 - DNA, 20 bp, Homo sapiens
caccttttgggaatgtttta

SEQ ID NO: 3358917 - DNA, 14 bp, Homo sapiens
cacgaaacttgtta

SEQ ID NO: 3358918 - DNA, 16 bp, Homo sapiens
cacgaaatgttatttt

SEQ ID NO: 3358919 - DNA, 19 bp, Homo sapiens
cacgaagccttaagccata

SEQ ID NO: 3358920 - DNA, 18 bp, Homo sapiens
cacgaatttgctggggaa

SEQ ID NO: 3358921 - DNA, 21 bp, Homo sapiens
cacgaccagccccttcctggg

SEQ ID NO: 3358922 - DNA, 23 bp, Homo sapiens
cacgaccagccccttcctgggta

SEQ ID NO: 3358923 - DNA, 12 bp, Homo sapiens
cacgagggctgg

SEQ ID NO: 3358924 - DNA, 21 bp, Homo sapiens
cacgagggctggctggcctca

SEQ ID NO: 3358925 - DNA, 15 bp, Homo sapiens
cacgaggtcaggaga

SEQ ID NO: 3358926 - DNA, 15 bp, Homo sapiens
cacgagtcacctgca

SEQ ID NO: 3358927 - DNA, 20 bp, Homo sapiens
cacgagtcacctgcaagccc

SEQ ID NO: 3358928 - DNA, 18 bp, Homo sapiens
cacgatgcatttaataaa

SEQ ID NO: 3358929 - DNA, 22 bp, Homo sapiens
cacgatgcatttaataaagatg

SEQ ID NO: 3358930 - DNA, 17 bp, Homo sapiens
cacgcaaatacactcca

SEQ ID NO: 3358931 - DNA, 15 bp, Homo sapiens
cacgcacacacacaa

SEQ ID NO: 3358932 - DNA, 15 bp, Homo sapiens
cacgcacgcacacac

SEQ ID NO: 3358933 - DNA, 16 bp, Homo sapiens
cacgcacgcacacaca

SEQ ID NO: 3358934 - DNA, 15 bp, Homo sapiens
cacgcacggcttcct

SEQ ID NO: 3358935 - DNA, 17 bp, Homo sapiens
cacgcacggcttcctat

SEQ ID NO: 3358936 - DNA, 18 bp, Homo sapiens
cacgcacggcttcctata

SEQ ID NO: 3358937 - DNA, 13 bp, Homo sapiens
cacgcactgggcc

SEQ ID NO: 3358938 - DNA, 23 bp, Homo sapiens
cacgcactgggccacggaggagg

SEQ ID NO: 3358939 - DNA, 12 bp, Homo sapiens
cacgcagaggac

SEQ ID NO: 3358940 - DNA, 13 bp, Homo sapiens
cacgcaggaccag

SEQ ID NO: 3358941 - DNA, 15 bp, Homo sapiens
cacgccactgcacta

SEQ ID NO: 3358942 - DNA, 14 bp, Homo sapiens
cacgcccgtcctgc

SEQ ID NO: 3358943 - DNA, 20 bp, Homo sapiens
cacgcccgtcctgcctgtgg

SEQ ID NO: 3358944 - DNA, 15 bp, Homo sapiens
cacgccctcccctcc

SEQ ID NO: 3358945 - DNA, 16 bp, Homo sapiens
cacgccctcccctccc

SEQ ID NO: 3358946 - DNA, 20 bp, Homo sapiens
cacgccctcccctcccctgc

SEQ ID NO: 3358947 - DNA, 14 bp, Homo sapiens
cacgccctccctct

SEQ ID NO: 3358948 - DNA, 21 bp, Homo sapiens
cacgcctatgatcccagcact

SEQ ID NO: 3358949 - DNA, 14 bp, Homo sapiens
cacgcctcctggcc

SEQ ID NO: 3358950 - DNA, 21 bp, Homo sapiens
cacgcctgtaatcccagcact

SEQ ID NO: 3358951 - DNA, 15 bp, Homo sapiens
cacgccttcccctca

SEQ ID NO: 3358952 - DNA, 13 bp, Homo sapiens
cacgctccagctg

SEQ ID NO: 3358953 - DNA, 19 bp, Homo sapiens
cacgctcccccgcagtccc

SEQ ID NO: 3358954 - DNA, 18 bp, Homo sapiens
cacgctccccgcctgttc

SEQ ID NO: 3358955 - DNA, 21 bp, Homo sapiens
cacgctccccgcctgttcccc

SEQ ID NO: 3358956 - DNA, 15 bp, Homo sapiens
cacgctcgcgggcag

SEQ ID NO: 3358957 - DNA, 23 bp, Homo sapiens
cacgctcgcgggcagcgggccag

SEQ ID NO: 3358958 - DNA, 12 bp, Homo sapiens
cacgctcgctgc

SEQ ID NO: 3358959 - DNA, 17 bp, Homo sapiens
cacgctcgctgccatca

SEQ ID NO: 3358960 - DNA, 19 bp, Homo sapiens
cacgctcgctgccatcacc

SEQ ID NO: 3358961 - DNA, 17 bp, Homo sapiens
cacgctggagtgcagtg

SEQ ID NO: 3358962 - DNA, 21 bp, Homo sapiens
cacgctggagtgcagtgagcc

SEQ ID NO: 3358963 - DNA, 17 bp, Homo sapiens
cacgctggggctctctg

SEQ ID NO: 3358964 - DNA, 22 bp, Homo sapiens
cacgctggggctctctgagact

SEQ ID NO: 3358965 - DNA, 18 bp, Homo sapiens
cacggaccactcgaggcc

SEQ ID NO: 3358966 - DNA, 18 bp, Homo sapiens
cacggacgtttccatcag

SEQ ID NO: 3358967 - DNA, 13 bp, Homo sapiens
cacggagccctcc

SEQ ID NO: 3358968 - DNA, 18 bp, Homo sapiens
cacggaggagggatgctg

SEQ ID NO: 3358969 - DNA, 23 bp, Homo sapiens
cacggaggagttttggcagccag

SEQ ID NO: 3358970 - DNA, 21 bp, Homo sapiens
cacggaggcatctgcaccctc

SEQ ID NO: 3358971 - DNA, 12 bp, Homo sapiens
cacggccaggcc

SEQ ID NO: 3358972 - DNA, 14 bp, Homo sapiens
cacggccaggccag

SEQ ID NO: 3358973 - DNA, 19 bp, Homo sapiens
cacggccgctccaggggtg

SEQ ID NO: 3358974 - DNA, 14 bp, Homo sapiens
cacggcctggctgg

SEQ ID NO: 3358975 - DNA, 16 bp, Homo sapiens
cacggctcactgcagc

SEQ ID NO: 3358976 - DNA, 19 bp, Homo sapiens
cacggctcactgcagcctc

SEQ ID NO: 3358977 - DNA, 15 bp, Homo sapiens
cacgggtggtccccg

SEQ ID NO: 3358978 - DNA, 22 bp, Homo sapiens
cacggtatttatagagagagac

SEQ ID NO: 3358979 - DNA, 16 bp, Homo sapiens
cacggtgcgtggctgt

SEQ ID NO: 3358980 - DNA, 19 bp, Homo sapiens
cacggtgcgtggctgtggc

SEQ ID NO: 3358981 - DNA, 21 bp, Homo sapiens
cacggtgcgtggctgtggcac

SEQ ID NO: 3358982 - DNA, 19 bp, Homo sapiens
cacgtacacacacatacac

SEQ ID NO: 3358983 - DNA, 14 bp, Homo sapiens
cacgtcccagcatc

SEQ ID NO: 3358984 - DNA, 20 bp, Homo sapiens
cacgtcccagcatccctgga

SEQ ID NO: 3358985 - DNA, 13 bp, Homo sapiens
cacgtccccctgg

SEQ ID NO: 3358986 - DNA, 15 bp, Homo sapiens
cacgtccccctgggg

SEQ ID NO: 3358987 - DNA, 20 bp, Homo sapiens
cacgtccccctggggcttct

SEQ ID NO: 3358988 - DNA, 15 bp, Homo sapiens
cacgtctgacaaatg

SEQ ID NO: 3358989 - DNA, 12 bp, Homo sapiens
cacgtctgccag

SEQ ID NO: 3358990 - DNA, 13 bp, Homo sapiens
cacgtctgccagg

SEQ ID NO: 3358991 - DNA, 16 bp, Homo sapiens
cacgtctgccaggccc

SEQ ID NO: 3358992 - DNA, 17 bp, Homo sapiens
cacgtctgccaggccca

SEQ ID NO: 3358993 - DNA, 12 bp, Homo sapiens
cacgtctggcca

SEQ ID NO: 3358994 - DNA, 14 bp, Homo sapiens
cacgtctgtcttca

SEQ ID NO: 3358995 - DNA, 17 bp, Homo sapiens
cacgtcttggtgccttt

SEQ ID NO: 3358996 - DNA, 12 bp, Homo sapiens
cacgtgaatggc

SEQ ID NO: 3358997 - DNA, 18 bp, Homo sapiens
cacgtgacagtgcctggg

SEQ ID NO: 3358998 - DNA, 15 bp, Homo sapiens
cacgtggagagctgg

SEQ ID NO: 3358999 - DNA, 23 bp, Homo sapiens
cacgtggagagctggtgcccgga

SEQ ID NO: 3359000 - DNA, 20 bp, Homo sapiens
cacgtggcatgtggcctgtg

SEQ ID NO: 3359001 - DNA, 22 bp, Homo sapiens
cacgtggcatgtggcctgtggc

SEQ ID NO: 3359002 - DNA, 13 bp, Homo sapiens
cacgtggcctctt

SEQ ID NO: 3359003 - DNA, 22 bp, Homo sapiens
cacgtggtcactgtgcactgcc

SEQ ID NO: 3359004 - DNA, 23 bp, Homo sapiens
cacgtggttggggccctgccctg

SEQ ID NO: 3359005 - DNA, 23 bp, Homo sapiens
cacgtgtatagtatctgtatata

SEQ ID NO: 3359006 - DNA, 16 bp, Homo sapiens
cacgtgtcctgtagtt

SEQ ID NO: 3359007 - DNA, 23 bp, Homo sapiens
cacgtgttttattcctgtatgtt

SEQ ID NO: 3359008 - DNA, 18 bp, Homo sapiens
cacgttccacagttgcca

SEQ ID NO: 3359009 - DNA, 18 bp, Homo sapiens
cacgttctcacacccacc

SEQ ID NO: 3359010 - DNA, 22 bp, Homo sapiens
cacgttctcacacccaccgtcc

SEQ ID NO: 3359011 - DNA, 20 bp, Homo sapiens
cacgttggggtgatttaatc

SEQ ID NO: 3359012 - DNA, 22 bp, Homo sapiens
cacgtttttacatacttttgca

SEQ ID NO: 3359013 - DNA, 19 bp, Homo sapiens
cactaaaacacacaggtgc

SEQ ID NO: 3359014 - DNA, 20 bp, Homo sapiens
cactaacattatattgcaat

SEQ ID NO: 3359015 - DNA, 16 bp, Homo sapiens
cactaaccacgctgga

SEQ ID NO: 3359016 - DNA, 20 bp, Homo sapiens
cactaacgttgagcccctgg

SEQ ID NO: 3359017 - DNA, 15 bp, Homo sapiens
cactaactcaccagc

SEQ ID NO: 3359018 - DNA, 18 bp, Homo sapiens
cactaactcaccagcccc

SEQ ID NO: 3359019 - DNA, 21 bp, Homo sapiens
cactaagagaaaattgcacta

SEQ ID NO: 3359020 - DNA, 23 bp, Homo sapiens
cactaaggccgtgtctctgagga

SEQ ID NO: 3359021 - DNA, 18 bp, Homo sapiens
cactaaggtgtgctctga

SEQ ID NO: 3359022 - DNA, 19 bp, Homo sapiens
cactaatgagtatttggta

SEQ ID NO: 3359023 - DNA, 23 bp, Homo sapiens
cactaatttttgtattatttttg

SEQ ID NO: 3359024 - DNA, 15 bp, Homo sapiens
cactacacctggctg

SEQ ID NO: 3359025 - DNA, 16 bp, Homo sapiens
cactacaccttgcctt

SEQ ID NO: 3359026 - DNA, 20 bp, Homo sapiens
cactacactccagcctgagc

SEQ ID NO: 3359027 - DNA, 21 bp, Homo sapiens
cactacactccagcctgagca

SEQ ID NO: 3359028 - DNA, 14 bp, Homo sapiens
cactacataaactg

SEQ ID NO: 3359029 - DNA, 17 bp, Homo sapiens
cactacataaactgact

SEQ ID NO: 3359030 - DNA, 23 bp, Homo sapiens
cactacatgcagcccatgcccac

SEQ ID NO: 3359031 - DNA, 15 bp, Homo sapiens
cactacattcattta

SEQ ID NO: 3359032 - DNA, 18 bp, Homo sapiens
cactactacatctgtgat

SEQ ID NO: 3359033 - DNA, 13 bp, Homo sapiens
cactactacctct

SEQ ID NO: 3359034 - DNA, 19 bp, Homo sapiens
cactactcaatactacctc

SEQ ID NO: 3359035 - DNA, 17 bp, Homo sapiens
cactactcacagtctct

SEQ ID NO: 3359036 - DNA, 20 bp, Homo sapiens
cactactcctctgcagtgcc

SEQ ID NO: 3359037 - DNA, 13 bp, Homo sapiens
cactactctgtgc

SEQ ID NO: 3359038 - DNA, 15 bp, Homo sapiens
cactactgacatgtg

SEQ ID NO: 3359039 - DNA, 17 bp, Homo sapiens
cactactgcagcacctc

SEQ ID NO: 3359040 - DNA, 12 bp, Homo sapiens
cactagaaaact

SEQ ID NO: 3359041 - DNA, 20 bp, Homo sapiens
cactagaaaagctgatcata

SEQ ID NO: 3359042 - DNA, 19 bp, Homo sapiens
cacttgtgtgtgggctgtg

SEQ ID NO: 3359043 - DNA, 23 bp, Homo sapiens
cacttgtgtgtgggctgtgagtg

SEQ ID NO: 3359044 - DNA, 17 bp, Homo sapiens
cacttgttccagctctt

SEQ ID NO: 3359045 - DNA, 15 bp, Homo sapiens
cactttaagctcctt

SEQ ID NO: 3359046 - DNA, 22 bp, Homo sapiens
cactttacccacctagaacact

SEQ ID NO: 3359047 - DNA, 14 bp, Homo sapiens
cactttagatgctg

SEQ ID NO: 3359048 - DNA, 17 bp, Homo sapiens
cactttagggctgtaaa

SEQ ID NO: 3359049 - DNA, 15 bp, Homo sapiens
cactttatttacttc

SEQ ID NO: 3359050 - DNA, 24 bp, Homo sapiens
cactttcagagcccccagccctgg

SEQ ID NO: 3359051 - DNA, 20 bp, Homo sapiens
cactttcattgccagtgtct

SEQ ID NO: 3359052 - DNA, 19 bp, Homo sapiens
cactttctacaatgtgaac

SEQ ID NO: 3359053 - DNA, 16 bp, Homo sapiens
cactttctatagcaga

SEQ ID NO: 3359054 - DNA, 22 bp, Homo sapiens
cactttctcttcttgtttctcc

SEQ ID NO: 3359055 - DNA, 15 bp, Homo sapiens
cactttgaaatacct

SEQ ID NO: 3359056 - DNA, 16 bp, Homo sapiens
cactttgaaatacctc

SEQ ID NO: 3359057 - DNA, 21 bp, Homo sapiens
cactttgctctcaattaaagt

SEQ ID NO: 3359058 - DNA, 20 bp, Homo sapiens
cactttggaagtttgtgttc

SEQ ID NO: 3359059 - DNA, 13 bp, Homo sapiens
cactttgggaggc

SEQ ID NO: 3359060 - DNA, 19 bp, Homo sapiens
cactttggtacatggccag

SEQ ID NO: 3359061 - DNA, 15 bp, Homo sapiens
cactttgtattactt

SEQ ID NO: 3359062 - DNA, 15 bp, Homo sapiens
cactttgttaaaaat

SEQ ID NO: 3359063 - DNA, 14 bp, Homo sapiens
cactttgttcttta

SEQ ID NO: 3359064 - DNA, 20 bp, Homo sapiens
cactttgtttcgtggggagg

SEQ ID NO: 3359065 - DNA, 21 bp, Homo sapiens
cactttgtttcgtggggaggt

SEQ ID NO: 3359066 - DNA, 15 bp, Homo sapiens
cacttttatttcctg

SEQ ID NO: 3359067 - DNA, 19 bp, Homo sapiens
cacttttccacattccagt

SEQ ID NO: 3359068 - DNA, 16 bp, Homo sapiens
cacttttcctccctca

SEQ ID NO: 3359069 - DNA, 19 bp, Homo sapiens
cacttttgttattccatca

SEQ ID NO: 3359070 - DNA, 19 bp, Homo sapiens
cactttttcgtgtggatct

SEQ ID NO: 3359071 - DNA, 19 bp, Homo sapiens
cactttttgaactaagaaa

SEQ ID NO: 3359072 - DNA, 20 bp, Homo sapiens
cactttttggctgacttcat

SEQ ID NO: 3359073 - DNA, 11 bp, Homo sapiens
cagaaaaacaa

SEQ ID NO: 3359074 - DNA, 20 bp, Homo sapiens
cagaaaaacaatcttattcc

SEQ ID NO: 3359075 - DNA, 13 bp, Homo sapiens
cagaaaaagcatg

SEQ ID NO: 3359076 - DNA, 15 bp, Homo sapiens
cagaaaacctgttca

SEQ ID NO: 3359077 - DNA, 16 bp, Homo sapiens
cagaaaagaaaaccat

SEQ ID NO: 3359078 - DNA, 20 bp, Homo sapiens
cagaaaagcataacaccaat

SEQ ID NO: 3359079 - DNA, 19 bp, Homo sapiens
cagaaaatattatgtgttt

SEQ ID NO: 3359080 - DNA, 14 bp, Homo sapiens
cagaaaatgttgag

SEQ ID NO: 3359081 - DNA, 15 bp, Homo sapiens
cagaaaattctgtgc

SEQ ID NO: 3359082 - DNA, 15 bp, Homo sapiens
cagaaacagccattg

SEQ ID NO: 3359083 - DNA, 18 bp, Homo sapiens
cagaaacaggtgcatctg

SEQ ID NO: 3359084 - DNA, 22 bp, Homo sapiens
cagaaacaggtgcatctgggga

SEQ ID NO: 3359085 - DNA, 14 bp, Homo sapiens
cagaaacagtggga

SEQ ID NO: 3359086 - DNA, 18 bp, Homo sapiens
cagaaaccagaaaagcaa

SEQ ID NO: 3359087 - DNA, 22 bp, Homo sapiens
cagaaacctatcctcactgccc

SEQ ID NO: 3359088 - DNA, 17 bp, Homo sapiens
cagaaacgcatccagca

SEQ ID NO: 3359089 - DNA, 13 bp, Homo sapiens
cagaaactgatgc

SEQ ID NO: 3359090 - DNA, 23 bp, Homo sapiens
cagaaagaggtctccccatcccc

SEQ ID NO: 3359091 - DNA, 19 bp, Homo sapiens
cagaaagcctgggtgacat

SEQ ID NO: 3359092 - DNA, 22 bp, Homo sapiens
cagaaagcctgggtgacatttg

SEQ ID NO: 3359093 - DNA, 14 bp, Homo sapiens
cagaaagctgcctg

SEQ ID NO: 3359094 - DNA, 15 bp, Homo sapiens
cagaaagctgcctgg

SEQ ID NO: 3359095 - DNA, 18 bp, Homo sapiens
cagaaagctgtgaacagg

SEQ ID NO: 3359096 - DNA, 12 bp, Homo sapiens
cagaaaggattt

SEQ ID NO: 3359097 - DNA, 14 bp, Homo sapiens
cagaaaggctctga

SEQ ID NO: 3359098 - DNA, 15 bp, Homo sapiens
cagaaagtatatact

SEQ ID NO: 3359099 - DNA, 14 bp, Homo sapiens
cagaaagtgcctga

SEQ ID NO: 3359100 - DNA, 19 bp, Homo sapiens
cagaaagtgcctgacacac

SEQ ID NO: 3359101 - DNA, 22 bp, Homo sapiens
cagaaagtggccatgccaccct

SEQ ID NO: 3359102 - DNA, 23 bp, Homo sapiens
cagaaagtggccatgccaccctg

SEQ ID NO: 3359103 - DNA, 21 bp, Homo sapiens
cagaaagtttgtaaaaatata

SEQ ID NO: 3359104 - DNA, 14 bp, Homo sapiens
cagaaatagacaaa

SEQ ID NO: 3359105 - DNA, 16 bp, Homo sapiens
cagaaatagacaaaaa

SEQ ID NO: 3359106 - DNA, 21 bp, Homo sapiens
cagaaatagacaaaaagtata

SEQ ID NO: 3359107 - DNA, 20 bp, Homo sapiens
cagaaatataacacattttt

SEQ ID NO: 3359108 - DNA, 16 bp, Homo sapiens
cagaaatatatataca

SEQ ID NO: 3359109 - DNA, 20 bp, Homo sapiens
cagaaatatatatacatatg

SEQ ID NO: 3359110 - DNA, 14 bp, Homo sapiens
cagaaatcagagga

SEQ ID NO: 3359111 - DNA, 15 bp, Homo sapiens
cagaaatcagaggag

SEQ ID NO: 3359112 - DNA, 19 bp, Homo sapiens
cagaaatctagaagactgt

SEQ ID NO: 3359113 - DNA, 12 bp, Homo sapiens
cagaaatgcaaa

SEQ ID NO: 3359114 - DNA, 13 bp, Homo sapiens
cagaaatgcaaaa

SEQ ID NO: 3359115 - DNA, 21 bp, Homo sapiens
cagaaatggggaattctctaa

SEQ ID NO: 3359116 - DNA, 22 bp, Homo sapiens
cagaaatgttgagtctgtacta

SEQ ID NO: 3359117 - DNA, 16 bp, Homo sapiens
cagaaattagccgggc

SEQ ID NO: 3359118 - DNA, 20 bp, Homo sapiens
cagaaattcaatttggattt

SEQ ID NO: 3359119 - DNA, 21 bp, Homo sapiens
cagaaattggaacagaatgtt

SEQ ID NO: 3359120 - DNA, 15 bp, Homo sapiens
cagaaatttttattt

SEQ ID NO: 3359121 - DNA, 16 bp, Homo sapiens
cagaacaaaaagaaat

SEQ ID NO: 3359122 - DNA, 19 bp, Homo sapiens
cagaacacacagactttct

SEQ ID NO: 3359123 - DNA, 21 bp, Homo sapiens
cagaacacccctaatgagggt

SEQ ID NO: 3359124 - DNA, 19 bp, Homo sapiens
cagaacacggctcacgctt

SEQ ID NO: 3359125 - DNA, 21 bp, Homo sapiens
cagaacagcagaggttctttt

SEQ ID NO: 3359126 - DNA, 19 bp, Homo sapiens
cagaacaggaggtgtgaat

SEQ ID NO: 3359127 - DNA, 20 bp, Homo sapiens
cagaacaggaggtgtgaatg

SEQ ID NO: 3359128 - DNA, 13 bp, Homo sapiens
cagaacagtgaaa

SEQ ID NO: 3359129 - DNA, 16 bp, Homo sapiens
cagaacagtgaaaggt

SEQ ID NO: 3359130 - DNA, 22 bp, Homo sapiens
cagaacagtgaaaggtattgca

SEQ ID NO: 3359131 - DNA, 16 bp, Homo sapiens
cagaacatcattagaa

SEQ ID NO: 3359132 - DNA, 17 bp, Homo sapiens
cagaacattcagctctg

SEQ ID NO: 3359133 - DNA, 20 bp, Homo sapiens
cagaacattcagctctggag

SEQ ID NO: 3359134 - DNA, 16 bp, Homo sapiens
cagaaccacaaacaat

SEQ ID NO: 3359135 - DNA, 21 bp, Homo sapiens
cagaaccacacttgaaacctt

SEQ ID NO: 3359136 - DNA, 12 bp, Homo sapiens
cagaacccaggg

SEQ ID NO: 3359137 - DNA, 14 bp, Homo sapiens
cagaacccagggct

SEQ ID NO: 3359138 - DNA, 15 bp, Homo sapiens
cagaacccagggctc

SEQ ID NO: 3359139 - DNA, 23 bp, Homo sapiens
cagaacccctacatgaaacagaa

SEQ ID NO: 3359140 - DNA, 18 bp, Homo sapiens
cagaacctactgttcctt

SEQ ID NO: 3359141 - DNA, 21 bp, Homo sapiens
cagaacctcttccccagaaag

SEQ ID NO: 3359142 - DNA, 21 bp, Homo sapiens
cagaaccttcaacccagtggg

SEQ ID NO: 3359143 - DNA, 17 bp, Homo sapiens
cagaactaaatgttcta

SEQ ID NO: 3359144 - DNA, 18 bp, Homo sapiens
cagaactaaatgttctat

SEQ ID NO: 3359145 - DNA, 21 bp, Homo sapiens
cagaactcattctatccccaa

SEQ ID NO: 3359146 - DNA, 13 bp, Homo sapiens
cagaactgaaata

SEQ ID NO: 3359147 - DNA, 11 bp, Homo sapiens
cagaactgcca

SEQ ID NO: 3359148 - DNA, 20 bp, Homo sapiens
cagaactgccattattttct

SEQ ID NO: 3359149 - DNA, 12 bp, Homo sapiens
cagaactgcccc

SEQ ID NO: 3359150 - DNA, 15 bp, Homo sapiens
cagaactgcccccac

SEQ ID NO: 3359151 - DNA, 12 bp, Homo sapiens
cagaactgccct

SEQ ID NO: 3359152 - DNA, 19 bp, Homo sapiens
cagaacttcagaaagactt

SEQ ID NO: 3359153 - DNA, 16 bp, Homo sapiens
cagaagaaaggaacat

SEQ ID NO: 3359154 - DNA, 16 bp, Homo sapiens
cagaagaaagggtgga

SEQ ID NO: 3359155 - DNA, 15 bp, Homo sapiens
cagaagaaataaata

SEQ ID NO: 3359156 - DNA, 17 bp, Homo sapiens
cagaagaaataaatata

SEQ ID NO: 3359157 - DNA, 22 bp, Homo sapiens
cagaagaaataattgtgtcatg

SEQ ID NO: 3359158 - DNA, 19 bp, Homo sapiens
cagaagagaaggaagccat

SEQ ID NO: 3359159 - DNA, 22 bp, Homo sapiens
cagaagagaaggaagccatagt

SEQ ID NO: 3359160 - DNA, 13 bp, Homo sapiens
cagaagaggaaat

SEQ ID NO: 3359161 - DNA, 22 bp, Homo sapiens
cagaagaggggcagctttttca

SEQ ID NO: 3359162 - DNA, 19 bp, Homo sapiens
cagaagaggttgggcttcc

SEQ ID NO: 3359163 - DNA, 14 bp, Homo sapiens
cagaagcaggctgg

SEQ ID NO: 3359164 - DNA, 21 bp, Homo sapiens
cagaagcagggtaccctttgg

SEQ ID NO: 3359165 - DNA, 22 bp, Homo sapiens
cagaagcatattttgctggttt

SEQ ID NO: 3359166 - DNA, 14 bp, Homo sapiens
cagaagcattaact

SEQ ID NO: 3359167 - DNA, 23 bp, Homo sapiens
cagagcccaatgcatagagccct

SEQ ID NO: 3359168 - DNA, 20 bp, Homo sapiens
cagagcccaccttggctcaa

SEQ ID NO: 3359169 - DNA, 16 bp, Homo sapiens
cagagcccctacagca

SEQ ID NO: 3359170 - DNA, 22 bp, Homo sapiens
cagagcccctcctccagcccct

SEQ ID NO: 3359171 - DNA, 15 bp, Homo sapiens
cagagccctgccctg

SEQ ID NO: 3359172 - DNA, 15 bp, Homo sapiens
cagagccctggctgg

SEQ ID NO: 3359173 - DNA, 17 bp, Homo sapiens
cagagccctggctgggt

SEQ ID NO: 3359174 - DNA, 16 bp, Homo sapiens
cagagcccttcactgc

SEQ ID NO: 3359175 - DNA, 18 bp, Homo sapiens
cagagcccttcactgcca

SEQ ID NO: 3359176 - DNA, 20 bp, Homo sapiens
cagagcccttcactgccatg

SEQ ID NO: 3359177 - DNA, 13 bp, Homo sapiens
cagagcctgcagt

SEQ ID NO: 3359178 - DNA, 13 bp, Homo sapiens
cagagcctgccta

SEQ ID NO: 3359179 - DNA, 19 bp, Homo sapiens
cagagcctggggtgttctc

SEQ ID NO: 3359180 - DNA, 11 bp, Homo sapiens
cagagccttca

SEQ ID NO: 3359181 - DNA, 16 bp, Homo sapiens
cagagccttcaagtgc

SEQ ID NO: 3359182 - DNA, 21 bp, Homo sapiens
cagagcgaagacccggccagg

SEQ ID NO: 3359183 - DNA, 20 bp, Homo sapiens
cagagcgagactccgtctca

SEQ ID NO: 3359184 - DNA, 20 bp, Homo sapiens
cagagcgagagtctgtctca

SEQ ID NO: 3359185 - DNA, 21 bp, Homo sapiens
cagagcgccgtgagttctcag

SEQ ID NO: 3359186 - DNA, 19 bp, Homo sapiens
cagagcgtccttccccctg

SEQ ID NO: 3359187 - DNA, 22 bp, Homo sapiens
cagagctaagggtgggtgctca

SEQ ID NO: 3359188 - DNA, 12 bp, Homo sapiens
cagagctgaccc

SEQ ID NO: 3359189 - DNA, 17 bp, Homo sapiens
cagagctgacgggaggc

SEQ ID NO: 3359190 - DNA, 21 bp, Homo sapiens
cagagctgacgggaggcccca

SEQ ID NO: 3359191 - DNA, 22 bp, Homo sapiens
cagagctgacgggaggccccag

SEQ ID NO: 3359192 - DNA, 16 bp, Homo sapiens
cagagctgcacttggc

SEQ ID NO: 3359193 - DNA, 19 bp, Homo sapiens
cagagctgcacttggcctc

SEQ ID NO: 3359194 - DNA, 20 bp, Homo sapiens
cagagctgcacttggcctca

SEQ ID NO: 3359195 - DNA, 13 bp, Homo sapiens
cagagctgggagg

SEQ ID NO: 3359196 - DNA, 20 bp, Homo sapiens
cagagctgggaggcatggcc

SEQ ID NO: 3359197 - DNA, 23 bp, Homo sapiens
cagaggaaacaatatttataaag

SEQ ID NO: 3359198 - DNA, 17 bp, Homo sapiens
cagaggaactgtccaga

SEQ ID NO: 3359199 - DNA, 18 bp, Homo sapiens
cagaggaatcctggcagc

SEQ ID NO: 3359200 - DNA, 19 bp, Homo sapiens
cagaggaatcctggcagcc

SEQ ID NO: 3359201 - DNA, 21 bp, Homo sapiens
cagaggaatcctggcagccca

SEQ ID NO: 3359202 - DNA, 23 bp, Homo sapiens
cagaggaatcctggcagcccaga

SEQ ID NO: 3359203 - DNA, 18 bp, Homo sapiens
cagaggacagtctggaga

SEQ ID NO: 3359204 - DNA, 12 bp, Homo sapiens
cagaggaccaca

SEQ ID NO: 3359205 - DNA, 15 bp, Homo sapiens
cagaggaccacagtg

SEQ ID NO: 3359206 - DNA, 18 bp, Homo sapiens
cagaggaccacagtgggt

SEQ ID NO: 3359207 - DNA, 23 bp, Homo sapiens
cagaggacgcacgctcgctgcca

SEQ ID NO: 3359208 - DNA, 18 bp, Homo sapiens
cagaggagccaccagttc

SEQ ID NO: 3359209 - DNA, 19 bp, Homo sapiens
cagaggagccaccagttct

SEQ ID NO: 3359210 - DNA, 22 bp, Homo sapiens
cagaggagctctaccctgctcc

SEQ ID NO: 3359211 - DNA, 24 bp, Homo sapiens
cagaggagctctaccctgctccct

SEQ ID NO: 3359212 - DNA, 23 bp, Homo sapiens
cagaggagtgattgaaccagctc

SEQ ID NO: 3359213 - DNA, 18 bp, Homo sapiens
cagaggatggccagtgtc

SEQ ID NO: 3359214 - DNA, 13 bp, Homo sapiens
cagaggcacctca

SEQ ID NO: 3359215 - DNA, 12 bp, Homo sapiens
cagaggcagccc

SEQ ID NO: 3359216 - DNA, 13 bp, Homo sapiens
cagaggcagcccc

SEQ ID NO: 3359217 - DNA, 20 bp, Homo sapiens
cagaggcagccccattctgc

SEQ ID NO: 3359218 - DNA, 22 bp, Homo sapiens
cagaggcagcttcaagtgcctt

SEQ ID NO: 3359219 - DNA, 11 bp, Homo sapiens
cagaggcaggc

SEQ ID NO: 3359220 - DNA, 20 bp, Homo sapiens
cagaggccatgggcctcctg

SEQ ID NO: 3359221 - DNA, 17 bp, Homo sapiens
cagaggcccccagccca

SEQ ID NO: 3359222 - DNA, 23 bp, Homo sapiens
cagaggcccccagcccagggctc

SEQ ID NO: 3359223 - DNA, 15 bp, Homo sapiens
cagaggccctggagg

SEQ ID NO: 3359224 - DNA, 20 bp, Homo sapiens
cagaggccgaaggtgcctca

SEQ ID NO: 3359225 - DNA, 22 bp, Homo sapiens
cagaggccgaaggtgcctcaga

SEQ ID NO: 3359226 - DNA, 23 bp, Homo sapiens
cagaggccgaaggtgcctcagac

SEQ ID NO: 3359227 - DNA, 16 bp, Homo sapiens
cagaggcctataatga

SEQ ID NO: 3359228 - DNA, 16 bp, Homo sapiens
cagaggctaagatgag

SEQ ID NO: 3359229 - DNA, 20 bp, Homo sapiens
cagaggctattattttcact

SEQ ID NO: 3359230 - DNA, 13 bp, Homo sapiens
cagaggctgcctc

SEQ ID NO: 3359231 - DNA, 21 bp, Homo sapiens
cagaggctgggagcatagcag

SEQ ID NO: 3359232 - DNA, 22 bp, Homo sapiens
cagaggctgggagcatagcaga

SEQ ID NO: 3359233 - DNA, 12 bp, Homo sapiens
cagaggctgggt

SEQ ID NO: 3359234 - DNA, 14 bp, Homo sapiens
cagaggctgggttc

SEQ ID NO: 3359235 - DNA, 13 bp, Homo sapiens
cagagggagcagg

SEQ ID NO: 3359236 - DNA, 22 bp, Homo sapiens
cagagggagctggaacccgagg

SEQ ID NO: 3359237 - DNA, 14 bp, Homo sapiens
cagagggctaggga

SEQ ID NO: 3359238 - DNA, 11 bp, Homo sapiens
cagagggctgg

SEQ ID NO: 3359239 - DNA, 12 bp, Homo sapiens
cagagggctgga

SEQ ID NO: 3359240 - DNA, 14 bp, Homo sapiens
cagagggctggagg

SEQ ID NO: 3359241 - DNA, 19 bp, Homo sapiens
cagagggctggaggcccag

SEQ ID NO: 3359242 - DNA, 19 bp, Homo sapiens
cagagggcttgtgaacaga

SEQ ID NO: 3359243 - DNA, 13 bp, Homo sapiens
cagaggggccagg

SEQ ID NO: 3359244 - DNA, 20 bp, Homo sapiens
cagaggggccaggcccaggc

SEQ ID NO: 3359245 - DNA, 13 bp, Homo sapiens
cagaggtaacaga

SEQ ID NO: 3359246 - DNA, 14 bp, Homo sapiens
cagaggtaacagaa

SEQ ID NO: 3359247 - DNA, 17 bp, Homo sapiens
cagaggtaacagaacag

SEQ ID NO: 3359248 - DNA, 18 bp, Homo sapiens
cagaggtaacagaacagc

SEQ ID NO: 3359249 - DNA, 19 bp, Homo sapiens
cagaggtaacagaacagct

SEQ ID NO: 3359250 - DNA, 20 bp, Homo sapiens
cagaggtaacagaacagctt

SEQ ID NO: 3359251 - DNA, 22 bp, Homo sapiens
cagaggtaacagaacagcttca

SEQ ID NO: 3359252 - DNA, 23 bp, Homo sapiens
cagaggtaacagaacagcttcag

SEQ ID NO: 3359253 - DNA, 18 bp, Homo sapiens
cagaggtagggctgccac

SEQ ID NO: 3359254 - DNA, 13 bp, Homo sapiens
cagaggtccagcc

SEQ ID NO: 3359255 - DNA, 13 bp, Homo sapiens
cagaggtctccca

SEQ ID NO: 3359256 - DNA, 14 bp, Homo sapiens
cagaggtgcttcac

SEQ ID NO: 3359257 - DNA, 19 bp, Homo sapiens
cagaggtggccagagctgg

SEQ ID NO: 3359258 - DNA, 16 bp, Homo sapiens
cagaggtggcgcccag

SEQ ID NO: 3359259 - DNA, 12 bp, Homo sapiens
cagaggtgggca

SEQ ID NO: 3359260 - DNA, 22 bp, Homo sapiens
cagaggtgggcaggtggtggca

SEQ ID NO: 3359261 - DNA, 21 bp, Homo sapiens
cagaggttatctgcctggcct

SEQ ID NO: 3359262 - DNA, 18 bp, Homo sapiens
cagaggtttgcttcctca

SEQ ID NO: 3359263 - DNA, 20 bp, Homo sapiens
cagagtatgtccgatggtat

SEQ ID NO: 3359264 - DNA, 22 bp, Homo sapiens
cagagtatgtccgatggtatct

SEQ ID NO: 3359265 - DNA, 23 bp, Homo sapiens
cagagtcagaggagaagagacat

SEQ ID NO: 3359266 - DNA, 17 bp, Homo sapiens
cagagtccaatttaagg

SEQ ID NO: 3359267 - DNA, 21 bp, Homo sapiens
cagagtccatttcccacatct

SEQ ID NO: 3359268 - DNA, 23 bp, Homo sapiens
cagagtccatttcccacatcttt

SEQ ID NO: 3359269 - DNA, 20 bp, Homo sapiens
cagagtccgggagaatgctg

SEQ ID NO: 3359270 - DNA, 16 bp, Homo sapiens
cagagtccttaaaatg

SEQ ID NO: 3359271 - DNA, 19 bp, Homo sapiens
cagagtcgttggagactga

SEQ ID NO: 3359272 - DNA, 21 bp, Homo sapiens
cagagtcgttggagactgaag

SEQ ID NO: 3359273 - DNA, 17 bp, Homo sapiens
cagagtctcactgttgc

SEQ ID NO: 3359274 - DNA, 22 bp, Homo sapiens
cagagtctcactgttgcccagg

SEQ ID NO: 3359275 - DNA, 23 bp, Homo sapiens
cagagtctcactgttgcccaggc

SEQ ID NO: 3359276 - DNA, 12 bp, Homo sapiens
cagagtctgagc

SEQ ID NO: 3359277 - DNA, 16 bp, Homo sapiens
cagagtctgggcctct

SEQ ID NO: 3359278 - DNA, 19 bp, Homo sapiens
cagagtctgggcctctgac

SEQ ID NO: 3359279 - DNA, 21 bp, Homo sapiens
cagagtgaatgtcccccatca

SEQ ID NO: 3359280 - DNA, 15 bp, Homo sapiens
cagagtgagaccctg

SEQ ID NO: 3359281 - DNA, 20 bp, Homo sapiens
cagagtgagactctgtctca

SEQ ID NO: 3359282 - DNA, 22 bp, Homo sapiens
cagagtgagcaagggggcccaa

SEQ ID NO: 3359283 - DNA, 15 bp, Homo sapiens
cagagtgagccagtg

SEQ ID NO: 3359284 - DNA, 15 bp, Homo sapiens
cagagtgccactgcg

SEQ ID NO: 3359285 - DNA, 15 bp, Homo sapiens
cagagtgctggactg

SEQ ID NO: 3359286 - DNA, 22 bp, Homo sapiens
cagagtgctggactgttccagg

SEQ ID NO: 3359287 - DNA, 16 bp, Homo sapiens
cagagtggactgcatt

SEQ ID NO: 3359288 - DNA, 17 bp, Homo sapiens
cagagtggactgcattt

SEQ ID NO: 3359289 - DNA, 13 bp, Homo sapiens
cagagtggagtct

SEQ ID NO: 3359290 - DNA, 15 bp, Homo sapiens
cagagtggagtctga

SEQ ID NO: 3359291 - DNA, 19 bp, Homo sapiens
cagagtggagtctgagtct

SEQ ID NO: 3359292 - DNA, 23 bp, Homo sapiens
cagccccagtcttccttgtctct

SEQ ID NO: 3359293 - DNA, 13 bp, Homo sapiens
cagccccagtgcc

SEQ ID NO: 3359294 - DNA, 15 bp, Homo sapiens
cagccccagtgccca

SEQ ID NO: 3359295 - DNA, 18 bp, Homo sapiens
cagccccagtgcccacag

SEQ ID NO: 3359296 - DNA, 19 bp, Homo sapiens
cagccccattctgcctgcc

SEQ ID NO: 3359297 - DNA, 17 bp, Homo sapiens
cagcccccagcccctcc

SEQ ID NO: 3359298 - DNA, 16 bp, Homo sapiens
cagcccccaggccagg

SEQ ID NO: 3359299 - DNA, 16 bp, Homo sapiens
cagccccccagcacta

SEQ ID NO: 3359300 - DNA, 24 bp, Homo sapiens
cagccccctccacaccagtggcct

SEQ ID NO: 3359301 - DNA, 22 bp, Homo sapiens
cagccccctggatgggcattgg

SEQ ID NO: 3359302 - DNA, 17 bp, Homo sapiens
cagcccccttgccctcc

SEQ ID NO: 3359303 - DNA, 18 bp, Homo sapiens
cagccccgagttgtttcc

SEQ ID NO: 3359304 - DNA, 20 bp, Homo sapiens
cagccccgagttgtttcctc

SEQ ID NO: 3359305 - DNA, 18 bp, Homo sapiens
cagccccggtggctgggc

SEQ ID NO: 3359306 - DNA, 19 bp, Homo sapiens
cagccccggtggctgggca

SEQ ID NO: 3359307 - DNA, 13 bp, Homo sapiens
cagcccctagaaa

SEQ ID NO: 3359308 - DNA, 20 bp, Homo sapiens
cagcccctagaaacccaagc

SEQ ID NO: 3359309 - DNA, 21 bp, Homo sapiens
cagcccctagaaacccaagct

SEQ ID NO: 3359310 - DNA, 12 bp, Homo sapiens
cagcccctagcc

SEQ ID NO: 3359311 - DNA, 22 bp, Homo sapiens
cagcccctagcccaggagagag

SEQ ID NO: 3359312 - DNA, 23 bp, Homo sapiens
cagcccctagcccaggagagaga

SEQ ID NO: 3359313 - DNA, 21 bp, Homo sapiens
cagcccctctggtcgctcctg

SEQ ID NO: 3359314 - DNA, 17 bp, Homo sapiens
cagcccctgccccagcc

SEQ ID NO: 3359315 - DNA, 19 bp, Homo sapiens
cagcccctgccccagccca

SEQ ID NO: 3359316 - DNA, 22 bp, Homo sapiens
cagcccctgccccagcccaagt

SEQ ID NO: 3359317 - DNA, 13 bp, Homo sapiens
cagcccctgcctg

SEQ ID NO: 3359318 - DNA, 15 bp, Homo sapiens
cagcccctgcctggg

SEQ ID NO: 3359319 - DNA, 16 bp, Homo sapiens
cagcccctgcctgggt

SEQ ID NO: 3359320 - DNA, 17 bp, Homo sapiens
cagccccttcctgggta

SEQ ID NO: 3359321 - DNA, 17 bp, Homo sapiens
cagccccttctcccagc

SEQ ID NO: 3359322 - DNA, 21 bp, Homo sapiens
cagccccttctcccagcacac

SEQ ID NO: 3359323 - DNA, 19 bp, Homo sapiens
cagcccgacaatgtcgagt

SEQ ID NO: 3359324 - DNA, 16 bp, Homo sapiens
cagcccgacagtgcca

SEQ ID NO: 3359325 - DNA, 16 bp, Homo sapiens
cagcccgcaactctcc

SEQ ID NO: 3359326 - DNA, 18 bp, Homo sapiens
cagcccgcaactctccag

SEQ ID NO: 3359327 - DNA, 15 bp, Homo sapiens
cagcccgcacacctg

SEQ ID NO: 3359328 - DNA, 20 bp, Homo sapiens
cagcccggcctgctcccagc

SEQ ID NO: 3359329 - DNA, 13 bp, Homo sapiens
cagcccggctggt

SEQ ID NO: 3359330 - DNA, 14 bp, Homo sapiens
cagcccggctggtt

SEQ ID NO: 3359331 - DNA, 19 bp, Homo sapiens
cagcccggctggttttgta

SEQ ID NO: 3359332 - DNA, 14 bp, Homo sapiens
cagcccgggagcct

SEQ ID NO: 3359333 - DNA, 16 bp, Homo sapiens
cagcccgggagcctag

SEQ ID NO: 3359334 - DNA, 18 bp, Homo sapiens
cagcccgtgaagcagtgc

SEQ ID NO: 3359335 - DNA, 20 bp, Homo sapiens
cagcccgtgaagcagtgcct

SEQ ID NO: 3359336 - DNA, 17 bp, Homo sapiens
cagccctaaggatctct

SEQ ID NO: 3359337 - DNA, 21 bp, Homo sapiens
cagccctccccatggagccag

SEQ ID NO: 3359338 - DNA, 15 bp, Homo sapiens
cagccctccctgccc

SEQ ID NO: 3359339 - DNA, 16 bp, Homo sapiens
cagccctccctgcccc

SEQ ID NO: 3359340 - DNA, 17 bp, Homo sapiens
cagccctccctgcccct

SEQ ID NO: 3359341 - DNA, 18 bp, Homo sapiens
cagccctccctgcccctc

SEQ ID NO: 3359342 - DNA, 21 bp, Homo sapiens
cagccctccgaccctcatggc

SEQ ID NO: 3359343 - DNA, 11 bp, Homo sapiens
cagccctgctg

SEQ ID NO: 3359344 - DNA, 12 bp, Homo sapiens
cagccctgctgg

SEQ ID NO: 3359345 - DNA, 11 bp, Homo sapiens
cagccctgctt

SEQ ID NO: 3359346 - DNA, 19 bp, Homo sapiens
cagccctgctttgggctgc

SEQ ID NO: 3359347 - DNA, 12 bp, Homo sapiens
cagccctggctc

SEQ ID NO: 3359348 - DNA, 16 bp, Homo sapiens
cagccctggctctgca

SEQ ID NO: 3359349 - DNA, 17 bp, Homo sapiens
cagccctgtcctggttc

SEQ ID NO: 3359350 - DNA, 15 bp, Homo sapiens
cagcccttagcaggg

SEQ ID NO: 3359351 - DNA, 16 bp, Homo sapiens
cagcccttcaggaagc

SEQ ID NO: 3359352 - DNA, 14 bp, Homo sapiens
cagcccttcctctc

SEQ ID NO: 3359353 - DNA, 19 bp, Homo sapiens
cagcccttcctctcactcc

SEQ ID NO: 3359354 - DNA, 21 bp, Homo sapiens
cagcccttcctctcactcctg

SEQ ID NO: 3359355 - DNA, 20 bp, Homo sapiens
cagcccttgagggagaactt

SEQ ID NO: 3359356 - DNA, 20 bp, Homo sapiens
cagccgaagctgcaggggca

SEQ ID NO: 3359357 - DNA, 17 bp, Homo sapiens
cagccgagccgggcctg

SEQ ID NO: 3359358 - DNA, 16 bp, Homo sapiens
cagccgcagcctccct

SEQ ID NO: 3359359 - DNA, 17 bp, Homo sapiens
cagccgcattggtgact

SEQ ID NO: 3359360 - DNA, 20 bp, Homo sapiens
cagccgcattggtgactcac

SEQ ID NO: 3359361 - DNA, 13 bp, Homo sapiens
cagccgccagctg

SEQ ID NO: 3359362 - DNA, 22 bp, Homo sapiens
cagccgccattgccaccaggag

SEQ ID NO: 3359363 - DNA, 18 bp, Homo sapiens
cagccgccccagcccctt

SEQ ID NO: 3359364 - DNA, 14 bp, Homo sapiens
cagccgccctgggc

SEQ ID NO: 3359365 - DNA, 17 bp, Homo sapiens
cagccgctaggagagac

SEQ ID NO: 3359366 - DNA, 18 bp, Homo sapiens
cagccggcacagggtctg

SEQ ID NO: 3359367 - DNA, 14 bp, Homo sapiens
cagccggcctctct

SEQ ID NO: 3359368 - DNA, 16 bp, Homo sapiens
cagccggcctctctgg

SEQ ID NO: 3359369 - DNA, 18 bp, Homo sapiens
cagccggcctctctggcc

SEQ ID NO: 3359370 - DNA, 19 bp, Homo sapiens
cagccggcctctctggcct

SEQ ID NO: 3359371 - DNA, 20 bp, Homo sapiens
cagccggcctctctggcctc

SEQ ID NO: 3359372 - DNA, 20 bp, Homo sapiens
cagccggcgtggcaaatata

SEQ ID NO: 3359373 - DNA, 13 bp, Homo sapiens
cagccggtgcctg

SEQ ID NO: 3359374 - DNA, 15 bp, Homo sapiens
cagccgtattttaca

SEQ ID NO: 3359375 - DNA, 17 bp, Homo sapiens
cagccgtgatgctcagg

SEQ ID NO: 3359376 - DNA, 12 bp, Homo sapiens
cagcctacagtt

SEQ ID NO: 3359377 - DNA, 15 bp, Homo sapiens
cagcctaccatgaga

SEQ ID NO: 3359378 - DNA, 19 bp, Homo sapiens
cagcctagcccttgtccct

SEQ ID NO: 3359379 - DNA, 20 bp, Homo sapiens
cagcctagcccttgtccctt

SEQ ID NO: 3359380 - DNA, 22 bp, Homo sapiens
cagcctagcccttgtccctttt

SEQ ID NO: 3359381 - DNA, 21 bp, Homo sapiens
cagcctagggctgagctgggg

SEQ ID NO: 3359382 - DNA, 19 bp, Homo sapiens
cagcctatgagcatcctga

SEQ ID NO: 3359383 - DNA, 19 bp, Homo sapiens
cagcctcaacctcctgggc

SEQ ID NO: 3359384 - DNA, 16 bp, Homo sapiens
cagcctcagtcctccc

SEQ ID NO: 3359385 - DNA, 21 bp, Homo sapiens
cagcctcattctgaggcctga

SEQ ID NO: 3359386 - DNA, 22 bp, Homo sapiens
cagcctccaacacaaggctcca

SEQ ID NO: 3359387 - DNA, 20 bp, Homo sapiens
cagcctccaagctccatctc

SEQ ID NO: 3359388 - DNA, 17 bp, Homo sapiens
cagcctccagagccagc

SEQ ID NO: 3359389 - DNA, 21 bp, Homo sapiens
cagcctccagagccagcctgg

SEQ ID NO: 3359390 - DNA, 23 bp, Homo sapiens
cagcctccagagccagcctggga

SEQ ID NO: 3359391 - DNA, 14 bp, Homo sapiens
cagcctccagcctg

SEQ ID NO: 3359392 - DNA, 17 bp, Homo sapiens
cagcctccatgctgcct

SEQ ID NO: 3359393 - DNA, 20 bp, Homo sapiens
cagcctccatgctgcctcca

SEQ ID NO: 3359394 - DNA, 14 bp, Homo sapiens
cagcctcccaaagt

SEQ ID NO: 3359395 - DNA, 15 bp, Homo sapiens
cagcctcccaaagtg

SEQ ID NO: 3359396 - DNA, 21 bp, Homo sapiens
cagcctcccaaagtgctgaga

SEQ ID NO: 3359397 - DNA, 20 bp, Homo sapiens
cagcctcccaaagtgctggg

SEQ ID NO: 3359398 - DNA, 21 bp, Homo sapiens
cagcctcccaaagtgctggga

SEQ ID NO: 3359399 - DNA, 19 bp, Homo sapiens
cagcctcccacccccatct

SEQ ID NO: 3359400 - DNA, 20 bp, Homo sapiens
cagcctcccgaatagctggg

SEQ ID NO: 3359401 - DNA, 22 bp, Homo sapiens
cagcctcccgagtagctgggac

SEQ ID NO: 3359402 - DNA, 23 bp, Homo sapiens
cagcctcccgagtagctgggact

SEQ ID NO: 3359403 - DNA, 15 bp, Homo sapiens
cagcctccctctgac

SEQ ID NO: 3359404 - DNA, 23 bp, Homo sapiens
cagcctcctctggacggcaggct

SEQ ID NO: 3359405 - DNA, 15 bp, Homo sapiens
cagcctcctgagcct

SEQ ID NO: 3359406 - DNA, 14 bp, Homo sapiens
cagcctcctgctgg

SEQ ID NO: 3359407 - DNA, 23 bp, Homo sapiens
cagcctcgttggaagaggaacag

SEQ ID NO: 3359408 - DNA, 20 bp, Homo sapiens
cagcctctcaagtagctggg

SEQ ID NO: 3359409 - DNA, 12 bp, Homo sapiens
cagcctctcccg

SEQ ID NO: 3359410 - DNA, 14 bp, Homo sapiens
cagcctctcccggc

SEQ ID NO: 3359411 - DNA, 13 bp, Homo sapiens
cagcctctgaccc

SEQ ID NO: 3359412 - DNA, 18 bp, Homo sapiens
cagcctctgacccctcct

SEQ ID NO: 3359413 - DNA, 22 bp, Homo sapiens
cagcctctgacccctcctcact

SEQ ID NO: 3359414 - DNA, 20 bp, Homo sapiens
cagcctctgcaagattttaa

SEQ ID NO: 3359415 - DNA, 18 bp, Homo sapiens
cagcctctggctccacac

SEQ ID NO: 3359416 - DNA, 23 bp, Homo sapiens
cagcctctggctccacacctcca

SEQ ID NO: 3359417 - DNA, 21 bp, Homo sapiens
cagcttcatttcctgtgtctt

SEQ ID NO: 3359418 - DNA, 13 bp, Homo sapiens
cagcttcatttgt

SEQ ID NO: 3359419 - DNA, 16 bp, Homo sapiens
cagcttcccagccatg

SEQ ID NO: 3359420 - DNA, 20 bp, Homo sapiens
cagcttcccagccatgccca

SEQ ID NO: 3359421 - DNA, 23 bp, Homo sapiens
cagcttcccagccatgcccagga

SEQ ID NO: 3359422 - DNA, 20 bp, Homo sapiens
cagcttcctttcctgtgtgt

SEQ ID NO: 3359423 - DNA, 22 bp, Homo sapiens
cagcttcgtttattttcaagaa

SEQ ID NO: 3359424 - DNA, 14 bp, Homo sapiens
cagcttctcctgcg

SEQ ID NO: 3359425 - DNA, 15 bp, Homo sapiens
cagcttctctgcagt

SEQ ID NO: 3359426 - DNA, 16 bp, Homo sapiens
cagcttctctgcagta

SEQ ID NO: 3359427 - DNA, 22 bp, Homo sapiens
cagcttctctgctagatttcta

SEQ ID NO: 3359428 - DNA, 19 bp, Homo sapiens
cagcttctggtactctcct

SEQ ID NO: 3359429 - DNA, 23 bp, Homo sapiens
cagcttctggtactctcctagag

SEQ ID NO: 3359430 - DNA, 15 bp, Homo sapiens
cagcttcttcctagg

SEQ ID NO: 3359431 - DNA, 17 bp, Homo sapiens
cagcttcttcctaggtc

SEQ ID NO: 3359432 - DNA, 12 bp, Homo sapiens
cagcttcttttg

SEQ ID NO: 3359433 - DNA, 15 bp, Homo sapiens
cagcttgacctgagg

SEQ ID NO: 3359434 - DNA, 19 bp, Homo sapiens
cagcttgacctgaggctgt

SEQ ID NO: 3359435 - DNA, 20 bp, Homo sapiens
cagcttgacctgaggctgtg

SEQ ID NO: 3359436 - DNA, 22 bp, Homo sapiens
cagcttgacctgaggctgtggt

SEQ ID NO: 3359437 - DNA, 23 bp, Homo sapiens
cagcttgggagagcccctggggc

SEQ ID NO: 3359438 - DNA, 21 bp, Homo sapiens
cagcttggggccaccaaagct

SEQ ID NO: 3359439 - DNA, 19 bp, Homo sapiens
cagcttgtaaatagctcag

SEQ ID NO: 3359440 - DNA, 20 bp, Homo sapiens
cagcttgtaaatagctcagg

SEQ ID NO: 3359441 - DNA, 22 bp, Homo sapiens
cagcttgtaaatagctcaggtg

SEQ ID NO: 3359442 - DNA, 17 bp, Homo sapiens
cagcttgttatttataa

SEQ ID NO: 3359443 - DNA, 16 bp, Homo sapiens
cagcttgttctgggct

SEQ ID NO: 3359444 - DNA, 19 bp, Homo sapiens
cagcttgttctgggctcag

SEQ ID NO: 3359445 - DNA, 17 bp, Homo sapiens
cagctttaaactcaggg

SEQ ID NO: 3359446 - DNA, 20 bp, Homo sapiens
cagctttaaactcagggaca

SEQ ID NO: 3359447 - DNA, 15 bp, Homo sapiens
cagctttacatgcaa

SEQ ID NO: 3359448 - DNA, 21 bp, Homo sapiens
cagctttacatgcaatttatt

SEQ ID NO: 3359449 - DNA, 14 bp, Homo sapiens
cagctttcaagtgc

SEQ ID NO: 3359450 - DNA, 19 bp, Homo sapiens
cagctttcagagccagtga

SEQ ID NO: 3359451 - DNA, 19 bp, Homo sapiens
cagctttccctgcctctca

SEQ ID NO: 3359452 - DNA, 21 bp, Homo sapiens
cagctttcttgctcccttcag

SEQ ID NO: 3359453 - DNA, 22 bp, Homo sapiens
cagctttcttgctcccttcagc

SEQ ID NO: 3359454 - DNA, 23 bp, Homo sapiens
cagctttgcccaacaccagcccc

SEQ ID NO: 3359455 - DNA, 11 bp, Homo sapiens
cagctttgcta

SEQ ID NO: 3359456 - DNA, 19 bp, Homo sapiens
cagctttgctccgctccca

SEQ ID NO: 3359457 - DNA, 16 bp, Homo sapiens
cagcttttatggatga

SEQ ID NO: 3359458 - DNA, 20 bp, Homo sapiens
cagcttttatggatgattaa

SEQ ID NO: 3359459 - DNA, 19 bp, Homo sapiens
cagctttttattccctgcc

SEQ ID NO: 3359460 - DNA, 21 bp, Homo sapiens
cagctttttattccctgccca

SEQ ID NO: 3359461 - DNA, 22 bp, Homo sapiens
cagctttttattccctgcccaa

SEQ ID NO: 3359462 - DNA, 18 bp, Homo sapiens
caggaaaaaaaattctgt

SEQ ID NO: 3359463 - DNA, 20 bp, Homo sapiens
caggaaaaaaaattctgttg

SEQ ID NO: 3359464 - DNA, 21 bp, Homo sapiens
caggaaaaacaaaacaaagaa

SEQ ID NO: 3359465 - DNA, 19 bp, Homo sapiens
caggaaaccctggcttgct

SEQ ID NO: 3359466 - DNA, 22 bp, Homo sapiens
caggaaactccacatctgcctt

SEQ ID NO: 3359467 - DNA, 17 bp, Homo sapiens
caggaaagagattagaa

SEQ ID NO: 3359468 - DNA, 19 bp, Homo sapiens
caggaaagagattagaaca

SEQ ID NO: 3359469 - DNA, 20 bp, Homo sapiens
caggaaagccctcccccttc

SEQ ID NO: 3359470 - DNA, 15 bp, Homo sapiens
caggaaatatatatg

SEQ ID NO: 3359471 - DNA, 16 bp, Homo sapiens
caggaaatatatatgt

SEQ ID NO: 3359472 - DNA, 14 bp, Homo sapiens
caggaacaaacagg

SEQ ID NO: 3359473 - DNA, 22 bp, Homo sapiens
caggaacaaacagggctgcctt

SEQ ID NO: 3359474 - DNA, 21 bp, Homo sapiens
caggaacaagtaatgtattag

SEQ ID NO: 3359475 - DNA, 17 bp, Homo sapiens
caggaacagtggctggg

SEQ ID NO: 3359476 - DNA, 19 bp, Homo sapiens
caggaacagtggctgggtg

SEQ ID NO: 3359477 - DNA, 20 bp, Homo sapiens
caggaacagtggctgggtgg

SEQ ID NO: 3359478 - DNA, 16 bp, Homo sapiens
caggaacgagcactgg

SEQ ID NO: 3359479 - DNA, 17 bp, Homo sapiens
caggaacgagcactggc

SEQ ID NO: 3359480 - DNA, 19 bp, Homo sapiens
caggaacgagcactggcca

SEQ ID NO: 3359481 - DNA, 21 bp, Homo sapiens
caggaacgagcactggccaga

SEQ ID NO: 3359482 - DNA, 13 bp, Homo sapiens
caggaactgggcc

SEQ ID NO: 3359483 - DNA, 15 bp, Homo sapiens
caggaactgggctgg

SEQ ID NO: 3359484 - DNA, 22 bp, Homo sapiens
caggaactggggctttgccttg

SEQ ID NO: 3359485 - DNA, 14 bp, Homo sapiens
caggaagcacccca

SEQ ID NO: 3359486 - DNA, 16 bp, Homo sapiens
caggaagcaccccatg

SEQ ID NO: 3359487 - DNA, 15 bp, Homo sapiens
caggaagcaggggtg

SEQ ID NO: 3359488 - DNA, 18 bp, Homo sapiens
caggaagcattcagagag

SEQ ID NO: 3359489 - DNA, 16 bp, Homo sapiens
caggaagcccaattgc

SEQ ID NO: 3359490 - DNA, 18 bp, Homo sapiens
caggaagcccaattgctg

SEQ ID NO: 3359491 - DNA, 15 bp, Homo sapiens
caggaagcccacact

SEQ ID NO: 3359492 - DNA, 21 bp, Homo sapiens
caggaagcctgcagtcctgga

SEQ ID NO: 3359493 - DNA, 20 bp, Homo sapiens
caggaaggaaaactatgtat

SEQ ID NO: 3359494 - DNA, 14 bp, Homo sapiens
caggaaggacagac

SEQ ID NO: 3359495 - DNA, 16 bp, Homo sapiens
caggaaggagagcctg

SEQ ID NO: 3359496 - DNA, 13 bp, Homo sapiens
caggaaggagcgg

SEQ ID NO: 3359497 - DNA, 15 bp, Homo sapiens
caggaaggagcggcg

SEQ ID NO: 3359498 - DNA, 12 bp, Homo sapiens
caggaaggcagc

SEQ ID NO: 3359499 - DNA, 18 bp, Homo sapiens
caggaaggcagctgctct

SEQ ID NO: 3359500 - DNA, 14 bp, Homo sapiens
caggaaggcaggag

SEQ ID NO: 3359501 - DNA, 21 bp, Homo sapiens
caggaaggcctaggctaggac

SEQ ID NO: 3359502 - DNA, 15 bp, Homo sapiens
caggaaggcctgggt

SEQ ID NO: 3359503 - DNA, 15 bp, Homo sapiens
caggaatagatgtgg

SEQ ID NO: 3359504 - DNA, 22 bp, Homo sapiens
caggaatatgacacaaaggtgg

SEQ ID NO: 3359505 - DNA, 14 bp, Homo sapiens
caggaatggctgca

SEQ ID NO: 3359506 - DNA, 19 bp, Homo sapiens
caggaatgtctggagtggt

SEQ ID NO: 3359507 - DNA, 23 bp, Homo sapiens
caggaatgtctggagtggtaaca

SEQ ID NO: 3359508 - DNA, 17 bp, Homo sapiens
caggaatgtgtggcctg

SEQ ID NO: 3359509 - DNA, 21 bp, Homo sapiens
caggaatgtgtggcctgcaca

SEQ ID NO: 3359510 - DNA, 23 bp, Homo sapiens
caggaatgtgtggcctgcacagt

SEQ ID NO: 3359511 - DNA, 13 bp, Homo sapiens
caggaattatgtc

SEQ ID NO: 3359512 - DNA, 15 bp, Homo sapiens
caggaattcagtgcc

SEQ ID NO: 3359513 - DNA, 17 bp, Homo sapiens
caggaattcagtgcctt

SEQ ID NO: 3359514 - DNA, 20 bp, Homo sapiens
caggaatttgaagctgcagt

SEQ ID NO: 3359515 - DNA, 15 bp, Homo sapiens
caggaattttatttt

SEQ ID NO: 3359516 - DNA, 19 bp, Homo sapiens
caggacaacacttcatttt

SEQ ID NO: 3359517 - DNA, 14 bp, Homo sapiens
caggacagagttca

SEQ ID NO: 3359518 - DNA, 17 bp, Homo sapiens
caggacagagttcacag

SEQ ID NO: 3359519 - DNA, 17 bp, Homo sapiens
caggacaggaggcggcc

SEQ ID NO: 3359520 - DNA, 22 bp, Homo sapiens
caggacagtgcttcagcctgag

SEQ ID NO: 3359521 - DNA, 13 bp, Homo sapiens
caggacatctcct

SEQ ID NO: 3359522 - DNA, 21 bp, Homo sapiens
caggacatgcaataaaattta

SEQ ID NO: 3359523 - DNA, 16 bp, Homo sapiens
caggacattaaaaatg

SEQ ID NO: 3359524 - DNA, 20 bp, Homo sapiens
caggaccacacagtccccag

SEQ ID NO: 3359525 - DNA, 16 bp, Homo sapiens
caggaccagctggggc

SEQ ID NO: 3359526 - DNA, 24 bp, Homo sapiens
caggacccaggccctccatgggct

SEQ ID NO: 3359527 - DNA, 13 bp, Homo sapiens
caggacccctggg

SEQ ID NO: 3359528 - DNA, 13 bp, Homo sapiens
caggaccctcagg

SEQ ID NO: 3359529 - DNA, 19 bp, Homo sapiens
caggacctagagccgggca

SEQ ID NO: 3359530 - DNA, 22 bp, Homo sapiens
caggacctcccttccgaccctc

SEQ ID NO: 3359531 - DNA, 14 bp, Homo sapiens
caggacctggcatc

SEQ ID NO: 3359532 - DNA, 21 bp, Homo sapiens
caggaccttcgggctgtgccc

SEQ ID NO: 3359533 - DNA, 13 bp, Homo sapiens
caggaccttttga

SEQ ID NO: 3359534 - DNA, 20 bp, Homo sapiens
caggacgtcctatctccccc

SEQ ID NO: 3359535 - DNA, 21 bp, Homo sapiens
caggacgtcctatctccccca

SEQ ID NO: 3359536 - DNA, 13 bp, Homo sapiens
caggactcacagg

SEQ ID NO: 3359537 - DNA, 15 bp, Homo sapiens
caggactccactgga

SEQ ID NO: 3359538 - DNA, 20 bp, Homo sapiens
caggactccactggacagac

SEQ ID NO: 3359539 - DNA, 21 bp, Homo sapiens
caggactccactggacagacc

SEQ ID NO: 3359540 - DNA, 16 bp, Homo sapiens
caggactccaggccca

SEQ ID NO: 3359541 - DNA, 15 bp, Homo sapiens
caggactccctcctc

SEQ ID NO: 3359542 - DNA, 17 bp, Homo sapiens
caggcctgcctcccact

SEQ ID NO: 3359543 - DNA, 13 bp, Homo sapiens
caggcctgggacc

SEQ ID NO: 3359544 - DNA, 21 bp, Homo sapiens
caggcctgggacccagctact

SEQ ID NO: 3359545 - DNA, 16 bp, Homo sapiens
caggcctgggtctgtg

SEQ ID NO: 3359546 - DNA, 19 bp, Homo sapiens
caggcctgggtctgtgtct

SEQ ID NO: 3359547 - DNA, 13 bp, Homo sapiens
caggcctgggttt

SEQ ID NO: 3359548 - DNA, 18 bp, Homo sapiens
caggcgaccgggcctccc

SEQ ID NO: 3359549 - DNA, 20 bp, Homo sapiens
caggcgagagaggagccaga

SEQ ID NO: 3359550 - DNA, 16 bp, Homo sapiens
caggcgatccacctgt

SEQ ID NO: 3359551 - DNA, 17 bp, Homo sapiens
caggcgcctggcacatt

SEQ ID NO: 3359552 - DNA, 16 bp, Homo sapiens
caggcgggctcaagga

SEQ ID NO: 3359553 - DNA, 19 bp, Homo sapiens
caggcgtgactcagcagcc

SEQ ID NO: 3359554 - DNA, 15 bp, Homo sapiens
caggcgttggtgcca

SEQ ID NO: 3359555 - DNA, 17 bp, Homo sapiens
caggcgttggtgccact

SEQ ID NO: 3359556 - DNA, 19 bp, Homo sapiens
caggcgttggtgccacttc

SEQ ID NO: 3359557 - DNA, 20 bp, Homo sapiens
caggcgttggtgccacttct

SEQ ID NO: 3359558 - DNA, 16 bp, Homo sapiens
caggctactctcctcg

SEQ ID NO: 3359559 - DNA, 13 bp, Homo sapiens
caggctagatccc

SEQ ID NO: 3359560 - DNA, 18 bp, Homo sapiens
caggctagatccccggtg

SEQ ID NO: 3359561 - DNA, 17 bp, Homo sapiens
caggctatggttgccac

SEQ ID NO: 3359562 - DNA, 22 bp, Homo sapiens
caggctatggttgccaccccaa

SEQ ID NO: 3359563 - DNA, 23 bp, Homo sapiens
caggctatggttgccaccccaac

SEQ ID NO: 3359564 - DNA, 22 bp, Homo sapiens
caggctcactgccaggccagcc

SEQ ID NO: 3359565 - DNA, 22 bp, Homo sapiens
caggctccgcccttagtccccc

SEQ ID NO: 3359566 - DNA, 21 bp, Homo sapiens
caggctcctttagcgcccagt

SEQ ID NO: 3359567 - DNA, 11 bp, Homo sapiens
caggctctgca

SEQ ID NO: 3359568 - DNA, 14 bp, Homo sapiens
caggctctgcacag

SEQ ID NO: 3359569 - DNA, 17 bp, Homo sapiens
caggctctgcacagaca

SEQ ID NO: 3359570 - DNA, 15 bp, Homo sapiens
caggctctggccctt

SEQ ID NO: 3359571 - DNA, 13 bp, Homo sapiens
caggctctgggct

SEQ ID NO: 3359572 - DNA, 15 bp, Homo sapiens
caggctctgggctca

SEQ ID NO: 3359573 - DNA, 16 bp, Homo sapiens
caggctctgggctcag

SEQ ID NO: 3359574 - DNA, 18 bp, Homo sapiens
caggctctgggctcaggg

SEQ ID NO: 3359575 - DNA, 20 bp, Homo sapiens
caggctctgggctcagggct

SEQ ID NO: 3359576 - DNA, 21 bp, Homo sapiens
caggctctgggctcagggctg

SEQ ID NO: 3359577 - DNA, 22 bp, Homo sapiens
caggctcttagcagcttccaga

SEQ ID NO: 3359578 - DNA, 17 bp, Homo sapiens
caggctcttcctggacc

SEQ ID NO: 3359579 - DNA, 21 bp, Homo sapiens
caggctcttcctggacctgag

SEQ ID NO: 3359580 - DNA, 18 bp, Homo sapiens
caggctcttctcctttca

SEQ ID NO: 3359581 - DNA, 16 bp, Homo sapiens
caggctgacatctgtg

SEQ ID NO: 3359582 - DNA, 13 bp, Homo sapiens
caggctgcactgc

SEQ ID NO: 3359583 - DNA, 21 bp, Homo sapiens
caggctgcactgcagtgatgg

SEQ ID NO: 3359584 - DNA, 11 bp, Homo sapiens
caggctgcccc

SEQ ID NO: 3359585 - DNA, 19 bp, Homo sapiens
caggctgcccccaacactc

SEQ ID NO: 3359586 - DNA, 16 bp, Homo sapiens
caggctggcagctctc

SEQ ID NO: 3359587 - DNA, 17 bp, Homo sapiens
caggctggcagctctcc

SEQ ID NO: 3359588 - DNA, 19 bp, Homo sapiens
caggctggccagtccaggc

SEQ ID NO: 3359589 - DNA, 18 bp, Homo sapiens
caggctggcgcagccaag

SEQ ID NO: 3359590 - DNA, 20 bp, Homo sapiens
caggctggcgcagccaaggc

SEQ ID NO: 3359591 - DNA, 19 bp, Homo sapiens
caggctggcgtgcagtggt

SEQ ID NO: 3359592 - DNA, 10 bp, Homo sapiens
caggctgggc

SEQ ID NO: 3359593 - DNA, 12 bp, Homo sapiens
caggctgggcag

SEQ ID NO: 3359594 - DNA, 21 bp, Homo sapiens
caggctgggcagccccagaga

SEQ ID NO: 3359595 - DNA, 17 bp, Homo sapiens
caggctgggcttcagtg

SEQ ID NO: 3359596 - DNA, 21 bp, Homo sapiens
caggctgggcttcagtggcag

SEQ ID NO: 3359597 - DNA, 16 bp, Homo sapiens
caggctggtctaaaac

SEQ ID NO: 3359598 - DNA, 18 bp, Homo sapiens
caggctggtgggaggggc

SEQ ID NO: 3359599 - DNA, 17 bp, Homo sapiens
caggctgtaaattgaac

SEQ ID NO: 3359600 - DNA, 20 bp, Homo sapiens
caggctgtatcccatgagcc

SEQ ID NO: 3359601 - DNA, 22 bp, Homo sapiens
caggctgtatcccatgagcctc

SEQ ID NO: 3359602 - DNA, 23 bp, Homo sapiens
caggctgtatcccatgagcctca

SEQ ID NO: 3359603 - DNA, 17 bp, Homo sapiens
caggctgttctgcactg

SEQ ID NO: 3359604 - DNA, 22 bp, Homo sapiens
caggctgttctgcactgaaaag

SEQ ID NO: 3359605 - DNA, 15 bp, Homo sapiens
caggcttcaccctga

SEQ ID NO: 3359606 - DNA, 20 bp, Homo sapiens
caggcttccctgacttgctt

SEQ ID NO: 3359607 - DNA, 21 bp, Homo sapiens
caggcttcctgcaattttcta

SEQ ID NO: 3359608 - DNA, 21 bp, Homo sapiens
caggcttcggacagtgcccat

SEQ ID NO: 3359609 - DNA, 17 bp, Homo sapiens
cagggaaagctccacgg

SEQ ID NO: 3359610 - DNA, 17 bp, Homo sapiens
cagggaaaggaaaagaa

SEQ ID NO: 3359611 - DNA, 23 bp, Homo sapiens
cagggaaccgttattataattgt

SEQ ID NO: 3359612 - DNA, 22 bp, Homo sapiens
cagggaagagcagaacggagcc

SEQ ID NO: 3359613 - DNA, 15 bp, Homo sapiens
cagggaagagggcag

SEQ ID NO: 3359614 - DNA, 13 bp, Homo sapiens
cagggaagctggc

SEQ ID NO: 3359615 - DNA, 23 bp, Homo sapiens
cagggaaggacttggagagaatc

SEQ ID NO: 3359616 - DNA, 23 bp, Homo sapiens
cagggaaggcctgacttctgctg

SEQ ID NO: 3359617 - DNA, 19 bp, Homo sapiens
cagggaaggggaggcagcc

SEQ ID NO: 3359618 - DNA, 23 bp, Homo sapiens
cagggaatccaagcctccacagc

SEQ ID NO: 3359619 - DNA, 22 bp, Homo sapiens
cagggaatccagctccctagac

SEQ ID NO: 3359620 - DNA, 14 bp, Homo sapiens
cagggaatttctat

SEQ ID NO: 3359621 - DNA, 16 bp, Homo sapiens
cagggaccacaccctg

SEQ ID NO: 3359622 - DNA, 15 bp, Homo sapiens
cagggaccggtgctg

SEQ ID NO: 3359623 - DNA, 20 bp, Homo sapiens
cagggaccggtgctgcagga

SEQ ID NO: 3359624 - DNA, 20 bp, Homo sapiens
cagggacttggacaggagtc

SEQ ID NO: 3359625 - DNA, 21 bp, Homo sapiens
cagggacttggacaggagtca

SEQ ID NO: 3359626 - DNA, 14 bp, Homo sapiens
cagggagcagggaa

SEQ ID NO: 3359627 - DNA, 16 bp, Homo sapiens
cagggagcagggaagg

SEQ ID NO: 3359628 - DNA, 19 bp, Homo sapiens
cagggagcctagaagctgg

SEQ ID NO: 3359629 - DNA, 15 bp, Homo sapiens
cagggagcctcctgc

SEQ ID NO: 3359630 - DNA, 12 bp, Homo sapiens
cagggagctcaa

SEQ ID NO: 3359631 - DNA, 18 bp, Homo sapiens
cagggaggacgctctctg

SEQ ID NO: 3359632 - DNA, 22 bp, Homo sapiens
cagggaggagaggggaagggcc

SEQ ID NO: 3359633 - DNA, 23 bp, Homo sapiens
cagggaggagaggggaagggcca

SEQ ID NO: 3359634 - DNA, 21 bp, Homo sapiens
cagggaggaggtggcagccct

SEQ ID NO: 3359635 - DNA, 21 bp, Homo sapiens
cagggagggagggcggtggac

SEQ ID NO: 3359636 - DNA, 19 bp, Homo sapiens
cagggaggggactatttat

SEQ ID NO: 3359637 - DNA, 21 bp, Homo sapiens
cagggaggggactatttatga

SEQ ID NO: 3359638 - DNA, 19 bp, Homo sapiens
cagggaggtcaggccctgg

SEQ ID NO: 3359639 - DNA, 14 bp, Homo sapiens
cagggagtgctggc

SEQ ID NO: 3359640 - DNA, 20 bp, Homo sapiens
cagggatgctgggctgggcc

SEQ ID NO: 3359641 - DNA, 21 bp, Homo sapiens
cagggatgctgggctgggccc

SEQ ID NO: 3359642 - DNA, 22 bp, Homo sapiens
cagggatgctgggctgggccct

SEQ ID NO: 3359643 - DNA, 14 bp, Homo sapiens
cagggatgggggtg

SEQ ID NO: 3359644 - DNA, 20 bp, Homo sapiens
cagggattaacctctgcact

SEQ ID NO: 3359645 - DNA, 21 bp, Homo sapiens
cagggatttccaactggcact

SEQ ID NO: 3359646 - DNA, 20 bp, Homo sapiens
cagggcaaatgacatgcact

SEQ ID NO: 3359647 - DNA, 15 bp, Homo sapiens
cagggcaacaagccc

SEQ ID NO: 3359648 - DNA, 23 bp, Homo sapiens
cagggcacaccgggcactcagaa

SEQ ID NO: 3359649 - DNA, 13 bp, Homo sapiens
cagggcaccagag

SEQ ID NO: 3359650 - DNA, 14 bp, Homo sapiens
cagggcaccagagg

SEQ ID NO: 3359651 - DNA, 18 bp, Homo sapiens
cagggcaccagaggccga

SEQ ID NO: 3359652 - DNA, 22 bp, Homo sapiens
cagggcaccctgtggccctggc

SEQ ID NO: 3359653 - DNA, 13 bp, Homo sapiens
cagggcagaggga

SEQ ID NO: 3359654 - DNA, 12 bp, Homo sapiens
cagggcagcccc

SEQ ID NO: 3359655 - DNA, 12 bp, Homo sapiens
cagggcagggcc

SEQ ID NO: 3359656 - DNA, 14 bp, Homo sapiens
cagggcagggccac

SEQ ID NO: 3359657 - DNA, 15 bp, Homo sapiens
cagggcagggccacc

SEQ ID NO: 3359658 - DNA, 16 bp, Homo sapiens
cagggcagggccaccc

SEQ ID NO: 3359659 - DNA, 16 bp, Homo sapiens
cagggcagggctctga

SEQ ID NO: 3359660 - DNA, 17 bp, Homo sapiens
cagggcagggctctgat

SEQ ID NO: 3359661 - DNA, 19 bp, Homo sapiens
cagggcagggctctgatat

SEQ ID NO: 3359662 - DNA, 19 bp, Homo sapiens
cagggcaggggtggtggag

SEQ ID NO: 3359663 - DNA, 23 bp, Homo sapiens
cagggcatgccccggccacctct

SEQ ID NO: 3359664 - DNA, 22 bp, Homo sapiens
cagggcatgtgtatgtgtctgc

SEQ ID NO: 3359665 - DNA, 16 bp, Homo sapiens
cagggccaccccactc

SEQ ID NO: 3359666 - DNA, 16 bp, Homo sapiens
cagggccagaaggagg

SEQ ID NO: 3359667 - DNA, 13 bp, Homo sapiens
cagtaataactct

SEQ ID NO: 3359668 - DNA, 18 bp, Homo sapiens
cagtaatctttatactgg

SEQ ID NO: 3359669 - DNA, 21 bp, Homo sapiens
cagtacacttggtgtactggg

SEQ ID NO: 3359670 - DNA, 15 bp, Homo sapiens
cagtacatgggaaag

SEQ ID NO: 3359671 - DNA, 15 bp, Homo sapiens
cagtacatttaaatt

SEQ ID NO: 3359672 - DNA, 16 bp, Homo sapiens
cagtaccataatctta

SEQ ID NO: 3359673 - DNA, 22 bp, Homo sapiens
cagtaccataatcttagagaca

SEQ ID NO: 3359674 - DNA, 16 bp, Homo sapiens
cagtaccctctcagct

SEQ ID NO: 3359675 - DNA, 20 bp, Homo sapiens
cagtacctagctggctctgt

SEQ ID NO: 3359676 - DNA, 16 bp, Homo sapiens
cagtacctgattgtat

SEQ ID NO: 3359677 - DNA, 18 bp, Homo sapiens
cagtacctgggaaaggac

SEQ ID NO: 3359678 - DNA, 23 bp, Homo sapiens
cagtacctgggaaaggacccacc

SEQ ID NO: 3359679 - DNA, 21 bp, Homo sapiens
cagtactaagggaacaatcca

SEQ ID NO: 3359680 - DNA, 17 bp, Homo sapiens
cagtactgactttctga

SEQ ID NO: 3359681 - DNA, 16 bp, Homo sapiens
cagtactttgtgcatt

SEQ ID NO: 3359682 - DNA, 19 bp, Homo sapiens
cagtagaaataatatgcat

SEQ ID NO: 3359683 - DNA, 14 bp, Homo sapiens
cagtagaactccag

SEQ ID NO: 3359684 - DNA, 12 bp, Homo sapiens
cagtagaactgt

SEQ ID NO: 3359685 - DNA, 20 bp, Homo sapiens
cagtagaccttgttacttct

SEQ ID NO: 3359686 - DNA, 15 bp, Homo sapiens
cagtagagccagctt

SEQ ID NO: 3359687 - DNA, 16 bp, Homo sapiens
cagtagagccagcttg

SEQ ID NO: 3359688 - DNA, 17 bp, Homo sapiens
cagtagagccagcttgg

SEQ ID NO: 3359689 - DNA, 17 bp, Homo sapiens
cagtagagtcatctcca

SEQ ID NO: 3359690 - DNA, 18 bp, Homo sapiens
cagtagatgtgcttctga

SEQ ID NO: 3359691 - DNA, 19 bp, Homo sapiens
cagtagatgtgcttctgaa

SEQ ID NO: 3359692 - DNA, 14 bp, Homo sapiens
cagtagattcaagt

SEQ ID NO: 3359693 - DNA, 23 bp, Homo sapiens
cagtagattcaagttgtgtctga

SEQ ID NO: 3359694 - DNA, 15 bp, Homo sapiens
cagtagattgcagaa

SEQ ID NO: 3359695 - DNA, 18 bp, Homo sapiens
cagtaggcttttaccatt

SEQ ID NO: 3359696 - DNA, 22 bp, Homo sapiens
cagtaggtgacactatagttta

SEQ ID NO: 3359697 - DNA, 20 bp, Homo sapiens
cagtagtttggtttgacttg

SEQ ID NO: 3359698 - DNA, 13 bp, Homo sapiens
cagtatacctcat

SEQ ID NO: 3359699 - DNA, 23 bp, Homo sapiens
cagtatatgttaatttgtgtgtt

SEQ ID NO: 3359700 - DNA, 14 bp, Homo sapiens
cagtatattagtat

SEQ ID NO: 3359701 - DNA, 15 bp, Homo sapiens
cagtatatttaaact

SEQ ID NO: 3359702 - DNA, 22 bp, Homo sapiens
cagtatatttatagtcacaaga

SEQ ID NO: 3359703 - DNA, 17 bp, Homo sapiens
cagtatcatctccatca

SEQ ID NO: 3359704 - DNA, 15 bp, Homo sapiens
cagtatgatttataa

SEQ ID NO: 3359705 - DNA, 19 bp, Homo sapiens
cagtattaaaggggggagg

SEQ ID NO: 3359706 - DNA, 20 bp, Homo sapiens
cagtattaaaggggggaggg

SEQ ID NO: 3359707 - DNA, 21 bp, Homo sapiens
cagtattaaaggggggagggg

SEQ ID NO: 3359708 - DNA, 14 bp, Homo sapiens
cagtattctcagag

SEQ ID NO: 3359709 - DNA, 16 bp, Homo sapiens
cagtattcttgtcaaa

SEQ ID NO: 3359710 - DNA, 15 bp, Homo sapiens
cagtattgaaaactt

SEQ ID NO: 3359711 - DNA, 13 bp, Homo sapiens
cagtatttattgg

SEQ ID NO: 3359712 - DNA, 14 bp, Homo sapiens
cagtatttattggt

SEQ ID NO: 3359713 - DNA, 11 bp, Homo sapiens
cagtatttcag

SEQ ID NO: 3359714 - DNA, 18 bp, Homo sapiens
cagtattttggagaaatt

SEQ ID NO: 3359715 - DNA, 23 bp, Homo sapiens
cagtattttggagaaattattta

SEQ ID NO: 3359716 - DNA, 19 bp, Homo sapiens
cagtattttggttcttagt

SEQ ID NO: 3359717 - DNA, 18 bp, Homo sapiens
cagtcaaatttacattta

SEQ ID NO: 3359718 - DNA, 14 bp, Homo sapiens
cagtcacattgcca

SEQ ID NO: 3359719 - DNA, 17 bp, Homo sapiens
cagtcacccactgtcag

SEQ ID NO: 3359720 - DNA, 22 bp, Homo sapiens
cagtcagatttttaaagttttg

SEQ ID NO: 3359721 - DNA, 19 bp, Homo sapiens
cagtcagcatgcttcccag

SEQ ID NO: 3359722 - DNA, 21 bp, Homo sapiens
cagtcagcatgcttcccagag

SEQ ID NO: 3359723 - DNA, 22 bp, Homo sapiens
cagtcagcatgcttcccagagg

SEQ ID NO: 3359724 - DNA, 23 bp, Homo sapiens
cagtcagcatgcttcccagaggg

SEQ ID NO: 3359725 - DNA, 23 bp, Homo sapiens
cagtcagggaaggtgcctctgga

SEQ ID NO: 3359726 - DNA, 21 bp, Homo sapiens
cagtcaggtagttgcaattga

SEQ ID NO: 3359727 - DNA, 16 bp, Homo sapiens
cagtcagtaattgcca

SEQ ID NO: 3359728 - DNA, 21 bp, Homo sapiens
cagtcagttcccggagcacag

SEQ ID NO: 3359729 - DNA, 22 bp, Homo sapiens
cagtcagttcccggagcacagc

SEQ ID NO: 3359730 - DNA, 15 bp, Homo sapiens
cagtcataaagaggt

SEQ ID NO: 3359731 - DNA, 14 bp, Homo sapiens
cagtcatcatcagg

SEQ ID NO: 3359732 - DNA, 15 bp, Homo sapiens
cagtcatcatcaggg

SEQ ID NO: 3359733 - DNA, 19 bp, Homo sapiens
cagtcatcatcagggcctg

SEQ ID NO: 3359734 - DNA, 16 bp, Homo sapiens
cagtcatgcataaata

SEQ ID NO: 3359735 - DNA, 18 bp, Homo sapiens
cagtccaaatgtcctcca

SEQ ID NO: 3359736 - DNA, 23 bp, Homo sapiens
cagtccaggatgctaacatctaa

SEQ ID NO: 3359737 - DNA, 15 bp, Homo sapiens
cagtccaggctgccg

SEQ ID NO: 3359738 - DNA, 17 bp, Homo sapiens
cagtccagtgtcacctc

SEQ ID NO: 3359739 - DNA, 19 bp, Homo sapiens
cagtccccaacctgcactc

SEQ ID NO: 3359740 - DNA, 16 bp, Homo sapiens
cagtccccacccctgc

SEQ ID NO: 3359741 - DNA, 17 bp, Homo sapiens
cagtccccacccctgcc

SEQ ID NO: 3359742 - DNA, 19 bp, Homo sapiens
cagtccccacccctgcccc

SEQ ID NO: 3359743 - DNA, 13 bp, Homo sapiens
cagtccccagact

SEQ ID NO: 3359744 - DNA, 19 bp, Homo sapiens
cagtccccagcccttcaca

SEQ ID NO: 3359745 - DNA, 18 bp, Homo sapiens
cagtcccccaaccccagc

SEQ ID NO: 3359746 - DNA, 22 bp, Homo sapiens
cagtccccctatccttggcacc

SEQ ID NO: 3359747 - DNA, 13 bp, Homo sapiens
cagtccccgagga

SEQ ID NO: 3359748 - DNA, 13 bp, Homo sapiens
cagtcccctccca

SEQ ID NO: 3359749 - DNA, 17 bp, Homo sapiens
cagtcccctcccatctg

SEQ ID NO: 3359750 - DNA, 15 bp, Homo sapiens
cagtccctatgtatt

SEQ ID NO: 3359751 - DNA, 23 bp, Homo sapiens
cagtccctgagaccatttaacat

SEQ ID NO: 3359752 - DNA, 18 bp, Homo sapiens
cagtccgcagtctggcct

SEQ ID NO: 3359753 - DNA, 18 bp, Homo sapiens
cagtcctagctcttacac

SEQ ID NO: 3359754 - DNA, 20 bp, Homo sapiens
cagtcctccagaccaccagc

SEQ ID NO: 3359755 - DNA, 13 bp, Homo sapiens
cagtcctcccctc

SEQ ID NO: 3359756 - DNA, 15 bp, Homo sapiens
cagtcctcccctcac

SEQ ID NO: 3359757 - DNA, 16 bp, Homo sapiens
cagtcctcctgggagc

SEQ ID NO: 3359758 - DNA, 14 bp, Homo sapiens
cagtcctgcctggc

SEQ ID NO: 3359759 - DNA, 18 bp, Homo sapiens
cagtcctgcctggccagg

SEQ ID NO: 3359760 - DNA, 21 bp, Homo sapiens
cagtcctgcctggccaggcag

SEQ ID NO: 3359761 - DNA, 14 bp, Homo sapiens
cagtcctgctccag

SEQ ID NO: 3359762 - DNA, 16 bp, Homo sapiens
cagtccttaaaaatca

SEQ ID NO: 3359763 - DNA, 13 bp, Homo sapiens
cagtcctttccca

SEQ ID NO: 3359764 - DNA, 14 bp, Homo sapiens
cagtcctttgtaaa

SEQ ID NO: 3359765 - DNA, 20 bp, Homo sapiens
cagtcctttgtaaacagtgt

SEQ ID NO: 3359766 - DNA, 21 bp, Homo sapiens
cagtcgcgagcacatgttcat

SEQ ID NO: 3359767 - DNA, 18 bp, Homo sapiens
cagtcgggggctggccta

SEQ ID NO: 3359768 - DNA, 13 bp, Homo sapiens
cagtcgtcgcaca

SEQ ID NO: 3359769 - DNA, 16 bp, Homo sapiens
cagtctaaacagagtc

SEQ ID NO: 3359770 - DNA, 19 bp, Homo sapiens
cagtctagtacttattaca

SEQ ID NO: 3359771 - DNA, 13 bp, Homo sapiens
cagtctatccaca

SEQ ID NO: 3359772 - DNA, 23 bp, Homo sapiens
cagtctcaaaaatacaaaataaa

SEQ ID NO: 3359773 - DNA, 19 bp, Homo sapiens
cagtctcactgtgggaagg

SEQ ID NO: 3359774 - DNA, 23 bp, Homo sapiens
cagtctcactgtgggaaggccag

SEQ ID NO: 3359775 - DNA, 21 bp, Homo sapiens
cagtctcccaggccccctgca

SEQ ID NO: 3359776 - DNA, 23 bp, Homo sapiens
cagtctcccaggccccctgcatc

SEQ ID NO: 3359777 - DNA, 19 bp, Homo sapiens
cagtctcctcactctgtcc

SEQ ID NO: 3359778 - DNA, 16 bp, Homo sapiens
cagtctccttcagcac

SEQ ID NO: 3359779 - DNA, 17 bp, Homo sapiens
cagtctctcttaaagtt

SEQ ID NO: 3359780 - DNA, 22 bp, Homo sapiens
cagtctctcttctctccagctg

SEQ ID NO: 3359781 - DNA, 20 bp, Homo sapiens
cagtctctttaatcttcagt

SEQ ID NO: 3359782 - DNA, 18 bp, Homo sapiens
cagtctctttctgtacaa

SEQ ID NO: 3359783 - DNA, 19 bp, Homo sapiens
cagtctctttcttcctttc

SEQ ID NO: 3359784 - DNA, 18 bp, Homo sapiens
cagtctgaatgctgccac

SEQ ID NO: 3359785 - DNA, 19 bp, Homo sapiens
cagtctgcccacgcagagg

SEQ ID NO: 3359786 - DNA, 17 bp, Homo sapiens
cagtctggaatgcagtg

SEQ ID NO: 3359787 - DNA, 18 bp, Homo sapiens
cagtctggaatgcagtgg

SEQ ID NO: 3359788 - DNA, 24 bp, Homo sapiens
cagtctgtcatgaacatgttcctg

SEQ ID NO: 3359789 - DNA, 15 bp, Homo sapiens
cagtctgtctactgt

SEQ ID NO: 3359790 - DNA, 15 bp, Homo sapiens
cagtctgtgtttaca

SEQ ID NO: 3359791 - DNA, 19 bp, Homo sapiens
cagtcttatcaactggttg

SEQ ID NO: 3359792 - DNA, 21 bp, Homo sapiens
cataaagctcaaatgaaatgt

SEQ ID NO: 3359793 - DNA, 19 bp, Homo sapiens
cataaagggtgtaggggcc

SEQ ID NO: 3359794 - DNA, 15 bp, Homo sapiens
cataaagggttgaaa

SEQ ID NO: 3359795 - DNA, 16 bp, Homo sapiens
cataaagggttgaaaa

SEQ ID NO: 3359796 - DNA, 18 bp, Homo sapiens
cataaatagtagaaaaat

SEQ ID NO: 3359797 - DNA, 20 bp, Homo sapiens
cataaatatgcagtgatatg

SEQ ID NO: 3359798 - DNA, 14 bp, Homo sapiens
cataaatgaagcag

SEQ ID NO: 3359799 - DNA, 13 bp, Homo sapiens
cataaatgtgttc

SEQ ID NO: 3359800 - DNA, 14 bp, Homo sapiens
cataaatgtgttcc

SEQ ID NO: 3359801 - DNA, 13 bp, Homo sapiens
cataaatgttcac

SEQ ID NO: 3359802 - DNA, 14 bp, Homo sapiens
cataaatgttcact

SEQ ID NO: 3359803 - DNA, 20 bp, Homo sapiens
cataaattcaactttgtaaa

SEQ ID NO: 3359804 - DNA, 19 bp, Homo sapiens
cataacagtgccattgtct

SEQ ID NO: 3359805 - DNA, 18 bp, Homo sapiens
cataacccacttgtcact

SEQ ID NO: 3359806 - DNA, 16 bp, Homo sapiens
cataacctagccttag

SEQ ID NO: 3359807 - DNA, 23 bp, Homo sapiens
cataacctgtctcacctggactt

SEQ ID NO: 3359808 - DNA, 20 bp, Homo sapiens
cataacgtttttcctttaaa

SEQ ID NO: 3359809 - DNA, 10 bp, Homo sapiens
cataactgta

SEQ ID NO: 3359810 - DNA, 19 bp, Homo sapiens
cataactgtagctcaagtt

SEQ ID NO: 3359811 - DNA, 19 bp, Homo sapiens
cataagaaaactaagaaat

SEQ ID NO: 3359812 - DNA, 12 bp, Homo sapiens
cataagaatgaa

SEQ ID NO: 3359813 - DNA, 21 bp, Homo sapiens
cataagaatgaataataatta

SEQ ID NO: 3359814 - DNA, 17 bp, Homo sapiens
cataagaccgtgtccca

SEQ ID NO: 3359815 - DNA, 21 bp, Homo sapiens
cataagaccgtgtcccaagga

SEQ ID NO: 3359816 - DNA, 23 bp, Homo sapiens
cataagactggacatttaacttt

SEQ ID NO: 3359817 - DNA, 14 bp, Homo sapiens
cataagataaatgt

SEQ ID NO: 3359818 - DNA, 15 bp, Homo sapiens
cataagattaaagga

SEQ ID NO: 3359819 - DNA, 16 bp, Homo sapiens
cataagattaaaggaa

SEQ ID NO: 3359820 - DNA, 13 bp, Homo sapiens
cataagcttccat

SEQ ID NO: 3359821 - DNA, 17 bp, Homo sapiens
cataaggacgtgtgtaa

SEQ ID NO: 3359822 - DNA, 20 bp, Homo sapiens
cataaggacgtgtgtaaata

SEQ ID NO: 3359823 - DNA, 15 bp, Homo sapiens
cataaggtttcgttt

SEQ ID NO: 3359824 - DNA, 21 bp, Homo sapiens
cataaggtttcgtttctgtat

SEQ ID NO: 3359825 - DNA, 22 bp, Homo sapiens
cataagtaattcaagaaaacaa

SEQ ID NO: 3359826 - DNA, 14 bp, Homo sapiens
cataagtgaattta

SEQ ID NO: 3359827 - DNA, 22 bp, Homo sapiens
cataagtgctattgcagagccg

SEQ ID NO: 3359828 - DNA, 12 bp, Homo sapiens
cataagtttctg

SEQ ID NO: 3359829 - DNA, 17 bp, Homo sapiens
cataataataatttgca

SEQ ID NO: 3359830 - DNA, 20 bp, Homo sapiens
cataataataatttgcactt

SEQ ID NO: 3359831 - DNA, 22 bp, Homo sapiens
cataataggtagtttggatatt

SEQ ID NO: 3359832 - DNA, 15 bp, Homo sapiens
cataatcactctaat

SEQ ID NO: 3359833 - DNA, 19 bp, Homo sapiens
cataatcagtatatttggt

SEQ ID NO: 3359834 - DNA, 20 bp, Homo sapiens
cataatctggactcctctgt

SEQ ID NO: 3359835 - DNA, 22 bp, Homo sapiens
cataatctggactcctctgtcc

SEQ ID NO: 3359836 - DNA, 23 bp, Homo sapiens
cataatctggactcctctgtcca

SEQ ID NO: 3359837 - DNA, 21 bp, Homo sapiens
cataatcttctgccttctcat

SEQ ID NO: 3359838 - DNA, 22 bp, Homo sapiens
cataatcttctgccttctcatg

SEQ ID NO: 3359839 - DNA, 18 bp, Homo sapiens
cataatgaattataacag

SEQ ID NO: 3359840 - DNA, 18 bp, Homo sapiens
cataatgctaatttaaag

SEQ ID NO: 3359841 - DNA, 22 bp, Homo sapiens
cataatgctaatttaaagagac

SEQ ID NO: 3359842 - DNA, 14 bp, Homo sapiens
cataatgctactgt

SEQ ID NO: 3359843 - DNA, 16 bp, Homo sapiens
cataatgctactgtct

SEQ ID NO: 3359844 - DNA, 12 bp, Homo sapiens
cataatgctttg

SEQ ID NO: 3359845 - DNA, 17 bp, Homo sapiens
cataatgctttggaaaa

SEQ ID NO: 3359846 - DNA, 15 bp, Homo sapiens
cataatgtataaaga

SEQ ID NO: 3359847 - DNA, 16 bp, Homo sapiens
cataatgtttttcctt

SEQ ID NO: 3359848 - DNA, 13 bp, Homo sapiens
cataattacattc

SEQ ID NO: 3359849 - DNA, 18 bp, Homo sapiens
cataattacattcctaac

SEQ ID NO: 3359850 - DNA, 19 bp, Homo sapiens
cataattacattcctaact

SEQ ID NO: 3359851 - DNA, 20 bp, Homo sapiens
cataattacattcctaacta

SEQ ID NO: 3359852 - DNA, 15 bp, Homo sapiens
cataattatgacagt

SEQ ID NO: 3359853 - DNA, 17 bp, Homo sapiens
cataattatgacagtta

SEQ ID NO: 3359854 - DNA, 18 bp, Homo sapiens
cataattcagcacttaac

SEQ ID NO: 3359855 - DNA, 18 bp, Homo sapiens
cataattcttgtatatta

SEQ ID NO: 3359856 - DNA, 19 bp, Homo sapiens
cataattgctttgccaaaa

SEQ ID NO: 3359857 - DNA, 17 bp, Homo sapiens
cataattgtggattata

SEQ ID NO: 3359858 - DNA, 23 bp, Homo sapiens
cataattgtggattataaaaaat

SEQ ID NO: 3359859 - DNA, 21 bp, Homo sapiens
cataattgttgtggtttaaat

SEQ ID NO: 3359860 - DNA, 23 bp, Homo sapiens
cataattgttgtggtttaaatac

SEQ ID NO: 3359861 - DNA, 20 bp, Homo sapiens
cataatttagttgtttctag

SEQ ID NO: 3359862 - DNA, 14 bp, Homo sapiens
cataattttcttca

SEQ ID NO: 3359863 - DNA, 18 bp, Homo sapiens
cataattttttttaaaga

SEQ ID NO: 3359864 - DNA, 13 bp, Homo sapiens
catacaaaataaa

SEQ ID NO: 3359865 - DNA, 18 bp, Homo sapiens
catacaaaataaaactgt

SEQ ID NO: 3359866 - DNA, 18 bp, Homo sapiens
catacaaagcgtgcacaa

SEQ ID NO: 3359867 - DNA, 17 bp, Homo sapiens
catacaacagaaaccag

SEQ ID NO: 3359868 - DNA, 21 bp, Homo sapiens
catacacacatgccctcctgg

SEQ ID NO: 3359869 - DNA, 18 bp, Homo sapiens
catacacgcaaatacact

SEQ ID NO: 3359870 - DNA, 17 bp, Homo sapiens
catacactcaaacaatc

SEQ ID NO: 3359871 - DNA, 23 bp, Homo sapiens
catacacttattggaactctgct

SEQ ID NO: 3359872 - DNA, 16 bp, Homo sapiens
catacacttgtataaa

SEQ ID NO: 3359873 - DNA, 20 bp, Homo sapiens
catacacttgtataaatgta

SEQ ID NO: 3359874 - DNA, 17 bp, Homo sapiens
catacagagtgggcccc

SEQ ID NO: 3359875 - DNA, 18 bp, Homo sapiens
catacagggtctcttcct

SEQ ID NO: 3359876 - DNA, 20 bp, Homo sapiens
catacagttttatgctcttt

SEQ ID NO: 3359877 - DNA, 22 bp, Homo sapiens
catacagttttatgctcttttt

SEQ ID NO: 3359878 - DNA, 13 bp, Homo sapiens
catacagttttct

SEQ ID NO: 3359879 - DNA, 15 bp, Homo sapiens
catacatatgtagaa

SEQ ID NO: 3359880 - DNA, 22 bp, Homo sapiens
catacatatgtagaaacattta

SEQ ID NO: 3359881 - DNA, 21 bp, Homo sapiens
catacatcagttattcattct

SEQ ID NO: 3359882 - DNA, 14 bp, Homo sapiens
catacatgctactt

SEQ ID NO: 3359883 - DNA, 15 bp, Homo sapiens
catacattttctggt

SEQ ID NO: 3359884 - DNA, 17 bp, Homo sapiens
catacctaagtactgta

SEQ ID NO: 3359885 - DNA, 22 bp, Homo sapiens
catacctcagaatgtaaaagaa

SEQ ID NO: 3359886 - DNA, 12 bp, Homo sapiens
catacctctctg

SEQ ID NO: 3359887 - DNA, 13 bp, Homo sapiens
catacctctgacc

SEQ ID NO: 3359888 - DNA, 17 bp, Homo sapiens
catacctctgaccaaca

SEQ ID NO: 3359889 - DNA, 19 bp, Homo sapiens
catacggtcaggtttaaca

SEQ ID NO: 3359890 - DNA, 13 bp, Homo sapiens
catactacccttt

SEQ ID NO: 3359891 - DNA, 23 bp, Homo sapiens
catactaccctttgctggaagaa

SEQ ID NO: 3359892 - DNA, 19 bp, Homo sapiens
catactatttagattttct

SEQ ID NO: 3359893 - DNA, 20 bp, Homo sapiens
catactcatttctaaaagaa

SEQ ID NO: 3359894 - DNA, 21 bp, Homo sapiens
catactcatttctaaaagaat

SEQ ID NO: 3359895 - DNA, 20 bp, Homo sapiens
catactccttccatcaaata

SEQ ID NO: 3359896 - DNA, 14 bp, Homo sapiens
catactctctgcct

SEQ ID NO: 3359897 - DNA, 19 bp, Homo sapiens
catactctctgcctggtgg

SEQ ID NO: 3359898 - DNA, 19 bp, Homo sapiens
catactgagggaccaactg

SEQ ID NO: 3359899 - DNA, 20 bp, Homo sapiens
catactgagggaccaactgg

SEQ ID NO: 3359900 - DNA, 15 bp, Homo sapiens
catactggcctggac

SEQ ID NO: 3359901 - DNA, 23 bp, Homo sapiens
catactgtctgggattaagggca

SEQ ID NO: 3359902 - DNA, 12 bp, Homo sapiens
catactttattg

SEQ ID NO: 3359903 - DNA, 14 bp, Homo sapiens
catactttgtaaat

SEQ ID NO: 3359904 - DNA, 15 bp, Homo sapiens
catactttgtaaata

SEQ ID NO: 3359905 - DNA, 17 bp, Homo sapiens
catactttgtattttga

SEQ ID NO: 3359906 - DNA, 12 bp, Homo sapiens
catactttgtct

SEQ ID NO: 3359907 - DNA, 14 bp, Homo sapiens
catactttgtctga

SEQ ID NO: 3359908 - DNA, 17 bp, Homo sapiens
catacttttgagagggg

SEQ ID NO: 3359909 - DNA, 13 bp, Homo sapiens
catacttttgcaa

SEQ ID NO: 3359910 - DNA, 16 bp, Homo sapiens
catacttttggctcct

SEQ ID NO: 3359911 - DNA, 16 bp, Homo sapiens
catactttttaaatgt

SEQ ID NO: 3359912 - DNA, 22 bp, Homo sapiens
catactttttaaatgtaaagat

SEQ ID NO: 3359913 - DNA, 14 bp, Homo sapiens
catagaaacatgac

SEQ ID NO: 3359914 - DNA, 23 bp, Homo sapiens
catagaaatggaaattttgctat

SEQ ID NO: 3359915 - DNA, 23 bp, Homo sapiens
catagaactgggtaaatgcaaag

SEQ ID NO: 3359916 - DNA, 14 bp, Homo sapiens
catagacatgaaag

SEQ ID NO: 3359917 - DNA, 14 bp, Homo sapiens
catatttgtggaat

SEQ ID NO: 3359918 - DNA, 22 bp, Homo sapiens
catattttattgtattttgatg

SEQ ID NO: 3359919 - DNA, 19 bp, Homo sapiens
catattttgattattgtat

SEQ ID NO: 3359920 - DNA, 13 bp, Homo sapiens
catattttgtata

SEQ ID NO: 3359921 - DNA, 20 bp, Homo sapiens
catatttttgatcatccctt

SEQ ID NO: 3359922 - DNA, 18 bp, Homo sapiens
catcaaaaactttggagt

SEQ ID NO: 3359923 - DNA, 21 bp, Homo sapiens
catcaaaaagaaaaatcaaag

SEQ ID NO: 3359924 - DNA, 15 bp, Homo sapiens
catcaaaatgctttt

SEQ ID NO: 3359925 - DNA, 14 bp, Homo sapiens
catcaaagcctggc

SEQ ID NO: 3359926 - DNA, 14 bp, Homo sapiens
catcaaataaactg

SEQ ID NO: 3359927 - DNA, 21 bp, Homo sapiens
catcaaataaatttctgggat

SEQ ID NO: 3359928 - DNA, 13 bp, Homo sapiens
catcaaataagaa

SEQ ID NO: 3359929 - DNA, 10 bp, Homo sapiens
catcaactga

SEQ ID NO: 3359930 - DNA, 12 bp, Homo sapiens
catcaactgaat

SEQ ID NO: 3359931 - DNA, 14 bp, Homo sapiens
catcaagcttttct

SEQ ID NO: 3359932 - DNA, 19 bp, Homo sapiens
catcaataaatgctctatt

SEQ ID NO: 3359933 - DNA, 17 bp, Homo sapiens
catcaatacaaccagcc

SEQ ID NO: 3359934 - DNA, 20 bp, Homo sapiens
catcaatatccctcttgtaa

SEQ ID NO: 3359935 - DNA, 18 bp, Homo sapiens
catcaatgtgacatttac

SEQ ID NO: 3359936 - DNA, 15 bp, Homo sapiens
catcaatgttcattg

SEQ ID NO: 3359937 - DNA, 18 bp, Homo sapiens
catcaatgttcattgtaa

SEQ ID NO: 3359938 - DNA, 18 bp, Homo sapiens
catcaattaacatcgtgg

SEQ ID NO: 3359939 - DNA, 22 bp, Homo sapiens
catcaattgaatggtcagcgtt

SEQ ID NO: 3359940 - DNA, 12 bp, Homo sapiens
catcacacacac

SEQ ID NO: 3359941 - DNA, 12 bp, Homo sapiens
catcacagcagc

SEQ ID NO: 3359942 - DNA, 13 bp, Homo sapiens
catcacagggcag

SEQ ID NO: 3359943 - DNA, 22 bp, Homo sapiens
catcacagggttgggcccagat

SEQ ID NO: 3359944 - DNA, 14 bp, Homo sapiens
catcaccgctgggt

SEQ ID NO: 3359945 - DNA, 15 bp, Homo sapiens
catcaccgctgggtg

SEQ ID NO: 3359946 - DNA, 18 bp, Homo sapiens
catcactagaagaaaagc

SEQ ID NO: 3359947 - DNA, 14 bp, Homo sapiens
catcactccctgga

SEQ ID NO: 3359948 - DNA, 17 bp, Homo sapiens
catcactccctggatgt

SEQ ID NO: 3359949 - DNA, 15 bp, Homo sapiens
catcacttgtacaaa

SEQ ID NO: 3359950 - DNA, 15 bp, Homo sapiens
catcactttgaccta

SEQ ID NO: 3359951 - DNA, 19 bp, Homo sapiens
catcagacctgtcttccaa

SEQ ID NO: 3359952 - DNA, 14 bp, Homo sapiens
catcagagcagcta

SEQ ID NO: 3359953 - DNA, 18 bp, Homo sapiens
catcagaggtttgcttcc

SEQ ID NO: 3359954 - DNA, 19 bp, Homo sapiens
catcagatggaaatatttt

SEQ ID NO: 3359955 - DNA, 22 bp, Homo sapiens
catcagcagcccatggcctctg

SEQ ID NO: 3359956 - DNA, 23 bp, Homo sapiens
catcagcattgtctcgtgtacag

SEQ ID NO: 3359957 - DNA, 17 bp, Homo sapiens
catcagctgtaagaaga

SEQ ID NO: 3359958 - DNA, 17 bp, Homo sapiens
catcaggcactggtggc

SEQ ID NO: 3359959 - DNA, 18 bp, Homo sapiens
catcagggacaggatgac

SEQ ID NO: 3359960 - DNA, 11 bp, Homo sapiens
catcagggcct

SEQ ID NO: 3359961 - DNA, 16 bp, Homo sapiens
catcagggcctggggc

SEQ ID NO: 3359962 - DNA, 23 bp, Homo sapiens
catcagggcctggggcctgagag

SEQ ID NO: 3359963 - DNA, 17 bp, Homo sapiens
catcagtccctatgtat

SEQ ID NO: 3359964 - DNA, 15 bp, Homo sapiens
catcagtgcctcttt

SEQ ID NO: 3359965 - DNA, 17 bp, Homo sapiens
catcagtgttaaaaaat

SEQ ID NO: 3359966 - DNA, 22 bp, Homo sapiens
catcagtgttaaaaaatttttg

SEQ ID NO: 3359967 - DNA, 17 bp, Homo sapiens
catcataaaatttttat

SEQ ID NO: 3359968 - DNA, 14 bp, Homo sapiens
catcataattacat

SEQ ID NO: 3359969 - DNA, 22 bp, Homo sapiens
catcataattacattcctaact

SEQ ID NO: 3359970 - DNA, 16 bp, Homo sapiens
catcatcagggcctgg

SEQ ID NO: 3359971 - DNA, 13 bp, Homo sapiens
catcatgcctgac

SEQ ID NO: 3359972 - DNA, 21 bp, Homo sapiens
catcatgcttacaaaaaagaa

SEQ ID NO: 3359973 - DNA, 17 bp, Homo sapiens
catcatggctgcttgat

SEQ ID NO: 3359974 - DNA, 12 bp, Homo sapiens
catcatgtagaa

SEQ ID NO: 3359975 - DNA, 15 bp, Homo sapiens
catcatgtagaatat

SEQ ID NO: 3359976 - DNA, 10 bp, Homo sapiens
catcatgtca

SEQ ID NO: 3359977 - DNA, 15 bp, Homo sapiens
catcatgtctggcta

SEQ ID NO: 3359978 - DNA, 17 bp, Homo sapiens
catcattacccttccct

SEQ ID NO: 3359979 - DNA, 20 bp, Homo sapiens
catcattacccttccctgca

SEQ ID NO: 3359980 - DNA, 20 bp, Homo sapiens
catcattactgttccagatt

SEQ ID NO: 3359981 - DNA, 10 bp, Homo sapiens
catcattaga

SEQ ID NO: 3359982 - DNA, 16 bp, Homo sapiens
catcattccctctcat

SEQ ID NO: 3359983 - DNA, 13 bp, Homo sapiens
catcattgtttct

SEQ ID NO: 3359984 - DNA, 20 bp, Homo sapiens
catcatttctgtctttaaga

SEQ ID NO: 3359985 - DNA, 12 bp, Homo sapiens
catccaaatcta

SEQ ID NO: 3359986 - DNA, 13 bp, Homo sapiens
catccaaatctag

SEQ ID NO: 3359987 - DNA, 16 bp, Homo sapiens
catccaaattaagttt

SEQ ID NO: 3359988 - DNA, 17 bp, Homo sapiens
catccaaccactgtaca

SEQ ID NO: 3359989 - DNA, 16 bp, Homo sapiens
catccaaccccccacc

SEQ ID NO: 3359990 - DNA, 14 bp, Homo sapiens
catccaactccagc

SEQ ID NO: 3359991 - DNA, 21 bp, Homo sapiens
catccaaggagaaacagagac

SEQ ID NO: 3359992 - DNA, 19 bp, Homo sapiens
catccaaggcaaacaatcc

SEQ ID NO: 3359993 - DNA, 16 bp, Homo sapiens
catccaatcctcactg

SEQ ID NO: 3359994 - DNA, 19 bp, Homo sapiens
catccaatcctcactgggt

SEQ ID NO: 3359995 - DNA, 14 bp, Homo sapiens
catccaccaatctc

SEQ ID NO: 3359996 - DNA, 14 bp, Homo sapiens
catccacccagtgc

SEQ ID NO: 3359997 - DNA, 23 bp, Homo sapiens
catccacccagtgctgccatgcc

SEQ ID NO: 3359998 - DNA, 12 bp, Homo sapiens
catccaccccag

SEQ ID NO: 3359999 - DNA, 14 bp, Homo sapiens
catccactctaccc

SEQ ID NO: 3360000 - DNA, 12 bp, Homo sapiens
catccagcctgt

SEQ ID NO: 3360001 - DNA, 15 bp, Homo sapiens
catccagcctgtgtg

SEQ ID NO: 3360002 - DNA, 16 bp, Homo sapiens
catccagcctgtgtgt

SEQ ID NO: 3360003 - DNA, 13 bp, Homo sapiens
catccatctccag

SEQ ID NO: 3360004 - DNA, 22 bp, Homo sapiens
catccatctccagggagcaaga

SEQ ID NO: 3360005 - DNA, 22 bp, Homo sapiens
catccatggccgggcttggtgg

SEQ ID NO: 3360006 - DNA, 20 bp, Homo sapiens
catccatgtcctatgtgtga

SEQ ID NO: 3360007 - DNA, 18 bp, Homo sapiens
catccatgttccgagaag

SEQ ID NO: 3360008 - DNA, 17 bp, Homo sapiens
catccattaggccagca

SEQ ID NO: 3360009 - DNA, 12 bp, Homo sapiens
catccattccca

SEQ ID NO: 3360010 - DNA, 13 bp, Homo sapiens
catccattgttgt

SEQ ID NO: 3360011 - DNA, 20 bp, Homo sapiens
catcccaaccaggcacctct

SEQ ID NO: 3360012 - DNA, 23 bp, Homo sapiens
catcccacttagccgcaccctgc

SEQ ID NO: 3360013 - DNA, 17 bp, Homo sapiens
catcccagacaggtccc

SEQ ID NO: 3360014 - DNA, 21 bp, Homo sapiens
catcccagacaggtccctccc

SEQ ID NO: 3360015 - DNA, 16 bp, Homo sapiens
catcccagaccagcca

SEQ ID NO: 3360016 - DNA, 20 bp, Homo sapiens
catcccagccccaattttct

SEQ ID NO: 3360017 - DNA, 20 bp, Homo sapiens
catcccaggatgctgggtgg

SEQ ID NO: 3360018 - DNA, 16 bp, Homo sapiens
catccccacaatctgg

SEQ ID NO: 3360019 - DNA, 14 bp, Homo sapiens
catccccaccccac

SEQ ID NO: 3360020 - DNA, 12 bp, Homo sapiens
catccccagggg

SEQ ID NO: 3360021 - DNA, 17 bp, Homo sapiens
catccccatcctccagc

SEQ ID NO: 3360022 - DNA, 11 bp, Homo sapiens
catccccctgc

SEQ ID NO: 3360023 - DNA, 14 bp, Homo sapiens
catcccctcccatc

SEQ ID NO: 3360024 - DNA, 20 bp, Homo sapiens
catcccctcgtcctgtccca

SEQ ID NO: 3360025 - DNA, 19 bp, Homo sapiens
catcccctggactgggagg

SEQ ID NO: 3360026 - DNA, 19 bp, Homo sapiens
catcccggaggaaatctgc

SEQ ID NO: 3360027 - DNA, 14 bp, Homo sapiens
catcccggcctctt

SEQ ID NO: 3360028 - DNA, 17 bp, Homo sapiens
catcccgtgttctcctt

SEQ ID NO: 3360029 - DNA, 14 bp, Homo sapiens
catccctaccccct

SEQ ID NO: 3360030 - DNA, 13 bp, Homo sapiens
catccctccccag

SEQ ID NO: 3360031 - DNA, 14 bp, Homo sapiens
catccctccccagt

SEQ ID NO: 3360032 - DNA, 19 bp, Homo sapiens
catccctcgggaagcagcc

SEQ ID NO: 3360033 - DNA, 20 bp, Homo sapiens
catccctcgggaagcagcca

SEQ ID NO: 3360034 - DNA, 22 bp, Homo sapiens
catccctcgggaagcagccagc

SEQ ID NO: 3360035 - DNA, 17 bp, Homo sapiens
catccctgactggccaa

SEQ ID NO: 3360036 - DNA, 12 bp, Homo sapiens
catccctgccac

SEQ ID NO: 3360037 - DNA, 13 bp, Homo sapiens
catccctgcctgg

SEQ ID NO: 3360038 - DNA, 14 bp, Homo sapiens
catccctgcctggt

SEQ ID NO: 3360039 - DNA, 18 bp, Homo sapiens
catccctggagcaggagc

SEQ ID NO: 3360040 - DNA, 20 bp, Homo sapiens
catccctggccccctccctg

SEQ ID NO: 3360041 - DNA, 21 bp, Homo sapiens
catccctggccccctccctgg

SEQ ID NO: 3360042 - DNA, 12 bp, Homo sapiens
catccctgggcc

SEQ ID NO: 3360043 - DNA, 13 bp, Homo sapiens
catccctgggccc

SEQ ID NO: 3360044 - DNA, 13 bp, Homo sapiens
catccctgtcatt

SEQ ID NO: 3360045 - DNA, 17 bp, Homo sapiens
catgcaaaaagaaatga

SEQ ID NO: 3360046 - DNA, 16 bp, Homo sapiens
catgcaaaatatgttt

SEQ ID NO: 3360047 - DNA, 18 bp, Homo sapiens
catgcaaacaagaaacgt

SEQ ID NO: 3360048 - DNA, 16 bp, Homo sapiens
catgcaaatgagctct

SEQ ID NO: 3360049 - DNA, 20 bp, Homo sapiens
catgcaaatgagctctgaaa

SEQ ID NO: 3360050 - DNA, 18 bp, Homo sapiens
catgcaatttattaaaat

SEQ ID NO: 3360051 - DNA, 10 bp, Homo sapiens
catgcacaca

SEQ ID NO: 3360052 - DNA, 16 bp, Homo sapiens
catgcaccctcataca

SEQ ID NO: 3360053 - DNA, 17 bp, Homo sapiens
catgcactgacccttcc

SEQ ID NO: 3360054 - DNA, 15 bp, Homo sapiens
catgcactgatgttg

SEQ ID NO: 3360055 - DNA, 18 bp, Homo sapiens
catgcagactcctcagat

SEQ ID NO: 3360056 - DNA, 13 bp, Homo sapiens
catgcagagcgcc

SEQ ID NO: 3360057 - DNA, 23 bp, Homo sapiens
catgcagcccatgcccacctgcc

SEQ ID NO: 3360058 - DNA, 12 bp, Homo sapiens
catgcagccttg

SEQ ID NO: 3360059 - DNA, 13 bp, Homo sapiens
catgcaggaagga

SEQ ID NO: 3360060 - DNA, 16 bp, Homo sapiens
catgcaggaaggaaaa

SEQ ID NO: 3360061 - DNA, 12 bp, Homo sapiens
catgcaggccct

SEQ ID NO: 3360062 - DNA, 19 bp, Homo sapiens
catgcaggggtcagtgcag

SEQ ID NO: 3360063 - DNA, 23 bp, Homo sapiens
catgcagtctaaaatgcttcagt

SEQ ID NO: 3360064 - DNA, 15 bp, Homo sapiens
catgcagttcctggc

SEQ ID NO: 3360065 - DNA, 13 bp, Homo sapiens
catgcataaatat

SEQ ID NO: 3360066 - DNA, 16 bp, Homo sapiens
catgcataaatatgca

SEQ ID NO: 3360067 - DNA, 18 bp, Homo sapiens
catgcataaatatgcagt

SEQ ID NO: 3360068 - DNA, 16 bp, Homo sapiens
catgcatactttattg

SEQ ID NO: 3360069 - DNA, 17 bp, Homo sapiens
catgcatagtcccagct

SEQ ID NO: 3360070 - DNA, 14 bp, Homo sapiens
catgcatgcaaatg

SEQ ID NO: 3360071 - DNA, 20 bp, Homo sapiens
catgcattgttgaggtggtc

SEQ ID NO: 3360072 - DNA, 22 bp, Homo sapiens
catgcattgttgaggtggtctg

SEQ ID NO: 3360073 - DNA, 14 bp, Homo sapiens
catgcattgttggc

SEQ ID NO: 3360074 - DNA, 13 bp, Homo sapiens
catgcattttctt

SEQ ID NO: 3360075 - DNA, 19 bp, Homo sapiens
catgcattttcttgtatga

SEQ ID NO: 3360076 - DNA, 20 bp, Homo sapiens
catgcattttgcagcagtga

SEQ ID NO: 3360077 - DNA, 21 bp, Homo sapiens
catgccaccatggccagccaa

SEQ ID NO: 3360078 - DNA, 15 bp, Homo sapiens
catgccaccctcaca

SEQ ID NO: 3360079 - DNA, 18 bp, Homo sapiens
catgccaccctcacacac

SEQ ID NO: 3360080 - DNA, 17 bp, Homo sapiens
catgccacgttccacag

SEQ ID NO: 3360081 - DNA, 19 bp, Homo sapiens
catgccacgttccacagtt

SEQ ID NO: 3360082 - DNA, 14 bp, Homo sapiens
catgccactgccag

SEQ ID NO: 3360083 - DNA, 16 bp, Homo sapiens
catgccactgccaggc

SEQ ID NO: 3360084 - DNA, 22 bp, Homo sapiens
catgccagaaggaatcttctca

SEQ ID NO: 3360085 - DNA, 16 bp, Homo sapiens
catgcccaccccctgc

SEQ ID NO: 3360086 - DNA, 17 bp, Homo sapiens
catgcccaccccctgcc

SEQ ID NO: 3360087 - DNA, 18 bp, Homo sapiens
catgcccaccccctgccc

SEQ ID NO: 3360088 - DNA, 22 bp, Homo sapiens
catgcccaccccctgccctgca

SEQ ID NO: 3360089 - DNA, 23 bp, Homo sapiens
catgcccaccccctgccctgcac

SEQ ID NO: 3360090 - DNA, 13 bp, Homo sapiens
catgcccacctgc

SEQ ID NO: 3360091 - DNA, 14 bp, Homo sapiens
catgcccacctgcc

SEQ ID NO: 3360092 - DNA, 16 bp, Homo sapiens
catgcccacctgccca

SEQ ID NO: 3360093 - DNA, 17 bp, Homo sapiens
catgcccacctgcccat

SEQ ID NO: 3360094 - DNA, 13 bp, Homo sapiens
catgccccagtcg

SEQ ID NO: 3360095 - DNA, 13 bp, Homo sapiens
catgcccccctca

SEQ ID NO: 3360096 - DNA, 23 bp, Homo sapiens
catgcccccctcaaacctcctct

SEQ ID NO: 3360097 - DNA, 11 bp, Homo sapiens
catgccccctg

SEQ ID NO: 3360098 - DNA, 19 bp, Homo sapiens
catgccccggccacctctg

SEQ ID NO: 3360099 - DNA, 14 bp, Homo sapiens
catgccccttggct

SEQ ID NO: 3360100 - DNA, 21 bp, Homo sapiens
catgcccggctaatttttgta

SEQ ID NO: 3360101 - DNA, 11 bp, Homo sapiens
catgcctgagg

SEQ ID NO: 3360102 - DNA, 12 bp, Homo sapiens
catgcctgctga

SEQ ID NO: 3360103 - DNA, 14 bp, Homo sapiens
catgcctgctgaga

SEQ ID NO: 3360104 - DNA, 22 bp, Homo sapiens
catgcctgtagctttcctggtc

SEQ ID NO: 3360105 - DNA, 23 bp, Homo sapiens
catgcctgtccagcctgggcagc

SEQ ID NO: 3360106 - DNA, 13 bp, Homo sapiens
catgcctgtctct

SEQ ID NO: 3360107 - DNA, 16 bp, Homo sapiens
catgccttaaatttgt

SEQ ID NO: 3360108 - DNA, 15 bp, Homo sapiens
catgccttgataaat

SEQ ID NO: 3360109 - DNA, 12 bp, Homo sapiens
catgccttgtgc

SEQ ID NO: 3360110 - DNA, 16 bp, Homo sapiens
catgcctttgtaagtt

SEQ ID NO: 3360111 - DNA, 15 bp, Homo sapiens
catgcgctcagggcc

SEQ ID NO: 3360112 - DNA, 22 bp, Homo sapiens
catgcgctcagggccatgctga

SEQ ID NO: 3360113 - DNA, 20 bp, Homo sapiens
catgcgtgccgcctgctcct

SEQ ID NO: 3360114 - DNA, 16 bp, Homo sapiens
catgcgtgtttctgac

SEQ ID NO: 3360115 - DNA, 13 bp, Homo sapiens
catgctcacctct

SEQ ID NO: 3360116 - DNA, 14 bp, Homo sapiens
catgctcctcacct

SEQ ID NO: 3360117 - DNA, 21 bp, Homo sapiens
catgctctgagaagaggagcc

SEQ ID NO: 3360118 - DNA, 13 bp, Homo sapiens
catgctctgcccc

SEQ ID NO: 3360119 - DNA, 18 bp, Homo sapiens
catgctctgccccaagcc

SEQ ID NO: 3360120 - DNA, 13 bp, Homo sapiens
catgctctttttc

SEQ ID NO: 3360121 - DNA, 17 bp, Homo sapiens
catgctgaaaaatatag

SEQ ID NO: 3360122 - DNA, 20 bp, Homo sapiens
catgctgaaaaatatagcct

SEQ ID NO: 3360123 - DNA, 17 bp, Homo sapiens
catgctgaggcctgggc

SEQ ID NO: 3360124 - DNA, 18 bp, Homo sapiens
catgctgaggcctgggcc

SEQ ID NO: 3360125 - DNA, 19 bp, Homo sapiens
catgctgaggcctgggccg

SEQ ID NO: 3360126 - DNA, 15 bp, Homo sapiens
catgctgagtctccc

SEQ ID NO: 3360127 - DNA, 21 bp, Homo sapiens
catgctgagtctcccaaggct

SEQ ID NO: 3360128 - DNA, 14 bp, Homo sapiens
catgctgcctccag

SEQ ID NO: 3360129 - DNA, 17 bp, Homo sapiens
catgctgctatacacaa

SEQ ID NO: 3360130 - DNA, 15 bp, Homo sapiens
catgctgctttgcca

SEQ ID NO: 3360131 - DNA, 15 bp, Homo sapiens
catgctggccagcct

SEQ ID NO: 3360132 - DNA, 19 bp, Homo sapiens
catgctgggatttccaact

SEQ ID NO: 3360133 - DNA, 15 bp, Homo sapiens
catgctgtgctcttt

SEQ ID NO: 3360134 - DNA, 22 bp, Homo sapiens
catgctgtgctctttgaagaga

SEQ ID NO: 3360135 - DNA, 21 bp, Homo sapiens
catgctgttgcatttagaact

SEQ ID NO: 3360136 - DNA, 17 bp, Homo sapiens
catgcttagcttatctt

SEQ ID NO: 3360137 - DNA, 18 bp, Homo sapiens
catgcttagcttatcttt

SEQ ID NO: 3360138 - DNA, 22 bp, Homo sapiens
catgcttagcttatctttcttt

SEQ ID NO: 3360139 - DNA, 15 bp, Homo sapiens
catgcttatgacaat

SEQ ID NO: 3360140 - DNA, 20 bp, Homo sapiens
catgcttccaggtaaaaaca

SEQ ID NO: 3360141 - DNA, 17 bp, Homo sapiens
catgcttcccagaggga

SEQ ID NO: 3360142 - DNA, 14 bp, Homo sapiens
catgcttctcaccg

SEQ ID NO: 3360143 - DNA, 14 bp, Homo sapiens
catgcttcttcctt

SEQ ID NO: 3360144 - DNA, 16 bp, Homo sapiens
catgcttcttccttac

SEQ ID NO: 3360145 - DNA, 22 bp, Homo sapiens
catgcttgggctgacccagcat

SEQ ID NO: 3360146 - DNA, 18 bp, Homo sapiens
catgctttaaagtgtaat

SEQ ID NO: 3360147 - DNA, 19 bp, Homo sapiens
catgctttaaagtgtaata

SEQ ID NO: 3360148 - DNA, 15 bp, Homo sapiens
catgctttgctgcta

SEQ ID NO: 3360149 - DNA, 13 bp, Homo sapiens
catggaaaaatgg

SEQ ID NO: 3360150 - DNA, 17 bp, Homo sapiens
catggaaacctgaaaaa

SEQ ID NO: 3360151 - DNA, 16 bp, Homo sapiens
catggaataacatgta

SEQ ID NO: 3360152 - DNA, 18 bp, Homo sapiens
catggaatttaatgctga

SEQ ID NO: 3360153 - DNA, 12 bp, Homo sapiens
catggacactcc

SEQ ID NO: 3360154 - DNA, 18 bp, Homo sapiens
catggacactccagtgcc

SEQ ID NO: 3360155 - DNA, 18 bp, Homo sapiens
catggacatttagaagaa

SEQ ID NO: 3360156 - DNA, 19 bp, Homo sapiens
catggacgttcggggcatg

SEQ ID NO: 3360157 - DNA, 17 bp, Homo sapiens
catggacttgtatattt

SEQ ID NO: 3360158 - DNA, 16 bp, Homo sapiens
catggagagcctctta

SEQ ID NO: 3360159 - DNA, 18 bp, Homo sapiens
catggagccccctctgcc

SEQ ID NO: 3360160 - DNA, 17 bp, Homo sapiens
catggaggccctcctgt

SEQ ID NO: 3360161 - DNA, 17 bp, Homo sapiens
catggaggtttgaagat

SEQ ID NO: 3360162 - DNA, 17 bp, Homo sapiens
catggagtgtgtattgt

SEQ ID NO: 3360163 - DNA, 18 bp, Homo sapiens
catggagtgtgtattgtt

SEQ ID NO: 3360164 - DNA, 16 bp, Homo sapiens
catggatgcatttcaa

SEQ ID NO: 3360165 - DNA, 19 bp, Homo sapiens
catggatgcatttcaaatg

SEQ ID NO: 3360166 - DNA, 18 bp, Homo sapiens
catggatgcgaggaccac

SEQ ID NO: 3360167 - DNA, 21 bp, Homo sapiens
catggatttctgtcttctcta

SEQ ID NO: 3360168 - DNA, 14 bp, Homo sapiens
catggattttggat

SEQ ID NO: 3360169 - DNA, 20 bp, Homo sapiens
catggattttggataaatca

SEQ ID NO: 3360170 - DNA, 14 bp, Homo sapiens
catggatttttaca

SEQ ID NO: 3360171 - DNA, 23 bp, Homo sapiens
catggcaacgtgtgaactgcaac

SEQ ID NO: 3360172 - DNA, 16 bp, Homo sapiens
cattagcataattttg

SEQ ID NO: 3360173 - DNA, 19 bp, Homo sapiens
cattaggacaatcagtccc

SEQ ID NO: 3360174 - DNA, 16 bp, Homo sapiens
cattaggccagcaacg

SEQ ID NO: 3360175 - DNA, 17 bp, Homo sapiens
cattagggatgcctcct

SEQ ID NO: 3360176 - DNA, 21 bp, Homo sapiens
cattagggctgaggtctgttt

SEQ ID NO: 3360177 - DNA, 22 bp, Homo sapiens
cattaggtccctcactccacag

SEQ ID NO: 3360178 - DNA, 18 bp, Homo sapiens
cattaggttgtcctagaa

SEQ ID NO: 3360179 - DNA, 13 bp, Homo sapiens
cattagttttaga

SEQ ID NO: 3360180 - DNA, 22 bp, Homo sapiens
cattataatctcaaaggagaaa

SEQ ID NO: 3360181 - DNA, 14 bp, Homo sapiens
cattatactttata

SEQ ID NO: 3360182 - DNA, 17 bp, Homo sapiens
cattatcgggagcagtg

SEQ ID NO: 3360183 - DNA, 13 bp, Homo sapiens
cattatctgagtt

SEQ ID NO: 3360184 - DNA, 16 bp, Homo sapiens
cattatgagaggcaat

SEQ ID NO: 3360185 - DNA, 13 bp, Homo sapiens
cattatgattctt

SEQ ID NO: 3360186 - DNA, 21 bp, Homo sapiens
cattatgggttaggcattaat

SEQ ID NO: 3360187 - DNA, 15 bp, Homo sapiens
cattatgtaaaagaa

SEQ ID NO: 3360188 - DNA, 17 bp, Homo sapiens
cattatgtccactgtgt

SEQ ID NO: 3360189 - DNA, 21 bp, Homo sapiens
cattatgtccactgtgtatag

SEQ ID NO: 3360190 - DNA, 17 bp, Homo sapiens
cattatgtggttttaga

SEQ ID NO: 3360191 - DNA, 22 bp, Homo sapiens
cattatgtgtgcatgtgtgtat

SEQ ID NO: 3360192 - DNA, 13 bp, Homo sapiens
cattatgttcatg

SEQ ID NO: 3360193 - DNA, 14 bp, Homo sapiens
cattattcatttag

SEQ ID NO: 3360194 - DNA, 20 bp, Homo sapiens
cattattcatttagtgagtt

SEQ ID NO: 3360195 - DNA, 14 bp, Homo sapiens
cattattctcataa

SEQ ID NO: 3360196 - DNA, 14 bp, Homo sapiens
cattattgcttatt

SEQ ID NO: 3360197 - DNA, 17 bp, Homo sapiens
cattattggaattaacc

SEQ ID NO: 3360198 - DNA, 12 bp, Homo sapiens
cattatttaata

SEQ ID NO: 3360199 - DNA, 23 bp, Homo sapiens
cattatttatatggggaatatat

SEQ ID NO: 3360200 - DNA, 21 bp, Homo sapiens
cattatttattaaaaatgttc

SEQ ID NO: 3360201 - DNA, 13 bp, Homo sapiens
cattatttgtgct

SEQ ID NO: 3360202 - DNA, 15 bp, Homo sapiens
cattattttgtggtt

SEQ ID NO: 3360203 - DNA, 22 bp, Homo sapiens
cattattttgtggttctatttt

SEQ ID NO: 3360204 - DNA, 21 bp, Homo sapiens
cattatttttgttagcaaaga

SEQ ID NO: 3360205 - DNA, 13 bp, Homo sapiens
cattcaaactgca

SEQ ID NO: 3360206 - DNA, 17 bp, Homo sapiens
cattcaaatcagtgatc

SEQ ID NO: 3360207 - DNA, 17 bp, Homo sapiens
cattcacaagcctcctg

SEQ ID NO: 3360208 - DNA, 17 bp, Homo sapiens
cattcacacagggctct

SEQ ID NO: 3360209 - DNA, 13 bp, Homo sapiens
cattcacttctct

SEQ ID NO: 3360210 - DNA, 14 bp, Homo sapiens
cattcagaaatgtt

SEQ ID NO: 3360211 - DNA, 20 bp, Homo sapiens
cattcagaaatgttgagtct

SEQ ID NO: 3360212 - DNA, 15 bp, Homo sapiens
cattcagagagcagc

SEQ ID NO: 3360213 - DNA, 16 bp, Homo sapiens
cattcagatcactgaa

SEQ ID NO: 3360214 - DNA, 21 bp, Homo sapiens
cattcagatcactgaatttat

SEQ ID NO: 3360215 - DNA, 20 bp, Homo sapiens
cattcagcagcaaattttca

SEQ ID NO: 3360216 - DNA, 21 bp, Homo sapiens
cattcagctaacaaactagaa

SEQ ID NO: 3360217 - DNA, 19 bp, Homo sapiens
cattcaggaattcttggag

SEQ ID NO: 3360218 - DNA, 18 bp, Homo sapiens
cattcatagggaaaggtt

SEQ ID NO: 3360219 - DNA, 19 bp, Homo sapiens
cattcatattaagacagtg

SEQ ID NO: 3360220 - DNA, 23 bp, Homo sapiens
cattcatttgttttttcaatgtt

SEQ ID NO: 3360221 - DNA, 14 bp, Homo sapiens
cattccaagcctga

SEQ ID NO: 3360222 - DNA, 17 bp, Homo sapiens
cattccaccttcccatg

SEQ ID NO: 3360223 - DNA, 22 bp, Homo sapiens
cattccaccttcccatgccctg

SEQ ID NO: 3360224 - DNA, 15 bp, Homo sapiens
cattccactgtgcgt

SEQ ID NO: 3360225 - DNA, 19 bp, Homo sapiens
cattccagacttcaaaaat

SEQ ID NO: 3360226 - DNA, 15 bp, Homo sapiens
cattccagcccctct

SEQ ID NO: 3360227 - DNA, 18 bp, Homo sapiens
cattccagcccctctggt

SEQ ID NO: 3360228 - DNA, 13 bp, Homo sapiens
cattccagtgcta

SEQ ID NO: 3360229 - DNA, 17 bp, Homo sapiens
cattcccagagtcagag

SEQ ID NO: 3360230 - DNA, 18 bp, Homo sapiens
cattcccccatgtggctg

SEQ ID NO: 3360231 - DNA, 19 bp, Homo sapiens
cattcccccatgtggctga

SEQ ID NO: 3360232 - DNA, 20 bp, Homo sapiens
cattcccccatgtggctgaa

SEQ ID NO: 3360233 - DNA, 21 bp, Homo sapiens
cattcccccatgtggctgaag

SEQ ID NO: 3360234 - DNA, 17 bp, Homo sapiens
cattcccccttcctagt

SEQ ID NO: 3360235 - DNA, 18 bp, Homo sapiens
cattcccccttcctagtg

SEQ ID NO: 3360236 - DNA, 19 bp, Homo sapiens
cattcccccttcctagtga

SEQ ID NO: 3360237 - DNA, 16 bp, Homo sapiens
cattcccctcccacct

SEQ ID NO: 3360238 - DNA, 20 bp, Homo sapiens
cattcccctccccactcctc

SEQ ID NO: 3360239 - DNA, 23 bp, Homo sapiens
cattcccgtggtctccttgcact

SEQ ID NO: 3360240 - DNA, 20 bp, Homo sapiens
cattcctaacacagcatgtg

SEQ ID NO: 3360241 - DNA, 21 bp, Homo sapiens
cattcctaacacagcatgtgt

SEQ ID NO: 3360242 - DNA, 23 bp, Homo sapiens
cattcctaacacagcatgtgtat

SEQ ID NO: 3360243 - DNA, 21 bp, Homo sapiens
cattcctaactagaattagta

SEQ ID NO: 3360244 - DNA, 22 bp, Homo sapiens
cattcctaactagaattagtat

SEQ ID NO: 3360245 - DNA, 13 bp, Homo sapiens
cattcctgaaaga

SEQ ID NO: 3360246 - DNA, 22 bp, Homo sapiens
cattcctgcctttaagccaaag

SEQ ID NO: 3360247 - DNA, 17 bp, Homo sapiens
cattcctggaaaccaca

SEQ ID NO: 3360248 - DNA, 19 bp, Homo sapiens
cattcctggaaaccacagt

SEQ ID NO: 3360249 - DNA, 21 bp, Homo sapiens
cattcctggtacccagccatc

SEQ ID NO: 3360250 - DNA, 23 bp, Homo sapiens
cattcctggtacccagccatctg

SEQ ID NO: 3360251 - DNA, 24 bp, Homo sapiens
cattcctggtacccagccatctgc

SEQ ID NO: 3360252 - DNA, 16 bp, Homo sapiens
cattccttctttgata

SEQ ID NO: 3360253 - DNA, 19 bp, Homo sapiens
cattccttctttgataatg

SEQ ID NO: 3360254 - DNA, 16 bp, Homo sapiens
cattcgatctcattca

SEQ ID NO: 3360255 - DNA, 22 bp, Homo sapiens
cattcgcctttgtcttgtactt

SEQ ID NO: 3360256 - DNA, 21 bp, Homo sapiens
cattcgctgtaccctttaaga

SEQ ID NO: 3360257 - DNA, 15 bp, Homo sapiens
cattcgggccacagg

SEQ ID NO: 3360258 - DNA, 16 bp, Homo sapiens
cattcggggctgacga

SEQ ID NO: 3360259 - DNA, 17 bp, Homo sapiens
cattcgtgagctgggga

SEQ ID NO: 3360260 - DNA, 19 bp, Homo sapiens
cattcgtgagctggggact

SEQ ID NO: 3360261 - DNA, 23 bp, Homo sapiens
cattcgtgagctggggactcagg

SEQ ID NO: 3360262 - DNA, 15 bp, Homo sapiens
cattctacagaataa

SEQ ID NO: 3360263 - DNA, 16 bp, Homo sapiens
cattctacagaataat

SEQ ID NO: 3360264 - DNA, 21 bp, Homo sapiens
cattctacagaataatccagt

SEQ ID NO: 3360265 - DNA, 14 bp, Homo sapiens
cattctacctgagg

SEQ ID NO: 3360266 - DNA, 15 bp, Homo sapiens
cattctacttgctta

SEQ ID NO: 3360267 - DNA, 23 bp, Homo sapiens
cattctacttgcttattacattt

SEQ ID NO: 3360268 - DNA, 18 bp, Homo sapiens
cattctatcaagcccagg

SEQ ID NO: 3360269 - DNA, 22 bp, Homo sapiens
cattctatccccaatcagctcc

SEQ ID NO: 3360270 - DNA, 16 bp, Homo sapiens
cattctcactcctacc

SEQ ID NO: 3360271 - DNA, 12 bp, Homo sapiens
cattctcccagg

SEQ ID NO: 3360272 - DNA, 23 bp, Homo sapiens
cattctcccaggtaccagctgcg

SEQ ID NO: 3360273 - DNA, 11 bp, Homo sapiens
cattctcctgc

SEQ ID NO: 3360274 - DNA, 13 bp, Homo sapiens
cattctcctgcct

SEQ ID NO: 3360275 - DNA, 16 bp, Homo sapiens
cattctcctgcctcac

SEQ ID NO: 3360276 - DNA, 22 bp, Homo sapiens
cattctcctgcctgtagcagtg

SEQ ID NO: 3360277 - DNA, 17 bp, Homo sapiens
cattctctcccatcctg

SEQ ID NO: 3360278 - DNA, 12 bp, Homo sapiens
cattctgaatta

SEQ ID NO: 3360279 - DNA, 19 bp, Homo sapiens
cattctgactcggtttctc

SEQ ID NO: 3360280 - DNA, 21 bp, Homo sapiens
cattctgactcggtttctcca

SEQ ID NO: 3360281 - DNA, 14 bp, Homo sapiens
cattctgcctagag

SEQ ID NO: 3360282 - DNA, 18 bp, Homo sapiens
cattctgcctctctagga

SEQ ID NO: 3360283 - DNA, 17 bp, Homo sapiens
cattctgcctgcccagg

SEQ ID NO: 3360284 - DNA, 18 bp, Homo sapiens
cattctgcctgcccaggc

SEQ ID NO: 3360285 - DNA, 19 bp, Homo sapiens
cattctgcctgcccaggcc

SEQ ID NO: 3360286 - DNA, 22 bp, Homo sapiens
cattctgctacttcactgtcat

SEQ ID NO: 3360287 - DNA, 23 bp, Homo sapiens
cattctggtcaagggctgtcatt

SEQ ID NO: 3360288 - DNA, 21 bp, Homo sapiens
cattctgtcgccttagcatgt

SEQ ID NO: 3360289 - DNA, 21 bp, Homo sapiens
cattctgtctttcaaaaggta

SEQ ID NO: 3360290 - DNA, 16 bp, Homo sapiens
cattctgtgatcattt

SEQ ID NO: 3360291 - DNA, 15 bp, Homo sapiens
cattcttagcctgtg

SEQ ID NO: 3360292 - DNA, 17 bp, Homo sapiens
cattcttattgacaatt

SEQ ID NO: 3360293 - DNA, 13 bp, Homo sapiens
cattcttcctagt

SEQ ID NO: 3360294 - DNA, 18 bp, Homo sapiens
cattcttcctagttttct

SEQ ID NO: 3360295 - DNA, 19 bp, Homo sapiens
cattcttctctagctggtg

SEQ ID NO: 3360296 - DNA, 21 bp, Homo sapiens
cattcttctctgttgtcgtaa

SEQ ID NO: 3360297 - DNA, 23 bp, Homo sapiens
ccaaagttctaataatttctaat

SEQ ID NO: 3360298 - DNA, 15 bp, Homo sapiens
ccaaagttgttgtaa

SEQ ID NO: 3360299 - DNA, 14 bp, Homo sapiens
ccaaataaaaatta

SEQ ID NO: 3360300 - DNA, 15 bp, Homo sapiens
ccaaataaacagcta

SEQ ID NO: 3360301 - DNA, 19 bp, Homo sapiens
ccaaataaacagctattta

SEQ ID NO: 3360302 - DNA, 16 bp, Homo sapiens
ccaaataaagataacc

SEQ ID NO: 3360303 - DNA, 16 bp, Homo sapiens
ccaaataagaaaccta

SEQ ID NO: 3360304 - DNA, 13 bp, Homo sapiens
ccaaatacacatt

SEQ ID NO: 3360305 - DNA, 15 bp, Homo sapiens
ccaaatacacatttc

SEQ ID NO: 3360306 - DNA, 18 bp, Homo sapiens
ccaaatatagcgttccca

SEQ ID NO: 3360307 - DNA, 23 bp, Homo sapiens
ccaaatcagctgctactactcct

SEQ ID NO: 3360308 - DNA, 15 bp, Homo sapiens
ccaaatcccagggaa

SEQ ID NO: 3360309 - DNA, 20 bp, Homo sapiens
ccaaatctagccagagccct

SEQ ID NO: 3360310 - DNA, 18 bp, Homo sapiens
ccaaatctgacatattat

SEQ ID NO: 3360311 - DNA, 19 bp, Homo sapiens
ccaaatgatgccacttccc

SEQ ID NO: 3360312 - DNA, 21 bp, Homo sapiens
ccaaatgtgatcaactgttca

SEQ ID NO: 3360313 - DNA, 20 bp, Homo sapiens
ccaaatgtgtataattttaa

SEQ ID NO: 3360314 - DNA, 21 bp, Homo sapiens
ccaaatgtgtataattttaaa

SEQ ID NO: 3360315 - DNA, 15 bp, Homo sapiens
ccaaatgttcatcct

SEQ ID NO: 3360316 - DNA, 18 bp, Homo sapiens
ccaaatgtttacagggag

SEQ ID NO: 3360317 - DNA, 12 bp, Homo sapiens
ccaaattaaaaa

SEQ ID NO: 3360318 - DNA, 17 bp, Homo sapiens
ccaaattatttgtgtaa

SEQ ID NO: 3360319 - DNA, 15 bp, Homo sapiens
ccaaattcagtttca

SEQ ID NO: 3360320 - DNA, 18 bp, Homo sapiens
ccaaattcagtttcataa

SEQ ID NO: 3360321 - DNA, 22 bp, Homo sapiens
ccaaattctttcagtggctacc

SEQ ID NO: 3360322 - DNA, 19 bp, Homo sapiens
ccaaattgcactgaagttt

SEQ ID NO: 3360323 - DNA, 23 bp, Homo sapiens
ccaaattgcactgaagtttttga

SEQ ID NO: 3360324 - DNA, 16 bp, Homo sapiens
ccaaattgtgcttctc

SEQ ID NO: 3360325 - DNA, 14 bp, Homo sapiens
ccaaatttatcaaa

SEQ ID NO: 3360326 - DNA, 15 bp, Homo sapiens
ccaaatttgattgat

SEQ ID NO: 3360327 - DNA, 11 bp, Homo sapiens
ccaacaaacca

SEQ ID NO: 3360328 - DNA, 21 bp, Homo sapiens
ccaacaaggttggcaccccag

SEQ ID NO: 3360329 - DNA, 21 bp, Homo sapiens
ccaacaataaacaggaatttt

SEQ ID NO: 3360330 - DNA, 14 bp, Homo sapiens
ccaacaatggggtg

SEQ ID NO: 3360331 - DNA, 16 bp, Homo sapiens
ccaacaatggggtggg

SEQ ID NO: 3360332 - DNA, 21 bp, Homo sapiens
ccaacaatggggtgggcccat

SEQ ID NO: 3360333 - DNA, 21 bp, Homo sapiens
ccaacaccacagacacacaca

SEQ ID NO: 3360334 - DNA, 15 bp, Homo sapiens
ccaacaccagcccct

SEQ ID NO: 3360335 - DNA, 22 bp, Homo sapiens
ccaacaccagcccctgccccag

SEQ ID NO: 3360336 - DNA, 20 bp, Homo sapiens
ccaacacccaaagcatggac

SEQ ID NO: 3360337 - DNA, 15 bp, Homo sapiens
ccaacactccaggcc

SEQ ID NO: 3360338 - DNA, 15 bp, Homo sapiens
ccaacactgtgccct

SEQ ID NO: 3360339 - DNA, 20 bp, Homo sapiens
ccaacagaaacatgccagaa

SEQ ID NO: 3360340 - DNA, 18 bp, Homo sapiens
ccaacagaactaaatgtt

SEQ ID NO: 3360341 - DNA, 15 bp, Homo sapiens
ccaacagcacctccc

SEQ ID NO: 3360342 - DNA, 17 bp, Homo sapiens
ccaacagcacctccccg

SEQ ID NO: 3360343 - DNA, 22 bp, Homo sapiens
ccaacaggctgttctgcactga

SEQ ID NO: 3360344 - DNA, 12 bp, Homo sapiens
ccaacatctttg

SEQ ID NO: 3360345 - DNA, 17 bp, Homo sapiens
ccaacatgcactgatgt

SEQ ID NO: 3360346 - DNA, 14 bp, Homo sapiens
ccaaccacagagaa

SEQ ID NO: 3360347 - DNA, 21 bp, Homo sapiens
ccaaccacagcatcgggagca

SEQ ID NO: 3360348 - DNA, 15 bp, Homo sapiens
ccaaccagacagcac

SEQ ID NO: 3360349 - DNA, 21 bp, Homo sapiens
ccaaccagacagcacagggca

SEQ ID NO: 3360350 - DNA, 13 bp, Homo sapiens
ccaaccagcccga

SEQ ID NO: 3360351 - DNA, 20 bp, Homo sapiens
ccaaccagcccgacagtgcc

SEQ ID NO: 3360352 - DNA, 17 bp, Homo sapiens
ccaaccagtgccaagga

SEQ ID NO: 3360353 - DNA, 14 bp, Homo sapiens
ccaacccaataaaa

SEQ ID NO: 3360354 - DNA, 20 bp, Homo sapiens
ccaacccaataaaactgatg

SEQ ID NO: 3360355 - DNA, 19 bp, Homo sapiens
ccaacccacctctggccct

SEQ ID NO: 3360356 - DNA, 21 bp, Homo sapiens
ccaacccacctctggccctgt

SEQ ID NO: 3360357 - DNA, 16 bp, Homo sapiens
ccaacccccaccccac

SEQ ID NO: 3360358 - DNA, 17 bp, Homo sapiens
ccaacccccaccccaca

SEQ ID NO: 3360359 - DNA, 13 bp, Homo sapiens
ccaacccccctcc

SEQ ID NO: 3360360 - DNA, 17 bp, Homo sapiens
ccaacccccctcctgct

SEQ ID NO: 3360361 - DNA, 19 bp, Homo sapiens
ccaacccccctcctgctcc

SEQ ID NO: 3360362 - DNA, 20 bp, Homo sapiens
ccaacccccgccacctcagg

SEQ ID NO: 3360363 - DNA, 23 bp, Homo sapiens
ccaaccctatctcctgacagaag

SEQ ID NO: 3360364 - DNA, 17 bp, Homo sapiens
ccaaccctggcttgggg

SEQ ID NO: 3360365 - DNA, 18 bp, Homo sapiens
ccaaccctggggaaggag

SEQ ID NO: 3360366 - DNA, 16 bp, Homo sapiens
ccaaccgtgtctgtct

SEQ ID NO: 3360367 - DNA, 17 bp, Homo sapiens
ccaacctcagaggcagc

SEQ ID NO: 3360368 - DNA, 14 bp, Homo sapiens
ccaacctcagggct

SEQ ID NO: 3360369 - DNA, 18 bp, Homo sapiens
ccaacctcagggctccca

SEQ ID NO: 3360370 - DNA, 13 bp, Homo sapiens
ccaacctttaaaa

SEQ ID NO: 3360371 - DNA, 14 bp, Homo sapiens
ccaacgcccctgtg

SEQ ID NO: 3360372 - DNA, 18 bp, Homo sapiens
ccaacgcccctgtggcca

SEQ ID NO: 3360373 - DNA, 21 bp, Homo sapiens
ccaacgcccctgtggccaact

SEQ ID NO: 3360374 - DNA, 20 bp, Homo sapiens
ccaacggccctgcagccagc

SEQ ID NO: 3360375 - DNA, 19 bp, Homo sapiens
ccaacgttcgatttctacc

SEQ ID NO: 3360376 - DNA, 16 bp, Homo sapiens
ccaactagacattctg

SEQ ID NO: 3360377 - DNA, 15 bp, Homo sapiens
ccaactagcccctgg

SEQ ID NO: 3360378 - DNA, 17 bp, Homo sapiens
ccaactagcccctgggg

SEQ ID NO: 3360379 - DNA, 15 bp, Homo sapiens
ccaactccagcaact

SEQ ID NO: 3360380 - DNA, 12 bp, Homo sapiens
ccaactccagga

SEQ ID NO: 3360381 - DNA, 16 bp, Homo sapiens
ccaactcctaatttta

SEQ ID NO: 3360382 - DNA, 16 bp, Homo sapiens
ccaactctaacaggca

SEQ ID NO: 3360383 - DNA, 11 bp, Homo sapiens
ccaactctaat

SEQ ID NO: 3360384 - DNA, 14 bp, Homo sapiens
ccaactctcctggc

SEQ ID NO: 3360385 - DNA, 14 bp, Homo sapiens
ccaactctgagccc

SEQ ID NO: 3360386 - DNA, 13 bp, Homo sapiens
ccaactgtgttgt

SEQ ID NO: 3360387 - DNA, 21 bp, Homo sapiens
ccaactgtgttgtattaacaa

SEQ ID NO: 3360388 - DNA, 23 bp, Homo sapiens
ccaactgttcagctgtcctccct

SEQ ID NO: 3360389 - DNA, 17 bp, Homo sapiens
ccaactgtttccctgct

SEQ ID NO: 3360390 - DNA, 21 bp, Homo sapiens
ccaacttggttctgcttcaat

SEQ ID NO: 3360391 - DNA, 13 bp, Homo sapiens
ccaactttctgta

SEQ ID NO: 3360392 - DNA, 21 bp, Homo sapiens
ccaagaaagctcactgtagct

SEQ ID NO: 3360393 - DNA, 20 bp, Homo sapiens
ccaagaatagatgctgactg

SEQ ID NO: 3360394 - DNA, 21 bp, Homo sapiens
ccaagaatccacatttctaaa

SEQ ID NO: 3360395 - DNA, 13 bp, Homo sapiens
ccaagacaaatca

SEQ ID NO: 3360396 - DNA, 22 bp, Homo sapiens
ccaagacaaatcaacagaagca

SEQ ID NO: 3360397 - DNA, 18 bp, Homo sapiens
ccaagacagatgccccag

SEQ ID NO: 3360398 - DNA, 16 bp, Homo sapiens
ccaagacagtgagaca

SEQ ID NO: 3360399 - DNA, 22 bp, Homo sapiens
ccaagacagtgagacagtctgg

SEQ ID NO: 3360400 - DNA, 12 bp, Homo sapiens
ccaagacattgt

SEQ ID NO: 3360401 - DNA, 16 bp, Homo sapiens
ccaagacattgtcaat

SEQ ID NO: 3360402 - DNA, 16 bp, Homo sapiens
ccaagactcctcaggc

SEQ ID NO: 3360403 - DNA, 13 bp, Homo sapiens
ccaagactctaga

SEQ ID NO: 3360404 - DNA, 14 bp, Homo sapiens
ccaagactctagag

SEQ ID NO: 3360405 - DNA, 15 bp, Homo sapiens
ccaagactctagagt

SEQ ID NO: 3360406 - DNA, 18 bp, Homo sapiens
ccaagacttggcaacaga

SEQ ID NO: 3360407 - DNA, 22 bp, Homo sapiens
ccaagacttggcaacagaagca

SEQ ID NO: 3360408 - DNA, 19 bp, Homo sapiens
ccaagagcagaggcagcga

SEQ ID NO: 3360409 - DNA, 20 bp, Homo sapiens
ccaagagcagagtctgggcc

SEQ ID NO: 3360410 - DNA, 14 bp, Homo sapiens
ccaagaggtctgag

SEQ ID NO: 3360411 - DNA, 17 bp, Homo sapiens
ccaagagtaactttact

SEQ ID NO: 3360412 - DNA, 14 bp, Homo sapiens
ccaagataaaagaa

SEQ ID NO: 3360413 - DNA, 13 bp, Homo sapiens
ccaagataagcct

SEQ ID NO: 3360414 - DNA, 15 bp, Homo sapiens
ccaagataagcctga

SEQ ID NO: 3360415 - DNA, 17 bp, Homo sapiens
ccaagatctacaggaca

SEQ ID NO: 3360416 - DNA, 18 bp, Homo sapiens
ccaagatctacaggacaa

SEQ ID NO: 3360417 - DNA, 22 bp, Homo sapiens
ccaagattctactcttgtcatt

SEQ ID NO: 3360418 - DNA, 15 bp, Homo sapiens
ccaagattctagatg

SEQ ID NO: 3360419 - DNA, 16 bp, Homo sapiens
ccaagattctagatga

SEQ ID NO: 3360420 - DNA, 14 bp, Homo sapiens
ccaagcaagtagct

SEQ ID NO: 3360421 - DNA, 12 bp, Homo sapiens
ccaagcagccag

SEQ ID NO: 3360422 - DNA, 18 bp, Homo sapiens
ccaagcagccagccagtc

SEQ ID NO: 3360423 - DNA, 16 bp, Homo sapiens
ccacatctctgaaagc

SEQ ID NO: 3360424 - DNA, 14 bp, Homo sapiens
ccacatctgcctta

SEQ ID NO: 3360425 - DNA, 13 bp, Homo sapiens
ccacatctgctct

SEQ ID NO: 3360426 - DNA, 14 bp, Homo sapiens
ccacatcttgctct

SEQ ID NO: 3360427 - DNA, 20 bp, Homo sapiens
ccacatcttgctctgctgac

SEQ ID NO: 3360428 - DNA, 22 bp, Homo sapiens
ccacatcttgctctgctgacag

SEQ ID NO: 3360429 - DNA, 17 bp, Homo sapiens
ccacatgaggccatctc

SEQ ID NO: 3360430 - DNA, 20 bp, Homo sapiens
ccacatgaggccatctcagg

SEQ ID NO: 3360431 - DNA, 16 bp, Homo sapiens
ccacatggagccccct

SEQ ID NO: 3360432 - DNA, 20 bp, Homo sapiens
ccacatgtacagacatacat

SEQ ID NO: 3360433 - DNA, 14 bp, Homo sapiens
ccacatgtacataa

SEQ ID NO: 3360434 - DNA, 22 bp, Homo sapiens
ccacattgtacttttttttact

SEQ ID NO: 3360435 - DNA, 12 bp, Homo sapiens
ccaccaaagctg

SEQ ID NO: 3360436 - DNA, 13 bp, Homo sapiens
ccaccaacactgc

SEQ ID NO: 3360437 - DNA, 15 bp, Homo sapiens
ccaccaaccctcaga

SEQ ID NO: 3360438 - DNA, 17 bp, Homo sapiens
ccaccaagacttgtttt

SEQ ID NO: 3360439 - DNA, 15 bp, Homo sapiens
ccaccaagggatctg

SEQ ID NO: 3360440 - DNA, 16 bp, Homo sapiens
ccaccacacccagccc

SEQ ID NO: 3360441 - DNA, 17 bp, Homo sapiens
ccaccacaccgcagaag

SEQ ID NO: 3360442 - DNA, 14 bp, Homo sapiens
ccaccacagccagc

SEQ ID NO: 3360443 - DNA, 15 bp, Homo sapiens
ccaccacatctgcca

SEQ ID NO: 3360444 - DNA, 20 bp, Homo sapiens
ccaccacatctgccagacct

SEQ ID NO: 3360445 - DNA, 14 bp, Homo sapiens
ccaccaccactggc

SEQ ID NO: 3360446 - DNA, 16 bp, Homo sapiens
ccaccaccactggcca

SEQ ID NO: 3360447 - DNA, 18 bp, Homo sapiens
ccaccacccgaaatgcca

SEQ ID NO: 3360448 - DNA, 14 bp, Homo sapiens
ccaccacctctgtg

SEQ ID NO: 3360449 - DNA, 15 bp, Homo sapiens
ccaccacgtctgcca

SEQ ID NO: 3360450 - DNA, 18 bp, Homo sapiens
ccaccacgtctgccaggc

SEQ ID NO: 3360451 - DNA, 20 bp, Homo sapiens
ccaccacgtctgccaggccc

SEQ ID NO: 3360452 - DNA, 22 bp, Homo sapiens
ccaccacgtctgccaggcccat

SEQ ID NO: 3360453 - DNA, 20 bp, Homo sapiens
ccaccactaggactctgagg

SEQ ID NO: 3360454 - DNA, 14 bp, Homo sapiens
ccaccactggccac

SEQ ID NO: 3360455 - DNA, 20 bp, Homo sapiens
ccaccacttcaggggatggg

SEQ ID NO: 3360456 - DNA, 17 bp, Homo sapiens
ccaccagagaccgtcct

SEQ ID NO: 3360457 - DNA, 15 bp, Homo sapiens
ccaccagagactggg

SEQ ID NO: 3360458 - DNA, 21 bp, Homo sapiens
ccaccagcccgcaactctcca

SEQ ID NO: 3360459 - DNA, 19 bp, Homo sapiens
ccaccagccgccccagccc

SEQ ID NO: 3360460 - DNA, 21 bp, Homo sapiens
ccaccagccgccccagcccct

SEQ ID NO: 3360461 - DNA, 14 bp, Homo sapiens
ccaccatccccacc

SEQ ID NO: 3360462 - DNA, 15 bp, Homo sapiens
ccaccatcctgcagc

SEQ ID NO: 3360463 - DNA, 16 bp, Homo sapiens
ccaccatgcctcacta

SEQ ID NO: 3360464 - DNA, 16 bp, Homo sapiens
ccaccatggccagcca

SEQ ID NO: 3360465 - DNA, 21 bp, Homo sapiens
ccaccattcctggaaaccaca

SEQ ID NO: 3360466 - DNA, 12 bp, Homo sapiens
ccacccaagcct

SEQ ID NO: 3360467 - DNA, 18 bp, Homo sapiens
ccacccaagcctgctggc

SEQ ID NO: 3360468 - DNA, 13 bp, Homo sapiens
ccacccaccccac

SEQ ID NO: 3360469 - DNA, 11 bp, Homo sapiens
ccacccacctc

SEQ ID NO: 3360470 - DNA, 15 bp, Homo sapiens
ccacccacctcagcc

SEQ ID NO: 3360471 - DNA, 18 bp, Homo sapiens
ccacccacctccacccag

SEQ ID NO: 3360472 - DNA, 14 bp, Homo sapiens
ccacccagcccctg

SEQ ID NO: 3360473 - DNA, 18 bp, Homo sapiens
ccacccaggagggagggg

SEQ ID NO: 3360474 - DNA, 16 bp, Homo sapiens
ccacccaggctgcact

SEQ ID NO: 3360475 - DNA, 21 bp, Homo sapiens
ccacccaggctgcactgcagt

SEQ ID NO: 3360476 - DNA, 21 bp, Homo sapiens
ccacccatcttcctgctgctg

SEQ ID NO: 3360477 - DNA, 22 bp, Homo sapiens
ccacccatcttcctgctgctgt

SEQ ID NO: 3360478 - DNA, 16 bp, Homo sapiens
ccacccattcccccat

SEQ ID NO: 3360479 - DNA, 18 bp, Homo sapiens
ccaccccacgcccgcacc

SEQ ID NO: 3360480 - DNA, 13 bp, Homo sapiens
ccaccccactcta

SEQ ID NO: 3360481 - DNA, 21 bp, Homo sapiens
ccaccccactctacctcctta

SEQ ID NO: 3360482 - DNA, 17 bp, Homo sapiens
ccaccccatgtgccttt

SEQ ID NO: 3360483 - DNA, 14 bp, Homo sapiens
ccacccccagccag

SEQ ID NO: 3360484 - DNA, 13 bp, Homo sapiens
ccacccccagctc

SEQ ID NO: 3360485 - DNA, 13 bp, Homo sapiens
ccacccccatctt

SEQ ID NO: 3360486 - DNA, 15 bp, Homo sapiens
ccaccccctgccctg

SEQ ID NO: 3360487 - DNA, 20 bp, Homo sapiens
ccacccccttctctgctcca

SEQ ID NO: 3360488 - DNA, 17 bp, Homo sapiens
ccaccccgggctctctg

SEQ ID NO: 3360489 - DNA, 21 bp, Homo sapiens
ccaccccggggaccctgtgac

SEQ ID NO: 3360490 - DNA, 13 bp, Homo sapiens
ccacccctccaga

SEQ ID NO: 3360491 - DNA, 13 bp, Homo sapiens
ccacccctgtgct

SEQ ID NO: 3360492 - DNA, 22 bp, Homo sapiens
ccaccccttccccaggcccacc

SEQ ID NO: 3360493 - DNA, 19 bp, Homo sapiens
ccaccccttggaggagaga

SEQ ID NO: 3360494 - DNA, 20 bp, Homo sapiens
ccaccccttggaggagagag

SEQ ID NO: 3360495 - DNA, 21 bp, Homo sapiens
ccaccccttggaggagagaga

SEQ ID NO: 3360496 - DNA, 23 bp, Homo sapiens
ccaccccttggaggagagagacc

SEQ ID NO: 3360497 - DNA, 20 bp, Homo sapiens
ccacccgaggggggccccgg

SEQ ID NO: 3360498 - DNA, 14 bp, Homo sapiens
ccacccgatgctgc

SEQ ID NO: 3360499 - DNA, 17 bp, Homo sapiens
ccacccgatgctgcttt

SEQ ID NO: 3360500 - DNA, 21 bp, Homo sapiens
ccacccgccgcctcccacggc

SEQ ID NO: 3360501 - DNA, 11 bp, Homo sapiens
ccaccctcaca

SEQ ID NO: 3360502 - DNA, 14 bp, Homo sapiens
ccaccctcacacac

SEQ ID NO: 3360503 - DNA, 23 bp, Homo sapiens
ccaccctcacacacacagctggg

SEQ ID NO: 3360504 - DNA, 19 bp, Homo sapiens
ccaccctcagcaccccttc

SEQ ID NO: 3360505 - DNA, 16 bp, Homo sapiens
ccaccctcctcttgga

SEQ ID NO: 3360506 - DNA, 18 bp, Homo sapiens
ccaccctccttgagactg

SEQ ID NO: 3360507 - DNA, 21 bp, Homo sapiens
ccaccctgccccccctaagag

SEQ ID NO: 3360508 - DNA, 13 bp, Homo sapiens
ccaccctgctctc

SEQ ID NO: 3360509 - DNA, 16 bp, Homo sapiens
ccaccctgctgccttc

SEQ ID NO: 3360510 - DNA, 13 bp, Homo sapiens
ccaccctgggccc

SEQ ID NO: 3360511 - DNA, 22 bp, Homo sapiens
ccaccctgggccctgggctgga

SEQ ID NO: 3360512 - DNA, 11 bp, Homo sapiens
ccaccctgggg

SEQ ID NO: 3360513 - DNA, 21 bp, Homo sapiens
ccaccctgtacctcatcccat

SEQ ID NO: 3360514 - DNA, 13 bp, Homo sapiens
ccaccctgtgcca

SEQ ID NO: 3360515 - DNA, 12 bp, Homo sapiens
ccacccttggcc

SEQ ID NO: 3360516 - DNA, 13 bp, Homo sapiens
ccacccttggcct

SEQ ID NO: 3360517 - DNA, 16 bp, Homo sapiens
ccacccttggcctgtc

SEQ ID NO: 3360518 - DNA, 18 bp, Homo sapiens
ccaccgaagccgcctgtg

SEQ ID NO: 3360519 - DNA, 14 bp, Homo sapiens
ccaccgatggagcc

SEQ ID NO: 3360520 - DNA, 17 bp, Homo sapiens
ccaccgatggagccccc

SEQ ID NO: 3360521 - DNA, 13 bp, Homo sapiens
ccaccgcccagag

SEQ ID NO: 3360522 - DNA, 12 bp, Homo sapiens
ccaccgccccca

SEQ ID NO: 3360523 - DNA, 14 bp, Homo sapiens
ccaccgctgccagc

SEQ ID NO: 3360524 - DNA, 20 bp, Homo sapiens
ccaccgctgccagcacagag

SEQ ID NO: 3360525 - DNA, 19 bp, Homo sapiens
ccaccgctgctccacgcgc

SEQ ID NO: 3360526 - DNA, 22 bp, Homo sapiens
ccaccgggagcctccccctcag

SEQ ID NO: 3360527 - DNA, 15 bp, Homo sapiens
ccaccggtccagctg

SEQ ID NO: 3360528 - DNA, 14 bp, Homo sapiens
ccaccgtccgccct

SEQ ID NO: 3360529 - DNA, 15 bp, Homo sapiens
ccaccgtccgccctg

SEQ ID NO: 3360530 - DNA, 17 bp, Homo sapiens
ccaccgtccgccctgct

SEQ ID NO: 3360531 - DNA, 18 bp, Homo sapiens
ccaccgtccgccctgctc

SEQ ID NO: 3360532 - DNA, 18 bp, Homo sapiens
ccaccgttcaagcgccag

SEQ ID NO: 3360533 - DNA, 23 bp, Homo sapiens
ccacctaattcgatgaaggctgc

SEQ ID NO: 3360534 - DNA, 17 bp, Homo sapiens
ccacctacttgtgactg

SEQ ID NO: 3360535 - DNA, 19 bp, Homo sapiens
ccacctacttgtgactgaa

SEQ ID NO: 3360536 - DNA, 14 bp, Homo sapiens
ccacctagaacact

SEQ ID NO: 3360537 - DNA, 18 bp, Homo sapiens
ccacctagaacactaact

SEQ ID NO: 3360538 - DNA, 14 bp, Homo sapiens
ccacctagcccagg

SEQ ID NO: 3360539 - DNA, 17 bp, Homo sapiens
ccacctagcccaggaga

SEQ ID NO: 3360540 - DNA, 21 bp, Homo sapiens
ccacctatctcgtgggagagc

SEQ ID NO: 3360541 - DNA, 14 bp, Homo sapiens
ccacctcagcctcc

SEQ ID NO: 3360542 - DNA, 15 bp, Homo sapiens
ccacctcagcctccc

SEQ ID NO: 3360543 - DNA, 21 bp, Homo sapiens
ccacctccaccacatctgcca

SEQ ID NO: 3360544 - DNA, 18 bp, Homo sapiens
ccacctccacccagcccc

SEQ ID NO: 3360545 - DNA, 19 bp, Homo sapiens
ccacctccacccagcccct

SEQ ID NO: 3360546 - DNA, 22 bp, Homo sapiens
ccacctccacccagcccctggc

SEQ ID NO: 3360547 - DNA, 18 bp, Homo sapiens
ccacctccagcccgggag

SEQ ID NO: 3360548 - DNA, 20 bp, Homo sapiens
ccacctccagcccgggagcc

SEQ ID NO: 3360549 - DNA, 14 bp, Homo sapiens
ccacctccagtccc

SEQ ID NO: 3360550 - DNA, 20 bp, Homo sapiens
ccagagagggcccagctgta

SEQ ID NO: 3360551 - DNA, 17 bp, Homo sapiens
ccagagaggggctgctc

SEQ ID NO: 3360552 - DNA, 14 bp, Homo sapiens
ccagagagggtggt

SEQ ID NO: 3360553 - DNA, 14 bp, Homo sapiens
ccagagagtggctc

SEQ ID NO: 3360554 - DNA, 22 bp, Homo sapiens
ccagagagtggctcctcccggt

SEQ ID NO: 3360555 - DNA, 14 bp, Homo sapiens
ccagagatgccagc

SEQ ID NO: 3360556 - DNA, 19 bp, Homo sapiens
ccagagatgccagcccttc

SEQ ID NO: 3360557 - DNA, 13 bp, Homo sapiens
ccagagcaaaata

SEQ ID NO: 3360558 - DNA, 21 bp, Homo sapiens
ccagagcaacctctcactccc

SEQ ID NO: 3360559 - DNA, 12 bp, Homo sapiens
ccagagcacccc

SEQ ID NO: 3360560 - DNA, 23 bp, Homo sapiens
ccagagcaccccctgctccacca

SEQ ID NO: 3360561 - DNA, 14 bp, Homo sapiens
ccagagcagatgca

SEQ ID NO: 3360562 - DNA, 18 bp, Homo sapiens
ccagagcagatgcagaga

SEQ ID NO: 3360563 - DNA, 20 bp, Homo sapiens
ccagagcagatgcagagagc

SEQ ID NO: 3360564 - DNA, 22 bp, Homo sapiens
ccagagcatttccaacaccaca

SEQ ID NO: 3360565 - DNA, 11 bp, Homo sapiens
ccagagccaaa

SEQ ID NO: 3360566 - DNA, 13 bp, Homo sapiens
ccagagccacctg

SEQ ID NO: 3360567 - DNA, 18 bp, Homo sapiens
ccagagccacctggatct

SEQ ID NO: 3360568 - DNA, 11 bp, Homo sapiens
ccagagccaga

SEQ ID NO: 3360569 - DNA, 13 bp, Homo sapiens
ccagagccagcct

SEQ ID NO: 3360570 - DNA, 16 bp, Homo sapiens
ccagagcccaccttgg

SEQ ID NO: 3360571 - DNA, 18 bp, Homo sapiens
ccagagccccacacggag

SEQ ID NO: 3360572 - DNA, 21 bp, Homo sapiens
ccagagcccttcactgccatg

SEQ ID NO: 3360573 - DNA, 22 bp, Homo sapiens
ccagagcccttcactgccatga

SEQ ID NO: 3360574 - DNA, 19 bp, Homo sapiens
ccagagccttcaagtgcca

SEQ ID NO: 3360575 - DNA, 22 bp, Homo sapiens
ccagagccttcaagtgccaaac

SEQ ID NO: 3360576 - DNA, 19 bp, Homo sapiens
ccagagcggaggctgtgtg

SEQ ID NO: 3360577 - DNA, 15 bp, Homo sapiens
ccagagctgccgact

SEQ ID NO: 3360578 - DNA, 13 bp, Homo sapiens
ccagagctggaag

SEQ ID NO: 3360579 - DNA, 17 bp, Homo sapiens
ccagagctggaaggcag

SEQ ID NO: 3360580 - DNA, 20 bp, Homo sapiens
ccagagctgggtggggacag

SEQ ID NO: 3360581 - DNA, 12 bp, Homo sapiens
ccagagctgtgc

SEQ ID NO: 3360582 - DNA, 13 bp, Homo sapiens
ccagagctgtgcc

SEQ ID NO: 3360583 - DNA, 15 bp, Homo sapiens
ccagagctgtgccag

SEQ ID NO: 3360584 - DNA, 19 bp, Homo sapiens
ccagagctgtgccagcagg

SEQ ID NO: 3360585 - DNA, 24 bp, Homo sapiens
ccagagctgtttatggcctcagct

SEQ ID NO: 3360586 - DNA, 19 bp, Homo sapiens
ccagagctttgttttatat

SEQ ID NO: 3360587 - DNA, 21 bp, Homo sapiens
ccagaggaatcctggcagccc

SEQ ID NO: 3360588 - DNA, 22 bp, Homo sapiens
ccagaggaatcctggcagccca

SEQ ID NO: 3360589 - DNA, 17 bp, Homo sapiens
ccagaggagccaccagt

SEQ ID NO: 3360590 - DNA, 17 bp, Homo sapiens
ccagaggccctggaggt

SEQ ID NO: 3360591 - DNA, 21 bp, Homo sapiens
ccagaggccgaaggtgcctca

SEQ ID NO: 3360592 - DNA, 22 bp, Homo sapiens
ccagaggccgaaggtgcctcag

SEQ ID NO: 3360593 - DNA, 19 bp, Homo sapiens
ccagaggctattattttca

SEQ ID NO: 3360594 - DNA, 13 bp, Homo sapiens
ccagagggagcag

SEQ ID NO: 3360595 - DNA, 14 bp, Homo sapiens
ccagagggagcagg

SEQ ID NO: 3360596 - DNA, 18 bp, Homo sapiens
ccagagggagtgacagag

SEQ ID NO: 3360597 - DNA, 19 bp, Homo sapiens
ccagagggagtgacagagg

SEQ ID NO: 3360598 - DNA, 23 bp, Homo sapiens
ccagaggggaaggagggtacagc

SEQ ID NO: 3360599 - DNA, 17 bp, Homo sapiens
ccagaggtaacagaaca

SEQ ID NO: 3360600 - DNA, 14 bp, Homo sapiens
ccagaggtccagcc

SEQ ID NO: 3360601 - DNA, 15 bp, Homo sapiens
ccagaggtccagccc

SEQ ID NO: 3360602 - DNA, 12 bp, Homo sapiens
ccagaggtgctt

SEQ ID NO: 3360603 - DNA, 22 bp, Homo sapiens
ccagaggtgggcaggtggtggc

SEQ ID NO: 3360604 - DNA, 22 bp, Homo sapiens
ccagaggttatctgcctggcct

SEQ ID NO: 3360605 - DNA, 23 bp, Homo sapiens
ccagaggttatctgcctggcctg

SEQ ID NO: 3360606 - DNA, 17 bp, Homo sapiens
ccagagtcagaggagaa

SEQ ID NO: 3360607 - DNA, 21 bp, Homo sapiens
ccagagtcctttccaaggctt

SEQ ID NO: 3360608 - DNA, 16 bp, Homo sapiens
ccagagtctgagcccc

SEQ ID NO: 3360609 - DNA, 18 bp, Homo sapiens
ccagagtctgagcccccg

SEQ ID NO: 3360610 - DNA, 23 bp, Homo sapiens
ccagagtctgagcccccggctag

SEQ ID NO: 3360611 - DNA, 13 bp, Homo sapiens
ccagagtggcctg

SEQ ID NO: 3360612 - DNA, 16 bp, Homo sapiens
ccagagtggcctggcc

SEQ ID NO: 3360613 - DNA, 14 bp, Homo sapiens
ccagataagaatgc

SEQ ID NO: 3360614 - DNA, 13 bp, Homo sapiens
ccagataccagcc

SEQ ID NO: 3360615 - DNA, 21 bp, Homo sapiens
ccagatacttcccattttgga

SEQ ID NO: 3360616 - DNA, 13 bp, Homo sapiens
ccagatagagaaa

SEQ ID NO: 3360617 - DNA, 20 bp, Homo sapiens
ccagatagtgtagctgagga

SEQ ID NO: 3360618 - DNA, 14 bp, Homo sapiens
ccagatataaaata

SEQ ID NO: 3360619 - DNA, 21 bp, Homo sapiens
ccagatcaccagcccggcctg

SEQ ID NO: 3360620 - DNA, 15 bp, Homo sapiens
ccagatcactgccac

SEQ ID NO: 3360621 - DNA, 16 bp, Homo sapiens
ccagatccagactgta

SEQ ID NO: 3360622 - DNA, 17 bp, Homo sapiens
ccagatccagactgtaa

SEQ ID NO: 3360623 - DNA, 20 bp, Homo sapiens
ccagatccagtatcttgttt

SEQ ID NO: 3360624 - DNA, 18 bp, Homo sapiens
ccagatcgatcctggatt

SEQ ID NO: 3360625 - DNA, 17 bp, Homo sapiens
ccagatctgcctgggcc

SEQ ID NO: 3360626 - DNA, 18 bp, Homo sapiens
ccagatctgcctgggcct

SEQ ID NO: 3360627 - DNA, 14 bp, Homo sapiens
ccagatgcaacctc

SEQ ID NO: 3360628 - DNA, 18 bp, Homo sapiens
ccagatgcacatccctgg

SEQ ID NO: 3360629 - DNA, 18 bp, Homo sapiens
ccagatgcaccagccctt

SEQ ID NO: 3360630 - DNA, 14 bp, Homo sapiens
ccagatgcaggaca

SEQ ID NO: 3360631 - DNA, 17 bp, Homo sapiens
ccagatgcaggacagga

SEQ ID NO: 3360632 - DNA, 17 bp, Homo sapiens
ccagatggactccagcc

SEQ ID NO: 3360633 - DNA, 19 bp, Homo sapiens
ccagatggcccctccactg

SEQ ID NO: 3360634 - DNA, 18 bp, Homo sapiens
ccagattgacgacaagtg

SEQ ID NO: 3360635 - DNA, 19 bp, Homo sapiens
ccagattgacgacaagtgc

SEQ ID NO: 3360636 - DNA, 18 bp, Homo sapiens
ccagcaacttgtcttttt

SEQ ID NO: 3360637 - DNA, 21 bp, Homo sapiens
ccagcaagaataaaaaagaaa

SEQ ID NO: 3360638 - DNA, 18 bp, Homo sapiens
ccagcaagagggaacaaa

SEQ ID NO: 3360639 - DNA, 20 bp, Homo sapiens
ccagcaagcgggagcccgtg

SEQ ID NO: 3360640 - DNA, 13 bp, Homo sapiens
ccagcaaggcagg

SEQ ID NO: 3360641 - DNA, 20 bp, Homo sapiens
ccagcaagtgagagctgggt

SEQ ID NO: 3360642 - DNA, 22 bp, Homo sapiens
ccagcaagtgagagctgggtgt

SEQ ID NO: 3360643 - DNA, 18 bp, Homo sapiens
ccagcaatgatgtccaga

SEQ ID NO: 3360644 - DNA, 21 bp, Homo sapiens
ccagcaattcataaaaactgc

SEQ ID NO: 3360645 - DNA, 18 bp, Homo sapiens
ccagcacagagcgtcctt

SEQ ID NO: 3360646 - DNA, 19 bp, Homo sapiens
ccagcacagcttagatttc

SEQ ID NO: 3360647 - DNA, 22 bp, Homo sapiens
ccagcacagcttagatttcata

SEQ ID NO: 3360648 - DNA, 17 bp, Homo sapiens
ccagcacagcttgacct

SEQ ID NO: 3360649 - DNA, 15 bp, Homo sapiens
ccagcacaggggccc

SEQ ID NO: 3360650 - DNA, 18 bp, Homo sapiens
ccagcacaggggccccag

SEQ ID NO: 3360651 - DNA, 19 bp, Homo sapiens
ccagcaccctctcctgggg

SEQ ID NO: 3360652 - DNA, 20 bp, Homo sapiens
ccagcaccctctcctggggg

SEQ ID NO: 3360653 - DNA, 19 bp, Homo sapiens
ccagcaccttctttctgga

SEQ ID NO: 3360654 - DNA, 22 bp, Homo sapiens
ccagcactaaggccgtgtctct

SEQ ID NO: 3360655 - DNA, 17 bp, Homo sapiens
ccagcactccccttgcc

SEQ ID NO: 3360656 - DNA, 15 bp, Homo sapiens
ccagcactgtctcag

SEQ ID NO: 3360657 - DNA, 11 bp, Homo sapiens
ccagcactttg

SEQ ID NO: 3360658 - DNA, 14 bp, Homo sapiens
ccagcactttggga

SEQ ID NO: 3360659 - DNA, 17 bp, Homo sapiens
ccagcactttgggaggc

SEQ ID NO: 3360660 - DNA, 20 bp, Homo sapiens
ccagcactttgggaggccga

SEQ ID NO: 3360661 - DNA, 19 bp, Homo sapiens
ccagcactttgggaggcct

SEQ ID NO: 3360662 - DNA, 20 bp, Homo sapiens
ccagcactttgggaggctga

SEQ ID NO: 3360663 - DNA, 21 bp, Homo sapiens
ccagcactttgggaggctgag

SEQ ID NO: 3360664 - DNA, 13 bp, Homo sapiens
ccagcagcatggc

SEQ ID NO: 3360665 - DNA, 12 bp, Homo sapiens
ccagcagcccta

SEQ ID NO: 3360666 - DNA, 22 bp, Homo sapiens
ccagcagccctcaacaggccca

SEQ ID NO: 3360667 - DNA, 24 bp, Homo sapiens
ccagcagctgcgggtctgaaggaa

SEQ ID NO: 3360668 - DNA, 22 bp, Homo sapiens
ccagcaggccagggactcagcg

SEQ ID NO: 3360669 - DNA, 13 bp, Homo sapiens
ccagcatacattt

SEQ ID NO: 3360670 - DNA, 17 bp, Homo sapiens
ccagcatccagcctgtg

SEQ ID NO: 3360671 - DNA, 18 bp, Homo sapiens
ccagcatccagcctgtgt

SEQ ID NO: 3360672 - DNA, 15 bp, Homo sapiens
ccagcatccctggag

SEQ ID NO: 3360673 - DNA, 16 bp, Homo sapiens
ccagcatccctggagc

SEQ ID NO: 3360674 - DNA, 21 bp, Homo sapiens
ccagcatccttttctgcagag

SEQ ID NO: 3360675 - DNA, 21 bp, Homo sapiens
ccaggagtttgagacaagccc

SEQ ID NO: 3360676 - DNA, 21 bp, Homo sapiens
ccaggagtttgaggctgcagc

SEQ ID NO: 3360677 - DNA, 22 bp, Homo sapiens
ccaggataaggagactgaggct

SEQ ID NO: 3360678 - DNA, 17 bp, Homo sapiens
ccaggatactggcacag

SEQ ID NO: 3360679 - DNA, 20 bp, Homo sapiens
ccaggatcatggtgtaataa

SEQ ID NO: 3360680 - DNA, 23 bp, Homo sapiens
ccaggatcatggtgtaataagac

SEQ ID NO: 3360681 - DNA, 18 bp, Homo sapiens
ccaggatcccaagcctcc

SEQ ID NO: 3360682 - DNA, 14 bp, Homo sapiens
ccaggatcctgcag

SEQ ID NO: 3360683 - DNA, 16 bp, Homo sapiens
ccaggatctttgactg

SEQ ID NO: 3360684 - DNA, 20 bp, Homo sapiens
ccaggatctttgactgaaaa

SEQ ID NO: 3360685 - DNA, 21 bp, Homo sapiens
ccaggatgataagttcctttc

SEQ ID NO: 3360686 - DNA, 14 bp, Homo sapiens
ccaggatgcccaga

SEQ ID NO: 3360687 - DNA, 18 bp, Homo sapiens
ccaggatgctgggtggcc

SEQ ID NO: 3360688 - DNA, 22 bp, Homo sapiens
ccaggatggtctcgatctcctg

SEQ ID NO: 3360689 - DNA, 20 bp, Homo sapiens
ccaggattattgtcaaagaa

SEQ ID NO: 3360690 - DNA, 17 bp, Homo sapiens
ccaggattcccccagcc

SEQ ID NO: 3360691 - DNA, 13 bp, Homo sapiens
ccaggatttctaa

SEQ ID NO: 3360692 - DNA, 13 bp, Homo sapiens
ccaggcacagggc

SEQ ID NO: 3360693 - DNA, 15 bp, Homo sapiens
ccaggcacagggccc

SEQ ID NO: 3360694 - DNA, 17 bp, Homo sapiens
ccaggcacagggcccgc

SEQ ID NO: 3360695 - DNA, 22 bp, Homo sapiens
ccaggcacccttctttcctctt

SEQ ID NO: 3360696 - DNA, 16 bp, Homo sapiens
ccaggcacctggcctg

SEQ ID NO: 3360697 - DNA, 19 bp, Homo sapiens
ccaggcacctggcctgctg

SEQ ID NO: 3360698 - DNA, 22 bp, Homo sapiens
ccaggcacctggcctgctggga

SEQ ID NO: 3360699 - DNA, 13 bp, Homo sapiens
ccaggcactgcct

SEQ ID NO: 3360700 - DNA, 19 bp, Homo sapiens
ccaggcactgccttctcct

SEQ ID NO: 3360701 - DNA, 16 bp, Homo sapiens
ccaggcactgctgccc

SEQ ID NO: 3360702 - DNA, 17 bp, Homo sapiens
ccaggcagagctgacgg

SEQ ID NO: 3360703 - DNA, 23 bp, Homo sapiens
ccaggcagagctgacgggaggcc

SEQ ID NO: 3360704 - DNA, 13 bp, Homo sapiens
ccaggcagatctg

SEQ ID NO: 3360705 - DNA, 22 bp, Homo sapiens
ccaggcaggggtgggggtggag

SEQ ID NO: 3360706 - DNA, 14 bp, Homo sapiens
ccaggcaggtagcc

SEQ ID NO: 3360707 - DNA, 23 bp, Homo sapiens
ccaggcaggtcttgaactcctgg

SEQ ID NO: 3360708 - DNA, 17 bp, Homo sapiens
ccaggcaggtgcctgga

SEQ ID NO: 3360709 - DNA, 19 bp, Homo sapiens
ccaggcagtcgggggctgg

SEQ ID NO: 3360710 - DNA, 17 bp, Homo sapiens
ccaggcatctccttggg

SEQ ID NO: 3360711 - DNA, 16 bp, Homo sapiens
ccaggccaacagcacc

SEQ ID NO: 3360712 - DNA, 17 bp, Homo sapiens
ccaggccacagccgcct

SEQ ID NO: 3360713 - DNA, 18 bp, Homo sapiens
ccaggccacagccgcctt

SEQ ID NO: 3360714 - DNA, 16 bp, Homo sapiens
ccaggccacctcccca

SEQ ID NO: 3360715 - DNA, 14 bp, Homo sapiens
ccaggccactgtgg

SEQ ID NO: 3360716 - DNA, 15 bp, Homo sapiens
ccaggccactgtggc

SEQ ID NO: 3360717 - DNA, 21 bp, Homo sapiens
ccaggccactgtggccagagc

SEQ ID NO: 3360718 - DNA, 11 bp, Homo sapiens
ccaggccagcc

SEQ ID NO: 3360719 - DNA, 19 bp, Homo sapiens
ccaggccagcctccgagag

SEQ ID NO: 3360720 - DNA, 23 bp, Homo sapiens
ccaggccagcctccgagagggag

SEQ ID NO: 3360721 - DNA, 15 bp, Homo sapiens
ccaggccaggaccac

SEQ ID NO: 3360722 - DNA, 21 bp, Homo sapiens
ccaggccaggaccacacagtc

SEQ ID NO: 3360723 - DNA, 18 bp, Homo sapiens
ccaggcccaaggctcccg

SEQ ID NO: 3360724 - DNA, 12 bp, Homo sapiens
ccaggcccacca

SEQ ID NO: 3360725 - DNA, 17 bp, Homo sapiens
ccaggcccaccatcacc

SEQ ID NO: 3360726 - DNA, 23 bp, Homo sapiens
ccaggcccaccatcaccaccgcc

SEQ ID NO: 3360727 - DNA, 14 bp, Homo sapiens
ccaggcccaggcag

SEQ ID NO: 3360728 - DNA, 17 bp, Homo sapiens
ccaggcccaggcagagc

SEQ ID NO: 3360729 - DNA, 14 bp, Homo sapiens
ccaggcccatctca

SEQ ID NO: 3360730 - DNA, 17 bp, Homo sapiens
ccaggcccctgaggact

SEQ ID NO: 3360731 - DNA, 23 bp, Homo sapiens
ccaggcccctgaggactggagac

SEQ ID NO: 3360732 - DNA, 13 bp, Homo sapiens
ccaggcccctgcc

SEQ ID NO: 3360733 - DNA, 16 bp, Homo sapiens
ccaggcccctgccacc

SEQ ID NO: 3360734 - DNA, 21 bp, Homo sapiens
ccaggcccctgccaccctggg

SEQ ID NO: 3360735 - DNA, 21 bp, Homo sapiens
ccaggccctccagtgggctga

SEQ ID NO: 3360736 - DNA, 16 bp, Homo sapiens
ccaggccctccatggg

SEQ ID NO: 3360737 - DNA, 17 bp, Homo sapiens
ccaggccctccctgact

SEQ ID NO: 3360738 - DNA, 19 bp, Homo sapiens
ccaggccctcctctcccat

SEQ ID NO: 3360739 - DNA, 14 bp, Homo sapiens
ccaggccgcagctc

SEQ ID NO: 3360740 - DNA, 14 bp, Homo sapiens
ccaggccggccagc

SEQ ID NO: 3360741 - DNA, 15 bp, Homo sapiens
ccaggccggccagcc

SEQ ID NO: 3360742 - DNA, 17 bp, Homo sapiens
ccaggcctccagcctct

SEQ ID NO: 3360743 - DNA, 18 bp, Homo sapiens
ccaggcctccagcctctc

SEQ ID NO: 3360744 - DNA, 16 bp, Homo sapiens
ccaggcctctgtgtcc

SEQ ID NO: 3360745 - DNA, 17 bp, Homo sapiens
ccaggcctctgtgtcct

SEQ ID NO: 3360746 - DNA, 13 bp, Homo sapiens
ccaggcctgcagc

SEQ ID NO: 3360747 - DNA, 18 bp, Homo sapiens
ccaggcctgcagcaggag

SEQ ID NO: 3360748 - DNA, 18 bp, Homo sapiens
ccaggcctgggtctgtgt

SEQ ID NO: 3360749 - DNA, 13 bp, Homo sapiens
ccaggcctgttgc

SEQ ID NO: 3360750 - DNA, 18 bp, Homo sapiens
ccaggcgccccttccccc

SEQ ID NO: 3360751 - DNA, 15 bp, Homo sapiens
ccaggcgcctgcgct

SEQ ID NO: 3360752 - DNA, 18 bp, Homo sapiens
ccaggcgcgtgtaaatgg

SEQ ID NO: 3360753 - DNA, 21 bp, Homo sapiens
ccaggcgggagcggtggccct

SEQ ID NO: 3360754 - DNA, 18 bp, Homo sapiens
ccaggcgttggtgccact

SEQ ID NO: 3360755 - DNA, 20 bp, Homo sapiens
ccaggctagtccggacccac

SEQ ID NO: 3360756 - DNA, 23 bp, Homo sapiens
ccaggctagtccggacccacctc

SEQ ID NO: 3360757 - DNA, 18 bp, Homo sapiens
ccaggctatggttgccac

SEQ ID NO: 3360758 - DNA, 21 bp, Homo sapiens
ccaggctatggttgccacccc

SEQ ID NO: 3360759 - DNA, 21 bp, Homo sapiens
ccaggctccctttctcttctt

SEQ ID NO: 3360760 - DNA, 21 bp, Homo sapiens
ccaggctcctttagcgcccag

SEQ ID NO: 3360761 - DNA, 18 bp, Homo sapiens
ccaggctcttcctggacc

SEQ ID NO: 3360762 - DNA, 13 bp, Homo sapiens
ccaggctgatgct

SEQ ID NO: 3360763 - DNA, 13 bp, Homo sapiens
ccaggctgcactg

SEQ ID NO: 3360764 - DNA, 16 bp, Homo sapiens
ccaggctgcactgcag

SEQ ID NO: 3360765 - DNA, 19 bp, Homo sapiens
ccaggctgcactgcagtga

SEQ ID NO: 3360766 - DNA, 20 bp, Homo sapiens
ccaggctgccaaggccagag

SEQ ID NO: 3360767 - DNA, 18 bp, Homo sapiens
ccaggctggcgcagccaa

SEQ ID NO: 3360768 - DNA, 23 bp, Homo sapiens
ccaggctggcgcagccaaggccg

SEQ ID NO: 3360769 - DNA, 12 bp, Homo sapiens
ccaggctggcgt

SEQ ID NO: 3360770 - DNA, 15 bp, Homo sapiens
ccaggctgtgcagcg

SEQ ID NO: 3360771 - DNA, 21 bp, Homo sapiens
ccaggctgtgggcctcaagga

SEQ ID NO: 3360772 - DNA, 22 bp, Homo sapiens
ccaggctgtgggcctcaaggac

SEQ ID NO: 3360773 - DNA, 18 bp, Homo sapiens
ccaggcttcaccctgaat

SEQ ID NO: 3360774 - DNA, 17 bp, Homo sapiens
ccagggaagctgtccct

SEQ ID NO: 3360775 - DNA, 22 bp, Homo sapiens
ccagggaatcagggaccagctt

SEQ ID NO: 3360776 - DNA, 16 bp, Homo sapiens
ccagggagcaagacag

SEQ ID NO: 3360777 - DNA, 18 bp, Homo sapiens
ccagggagcaagacagag

SEQ ID NO: 3360778 - DNA, 14 bp, Homo sapiens
ccagggagcctttg

SEQ ID NO: 3360779 - DNA, 15 bp, Homo sapiens
ccagggaggagagga

SEQ ID NO: 3360780 - DNA, 19 bp, Homo sapiens
ccagggagggaagtgtgag

SEQ ID NO: 3360781 - DNA, 20 bp, Homo sapiens
ccagggagggaagtgtgagc

SEQ ID NO: 3360782 - DNA, 14 bp, Homo sapiens
ccagggatgctggg

SEQ ID NO: 3360783 - DNA, 17 bp, Homo sapiens
ccagggatgctgggctg

SEQ ID NO: 3360784 - DNA, 21 bp, Homo sapiens
ccagggatgctgggctgggcc

SEQ ID NO: 3360785 - DNA, 21 bp, Homo sapiens
ccagggcagggtgggcagcct

SEQ ID NO: 3360786 - DNA, 23 bp, Homo sapiens
ccagggcagggtgggcagcctat

SEQ ID NO: 3360787 - DNA, 17 bp, Homo sapiens
ccagggcagtgctagtg

SEQ ID NO: 3360788 - DNA, 19 bp, Homo sapiens
ccagggcattcgggccaca

SEQ ID NO: 3360789 - DNA, 23 bp, Homo sapiens
ccagggcattcgggccacagggc

SEQ ID NO: 3360790 - DNA, 19 bp, Homo sapiens
ccagggccacgctccagct

SEQ ID NO: 3360791 - DNA, 16 bp, Homo sapiens
ccagggccagggccct

SEQ ID NO: 3360792 - DNA, 21 bp, Homo sapiens
ccagggcccctccctctgccc

SEQ ID NO: 3360793 - DNA, 23 bp, Homo sapiens
ccagggcccctccctctgcccca

SEQ ID NO: 3360794 - DNA, 12 bp, Homo sapiens
ccagggccctgg

SEQ ID NO: 3360795 - DNA, 16 bp, Homo sapiens
ccagggccgaggaggt

SEQ ID NO: 3360796 - DNA, 17 bp, Homo sapiens
ccagggcctactgccac

SEQ ID NO: 3360797 - DNA, 16 bp, Homo sapiens
ccagggcctgcatggg

SEQ ID NO: 3360798 - DNA, 19 bp, Homo sapiens
ccagggcctgggggcagtg

SEQ ID NO: 3360799 - DNA, 18 bp, Homo sapiens
ccagggcgctgggaaggg

SEQ ID NO: 3360800 - DNA, 18 bp, Homo sapiens
ccatctcagcctcctgag

SEQ ID NO: 3360801 - DNA, 23 bp, Homo sapiens
ccatctcagcctcctgagcctgt

SEQ ID NO: 3360802 - DNA, 23 bp, Homo sapiens
ccatctcaggagatggagggctt

SEQ ID NO: 3360803 - DNA, 14 bp, Homo sapiens
ccatctcatcctgg

SEQ ID NO: 3360804 - DNA, 19 bp, Homo sapiens
ccatctccccaggcctcca

SEQ ID NO: 3360805 - DNA, 23 bp, Homo sapiens
ccatctccccaggcctccagcct

SEQ ID NO: 3360806 - DNA, 17 bp, Homo sapiens
ccatctccctgcctggc

SEQ ID NO: 3360807 - DNA, 22 bp, Homo sapiens
ccatctcctataatctgtcaaa

SEQ ID NO: 3360808 - DNA, 13 bp, Homo sapiens
ccatctcggagca

SEQ ID NO: 3360809 - DNA, 15 bp, Homo sapiens
ccatctctactaaaa

SEQ ID NO: 3360810 - DNA, 17 bp, Homo sapiens
ccatctctccctcccct

SEQ ID NO: 3360811 - DNA, 13 bp, Homo sapiens
ccatctcttccta

SEQ ID NO: 3360812 - DNA, 23 bp, Homo sapiens
ccatctgcaccccttctctcctc

SEQ ID NO: 3360813 - DNA, 12 bp, Homo sapiens
ccatctgcccag

SEQ ID NO: 3360814 - DNA, 20 bp, Homo sapiens
ccatctgcccaggggtgccc

SEQ ID NO: 3360815 - DNA, 21 bp, Homo sapiens
ccatctgcccaggggtgcccc

SEQ ID NO: 3360816 - DNA, 22 bp, Homo sapiens
ccatctgcccaggggtgccccc

SEQ ID NO: 3360817 - DNA, 18 bp, Homo sapiens
ccatctgcctgttctgag

SEQ ID NO: 3360818 - DNA, 23 bp, Homo sapiens
ccatctgcttttattaaatttgt

SEQ ID NO: 3360819 - DNA, 13 bp, Homo sapiens
ccatctggcctgg

SEQ ID NO: 3360820 - DNA, 15 bp, Homo sapiens
ccatctggcctggcc

SEQ ID NO: 3360821 - DNA, 22 bp, Homo sapiens
ccatctggcctggcctggccct

SEQ ID NO: 3360822 - DNA, 15 bp, Homo sapiens
ccatctgtgtcctgg

SEQ ID NO: 3360823 - DNA, 20 bp, Homo sapiens
ccatcttcactggcttccat

SEQ ID NO: 3360824 - DNA, 15 bp, Homo sapiens
ccatcttcataattt

SEQ ID NO: 3360825 - DNA, 14 bp, Homo sapiens
ccatcttccacctg

SEQ ID NO: 3360826 - DNA, 15 bp, Homo sapiens
ccatcttccacctgt

SEQ ID NO: 3360827 - DNA, 22 bp, Homo sapiens
ccatcttccacctgtgccctca

SEQ ID NO: 3360828 - DNA, 13 bp, Homo sapiens
ccatcttccattg

SEQ ID NO: 3360829 - DNA, 18 bp, Homo sapiens
ccatcttctccccacagc

SEQ ID NO: 3360830 - DNA, 23 bp, Homo sapiens
ccatcttctccccacagcctctg

SEQ ID NO: 3360831 - DNA, 20 bp, Homo sapiens
ccatcttgcttccctaatct

SEQ ID NO: 3360832 - DNA, 13 bp, Homo sapiens
ccatgaaacaaag

SEQ ID NO: 3360833 - DNA, 13 bp, Homo sapiens
ccatgaagacagg

SEQ ID NO: 3360834 - DNA, 13 bp, Homo sapiens
ccatgaagcatta

SEQ ID NO: 3360835 - DNA, 14 bp, Homo sapiens
ccatgaccatactg

SEQ ID NO: 3360836 - DNA, 15 bp, Homo sapiens
ccatgacccacccct

SEQ ID NO: 3360837 - DNA, 16 bp, Homo sapiens
ccatgacccacccctg

SEQ ID NO: 3360838 - DNA, 19 bp, Homo sapiens
ccatgacccacccctgtgc

SEQ ID NO: 3360839 - DNA, 19 bp, Homo sapiens
ccatgaccttggggtacaa

SEQ ID NO: 3360840 - DNA, 17 bp, Homo sapiens
ccatgactgcacccagc

SEQ ID NO: 3360841 - DNA, 19 bp, Homo sapiens
ccatgactgcacccagctc

SEQ ID NO: 3360842 - DNA, 20 bp, Homo sapiens
ccatgactgcacccagctcc

SEQ ID NO: 3360843 - DNA, 17 bp, Homo sapiens
ccatgactggctgtctg

SEQ ID NO: 3360844 - DNA, 18 bp, Homo sapiens
ccatgagaagagggcctg

SEQ ID NO: 3360845 - DNA, 19 bp, Homo sapiens
ccatgagaagagggcctgt

SEQ ID NO: 3360846 - DNA, 21 bp, Homo sapiens
ccatgagcaccccaaggctgc

SEQ ID NO: 3360847 - DNA, 22 bp, Homo sapiens
ccatgagcaccccaaggctgcg

SEQ ID NO: 3360848 - DNA, 14 bp, Homo sapiens
ccatgagcctcagc

SEQ ID NO: 3360849 - DNA, 18 bp, Homo sapiens
ccatgagcctcagcatcc

SEQ ID NO: 3360850 - DNA, 23 bp, Homo sapiens
ccatgagcctcagcatcctggca

SEQ ID NO: 3360851 - DNA, 12 bp, Homo sapiens
ccatgagcctgc

SEQ ID NO: 3360852 - DNA, 19 bp, Homo sapiens
ccatgagggacagggtctt

SEQ ID NO: 3360853 - DNA, 13 bp, Homo sapiens
ccatgatagctgg

SEQ ID NO: 3360854 - DNA, 22 bp, Homo sapiens
ccatgatccctgtgttgtctct

SEQ ID NO: 3360855 - DNA, 20 bp, Homo sapiens
ccatgatcgagccactgcac

SEQ ID NO: 3360856 - DNA, 21 bp, Homo sapiens
ccatgatcgagccactgcact

SEQ ID NO: 3360857 - DNA, 15 bp, Homo sapiens
ccatgattctctgag

SEQ ID NO: 3360858 - DNA, 15 bp, Homo sapiens
ccatgatttgtccca

SEQ ID NO: 3360859 - DNA, 19 bp, Homo sapiens
ccatgatttgtcccagcct

SEQ ID NO: 3360860 - DNA, 21 bp, Homo sapiens
ccatgatttgtcccagcctgg

SEQ ID NO: 3360861 - DNA, 22 bp, Homo sapiens
ccatgcaattttattaaatgca

SEQ ID NO: 3360862 - DNA, 13 bp, Homo sapiens
ccatgcagccttg

SEQ ID NO: 3360863 - DNA, 16 bp, Homo sapiens
ccatgcaggaaggaaa

SEQ ID NO: 3360864 - DNA, 13 bp, Homo sapiens
ccatgcaggccct

SEQ ID NO: 3360865 - DNA, 19 bp, Homo sapiens
ccatgcaggggtcagtgca

SEQ ID NO: 3360866 - DNA, 18 bp, Homo sapiens
ccatgccactgccaggca

SEQ ID NO: 3360867 - DNA, 16 bp, Homo sapiens
ccatgcctcatgccac

SEQ ID NO: 3360868 - DNA, 17 bp, Homo sapiens
ccatgcctcatgccaca

SEQ ID NO: 3360869 - DNA, 20 bp, Homo sapiens
ccatgcctcatgccacacct

SEQ ID NO: 3360870 - DNA, 13 bp, Homo sapiens
ccatgcctctgga

SEQ ID NO: 3360871 - DNA, 16 bp, Homo sapiens
ccatgcctgagggtgg

SEQ ID NO: 3360872 - DNA, 17 bp, Homo sapiens
ccatgcctgagggtgga

SEQ ID NO: 3360873 - DNA, 17 bp, Homo sapiens
ccatgcctgtccagcct

SEQ ID NO: 3360874 - DNA, 15 bp, Homo sapiens
ccatgcgctcagggc

SEQ ID NO: 3360875 - DNA, 22 bp, Homo sapiens
ccatgcgctcagggccatgctg

SEQ ID NO: 3360876 - DNA, 17 bp, Homo sapiens
ccatgcgtgccgcctgc

SEQ ID NO: 3360877 - DNA, 23 bp, Homo sapiens
ccatgcgtgccgcctgctcctca

SEQ ID NO: 3360878 - DNA, 20 bp, Homo sapiens
ccatgcgtgtttctgactct

SEQ ID NO: 3360879 - DNA, 13 bp, Homo sapiens
ccatgctcatctg

SEQ ID NO: 3360880 - DNA, 18 bp, Homo sapiens
ccatgctcatctgctggt

SEQ ID NO: 3360881 - DNA, 16 bp, Homo sapiens
ccatgctcctcacctg

SEQ ID NO: 3360882 - DNA, 16 bp, Homo sapiens
ccatgctcctcactgc

SEQ ID NO: 3360883 - DNA, 17 bp, Homo sapiens
ccatgctcctcactgcc

SEQ ID NO: 3360884 - DNA, 14 bp, Homo sapiens
ccatgctctgcccc

SEQ ID NO: 3360885 - DNA, 17 bp, Homo sapiens
ccatgctctgccccaag

SEQ ID NO: 3360886 - DNA, 17 bp, Homo sapiens
ccatgctgaggcctggg

SEQ ID NO: 3360887 - DNA, 17 bp, Homo sapiens
ccatgctgggccactgg

SEQ ID NO: 3360888 - DNA, 16 bp, Homo sapiens
ccatgctggtcagaga

SEQ ID NO: 3360889 - DNA, 23 bp, Homo sapiens
ccatgctggtcagagacggcaga

SEQ ID NO: 3360890 - DNA, 22 bp, Homo sapiens
ccatgcttctcatcttgtgaaa

SEQ ID NO: 3360891 - DNA, 15 bp, Homo sapiens
ccatggacactccag

SEQ ID NO: 3360892 - DNA, 17 bp, Homo sapiens
ccatggagccagctccc

SEQ ID NO: 3360893 - DNA, 23 bp, Homo sapiens
ccatggatttttacaagatccat

SEQ ID NO: 3360894 - DNA, 23 bp, Homo sapiens
ccatggcaattttgtaaattgac

SEQ ID NO: 3360895 - DNA, 14 bp, Homo sapiens
ccatggcaccagcc

SEQ ID NO: 3360896 - DNA, 12 bp, Homo sapiens
ccatggccccca

SEQ ID NO: 3360897 - DNA, 16 bp, Homo sapiens
ccatggcccccaataa

SEQ ID NO: 3360898 - DNA, 20 bp, Homo sapiens
ccatggcccccaataaaggc

SEQ ID NO: 3360899 - DNA, 17 bp, Homo sapiens
ccatggcctctggccag

SEQ ID NO: 3360900 - DNA, 13 bp, Homo sapiens
ccatggctcaggc

SEQ ID NO: 3360901 - DNA, 14 bp, Homo sapiens
ccatgggagccagc

SEQ ID NO: 3360902 - DNA, 21 bp, Homo sapiens
ccatgggagccagctgctttt

SEQ ID NO: 3360903 - DNA, 14 bp, Homo sapiens
ccatgggcagagga

SEQ ID NO: 3360904 - DNA, 14 bp, Homo sapiens
ccatgggccagcct

SEQ ID NO: 3360905 - DNA, 16 bp, Homo sapiens
ccatgggccagcctag

SEQ ID NO: 3360906 - DNA, 16 bp, Homo sapiens
ccatgggcctgggcct

SEQ ID NO: 3360907 - DNA, 20 bp, Homo sapiens
ccatgggcctgggcctgctt

SEQ ID NO: 3360908 - DNA, 22 bp, Homo sapiens
ccatgggctgagtggggagcag

SEQ ID NO: 3360909 - DNA, 20 bp, Homo sapiens
ccatgggcttcactgtataa

SEQ ID NO: 3360910 - DNA, 22 bp, Homo sapiens
ccatgggcttggacttcctggg

SEQ ID NO: 3360911 - DNA, 12 bp, Homo sapiens
ccatggggaggg

SEQ ID NO: 3360912 - DNA, 20 bp, Homo sapiens
ccatggggagggattctggt

SEQ ID NO: 3360913 - DNA, 14 bp, Homo sapiens
ccatggtaccccct

SEQ ID NO: 3360914 - DNA, 15 bp, Homo sapiens
ccatggtaccccctt

SEQ ID NO: 3360915 - DNA, 20 bp, Homo sapiens
ccatggtacccccttctggg

SEQ ID NO: 3360916 - DNA, 14 bp, Homo sapiens
ccatgtaaatacca

SEQ ID NO: 3360917 - DNA, 20 bp, Homo sapiens
ccatgtaaataccagactgc

SEQ ID NO: 3360918 - DNA, 23 bp, Homo sapiens
ccatgtaaatccccactgggacc

SEQ ID NO: 3360919 - DNA, 15 bp, Homo sapiens
ccatgtactgtagtt

SEQ ID NO: 3360920 - DNA, 14 bp, Homo sapiens
ccatgtagccccct

SEQ ID NO: 3360921 - DNA, 16 bp, Homo sapiens
ccatgtatttatctct

SEQ ID NO: 3360922 - DNA, 23 bp, Homo sapiens
ccatgtatttatctctatttaat

SEQ ID NO: 3360923 - DNA, 21 bp, Homo sapiens
ccatgtcaccggtcagtgcct

SEQ ID NO: 3360924 - DNA, 13 bp, Homo sapiens
ccatgtccaaaga

SEQ ID NO: 3360925 - DNA, 17 bp, Homo sapiens
cccacctcagcctcccg

SEQ ID NO: 3360926 - DNA, 15 bp, Homo sapiens
cccacctccacctgt

SEQ ID NO: 3360927 - DNA, 15 bp, Homo sapiens
cccacctccccacgc

SEQ ID NO: 3360928 - DNA, 13 bp, Homo sapiens
cccacctccctgc

SEQ ID NO: 3360929 - DNA, 18 bp, Homo sapiens
cccacctccctgcccagg

SEQ ID NO: 3360930 - DNA, 19 bp, Homo sapiens
cccacctctggccctgtgt

SEQ ID NO: 3360931 - DNA, 20 bp, Homo sapiens
cccacctctgtgacctcagg

SEQ ID NO: 3360932 - DNA, 14 bp, Homo sapiens
cccacctgcaccca

SEQ ID NO: 3360933 - DNA, 14 bp, Homo sapiens
cccacctgcagggc

SEQ ID NO: 3360934 - DNA, 20 bp, Homo sapiens
cccacctgcccatcacaggg

SEQ ID NO: 3360935 - DNA, 20 bp, Homo sapiens
cccacctggccacctgaggt

SEQ ID NO: 3360936 - DNA, 20 bp, Homo sapiens
cccaccttcaattcctgggc

SEQ ID NO: 3360937 - DNA, 14 bp, Homo sapiens
cccaccttggctgc

SEQ ID NO: 3360938 - DNA, 15 bp, Homo sapiens
cccaccttggctgca

SEQ ID NO: 3360939 - DNA, 15 bp, Homo sapiens
cccacgagggctggc

SEQ ID NO: 3360940 - DNA, 16 bp, Homo sapiens
cccacgatcccctccc

SEQ ID NO: 3360941 - DNA, 19 bp, Homo sapiens
cccacgattttctccagct

SEQ ID NO: 3360942 - DNA, 14 bp, Homo sapiens
cccacgccttatcc

SEQ ID NO: 3360943 - DNA, 19 bp, Homo sapiens
cccacgctggagtgcagtg

SEQ ID NO: 3360944 - DNA, 21 bp, Homo sapiens
cccacgctggagtgcagtgag

SEQ ID NO: 3360945 - DNA, 22 bp, Homo sapiens
cccacggagccctccctatgtc

SEQ ID NO: 3360946 - DNA, 19 bp, Homo sapiens
cccacggcacctcggggac

SEQ ID NO: 3360947 - DNA, 23 bp, Homo sapiens
cccacggcacctcggggacacca

SEQ ID NO: 3360948 - DNA, 15 bp, Homo sapiens
cccacggctaagagg

SEQ ID NO: 3360949 - DNA, 19 bp, Homo sapiens
cccacgtctggccaggcac

SEQ ID NO: 3360950 - DNA, 12 bp, Homo sapiens
cccacgtgggag

SEQ ID NO: 3360951 - DNA, 18 bp, Homo sapiens
cccacgtgtcttccactt

SEQ ID NO: 3360952 - DNA, 21 bp, Homo sapiens
cccactactcaatactacctc

SEQ ID NO: 3360953 - DNA, 17 bp, Homo sapiens
cccactcaccagggtcc

SEQ ID NO: 3360954 - DNA, 13 bp, Homo sapiens
cccactcaccccc

SEQ ID NO: 3360955 - DNA, 22 bp, Homo sapiens
cccactccctggctctcagaag

SEQ ID NO: 3360956 - DNA, 19 bp, Homo sapiens
cccactcccttgctggccc

SEQ ID NO: 3360957 - DNA, 16 bp, Homo sapiens
cccactcctctcccac

SEQ ID NO: 3360958 - DNA, 14 bp, Homo sapiens
cccactctacctcc

SEQ ID NO: 3360959 - DNA, 15 bp, Homo sapiens
cccactctacctcct

SEQ ID NO: 3360960 - DNA, 19 bp, Homo sapiens
cccactctacctccttagc

SEQ ID NO: 3360961 - DNA, 17 bp, Homo sapiens
cccactctccccacact

SEQ ID NO: 3360962 - DNA, 22 bp, Homo sapiens
cccactgatctctactaccaca

SEQ ID NO: 3360963 - DNA, 16 bp, Homo sapiens
cccactgcccaccccc

SEQ ID NO: 3360964 - DNA, 17 bp, Homo sapiens
cccactgcccaccccct

SEQ ID NO: 3360965 - DNA, 23 bp, Homo sapiens
cccactgcggggagacagaagcc

SEQ ID NO: 3360966 - DNA, 23 bp, Homo sapiens
cccactgcttttggtctgtgtga

SEQ ID NO: 3360967 - DNA, 13 bp, Homo sapiens
cccactggaagat

SEQ ID NO: 3360968 - DNA, 24 bp, Homo sapiens
cccactggaagatcccctctcctg

SEQ ID NO: 3360969 - DNA, 21 bp, Homo sapiens
cccactggttccttcttcctg

SEQ ID NO: 3360970 - DNA, 12 bp, Homo sapiens
cccactgtatga

SEQ ID NO: 3360971 - DNA, 21 bp, Homo sapiens
cccactgtcaggcctctgagc

SEQ ID NO: 3360972 - DNA, 16 bp, Homo sapiens
cccacttagccgcacc

SEQ ID NO: 3360973 - DNA, 18 bp, Homo sapiens
cccacttagccgcaccct

SEQ ID NO: 3360974 - DNA, 21 bp, Homo sapiens
cccacttagccgcaccctgca

SEQ ID NO: 3360975 - DNA, 20 bp, Homo sapiens
cccacttagccgtccatggc

SEQ ID NO: 3360976 - DNA, 14 bp, Homo sapiens
cccacttgcctctt

SEQ ID NO: 3360977 - DNA, 21 bp, Homo sapiens
cccacttgcctcttccttgaa

SEQ ID NO: 3360978 - DNA, 22 bp, Homo sapiens
cccacttgtcactgacacaaag

SEQ ID NO: 3360979 - DNA, 16 bp, Homo sapiens
cccagaaagattttct

SEQ ID NO: 3360980 - DNA, 14 bp, Homo sapiens
cccagaaaggagac

SEQ ID NO: 3360981 - DNA, 20 bp, Homo sapiens
cccagaacaaaaagaaatct

SEQ ID NO: 3360982 - DNA, 23 bp, Homo sapiens
cccagaacaaaaagaaatcttgt

SEQ ID NO: 3360983 - DNA, 22 bp, Homo sapiens
cccagaacccttcctgagacct

SEQ ID NO: 3360984 - DNA, 18 bp, Homo sapiens
cccagaactgcccccact

SEQ ID NO: 3360985 - DNA, 15 bp, Homo sapiens
cccagaacttccctg

SEQ ID NO: 3360986 - DNA, 16 bp, Homo sapiens
cccagaacttccctga

SEQ ID NO: 3360987 - DNA, 19 bp, Homo sapiens
cccagaacttccctgattg

SEQ ID NO: 3360988 - DNA, 13 bp, Homo sapiens
cccagaaggcagg

SEQ ID NO: 3360989 - DNA, 23 bp, Homo sapiens
cccagaaggcagggaaaggctct

SEQ ID NO: 3360990 - DNA, 19 bp, Homo sapiens
cccagaatccataaatgtg

SEQ ID NO: 3360991 - DNA, 15 bp, Homo sapiens
cccagaatcccagcc

SEQ ID NO: 3360992 - DNA, 19 bp, Homo sapiens
cccagaatcccagccggcc

SEQ ID NO: 3360993 - DNA, 14 bp, Homo sapiens
cccagaatggagcc

SEQ ID NO: 3360994 - DNA, 19 bp, Homo sapiens
cccagaatggagcctgctc

SEQ ID NO: 3360995 - DNA, 20 bp, Homo sapiens
cccagaatggagcctgctct

SEQ ID NO: 3360996 - DNA, 11 bp, Homo sapiens
cccagaattca

SEQ ID NO: 3360997 - DNA, 18 bp, Homo sapiens
cccagacaacagcccagg

SEQ ID NO: 3360998 - DNA, 19 bp, Homo sapiens
cccagacccctctggccag

SEQ ID NO: 3360999 - DNA, 21 bp, Homo sapiens
cccagacccctctggccagga

SEQ ID NO: 3361000 - DNA, 15 bp, Homo sapiens
cccagactctgagct

SEQ ID NO: 3361001 - DNA, 19 bp, Homo sapiens
cccagactttagtgccctg

SEQ ID NO: 3361002 - DNA, 19 bp, Homo sapiens
cccagagactttgtagatc

SEQ ID NO: 3361003 - DNA, 13 bp, Homo sapiens
cccagagatgcca

SEQ ID NO: 3361004 - DNA, 14 bp, Homo sapiens
cccagagatgccag

SEQ ID NO: 3361005 - DNA, 15 bp, Homo sapiens
cccagagatgccagc

SEQ ID NO: 3361006 - DNA, 18 bp, Homo sapiens
cccagagatgccagccct

SEQ ID NO: 3361007 - DNA, 16 bp, Homo sapiens
cccagagcacccccaa

SEQ ID NO: 3361008 - DNA, 20 bp, Homo sapiens
cccagagcaccccctgctcc

SEQ ID NO: 3361009 - DNA, 17 bp, Homo sapiens
cccagagcacctcacct

SEQ ID NO: 3361010 - DNA, 12 bp, Homo sapiens
cccagagcactg

SEQ ID NO: 3361011 - DNA, 15 bp, Homo sapiens
cccagagcactttag

SEQ ID NO: 3361012 - DNA, 14 bp, Homo sapiens
cccagagcaggaag

SEQ ID NO: 3361013 - DNA, 15 bp, Homo sapiens
cccagagcagggtgt

SEQ ID NO: 3361014 - DNA, 11 bp, Homo sapiens
cccagagcccg

SEQ ID NO: 3361015 - DNA, 11 bp, Homo sapiens
cccagagctgt

SEQ ID NO: 3361016 - DNA, 14 bp, Homo sapiens
cccagagctgtgcc

SEQ ID NO: 3361017 - DNA, 15 bp, Homo sapiens
cccagagctgtgcca

SEQ ID NO: 3361018 - DNA, 13 bp, Homo sapiens
cccagagctgttt

SEQ ID NO: 3361019 - DNA, 21 bp, Homo sapiens
cccagagctgtttatggcctc

SEQ ID NO: 3361020 - DNA, 12 bp, Homo sapiens
cccagaggctga

SEQ ID NO: 3361021 - DNA, 15 bp, Homo sapiens
cccagagggcccagg

SEQ ID NO: 3361022 - DNA, 17 bp, Homo sapiens
cccagaggtccagccca

SEQ ID NO: 3361023 - DNA, 17 bp, Homo sapiens
cccagaggttatctgcc

SEQ ID NO: 3361024 - DNA, 18 bp, Homo sapiens
cccagaggttatctgcct

SEQ ID NO: 3361025 - DNA, 19 bp, Homo sapiens
cccagaggttatctgcctg

SEQ ID NO: 3361026 - DNA, 18 bp, Homo sapiens
cccagataccagcccctg

SEQ ID NO: 3361027 - DNA, 14 bp, Homo sapiens
cccagatctgcctg

SEQ ID NO: 3361028 - DNA, 20 bp, Homo sapiens
cccagatctgcctgggcctg

SEQ ID NO: 3361029 - DNA, 22 bp, Homo sapiens
cccagatctgcctgggcctgtg

SEQ ID NO: 3361030 - DNA, 18 bp, Homo sapiens
cccagatctggtcccttg

SEQ ID NO: 3361031 - DNA, 23 bp, Homo sapiens
cccagatggctggaaggggtcca

SEQ ID NO: 3361032 - DNA, 12 bp, Homo sapiens
cccagattccct

SEQ ID NO: 3361033 - DNA, 23 bp, Homo sapiens
cccagattgcaacaggctgggct

SEQ ID NO: 3361034 - DNA, 19 bp, Homo sapiens
cccagcaagacctcatctg

SEQ ID NO: 3361035 - DNA, 23 bp, Homo sapiens
cccagcaagacctcatctgtgga

SEQ ID NO: 3361036 - DNA, 20 bp, Homo sapiens
cccagcaagtgagagctggg

SEQ ID NO: 3361037 - DNA, 21 bp, Homo sapiens
cccagcaagtgagagctgggt

SEQ ID NO: 3361038 - DNA, 20 bp, Homo sapiens
cccagcacaaagcagatcct

SEQ ID NO: 3361039 - DNA, 12 bp, Homo sapiens
cccagcactccc

SEQ ID NO: 3361040 - DNA, 22 bp, Homo sapiens
cccagcactccccttgccttcc

SEQ ID NO: 3361041 - DNA, 17 bp, Homo sapiens
cccagcactttgggagg

SEQ ID NO: 3361042 - DNA, 18 bp, Homo sapiens
cccagcactttgggaggc

SEQ ID NO: 3361043 - DNA, 23 bp, Homo sapiens
cccagcactttgggaggccgagg

SEQ ID NO: 3361044 - DNA, 21 bp, Homo sapiens
cccagcactttgggaggccta

SEQ ID NO: 3361045 - DNA, 15 bp, Homo sapiens
cccagcagcccaagc

SEQ ID NO: 3361046 - DNA, 14 bp, Homo sapiens
cccagcatccctgg

SEQ ID NO: 3361047 - DNA, 19 bp, Homo sapiens
cccagcattccagcccctc

SEQ ID NO: 3361048 - DNA, 20 bp, Homo sapiens
cccagcattccagcccctct

SEQ ID NO: 3361049 - DNA, 22 bp, Homo sapiens
cccagccaccccgggctctctg

SEQ ID NO: 3361050 - DNA, 13 bp, Homo sapiens
cccaggcctgtcc

SEQ ID NO: 3361051 - DNA, 16 bp, Homo sapiens
cccaggcctgtccacc

SEQ ID NO: 3361052 - DNA, 15 bp, Homo sapiens
cccaggcgcctgcgc

SEQ ID NO: 3361053 - DNA, 22 bp, Homo sapiens
cccaggcgggagcggtggccct

SEQ ID NO: 3361054 - DNA, 23 bp, Homo sapiens
cccaggctccgcccttagtcccc

SEQ ID NO: 3361055 - DNA, 16 bp, Homo sapiens
cccaggctgcactgca

SEQ ID NO: 3361056 - DNA, 11 bp, Homo sapiens
cccaggctgcc

SEQ ID NO: 3361057 - DNA, 19 bp, Homo sapiens
cccaggctggacatgctga

SEQ ID NO: 3361058 - DNA, 18 bp, Homo sapiens
cccaggctggagtgcagt

SEQ ID NO: 3361059 - DNA, 20 bp, Homo sapiens
cccaggctggcgtgcagtgg

SEQ ID NO: 3361060 - DNA, 12 bp, Homo sapiens
cccaggctggga

SEQ ID NO: 3361061 - DNA, 16 bp, Homo sapiens
cccaggctggtctcaa

SEQ ID NO: 3361062 - DNA, 21 bp, Homo sapiens
cccaggctgtgcagcgcagct

SEQ ID NO: 3361063 - DNA, 22 bp, Homo sapiens
cccaggctgtgcagcgcagctg

SEQ ID NO: 3361064 - DNA, 23 bp, Homo sapiens
cccaggctgtgcagcgcagctgg

SEQ ID NO: 3361065 - DNA, 13 bp, Homo sapiens
cccagggaaggac

SEQ ID NO: 3361066 - DNA, 18 bp, Homo sapiens
cccagggaaggtggggcc

SEQ ID NO: 3361067 - DNA, 21 bp, Homo sapiens
cccagggaaggtggggccctg

SEQ ID NO: 3361068 - DNA, 18 bp, Homo sapiens
cccagggaatcagggacc

SEQ ID NO: 3361069 - DNA, 20 bp, Homo sapiens
cccagggccagggccctgca

SEQ ID NO: 3361070 - DNA, 14 bp, Homo sapiens
cccagggcccctcc

SEQ ID NO: 3361071 - DNA, 22 bp, Homo sapiens
cccagggcccctccctctgccc

SEQ ID NO: 3361072 - DNA, 23 bp, Homo sapiens
cccagggcctgggggcagtgact

SEQ ID NO: 3361073 - DNA, 24 bp, Homo sapiens
cccagggcctgggggcagtgactg

SEQ ID NO: 3361074 - DNA, 21 bp, Homo sapiens
cccagggctaccctcccccag

SEQ ID NO: 3361075 - DNA, 19 bp, Homo sapiens
cccagggctctgccccagt

SEQ ID NO: 3361076 - DNA, 13 bp, Homo sapiens
cccagggctggct

SEQ ID NO: 3361077 - DNA, 14 bp, Homo sapiens
cccagggctggctc

SEQ ID NO: 3361078 - DNA, 17 bp, Homo sapiens
cccaggggaccacacct

SEQ ID NO: 3361079 - DNA, 14 bp, Homo sapiens
cccaggggggcctc

SEQ ID NO: 3361080 - DNA, 16 bp, Homo sapiens
cccaggggggcctcct

SEQ ID NO: 3361081 - DNA, 16 bp, Homo sapiens
cccaggggtcccagcc

SEQ ID NO: 3361082 - DNA, 18 bp, Homo sapiens
cccaggggtgccccctcc

SEQ ID NO: 3361083 - DNA, 21 bp, Homo sapiens
cccaggggtgccccctcctct

SEQ ID NO: 3361084 - DNA, 15 bp, Homo sapiens
cccagggtcttccct

SEQ ID NO: 3361085 - DNA, 22 bp, Homo sapiens
cccagggtggacttagaaagca

SEQ ID NO: 3361086 - DNA, 15 bp, Homo sapiens
cccaggtaccagctg

SEQ ID NO: 3361087 - DNA, 17 bp, Homo sapiens
cccaggtaccagctgcg

SEQ ID NO: 3361088 - DNA, 13 bp, Homo sapiens
cccaggtcctcac

SEQ ID NO: 3361089 - DNA, 14 bp, Homo sapiens
cccaggtcttccag

SEQ ID NO: 3361090 - DNA, 18 bp, Homo sapiens
cccaggtcttccagacct

SEQ ID NO: 3361091 - DNA, 19 bp, Homo sapiens
cccaggtcttccagacctg

SEQ ID NO: 3361092 - DNA, 21 bp, Homo sapiens
cccaggtcttccagacctgct

SEQ ID NO: 3361093 - DNA, 23 bp, Homo sapiens
cccaggtggaaggcagacagcag

SEQ ID NO: 3361094 - DNA, 18 bp, Homo sapiens
cccaggtggagggcacag

SEQ ID NO: 3361095 - DNA, 22 bp, Homo sapiens
cccaggtggagggcacagccct

SEQ ID NO: 3361096 - DNA, 19 bp, Homo sapiens
cccaggtgttaacattcca

SEQ ID NO: 3361097 - DNA, 21 bp, Homo sapiens
cccaggtgttaacattccaag

SEQ ID NO: 3361098 - DNA, 21 bp, Homo sapiens
cccagtacctagctggctctg

SEQ ID NO: 3361099 - DNA, 18 bp, Homo sapiens
cccagtacctccaagcaa

SEQ ID NO: 3361100 - DNA, 15 bp, Homo sapiens
cccagtcccagggaa

SEQ ID NO: 3361101 - DNA, 21 bp, Homo sapiens
cccagtcccagggaaggtggg

SEQ ID NO: 3361102 - DNA, 20 bp, Homo sapiens
cccagtcccccaaccccagc

SEQ ID NO: 3361103 - DNA, 22 bp, Homo sapiens
cccagtcccccaaccccagccg

SEQ ID NO: 3361104 - DNA, 18 bp, Homo sapiens
cccagtcggccccatctc

SEQ ID NO: 3361105 - DNA, 10 bp, Homo sapiens
cccagtctgg

SEQ ID NO: 3361106 - DNA, 19 bp, Homo sapiens
cccagtctggaatgcagtg

SEQ ID NO: 3361107 - DNA, 12 bp, Homo sapiens
cccagtcttcct

SEQ ID NO: 3361108 - DNA, 14 bp, Homo sapiens
cccagtcttccttg

SEQ ID NO: 3361109 - DNA, 18 bp, Homo sapiens
cccagtgaagcctctgag

SEQ ID NO: 3361110 - DNA, 23 bp, Homo sapiens
cccagtgacaaagactcctctgg

SEQ ID NO: 3361111 - DNA, 15 bp, Homo sapiens
cccagtgacaacatc

SEQ ID NO: 3361112 - DNA, 12 bp, Homo sapiens
cccagtgacact

SEQ ID NO: 3361113 - DNA, 13 bp, Homo sapiens
cccagtgacactt

SEQ ID NO: 3361114 - DNA, 21 bp, Homo sapiens
cccagtgcccacaggatcagt

SEQ ID NO: 3361115 - DNA, 14 bp, Homo sapiens
cccagtgctgccat

SEQ ID NO: 3361116 - DNA, 17 bp, Homo sapiens
cccagtgctgccatgcc

SEQ ID NO: 3361117 - DNA, 18 bp, Homo sapiens
cccagtgctgccatgcca

SEQ ID NO: 3361118 - DNA, 15 bp, Homo sapiens
cccagtgctgctgta

SEQ ID NO: 3361119 - DNA, 19 bp, Homo sapiens
cccagtgctgctgtaaata

SEQ ID NO: 3361120 - DNA, 16 bp, Homo sapiens
cccagtgggacagagg

SEQ ID NO: 3361121 - DNA, 17 bp, Homo sapiens
cccagtgggaggggcag

SEQ ID NO: 3361122 - DNA, 19 bp, Homo sapiens
cccagtgtatgtcttgtat

SEQ ID NO: 3361123 - DNA, 22 bp, Homo sapiens
cccagtgttctgcatggattca

SEQ ID NO: 3361124 - DNA, 16 bp, Homo sapiens
cccagtgttgtttgta

SEQ ID NO: 3361125 - DNA, 18 bp, Homo sapiens
cccagtgttgtttgtaaa

SEQ ID NO: 3361126 - DNA, 21 bp, Homo sapiens
cccagtgttgtttgtaaataa

SEQ ID NO: 3361127 - DNA, 12 bp, Homo sapiens
cccagttacttt

SEQ ID NO: 3361128 - DNA, 22 bp, Homo sapiens
cccagttacttttttacactga

SEQ ID NO: 3361129 - DNA, 16 bp, Homo sapiens
cccagttctgctcctc

SEQ ID NO: 3361130 - DNA, 20 bp, Homo sapiens
cccagttctgctcctctcca

SEQ ID NO: 3361131 - DNA, 21 bp, Homo sapiens
cccagttggggaagccaggtg

SEQ ID NO: 3361132 - DNA, 22 bp, Homo sapiens
cccagtttcttcttacacttct

SEQ ID NO: 3361133 - DNA, 20 bp, Homo sapiens
cccataatagttagccctca

SEQ ID NO: 3361134 - DNA, 22 bp, Homo sapiens
cccataattttttttttccttt

SEQ ID NO: 3361135 - DNA, 22 bp, Homo sapiens
cccatactcagcctgctgccca

SEQ ID NO: 3361136 - DNA, 15 bp, Homo sapiens
cccatagaaacatga

SEQ ID NO: 3361137 - DNA, 17 bp, Homo sapiens
cccatagaaacatgaca

SEQ ID NO: 3361138 - DNA, 19 bp, Homo sapiens
cccatagaaacatgacact

SEQ ID NO: 3361139 - DNA, 21 bp, Homo sapiens
cccatagaaacatgacactga

SEQ ID NO: 3361140 - DNA, 23 bp, Homo sapiens
cccatagaaacatgacactgacc

SEQ ID NO: 3361141 - DNA, 17 bp, Homo sapiens
cccatagatcttctgaa

SEQ ID NO: 3361142 - DNA, 18 bp, Homo sapiens
cccataggccacccccta

SEQ ID NO: 3361143 - DNA, 19 bp, Homo sapiens
cccatagtggggcctggga

SEQ ID NO: 3361144 - DNA, 21 bp, Homo sapiens
cccatagtggggcctgggagg

SEQ ID NO: 3361145 - DNA, 23 bp, Homo sapiens
cccatattggcatggatttctgt

SEQ ID NO: 3361146 - DNA, 22 bp, Homo sapiens
cccatcatgcccggtcccaccc

SEQ ID NO: 3361147 - DNA, 20 bp, Homo sapiens
cccatccaaccactgtacac

SEQ ID NO: 3361148 - DNA, 19 bp, Homo sapiens
cccatccattaggccagca

SEQ ID NO: 3361149 - DNA, 13 bp, Homo sapiens
cccatccccacca

SEQ ID NO: 3361150 - DNA, 14 bp, Homo sapiens
cccatccccctgcc

SEQ ID NO: 3361151 - DNA, 17 bp, Homo sapiens
cccatccccctgccctc

SEQ ID NO: 3361152 - DNA, 22 bp, Homo sapiens
cccatccctcgggaagcagcca

SEQ ID NO: 3361153 - DNA, 18 bp, Homo sapiens
cccatccctgcctggtca

SEQ ID NO: 3361154 - DNA, 18 bp, Homo sapiens
cccatcctaccctcgggc

SEQ ID NO: 3361155 - DNA, 17 bp, Homo sapiens
cccatcctcatccctga

SEQ ID NO: 3361156 - DNA, 13 bp, Homo sapiens
cccatcctggggc

SEQ ID NO: 3361157 - DNA, 16 bp, Homo sapiens
cccatcctggggcagc

SEQ ID NO: 3361158 - DNA, 15 bp, Homo sapiens
cccatctcagcctcc

SEQ ID NO: 3361159 - DNA, 15 bp, Homo sapiens
cccatctcaggtgcc

SEQ ID NO: 3361160 - DNA, 23 bp, Homo sapiens
cccatctcaggtgccactccctg

SEQ ID NO: 3361161 - DNA, 18 bp, Homo sapiens
cccatctcatcctggcac

SEQ ID NO: 3361162 - DNA, 22 bp, Homo sapiens
cccatctcatcctggcacgccc

SEQ ID NO: 3361163 - DNA, 14 bp, Homo sapiens
cccatctccccagg

SEQ ID NO: 3361164 - DNA, 12 bp, Homo sapiens
cccatctccctg

SEQ ID NO: 3361165 - DNA, 18 bp, Homo sapiens
cccatctctccctcccct

SEQ ID NO: 3361166 - DNA, 18 bp, Homo sapiens
cccatctcttcctaccca

SEQ ID NO: 3361167 - DNA, 16 bp, Homo sapiens
cccatctgggagtccc

SEQ ID NO: 3361168 - DNA, 18 bp, Homo sapiens
cccatctgggtccttgca

SEQ ID NO: 3361169 - DNA, 13 bp, Homo sapiens
cccatcttccacc

SEQ ID NO: 3361170 - DNA, 12 bp, Homo sapiens
cccatcttcctg

SEQ ID NO: 3361171 - DNA, 15 bp, Homo sapiens
cccatcttcctgctg

SEQ ID NO: 3361172 - DNA, 12 bp, Homo sapiens
cccatcttgctt

SEQ ID NO: 3361173 - DNA, 18 bp, Homo sapiens
cccatgaagacaggacag

SEQ ID NO: 3361174 - DNA, 19 bp, Homo sapiens
cccatgaagacaggacagt

SEQ ID NO: 3361175 - DNA, 15 bp, Homo sapiens
cccctcccttcaacc

SEQ ID NO: 3361176 - DNA, 19 bp, Homo sapiens
cccctccgccctgccactc

SEQ ID NO: 3361177 - DNA, 23 bp, Homo sapiens
cccctcctcactggccatccctc

SEQ ID NO: 3361178 - DNA, 22 bp, Homo sapiens
cccctcctccagcccctgtccc

SEQ ID NO: 3361179 - DNA, 17 bp, Homo sapiens
cccctcctctagctgtg

SEQ ID NO: 3361180 - DNA, 18 bp, Homo sapiens
cccctcctctcccatccc

SEQ ID NO: 3361181 - DNA, 12 bp, Homo sapiens
cccctcctgctc

SEQ ID NO: 3361182 - DNA, 18 bp, Homo sapiens
cccctcctggcaatcaat

SEQ ID NO: 3361183 - DNA, 9 bp, Homo sapiens
cccctcctt

SEQ ID NO: 3361184 - DNA, 12 bp, Homo sapiens
cccctccttctc

SEQ ID NO: 3361185 - DNA, 13 bp, Homo sapiens
cccctccttgggc

SEQ ID NO: 3361186 - DNA, 13 bp, Homo sapiens
cccctccttgtct

SEQ ID NO: 3361187 - DNA, 19 bp, Homo sapiens
cccctcgccagcttctcct

SEQ ID NO: 3361188 - DNA, 14 bp, Homo sapiens
cccctcggacagcc

SEQ ID NO: 3361189 - DNA, 21 bp, Homo sapiens
cccctcgtcctgtcccagagg

SEQ ID NO: 3361190 - DNA, 23 bp, Homo sapiens
cccctcgtgtcagctcaggcagc

SEQ ID NO: 3361191 - DNA, 12 bp, Homo sapiens
cccctctcacca

SEQ ID NO: 3361192 - DNA, 14 bp, Homo sapiens
cccctctccttcct

SEQ ID NO: 3361193 - DNA, 12 bp, Homo sapiens
cccctctctgcc

SEQ ID NO: 3361194 - DNA, 13 bp, Homo sapiens
cccctctctgccc

SEQ ID NO: 3361195 - DNA, 15 bp, Homo sapiens
cccctctgacctgca

SEQ ID NO: 3361196 - DNA, 18 bp, Homo sapiens
cccctctgacctgcactg

SEQ ID NO: 3361197 - DNA, 16 bp, Homo sapiens
cccctctggccaggat

SEQ ID NO: 3361198 - DNA, 21 bp, Homo sapiens
cccctctgtcatcactccctg

SEQ ID NO: 3361199 - DNA, 22 bp, Homo sapiens
cccctctgtcatcactccctgg

SEQ ID NO: 3361200 - DNA, 18 bp, Homo sapiens
cccctctgtctacaaata

SEQ ID NO: 3361201 - DNA, 14 bp, Homo sapiens
cccctgactcatca

SEQ ID NO: 3361202 - DNA, 17 bp, Homo sapiens
cccctgagatcccctga

SEQ ID NO: 3361203 - DNA, 13 bp, Homo sapiens
cccctgagcccca

SEQ ID NO: 3361204 - DNA, 14 bp, Homo sapiens
cccctgaggactgg

SEQ ID NO: 3361205 - DNA, 15 bp, Homo sapiens
cccctgaggactgga

SEQ ID NO: 3361206 - DNA, 17 bp, Homo sapiens
cccctgatcactcccag

SEQ ID NO: 3361207 - DNA, 18 bp, Homo sapiens
cccctgatcactcccagc

SEQ ID NO: 3361208 - DNA, 19 bp, Homo sapiens
cccctgatcactcccagca

SEQ ID NO: 3361209 - DNA, 20 bp, Homo sapiens
cccctgatcactcccagcac

SEQ ID NO: 3361210 - DNA, 22 bp, Homo sapiens
cccctgatcactcccagcactc

SEQ ID NO: 3361211 - DNA, 21 bp, Homo sapiens
cccctgcaacttccgctgagg

SEQ ID NO: 3361212 - DNA, 20 bp, Homo sapiens
cccctgcagcacggacaata

SEQ ID NO: 3361213 - DNA, 20 bp, Homo sapiens
cccctgccaccaggccacct

SEQ ID NO: 3361214 - DNA, 14 bp, Homo sapiens
cccctgccaccctg

SEQ ID NO: 3361215 - DNA, 16 bp, Homo sapiens
cccctgccaccctggg

SEQ ID NO: 3361216 - DNA, 16 bp, Homo sapiens
cccctgccccagccca

SEQ ID NO: 3361217 - DNA, 17 bp, Homo sapiens
cccctgccccccagcct

SEQ ID NO: 3361218 - DNA, 17 bp, Homo sapiens
cccctgcccggctgcgg

SEQ ID NO: 3361219 - DNA, 19 bp, Homo sapiens
cccctgccctcgtggccag

SEQ ID NO: 3361220 - DNA, 23 bp, Homo sapiens
cccctgccctcgtggccagcccg

SEQ ID NO: 3361221 - DNA, 13 bp, Homo sapiens
cccctgccctgca

SEQ ID NO: 3361222 - DNA, 14 bp, Homo sapiens
cccctgccctgctg

SEQ ID NO: 3361223 - DNA, 12 bp, Homo sapiens
cccctgcctggg

SEQ ID NO: 3361224 - DNA, 13 bp, Homo sapiens
cccctgcctgggt

SEQ ID NO: 3361225 - DNA, 22 bp, Homo sapiens
cccctgcgggcgcgggcagcca

SEQ ID NO: 3361226 - DNA, 19 bp, Homo sapiens
cccctgcgtggcctgagtc

SEQ ID NO: 3361227 - DNA, 18 bp, Homo sapiens
cccctgctactcctgtgc

SEQ ID NO: 3361228 - DNA, 17 bp, Homo sapiens
cccctgctcccagcctg

SEQ ID NO: 3361229 - DNA, 22 bp, Homo sapiens
cccctgctgcaggggctctgga

SEQ ID NO: 3361230 - DNA, 23 bp, Homo sapiens
cccctgctgcaggggctctggag

SEQ ID NO: 3361231 - DNA, 15 bp, Homo sapiens
cccctgctggttcag

SEQ ID NO: 3361232 - DNA, 20 bp, Homo sapiens
cccctgctggttcagggttg

SEQ ID NO: 3361233 - DNA, 19 bp, Homo sapiens
cccctgcttctccagcctg

SEQ ID NO: 3361234 - DNA, 22 bp, Homo sapiens
cccctggatgggcattgggctg

SEQ ID NO: 3361235 - DNA, 19 bp, Homo sapiens
cccctggcagcacagccca

SEQ ID NO: 3361236 - DNA, 20 bp, Homo sapiens
cccctggcccatctcagcct

SEQ ID NO: 3361237 - DNA, 11 bp, Homo sapiens
cccctggcctc

SEQ ID NO: 3361238 - DNA, 14 bp, Homo sapiens
cccctggcctctgt

SEQ ID NO: 3361239 - DNA, 11 bp, Homo sapiens
cccctggcctt

SEQ ID NO: 3361240 - DNA, 23 bp, Homo sapiens
cccctggcttttcactgctggct

SEQ ID NO: 3361241 - DNA, 22 bp, Homo sapiens
cccctgggagacaactggacaa

SEQ ID NO: 3361242 - DNA, 12 bp, Homo sapiens
cccctgggcagg

SEQ ID NO: 3361243 - DNA, 23 bp, Homo sapiens
cccctgggcatcttctggcttga

SEQ ID NO: 3361244 - DNA, 21 bp, Homo sapiens
cccctgggctctgccccagct

SEQ ID NO: 3361245 - DNA, 16 bp, Homo sapiens
cccctgggcttggcct

SEQ ID NO: 3361246 - DNA, 19 bp, Homo sapiens
cccctgggcttggcctgct

SEQ ID NO: 3361247 - DNA, 22 bp, Homo sapiens
cccctgggcttggcctgctgtg

SEQ ID NO: 3361248 - DNA, 11 bp, Homo sapiens
cccctggggcc

SEQ ID NO: 3361249 - DNA, 15 bp, Homo sapiens
cccctggggcctaga

SEQ ID NO: 3361250 - DNA, 23 bp, Homo sapiens
cccctggggcctagactctgtaa

SEQ ID NO: 3361251 - DNA, 18 bp, Homo sapiens
cccctggggcttctcctg

SEQ ID NO: 3361252 - DNA, 19 bp, Homo sapiens
cccctggggcttctcctga

SEQ ID NO: 3361253 - DNA, 20 bp, Homo sapiens
cccctgggggtttcacctgg

SEQ ID NO: 3361254 - DNA, 19 bp, Homo sapiens
cccctggtggacagtcctg

SEQ ID NO: 3361255 - DNA, 23 bp, Homo sapiens
cccctggtggacagtcctgggag

SEQ ID NO: 3361256 - DNA, 16 bp, Homo sapiens
cccctgtacccagctc

SEQ ID NO: 3361257 - DNA, 20 bp, Homo sapiens
cccctgtcccctcagctcca

SEQ ID NO: 3361258 - DNA, 13 bp, Homo sapiens
cccctgtcctcac

SEQ ID NO: 3361259 - DNA, 12 bp, Homo sapiens
cccctgtcctga

SEQ ID NO: 3361260 - DNA, 23 bp, Homo sapiens
cccctgtcctgtgaatggaagca

SEQ ID NO: 3361261 - DNA, 23 bp, Homo sapiens
cccctgtctccttattcggcagc

SEQ ID NO: 3361262 - DNA, 21 bp, Homo sapiens
cccctgtcttcacctgccacc

SEQ ID NO: 3361263 - DNA, 12 bp, Homo sapiens
cccctgtggcca

SEQ ID NO: 3361264 - DNA, 12 bp, Homo sapiens
cccctgtgggga

SEQ ID NO: 3361265 - DNA, 18 bp, Homo sapiens
cccctgtggggatctcag

SEQ ID NO: 3361266 - DNA, 24 bp, Homo sapiens
cccctgtggggatctcaggggctg

SEQ ID NO: 3361267 - DNA, 20 bp, Homo sapiens
cccctgtgtattcaccacca

SEQ ID NO: 3361268 - DNA, 20 bp, Homo sapiens
cccctgtttcaatcactgtc

SEQ ID NO: 3361269 - DNA, 22 bp, Homo sapiens
ccccttaagggttgaaggcagt

SEQ ID NO: 3361270 - DNA, 16 bp, Homo sapiens
ccccttcatcctctga

SEQ ID NO: 3361271 - DNA, 13 bp, Homo sapiens
ccccttccatgtg

SEQ ID NO: 3361272 - DNA, 16 bp, Homo sapiens
ccccttccccaggccc

SEQ ID NO: 3361273 - DNA, 13 bp, Homo sapiens
ccccttcccctcc

SEQ ID NO: 3361274 - DNA, 14 bp, Homo sapiens
ccccttcccctccc

SEQ ID NO: 3361275 - DNA, 16 bp, Homo sapiens
ccccttcccctcccct

SEQ ID NO: 3361276 - DNA, 21 bp, Homo sapiens
ccccttcccctcccctccttg

SEQ ID NO: 3361277 - DNA, 12 bp, Homo sapiens
ccccttcctaag

SEQ ID NO: 3361278 - DNA, 15 bp, Homo sapiens
ccccttcctagtgaa

SEQ ID NO: 3361279 - DNA, 15 bp, Homo sapiens
ccccttcgctcctgt

SEQ ID NO: 3361280 - DNA, 14 bp, Homo sapiens
ccccttctctgctc

SEQ ID NO: 3361281 - DNA, 14 bp, Homo sapiens
ccccttctgggcat

SEQ ID NO: 3361282 - DNA, 23 bp, Homo sapiens
ccccttctgggcatctgttctgg

SEQ ID NO: 3361283 - DNA, 15 bp, Homo sapiens
ccccttcttgggccc

SEQ ID NO: 3361284 - DNA, 20 bp, Homo sapiens
ccccttcttgggccccagac

SEQ ID NO: 3361285 - DNA, 12 bp, Homo sapiens
ccccttgccctc

SEQ ID NO: 3361286 - DNA, 18 bp, Homo sapiens
ccccttgccctccgcctg

SEQ ID NO: 3361287 - DNA, 18 bp, Homo sapiens
ccccttgcccttgccctg

SEQ ID NO: 3361288 - DNA, 19 bp, Homo sapiens
ccccttgcccttgccctga

SEQ ID NO: 3361289 - DNA, 17 bp, Homo sapiens
ccccttgccttcccctg

SEQ ID NO: 3361290 - DNA, 19 bp, Homo sapiens
ccccttgccttcccctgtc

SEQ ID NO: 3361291 - DNA, 22 bp, Homo sapiens
ccccttggaggagagagacccc

SEQ ID NO: 3361292 - DNA, 17 bp, Homo sapiens
ccccttggcaggtcctg

SEQ ID NO: 3361293 - DNA, 14 bp, Homo sapiens
ccccttggctggat

SEQ ID NO: 3361294 - DNA, 18 bp, Homo sapiens
ccccttgtcctttccctt

SEQ ID NO: 3361295 - DNA, 13 bp, Homo sapiens
cccctttgtgctg

SEQ ID NO: 3361296 - DNA, 23 bp, Homo sapiens
ccccttttcagctgagccctggg

SEQ ID NO: 3361297 - DNA, 17 bp, Homo sapiens
ccccttttcttttctac

SEQ ID NO: 3361298 - DNA, 19 bp, Homo sapiens
ccccttttcttttctaccc

SEQ ID NO: 3361299 - DNA, 14 bp, Homo sapiens
ccccttttgcctgg

SEQ ID NO: 3361300 - DNA, 16 bp, Homo sapiens
ccccttttgcctggct

SEQ ID NO: 3361301 - DNA, 13 bp, Homo sapiens
ccctcgtggccag

SEQ ID NO: 3361302 - DNA, 15 bp, Homo sapiens
ccctcgtggccagcc

SEQ ID NO: 3361303 - DNA, 19 bp, Homo sapiens
ccctcgtggccagcccggc

SEQ ID NO: 3361304 - DNA, 16 bp, Homo sapiens
ccctctaaagcaataa

SEQ ID NO: 3361305 - DNA, 17 bp, Homo sapiens
ccctctcagaggcctgc

SEQ ID NO: 3361306 - DNA, 19 bp, Homo sapiens
ccctctcagaggcctgctg

SEQ ID NO: 3361307 - DNA, 14 bp, Homo sapiens
ccctctcagctcca

SEQ ID NO: 3361308 - DNA, 20 bp, Homo sapiens
ccctctcatctcaggtagaa

SEQ ID NO: 3361309 - DNA, 16 bp, Homo sapiens
ccctctcccaggcccg

SEQ ID NO: 3361310 - DNA, 11 bp, Homo sapiens
ccctctccctg

SEQ ID NO: 3361311 - DNA, 15 bp, Homo sapiens
ccctctcctgcccag

SEQ ID NO: 3361312 - DNA, 13 bp, Homo sapiens
ccctctcctgggg

SEQ ID NO: 3361313 - DNA, 21 bp, Homo sapiens
ccctctcggccaggcattggc

SEQ ID NO: 3361314 - DNA, 19 bp, Homo sapiens
ccctctctcccatttcagg

SEQ ID NO: 3361315 - DNA, 13 bp, Homo sapiens
ccctctctcttct

SEQ ID NO: 3361316 - DNA, 15 bp, Homo sapiens
ccctctctcttctgc

SEQ ID NO: 3361317 - DNA, 23 bp, Homo sapiens
ccctctctcttctgctccaccct

SEQ ID NO: 3361318 - DNA, 15 bp, Homo sapiens
ccctctctgcccctg

SEQ ID NO: 3361319 - DNA, 15 bp, Homo sapiens
ccctctctgctcctt

SEQ ID NO: 3361320 - DNA, 13 bp, Homo sapiens
ccctctcttgcac

SEQ ID NO: 3361321 - DNA, 18 bp, Homo sapiens
ccctctcttgcacccgcc

SEQ ID NO: 3361322 - DNA, 23 bp, Homo sapiens
ccctctcttgcacccgcctctcc

SEQ ID NO: 3361323 - DNA, 19 bp, Homo sapiens
ccctctgacctgcactggg

SEQ ID NO: 3361324 - DNA, 11 bp, Homo sapiens
ccctctgaggc

SEQ ID NO: 3361325 - DNA, 19 bp, Homo sapiens
ccctctgcagaacagtgaa

SEQ ID NO: 3361326 - DNA, 23 bp, Homo sapiens
ccctctgccccaagcagccagcc

SEQ ID NO: 3361327 - DNA, 16 bp, Homo sapiens
ccctctgccttcaggc

SEQ ID NO: 3361328 - DNA, 15 bp, Homo sapiens
ccctctgctcagcca

SEQ ID NO: 3361329 - DNA, 14 bp, Homo sapiens
ccctctgctgctgt

SEQ ID NO: 3361330 - DNA, 21 bp, Homo sapiens
ccctctggaggggtgtggctc

SEQ ID NO: 3361331 - DNA, 18 bp, Homo sapiens
ccctctggccaggatgga

SEQ ID NO: 3361332 - DNA, 13 bp, Homo sapiens
ccctctggcttcc

SEQ ID NO: 3361333 - DNA, 12 bp, Homo sapiens
ccctctgggaac

SEQ ID NO: 3361334 - DNA, 20 bp, Homo sapiens
ccctctgggaacctcccaga

SEQ ID NO: 3361335 - DNA, 21 bp, Homo sapiens
ccctctgggaacctcccagag

SEQ ID NO: 3361336 - DNA, 22 bp, Homo sapiens
ccctctggtcgctcctgcccac

SEQ ID NO: 3361337 - DNA, 20 bp, Homo sapiens
ccctctgtcatcactccctg

SEQ ID NO: 3361338 - DNA, 14 bp, Homo sapiens
ccctctgtgtctgc

SEQ ID NO: 3361339 - DNA, 22 bp, Homo sapiens
ccctcttcactgtggccacagc

SEQ ID NO: 3361340 - DNA, 12 bp, Homo sapiens
ccctcttcctga

SEQ ID NO: 3361341 - DNA, 14 bp, Homo sapiens
ccctcttcctgtga

SEQ ID NO: 3361342 - DNA, 16 bp, Homo sapiens
ccctcttctcaagtgc

SEQ ID NO: 3361343 - DNA, 13 bp, Homo sapiens
ccctcttgcccat

SEQ ID NO: 3361344 - DNA, 22 bp, Homo sapiens
ccctcttgcccatcctgactga

SEQ ID NO: 3361345 - DNA, 15 bp, Homo sapiens
ccctcttgttttgtt

SEQ ID NO: 3361346 - DNA, 12 bp, Homo sapiens
ccctctttccct

SEQ ID NO: 3361347 - DNA, 17 bp, Homo sapiens
ccctctttggctcccct

SEQ ID NO: 3361348 - DNA, 19 bp, Homo sapiens
ccctctttggctcccctgt

SEQ ID NO: 3361349 - DNA, 14 bp, Homo sapiens
ccctgaacaagaat

SEQ ID NO: 3361350 - DNA, 18 bp, Homo sapiens
ccctgaagccagccttct

SEQ ID NO: 3361351 - DNA, 20 bp, Homo sapiens
ccctgaagtgagcacagcct

SEQ ID NO: 3361352 - DNA, 16 bp, Homo sapiens
ccctgacctcccagcc

SEQ ID NO: 3361353 - DNA, 18 bp, Homo sapiens
ccctgacctcccagccct

SEQ ID NO: 3361354 - DNA, 19 bp, Homo sapiens
ccctgacctcccagcccta

SEQ ID NO: 3361355 - DNA, 22 bp, Homo sapiens
ccctgacctccgcccctgcccc

SEQ ID NO: 3361356 - DNA, 20 bp, Homo sapiens
ccctgaccttggctgactgg

SEQ ID NO: 3361357 - DNA, 10 bp, Homo sapiens
ccctgagact

SEQ ID NO: 3361358 - DNA, 13 bp, Homo sapiens
ccctgagactcca

SEQ ID NO: 3361359 - DNA, 16 bp, Homo sapiens
ccctgagactccagaa

SEQ ID NO: 3361360 - DNA, 12 bp, Homo sapiens
ccctgagcgcct

SEQ ID NO: 3361361 - DNA, 12 bp, Homo sapiens
ccctgaggccta

SEQ ID NO: 3361362 - DNA, 13 bp, Homo sapiens
ccctgaggcctga

SEQ ID NO: 3361363 - DNA, 18 bp, Homo sapiens
ccctgaggtcagggagtg

SEQ ID NO: 3361364 - DNA, 21 bp, Homo sapiens
ccctgaggtcagggagtgctg

SEQ ID NO: 3361365 - DNA, 16 bp, Homo sapiens
ccctgagttggagctc

SEQ ID NO: 3361366 - DNA, 20 bp, Homo sapiens
ccctgatcaagtcaccggag

SEQ ID NO: 3361367 - DNA, 22 bp, Homo sapiens
ccctgatcccattttcctctga

SEQ ID NO: 3361368 - DNA, 13 bp, Homo sapiens
ccctgatgacacc

SEQ ID NO: 3361369 - DNA, 13 bp, Homo sapiens
ccctgatgccttt

SEQ ID NO: 3361370 - DNA, 18 bp, Homo sapiens
ccctgatgccttttggac

SEQ ID NO: 3361371 - DNA, 20 bp, Homo sapiens
ccctgatgtgtcctcaggga

SEQ ID NO: 3361372 - DNA, 15 bp, Homo sapiens
ccctgcaaagacagt

SEQ ID NO: 3361373 - DNA, 16 bp, Homo sapiens
ccctgcaaggcccaca

SEQ ID NO: 3361374 - DNA, 23 bp, Homo sapiens
ccctgcaatgtatcccttctcac

SEQ ID NO: 3361375 - DNA, 14 bp, Homo sapiens
ccctgcacaggcac

SEQ ID NO: 3361376 - DNA, 22 bp, Homo sapiens
ccctgcacaggcacacagggcc

SEQ ID NO: 3361377 - DNA, 13 bp, Homo sapiens
ccctgcaccctgg

SEQ ID NO: 3361378 - DNA, 14 bp, Homo sapiens
ccctgcaccctgga

SEQ ID NO: 3361379 - DNA, 16 bp, Homo sapiens
ccctgcaccctggaaa

SEQ ID NO: 3361380 - DNA, 14 bp, Homo sapiens
ccctgcacccttgt

SEQ ID NO: 3361381 - DNA, 16 bp, Homo sapiens
ccctgcacctgctgcg

SEQ ID NO: 3361382 - DNA, 13 bp, Homo sapiens
ccctgcacgtcat

SEQ ID NO: 3361383 - DNA, 14 bp, Homo sapiens
ccctgcacgtcatg

SEQ ID NO: 3361384 - DNA, 19 bp, Homo sapiens
ccctgcacttgcagactct

SEQ ID NO: 3361385 - DNA, 15 bp, Homo sapiens
ccctgcagatgccac

SEQ ID NO: 3361386 - DNA, 20 bp, Homo sapiens
ccctgcagatgccaccctag

SEQ ID NO: 3361387 - DNA, 22 bp, Homo sapiens
ccctgcagcacggacaataaac

SEQ ID NO: 3361388 - DNA, 14 bp, Homo sapiens
ccctgcagccagct

SEQ ID NO: 3361389 - DNA, 13 bp, Homo sapiens
ccctgcagtgttc

SEQ ID NO: 3361390 - DNA, 12 bp, Homo sapiens
ccctgcatcccc

SEQ ID NO: 3361391 - DNA, 16 bp, Homo sapiens
ccctgccaaactgaag

SEQ ID NO: 3361392 - DNA, 17 bp, Homo sapiens
ccctgccaagtctcaga

SEQ ID NO: 3361393 - DNA, 18 bp, Homo sapiens
ccctgccacatacaggtg

SEQ ID NO: 3361394 - DNA, 17 bp, Homo sapiens
ccctgccaccctgggga

SEQ ID NO: 3361395 - DNA, 13 bp, Homo sapiens
ccctgccactcac

SEQ ID NO: 3361396 - DNA, 16 bp, Homo sapiens
ccctgccagaggggaa

SEQ ID NO: 3361397 - DNA, 22 bp, Homo sapiens
ccctgccaggagctttggacct

SEQ ID NO: 3361398 - DNA, 17 bp, Homo sapiens
ccctgcccaaaccctta

SEQ ID NO: 3361399 - DNA, 20 bp, Homo sapiens
ccctgcccaagggcctccca

SEQ ID NO: 3361400 - DNA, 22 bp, Homo sapiens
ccctgcccaagggcctcccacc

SEQ ID NO: 3361401 - DNA, 12 bp, Homo sapiens
ccctgcccatgt

SEQ ID NO: 3361402 - DNA, 20 bp, Homo sapiens
ccctgccccagcccaagtcc

SEQ ID NO: 3361403 - DNA, 19 bp, Homo sapiens
ccctgcccccatctcccca

SEQ ID NO: 3361404 - DNA, 23 bp, Homo sapiens
ccctgcccccatctccccaggcc

SEQ ID NO: 3361405 - DNA, 12 bp, Homo sapiens
ccctgcccccca

SEQ ID NO: 3361406 - DNA, 15 bp, Homo sapiens
ccctgccccccagcc

SEQ ID NO: 3361407 - DNA, 21 bp, Homo sapiens
ccctgccccccagcctctggc

SEQ ID NO: 3361408 - DNA, 16 bp, Homo sapiens
ccctgccccctggctg

SEQ ID NO: 3361409 - DNA, 10 bp, Homo sapiens
ccctgcccct

SEQ ID NO: 3361410 - DNA, 21 bp, Homo sapiens
ccctgcccctaggatgctgca

SEQ ID NO: 3361411 - DNA, 13 bp, Homo sapiens
ccctgcccctgca

SEQ ID NO: 3361412 - DNA, 15 bp, Homo sapiens
ccctgcccctgcaaa

SEQ ID NO: 3361413 - DNA, 17 bp, Homo sapiens
ccctgcccgctcccaac

SEQ ID NO: 3361414 - DNA, 17 bp, Homo sapiens
ccctgcccggctgcgga

SEQ ID NO: 3361415 - DNA, 13 bp, Homo sapiens
ccctgccctcgtg

SEQ ID NO: 3361416 - DNA, 14 bp, Homo sapiens
ccctgccctcgtgg

SEQ ID NO: 3361417 - DNA, 11 bp, Homo sapiens
ccctgccctct

SEQ ID NO: 3361418 - DNA, 17 bp, Homo sapiens
ccctgccctgaggaagg

SEQ ID NO: 3361419 - DNA, 11 bp, Homo sapiens
ccctgccctgc

SEQ ID NO: 3361420 - DNA, 12 bp, Homo sapiens
ccctgccctgca

SEQ ID NO: 3361421 - DNA, 18 bp, Homo sapiens
ccctgccctggtccaggg

SEQ ID NO: 3361422 - DNA, 20 bp, Homo sapiens
ccctgcctcccatgcctggt

SEQ ID NO: 3361423 - DNA, 15 bp, Homo sapiens
ccctgcctcctggga

SEQ ID NO: 3361424 - DNA, 16 bp, Homo sapiens
ccctgcctcctgggaa

SEQ ID NO: 3361425 - DNA, 15 bp, Homo sapiens
ccctgcctgcccact

SEQ ID NO: 3361426 - DNA, 13 bp, Homo sapiens
ccctgcctggccc

SEQ ID NO: 3361427 - DNA, 21 bp, Homo sapiens
ccctgcctggcccccaacctc

SEQ ID NO: 3361428 - DNA, 23 bp, Homo sapiens
ccctgcctggggcgggcccctca

SEQ ID NO: 3361429 - DNA, 18 bp, Homo sapiens
ccgcagacctccccagcc

SEQ ID NO: 3361430 - DNA, 15 bp, Homo sapiens
ccgcagacgggcaca

SEQ ID NO: 3361431 - DNA, 16 bp, Homo sapiens
ccgcagacgggcacag

SEQ ID NO: 3361432 - DNA, 12 bp, Homo sapiens
ccgcagagactg

SEQ ID NO: 3361433 - DNA, 23 bp, Homo sapiens
ccgcagatgacacgcgctctcca

SEQ ID NO: 3361434 - DNA, 20 bp, Homo sapiens
ccgcagccagccggtgcctg

SEQ ID NO: 3361435 - DNA, 18 bp, Homo sapiens
ccgcagctcttgcccttc

SEQ ID NO: 3361436 - DNA, 22 bp, Homo sapiens
ccgcagctcttgcccttccctg

SEQ ID NO: 3361437 - DNA, 20 bp, Homo sapiens
ccgcaggaactgggctgggc

SEQ ID NO: 3361438 - DNA, 22 bp, Homo sapiens
ccgcagggacaagccctggaga

SEQ ID NO: 3361439 - DNA, 22 bp, Homo sapiens
ccgcaggtgggtgctgccctgt

SEQ ID NO: 3361440 - DNA, 13 bp, Homo sapiens
ccgcagtccccag

SEQ ID NO: 3361441 - DNA, 16 bp, Homo sapiens
ccgcagtccccagccc

SEQ ID NO: 3361442 - DNA, 18 bp, Homo sapiens
ccgcagtgctgggaccag

SEQ ID NO: 3361443 - DNA, 22 bp, Homo sapiens
ccgcagtgctgggaccagagcc

SEQ ID NO: 3361444 - DNA, 16 bp, Homo sapiens
ccgcattggtgactca

SEQ ID NO: 3361445 - DNA, 20 bp, Homo sapiens
ccgccaagatctacaggaca

SEQ ID NO: 3361446 - DNA, 16 bp, Homo sapiens
ccgccacacagaccac

SEQ ID NO: 3361447 - DNA, 17 bp, Homo sapiens
ccgccacccccatcttc

SEQ ID NO: 3361448 - DNA, 22 bp, Homo sapiens
ccgccacccccatcttccacct

SEQ ID NO: 3361449 - DNA, 17 bp, Homo sapiens
ccgccacctatctcgtg

SEQ ID NO: 3361450 - DNA, 13 bp, Homo sapiens
ccgccacctcagg

SEQ ID NO: 3361451 - DNA, 16 bp, Homo sapiens
ccgccacggcctggct

SEQ ID NO: 3361452 - DNA, 17 bp, Homo sapiens
ccgccacggcctggctg

SEQ ID NO: 3361453 - DNA, 20 bp, Homo sapiens
ccgccacggcctggctggtg

SEQ ID NO: 3361454 - DNA, 18 bp, Homo sapiens
ccgccagcctcctctgga

SEQ ID NO: 3361455 - DNA, 15 bp, Homo sapiens
ccgccattgccacca

SEQ ID NO: 3361456 - DNA, 16 bp, Homo sapiens
ccgccattgccaccag

SEQ ID NO: 3361457 - DNA, 17 bp, Homo sapiens
ccgcccacaccctcggg

SEQ ID NO: 3361458 - DNA, 23 bp, Homo sapiens
ccgcccacaggaagcctgcagtc

SEQ ID NO: 3361459 - DNA, 12 bp, Homo sapiens
ccgcccacccac

SEQ ID NO: 3361460 - DNA, 14 bp, Homo sapiens
ccgccccagcccct

SEQ ID NO: 3361461 - DNA, 16 bp, Homo sapiens
ccgcccccaccccttc

SEQ ID NO: 3361462 - DNA, 12 bp, Homo sapiens
ccgcccccagcc

SEQ ID NO: 3361463 - DNA, 12 bp, Homo sapiens
ccgcccgctcct

SEQ ID NO: 3361464 - DNA, 14 bp, Homo sapiens
ccgccctcctcggg

SEQ ID NO: 3361465 - DNA, 15 bp, Homo sapiens
ccgccctcttcctga

SEQ ID NO: 3361466 - DNA, 12 bp, Homo sapiens
ccgccctgccac

SEQ ID NO: 3361467 - DNA, 13 bp, Homo sapiens
ccgccctgccact

SEQ ID NO: 3361468 - DNA, 15 bp, Homo sapiens
ccgccctgccactca

SEQ ID NO: 3361469 - DNA, 14 bp, Homo sapiens
ccgccctgctcctc

SEQ ID NO: 3361470 - DNA, 15 bp, Homo sapiens
ccgccctgctcctcc

SEQ ID NO: 3361471 - DNA, 19 bp, Homo sapiens
ccgccctgctcctccctgg

SEQ ID NO: 3361472 - DNA, 14 bp, Homo sapiens
ccgccctgggctgg

SEQ ID NO: 3361473 - DNA, 19 bp, Homo sapiens
ccgccctgggctggactgg

SEQ ID NO: 3361474 - DNA, 17 bp, Homo sapiens
ccgccgcctcccacggc

SEQ ID NO: 3361475 - DNA, 18 bp, Homo sapiens
ccgccgcctcccacggca

SEQ ID NO: 3361476 - DNA, 18 bp, Homo sapiens
ccgccgcttttctcctct

SEQ ID NO: 3361477 - DNA, 21 bp, Homo sapiens
ccgcctcctcggggctccagg

SEQ ID NO: 3361478 - DNA, 22 bp, Homo sapiens
ccgcctcctcggggctccaggc

SEQ ID NO: 3361479 - DNA, 13 bp, Homo sapiens
ccgcctctcccgt

SEQ ID NO: 3361480 - DNA, 16 bp, Homo sapiens
ccgcctctggccgcca

SEQ ID NO: 3361481 - DNA, 12 bp, Homo sapiens
ccgcctgccacc

SEQ ID NO: 3361482 - DNA, 15 bp, Homo sapiens
ccgcctggccaggag

SEQ ID NO: 3361483 - DNA, 20 bp, Homo sapiens
ccgcctggccaggagcaggc

SEQ ID NO: 3361484 - DNA, 14 bp, Homo sapiens
ccgcctggccaggg

SEQ ID NO: 3361485 - DNA, 22 bp, Homo sapiens
ccgcctggccagggcagggcca

SEQ ID NO: 3361486 - DNA, 23 bp, Homo sapiens
ccgcctggccagggcagggccac

SEQ ID NO: 3361487 - DNA, 11 bp, Homo sapiens
ccgcctgggat

SEQ ID NO: 3361488 - DNA, 17 bp, Homo sapiens
ccgcctgttcccccgcc

SEQ ID NO: 3361489 - DNA, 13 bp, Homo sapiens
ccgccttcctggg

SEQ ID NO: 3361490 - DNA, 23 bp, Homo sapiens
ccgccttccttgaccttcctctg

SEQ ID NO: 3361491 - DNA, 19 bp, Homo sapiens
ccgccttctcccacatgag

SEQ ID NO: 3361492 - DNA, 18 bp, Homo sapiens
ccgcgatgccctgggggc

SEQ ID NO: 3361493 - DNA, 20 bp, Homo sapiens
ccgcgctcgcccagcaggag

SEQ ID NO: 3361494 - DNA, 20 bp, Homo sapiens
ccgcgctgggggagcctcgc

SEQ ID NO: 3361495 - DNA, 16 bp, Homo sapiens
ccgcggtgctctggcg

SEQ ID NO: 3361496 - DNA, 16 bp, Homo sapiens
ccgcgtttagaccaag

SEQ ID NO: 3361497 - DNA, 13 bp, Homo sapiens
ccgctaaggaaga

SEQ ID NO: 3361498 - DNA, 18 bp, Homo sapiens
ccgctcacctagagccag

SEQ ID NO: 3361499 - DNA, 11 bp, Homo sapiens
ccgctcagccc

SEQ ID NO: 3361500 - DNA, 15 bp, Homo sapiens
ccgctcagccctccc

SEQ ID NO: 3361501 - DNA, 22 bp, Homo sapiens
ccgctcagccctccctgcccct

SEQ ID NO: 3361502 - DNA, 18 bp, Homo sapiens
ccgctcccaccgccccca

SEQ ID NO: 3361503 - DNA, 20 bp, Homo sapiens
ccgctcccaccgcccccacc

SEQ ID NO: 3361504 - DNA, 23 bp, Homo sapiens
ccgctcggaggccccaaaggaaa

SEQ ID NO: 3361505 - DNA, 20 bp, Homo sapiens
ccgctctacatcttctgcct

SEQ ID NO: 3361506 - DNA, 22 bp, Homo sapiens
ccgctgagctgagtggccagcc

SEQ ID NO: 3361507 - DNA, 13 bp, Homo sapiens
ccgctgaggggtc

SEQ ID NO: 3361508 - DNA, 18 bp, Homo sapiens
ccgctgaggggtctcgga

SEQ ID NO: 3361509 - DNA, 13 bp, Homo sapiens
ccgctgataagca

SEQ ID NO: 3361510 - DNA, 13 bp, Homo sapiens
ccgctgcaccacg

SEQ ID NO: 3361511 - DNA, 14 bp, Homo sapiens
ccgctgcagggctc

SEQ ID NO: 3361512 - DNA, 20 bp, Homo sapiens
ccgctgccaccacgtctgcc

SEQ ID NO: 3361513 - DNA, 13 bp, Homo sapiens
ccgctgccagcac

SEQ ID NO: 3361514 - DNA, 15 bp, Homo sapiens
ccgctgccagcacag

SEQ ID NO: 3361515 - DNA, 18 bp, Homo sapiens
ccgctgctccttggctta

SEQ ID NO: 3361516 - DNA, 22 bp, Homo sapiens
ccgctggctttgggaaagccca

SEQ ID NO: 3361517 - DNA, 20 bp, Homo sapiens
ccgctgggtggttttttccc

SEQ ID NO: 3361518 - DNA, 18 bp, Homo sapiens
ccgctgtaagctcctttg

SEQ ID NO: 3361519 - DNA, 19 bp, Homo sapiens
ccgctgtcgccccaggccc

SEQ ID NO: 3361520 - DNA, 20 bp, Homo sapiens
ccgctgtcgccccaggccct

SEQ ID NO: 3361521 - DNA, 22 bp, Homo sapiens
ccgctgtcgccccaggccctcc

SEQ ID NO: 3361522 - DNA, 19 bp, Homo sapiens
ccgctgtgagcccctggtc

SEQ ID NO: 3361523 - DNA, 13 bp, Homo sapiens
ccgcttcctgttt

SEQ ID NO: 3361524 - DNA, 18 bp, Homo sapiens
ccgcttctctcggtgtgg

SEQ ID NO: 3361525 - DNA, 19 bp, Homo sapiens
ccgcttgaaaagctagtgt

SEQ ID NO: 3361526 - DNA, 21 bp, Homo sapiens
ccgcttgtggggacccaggct

SEQ ID NO: 3361527 - DNA, 17 bp, Homo sapiens
ccgctttgaaagaagca

SEQ ID NO: 3361528 - DNA, 19 bp, Homo sapiens
ccgcttttgttctcgcaaa

SEQ ID NO: 3361529 - DNA, 14 bp, Homo sapiens
ccggaaccacaggg

SEQ ID NO: 3361530 - DNA, 23 bp, Homo sapiens
ccggaaggaggccaaccagcccg

SEQ ID NO: 3361531 - DNA, 19 bp, Homo sapiens
ccggacatactctctgcct

SEQ ID NO: 3361532 - DNA, 23 bp, Homo sapiens
ccggacatactctctgcctggtg

SEQ ID NO: 3361533 - DNA, 14 bp, Homo sapiens
ccggacccacctca

SEQ ID NO: 3361534 - DNA, 12 bp, Homo sapiens
ccggactggtgc

SEQ ID NO: 3361535 - DNA, 16 bp, Homo sapiens
ccggactggtgccctc

SEQ ID NO: 3361536 - DNA, 18 bp, Homo sapiens
ccggactggtgccctcct

SEQ ID NO: 3361537 - DNA, 15 bp, Homo sapiens
ccggacttttctgca

SEQ ID NO: 3361538 - DNA, 22 bp, Homo sapiens
ccggagatagatgactttgcag

SEQ ID NO: 3361539 - DNA, 19 bp, Homo sapiens
ccggagattggacggcctg

SEQ ID NO: 3361540 - DNA, 20 bp, Homo sapiens
ccggagattggacggcctga

SEQ ID NO: 3361541 - DNA, 21 bp, Homo sapiens
ccggagcacagccctgggagg

SEQ ID NO: 3361542 - DNA, 14 bp, Homo sapiens
ccggaggggcctgg

SEQ ID NO: 3361543 - DNA, 18 bp, Homo sapiens
ccggagggtgtttatgta

SEQ ID NO: 3361544 - DNA, 17 bp, Homo sapiens
ccggcaaccccagttct

SEQ ID NO: 3361545 - DNA, 20 bp, Homo sapiens
ccggcaaccccagttctgct

SEQ ID NO: 3361546 - DNA, 21 bp, Homo sapiens
ccggcaaccccagttctgctc

SEQ ID NO: 3361547 - DNA, 15 bp, Homo sapiens
ccggcacactgccaa

SEQ ID NO: 3361548 - DNA, 16 bp, Homo sapiens
ccggcacactgccaaa

SEQ ID NO: 3361549 - DNA, 13 bp, Homo sapiens
ccggcaggccctg

SEQ ID NO: 3361550 - DNA, 17 bp, Homo sapiens
ccggcaggccctgcagt

SEQ ID NO: 3361551 - DNA, 21 bp, Homo sapiens
ccggcaggccctgcagtgttc

SEQ ID NO: 3361552 - DNA, 16 bp, Homo sapiens
ccggcagggcgggcag

SEQ ID NO: 3361553 - DNA, 21 bp, Homo sapiens
ccggcagggcgggcagagggc

SEQ ID NO: 3361554 - DNA, 14 bp, Homo sapiens
ccggccacacccag

SEQ ID NO: 3361555 - DNA, 15 bp, Homo sapiens
cctagcccaccctgc

SEQ ID NO: 3361556 - DNA, 17 bp, Homo sapiens
cctagcccaccctgctg

SEQ ID NO: 3361557 - DNA, 21 bp, Homo sapiens
cctagcccagactctgagctg

SEQ ID NO: 3361558 - DNA, 13 bp, Homo sapiens
cctagcccagcgc

SEQ ID NO: 3361559 - DNA, 11 bp, Homo sapiens
cctagcccagg

SEQ ID NO: 3361560 - DNA, 15 bp, Homo sapiens
cctagcccaggagag

SEQ ID NO: 3361561 - DNA, 20 bp, Homo sapiens
cctagcccaggagagagaaa

SEQ ID NO: 3361562 - DNA, 13 bp, Homo sapiens
cctagccctctca

SEQ ID NO: 3361563 - DNA, 20 bp, Homo sapiens
cctagccctctcacatttat

SEQ ID NO: 3361564 - DNA, 17 bp, Homo sapiens
cctagcctgtttcttcc

SEQ ID NO: 3361565 - DNA, 17 bp, Homo sapiens
cctagcggagcccagcc

SEQ ID NO: 3361566 - DNA, 19 bp, Homo sapiens
cctagcggagcccagcctg

SEQ ID NO: 3361567 - DNA, 15 bp, Homo sapiens
cctagctcctgccac

SEQ ID NO: 3361568 - DNA, 15 bp, Homo sapiens
cctagctggctctgt

SEQ ID NO: 3361569 - DNA, 16 bp, Homo sapiens
cctaggaccactcagc

SEQ ID NO: 3361570 - DNA, 19 bp, Homo sapiens
cctaggagatatctgaggg

SEQ ID NO: 3361571 - DNA, 16 bp, Homo sapiens
cctaggatgctgcagc

SEQ ID NO: 3361572 - DNA, 11 bp, Homo sapiens
cctaggattct

SEQ ID NO: 3361573 - DNA, 16 bp, Homo sapiens
cctaggcccaggcctg

SEQ ID NO: 3361574 - DNA, 22 bp, Homo sapiens
cctaggcccctcctagacccag

SEQ ID NO: 3361575 - DNA, 23 bp, Homo sapiens
cctaggcccctcctagacccagg

SEQ ID NO: 3361576 - DNA, 14 bp, Homo sapiens
cctaggcgggcggt

SEQ ID NO: 3361577 - DNA, 22 bp, Homo sapiens
cctaggctaggacgttggcctc

SEQ ID NO: 3361578 - DNA, 14 bp, Homo sapiens
cctaggctcatgga

SEQ ID NO: 3361579 - DNA, 15 bp, Homo sapiens
cctaggctccacccc

SEQ ID NO: 3361580 - DNA, 18 bp, Homo sapiens
cctaggctccaccccatc

SEQ ID NO: 3361581 - DNA, 17 bp, Homo sapiens
cctaggggaacagacca

SEQ ID NO: 3361582 - DNA, 19 bp, Homo sapiens
cctaggggaacagaccagt

SEQ ID NO: 3361583 - DNA, 13 bp, Homo sapiens
cctaggtgacaga

SEQ ID NO: 3361584 - DNA, 19 bp, Homo sapiens
cctaggtgcagctcctcag

SEQ ID NO: 3361585 - DNA, 18 bp, Homo sapiens
cctaggttcccggtcccg

SEQ ID NO: 3361586 - DNA, 20 bp, Homo sapiens
cctaggttcccggtcccgag

SEQ ID NO: 3361587 - DNA, 22 bp, Homo sapiens
cctaggttccctgttcttcctc

SEQ ID NO: 3361588 - DNA, 20 bp, Homo sapiens
cctaggttttggagagtttg

SEQ ID NO: 3361589 - DNA, 16 bp, Homo sapiens
cctagtactctctgct

SEQ ID NO: 3361590 - DNA, 21 bp, Homo sapiens
cctagtactctctgctctagc

SEQ ID NO: 3361591 - DNA, 22 bp, Homo sapiens
cctagtactctctgctctagcc

SEQ ID NO: 3361592 - DNA, 23 bp, Homo sapiens
cctagtactctctgctctagcca

SEQ ID NO: 3361593 - DNA, 16 bp, Homo sapiens
cctagtccagtgacct

SEQ ID NO: 3361594 - DNA, 16 bp, Homo sapiens
cctagtcccttcccct

SEQ ID NO: 3361595 - DNA, 23 bp, Homo sapiens
cctagtctgtgtggcaaattaaa

SEQ ID NO: 3361596 - DNA, 16 bp, Homo sapiens
cctagtgaaccacagg

SEQ ID NO: 3361597 - DNA, 17 bp, Homo sapiens
cctagtggatgactgtt

SEQ ID NO: 3361598 - DNA, 20 bp, Homo sapiens
cctagtggatgactgttgat

SEQ ID NO: 3361599 - DNA, 15 bp, Homo sapiens
cctagttaaagaaag

SEQ ID NO: 3361600 - DNA, 20 bp, Homo sapiens
cctagttaaagaaaggaaaa

SEQ ID NO: 3361601 - DNA, 17 bp, Homo sapiens
cctagttccctctgctc

SEQ ID NO: 3361602 - DNA, 18 bp, Homo sapiens
cctagttccctctgctca

SEQ ID NO: 3361603 - DNA, 21 bp, Homo sapiens
cctagttccctctgctcagcc

SEQ ID NO: 3361604 - DNA, 15 bp, Homo sapiens
cctagtttcctctcc

SEQ ID NO: 3361605 - DNA, 15 bp, Homo sapiens
cctagtttgacctca

SEQ ID NO: 3361606 - DNA, 17 bp, Homo sapiens
cctataacttcttcctg

SEQ ID NO: 3361607 - DNA, 14 bp, Homo sapiens
cctataacttgatg

SEQ ID NO: 3361608 - DNA, 17 bp, Homo sapiens
cctataacttgatgcat

SEQ ID NO: 3361609 - DNA, 23 bp, Homo sapiens
cctataaggagagttcaagcctg

SEQ ID NO: 3361610 - DNA, 21 bp, Homo sapiens
cctataatacaaatacacaat

SEQ ID NO: 3361611 - DNA, 14 bp, Homo sapiens
cctataatgtgtgt

SEQ ID NO: 3361612 - DNA, 19 bp, Homo sapiens
cctataatgtgtgtatgtg

SEQ ID NO: 3361613 - DNA, 21 bp, Homo sapiens
cctataatgtgtgtatgtgta

SEQ ID NO: 3361614 - DNA, 19 bp, Homo sapiens
cctatactgtagtattctt

SEQ ID NO: 3361615 - DNA, 15 bp, Homo sapiens
cctatagagaggggg

SEQ ID NO: 3361616 - DNA, 18 bp, Homo sapiens
cctatagtcccagctact

SEQ ID NO: 3361617 - DNA, 13 bp, Homo sapiens
cctatatatttct

SEQ ID NO: 3361618 - DNA, 16 bp, Homo sapiens
cctatatcctgtgact

SEQ ID NO: 3361619 - DNA, 15 bp, Homo sapiens
cctatatttacagtg

SEQ ID NO: 3361620 - DNA, 24 bp, Homo sapiens
cctatatttacagtgaaaatgtaa

SEQ ID NO: 3361621 - DNA, 18 bp, Homo sapiens
cctatcatttattctgct

SEQ ID NO: 3361622 - DNA, 14 bp, Homo sapiens
cctatcccaaacct

SEQ ID NO: 3361623 - DNA, 15 bp, Homo sapiens
cctatccctctccta

SEQ ID NO: 3361624 - DNA, 15 bp, Homo sapiens
cctatccgctgccag

SEQ ID NO: 3361625 - DNA, 18 bp, Homo sapiens
cctatccgctgccagcct

SEQ ID NO: 3361626 - DNA, 17 bp, Homo sapiens
cctatccttccagtggc

SEQ ID NO: 3361627 - DNA, 13 bp, Homo sapiens
cctatctcctgac

SEQ ID NO: 3361628 - DNA, 15 bp, Homo sapiens
cctatctcctgacag

SEQ ID NO: 3361629 - DNA, 19 bp, Homo sapiens
cctatctggggagctcctg

SEQ ID NO: 3361630 - DNA, 20 bp, Homo sapiens
cctatgagcatcctgagccc

SEQ ID NO: 3361631 - DNA, 21 bp, Homo sapiens
cctatgagcatcctgagcccc

SEQ ID NO: 3361632 - DNA, 14 bp, Homo sapiens
cctatgatcccagc

SEQ ID NO: 3361633 - DNA, 22 bp, Homo sapiens
cctatgatggatggcagactct

SEQ ID NO: 3361634 - DNA, 14 bp, Homo sapiens
cctatgcacatatg

SEQ ID NO: 3361635 - DNA, 15 bp, Homo sapiens
cctatgcccaggtac

SEQ ID NO: 3361636 - DNA, 18 bp, Homo sapiens
cctatggctggccactgc

SEQ ID NO: 3361637 - DNA, 19 bp, Homo sapiens
cctatggctggccactgca

SEQ ID NO: 3361638 - DNA, 14 bp, Homo sapiens
cctatgtatttgca

SEQ ID NO: 3361639 - DNA, 14 bp, Homo sapiens
cctatgtcctaagg

SEQ ID NO: 3361640 - DNA, 15 bp, Homo sapiens
cctatgtcctaagga

SEQ ID NO: 3361641 - DNA, 24 bp, Homo sapiens
cctatgtcctaaggacacactaat

SEQ ID NO: 3361642 - DNA, 17 bp, Homo sapiens
cctattatctgtcagct

SEQ ID NO: 3361643 - DNA, 19 bp, Homo sapiens
cctattcaccctccacttc

SEQ ID NO: 3361644 - DNA, 22 bp, Homo sapiens
cctattctattgcagttataga

SEQ ID NO: 3361645 - DNA, 17 bp, Homo sapiens
cctatttgccatgggct

SEQ ID NO: 3361646 - DNA, 17 bp, Homo sapiens
cctattttcatttgtac

SEQ ID NO: 3361647 - DNA, 18 bp, Homo sapiens
cctattttcatttgtaca

SEQ ID NO: 3361648 - DNA, 20 bp, Homo sapiens
cctattttcatttgtacaag

SEQ ID NO: 3361649 - DNA, 20 bp, Homo sapiens
cctatttttgacatggaaat

SEQ ID NO: 3361650 - DNA, 19 bp, Homo sapiens
cctcaaactcattgcagca

SEQ ID NO: 3361651 - DNA, 15 bp, Homo sapiens
cctcaaagaggcctt

SEQ ID NO: 3361652 - DNA, 14 bp, Homo sapiens
cctcaaagtctgca

SEQ ID NO: 3361653 - DNA, 16 bp, Homo sapiens
cctcaaatgaattctt

SEQ ID NO: 3361654 - DNA, 16 bp, Homo sapiens
cctcaacaagggagag

SEQ ID NO: 3361655 - DNA, 21 bp, Homo sapiens
cctcaacaagggagagacctc

SEQ ID NO: 3361656 - DNA, 13 bp, Homo sapiens
cctcaacaggccc

SEQ ID NO: 3361657 - DNA, 17 bp, Homo sapiens
cctcaacaggcccaggg

SEQ ID NO: 3361658 - DNA, 18 bp, Homo sapiens
cctcaacaggcccaggga

SEQ ID NO: 3361659 - DNA, 21 bp, Homo sapiens
cctcaacaggcccagggaggg

SEQ ID NO: 3361660 - DNA, 16 bp, Homo sapiens
cctcaacctcctgggc

SEQ ID NO: 3361661 - DNA, 20 bp, Homo sapiens
cctcaacctcttctggctca

SEQ ID NO: 3361662 - DNA, 18 bp, Homo sapiens
cctcaacgtattgtttcg

SEQ ID NO: 3361663 - DNA, 21 bp, Homo sapiens
cctcaactcacctaatgttta

SEQ ID NO: 3361664 - DNA, 14 bp, Homo sapiens
cctcaagaagtaat

SEQ ID NO: 3361665 - DNA, 17 bp, Homo sapiens
cctcaagagcacacaga

SEQ ID NO: 3361666 - DNA, 17 bp, Homo sapiens
cctcaagcaataattgt

SEQ ID NO: 3361667 - DNA, 21 bp, Homo sapiens
cctcaagcaataattgtttcc

SEQ ID NO: 3361668 - DNA, 22 bp, Homo sapiens
cctcaagcaataattgtttcca

SEQ ID NO: 3361669 - DNA, 20 bp, Homo sapiens
cctcaagccaatcccctcct

SEQ ID NO: 3361670 - DNA, 20 bp, Homo sapiens
cctcaagccccatttcctca

SEQ ID NO: 3361671 - DNA, 12 bp, Homo sapiens
cctcaaggactt

SEQ ID NO: 3361672 - DNA, 22 bp, Homo sapiens
cctcaaggacttgaaagcatcc

SEQ ID NO: 3361673 - DNA, 23 bp, Homo sapiens
cctcaaggacttgaaagcatcca

SEQ ID NO: 3361674 - DNA, 20 bp, Homo sapiens
cctcaaggttttaggttcta

SEQ ID NO: 3361675 - DNA, 20 bp, Homo sapiens
cctcaagtgattctcctgcc

SEQ ID NO: 3361676 - DNA, 18 bp, Homo sapiens
cctcaatagatctccagc

SEQ ID NO: 3361677 - DNA, 20 bp, Homo sapiens
cctcacaagcgctcccagcc

SEQ ID NO: 3361678 - DNA, 16 bp, Homo sapiens
cctcacacacacagct

SEQ ID NO: 3361679 - DNA, 20 bp, Homo sapiens
cctcacacacacagctgggc

SEQ ID NO: 3361680 - DNA, 13 bp, Homo sapiens
cctccctctccca

SEQ ID NO: 3361681 - DNA, 19 bp, Homo sapiens
cctccctctcccaggcccg

SEQ ID NO: 3361682 - DNA, 18 bp, Homo sapiens
cctccctctctcttctgc

SEQ ID NO: 3361683 - DNA, 17 bp, Homo sapiens
cctccctctgccccaag

SEQ ID NO: 3361684 - DNA, 18 bp, Homo sapiens
cctccctctgccccaagc

SEQ ID NO: 3361685 - DNA, 23 bp, Homo sapiens
cctccctctgccccaagcagcca

SEQ ID NO: 3361686 - DNA, 13 bp, Homo sapiens
cctccctgaacca

SEQ ID NO: 3361687 - DNA, 15 bp, Homo sapiens
cctccctgcccaggc

SEQ ID NO: 3361688 - DNA, 24 bp, Homo sapiens
cctccctgcccctcccttcaacca

SEQ ID NO: 3361689 - DNA, 12 bp, Homo sapiens
cctccctgctgt

SEQ ID NO: 3361690 - DNA, 12 bp, Homo sapiens
cctccctggatg

SEQ ID NO: 3361691 - DNA, 13 bp, Homo sapiens
cctccctggcaga

SEQ ID NO: 3361692 - DNA, 12 bp, Homo sapiens
cctccctggctg

SEQ ID NO: 3361693 - DNA, 14 bp, Homo sapiens
cctccctggctgcc

SEQ ID NO: 3361694 - DNA, 17 bp, Homo sapiens
cctccctggctgccctg

SEQ ID NO: 3361695 - DNA, 18 bp, Homo sapiens
cctccctgtctctgcatc

SEQ ID NO: 3361696 - DNA, 19 bp, Homo sapiens
cctcccttccgaccctctg

SEQ ID NO: 3361697 - DNA, 15 bp, Homo sapiens
cctcccttggcgtgg

SEQ ID NO: 3361698 - DNA, 22 bp, Homo sapiens
cctccgacagccccctctgccg

SEQ ID NO: 3361699 - DNA, 22 bp, Homo sapiens
cctccgaccacttccaggggaa

SEQ ID NO: 3361700 - DNA, 22 bp, Homo sapiens
cctccgaccctcatggccccca

SEQ ID NO: 3361701 - DNA, 19 bp, Homo sapiens
cctccgagagggagagaga

SEQ ID NO: 3361702 - DNA, 14 bp, Homo sapiens
cctccgccctgcca

SEQ ID NO: 3361703 - DNA, 16 bp, Homo sapiens
cctccgccctgccact

SEQ ID NO: 3361704 - DNA, 18 bp, Homo sapiens
cctccgccctgccactca

SEQ ID NO: 3361705 - DNA, 13 bp, Homo sapiens
cctccgcctcttg

SEQ ID NO: 3361706 - DNA, 20 bp, Homo sapiens
cctccggtgagcagggtcag

SEQ ID NO: 3361707 - DNA, 13 bp, Homo sapiens
cctccgtccaccc

SEQ ID NO: 3361708 - DNA, 15 bp, Homo sapiens
cctccgtccacccag

SEQ ID NO: 3361709 - DNA, 20 bp, Homo sapiens
cctccgtccacccaggctgc

SEQ ID NO: 3361710 - DNA, 15 bp, Homo sapiens
cctccgtcccctgcc

SEQ ID NO: 3361711 - DNA, 16 bp, Homo sapiens
cctccgtgatccatcc

SEQ ID NO: 3361712 - DNA, 22 bp, Homo sapiens
cctccgtttatgggccttgctt

SEQ ID NO: 3361713 - DNA, 18 bp, Homo sapiens
cctcctagaggtgggcag

SEQ ID NO: 3361714 - DNA, 20 bp, Homo sapiens
cctcctagaggtgggcagct

SEQ ID NO: 3361715 - DNA, 19 bp, Homo sapiens
cctcctcacctcatgccca

SEQ ID NO: 3361716 - DNA, 13 bp, Homo sapiens
cctcctcacctct

SEQ ID NO: 3361717 - DNA, 16 bp, Homo sapiens
cctcctcacctctgga

SEQ ID NO: 3361718 - DNA, 15 bp, Homo sapiens
cctcctcactggcca

SEQ ID NO: 3361719 - DNA, 17 bp, Homo sapiens
cctcctcactggccatc

SEQ ID NO: 3361720 - DNA, 21 bp, Homo sapiens
cctcctcaggcacacagctac

SEQ ID NO: 3361721 - DNA, 20 bp, Homo sapiens
cctcctccagcccctgtccc

SEQ ID NO: 3361722 - DNA, 23 bp, Homo sapiens
cctcctcccacccggctgcagag

SEQ ID NO: 3361723 - DNA, 21 bp, Homo sapiens
cctcctccccaactgtggggg

SEQ ID NO: 3361724 - DNA, 16 bp, Homo sapiens
cctcctcccccacccc

SEQ ID NO: 3361725 - DNA, 17 bp, Homo sapiens
cctcctcccccacccct

SEQ ID NO: 3361726 - DNA, 16 bp, Homo sapiens
cctcctccccctgttc

SEQ ID NO: 3361727 - DNA, 24 bp, Homo sapiens
cctcctcggaaccgctcacctaga

SEQ ID NO: 3361728 - DNA, 18 bp, Homo sapiens
cctcctcggggctccagg

SEQ ID NO: 3361729 - DNA, 19 bp, Homo sapiens
cctcctctcccatccccct

SEQ ID NO: 3361730 - DNA, 19 bp, Homo sapiens
cctcctctcccatccttga

SEQ ID NO: 3361731 - DNA, 16 bp, Homo sapiens
cctcctcttcaccccg

SEQ ID NO: 3361732 - DNA, 14 bp, Homo sapiens
cctcctcttctgac

SEQ ID NO: 3361733 - DNA, 12 bp, Homo sapiens
cctcctcttgga

SEQ ID NO: 3361734 - DNA, 20 bp, Homo sapiens
cctcctgaaccgcacagctc

SEQ ID NO: 3361735 - DNA, 15 bp, Homo sapiens
cctcctgacctgtca

SEQ ID NO: 3361736 - DNA, 13 bp, Homo sapiens
cctcctgcagaca

SEQ ID NO: 3361737 - DNA, 19 bp, Homo sapiens
cctcctgcagacacctgga

SEQ ID NO: 3361738 - DNA, 23 bp, Homo sapiens
cctcctgcagacacctggactga

SEQ ID NO: 3361739 - DNA, 19 bp, Homo sapiens
cctcctgcagaccacgccc

SEQ ID NO: 3361740 - DNA, 23 bp, Homo sapiens
cctcctgccctgtccctgtcccc

SEQ ID NO: 3361741 - DNA, 11 bp, Homo sapiens
cctcctgctca

SEQ ID NO: 3361742 - DNA, 21 bp, Homo sapiens
cctcctgctgtagtcctttct

SEQ ID NO: 3361743 - DNA, 23 bp, Homo sapiens
cctcctgctgtagtcctttctgc

SEQ ID NO: 3361744 - DNA, 19 bp, Homo sapiens
cctcctggaaccttgctgt

SEQ ID NO: 3361745 - DNA, 21 bp, Homo sapiens
cctcctggaaccttgctgtcc

SEQ ID NO: 3361746 - DNA, 13 bp, Homo sapiens
cctcctggccaga

SEQ ID NO: 3361747 - DNA, 16 bp, Homo sapiens
cctcctggccagacgc

SEQ ID NO: 3361748 - DNA, 22 bp, Homo sapiens
cctcctgtaaatggtgtacata

SEQ ID NO: 3361749 - DNA, 19 bp, Homo sapiens
cctcctgtggaacccagca

SEQ ID NO: 3361750 - DNA, 20 bp, Homo sapiens
cctcctgtggaacccagcag

SEQ ID NO: 3361751 - DNA, 13 bp, Homo sapiens
cctcctgtgtgtg

SEQ ID NO: 3361752 - DNA, 13 bp, Homo sapiens
cctcctgttctgc

SEQ ID NO: 3361753 - DNA, 12 bp, Homo sapiens
cctccttcagac

SEQ ID NO: 3361754 - DNA, 14 bp, Homo sapiens
cctccttcagacac

SEQ ID NO: 3361755 - DNA, 22 bp, Homo sapiens
cctccttcagacaccctcaacc

SEQ ID NO: 3361756 - DNA, 17 bp, Homo sapiens
cctccttccacctccct

SEQ ID NO: 3361757 - DNA, 18 bp, Homo sapiens
cctccttccacctccctc

SEQ ID NO: 3361758 - DNA, 17 bp, Homo sapiens
cctccttcccatgcctg

SEQ ID NO: 3361759 - DNA, 12 bp, Homo sapiens
cctccttgggca

SEQ ID NO: 3361760 - DNA, 20 bp, Homo sapiens
cctccttgggcactttttaa

SEQ ID NO: 3361761 - DNA, 21 bp, Homo sapiens
cctccttgggtcattgacctc

SEQ ID NO: 3361762 - DNA, 17 bp, Homo sapiens
cctccttggtgcctggc

SEQ ID NO: 3361763 - DNA, 12 bp, Homo sapiens
cctcctttctcc

SEQ ID NO: 3361764 - DNA, 14 bp, Homo sapiens
cctcctttctcctc

SEQ ID NO: 3361765 - DNA, 16 bp, Homo sapiens
cctcgaaacacagaaa

SEQ ID NO: 3361766 - DNA, 15 bp, Homo sapiens
cctcgaaccaaggca

SEQ ID NO: 3361767 - DNA, 18 bp, Homo sapiens
cctcgaagcgcgccactc

SEQ ID NO: 3361768 - DNA, 19 bp, Homo sapiens
cctcgacagcgcccctgct

SEQ ID NO: 3361769 - DNA, 20 bp, Homo sapiens
cctcgacagcgcccctgctg

SEQ ID NO: 3361770 - DNA, 21 bp, Homo sapiens
cctcgacagcgcccctgctgt

SEQ ID NO: 3361771 - DNA, 23 bp, Homo sapiens
cctcgacagcgcccctgctgtct

SEQ ID NO: 3361772 - DNA, 17 bp, Homo sapiens
cctcgacagggcctgga

SEQ ID NO: 3361773 - DNA, 22 bp, Homo sapiens
cctcgacagggcctggagcccc

SEQ ID NO: 3361774 - DNA, 21 bp, Homo sapiens
cctcgagatgggtgctggtcc

SEQ ID NO: 3361775 - DNA, 12 bp, Homo sapiens
cctcgaggcacc

SEQ ID NO: 3361776 - DNA, 13 bp, Homo sapiens
cctcgaggcaccg

SEQ ID NO: 3361777 - DNA, 15 bp, Homo sapiens
cctcgcctccccacc

SEQ ID NO: 3361778 - DNA, 13 bp, Homo sapiens
cctcgcctgtgga

SEQ ID NO: 3361779 - DNA, 15 bp, Homo sapiens
cctcgcctgtggagc

SEQ ID NO: 3361780 - DNA, 21 bp, Homo sapiens
cctcgcctgtggagctcagcc

SEQ ID NO: 3361781 - DNA, 14 bp, Homo sapiens
cctcgctctgggat

SEQ ID NO: 3361782 - DNA, 15 bp, Homo sapiens
cctcgctctgggatg

SEQ ID NO: 3361783 - DNA, 21 bp, Homo sapiens
cctcggaaccgctcacctaga

SEQ ID NO: 3361784 - DNA, 17 bp, Homo sapiens
cctcggagagcagcagc

SEQ ID NO: 3361785 - DNA, 19 bp, Homo sapiens
cctcggagagcagcagcac

SEQ ID NO: 3361786 - DNA, 22 bp, Homo sapiens
cctcggagggatggagaaagaa

SEQ ID NO: 3361787 - DNA, 19 bp, Homo sapiens
cctcggcttgtgggctggt

SEQ ID NO: 3361788 - DNA, 19 bp, Homo sapiens
cctcgggcccacctggcca

SEQ ID NO: 3361789 - DNA, 22 bp, Homo sapiens
cctcgggcccacctggccacct

SEQ ID NO: 3361790 - DNA, 18 bp, Homo sapiens
cctcgggccccatcctca

SEQ ID NO: 3361791 - DNA, 14 bp, Homo sapiens
cctcggggacacca

SEQ ID NO: 3361792 - DNA, 19 bp, Homo sapiens
cctcggggacaccagagct

SEQ ID NO: 3361793 - DNA, 21 bp, Homo sapiens
cctcggggggtcacaggccca

SEQ ID NO: 3361794 - DNA, 17 bp, Homo sapiens
cctcgtccacaggggca

SEQ ID NO: 3361795 - DNA, 15 bp, Homo sapiens
cctcgtcctgtccca

SEQ ID NO: 3361796 - DNA, 23 bp, Homo sapiens
cctcgtgaggggcaagctaggcc

SEQ ID NO: 3361797 - DNA, 12 bp, Homo sapiens
cctcgtgcgccc

SEQ ID NO: 3361798 - DNA, 16 bp, Homo sapiens
cctcgtggccagcccg

SEQ ID NO: 3361799 - DNA, 22 bp, Homo sapiens
cctcgtggccagcccggctggt

SEQ ID NO: 3361800 - DNA, 19 bp, Homo sapiens
cctcgtggtccccaacagc

SEQ ID NO: 3361801 - DNA, 13 bp, Homo sapiens
cctcgtgtcatct

SEQ ID NO: 3361802 - DNA, 21 bp, Homo sapiens
cctcgttcctttctcctgttt

SEQ ID NO: 3361803 - DNA, 14 bp, Homo sapiens
cctctacccaaacc

SEQ ID NO: 3361804 - DNA, 15 bp, Homo sapiens
cctctagaagccaag

SEQ ID NO: 3361805 - DNA, 15 bp, Homo sapiens
cctctaggcaagcag

SEQ ID NO: 3361806 - DNA, 14 bp, Homo sapiens
cctgccaccctggg

SEQ ID NO: 3361807 - DNA, 13 bp, Homo sapiens
cctgccaccctgt

SEQ ID NO: 3361808 - DNA, 13 bp, Homo sapiens
cctgccacctccc

SEQ ID NO: 3361809 - DNA, 15 bp, Homo sapiens
cctgccactcactag

SEQ ID NO: 3361810 - DNA, 23 bp, Homo sapiens
cctgccactttggtacatggcca

SEQ ID NO: 3361811 - DNA, 12 bp, Homo sapiens
cctgccagcccc

SEQ ID NO: 3361812 - DNA, 15 bp, Homo sapiens
cctgccagctgcctt

SEQ ID NO: 3361813 - DNA, 19 bp, Homo sapiens
cctgccagttgaaaatgga

SEQ ID NO: 3361814 - DNA, 15 bp, Homo sapiens
cctgccatgggccag

SEQ ID NO: 3361815 - DNA, 17 bp, Homo sapiens
cctgccatgtttagtga

SEQ ID NO: 3361816 - DNA, 17 bp, Homo sapiens
cctgccattcttctggt

SEQ ID NO: 3361817 - DNA, 15 bp, Homo sapiens
cctgcccaaaccctt

SEQ ID NO: 3361818 - DNA, 16 bp, Homo sapiens
cctgcccaagcccagg

SEQ ID NO: 3361819 - DNA, 18 bp, Homo sapiens
cctgcccaagcccaggcc

SEQ ID NO: 3361820 - DNA, 15 bp, Homo sapiens
cctgcccaagggcct

SEQ ID NO: 3361821 - DNA, 23 bp, Homo sapiens
cctgcccaagggcctcccaccag

SEQ ID NO: 3361822 - DNA, 23 bp, Homo sapiens
cctgcccaatgagactctagggt

SEQ ID NO: 3361823 - DNA, 15 bp, Homo sapiens
cctgcccaggcccct

SEQ ID NO: 3361824 - DNA, 16 bp, Homo sapiens
cctgcccaggcccctg

SEQ ID NO: 3361825 - DNA, 21 bp, Homo sapiens
cctgcccaggcccctgccacc

SEQ ID NO: 3361826 - DNA, 22 bp, Homo sapiens
cctgcccaggcccctgccaccc

SEQ ID NO: 3361827 - DNA, 16 bp, Homo sapiens
cctgcccagtccccca

SEQ ID NO: 3361828 - DNA, 23 bp, Homo sapiens
cctgcccagtcccccaaccccag

SEQ ID NO: 3361829 - DNA, 16 bp, Homo sapiens
cctgcccatgccccag

SEQ ID NO: 3361830 - DNA, 12 bp, Homo sapiens
cctgcccatgtg

SEQ ID NO: 3361831 - DNA, 20 bp, Homo sapiens
cctgccccaatccctttatt

SEQ ID NO: 3361832 - DNA, 21 bp, Homo sapiens
cctgccccacccaccccacag

SEQ ID NO: 3361833 - DNA, 13 bp, Homo sapiens
cctgccccagccc

SEQ ID NO: 3361834 - DNA, 17 bp, Homo sapiens
cctgccccagcccaagt

SEQ ID NO: 3361835 - DNA, 18 bp, Homo sapiens
cctgccccaggcctgaaa

SEQ ID NO: 3361836 - DNA, 15 bp, Homo sapiens
cctgcccccagcccc

SEQ ID NO: 3361837 - DNA, 19 bp, Homo sapiens
cctgcccccatctccccag

SEQ ID NO: 3361838 - DNA, 22 bp, Homo sapiens
cctgcccccatctccccaggcc

SEQ ID NO: 3361839 - DNA, 21 bp, Homo sapiens
cctgccccccaaggttctggt

SEQ ID NO: 3361840 - DNA, 15 bp, Homo sapiens
cctgccccccagcct

SEQ ID NO: 3361841 - DNA, 17 bp, Homo sapiens
cctgccccccagcctct

SEQ ID NO: 3361842 - DNA, 13 bp, Homo sapiens
cctgccccctggc

SEQ ID NO: 3361843 - DNA, 13 bp, Homo sapiens
cctgccccctggt

SEQ ID NO: 3361844 - DNA, 22 bp, Homo sapiens
cctgccccgcccagctgcacct

SEQ ID NO: 3361845 - DNA, 20 bp, Homo sapiens
cctgccccgcccccagtccc

SEQ ID NO: 3361846 - DNA, 15 bp, Homo sapiens
cctgccccggaggaa

SEQ ID NO: 3361847 - DNA, 22 bp, Homo sapiens
cctgcccctaggatgctgcagc

SEQ ID NO: 3361848 - DNA, 12 bp, Homo sapiens
cctgcccctgca

SEQ ID NO: 3361849 - DNA, 14 bp, Homo sapiens
cctgcccctgcaaa

SEQ ID NO: 3361850 - DNA, 18 bp, Homo sapiens
cctgcccctgcaaagaca

SEQ ID NO: 3361851 - DNA, 13 bp, Homo sapiens
cctgcccgcacag

SEQ ID NO: 3361852 - DNA, 15 bp, Homo sapiens
cctgcccgcacagca

SEQ ID NO: 3361853 - DNA, 17 bp, Homo sapiens
cctgcccgcacagcagc

SEQ ID NO: 3361854 - DNA, 20 bp, Homo sapiens
cctgcccgcacagcagcctg

SEQ ID NO: 3361855 - DNA, 12 bp, Homo sapiens
cctgcccgctcc

SEQ ID NO: 3361856 - DNA, 14 bp, Homo sapiens
cctgcccggctgcg

SEQ ID NO: 3361857 - DNA, 13 bp, Homo sapiens
cctgccctccagc

SEQ ID NO: 3361858 - DNA, 18 bp, Homo sapiens
cctgccctccagctgctg

SEQ ID NO: 3361859 - DNA, 21 bp, Homo sapiens
cctgccctccccagagcactg

SEQ ID NO: 3361860 - DNA, 13 bp, Homo sapiens
cctgccctcgtgg

SEQ ID NO: 3361861 - DNA, 14 bp, Homo sapiens
cctgccctcgtggc

SEQ ID NO: 3361862 - DNA, 17 bp, Homo sapiens
cctgccctcgtggccag

SEQ ID NO: 3361863 - DNA, 18 bp, Homo sapiens
cctgccctcgtggccagc

SEQ ID NO: 3361864 - DNA, 19 bp, Homo sapiens
cctgccctcgtggccagcc

SEQ ID NO: 3361865 - DNA, 20 bp, Homo sapiens
cctgccctcgtggccagccc

SEQ ID NO: 3361866 - DNA, 13 bp, Homo sapiens
cctgccctgcacg

SEQ ID NO: 3361867 - DNA, 15 bp, Homo sapiens
cctgccctgccccca

SEQ ID NO: 3361868 - DNA, 12 bp, Homo sapiens
cctgccctggtc

SEQ ID NO: 3361869 - DNA, 15 bp, Homo sapiens
cctgccctggtccag

SEQ ID NO: 3361870 - DNA, 16 bp, Homo sapiens
cctgccctgtccctgt

SEQ ID NO: 3361871 - DNA, 17 bp, Homo sapiens
cctgccctgtccctgtc

SEQ ID NO: 3361872 - DNA, 16 bp, Homo sapiens
cctgcccttgtctgag

SEQ ID NO: 3361873 - DNA, 23 bp, Homo sapiens
cctgccgcagacgggcacagaca

SEQ ID NO: 3361874 - DNA, 18 bp, Homo sapiens
cctgccggtgggaccctg

SEQ ID NO: 3361875 - DNA, 17 bp, Homo sapiens
cctgcctaaccaggccc

SEQ ID NO: 3361876 - DNA, 16 bp, Homo sapiens
cctgcctcagcctccc

SEQ ID NO: 3361877 - DNA, 13 bp, Homo sapiens
cctgcctcccaag

SEQ ID NO: 3361878 - DNA, 18 bp, Homo sapiens
cctgcctcccatgcctgg

SEQ ID NO: 3361879 - DNA, 17 bp, Homo sapiens
cctgcctcctgggaaga

SEQ ID NO: 3361880 - DNA, 17 bp, Homo sapiens
cctgcctctcacacaca

SEQ ID NO: 3361881 - DNA, 23 bp, Homo sapiens
cctgcctctcatcaactgaatga

SEQ ID NO: 3361882 - DNA, 12 bp, Homo sapiens
cctgcctctgcc

SEQ ID NO: 3361883 - DNA, 13 bp, Homo sapiens
cctgcctctgcct

SEQ ID NO: 3361884 - DNA, 12 bp, Homo sapiens
cctgcctggaac

SEQ ID NO: 3361885 - DNA, 14 bp, Homo sapiens
cctgcctggcaggc

SEQ ID NO: 3361886 - DNA, 14 bp, Homo sapiens
cctgcctggccagg

SEQ ID NO: 3361887 - DNA, 23 bp, Homo sapiens
cctgcctggccaggcagatctgt

SEQ ID NO: 3361888 - DNA, 15 bp, Homo sapiens
cctgcctggccccca

SEQ ID NO: 3361889 - DNA, 18 bp, Homo sapiens
cctgcctgggtgggacag

SEQ ID NO: 3361890 - DNA, 20 bp, Homo sapiens
cctgcctgggtgggacagcc

SEQ ID NO: 3361891 - DNA, 24 bp, Homo sapiens
cctgcctgggttgggggcactcag

SEQ ID NO: 3361892 - DNA, 22 bp, Homo sapiens
cctgccttcttctttttgctgt

SEQ ID NO: 3361893 - DNA, 23 bp, Homo sapiens
cctgccttcttctttttgctgtt

SEQ ID NO: 3361894 - DNA, 16 bp, Homo sapiens
cctgccttgaagccac

SEQ ID NO: 3361895 - DNA, 17 bp, Homo sapiens
cctgccttgaagccact

SEQ ID NO: 3361896 - DNA, 13 bp, Homo sapiens
cctgcgagacgca

SEQ ID NO: 3361897 - DNA, 18 bp, Homo sapiens
cctgcgagacgcacacag

SEQ ID NO: 3361898 - DNA, 21 bp, Homo sapiens
cctgcgagacgcacacagctg

SEQ ID NO: 3361899 - DNA, 17 bp, Homo sapiens
cctgcgccccgcccaca

SEQ ID NO: 3361900 - DNA, 14 bp, Homo sapiens
cctgcgcctgtgat

SEQ ID NO: 3361901 - DNA, 18 bp, Homo sapiens
cctgcgctcggcaggaag

SEQ ID NO: 3361902 - DNA, 16 bp, Homo sapiens
cctgcggagtgaagag

SEQ ID NO: 3361903 - DNA, 18 bp, Homo sapiens
cctgcggagtgaagaggg

SEQ ID NO: 3361904 - DNA, 20 bp, Homo sapiens
cctgcggagtgaagaggggc

SEQ ID NO: 3361905 - DNA, 20 bp, Homo sapiens
cctgcgggcgcgggcagcca

SEQ ID NO: 3361906 - DNA, 21 bp, Homo sapiens
cctgcgggcgcgggcagccac

SEQ ID NO: 3361907 - DNA, 22 bp, Homo sapiens
cctgcgggctgccccgctttgc

SEQ ID NO: 3361908 - DNA, 15 bp, Homo sapiens
cctgcggtcaggctg

SEQ ID NO: 3361909 - DNA, 15 bp, Homo sapiens
cctgcgtcctcctca

SEQ ID NO: 3361910 - DNA, 16 bp, Homo sapiens
cctgcgtcctcctcac

SEQ ID NO: 3361911 - DNA, 20 bp, Homo sapiens
cctgcgtcctcctcacctca

SEQ ID NO: 3361912 - DNA, 21 bp, Homo sapiens
cctgcgtcctgacgccctgcg

SEQ ID NO: 3361913 - DNA, 12 bp, Homo sapiens
cctgcgtggcct

SEQ ID NO: 3361914 - DNA, 14 bp, Homo sapiens
cctgcgtggcctga

SEQ ID NO: 3361915 - DNA, 23 bp, Homo sapiens
cctgcgtggcctgagtcctggtc

SEQ ID NO: 3361916 - DNA, 13 bp, Homo sapiens
cctgcgttggagc

SEQ ID NO: 3361917 - DNA, 18 bp, Homo sapiens
cctgcgttggagccactc

SEQ ID NO: 3361918 - DNA, 21 bp, Homo sapiens
cctgcgttggagccactcctg

SEQ ID NO: 3361919 - DNA, 18 bp, Homo sapiens
cctgcgttggtccagagc

SEQ ID NO: 3361920 - DNA, 15 bp, Homo sapiens
cctgctactcctgtg

SEQ ID NO: 3361921 - DNA, 20 bp, Homo sapiens
cctgctagagcaacccctgt

SEQ ID NO: 3361922 - DNA, 22 bp, Homo sapiens
cctgctcaactctacccctgct

SEQ ID NO: 3361923 - DNA, 15 bp, Homo sapiens
cctgctcagtgcttg

SEQ ID NO: 3361924 - DNA, 20 bp, Homo sapiens
cctgctcagtgcttgggctc

SEQ ID NO: 3361925 - DNA, 23 bp, Homo sapiens
cctgctcagtgcttgggctccac

SEQ ID NO: 3361926 - DNA, 22 bp, Homo sapiens
cctgctccacgaagccttaagc

SEQ ID NO: 3361927 - DNA, 20 bp, Homo sapiens
cctgctccatgactggctgt

SEQ ID NO: 3361928 - DNA, 14 bp, Homo sapiens
cctgctcccagcag

SEQ ID NO: 3361929 - DNA, 16 bp, Homo sapiens
cctgctcccagcagcc

SEQ ID NO: 3361930 - DNA, 18 bp, Homo sapiens
cctgctcccagcctgctg

SEQ ID NO: 3361931 - DNA, 13 bp, Homo sapiens
cctgctccctgct

SEQ ID NO: 3361932 - DNA, 14 bp, Homo sapiens
cctgtacctcagtg

SEQ ID NO: 3361933 - DNA, 22 bp, Homo sapiens
cctgtaccttttgaggagcccc

SEQ ID NO: 3361934 - DNA, 15 bp, Homo sapiens
cctgtactcaggagg

SEQ ID NO: 3361935 - DNA, 22 bp, Homo sapiens
cctgtactcaggaggctgaggg

SEQ ID NO: 3361936 - DNA, 23 bp, Homo sapiens
cctgtactcaggaggctgagggg

SEQ ID NO: 3361937 - DNA, 13 bp, Homo sapiens
cctgtagagttgc

SEQ ID NO: 3361938 - DNA, 17 bp, Homo sapiens
cctgtagagttgctgag

SEQ ID NO: 3361939 - DNA, 21 bp, Homo sapiens
cctgtagcagtgagaaaaagc

SEQ ID NO: 3361940 - DNA, 17 bp, Homo sapiens
cctgtagccatctgcac

SEQ ID NO: 3361941 - DNA, 19 bp, Homo sapiens
cctgtagctttcctggtcc

SEQ ID NO: 3361942 - DNA, 13 bp, Homo sapiens
cctgtagtcccag

SEQ ID NO: 3361943 - DNA, 15 bp, Homo sapiens
cctgtagttaggaaa

SEQ ID NO: 3361944 - DNA, 17 bp, Homo sapiens
cctgtagttaggaaata

SEQ ID NO: 3361945 - DNA, 18 bp, Homo sapiens
cctgtagttgcgtggact

SEQ ID NO: 3361946 - DNA, 22 bp, Homo sapiens
cctgtataagtggaggcacttt

SEQ ID NO: 3361947 - DNA, 22 bp, Homo sapiens
cctgtatagttaggatagcatt

SEQ ID NO: 3361948 - DNA, 22 bp, Homo sapiens
cctgtatgtcaataaacaacag

SEQ ID NO: 3361949 - DNA, 15 bp, Homo sapiens
cctgtcaagttaaca

SEQ ID NO: 3361950 - DNA, 16 bp, Homo sapiens
cctgtcagaggctaag

SEQ ID NO: 3361951 - DNA, 16 bp, Homo sapiens
cctgtcaggctctggc

SEQ ID NO: 3361952 - DNA, 22 bp, Homo sapiens
cctgtcaggctctggcccttgc

SEQ ID NO: 3361953 - DNA, 15 bp, Homo sapiens
cctgtcatgcccccc

SEQ ID NO: 3361954 - DNA, 16 bp, Homo sapiens
cctgtcatgcccccct

SEQ ID NO: 3361955 - DNA, 20 bp, Homo sapiens
cctgtcatttgaacctggat

SEQ ID NO: 3361956 - DNA, 16 bp, Homo sapiens
cctgtccacacccagc

SEQ ID NO: 3361957 - DNA, 22 bp, Homo sapiens
cctgtcccacccccttccccca

SEQ ID NO: 3361958 - DNA, 13 bp, Homo sapiens
cctgtccccaccc

SEQ ID NO: 3361959 - DNA, 15 bp, Homo sapiens
cctgtcccccaaggt

SEQ ID NO: 3361960 - DNA, 13 bp, Homo sapiens
cctgtcccccagc

SEQ ID NO: 3361961 - DNA, 15 bp, Homo sapiens
cctgtcccccagctc

SEQ ID NO: 3361962 - DNA, 16 bp, Homo sapiens
cctgtcccccagctct

SEQ ID NO: 3361963 - DNA, 17 bp, Homo sapiens
cctgtcccccagctctg

SEQ ID NO: 3361964 - DNA, 19 bp, Homo sapiens
cctgtcccccagctctggt

SEQ ID NO: 3361965 - DNA, 16 bp, Homo sapiens
cctgtccccctcccct

SEQ ID NO: 3361966 - DNA, 21 bp, Homo sapiens
cctgtccccctcccctcccag

SEQ ID NO: 3361967 - DNA, 17 bp, Homo sapiens
cctgtcccctcagctcc

SEQ ID NO: 3361968 - DNA, 13 bp, Homo sapiens
cctgtccctccca

SEQ ID NO: 3361969 - DNA, 20 bp, Homo sapiens
cctgtccctcccacctctgt

SEQ ID NO: 3361970 - DNA, 16 bp, Homo sapiens
cctgtccggcccagtg

SEQ ID NO: 3361971 - DNA, 19 bp, Homo sapiens
cctgtccggcccagtgcca

SEQ ID NO: 3361972 - DNA, 20 bp, Homo sapiens
cctgtccggcccagtgccac

SEQ ID NO: 3361973 - DNA, 17 bp, Homo sapiens
cctgtcctaaggaacct

SEQ ID NO: 3361974 - DNA, 13 bp, Homo sapiens
cctgtcctcactg

SEQ ID NO: 3361975 - DNA, 16 bp, Homo sapiens
cctgtcctcactgctc

SEQ ID NO: 3361976 - DNA, 22 bp, Homo sapiens
cctgtcctcactgctccctgaa

SEQ ID NO: 3361977 - DNA, 13 bp, Homo sapiens
cctgtcctgatgg

SEQ ID NO: 3361978 - DNA, 20 bp, Homo sapiens
cctgtcgagacacttgcctt

SEQ ID NO: 3361979 - DNA, 20 bp, Homo sapiens
cctgtctaggtctcctcagg

SEQ ID NO: 3361980 - DNA, 21 bp, Homo sapiens
cctgtctaggtctcctcaggg

SEQ ID NO: 3361981 - DNA, 22 bp, Homo sapiens
cctgtctaggtctcctcagggt

SEQ ID NO: 3361982 - DNA, 16 bp, Homo sapiens
cctgtctagtctctcc

SEQ ID NO: 3361983 - DNA, 18 bp, Homo sapiens
cctgtctagtctctcctg

SEQ ID NO: 3361984 - DNA, 23 bp, Homo sapiens
cctgtctagtctctcctgtaagc

SEQ ID NO: 3361985 - DNA, 15 bp, Homo sapiens
cctgtctcacctgga

SEQ ID NO: 3361986 - DNA, 13 bp, Homo sapiens
cctgtctcctttc

SEQ ID NO: 3361987 - DNA, 13 bp, Homo sapiens
cctgtctctgcct

SEQ ID NO: 3361988 - DNA, 15 bp, Homo sapiens
cctgtctctgcctgc

SEQ ID NO: 3361989 - DNA, 18 bp, Homo sapiens
cctgtctctgttcagatg

SEQ ID NO: 3361990 - DNA, 23 bp, Homo sapiens
cctgtctgagactcacaggaagg

SEQ ID NO: 3361991 - DNA, 19 bp, Homo sapiens
cctgtctgccctctgggtc

SEQ ID NO: 3361992 - DNA, 20 bp, Homo sapiens
cctgtcttcacctgccacca

SEQ ID NO: 3361993 - DNA, 22 bp, Homo sapiens
cctgtcttcacctgccaccaca

SEQ ID NO: 3361994 - DNA, 15 bp, Homo sapiens
cctgtcttccaagga

SEQ ID NO: 3361995 - DNA, 16 bp, Homo sapiens
cctgtgaatgccactg

SEQ ID NO: 3361996 - DNA, 17 bp, Homo sapiens
cctgtgaatgccactgc

SEQ ID NO: 3361997 - DNA, 17 bp, Homo sapiens
cctgtgacatggtgcct

SEQ ID NO: 3361998 - DNA, 23 bp, Homo sapiens
cctgtgacatggtgcctgagagg

SEQ ID NO: 3361999 - DNA, 17 bp, Homo sapiens
cctgtgaccagcactgt

SEQ ID NO: 3362000 - DNA, 16 bp, Homo sapiens
cctgtgatgctgggca

SEQ ID NO: 3362001 - DNA, 22 bp, Homo sapiens
cctgtgcagcagcccagcttcc

SEQ ID NO: 3362002 - DNA, 17 bp, Homo sapiens
cctgtgcatgtatgtct

SEQ ID NO: 3362003 - DNA, 22 bp, Homo sapiens
cctgtgccgtaaggattgcatc

SEQ ID NO: 3362004 - DNA, 17 bp, Homo sapiens
cctgtgcctctgggact

SEQ ID NO: 3362005 - DNA, 19 bp, Homo sapiens
cctgtgcctctgggactgg

SEQ ID NO: 3362006 - DNA, 16 bp, Homo sapiens
cctgtgcgtcccagct

SEQ ID NO: 3362007 - DNA, 18 bp, Homo sapiens
cctgtgcgtcccagctga

SEQ ID NO: 3362008 - DNA, 13 bp, Homo sapiens
cctgtgctagttt

SEQ ID NO: 3362009 - DNA, 14 bp, Homo sapiens
cctgtgctggggga

SEQ ID NO: 3362010 - DNA, 22 bp, Homo sapiens
cctgtgctggtgtcctgaccac

SEQ ID NO: 3362011 - DNA, 16 bp, Homo sapiens
cctgtgctgtggcata

SEQ ID NO: 3362012 - DNA, 19 bp, Homo sapiens
cctgtggaaggcagagaaa

SEQ ID NO: 3362013 - DNA, 23 bp, Homo sapiens
cctgtggaatgagtgtgcatgga

SEQ ID NO: 3362014 - DNA, 14 bp, Homo sapiens
cctgtggagactgg

SEQ ID NO: 3362015 - DNA, 16 bp, Homo sapiens
cctgtggagctcagcc

SEQ ID NO: 3362016 - DNA, 19 bp, Homo sapiens
cctgtggcactcagggagc

SEQ ID NO: 3362017 - DNA, 20 bp, Homo sapiens
cctgtggcagaaaagaggag

SEQ ID NO: 3362018 - DNA, 15 bp, Homo sapiens
cctgtggcaggcagc

SEQ ID NO: 3362019 - DNA, 21 bp, Homo sapiens
cctgtggcagtaaagagaaac

SEQ ID NO: 3362020 - DNA, 23 bp, Homo sapiens
cctgtggcagtaaagagaaactt

SEQ ID NO: 3362021 - DNA, 18 bp, Homo sapiens
cctgtggcatctttgcct

SEQ ID NO: 3362022 - DNA, 23 bp, Homo sapiens
cctgtggcatctttgccttgggc

SEQ ID NO: 3362023 - DNA, 16 bp, Homo sapiens
cctgtggccaactgca

SEQ ID NO: 3362024 - DNA, 15 bp, Homo sapiens
cctgtggccgccacc

SEQ ID NO: 3362025 - DNA, 15 bp, Homo sapiens
cctgtggcctgtgtc

SEQ ID NO: 3362026 - DNA, 19 bp, Homo sapiens
cctgtggcctgtgtcccat

SEQ ID NO: 3362027 - DNA, 21 bp, Homo sapiens
cctgtggcctgtgtcccatga

SEQ ID NO: 3362028 - DNA, 15 bp, Homo sapiens
cctgtgggagcctgc

SEQ ID NO: 3362029 - DNA, 22 bp, Homo sapiens
cctgtggggatctcaggggctg

SEQ ID NO: 3362030 - DNA, 22 bp, Homo sapiens
cctgtgggtccccactcacccc

SEQ ID NO: 3362031 - DNA, 17 bp, Homo sapiens
cctgtgggtgtagccag

SEQ ID NO: 3362032 - DNA, 18 bp, Homo sapiens
cctgtgggtgtagccagg

SEQ ID NO: 3362033 - DNA, 23 bp, Homo sapiens
cctgtgggtgtagccaggtatgg

SEQ ID NO: 3362034 - DNA, 15 bp, Homo sapiens
cctgtggttacagtg

SEQ ID NO: 3362035 - DNA, 14 bp, Homo sapiens
cctgtgtactgtgt

SEQ ID NO: 3362036 - DNA, 21 bp, Homo sapiens
cctgtgtcagaaaccctggtc

SEQ ID NO: 3362037 - DNA, 18 bp, Homo sapiens
cctgtgtccagcagctgc

SEQ ID NO: 3362038 - DNA, 19 bp, Homo sapiens
cctgtgtccatgcgctcag

SEQ ID NO: 3362039 - DNA, 23 bp, Homo sapiens
cctgtgtgactggcaagaggcct

SEQ ID NO: 3362040 - DNA, 20 bp, Homo sapiens
cctgtgtgtactctgtccag

SEQ ID NO: 3362041 - DNA, 21 bp, Homo sapiens
cctgtgtgtccaaaactgcct

SEQ ID NO: 3362042 - DNA, 18 bp, Homo sapiens
cctgttattttatgtctg

SEQ ID NO: 3362043 - DNA, 19 bp, Homo sapiens
cctgttattttatgtctgt

SEQ ID NO: 3362044 - DNA, 21 bp, Homo sapiens
cctgttcacagaaaaagcatg

SEQ ID NO: 3362045 - DNA, 14 bp, Homo sapiens
cctgttcagctcca

SEQ ID NO: 3362046 - DNA, 15 bp, Homo sapiens
cctgttcagctccag

SEQ ID NO: 3362047 - DNA, 20 bp, Homo sapiens
cctgttcagctccagctcac

SEQ ID NO: 3362048 - DNA, 21 bp, Homo sapiens
cctgttcagctccagctcacc

SEQ ID NO: 3362049 - DNA, 16 bp, Homo sapiens
cctgttcatgtgcctc

SEQ ID NO: 3362050 - DNA, 22 bp, Homo sapiens
cctgttcccctcactggatgaa

SEQ ID NO: 3362051 - DNA, 14 bp, Homo sapiens
cctgttccctaccc

SEQ ID NO: 3362052 - DNA, 12 bp, Homo sapiens
cctgttctaagg

SEQ ID NO: 3362053 - DNA, 13 bp, Homo sapiens
cctgttctccctt

SEQ ID NO: 3362054 - DNA, 14 bp, Homo sapiens
cctgttctcccttt

SEQ ID NO: 3362055 - DNA, 17 bp, Homo sapiens
cctgttctccctttctc

SEQ ID NO: 3362056 - DNA, 21 bp, Homo sapiens
cctgttctccctttctctctc

SEQ ID NO: 3362057 - DNA, 19 bp, Homo sapiens
ccttccccctccaatccca

SEQ ID NO: 3362058 - DNA, 16 bp, Homo sapiens
ccttcccctcccctcc

SEQ ID NO: 3362059 - DNA, 19 bp, Homo sapiens
ccttcccctgtcttcacct

SEQ ID NO: 3362060 - DNA, 21 bp, Homo sapiens
ccttcccctgtcttcacctgc

SEQ ID NO: 3362061 - DNA, 14 bp, Homo sapiens
ccttccccttctgt

SEQ ID NO: 3362062 - DNA, 16 bp, Homo sapiens
ccttccctaaagtgat

SEQ ID NO: 3362063 - DNA, 17 bp, Homo sapiens
ccttccctaaagtgatg

SEQ ID NO: 3362064 - DNA, 14 bp, Homo sapiens
ccttccctgggaag

SEQ ID NO: 3362065 - DNA, 12 bp, Homo sapiens
ccttccctgtcc

SEQ ID NO: 3362066 - DNA, 14 bp, Homo sapiens
ccttccctgtccct

SEQ ID NO: 3362067 - DNA, 17 bp, Homo sapiens
ccttccctgtccctcta

SEQ ID NO: 3362068 - DNA, 15 bp, Homo sapiens
ccttccctgttctcc

SEQ ID NO: 3362069 - DNA, 17 bp, Homo sapiens
ccttccctgttctccct

SEQ ID NO: 3362070 - DNA, 23 bp, Homo sapiens
ccttccctgttctccctttctct

SEQ ID NO: 3362071 - DNA, 20 bp, Homo sapiens
ccttcccttccactgcctct

SEQ ID NO: 3362072 - DNA, 23 bp, Homo sapiens
ccttcccttccactgcctctgcc

SEQ ID NO: 3362073 - DNA, 16 bp, Homo sapiens
ccttccgaccctctgg

SEQ ID NO: 3362074 - DNA, 18 bp, Homo sapiens
ccttccgaccctctggga

SEQ ID NO: 3362075 - DNA, 22 bp, Homo sapiens
ccttccgaccctctgggaacct

SEQ ID NO: 3362076 - DNA, 16 bp, Homo sapiens
ccttccgccccttccc

SEQ ID NO: 3362077 - DNA, 19 bp, Homo sapiens
ccttccgccccttcccttc

SEQ ID NO: 3362078 - DNA, 18 bp, Homo sapiens
ccttcctaccctcctgca

SEQ ID NO: 3362079 - DNA, 11 bp, Homo sapiens
ccttcctataa

SEQ ID NO: 3362080 - DNA, 12 bp, Homo sapiens
ccttcctcatcc

SEQ ID NO: 3362081 - DNA, 19 bp, Homo sapiens
ccttcctcatccaccccat

SEQ ID NO: 3362082 - DNA, 10 bp, Homo sapiens
ccttcctcct

SEQ ID NO: 3362083 - DNA, 13 bp, Homo sapiens
ccttcctcctcca

SEQ ID NO: 3362084 - DNA, 16 bp, Homo sapiens
ccttcctcctccacag

SEQ ID NO: 3362085 - DNA, 12 bp, Homo sapiens
ccttcctcctta

SEQ ID NO: 3362086 - DNA, 17 bp, Homo sapiens
ccttcctctcaagctag

SEQ ID NO: 3362087 - DNA, 15 bp, Homo sapiens
ccttcctctcactcc

SEQ ID NO: 3362088 - DNA, 14 bp, Homo sapiens
ccttcctctccact

SEQ ID NO: 3362089 - DNA, 17 bp, Homo sapiens
ccttcctctccactgcc

SEQ ID NO: 3362090 - DNA, 20 bp, Homo sapiens
ccttcctctccactgccttc

SEQ ID NO: 3362091 - DNA, 22 bp, Homo sapiens
ccttcctctggggctctagggt

SEQ ID NO: 3362092 - DNA, 21 bp, Homo sapiens
ccttcctcttgtctgatttct

SEQ ID NO: 3362093 - DNA, 17 bp, Homo sapiens
ccttcctgagacctcgc

SEQ ID NO: 3362094 - DNA, 17 bp, Homo sapiens
ccttcctgcatttctct

SEQ ID NO: 3362095 - DNA, 12 bp, Homo sapiens
ccttcctggcct

SEQ ID NO: 3362096 - DNA, 18 bp, Homo sapiens
ccttcctggcctcactgg

SEQ ID NO: 3362097 - DNA, 23 bp, Homo sapiens
ccttcctggcctcactggctggg

SEQ ID NO: 3362098 - DNA, 17 bp, Homo sapiens
ccttcctgggaggacag

SEQ ID NO: 3362099 - DNA, 22 bp, Homo sapiens
ccttcctgggaggacaggcagg

SEQ ID NO: 3362100 - DNA, 22 bp, Homo sapiens
ccttcctggttttgtacactgc

SEQ ID NO: 3362101 - DNA, 19 bp, Homo sapiens
ccttcctgtttttcacatt

SEQ ID NO: 3362102 - DNA, 17 bp, Homo sapiens
ccttccttaagccagga

SEQ ID NO: 3362103 - DNA, 12 bp, Homo sapiens
ccttccttcagg

SEQ ID NO: 3362104 - DNA, 16 bp, Homo sapiens
ccttccttcccgccag

SEQ ID NO: 3362105 - DNA, 14 bp, Homo sapiens
ccttccttcttgct

SEQ ID NO: 3362106 - DNA, 13 bp, Homo sapiens
ccttccttgacct

SEQ ID NO: 3362107 - DNA, 12 bp, Homo sapiens
ccttcctttctc

SEQ ID NO: 3362108 - DNA, 14 bp, Homo sapiens
ccttcctttctcca

SEQ ID NO: 3362109 - DNA, 20 bp, Homo sapiens
ccttcctttggtgcctcact

SEQ ID NO: 3362110 - DNA, 17 bp, Homo sapiens
ccttccttttccctgct

SEQ ID NO: 3362111 - DNA, 18 bp, Homo sapiens
ccttccttttccctgctt

SEQ ID NO: 3362112 - DNA, 20 bp, Homo sapiens
ccttccttttccctgcttcc

SEQ ID NO: 3362113 - DNA, 15 bp, Homo sapiens
ccttcgatacaccgg

SEQ ID NO: 3362114 - DNA, 23 bp, Homo sapiens
ccttcgatacaccgggcctggag

SEQ ID NO: 3362115 - DNA, 20 bp, Homo sapiens
ccttcgcttcttgcctctgt

SEQ ID NO: 3362116 - DNA, 14 bp, Homo sapiens
ccttcggcctccat

SEQ ID NO: 3362117 - DNA, 16 bp, Homo sapiens
ccttcggcctccatcc

SEQ ID NO: 3362118 - DNA, 14 bp, Homo sapiens
ccttcgggctgtgc

SEQ ID NO: 3362119 - DNA, 21 bp, Homo sapiens
ccttcggggcgatgctccctc

SEQ ID NO: 3362120 - DNA, 14 bp, Homo sapiens
ccttcggtcacctg

SEQ ID NO: 3362121 - DNA, 22 bp, Homo sapiens
ccttcgtgaacatcccctccca

SEQ ID NO: 3362122 - DNA, 14 bp, Homo sapiens
ccttctagaacctg

SEQ ID NO: 3362123 - DNA, 17 bp, Homo sapiens
ccttctagaacctgggc

SEQ ID NO: 3362124 - DNA, 20 bp, Homo sapiens
ccttctagaacctgggctgt

SEQ ID NO: 3362125 - DNA, 14 bp, Homo sapiens
ccttctcacagcac

SEQ ID NO: 3362126 - DNA, 13 bp, Homo sapiens
ccttctcccagca

SEQ ID NO: 3362127 - DNA, 18 bp, Homo sapiens
ccttctcctctctgggcc

SEQ ID NO: 3362128 - DNA, 22 bp, Homo sapiens
ccttctccttcccatttctcta

SEQ ID NO: 3362129 - DNA, 19 bp, Homo sapiens
ccttctccttccccaggat

SEQ ID NO: 3362130 - DNA, 20 bp, Homo sapiens
ccttctctacactcttgtaa

SEQ ID NO: 3362131 - DNA, 21 bp, Homo sapiens
ccttctctgaacacaggcagc

SEQ ID NO: 3362132 - DNA, 15 bp, Homo sapiens
ccttctgacggccct

SEQ ID NO: 3362133 - DNA, 15 bp, Homo sapiens
ccttctgagtattct

SEQ ID NO: 3362134 - DNA, 17 bp, Homo sapiens
ccttctgcctttgatgt

SEQ ID NO: 3362135 - DNA, 15 bp, Homo sapiens
ccttctgctgcccag

SEQ ID NO: 3362136 - DNA, 16 bp, Homo sapiens
ccttctgctgcccagg

SEQ ID NO: 3362137 - DNA, 21 bp, Homo sapiens
ccttctgctgcccaggccaca

SEQ ID NO: 3362138 - DNA, 22 bp, Homo sapiens
ccttctgctgcccaggccacag

SEQ ID NO: 3362139 - DNA, 21 bp, Homo sapiens
ccttctgctggataaaatgag

SEQ ID NO: 3362140 - DNA, 20 bp, Homo sapiens
ccttctgggcagaccttgac

SEQ ID NO: 3362141 - DNA, 18 bp, Homo sapiens
ccttctgggcatctgttc

SEQ ID NO: 3362142 - DNA, 19 bp, Homo sapiens
ccttctgggcatctgttct

SEQ ID NO: 3362143 - DNA, 19 bp, Homo sapiens
ccttctggtacaatccttt

SEQ ID NO: 3362144 - DNA, 19 bp, Homo sapiens
ccttctgtccccagccctg

SEQ ID NO: 3362145 - DNA, 20 bp, Homo sapiens
ccttctgtcctactctgtgt

SEQ ID NO: 3362146 - DNA, 17 bp, Homo sapiens
ccttctgtcctggtgtc

SEQ ID NO: 3362147 - DNA, 19 bp, Homo sapiens
ccttctgtcctggtgtcac

SEQ ID NO: 3362148 - DNA, 21 bp, Homo sapiens
ccttctgtcctggtgtcactt

SEQ ID NO: 3362149 - DNA, 14 bp, Homo sapiens
ccttcttcacccag

SEQ ID NO: 3362150 - DNA, 15 bp, Homo sapiens
ccttcttcacccagc

SEQ ID NO: 3362151 - DNA, 19 bp, Homo sapiens
ccttcttcacccagctaat

SEQ ID NO: 3362152 - DNA, 18 bp, Homo sapiens
ccttcttccatcccagga

SEQ ID NO: 3362153 - DNA, 19 bp, Homo sapiens
ccttcttccatcccaggac

SEQ ID NO: 3362154 - DNA, 19 bp, Homo sapiens
ccttcttctttttgctgtt

SEQ ID NO: 3362155 - DNA, 13 bp, Homo sapiens
ccttcttgggccc

SEQ ID NO: 3362156 - DNA, 17 bp, Homo sapiens
ccttcttgggccccaga

SEQ ID NO: 3362157 - DNA, 13 bp, Homo sapiens
ccttcttggtgct

SEQ ID NO: 3362158 - DNA, 12 bp, Homo sapiens
ccttcttgtagt

SEQ ID NO: 3362159 - DNA, 15 bp, Homo sapiens
ccttctttctggact

SEQ ID NO: 3362160 - DNA, 21 bp, Homo sapiens
ccttctttgataatgttaaat

SEQ ID NO: 3362161 - DNA, 22 bp, Homo sapiens
ccttcttttatgagcagaagga

SEQ ID NO: 3362162 - DNA, 12 bp, Homo sapiens
ccttcttttgta

SEQ ID NO: 3362163 - DNA, 23 bp, Homo sapiens
ccttctttttcatatttctacct

SEQ ID NO: 3362164 - DNA, 16 bp, Homo sapiens
ccttctttttcttctt

SEQ ID NO: 3362165 - DNA, 21 bp, Homo sapiens
ccttgaagaactgcaggccct

SEQ ID NO: 3362166 - DNA, 23 bp, Homo sapiens
ccttgaagaactgcaggccctgg

SEQ ID NO: 3362167 - DNA, 19 bp, Homo sapiens
ccttgaagccactgaagct

SEQ ID NO: 3362168 - DNA, 12 bp, Homo sapiens
ccttgaaggaag

SEQ ID NO: 3362169 - DNA, 14 bp, Homo sapiens
ccttgaaggaagag

SEQ ID NO: 3362170 - DNA, 14 bp, Homo sapiens
ccttgacagggcac

SEQ ID NO: 3362171 - DNA, 14 bp, Homo sapiens
ccttgacatcagtt

SEQ ID NO: 3362172 - DNA, 20 bp, Homo sapiens
ccttgacgtcaagtctcctt

SEQ ID NO: 3362173 - DNA, 14 bp, Homo sapiens
ccttgagaaacctt

SEQ ID NO: 3362174 - DNA, 15 bp, Homo sapiens
ccttgagactggagc

SEQ ID NO: 3362175 - DNA, 18 bp, Homo sapiens
ccttgagactggagctgg

SEQ ID NO: 3362176 - DNA, 14 bp, Homo sapiens
ccttgagccctggc

SEQ ID NO: 3362177 - DNA, 15 bp, Homo sapiens
ccttgagccctggct

SEQ ID NO: 3362178 - DNA, 17 bp, Homo sapiens
ccttgagccctggctgt

SEQ ID NO: 3362179 - DNA, 22 bp, Homo sapiens
ccttgagccctggctgttctgt

SEQ ID NO: 3362180 - DNA, 11 bp, Homo sapiens
ccttgagggag

SEQ ID NO: 3362181 - DNA, 13 bp, Homo sapiens
ccttgaggtcttt

SEQ ID NO: 3362182 - DNA, 17 bp, Homo sapiens
ccttgcaacttcatgtc

SEQ ID NO: 3362183 - DNA, 20 bp, Homo sapiens
cgactctaagctgtgtgcag

SEQ ID NO: 3362184 - DNA, 13 bp, Homo sapiens
cgactgcccctgc

SEQ ID NO: 3362185 - DNA, 17 bp, Homo sapiens
cgactgcccctgctgtg

SEQ ID NO: 3362186 - DNA, 14 bp, Homo sapiens
cgactggccagggc

SEQ ID NO: 3362187 - DNA, 13 bp, Homo sapiens
cgactggtccagc

SEQ ID NO: 3362188 - DNA, 18 bp, Homo sapiens
cgactggtccagctctga

SEQ ID NO: 3362189 - DNA, 20 bp, Homo sapiens
cgactggtccagctctgaca

SEQ ID NO: 3362190 - DNA, 16 bp, Homo sapiens
cgacttggagactcct

SEQ ID NO: 3362191 - DNA, 22 bp, Homo sapiens
cgacttggagactcctggtctg

SEQ ID NO: 3362192 - DNA, 14 bp, Homo sapiens
cgactttctgcctg

SEQ ID NO: 3362193 - DNA, 13 bp, Homo sapiens
cgagaccagcctg

SEQ ID NO: 3362194 - DNA, 14 bp, Homo sapiens
cgagaccagcctgg

SEQ ID NO: 3362195 - DNA, 15 bp, Homo sapiens
cgagaccagcctggc

SEQ ID NO: 3362196 - DNA, 17 bp, Homo sapiens
cgagaccagcctggcca

SEQ ID NO: 3362197 - DNA, 13 bp, Homo sapiens
cgagaccagtctg

SEQ ID NO: 3362198 - DNA, 13 bp, Homo sapiens
cgagaccatcctg

SEQ ID NO: 3362199 - DNA, 15 bp, Homo sapiens
cgagaccatcctggc

SEQ ID NO: 3362200 - DNA, 21 bp, Homo sapiens
cgagacgcacacagctgagca

SEQ ID NO: 3362201 - DNA, 20 bp, Homo sapiens
cgagagaggagccagacaga

SEQ ID NO: 3362202 - DNA, 14 bp, Homo sapiens
cgagagggagagag

SEQ ID NO: 3362203 - DNA, 19 bp, Homo sapiens
cgagaggtgggccagtctg

SEQ ID NO: 3362204 - DNA, 20 bp, Homo sapiens
cgagaggtgggccagtctgt

SEQ ID NO: 3362205 - DNA, 23 bp, Homo sapiens
cgagaggtgggccagtctgtgga

SEQ ID NO: 3362206 - DNA, 18 bp, Homo sapiens
cgagatcacgccactgca

SEQ ID NO: 3362207 - DNA, 20 bp, Homo sapiens
cgagatcacgccactgcact

SEQ ID NO: 3362208 - DNA, 15 bp, Homo sapiens
cgagatcccatctct

SEQ ID NO: 3362209 - DNA, 20 bp, Homo sapiens
cgagatgtgacccaccagtg

SEQ ID NO: 3362210 - DNA, 19 bp, Homo sapiens
cgagattgcaccactgcac

SEQ ID NO: 3362211 - DNA, 23 bp, Homo sapiens
cgagatttgccaggggcatccaa

SEQ ID NO: 3362212 - DNA, 15 bp, Homo sapiens
cgagcacatgttcat

SEQ ID NO: 3362213 - DNA, 14 bp, Homo sapiens
cgagcactggccag

SEQ ID NO: 3362214 - DNA, 15 bp, Homo sapiens
cgagcagtcctgcct

SEQ ID NO: 3362215 - DNA, 17 bp, Homo sapiens
cgagcagtcctgcctca

SEQ ID NO: 3362216 - DNA, 23 bp, Homo sapiens
cgagcagtcctgcctcagcctcc

SEQ ID NO: 3362217 - DNA, 16 bp, Homo sapiens
cgagccctggtggcag

SEQ ID NO: 3362218 - DNA, 14 bp, Homo sapiens
cgagccgggcctgg

SEQ ID NO: 3362219 - DNA, 16 bp, Homo sapiens
cgagcgttcccagcag

SEQ ID NO: 3362220 - DNA, 19 bp, Homo sapiens
cgagctcttggcctttgca

SEQ ID NO: 3362221 - DNA, 22 bp, Homo sapiens
cgagctggtgcattacagagag

SEQ ID NO: 3362222 - DNA, 15 bp, Homo sapiens
cgaggaaaggatttt

SEQ ID NO: 3362223 - DNA, 16 bp, Homo sapiens
cgaggaatctgtgggt

SEQ ID NO: 3362224 - DNA, 12 bp, Homo sapiens
cgaggacacagt

SEQ ID NO: 3362225 - DNA, 19 bp, Homo sapiens
cgaggaccatcgggggcag

SEQ ID NO: 3362226 - DNA, 22 bp, Homo sapiens
cgaggaggcgcggcctcccgag

SEQ ID NO: 3362227 - DNA, 23 bp, Homo sapiens
cgaggaggggcccggtggcggca

SEQ ID NO: 3362228 - DNA, 16 bp, Homo sapiens
cgaggaggtgcctgga

SEQ ID NO: 3362229 - DNA, 22 bp, Homo sapiens
cgaggagtaacaatacaaatgg

SEQ ID NO: 3362230 - DNA, 17 bp, Homo sapiens
cgaggcaccggcgctgc

SEQ ID NO: 3362231 - DNA, 20 bp, Homo sapiens
cgaggcaccggcgctgcagg

SEQ ID NO: 3362232 - DNA, 22 bp, Homo sapiens
cgaggcaccggcgctgcaggta

SEQ ID NO: 3362233 - DNA, 11 bp, Homo sapiens
cgaggccagta

SEQ ID NO: 3362234 - DNA, 17 bp, Homo sapiens
cgaggcccagcgggcag

SEQ ID NO: 3362235 - DNA, 17 bp, Homo sapiens
cgaggcctaccccgcag

SEQ ID NO: 3362236 - DNA, 13 bp, Homo sapiens
cgaggcctgcaaa

SEQ ID NO: 3362237 - DNA, 15 bp, Homo sapiens
cgaggcgatgccacg

SEQ ID NO: 3362238 - DNA, 17 bp, Homo sapiens
cgaggcgatgccacgct

SEQ ID NO: 3362239 - DNA, 18 bp, Homo sapiens
cgaggcgatgccacgctt

SEQ ID NO: 3362240 - DNA, 17 bp, Homo sapiens
cgaggctggtgccaggc

SEQ ID NO: 3362241 - DNA, 21 bp, Homo sapiens
cgagggctgatggaggaaaaa

SEQ ID NO: 3362242 - DNA, 15 bp, Homo sapiens
cgagggctggctggc

SEQ ID NO: 3362243 - DNA, 13 bp, Homo sapiens
cgaggggcaggga

SEQ ID NO: 3362244 - DNA, 16 bp, Homo sapiens
cgagggtcctggctcc

SEQ ID NO: 3362245 - DNA, 13 bp, Homo sapiens
cgaggtcaggaga

SEQ ID NO: 3362246 - DNA, 14 bp, Homo sapiens
cgaggtccagaccc

SEQ ID NO: 3362247 - DNA, 13 bp, Homo sapiens
cgagtagctggga

SEQ ID NO: 3362248 - DNA, 20 bp, Homo sapiens
cgagtcacctgcaagcccca

SEQ ID NO: 3362249 - DNA, 15 bp, Homo sapiens
cgagtcaccttccag

SEQ ID NO: 3362250 - DNA, 18 bp, Homo sapiens
cgagtcatttcgttccct

SEQ ID NO: 3362251 - DNA, 21 bp, Homo sapiens
cgagtctcttctccactggat

SEQ ID NO: 3362252 - DNA, 14 bp, Homo sapiens
cgagtgaatttcta

SEQ ID NO: 3362253 - DNA, 22 bp, Homo sapiens
cgagtgaatttctaaatgttgg

SEQ ID NO: 3362254 - DNA, 17 bp, Homo sapiens
cgagtgcggcgtggaga

SEQ ID NO: 3362255 - DNA, 21 bp, Homo sapiens
cgagtgcggcgtggagactgg

SEQ ID NO: 3362256 - DNA, 13 bp, Homo sapiens
cgagtgggaagga

SEQ ID NO: 3362257 - DNA, 19 bp, Homo sapiens
cgagttcggctctgggtgg

SEQ ID NO: 3362258 - DNA, 15 bp, Homo sapiens
cgataatcagagaaa

SEQ ID NO: 3362259 - DNA, 15 bp, Homo sapiens
cgatatactctagat

SEQ ID NO: 3362260 - DNA, 16 bp, Homo sapiens
cgatatttttaaagat

SEQ ID NO: 3362261 - DNA, 22 bp, Homo sapiens
cgatatttttaaagatctgtaa

SEQ ID NO: 3362262 - DNA, 21 bp, Homo sapiens
cgatcatatttccccttggac

SEQ ID NO: 3362263 - DNA, 13 bp, Homo sapiens
cgatcccctcccc

SEQ ID NO: 3362264 - DNA, 14 bp, Homo sapiens
cgatcccctccccc

SEQ ID NO: 3362265 - DNA, 17 bp, Homo sapiens
cgatctctcctggccta

SEQ ID NO: 3362266 - DNA, 21 bp, Homo sapiens
cgatgaatttggagactctgt

SEQ ID NO: 3362267 - DNA, 23 bp, Homo sapiens
cgatgaatttggagactctgtgg

SEQ ID NO: 3362268 - DNA, 22 bp, Homo sapiens
cgatgatgcttgtaacaagaaa

SEQ ID NO: 3362269 - DNA, 14 bp, Homo sapiens
cgatgcatttaata

SEQ ID NO: 3362270 - DNA, 23 bp, Homo sapiens
cgatgcatttaataaagatgagt

SEQ ID NO: 3362271 - DNA, 16 bp, Homo sapiens
cgatgctccctcagcc

SEQ ID NO: 3362272 - DNA, 21 bp, Homo sapiens
cgatgctgctttcccctgtgg

SEQ ID NO: 3362273 - DNA, 14 bp, Homo sapiens
cgatggagccccca

SEQ ID NO: 3362274 - DNA, 17 bp, Homo sapiens
cgatggggggctgatgg

SEQ ID NO: 3362275 - DNA, 13 bp, Homo sapiens
cgattagctttat

SEQ ID NO: 3362276 - DNA, 17 bp, Homo sapiens
cgattattatctaaagt

SEQ ID NO: 3362277 - DNA, 13 bp, Homo sapiens
cgattcttctgct

SEQ ID NO: 3362278 - DNA, 21 bp, Homo sapiens
cgattcttctgcttcagcctc

SEQ ID NO: 3362279 - DNA, 23 bp, Homo sapiens
cgattggccacctgtagccatct

SEQ ID NO: 3362280 - DNA, 24 bp, Homo sapiens
cgattggccacctgtagccatctg

SEQ ID NO: 3362281 - DNA, 15 bp, Homo sapiens
cgatttctacctcag

SEQ ID NO: 3362282 - DNA, 13 bp, Homo sapiens
cgattttgcctgt

SEQ ID NO: 3362283 - DNA, 13 bp, Homo sapiens
cgattttgtctac

SEQ ID NO: 3362284 - DNA, 22 bp, Homo sapiens
cgatttttgtatgttatgaaca

SEQ ID NO: 3362285 - DNA, 19 bp, Homo sapiens
cgcaacaggagtcagtctc

SEQ ID NO: 3362286 - DNA, 14 bp, Homo sapiens
cgcaagtctgcagc

SEQ ID NO: 3362287 - DNA, 21 bp, Homo sapiens
cgcaattgtgggatgtcctct

SEQ ID NO: 3362288 - DNA, 16 bp, Homo sapiens
cgcacaaggctgacca

SEQ ID NO: 3362289 - DNA, 21 bp, Homo sapiens
cgcacaaggctgaccaagaga

SEQ ID NO: 3362290 - DNA, 17 bp, Homo sapiens
cgcacacagctgagcac

SEQ ID NO: 3362291 - DNA, 22 bp, Homo sapiens
cgcacaccctcactctgccagg

SEQ ID NO: 3362292 - DNA, 15 bp, Homo sapiens
cgcacagcagcctgc

SEQ ID NO: 3362293 - DNA, 15 bp, Homo sapiens
cgcacagccacccgt

SEQ ID NO: 3362294 - DNA, 16 bp, Homo sapiens
cgcacagccacccgtg

SEQ ID NO: 3362295 - DNA, 13 bp, Homo sapiens
cgcaccagctgct

SEQ ID NO: 3362296 - DNA, 16 bp, Homo sapiens
cgcaccatgtgggcac

SEQ ID NO: 3362297 - DNA, 10 bp, Homo sapiens
cgcacccccg

SEQ ID NO: 3362298 - DNA, 14 bp, Homo sapiens
cgcaccgccgccac

SEQ ID NO: 3362299 - DNA, 16 bp, Homo sapiens
cgcaccgccgccacca

SEQ ID NO: 3362300 - DNA, 16 bp, Homo sapiens
cgcacctaccatcagg

SEQ ID NO: 3362301 - DNA, 14 bp, Homo sapiens
cgcacgcacacaca

SEQ ID NO: 3362302 - DNA, 17 bp, Homo sapiens
cgcactccatgagcacc

SEQ ID NO: 3362303 - DNA, 22 bp, Homo sapiens
cgcacttcagaattccatatct

SEQ ID NO: 3362304 - DNA, 15 bp, Homo sapiens
cgcactttccacttc

SEQ ID NO: 3362305 - DNA, 19 bp, Homo sapiens
cgcactttccacttcttcc

SEQ ID NO: 3362306 - DNA, 15 bp, Homo sapiens
cgcagacctccccag

SEQ ID NO: 3362307 - DNA, 16 bp, Homo sapiens
cgcagacctccccagc

SEQ ID NO: 3362308 - DNA, 19 bp, Homo sapiens
cgcagacctccccagcccc

SEQ ID NO: 3362309 - DNA, 14 bp, Homo sapiens
cggagagaaaaaag

SEQ ID NO: 3362310 - DNA, 17 bp, Homo sapiens
cggagagcagcagcacc

SEQ ID NO: 3362311 - DNA, 13 bp, Homo sapiens
cggagaggacagt

SEQ ID NO: 3362312 - DNA, 19 bp, Homo sapiens
cggagaggctgtctggggc

SEQ ID NO: 3362313 - DNA, 21 bp, Homo sapiens
cggagaggctgtctggggcct

SEQ ID NO: 3362314 - DNA, 18 bp, Homo sapiens
cggagcacagccctggga

SEQ ID NO: 3362315 - DNA, 19 bp, Homo sapiens
cggagcacagccctgggag

SEQ ID NO: 3362316 - DNA, 15 bp, Homo sapiens
cggagcatcccggag

SEQ ID NO: 3362317 - DNA, 21 bp, Homo sapiens
cggagcccagcctgggagccc

SEQ ID NO: 3362318 - DNA, 12 bp, Homo sapiens
cggagccccagg

SEQ ID NO: 3362319 - DNA, 18 bp, Homo sapiens
cggagccctccctatgtc

SEQ ID NO: 3362320 - DNA, 19 bp, Homo sapiens
cggagcccttggcccctcg

SEQ ID NO: 3362321 - DNA, 22 bp, Homo sapiens
cggagcccttggcccctcggac

SEQ ID NO: 3362322 - DNA, 20 bp, Homo sapiens
cggagcgttctctgtcctac

SEQ ID NO: 3362323 - DNA, 22 bp, Homo sapiens
cggagcgttctctgtcctactt

SEQ ID NO: 3362324 - DNA, 12 bp, Homo sapiens
cggagctcctgt

SEQ ID NO: 3362325 - DNA, 22 bp, Homo sapiens
cggaggagctagcctgaaggat

SEQ ID NO: 3362326 - DNA, 23 bp, Homo sapiens
cggaggaggagggaggccaggcg

SEQ ID NO: 3362327 - DNA, 17 bp, Homo sapiens
cggaggagggatgctgc

SEQ ID NO: 3362328 - DNA, 17 bp, Homo sapiens
cggaggatagtatgagc

SEQ ID NO: 3362329 - DNA, 18 bp, Homo sapiens
cggaggatagtatgagcc

SEQ ID NO: 3362330 - DNA, 20 bp, Homo sapiens
cggaggcctcgagcagagag

SEQ ID NO: 3362331 - DNA, 14 bp, Homo sapiens
cggaggctgggccc

SEQ ID NO: 3362332 - DNA, 17 bp, Homo sapiens
cggagggattcccctaa

SEQ ID NO: 3362333 - DNA, 14 bp, Homo sapiens
cggaggggatccag

SEQ ID NO: 3362334 - DNA, 15 bp, Homo sapiens
cggaggggcctggca

SEQ ID NO: 3362335 - DNA, 17 bp, Homo sapiens
cggaggtcactccacca

SEQ ID NO: 3362336 - DNA, 22 bp, Homo sapiens
cggaggttgggtgggccggctt

SEQ ID NO: 3362337 - DNA, 14 bp, Homo sapiens
cggagtcccacctt

SEQ ID NO: 3362338 - DNA, 22 bp, Homo sapiens
cggagtcgtggggtgtgctggg

SEQ ID NO: 3362339 - DNA, 23 bp, Homo sapiens
cggagtcgtggggtgtgctggga

SEQ ID NO: 3362340 - DNA, 20 bp, Homo sapiens
cggagtgaagaggggcagcc

SEQ ID NO: 3362341 - DNA, 20 bp, Homo sapiens
cggagttcctaacaggatga

SEQ ID NO: 3362342 - DNA, 19 bp, Homo sapiens
cggatcatcaacaagattt

SEQ ID NO: 3362343 - DNA, 13 bp, Homo sapiens
cggatcctgctgg

SEQ ID NO: 3362344 - DNA, 17 bp, Homo sapiens
cggatgacaccctggcc

SEQ ID NO: 3362345 - DNA, 19 bp, Homo sapiens
cggatgacaccctggcctg

SEQ ID NO: 3362346 - DNA, 21 bp, Homo sapiens
cggatgaccaaaccagccttc

SEQ ID NO: 3362347 - DNA, 16 bp, Homo sapiens
cggatggggcacggac

SEQ ID NO: 3362348 - DNA, 24 bp, Homo sapiens
cggattccaaagagtagaattgca

SEQ ID NO: 3362349 - DNA, 13 bp, Homo sapiens
cggattttttcca

SEQ ID NO: 3362350 - DNA, 13 bp, Homo sapiens
cggcaaaaggaaa

SEQ ID NO: 3362351 - DNA, 21 bp, Homo sapiens
cggcaaccccagttctgctcc

SEQ ID NO: 3362352 - DNA, 22 bp, Homo sapiens
cggcaaccccagttctgctcct

SEQ ID NO: 3362353 - DNA, 23 bp, Homo sapiens
cggcaaccccagttctgctcctc

SEQ ID NO: 3362354 - DNA, 13 bp, Homo sapiens
cggcaccctctgg

SEQ ID NO: 3362355 - DNA, 16 bp, Homo sapiens
cggcaccctctggccg

SEQ ID NO: 3362356 - DNA, 20 bp, Homo sapiens
cggcagaaaacagagcctgc

SEQ ID NO: 3362357 - DNA, 21 bp, Homo sapiens
cggcagaaaacagagcctgcc

SEQ ID NO: 3362358 - DNA, 13 bp, Homo sapiens
cggcagcagccat

SEQ ID NO: 3362359 - DNA, 18 bp, Homo sapiens
cggcagcatcccagccag

SEQ ID NO: 3362360 - DNA, 16 bp, Homo sapiens
cggcaggaaggagcgg

SEQ ID NO: 3362361 - DNA, 18 bp, Homo sapiens
cggcaggaaggagcggcg

SEQ ID NO: 3362362 - DNA, 12 bp, Homo sapiens
cggcaggccctg

SEQ ID NO: 3362363 - DNA, 17 bp, Homo sapiens
cggcaggccctgcagtg

SEQ ID NO: 3362364 - DNA, 23 bp, Homo sapiens
cggcaggctcactgccaggccag

SEQ ID NO: 3362365 - DNA, 23 bp, Homo sapiens
cggcagggcgggcagagggctgg

SEQ ID NO: 3362366 - DNA, 18 bp, Homo sapiens
cggcaggggcctggagat

SEQ ID NO: 3362367 - DNA, 19 bp, Homo sapiens
cggcaggggcctggagatc

SEQ ID NO: 3362368 - DNA, 22 bp, Homo sapiens
cggcatgggaaagccacctctc

SEQ ID NO: 3362369 - DNA, 18 bp, Homo sapiens
cggcatgtttccagcaga

SEQ ID NO: 3362370 - DNA, 14 bp, Homo sapiens
cggcattcctgctt

SEQ ID NO: 3362371 - DNA, 14 bp, Homo sapiens
cggccacacccagc

SEQ ID NO: 3362372 - DNA, 22 bp, Homo sapiens
cggccacgcactgggccacgga

SEQ ID NO: 3362373 - DNA, 14 bp, Homo sapiens
cggccagcgggcac

SEQ ID NO: 3362374 - DNA, 17 bp, Homo sapiens
cggccagcgggcacagg

SEQ ID NO: 3362375 - DNA, 20 bp, Homo sapiens
cggccagcgggcacagggca

SEQ ID NO: 3362376 - DNA, 23 bp, Homo sapiens
cggccagcgggcacagggcacca

SEQ ID NO: 3362377 - DNA, 18 bp, Homo sapiens
cggccagcgtcccagggt

SEQ ID NO: 3362378 - DNA, 13 bp, Homo sapiens
cggccaggcacag

SEQ ID NO: 3362379 - DNA, 11 bp, Homo sapiens
cggccaggcca

SEQ ID NO: 3362380 - DNA, 15 bp, Homo sapiens
cggcccacacccagg

SEQ ID NO: 3362381 - DNA, 16 bp, Homo sapiens
cggcccagtgccactg

SEQ ID NO: 3362382 - DNA, 13 bp, Homo sapiens
cggccccatctct

SEQ ID NO: 3362383 - DNA, 22 bp, Homo sapiens
cggccccccgcacagccacccg

SEQ ID NO: 3362384 - DNA, 17 bp, Homo sapiens
cggccccctccatcggg

SEQ ID NO: 3362385 - DNA, 19 bp, Homo sapiens
cggccccggccccagccag

SEQ ID NO: 3362386 - DNA, 19 bp, Homo sapiens
cggcccctgctggttcagg

SEQ ID NO: 3362387 - DNA, 13 bp, Homo sapiens
cggcccctggcag

SEQ ID NO: 3362388 - DNA, 20 bp, Homo sapiens
cggcccggccagcgggcaca

SEQ ID NO: 3362389 - DNA, 14 bp, Homo sapiens
cggccctagcattg

SEQ ID NO: 3362390 - DNA, 14 bp, Homo sapiens
cggccctagcccag

SEQ ID NO: 3362391 - DNA, 22 bp, Homo sapiens
cggccctgcaatgtatcccttc

SEQ ID NO: 3362392 - DNA, 13 bp, Homo sapiens
cggccctgcccaa

SEQ ID NO: 3362393 - DNA, 14 bp, Homo sapiens
cggccgctccaggg

SEQ ID NO: 3362394 - DNA, 15 bp, Homo sapiens
cggcctcagggcgct

SEQ ID NO: 3362395 - DNA, 17 bp, Homo sapiens
cggcctcccgaggaggg

SEQ ID NO: 3362396 - DNA, 19 bp, Homo sapiens
cggcctcgtgccatgatct

SEQ ID NO: 3362397 - DNA, 21 bp, Homo sapiens
cggcctctctggcctcccacc

SEQ ID NO: 3362398 - DNA, 19 bp, Homo sapiens
cggcctgatgctccctccc

SEQ ID NO: 3362399 - DNA, 13 bp, Homo sapiens
cggcctgctccca

SEQ ID NO: 3362400 - DNA, 23 bp, Homo sapiens
cggcctgtaatcagctctcctgg

SEQ ID NO: 3362401 - DNA, 15 bp, Homo sapiens
cggcgatttttgtat

SEQ ID NO: 3362402 - DNA, 17 bp, Homo sapiens
cggcgccaccatcctgc

SEQ ID NO: 3362403 - DNA, 22 bp, Homo sapiens
cggcgcgctcttcgcgcccgcc

SEQ ID NO: 3362404 - DNA, 12 bp, Homo sapiens
cggcggccaggc

SEQ ID NO: 3362405 - DNA, 13 bp, Homo sapiens
cggcggccaggca

SEQ ID NO: 3362406 - DNA, 16 bp, Homo sapiens
cggcggccaggcacag

SEQ ID NO: 3362407 - DNA, 19 bp, Homo sapiens
cggcggccaggcacagggc

SEQ ID NO: 3362408 - DNA, 20 bp, Homo sapiens
cggcggccaggcacagggcc

SEQ ID NO: 3362409 - DNA, 15 bp, Homo sapiens
cggcgtggagactgg

SEQ ID NO: 3362410 - DNA, 21 bp, Homo sapiens
cggcgtggagactggcaggcg

SEQ ID NO: 3362411 - DNA, 20 bp, Homo sapiens
cggcgtggtgtgtccctgga

SEQ ID NO: 3362412 - DNA, 22 bp, Homo sapiens
cggcgtggtgtgtccctggaca

SEQ ID NO: 3362413 - DNA, 14 bp, Homo sapiens
cggctcactgcagc

SEQ ID NO: 3362414 - DNA, 18 bp, Homo sapiens
cggctcactgcagcctca

SEQ ID NO: 3362415 - DNA, 12 bp, Homo sapiens
cggctcaggctc

SEQ ID NO: 3362416 - DNA, 13 bp, Homo sapiens
cggctcaggctct

SEQ ID NO: 3362417 - DNA, 14 bp, Homo sapiens
cggctccaggctcc

SEQ ID NO: 3362418 - DNA, 20 bp, Homo sapiens
cggctcgagcagtcctgcct

SEQ ID NO: 3362419 - DNA, 16 bp, Homo sapiens
cggctcgtgtatttat

SEQ ID NO: 3362420 - DNA, 14 bp, Homo sapiens
cggctgaccatgct

SEQ ID NO: 3362421 - DNA, 22 bp, Homo sapiens
cggctgaccatgctcatctgct

SEQ ID NO: 3362422 - DNA, 12 bp, Homo sapiens
cggctgcctgcc

SEQ ID NO: 3362423 - DNA, 22 bp, Homo sapiens
cggctgctcgcccaggaaggcc

SEQ ID NO: 3362424 - DNA, 19 bp, Homo sapiens
cggctggggactgctacct

SEQ ID NO: 3362425 - DNA, 14 bp, Homo sapiens
cggctgtgctcaga

SEQ ID NO: 3362426 - DNA, 23 bp, Homo sapiens
cggctgtggagcaaaaggcagct

SEQ ID NO: 3362427 - DNA, 21 bp, Homo sapiens
cggctgttccccctgccgcag

SEQ ID NO: 3362428 - DNA, 23 bp, Homo sapiens
cggcttagacttcgactcaggat

SEQ ID NO: 3362429 - DNA, 16 bp, Homo sapiens
cggcttcatgccagct

SEQ ID NO: 3362430 - DNA, 14 bp, Homo sapiens
cggcttcctgtcca

SEQ ID NO: 3362431 - DNA, 20 bp, Homo sapiens
cggcttcgttagaccgctct

SEQ ID NO: 3362432 - DNA, 22 bp, Homo sapiens
cggcttgtcttcgctggctcct

SEQ ID NO: 3362433 - DNA, 23 bp, Homo sapiens
cggcttgtcttcgctggctccta

SEQ ID NO: 3362434 - DNA, 17 bp, Homo sapiens
cgtgctactgcactcca

SEQ ID NO: 3362435 - DNA, 16 bp, Homo sapiens
cgtggacaggcccagc

SEQ ID NO: 3362436 - DNA, 14 bp, Homo sapiens
cgtggagactggca

SEQ ID NO: 3362437 - DNA, 17 bp, Homo sapiens
cgtggagagctggtgcc

SEQ ID NO: 3362438 - DNA, 15 bp, Homo sapiens
cgtggagccagggag

SEQ ID NO: 3362439 - DNA, 20 bp, Homo sapiens
cgtggagcggggtatgaaga

SEQ ID NO: 3362440 - DNA, 17 bp, Homo sapiens
cgtggaggaggaaggca

SEQ ID NO: 3362441 - DNA, 21 bp, Homo sapiens
cgtggcagataatcagcctct

SEQ ID NO: 3362442 - DNA, 20 bp, Homo sapiens
cgtggcatgttttgatttgt

SEQ ID NO: 3362443 - DNA, 15 bp, Homo sapiens
cgtggccagcccggc

SEQ ID NO: 3362444 - DNA, 19 bp, Homo sapiens
cgtggccagcccggctggt

SEQ ID NO: 3362445 - DNA, 17 bp, Homo sapiens
cgtggccatccctgtga

SEQ ID NO: 3362446 - DNA, 18 bp, Homo sapiens
cgtggccctgccctctcc

SEQ ID NO: 3362447 - DNA, 21 bp, Homo sapiens
cgtggcctcccaaagtgctgg

SEQ ID NO: 3362448 - DNA, 18 bp, Homo sapiens
cgtggcctgagtcctggt

SEQ ID NO: 3362449 - DNA, 13 bp, Homo sapiens
cgtggctgtggca

SEQ ID NO: 3362450 - DNA, 15 bp, Homo sapiens
cgtggctgtggcaca

SEQ ID NO: 3362451 - DNA, 17 bp, Homo sapiens
cgtggctgtggcacaga

SEQ ID NO: 3362452 - DNA, 19 bp, Homo sapiens
cgtggcttcccgctcagcc

SEQ ID NO: 3362453 - DNA, 20 bp, Homo sapiens
cgtggcttcccgctcagccc

SEQ ID NO: 3362454 - DNA, 21 bp, Homo sapiens
cgtggcttcccgctcagccct

SEQ ID NO: 3362455 - DNA, 23 bp, Homo sapiens
cgtgggccagtccccgaggagct

SEQ ID NO: 3362456 - DNA, 15 bp, Homo sapiens
cgtggggtgctgccc

SEQ ID NO: 3362457 - DNA, 19 bp, Homo sapiens
cgtgggtctgttttccttt

SEQ ID NO: 3362458 - DNA, 23 bp, Homo sapiens
cgtgggtgtgtgtagccaaggtc

SEQ ID NO: 3362459 - DNA, 16 bp, Homo sapiens
cgtggtagaggcctgg

SEQ ID NO: 3362460 - DNA, 16 bp, Homo sapiens
cgtggtcactgctgtc

SEQ ID NO: 3362461 - DNA, 19 bp, Homo sapiens
cgtggtcactgtgcactgc

SEQ ID NO: 3362462 - DNA, 20 bp, Homo sapiens
cgtggtccatgctgatgatt

SEQ ID NO: 3362463 - DNA, 17 bp, Homo sapiens
cgtggtctccttgcact

SEQ ID NO: 3362464 - DNA, 17 bp, Homo sapiens
cgtggtgacatttccca

SEQ ID NO: 3362465 - DNA, 19 bp, Homo sapiens
cgtggtggcggtggctgcc

SEQ ID NO: 3362466 - DNA, 20 bp, Homo sapiens
cgtggtggctcacacctgca

SEQ ID NO: 3362467 - DNA, 15 bp, Homo sapiens
cgtggtgtgtccctg

SEQ ID NO: 3362468 - DNA, 18 bp, Homo sapiens
cgtggtgtgtccctggac

SEQ ID NO: 3362469 - DNA, 19 bp, Homo sapiens
cgtggtgtgtccctggaca

SEQ ID NO: 3362470 - DNA, 21 bp, Homo sapiens
cgtggtgtgtccctggacaca

SEQ ID NO: 3362471 - DNA, 23 bp, Homo sapiens
cgtggtgtgtccctggacacagc

SEQ ID NO: 3362472 - DNA, 14 bp, Homo sapiens
cgtggttcttaaat

SEQ ID NO: 3362473 - DNA, 18 bp, Homo sapiens
cgtggttggaagcctccc

SEQ ID NO: 3362474 - DNA, 19 bp, Homo sapiens
cgtgtacctcactttacat

SEQ ID NO: 3362475 - DNA, 20 bp, Homo sapiens
cgtgtagtggaagagcagcc

SEQ ID NO: 3362476 - DNA, 21 bp, Homo sapiens
cgtgtagtggaagagcagcct

SEQ ID NO: 3362477 - DNA, 23 bp, Homo sapiens
cgtgtagtggaagagcagcctga

SEQ ID NO: 3362478 - DNA, 16 bp, Homo sapiens
cgtgtatagtatctgt

SEQ ID NO: 3362479 - DNA, 15 bp, Homo sapiens
cgtgtatagtgccta

SEQ ID NO: 3362480 - DNA, 17 bp, Homo sapiens
cgtgtattgagatttct

SEQ ID NO: 3362481 - DNA, 17 bp, Homo sapiens
cgtgtatttattaccgt

SEQ ID NO: 3362482 - DNA, 22 bp, Homo sapiens
cgtgtcaatgaatgccggggac

SEQ ID NO: 3362483 - DNA, 12 bp, Homo sapiens
cgtgtcctctcc

SEQ ID NO: 3362484 - DNA, 20 bp, Homo sapiens
cgtgtcctctccctgccaag

SEQ ID NO: 3362485 - DNA, 12 bp, Homo sapiens
cgtgtctgaatc

SEQ ID NO: 3362486 - DNA, 14 bp, Homo sapiens
cgtgtctgtattta

SEQ ID NO: 3362487 - DNA, 14 bp, Homo sapiens
cgtgtcttccactt

SEQ ID NO: 3362488 - DNA, 21 bp, Homo sapiens
cgtgtgagaagtgaatgctgg

SEQ ID NO: 3362489 - DNA, 15 bp, Homo sapiens
cgtgtgagtgtgaca

SEQ ID NO: 3362490 - DNA, 14 bp, Homo sapiens
cgtgtggacacaga

SEQ ID NO: 3362491 - DNA, 21 bp, Homo sapiens
cgtgtggcaatagtgggccct

SEQ ID NO: 3362492 - DNA, 22 bp, Homo sapiens
cgtgtggcaatagtgggccctc

SEQ ID NO: 3362493 - DNA, 15 bp, Homo sapiens
cgtgtgtagagttaa

SEQ ID NO: 3362494 - DNA, 14 bp, Homo sapiens
cgtgtttctgactc

SEQ ID NO: 3362495 - DNA, 11 bp, Homo sapiens
cgttaacattg

SEQ ID NO: 3362496 - DNA, 22 bp, Homo sapiens
cgttaacattgaccaagaactg

SEQ ID NO: 3362497 - DNA, 17 bp, Homo sapiens
cgttaactgtgtatgta

SEQ ID NO: 3362498 - DNA, 19 bp, Homo sapiens
cgttaactgtgtatgtaca

SEQ ID NO: 3362499 - DNA, 14 bp, Homo sapiens
cgttacagctcccc

SEQ ID NO: 3362500 - DNA, 21 bp, Homo sapiens
cgttactcagggctcctccca

SEQ ID NO: 3362501 - DNA, 15 bp, Homo sapiens
cgttagctcctgtgg

SEQ ID NO: 3362502 - DNA, 17 bp, Homo sapiens
cgttagctcctgtggcc

SEQ ID NO: 3362503 - DNA, 12 bp, Homo sapiens
cgttcaaattct

SEQ ID NO: 3362504 - DNA, 17 bp, Homo sapiens
cgttcacctccctgctc

SEQ ID NO: 3362505 - DNA, 11 bp, Homo sapiens
cgttcatttgt

SEQ ID NO: 3362506 - DNA, 12 bp, Homo sapiens
cgttcatttgtg

SEQ ID NO: 3362507 - DNA, 13 bp, Homo sapiens
cgttccagttccc

SEQ ID NO: 3362508 - DNA, 13 bp, Homo sapiens
cgttccctgtcag

SEQ ID NO: 3362509 - DNA, 19 bp, Homo sapiens
cgttcctgacatcacagca

SEQ ID NO: 3362510 - DNA, 22 bp, Homo sapiens
cgttcctgacatcacagcagcc

SEQ ID NO: 3362511 - DNA, 16 bp, Homo sapiens
cgttcctttcttttcc

SEQ ID NO: 3362512 - DNA, 13 bp, Homo sapiens
cgttcgatttcta

SEQ ID NO: 3362513 - DNA, 15 bp, Homo sapiens
cgttcgatttctacc

SEQ ID NO: 3362514 - DNA, 14 bp, Homo sapiens
cgttctctgtccta

SEQ ID NO: 3362515 - DNA, 20 bp, Homo sapiens
cgttctctgtcctacttctg

SEQ ID NO: 3362516 - DNA, 18 bp, Homo sapiens
cgttctgctggcctggat

SEQ ID NO: 3362517 - DNA, 16 bp, Homo sapiens
cgttctgttctgctgg

SEQ ID NO: 3362518 - DNA, 21 bp, Homo sapiens
cgttgaggcggtttcctgaat

SEQ ID NO: 3362519 - DNA, 23 bp, Homo sapiens
cgttggacttttcgttaacattg

SEQ ID NO: 3362520 - DNA, 13 bp, Homo sapiens
cgttggagactga

SEQ ID NO: 3362521 - DNA, 20 bp, Homo sapiens
cgttggagccactcctgtcc

SEQ ID NO: 3362522 - DNA, 16 bp, Homo sapiens
cgttggcctcagggcc

SEQ ID NO: 3362523 - DNA, 14 bp, Homo sapiens
cgttggtccagagc

SEQ ID NO: 3362524 - DNA, 17 bp, Homo sapiens
cgttgtctgtggatggt

SEQ ID NO: 3362525 - DNA, 20 bp, Homo sapiens
cgtttaatatattttttgaa

SEQ ID NO: 3362526 - DNA, 17 bp, Homo sapiens
cgtttacctagaagaag

SEQ ID NO: 3362527 - DNA, 15 bp, Homo sapiens
cgtttagaccaagga

SEQ ID NO: 3362528 - DNA, 21 bp, Homo sapiens
cgtttagaccaaggaacaaaa

SEQ ID NO: 3362529 - DNA, 16 bp, Homo sapiens
cgtttatgggccttgc

SEQ ID NO: 3362530 - DNA, 19 bp, Homo sapiens
cgtttcaaagctttcctgt

SEQ ID NO: 3362531 - DNA, 22 bp, Homo sapiens
cgtttctccacctagactgtaa

SEQ ID NO: 3362532 - DNA, 13 bp, Homo sapiens
cgtttcttcctgc

SEQ ID NO: 3362533 - DNA, 21 bp, Homo sapiens
cgttttgtctgtgttgctgtt

SEQ ID NO: 3362534 - DNA, 20 bp, Homo sapiens
cgtttttattcctcttattg

SEQ ID NO: 3362535 - DNA, 13 bp, Homo sapiens
cgtttttgtgctg

SEQ ID NO: 3362536 - DNA, 15 bp, Homo sapiens
cgtttttgtgctgtg

SEQ ID NO: 3362537 - DNA, 22 bp, Homo sapiens
cgtttttgtgctgtgggcagca

SEQ ID NO: 3362538 - DNA, 17 bp, Homo sapiens
ctaaaaaaaaaaaggcc

SEQ ID NO: 3362539 - DNA, 15 bp, Homo sapiens
ctaaaaaaaagatga

SEQ ID NO: 3362540 - DNA, 18 bp, Homo sapiens
ctaaaaaaagtgcatgat

SEQ ID NO: 3362541 - DNA, 22 bp, Homo sapiens
ctaaaaagttgaaccattatac

SEQ ID NO: 3362542 - DNA, 14 bp, Homo sapiens
ctaaaagacatttg

SEQ ID NO: 3362543 - DNA, 16 bp, Homo sapiens
ctaaaaggttcaggga

SEQ ID NO: 3362544 - DNA, 14 bp, Homo sapiens
ctaaaagtaaacat

SEQ ID NO: 3362545 - DNA, 23 bp, Homo sapiens
ctaaaagttcataacagtgccat

SEQ ID NO: 3362546 - DNA, 22 bp, Homo sapiens
ctaaaatacatttaaaacttac

SEQ ID NO: 3362547 - DNA, 12 bp, Homo sapiens
ctaaaatatata

SEQ ID NO: 3362548 - DNA, 21 bp, Homo sapiens
ctaaaatatataatatactaa

SEQ ID NO: 3362549 - DNA, 18 bp, Homo sapiens
ctaaaatatataatttat

SEQ ID NO: 3362550 - DNA, 15 bp, Homo sapiens
ctaaaatatttattt

SEQ ID NO: 3362551 - DNA, 19 bp, Homo sapiens
ctaaaatcttatagttcta

SEQ ID NO: 3362552 - DNA, 23 bp, Homo sapiens
ctaaaatgattttatctgtgaat

SEQ ID NO: 3362553 - DNA, 13 bp, Homo sapiens
ctaaaatgtatct

SEQ ID NO: 3362554 - DNA, 18 bp, Homo sapiens
ctaaaatgtgatgttcta

SEQ ID NO: 3362555 - DNA, 16 bp, Homo sapiens
ctaaaattgtatgaaa

SEQ ID NO: 3362556 - DNA, 19 bp, Homo sapiens
ctaaacaatgctgatttgg

SEQ ID NO: 3362557 - DNA, 11 bp, Homo sapiens
ctaaacataat

SEQ ID NO: 3362558 - DNA, 12 bp, Homo sapiens
ctaaacataatt

SEQ ID NO: 3362559 - DNA, 14 bp, Homo sapiens
ctaaacataattgt

SEQ ID NO: 3362560 - DNA, 12 bp, Homo sapiens
ctaatttttaag

SEQ ID NO: 3362561 - DNA, 20 bp, Homo sapiens
ctaatttttgtaattttagt

SEQ ID NO: 3362562 - DNA, 13 bp, Homo sapiens
ctaatttttgtat

SEQ ID NO: 3362563 - DNA, 15 bp, Homo sapiens
ctaatttttgtattt

SEQ ID NO: 3362564 - DNA, 17 bp, Homo sapiens
ctaattttttgtacttt

SEQ ID NO: 3362565 - DNA, 18 bp, Homo sapiens
ctacaaaaaataaaataa

SEQ ID NO: 3362566 - DNA, 20 bp, Homo sapiens
ctacaaaaaggtataaataa

SEQ ID NO: 3362567 - DNA, 17 bp, Homo sapiens
ctacaaaatttgaaatt

SEQ ID NO: 3362568 - DNA, 18 bp, Homo sapiens
ctacaaagctttgctaca

SEQ ID NO: 3362569 - DNA, 19 bp, Homo sapiens
ctacaaagctttgctacaa

SEQ ID NO: 3362570 - DNA, 13 bp, Homo sapiens
ctacaaatttatg

SEQ ID NO: 3362571 - DNA, 15 bp, Homo sapiens
ctacaaatttatgca

SEQ ID NO: 3362572 - DNA, 20 bp, Homo sapiens
ctacaaatttatgcatttca

SEQ ID NO: 3362573 - DNA, 22 bp, Homo sapiens
ctacaaatttatgcatttcatt

SEQ ID NO: 3362574 - DNA, 15 bp, Homo sapiens
ctacaagatttagaa

SEQ ID NO: 3362575 - DNA, 13 bp, Homo sapiens
ctacaagatttcc

SEQ ID NO: 3362576 - DNA, 13 bp, Homo sapiens
ctacaataaactg

SEQ ID NO: 3362577 - DNA, 13 bp, Homo sapiens
ctacaatctcttt

SEQ ID NO: 3362578 - DNA, 18 bp, Homo sapiens
ctacaatgtgaactttat

SEQ ID NO: 3362579 - DNA, 14 bp, Homo sapiens
ctacacagacccct

SEQ ID NO: 3362580 - DNA, 17 bp, Homo sapiens
ctacacagcacaccagc

SEQ ID NO: 3362581 - DNA, 24 bp, Homo sapiens
ctacacagcacaccagccgctgca

SEQ ID NO: 3362582 - DNA, 19 bp, Homo sapiens
ctacacagtgggaactctg

SEQ ID NO: 3362583 - DNA, 20 bp, Homo sapiens
ctacacagtgggaactctga

SEQ ID NO: 3362584 - DNA, 21 bp, Homo sapiens
ctacacatatgtattcctgat

SEQ ID NO: 3362585 - DNA, 15 bp, Homo sapiens
ctacaccttgccttg

SEQ ID NO: 3362586 - DNA, 15 bp, Homo sapiens
ctacactcacctgca

SEQ ID NO: 3362587 - DNA, 13 bp, Homo sapiens
ctacactgaggag

SEQ ID NO: 3362588 - DNA, 13 bp, Homo sapiens
ctacactgatgca

SEQ ID NO: 3362589 - DNA, 20 bp, Homo sapiens
ctacagaagtggaagtgctt

SEQ ID NO: 3362590 - DNA, 14 bp, Homo sapiens
ctacagaataatgt

SEQ ID NO: 3362591 - DNA, 17 bp, Homo sapiens
ctacagaataatgtgtt

SEQ ID NO: 3362592 - DNA, 12 bp, Homo sapiens
ctacagaatttt

SEQ ID NO: 3362593 - DNA, 15 bp, Homo sapiens
ctacagacaaagaga

SEQ ID NO: 3362594 - DNA, 17 bp, Homo sapiens
ctacagaggccatgggc

SEQ ID NO: 3362595 - DNA, 20 bp, Homo sapiens
ctacagaggccatgggcctc

SEQ ID NO: 3362596 - DNA, 20 bp, Homo sapiens
ctacagatcctttttccatc

SEQ ID NO: 3362597 - DNA, 23 bp, Homo sapiens
ctacagatgatagaggattttat

SEQ ID NO: 3362598 - DNA, 19 bp, Homo sapiens
ctacagctcttaaatgtag

SEQ ID NO: 3362599 - DNA, 18 bp, Homo sapiens
ctacaggaagcaccccat

SEQ ID NO: 3362600 - DNA, 20 bp, Homo sapiens
ctacaggaagcaccccatgc

SEQ ID NO: 3362601 - DNA, 22 bp, Homo sapiens
ctacaggacaaagggagggagc

SEQ ID NO: 3362602 - DNA, 23 bp, Homo sapiens
ctacaggacaaagggagggagca

SEQ ID NO: 3362603 - DNA, 14 bp, Homo sapiens
ctacaggagtgagc

SEQ ID NO: 3362604 - DNA, 15 bp, Homo sapiens
ctacaggcacccacc

SEQ ID NO: 3362605 - DNA, 22 bp, Homo sapiens
ctacagggcgagactctgtctc

SEQ ID NO: 3362606 - DNA, 16 bp, Homo sapiens
ctacaggtgtgagtca

SEQ ID NO: 3362607 - DNA, 11 bp, Homo sapiens
ctacagtgcca

SEQ ID NO: 3362608 - DNA, 14 bp, Homo sapiens
ctacagtggtttta

SEQ ID NO: 3362609 - DNA, 21 bp, Homo sapiens
ctacagttatgttcagtcaca

SEQ ID NO: 3362610 - DNA, 22 bp, Homo sapiens
ctacagttgttttttgaaaaca

SEQ ID NO: 3362611 - DNA, 15 bp, Homo sapiens
ctacagttttaactg

SEQ ID NO: 3362612 - DNA, 12 bp, Homo sapiens
ctacataaactg

SEQ ID NO: 3362613 - DNA, 22 bp, Homo sapiens
ctacataagtaattcaagaaaa

SEQ ID NO: 3362614 - DNA, 17 bp, Homo sapiens
ctacatcccagcctgtg

SEQ ID NO: 3362615 - DNA, 18 bp, Homo sapiens
ctacatgacgacaaagct

SEQ ID NO: 3362616 - DNA, 14 bp, Homo sapiens
ctacatgactgggc

SEQ ID NO: 3362617 - DNA, 15 bp, Homo sapiens
ctacatgcagcccat

SEQ ID NO: 3362618 - DNA, 21 bp, Homo sapiens
ctacatgcagcccatgcccac

SEQ ID NO: 3362619 - DNA, 22 bp, Homo sapiens
ctacattaacttgaaaattttt

SEQ ID NO: 3362620 - DNA, 22 bp, Homo sapiens
ctacattataaatgtctcttta

SEQ ID NO: 3362621 - DNA, 14 bp, Homo sapiens
ctacattatggaat

SEQ ID NO: 3362622 - DNA, 23 bp, Homo sapiens
ctacattattgcttattgcttag

SEQ ID NO: 3362623 - DNA, 15 bp, Homo sapiens
ctacattccctctcc

SEQ ID NO: 3362624 - DNA, 21 bp, Homo sapiens
ctacattccctctcctgccca

SEQ ID NO: 3362625 - DNA, 18 bp, Homo sapiens
ctacatttgagggcccag

SEQ ID NO: 3362626 - DNA, 21 bp, Homo sapiens
ctaccaatctctgctctctat

SEQ ID NO: 3362627 - DNA, 20 bp, Homo sapiens
ctaccagcgccaaatgttca

SEQ ID NO: 3362628 - DNA, 19 bp, Homo sapiens
ctaccagtatttagaagcc

SEQ ID NO: 3362629 - DNA, 14 bp, Homo sapiens
ctaccagttgccct

SEQ ID NO: 3362630 - DNA, 15 bp, Homo sapiens
ctaccatcagggaca

SEQ ID NO: 3362631 - DNA, 18 bp, Homo sapiens
ctaccatctgatgtttca

SEQ ID NO: 3362632 - DNA, 13 bp, Homo sapiens
ctaccatgctgct

SEQ ID NO: 3362633 - DNA, 16 bp, Homo sapiens
ctacccaaaccctagg

SEQ ID NO: 3362634 - DNA, 13 bp, Homo sapiens
ctacccaaccact

SEQ ID NO: 3362635 - DNA, 22 bp, Homo sapiens
ctacccaccctcctttcaccac

SEQ ID NO: 3362636 - DNA, 20 bp, Homo sapiens
ctacccactatccttcgtga

SEQ ID NO: 3362637 - DNA, 20 bp, Homo sapiens
ctacccagcgagccctggtg

SEQ ID NO: 3362638 - DNA, 16 bp, Homo sapiens
ctacccatgagcctgc

SEQ ID NO: 3362639 - DNA, 20 bp, Homo sapiens
ctaccccgcagacaccttgg

SEQ ID NO: 3362640 - DNA, 23 bp, Homo sapiens
ctacccctgctcccattcctccc

SEQ ID NO: 3362641 - DNA, 17 bp, Homo sapiens
ctacccgcatcttctgt

SEQ ID NO: 3362642 - DNA, 14 bp, Homo sapiens
ctaccctcccaccc

SEQ ID NO: 3362643 - DNA, 19 bp, Homo sapiens
ctaccctcccacccccttc

SEQ ID NO: 3362644 - DNA, 17 bp, Homo sapiens
ctaccctcctgcactgt

SEQ ID NO: 3362645 - DNA, 15 bp, Homo sapiens
ctaccctcgggccca

SEQ ID NO: 3362646 - DNA, 16 bp, Homo sapiens
ctaccctcgggcccac

SEQ ID NO: 3362647 - DNA, 23 bp, Homo sapiens
ctaccctcgggcccacctggcca

SEQ ID NO: 3362648 - DNA, 16 bp, Homo sapiens
ctaccctgctccctgc

SEQ ID NO: 3362649 - DNA, 19 bp, Homo sapiens
ctaccctttttctccagct

SEQ ID NO: 3362650 - DNA, 21 bp, Homo sapiens
ctaccgagtctcttctccact

SEQ ID NO: 3362651 - DNA, 13 bp, Homo sapiens
ctaccgccctggg

SEQ ID NO: 3362652 - DNA, 14 bp, Homo sapiens
ctaccgccctgggc

SEQ ID NO: 3362653 - DNA, 13 bp, Homo sapiens
ctacctcactctc

SEQ ID NO: 3362654 - DNA, 12 bp, Homo sapiens
ctacctcagcct

SEQ ID NO: 3362655 - DNA, 14 bp, Homo sapiens
ctacctcagcctag

SEQ ID NO: 3362656 - DNA, 18 bp, Homo sapiens
ctacctcaggcagctcaa

SEQ ID NO: 3362657 - DNA, 23 bp, Homo sapiens
ctacctcaggcaggaagggcagg

SEQ ID NO: 3362658 - DNA, 12 bp, Homo sapiens
ctacctcaggtt

SEQ ID NO: 3362659 - DNA, 13 bp, Homo sapiens
ctacctcaggttg

SEQ ID NO: 3362660 - DNA, 17 bp, Homo sapiens
ctacctcaggttgctgg

SEQ ID NO: 3362661 - DNA, 14 bp, Homo sapiens
ctacctctctgtcc

SEQ ID NO: 3362662 - DNA, 20 bp, Homo sapiens
ctacctctctgtcccttgct

SEQ ID NO: 3362663 - DNA, 13 bp, Homo sapiens
ctacctctgagaa

SEQ ID NO: 3362664 - DNA, 15 bp, Homo sapiens
ctacctctgagaaga

SEQ ID NO: 3362665 - DNA, 17 bp, Homo sapiens
ctacctctgagaagaca

SEQ ID NO: 3362666 - DNA, 20 bp, Homo sapiens
ctacctgattggtgcaaccc

SEQ ID NO: 3362667 - DNA, 16 bp, Homo sapiens
ctacctgcagtgggaa

SEQ ID NO: 3362668 - DNA, 12 bp, Homo sapiens
ctacctgccctc

SEQ ID NO: 3362669 - DNA, 12 bp, Homo sapiens
ctacctgctgga

SEQ ID NO: 3362670 - DNA, 20 bp, Homo sapiens
ctacctgctggacagcctcc

SEQ ID NO: 3362671 - DNA, 21 bp, Homo sapiens
ctacctgctggacagcctccg

SEQ ID NO: 3362672 - DNA, 22 bp, Homo sapiens
ctacctgctggacagcctccgc

SEQ ID NO: 3362673 - DNA, 23 bp, Homo sapiens
ctaccttgaggtcttttgacatg

SEQ ID NO: 3362674 - DNA, 13 bp, Homo sapiens
ctacgaatcttcc

SEQ ID NO: 3362675 - DNA, 15 bp, Homo sapiens
ctactaaaaatgcaa

SEQ ID NO: 3362676 - DNA, 18 bp, Homo sapiens
ctactaaagtgcctaccc

SEQ ID NO: 3362677 - DNA, 15 bp, Homo sapiens
ctactaagttatttt

SEQ ID NO: 3362678 - DNA, 17 bp, Homo sapiens
ctactaagttattttat

SEQ ID NO: 3362679 - DNA, 16 bp, Homo sapiens
ctactaattttttaag

SEQ ID NO: 3362680 - DNA, 22 bp, Homo sapiens
ctactacatctgtgatgactgg

SEQ ID NO: 3362681 - DNA, 16 bp, Homo sapiens
ctactaccacaaggaa

SEQ ID NO: 3362682 - DNA, 12 bp, Homo sapiens
ctactacctctt

SEQ ID NO: 3362683 - DNA, 15 bp, Homo sapiens
ctactagatgtcttt

SEQ ID NO: 3362684 - DNA, 17 bp, Homo sapiens
ctactataaagagaaga

SEQ ID NO: 3362685 - DNA, 18 bp, Homo sapiens
ctactataatcaaatgat

SEQ ID NO: 3362686 - DNA, 16 bp, Homo sapiens
ctaggggagaagagcc

SEQ ID NO: 3362687 - DNA, 15 bp, Homo sapiens
ctaggggtcactgta

SEQ ID NO: 3362688 - DNA, 16 bp, Homo sapiens
ctaggggtcaggctcc

SEQ ID NO: 3362689 - DNA, 16 bp, Homo sapiens
ctagggtcttgggggt

SEQ ID NO: 3362690 - DNA, 13 bp, Homo sapiens
ctagggtggccct

SEQ ID NO: 3362691 - DNA, 18 bp, Homo sapiens
ctagggtttcttaaatat

SEQ ID NO: 3362692 - DNA, 19 bp, Homo sapiens
ctaggtacgatgacagtgt

SEQ ID NO: 3362693 - DNA, 17 bp, Homo sapiens
ctaggttatacaataac

SEQ ID NO: 3362694 - DNA, 23 bp, Homo sapiens
ctaggttatacaataacccagtt

SEQ ID NO: 3362695 - DNA, 14 bp, Homo sapiens
ctaggttgcagaga

SEQ ID NO: 3362696 - DNA, 19 bp, Homo sapiens
ctaggttggacagccccct

SEQ ID NO: 3362697 - DNA, 20 bp, Homo sapiens
ctaggttggacagccccctt

SEQ ID NO: 3362698 - DNA, 22 bp, Homo sapiens
ctaggttttggagagtttgcct

SEQ ID NO: 3362699 - DNA, 14 bp, Homo sapiens
ctagtaaaaccttg

SEQ ID NO: 3362700 - DNA, 18 bp, Homo sapiens
ctagtaaaaccttgttct

SEQ ID NO: 3362701 - DNA, 22 bp, Homo sapiens
ctagtaacaatacatgagaaag

SEQ ID NO: 3362702 - DNA, 16 bp, Homo sapiens
ctagtactctctgctc

SEQ ID NO: 3362703 - DNA, 19 bp, Homo sapiens
ctagtactctctgctctag

SEQ ID NO: 3362704 - DNA, 15 bp, Homo sapiens
ctagtacttattaca

SEQ ID NO: 3362705 - DNA, 22 bp, Homo sapiens
ctagtacttgggagacctgtaa

SEQ ID NO: 3362706 - DNA, 17 bp, Homo sapiens
ctagtagttcctgctac

SEQ ID NO: 3362707 - DNA, 12 bp, Homo sapiens
ctagtattcgct

SEQ ID NO: 3362708 - DNA, 16 bp, Homo sapiens
ctagtattcgctgtgt

SEQ ID NO: 3362709 - DNA, 17 bp, Homo sapiens
ctagtcaccccaagtag

SEQ ID NO: 3362710 - DNA, 20 bp, Homo sapiens
ctagtcagaaaattggcagt

SEQ ID NO: 3362711 - DNA, 14 bp, Homo sapiens
ctagtccagtgacc

SEQ ID NO: 3362712 - DNA, 17 bp, Homo sapiens
ctagtccccctgttttc

SEQ ID NO: 3362713 - DNA, 14 bp, Homo sapiens
ctagtcccttcccc

SEQ ID NO: 3362714 - DNA, 21 bp, Homo sapiens
ctagtcccttcccctccctgg

SEQ ID NO: 3362715 - DNA, 14 bp, Homo sapiens
ctagtccggaccca

SEQ ID NO: 3362716 - DNA, 15 bp, Homo sapiens
ctagtccggacccac

SEQ ID NO: 3362717 - DNA, 18 bp, Homo sapiens
ctagtcctattctattgc

SEQ ID NO: 3362718 - DNA, 23 bp, Homo sapiens
ctagtctcctttgcactgagggc

SEQ ID NO: 3362719 - DNA, 16 bp, Homo sapiens
ctagtctctcctgtaa

SEQ ID NO: 3362720 - DNA, 14 bp, Homo sapiens
ctagtgaatgaatc

SEQ ID NO: 3362721 - DNA, 16 bp, Homo sapiens
ctagtgacagcttgtg

SEQ ID NO: 3362722 - DNA, 19 bp, Homo sapiens
ctagtgaccccttccctgt

SEQ ID NO: 3362723 - DNA, 19 bp, Homo sapiens
ctagtgatgtttttatgat

SEQ ID NO: 3362724 - DNA, 14 bp, Homo sapiens
ctagtgcagctgat

SEQ ID NO: 3362725 - DNA, 22 bp, Homo sapiens
ctagtgcagctgattttaacaa

SEQ ID NO: 3362726 - DNA, 22 bp, Homo sapiens
ctagtggcaagacagtggttct

SEQ ID NO: 3362727 - DNA, 17 bp, Homo sapiens
ctagtgggacagcccag

SEQ ID NO: 3362728 - DNA, 15 bp, Homo sapiens
ctagtggtctttgta

SEQ ID NO: 3362729 - DNA, 16 bp, Homo sapiens
ctagtggtctttgtaa

SEQ ID NO: 3362730 - DNA, 17 bp, Homo sapiens
ctagtggtctttgtaag

SEQ ID NO: 3362731 - DNA, 18 bp, Homo sapiens
ctagtggtctttgtaaga

SEQ ID NO: 3362732 - DNA, 19 bp, Homo sapiens
ctagtgtacctcctctcag

SEQ ID NO: 3362733 - DNA, 21 bp, Homo sapiens
ctagtgtacctcctctcagtg

SEQ ID NO: 3362734 - DNA, 20 bp, Homo sapiens
ctagtgtattatcactgtct

SEQ ID NO: 3362735 - DNA, 19 bp, Homo sapiens
ctagtgtgagtggcagcca

SEQ ID NO: 3362736 - DNA, 17 bp, Homo sapiens
ctagtgtggtgtgtttg

SEQ ID NO: 3362737 - DNA, 23 bp, Homo sapiens
ctagtgttctgtctaaaaaccag

SEQ ID NO: 3362738 - DNA, 18 bp, Homo sapiens
ctagtgttctgtttgtta

SEQ ID NO: 3362739 - DNA, 16 bp, Homo sapiens
ctagttatacttattt

SEQ ID NO: 3362740 - DNA, 20 bp, Homo sapiens
ctagttatttacaggaactt

SEQ ID NO: 3362741 - DNA, 20 bp, Homo sapiens
ctagttcagacactttggaa

SEQ ID NO: 3362742 - DNA, 21 bp, Homo sapiens
ctagttcatccaatcctcact

SEQ ID NO: 3362743 - DNA, 24 bp, Homo sapiens
ctagttcatccaatcctcactggg

SEQ ID NO: 3362744 - DNA, 21 bp, Homo sapiens
ctagttccctctgctcagcca

SEQ ID NO: 3362745 - DNA, 22 bp, Homo sapiens
ctagtttcagtaaataatgaaa

SEQ ID NO: 3362746 - DNA, 15 bp, Homo sapiens
ctagtttcctctcct

SEQ ID NO: 3362747 - DNA, 18 bp, Homo sapiens
ctagtttcctctccttcg

SEQ ID NO: 3362748 - DNA, 22 bp, Homo sapiens
ctagtttgacctcacagtgacc

SEQ ID NO: 3362749 - DNA, 13 bp, Homo sapiens
ctagttttacaga

SEQ ID NO: 3362750 - DNA, 14 bp, Homo sapiens
ctagttttacagat

SEQ ID NO: 3362751 - DNA, 20 bp, Homo sapiens
ctagttttctcctcccagga

SEQ ID NO: 3362752 - DNA, 13 bp, Homo sapiens
ctagtttttaatt

SEQ ID NO: 3362753 - DNA, 19 bp, Homo sapiens
ctagtttttagtaatctgt

SEQ ID NO: 3362754 - DNA, 15 bp, Homo sapiens
ctataaaattaaatg

SEQ ID NO: 3362755 - DNA, 17 bp, Homo sapiens
ctataaaattaaatgcc

SEQ ID NO: 3362756 - DNA, 18 bp, Homo sapiens
ctataaacattaaaagaa

SEQ ID NO: 3362757 - DNA, 19 bp, Homo sapiens
ctataaagagaagacgaaa

SEQ ID NO: 3362758 - DNA, 16 bp, Homo sapiens
ctataaatcagtattt

SEQ ID NO: 3362759 - DNA, 16 bp, Homo sapiens
ctataaatggtgtttt

SEQ ID NO: 3362760 - DNA, 17 bp, Homo sapiens
ctataaattttttgaaa

SEQ ID NO: 3362761 - DNA, 14 bp, Homo sapiens
ctataacatgtctt

SEQ ID NO: 3362762 - DNA, 15 bp, Homo sapiens
ctataacctggattt

SEQ ID NO: 3362763 - DNA, 15 bp, Homo sapiens
ctataacttcttcct

SEQ ID NO: 3362764 - DNA, 12 bp, Homo sapiens
ctataacttgat

SEQ ID NO: 3362765 - DNA, 22 bp, Homo sapiens
ctataagagaattatatatttc

SEQ ID NO: 3362766 - DNA, 22 bp, Homo sapiens
ctataagaggaatttcttttcc

SEQ ID NO: 3362767 - DNA, 21 bp, Homo sapiens
ctataagcaaattgctttttt

SEQ ID NO: 3362768 - DNA, 22 bp, Homo sapiens
ctataagcttaaataggaaagt

SEQ ID NO: 3362769 - DNA, 11 bp, Homo sapiens
ctataatcatt

SEQ ID NO: 3362770 - DNA, 14 bp, Homo sapiens
ctataatcattagt

SEQ ID NO: 3362771 - DNA, 18 bp, Homo sapiens
ctataatcattagtttta

SEQ ID NO: 3362772 - DNA, 15 bp, Homo sapiens
ctataatctgtcaaa

SEQ ID NO: 3362773 - DNA, 14 bp, Homo sapiens
ctataatctgtttt

SEQ ID NO: 3362774 - DNA, 16 bp, Homo sapiens
ctataatcttatacaa

SEQ ID NO: 3362775 - DNA, 17 bp, Homo sapiens
ctataatcttatacaac

SEQ ID NO: 3362776 - DNA, 12 bp, Homo sapiens
ctataatgaagc

SEQ ID NO: 3362777 - DNA, 21 bp, Homo sapiens
ctataatgtaagctctactga

SEQ ID NO: 3362778 - DNA, 16 bp, Homo sapiens
ctataatgtgtgtatg

SEQ ID NO: 3362779 - DNA, 20 bp, Homo sapiens
ctataattccctatctttta

SEQ ID NO: 3362780 - DNA, 13 bp, Homo sapiens
ctatacaaatata

SEQ ID NO: 3362781 - DNA, 15 bp, Homo sapiens
ctatacaaatataaa

SEQ ID NO: 3362782 - DNA, 22 bp, Homo sapiens
ctatacacaagcaatgcaagaa

SEQ ID NO: 3362783 - DNA, 13 bp, Homo sapiens
ctatacacacaca

SEQ ID NO: 3362784 - DNA, 19 bp, Homo sapiens
ctatacacaccctgcccct

SEQ ID NO: 3362785 - DNA, 14 bp, Homo sapiens
ctatacactagaca

SEQ ID NO: 3362786 - DNA, 16 bp, Homo sapiens
ctatacatctctcccc

SEQ ID NO: 3362787 - DNA, 18 bp, Homo sapiens
ctatacatctctccccaa

SEQ ID NO: 3362788 - DNA, 19 bp, Homo sapiens
ctataccccttacttagca

SEQ ID NO: 3362789 - DNA, 20 bp, Homo sapiens
ctataccccttacttagcat

SEQ ID NO: 3362790 - DNA, 19 bp, Homo sapiens
ctatactgcatacttttta

SEQ ID NO: 3362791 - DNA, 13 bp, Homo sapiens
ctatactgcctct

SEQ ID NO: 3362792 - DNA, 17 bp, Homo sapiens
ctatactggaaatgtaa

SEQ ID NO: 3362793 - DNA, 14 bp, Homo sapiens
ctatactttacagg

SEQ ID NO: 3362794 - DNA, 21 bp, Homo sapiens
ctatagactggaaaaaatgag

SEQ ID NO: 3362795 - DNA, 22 bp, Homo sapiens
ctatagagaaaaactttcattt

SEQ ID NO: 3362796 - DNA, 21 bp, Homo sapiens
ctatagagagggggctctcca

SEQ ID NO: 3362797 - DNA, 17 bp, Homo sapiens
ctatagcctaggtgaca

SEQ ID NO: 3362798 - DNA, 18 bp, Homo sapiens
ctatagcctaggtgacag

SEQ ID NO: 3362799 - DNA, 19 bp, Homo sapiens
ctatagcctaggtgacaga

SEQ ID NO: 3362800 - DNA, 19 bp, Homo sapiens
ctatagcctggactttcct

SEQ ID NO: 3362801 - DNA, 15 bp, Homo sapiens
ctatagcttgcagaa

SEQ ID NO: 3362802 - DNA, 21 bp, Homo sapiens
ctataggttttggttccacaa

SEQ ID NO: 3362803 - DNA, 14 bp, Homo sapiens
ctatagtcccagct

SEQ ID NO: 3362804 - DNA, 15 bp, Homo sapiens
ctatagtcccagcta

SEQ ID NO: 3362805 - DNA, 22 bp, Homo sapiens
ctatagttatacatcaatttaa

SEQ ID NO: 3362806 - DNA, 14 bp, Homo sapiens
ctatataaaataac

SEQ ID NO: 3362807 - DNA, 17 bp, Homo sapiens
ctatataaaataactaa

SEQ ID NO: 3362808 - DNA, 13 bp, Homo sapiens
ctatataaaatgt

SEQ ID NO: 3362809 - DNA, 19 bp, Homo sapiens
ctatataaaatgtattcaa

SEQ ID NO: 3362810 - DNA, 16 bp, Homo sapiens
ctatatacatgtgtgt

SEQ ID NO: 3362811 - DNA, 23 bp, Homo sapiens
ctatataggaaactaagcattgt

SEQ ID NO: 3362812 - DNA, 20 bp, Homo sapiens
ctcactgttccctctgctcc

SEQ ID NO: 3362813 - DNA, 15 bp, Homo sapiens
ctcactgttctgcaa

SEQ ID NO: 3362814 - DNA, 16 bp, Homo sapiens
ctcactgttctgcaaa

SEQ ID NO: 3362815 - DNA, 21 bp, Homo sapiens
ctcactgttgaattttctcta

SEQ ID NO: 3362816 - DNA, 15 bp, Homo sapiens
ctcactgttgcccag

SEQ ID NO: 3362817 - DNA, 16 bp, Homo sapiens
ctcactgttgcccagg

SEQ ID NO: 3362818 - DNA, 14 bp, Homo sapiens
ctcacttcaatgtg

SEQ ID NO: 3362819 - DNA, 16 bp, Homo sapiens
ctcacttcaatgtgtc

SEQ ID NO: 3362820 - DNA, 20 bp, Homo sapiens
ctcacttccatacagctcta

SEQ ID NO: 3362821 - DNA, 20 bp, Homo sapiens
ctcacttctgggcttcatct

SEQ ID NO: 3362822 - DNA, 14 bp, Homo sapiens
ctcacttgggggaa

SEQ ID NO: 3362823 - DNA, 14 bp, Homo sapiens
ctcactttacataa

SEQ ID NO: 3362824 - DNA, 15 bp, Homo sapiens
ctcacttttcatctg

SEQ ID NO: 3362825 - DNA, 19 bp, Homo sapiens
ctcagaaaaaggcagtggc

SEQ ID NO: 3362826 - DNA, 19 bp, Homo sapiens
ctcagaaaagaaaaccatt

SEQ ID NO: 3362827 - DNA, 21 bp, Homo sapiens
ctcagaaactcccctgggggt

SEQ ID NO: 3362828 - DNA, 13 bp, Homo sapiens
ctcagaaagaggt

SEQ ID NO: 3362829 - DNA, 17 bp, Homo sapiens
ctcagaaagaggtctcc

SEQ ID NO: 3362830 - DNA, 22 bp, Homo sapiens
ctcagaaagaggtctccccatc

SEQ ID NO: 3362831 - DNA, 18 bp, Homo sapiens
ctcagaaagtcaccagga

SEQ ID NO: 3362832 - DNA, 16 bp, Homo sapiens
ctcagaaagtgcctga

SEQ ID NO: 3362833 - DNA, 14 bp, Homo sapiens
ctcagaaatgctgt

SEQ ID NO: 3362834 - DNA, 17 bp, Homo sapiens
ctcagaaatgctgtccc

SEQ ID NO: 3362835 - DNA, 21 bp, Homo sapiens
ctcagaaatttttatttttct

SEQ ID NO: 3362836 - DNA, 14 bp, Homo sapiens
ctcagaacagctga

SEQ ID NO: 3362837 - DNA, 13 bp, Homo sapiens
ctcagaacccagg

SEQ ID NO: 3362838 - DNA, 23 bp, Homo sapiens
ctcagaacccagggctctgcccc

SEQ ID NO: 3362839 - DNA, 15 bp, Homo sapiens
ctcagaagcctgagg

SEQ ID NO: 3362840 - DNA, 16 bp, Homo sapiens
ctcagaagcctgaggc

SEQ ID NO: 3362841 - DNA, 13 bp, Homo sapiens
ctcagaaggtatt

SEQ ID NO: 3362842 - DNA, 21 bp, Homo sapiens
ctcagaatctaaacgtggtca

SEQ ID NO: 3362843 - DNA, 19 bp, Homo sapiens
ctcagaatttatctccctt

SEQ ID NO: 3362844 - DNA, 17 bp, Homo sapiens
ctcagacggcggccagg

SEQ ID NO: 3362845 - DNA, 21 bp, Homo sapiens
ctcagacggcggccaggcaca

SEQ ID NO: 3362846 - DNA, 16 bp, Homo sapiens
ctcagacttttgtaca

SEQ ID NO: 3362847 - DNA, 20 bp, Homo sapiens
ctcagagaaaaatgctcccc

SEQ ID NO: 3362848 - DNA, 17 bp, Homo sapiens
ctcagagaaggaaaaga

SEQ ID NO: 3362849 - DNA, 14 bp, Homo sapiens
ctcagagcagagca

SEQ ID NO: 3362850 - DNA, 16 bp, Homo sapiens
ctcagagcatgtgtca

SEQ ID NO: 3362851 - DNA, 20 bp, Homo sapiens
ctcagagcatttaaggaaac

SEQ ID NO: 3362852 - DNA, 11 bp, Homo sapiens
ctcagagccct

SEQ ID NO: 3362853 - DNA, 14 bp, Homo sapiens
ctcagagccctgcc

SEQ ID NO: 3362854 - DNA, 16 bp, Homo sapiens
ctcagagccctgccct

SEQ ID NO: 3362855 - DNA, 19 bp, Homo sapiens
ctcagagccctgccctgca

SEQ ID NO: 3362856 - DNA, 20 bp, Homo sapiens
ctcagaggagctctaccctg

SEQ ID NO: 3362857 - DNA, 23 bp, Homo sapiens
ctcagaggtttacctagagaaca

SEQ ID NO: 3362858 - DNA, 16 bp, Homo sapiens
ctcagagtatctttac

SEQ ID NO: 3362859 - DNA, 15 bp, Homo sapiens
ctcagatataagaga

SEQ ID NO: 3362860 - DNA, 17 bp, Homo sapiens
ctcagatcagtgtacca

SEQ ID NO: 3362861 - DNA, 21 bp, Homo sapiens
ctcagatcagtgtaccatttg

SEQ ID NO: 3362862 - DNA, 19 bp, Homo sapiens
ctcagatcggccacagggc

SEQ ID NO: 3362863 - DNA, 12 bp, Homo sapiens
ctcagatctgaa

SEQ ID NO: 3362864 - DNA, 20 bp, Homo sapiens
ctcagatgatctctccacgg

SEQ ID NO: 3362865 - DNA, 17 bp, Homo sapiens
ctcagatggggcaccaa

SEQ ID NO: 3362866 - DNA, 13 bp, Homo sapiens
ctcagatgttaaa

SEQ ID NO: 3362867 - DNA, 17 bp, Homo sapiens
ctcagatgttaaaataa

SEQ ID NO: 3362868 - DNA, 23 bp, Homo sapiens
ctcagatgttaaaataaatggtt

SEQ ID NO: 3362869 - DNA, 17 bp, Homo sapiens
ctcagattatttttcct

SEQ ID NO: 3362870 - DNA, 20 bp, Homo sapiens
ctcagcaaggggctctgccc

SEQ ID NO: 3362871 - DNA, 16 bp, Homo sapiens
ctcagcaccccttcca

SEQ ID NO: 3362872 - DNA, 17 bp, Homo sapiens
ctcagcaccccttccat

SEQ ID NO: 3362873 - DNA, 20 bp, Homo sapiens
ctcagcaccccttccatgtg

SEQ ID NO: 3362874 - DNA, 23 bp, Homo sapiens
ctcagcagcctgcgctcggcagg

SEQ ID NO: 3362875 - DNA, 14 bp, Homo sapiens
ctcagcagtccaca

SEQ ID NO: 3362876 - DNA, 15 bp, Homo sapiens
ctcagcatcctggca

SEQ ID NO: 3362877 - DNA, 18 bp, Homo sapiens
ctcagcatcctggcaccc

SEQ ID NO: 3362878 - DNA, 21 bp, Homo sapiens
ctcagcatcctggcacccggc

SEQ ID NO: 3362879 - DNA, 18 bp, Homo sapiens
ctcagccaagacaaggag

SEQ ID NO: 3362880 - DNA, 13 bp, Homo sapiens
ctcagccaagctt

SEQ ID NO: 3362881 - DNA, 22 bp, Homo sapiens
ctcagccatttccccctcctca

SEQ ID NO: 3362882 - DNA, 23 bp, Homo sapiens
ctcagccatttccccctcctcag

SEQ ID NO: 3362883 - DNA, 21 bp, Homo sapiens
ctcagcccacatagtgatggt

SEQ ID NO: 3362884 - DNA, 17 bp, Homo sapiens
ctcagcccacctgcacc

SEQ ID NO: 3362885 - DNA, 17 bp, Homo sapiens
ctcagcccccaggccag

SEQ ID NO: 3362886 - DNA, 11 bp, Homo sapiens
ctcagccccta

SEQ ID NO: 3362887 - DNA, 13 bp, Homo sapiens
ctcagccctcaga

SEQ ID NO: 3362888 - DNA, 17 bp, Homo sapiens
ctcagccctcagaacaa

SEQ ID NO: 3362889 - DNA, 19 bp, Homo sapiens
ctcagccctccctgcccct

SEQ ID NO: 3362890 - DNA, 20 bp, Homo sapiens
ctcagccctccctgcccctc

SEQ ID NO: 3362891 - DNA, 21 bp, Homo sapiens
ctcagccctccctgcccctcc

SEQ ID NO: 3362892 - DNA, 14 bp, Homo sapiens
ctcagcccttgccc

SEQ ID NO: 3362893 - DNA, 15 bp, Homo sapiens
ctcagcctcagagga

SEQ ID NO: 3362894 - DNA, 14 bp, Homo sapiens
ctcagcctcccaaa

SEQ ID NO: 3362895 - DNA, 15 bp, Homo sapiens
ctcagcctcccaaag

SEQ ID NO: 3362896 - DNA, 17 bp, Homo sapiens
ctcagcctcccaaagtg

SEQ ID NO: 3362897 - DNA, 22 bp, Homo sapiens
ctcagcctcccaaagtgctggg

SEQ ID NO: 3362898 - DNA, 14 bp, Homo sapiens
ctcagcctcccaca

SEQ ID NO: 3362899 - DNA, 13 bp, Homo sapiens
ctcagcctcccga

SEQ ID NO: 3362900 - DNA, 14 bp, Homo sapiens
ctcagcctcctgag

SEQ ID NO: 3362901 - DNA, 20 bp, Homo sapiens
ctcagcctcctgagcctgtg

SEQ ID NO: 3362902 - DNA, 17 bp, Homo sapiens
ctcagcctgctgcccag

SEQ ID NO: 3362903 - DNA, 18 bp, Homo sapiens
ctcagccttacatttgtg

SEQ ID NO: 3362904 - DNA, 13 bp, Homo sapiens
ctcagcgctcctc

SEQ ID NO: 3362905 - DNA, 23 bp, Homo sapiens
ctcagcgctcctcctgtgtgact

SEQ ID NO: 3362906 - DNA, 14 bp, Homo sapiens
ctcagcggggacag

SEQ ID NO: 3362907 - DNA, 16 bp, Homo sapiens
ctcagcggggacagct

SEQ ID NO: 3362908 - DNA, 18 bp, Homo sapiens
ctcagcggggacagctcc

SEQ ID NO: 3362909 - DNA, 19 bp, Homo sapiens
ctcagcggggacagctcct

SEQ ID NO: 3362910 - DNA, 13 bp, Homo sapiens
ctcagctcagcgc

SEQ ID NO: 3362911 - DNA, 16 bp, Homo sapiens
ctcagctcagcgccag

SEQ ID NO: 3362912 - DNA, 22 bp, Homo sapiens
ctcagctccagacgtaggggag

SEQ ID NO: 3362913 - DNA, 17 bp, Homo sapiens
ctcagctccccctgtcc

SEQ ID NO: 3362914 - DNA, 19 bp, Homo sapiens
ctcagctccccctgtcccc

SEQ ID NO: 3362915 - DNA, 12 bp, Homo sapiens
ctcagctctggg

SEQ ID NO: 3362916 - DNA, 15 bp, Homo sapiens
ctcagctctgggaga

SEQ ID NO: 3362917 - DNA, 13 bp, Homo sapiens
ctcagctcttcca

SEQ ID NO: 3362918 - DNA, 23 bp, Homo sapiens
ctcagctgaatgcctcctgtggg

SEQ ID NO: 3362919 - DNA, 19 bp, Homo sapiens
ctcagctggaagtctacct

SEQ ID NO: 3362920 - DNA, 20 bp, Homo sapiens
ctcagctggaagtctacctg

SEQ ID NO: 3362921 - DNA, 22 bp, Homo sapiens
ctcagctggaagtctacctgct

SEQ ID NO: 3362922 - DNA, 14 bp, Homo sapiens
ctcagctggctgta

SEQ ID NO: 3362923 - DNA, 20 bp, Homo sapiens
ctcagctggttactcagggt

SEQ ID NO: 3362924 - DNA, 22 bp, Homo sapiens
ctcagctggttactcagggttc

SEQ ID NO: 3362925 - DNA, 23 bp, Homo sapiens
ctcagctggttactcagggttca

SEQ ID NO: 3362926 - DNA, 17 bp, Homo sapiens
ctcagctgtcctgcagc

SEQ ID NO: 3362927 - DNA, 20 bp, Homo sapiens
ctcagcttcttcacaggcac

SEQ ID NO: 3362928 - DNA, 12 bp, Homo sapiens
ctcagctttgag

SEQ ID NO: 3362929 - DNA, 21 bp, Homo sapiens
ctcagctttgagaagccttca

SEQ ID NO: 3362930 - DNA, 22 bp, Homo sapiens
ctcagctttgagaagccttcag

SEQ ID NO: 3362931 - DNA, 21 bp, Homo sapiens
ctcaggaactatggcaaggaa

SEQ ID NO: 3362932 - DNA, 17 bp, Homo sapiens
ctcaggaattcagtgcc

SEQ ID NO: 3362933 - DNA, 23 bp, Homo sapiens
ctcaggacccaggccctccatgg

SEQ ID NO: 3362934 - DNA, 15 bp, Homo sapiens
ctcaggactcctctc

SEQ ID NO: 3362935 - DNA, 16 bp, Homo sapiens
ctcaggagatggaggg

SEQ ID NO: 3362936 - DNA, 19 bp, Homo sapiens
ctcaggagatggagggctt

SEQ ID NO: 3362937 - DNA, 15 bp, Homo sapiens
ctcaggagcacaggc

SEQ ID NO: 3362938 - DNA, 13 bp, Homo sapiens
ctccactggctcc

SEQ ID NO: 3362939 - DNA, 14 bp, Homo sapiens
ctccactggctcca

SEQ ID NO: 3362940 - DNA, 17 bp, Homo sapiens
ctccactggctccatga

SEQ ID NO: 3362941 - DNA, 23 bp, Homo sapiens
ctccactggggaatgctcccagc

SEQ ID NO: 3362942 - DNA, 12 bp, Homo sapiens
ctccactgtcac

SEQ ID NO: 3362943 - DNA, 13 bp, Homo sapiens
ctccactgtcaca

SEQ ID NO: 3362944 - DNA, 16 bp, Homo sapiens
ctccactgtcacattg

SEQ ID NO: 3362945 - DNA, 18 bp, Homo sapiens
ctccactgtcaccctcca

SEQ ID NO: 3362946 - DNA, 17 bp, Homo sapiens
ctccactgtgcctttgc

SEQ ID NO: 3362947 - DNA, 20 bp, Homo sapiens
ctccacttcccgtctcagaa

SEQ ID NO: 3362948 - DNA, 23 bp, Homo sapiens
ctccacttggtctgtgagatgct

SEQ ID NO: 3362949 - DNA, 22 bp, Homo sapiens
ctccagaaatgtctaaatgctg

SEQ ID NO: 3362950 - DNA, 15 bp, Homo sapiens
ctccagaagcctctg

SEQ ID NO: 3362951 - DNA, 16 bp, Homo sapiens
ctccagaagcctctgg

SEQ ID NO: 3362952 - DNA, 18 bp, Homo sapiens
ctccagaatctgctgttg

SEQ ID NO: 3362953 - DNA, 19 bp, Homo sapiens
ctccagaatctgctgttgc

SEQ ID NO: 3362954 - DNA, 16 bp, Homo sapiens
ctccagaatgtaagaa

SEQ ID NO: 3362955 - DNA, 23 bp, Homo sapiens
ctccagaatgtaagaaaacaaaa

SEQ ID NO: 3362956 - DNA, 19 bp, Homo sapiens
ctccagaatttggaaatcc

SEQ ID NO: 3362957 - DNA, 22 bp, Homo sapiens
ctccagaatttggaaatcctag

SEQ ID NO: 3362958 - DNA, 16 bp, Homo sapiens
ctccagaccaccagcc

SEQ ID NO: 3362959 - DNA, 17 bp, Homo sapiens
ctccagacccaccacac

SEQ ID NO: 3362960 - DNA, 18 bp, Homo sapiens
ctccagagccagcctggg

SEQ ID NO: 3362961 - DNA, 19 bp, Homo sapiens
ctccagagccagcctggga

SEQ ID NO: 3362962 - DNA, 21 bp, Homo sapiens
ctccagagccagcctgggact

SEQ ID NO: 3362963 - DNA, 16 bp, Homo sapiens
ctccagagtctgagcc

SEQ ID NO: 3362964 - DNA, 17 bp, Homo sapiens
ctccagagtctgagccc

SEQ ID NO: 3362965 - DNA, 20 bp, Homo sapiens
ctccagagtctgagcccccg

SEQ ID NO: 3362966 - DNA, 13 bp, Homo sapiens
ctccagatagaga

SEQ ID NO: 3362967 - DNA, 16 bp, Homo sapiens
ctccagatagagaaat

SEQ ID NO: 3362968 - DNA, 13 bp, Homo sapiens
ctccagcaccttc

SEQ ID NO: 3362969 - DNA, 20 bp, Homo sapiens
ctccagcaccttctttctgg

SEQ ID NO: 3362970 - DNA, 23 bp, Homo sapiens
ctccagcaccttctttctggact

SEQ ID NO: 3362971 - DNA, 13 bp, Homo sapiens
ctccagcatccag

SEQ ID NO: 3362972 - DNA, 16 bp, Homo sapiens
ctccagcatccagcct

SEQ ID NO: 3362973 - DNA, 17 bp, Homo sapiens
ctccagcatccagcctg

SEQ ID NO: 3362974 - DNA, 16 bp, Homo sapiens
ctccagccaccaccca

SEQ ID NO: 3362975 - DNA, 12 bp, Homo sapiens
ctccagccagca

SEQ ID NO: 3362976 - DNA, 16 bp, Homo sapiens
ctccagccagcaatga

SEQ ID NO: 3362977 - DNA, 15 bp, Homo sapiens
ctccagcccctgtcc

SEQ ID NO: 3362978 - DNA, 16 bp, Homo sapiens
ctccagcccgggagcc

SEQ ID NO: 3362979 - DNA, 21 bp, Homo sapiens
ctccagcccgggagcctagga

SEQ ID NO: 3362980 - DNA, 13 bp, Homo sapiens
ctccagccgaagc

SEQ ID NO: 3362981 - DNA, 12 bp, Homo sapiens
ctccagcctctc

SEQ ID NO: 3362982 - DNA, 16 bp, Homo sapiens
ctccagcctctcccgg

SEQ ID NO: 3362983 - DNA, 17 bp, Homo sapiens
ctccagcctctcccggc

SEQ ID NO: 3362984 - DNA, 24 bp, Homo sapiens
ctccagcctctcccggctgcctgc

SEQ ID NO: 3362985 - DNA, 21 bp, Homo sapiens
ctccagcctgcccaagcccag

SEQ ID NO: 3362986 - DNA, 19 bp, Homo sapiens
ctccagcctgcctggcagg

SEQ ID NO: 3362987 - DNA, 11 bp, Homo sapiens
ctccagcctgg

SEQ ID NO: 3362988 - DNA, 19 bp, Homo sapiens
ctccagcctggacccccag

SEQ ID NO: 3362989 - DNA, 13 bp, Homo sapiens
ctccagcctgggc

SEQ ID NO: 3362990 - DNA, 14 bp, Homo sapiens
ctccagcctgggca

SEQ ID NO: 3362991 - DNA, 18 bp, Homo sapiens
ctccagcgtcagctgctc

SEQ ID NO: 3362992 - DNA, 23 bp, Homo sapiens
ctccagcgtcagctgctccctgg

SEQ ID NO: 3362993 - DNA, 18 bp, Homo sapiens
ctccagctcaccagcccc

SEQ ID NO: 3362994 - DNA, 16 bp, Homo sapiens
ctccagctcagaaccc

SEQ ID NO: 3362995 - DNA, 20 bp, Homo sapiens
ctccagctcagaacccaggg

SEQ ID NO: 3362996 - DNA, 21 bp, Homo sapiens
ctccagctccaagacctgttg

SEQ ID NO: 3362997 - DNA, 11 bp, Homo sapiens
ctccagctgcc

SEQ ID NO: 3362998 - DNA, 18 bp, Homo sapiens
ctccaggactccactgga

SEQ ID NO: 3362999 - DNA, 21 bp, Homo sapiens
ctccaggactccactggacag

SEQ ID NO: 3363000 - DNA, 22 bp, Homo sapiens
ctccaggactccactggacaga

SEQ ID NO: 3363001 - DNA, 20 bp, Homo sapiens
ctccaggcacccttctttcc

SEQ ID NO: 3363002 - DNA, 11 bp, Homo sapiens
ctccaggccca

SEQ ID NO: 3363003 - DNA, 12 bp, Homo sapiens
ctccaggcccaa

SEQ ID NO: 3363004 - DNA, 16 bp, Homo sapiens
ctccaggcccaaggct

SEQ ID NO: 3363005 - DNA, 13 bp, Homo sapiens
ctccaggccctcc

SEQ ID NO: 3363006 - DNA, 20 bp, Homo sapiens
ctccaggccctcctctccca

SEQ ID NO: 3363007 - DNA, 17 bp, Homo sapiens
ctccaggcctgcagcag

SEQ ID NO: 3363008 - DNA, 16 bp, Homo sapiens
ctccaggcctgcctcc

SEQ ID NO: 3363009 - DNA, 22 bp, Homo sapiens
ctccaggcctgcctcccacttc

SEQ ID NO: 3363010 - DNA, 13 bp, Homo sapiens
ctccaggcctgtt

SEQ ID NO: 3363011 - DNA, 20 bp, Homo sapiens
ctccaggcctgttgctatag

SEQ ID NO: 3363012 - DNA, 11 bp, Homo sapiens
ctccaggctcc

SEQ ID NO: 3363013 - DNA, 15 bp, Homo sapiens
ctccaggctccttta

SEQ ID NO: 3363014 - DNA, 23 bp, Homo sapiens
ctccaggctgtatcccatgagcc

SEQ ID NO: 3363015 - DNA, 19 bp, Homo sapiens
ctccagggaatccaagcct

SEQ ID NO: 3363016 - DNA, 15 bp, Homo sapiens
ctccagggcccccca

SEQ ID NO: 3363017 - DNA, 23 bp, Homo sapiens
ctccaggggcccttgggacagcc

SEQ ID NO: 3363018 - DNA, 21 bp, Homo sapiens
ctccaggggctgcttcctcct

SEQ ID NO: 3363019 - DNA, 23 bp, Homo sapiens
ctccaggggctgcttcctcctgg

SEQ ID NO: 3363020 - DNA, 15 bp, Homo sapiens
ctccaggggtggctg

SEQ ID NO: 3363021 - DNA, 16 bp, Homo sapiens
ctccagggtcttgggc

SEQ ID NO: 3363022 - DNA, 20 bp, Homo sapiens
ctccagggtcttgggctact

SEQ ID NO: 3363023 - DNA, 21 bp, Homo sapiens
ctccagggtcttgggctactg

SEQ ID NO: 3363024 - DNA, 22 bp, Homo sapiens
ctccagggtcttgggctactgg

SEQ ID NO: 3363025 - DNA, 18 bp, Homo sapiens
ctccaggtctcacgggca

SEQ ID NO: 3363026 - DNA, 14 bp, Homo sapiens
ctccagtattcttg

SEQ ID NO: 3363027 - DNA, 16 bp, Homo sapiens
ctccagtcaggaggca

SEQ ID NO: 3363028 - DNA, 21 bp, Homo sapiens
ctccagtccccctatccttgg

SEQ ID NO: 3363029 - DNA, 23 bp, Homo sapiens
ctccagtccccctatccttggca

SEQ ID NO: 3363030 - DNA, 20 bp, Homo sapiens
ctccagtgggctgatgctgg

SEQ ID NO: 3363031 - DNA, 21 bp, Homo sapiens
ctccagtgtacatagtgtaat

SEQ ID NO: 3363032 - DNA, 22 bp, Homo sapiens
ctccagtgtgggcttgaccagg

SEQ ID NO: 3363033 - DNA, 17 bp, Homo sapiens
ctccagttgggactcag

SEQ ID NO: 3363034 - DNA, 20 bp, Homo sapiens
ctccagttgggactcaggat

SEQ ID NO: 3363035 - DNA, 21 bp, Homo sapiens
ctccagttgggactcaggata

SEQ ID NO: 3363036 - DNA, 21 bp, Homo sapiens
ctccagtttgcacctgtcccc

SEQ ID NO: 3363037 - DNA, 20 bp, Homo sapiens
ctccagtttttgtttttgca

SEQ ID NO: 3363038 - DNA, 14 bp, Homo sapiens
ctccatactcagga

SEQ ID NO: 3363039 - DNA, 12 bp, Homo sapiens
ctccatccaagg

SEQ ID NO: 3363040 - DNA, 17 bp, Homo sapiens
ctccatcccaacagcca

SEQ ID NO: 3363041 - DNA, 20 bp, Homo sapiens
ctccatccctccctcccgtc

SEQ ID NO: 3363042 - DNA, 15 bp, Homo sapiens
ctccatccctctaat

SEQ ID NO: 3363043 - DNA, 14 bp, Homo sapiens
ctccatccctggcc

SEQ ID NO: 3363044 - DNA, 15 bp, Homo sapiens
ctccatccctggccc

SEQ ID NO: 3363045 - DNA, 12 bp, Homo sapiens
ctccatcctgag

SEQ ID NO: 3363046 - DNA, 19 bp, Homo sapiens
ctccatctctcatcctcca

SEQ ID NO: 3363047 - DNA, 13 bp, Homo sapiens
ctccatctttata

SEQ ID NO: 3363048 - DNA, 21 bp, Homo sapiens
ctccatgagacacatctcctc

SEQ ID NO: 3363049 - DNA, 12 bp, Homo sapiens
ctccatgattct

SEQ ID NO: 3363050 - DNA, 15 bp, Homo sapiens
ctccatgattctctg

SEQ ID NO: 3363051 - DNA, 18 bp, Homo sapiens
ctccatgattctctgagt

SEQ ID NO: 3363052 - DNA, 23 bp, Homo sapiens
ctccatgcctctggaggcctctg

SEQ ID NO: 3363053 - DNA, 21 bp, Homo sapiens
ctccatgctcctcacctgtct

SEQ ID NO: 3363054 - DNA, 19 bp, Homo sapiens
ctccatgctcctcactgcc

SEQ ID NO: 3363055 - DNA, 14 bp, Homo sapiens
ctccatgctgcctc

SEQ ID NO: 3363056 - DNA, 15 bp, Homo sapiens
ctccatgctgcctcc

SEQ ID NO: 3363057 - DNA, 14 bp, Homo sapiens
ctccatggcatctt

SEQ ID NO: 3363058 - DNA, 14 bp, Homo sapiens
ctccattaaagtct

SEQ ID NO: 3363059 - DNA, 16 bp, Homo sapiens
ctccattaaagtctga

SEQ ID NO: 3363060 - DNA, 17 bp, Homo sapiens
ctccatttctctccagg

SEQ ID NO: 3363061 - DNA, 17 bp, Homo sapiens
ctccatttggtcctttc

SEQ ID NO: 3363062 - DNA, 18 bp, Homo sapiens
ctccatttggtcctttct

SEQ ID NO: 3363063 - DNA, 20 bp, Homo sapiens
ctcccaaagctcagacttgc

SEQ ID NO: 3363064 - DNA, 13 bp, Homo sapiens
ctcccctcacagc

SEQ ID NO: 3363065 - DNA, 14 bp, Homo sapiens
ctcccctcacagcc

SEQ ID NO: 3363066 - DNA, 16 bp, Homo sapiens
ctcccctcacagcctc

SEQ ID NO: 3363067 - DNA, 15 bp, Homo sapiens
ctcccctccatccct

SEQ ID NO: 3363068 - DNA, 16 bp, Homo sapiens
ctcccctccatccctg

SEQ ID NO: 3363069 - DNA, 19 bp, Homo sapiens
ctcccctccccgcctggcc

SEQ ID NO: 3363070 - DNA, 16 bp, Homo sapiens
ctcccctcccctgctg

SEQ ID NO: 3363071 - DNA, 17 bp, Homo sapiens
ctcccctcccctgctgc

SEQ ID NO: 3363072 - DNA, 11 bp, Homo sapiens
ctcccctcctt

SEQ ID NO: 3363073 - DNA, 12 bp, Homo sapiens
ctcccctccttg

SEQ ID NO: 3363074 - DNA, 20 bp, Homo sapiens
ctcccctcgtgtcagctcag

SEQ ID NO: 3363075 - DNA, 12 bp, Homo sapiens
ctcccctgccct

SEQ ID NO: 3363076 - DNA, 14 bp, Homo sapiens
ctcccctgccctgc

SEQ ID NO: 3363077 - DNA, 15 bp, Homo sapiens
ctcccctgctgcagg

SEQ ID NO: 3363078 - DNA, 15 bp, Homo sapiens
ctcccctggaagcga

SEQ ID NO: 3363079 - DNA, 13 bp, Homo sapiens
ctccccttgcctt

SEQ ID NO: 3363080 - DNA, 23 bp, Homo sapiens
ctcccgaatagctgggactacag

SEQ ID NO: 3363081 - DNA, 17 bp, Homo sapiens
ctcccgagtagctggga

SEQ ID NO: 3363082 - DNA, 19 bp, Homo sapiens
ctcccgagtagctgggact

SEQ ID NO: 3363083 - DNA, 20 bp, Homo sapiens
ctcccgagtagctgggacta

SEQ ID NO: 3363084 - DNA, 13 bp, Homo sapiens
ctcccgctcccag

SEQ ID NO: 3363085 - DNA, 22 bp, Homo sapiens
ctcccggaattccgtcaccacg

SEQ ID NO: 3363086 - DNA, 19 bp, Homo sapiens
ctcccggcatgggaaagcc

SEQ ID NO: 3363087 - DNA, 15 bp, Homo sapiens
ctcccgggccacgcc

SEQ ID NO: 3363088 - DNA, 16 bp, Homo sapiens
ctcccgggccacgccc

SEQ ID NO: 3363089 - DNA, 20 bp, Homo sapiens
ctcccgggtctcaggcctcc

SEQ ID NO: 3363090 - DNA, 19 bp, Homo sapiens
ctcccgtagtctcctgggt

SEQ ID NO: 3363091 - DNA, 15 bp, Homo sapiens
ctcccgtcagggccc

SEQ ID NO: 3363092 - DNA, 16 bp, Homo sapiens
ctcccgtcagggccca

SEQ ID NO: 3363093 - DNA, 18 bp, Homo sapiens
ctccctaatttatgtgct

SEQ ID NO: 3363094 - DNA, 18 bp, Homo sapiens
ctccctactcccctgggc

SEQ ID NO: 3363095 - DNA, 15 bp, Homo sapiens
ctccctagactgcat

SEQ ID NO: 3363096 - DNA, 14 bp, Homo sapiens
ctccctagctcctc

SEQ ID NO: 3363097 - DNA, 18 bp, Homo sapiens
ctccctatccctcacaca

SEQ ID NO: 3363098 - DNA, 11 bp, Homo sapiens
ctccctcagcc

SEQ ID NO: 3363099 - DNA, 13 bp, Homo sapiens
ctccctcagcctc

SEQ ID NO: 3363100 - DNA, 14 bp, Homo sapiens
ctccctcagcctca

SEQ ID NO: 3363101 - DNA, 14 bp, Homo sapiens
ctccctcagtgccc

SEQ ID NO: 3363102 - DNA, 15 bp, Homo sapiens
ctccctcccctgcca

SEQ ID NO: 3363103 - DNA, 23 bp, Homo sapiens
ctccctcccctgccctggtccag

SEQ ID NO: 3363104 - DNA, 13 bp, Homo sapiens
ctccctcccgcac

SEQ ID NO: 3363105 - DNA, 15 bp, Homo sapiens
ctccctcctcacctc

SEQ ID NO: 3363106 - DNA, 15 bp, Homo sapiens
ctccctcctccaggc

SEQ ID NO: 3363107 - DNA, 20 bp, Homo sapiens
ctccctccttccttcttgct

SEQ ID NO: 3363108 - DNA, 12 bp, Homo sapiens
ctccctccttgg

SEQ ID NO: 3363109 - DNA, 13 bp, Homo sapiens
ctccctccttggg

SEQ ID NO: 3363110 - DNA, 14 bp, Homo sapiens
ctccctctatttat

SEQ ID NO: 3363111 - DNA, 17 bp, Homo sapiens
ctccctctcccaggccc

SEQ ID NO: 3363112 - DNA, 20 bp, Homo sapiens
ctccctctctcttctgctcc

SEQ ID NO: 3363113 - DNA, 18 bp, Homo sapiens
ctccctctctcttttcat

SEQ ID NO: 3363114 - DNA, 12 bp, Homo sapiens
ctccctctctgg

SEQ ID NO: 3363115 - DNA, 13 bp, Homo sapiens
ctccctctgacct

SEQ ID NO: 3363116 - DNA, 18 bp, Homo sapiens
ctccctctgacctgcagg

SEQ ID NO: 3363117 - DNA, 22 bp, Homo sapiens
ctccctctgccccaagcagcca

SEQ ID NO: 3363118 - DNA, 14 bp, Homo sapiens
ctccctcttcactg

SEQ ID NO: 3363119 - DNA, 23 bp, Homo sapiens
ctccctcttcactgtggccacag

SEQ ID NO: 3363120 - DNA, 11 bp, Homo sapiens
ctccctcttcc

SEQ ID NO: 3363121 - DNA, 20 bp, Homo sapiens
ctccctcttctcaagtgcct

SEQ ID NO: 3363122 - DNA, 13 bp, Homo sapiens
ctccctgaagcca

SEQ ID NO: 3363123 - DNA, 16 bp, Homo sapiens
ctccctgactccctgt

SEQ ID NO: 3363124 - DNA, 16 bp, Homo sapiens
ctccctgagctttggg

SEQ ID NO: 3363125 - DNA, 17 bp, Homo sapiens
ctccctgagctttgggg

SEQ ID NO: 3363126 - DNA, 14 bp, Homo sapiens
ctccctgatgacac

SEQ ID NO: 3363127 - DNA, 17 bp, Homo sapiens
ctccctgatgacaccca

SEQ ID NO: 3363128 - DNA, 22 bp, Homo sapiens
ctccctgatgacacccaccctg

SEQ ID NO: 3363129 - DNA, 15 bp, Homo sapiens
ctccctgcagatgcc

SEQ ID NO: 3363130 - DNA, 22 bp, Homo sapiens
ctccctgccaagtctcagaaga

SEQ ID NO: 3363131 - DNA, 21 bp, Homo sapiens
ctccctgcccctcccttcaac

SEQ ID NO: 3363132 - DNA, 18 bp, Homo sapiens
ctccctgcctggccccca

SEQ ID NO: 3363133 - DNA, 14 bp, Homo sapiens
ctccctgctcagtg

SEQ ID NO: 3363134 - DNA, 15 bp, Homo sapiens
ctccctgctcagtgc

SEQ ID NO: 3363135 - DNA, 17 bp, Homo sapiens
ctccctgctccacgaag

SEQ ID NO: 3363136 - DNA, 12 bp, Homo sapiens
ctccctggatga

SEQ ID NO: 3363137 - DNA, 19 bp, Homo sapiens
ctccctggatgtgtggggc

SEQ ID NO: 3363138 - DNA, 11 bp, Homo sapiens
ctccctggctc

SEQ ID NO: 3363139 - DNA, 15 bp, Homo sapiens
ctccctggctccctc

SEQ ID NO: 3363140 - DNA, 15 bp, Homo sapiens
ctccctggctgccct

SEQ ID NO: 3363141 - DNA, 17 bp, Homo sapiens
ctccctgtctctgcatc

SEQ ID NO: 3363142 - DNA, 22 bp, Homo sapiens
ctccctgtgggggtggccatcc

SEQ ID NO: 3363143 - DNA, 13 bp, Homo sapiens
ctccctgtgtcca

SEQ ID NO: 3363144 - DNA, 21 bp, Homo sapiens
ctccctgttgacgaagtctct

SEQ ID NO: 3363145 - DNA, 23 bp, Homo sapiens
ctccctgtttgaagcctgccctt

SEQ ID NO: 3363146 - DNA, 14 bp, Homo sapiens
ctcccttccgaccc

SEQ ID NO: 3363147 - DNA, 16 bp, Homo sapiens
ctcccttcctggcctc

SEQ ID NO: 3363148 - DNA, 18 bp, Homo sapiens
ctcccttcctggcctcac

SEQ ID NO: 3363149 - DNA, 12 bp, Homo sapiens
ctcccttgctgg

SEQ ID NO: 3363150 - DNA, 22 bp, Homo sapiens
ctcccttgctggccccagccct

SEQ ID NO: 3363151 - DNA, 19 bp, Homo sapiens
ctcccttggcagagaagca

SEQ ID NO: 3363152 - DNA, 16 bp, Homo sapiens
ctcccttgggctggaa

SEQ ID NO: 3363153 - DNA, 18 bp, Homo sapiens
ctcccttgggttctgata

SEQ ID NO: 3363154 - DNA, 13 bp, Homo sapiens
ctccctttcaaca

SEQ ID NO: 3363155 - DNA, 17 bp, Homo sapiens
ctccctttccttcctaa

SEQ ID NO: 3363156 - DNA, 20 bp, Homo sapiens
ctccctttctctctcctctc

SEQ ID NO: 3363157 - DNA, 22 bp, Homo sapiens
ctccctttctctctcctctctg

SEQ ID NO: 3363158 - DNA, 22 bp, Homo sapiens
ctccgaacaccctcgaagcgcg

SEQ ID NO: 3363159 - DNA, 15 bp, Homo sapiens
ctccgaccctcatgg

SEQ ID NO: 3363160 - DNA, 15 bp, Homo sapiens
ctccgagaggtgggc

SEQ ID NO: 3363161 - DNA, 17 bp, Homo sapiens
ctccgagaggtgggcca

SEQ ID NO: 3363162 - DNA, 18 bp, Homo sapiens
ctccgaggtggttttaaa

SEQ ID NO: 3363163 - DNA, 16 bp, Homo sapiens
ctccgccaagatctac

SEQ ID NO: 3363164 - DNA, 22 bp, Homo sapiens
ctccgccaagatctacaggaca

SEQ ID NO: 3363165 - DNA, 15 bp, Homo sapiens
ctccgcccccagcct

SEQ ID NO: 3363166 - DNA, 17 bp, Homo sapiens
ctccgcccccagcctat

SEQ ID NO: 3363167 - DNA, 22 bp, Homo sapiens
ctccgcccgctcctgccgcaga

SEQ ID NO: 3363168 - DNA, 15 bp, Homo sapiens
ctccgccctcctcgg

SEQ ID NO: 3363169 - DNA, 14 bp, Homo sapiens
ctccgccctgccac

SEQ ID NO: 3363170 - DNA, 14 bp, Homo sapiens
ctccgcctgggatc

SEQ ID NO: 3363171 - DNA, 18 bp, Homo sapiens
ctccgccttcactccggt

SEQ ID NO: 3363172 - DNA, 16 bp, Homo sapiens
ctccgctcccaccgcc

SEQ ID NO: 3363173 - DNA, 13 bp, Homo sapiens
ctccgctgctcct

SEQ ID NO: 3363174 - DNA, 16 bp, Homo sapiens
ctccgctgctccttgg

SEQ ID NO: 3363175 - DNA, 19 bp, Homo sapiens
ctccgctttctacccagcg

SEQ ID NO: 3363176 - DNA, 23 bp, Homo sapiens
ctccgctttctacccagcgagcc

SEQ ID NO: 3363177 - DNA, 18 bp, Homo sapiens
ctccggcttgacctgttt

SEQ ID NO: 3363178 - DNA, 18 bp, Homo sapiens
ctccggggtctgtgctgt

SEQ ID NO: 3363179 - DNA, 15 bp, Homo sapiens
ctccgggtgtggcct

SEQ ID NO: 3363180 - DNA, 17 bp, Homo sapiens
ctccgggtgtggcctca

SEQ ID NO: 3363181 - DNA, 23 bp, Homo sapiens
ctccgggtgtggcctcagccctc

SEQ ID NO: 3363182 - DNA, 14 bp, Homo sapiens
ctccgtccacccag

SEQ ID NO: 3363183 - DNA, 15 bp, Homo sapiens
ctccgtccacccagg

SEQ ID NO: 3363184 - DNA, 15 bp, Homo sapiens
ctccgtccagccgcc

SEQ ID NO: 3363185 - DNA, 21 bp, Homo sapiens
ctccgtccatccgactgcccc

SEQ ID NO: 3363186 - DNA, 22 bp, Homo sapiens
ctccgtgcctccaccaccactg

SEQ ID NO: 3363187 - DNA, 17 bp, Homo sapiens
ctccgttagctcctgtg

SEQ ID NO: 3363188 - DNA, 21 bp, Homo sapiens
ctccgttagctcctgtggccc

SEQ ID NO: 3363189 - DNA, 20 bp, Homo sapiens
ctccgtttatgggccttgct

SEQ ID NO: 3363190 - DNA, 21 bp, Homo sapiens
ctccgtttatgggccttgctt

SEQ ID NO: 3363191 - DNA, 12 bp, Homo sapiens
ctcctgctggta

SEQ ID NO: 3363192 - DNA, 17 bp, Homo sapiens
ctcctgctggtacctgc

SEQ ID NO: 3363193 - DNA, 12 bp, Homo sapiens
ctcctgctgtag

SEQ ID NO: 3363194 - DNA, 20 bp, Homo sapiens
ctcctgctgtagtcctttct

SEQ ID NO: 3363195 - DNA, 22 bp, Homo sapiens
ctcctggaaaggctcagtctca

SEQ ID NO: 3363196 - DNA, 22 bp, Homo sapiens
ctcctggaacagaagacagctg

SEQ ID NO: 3363197 - DNA, 17 bp, Homo sapiens
ctcctggaaccttgctg

SEQ ID NO: 3363198 - DNA, 20 bp, Homo sapiens
ctcctggaaccttgctgtcc

SEQ ID NO: 3363199 - DNA, 21 bp, Homo sapiens
ctcctggaaccttgctgtcct

SEQ ID NO: 3363200 - DNA, 23 bp, Homo sapiens
ctcctggaaccttgctgtcctga

SEQ ID NO: 3363201 - DNA, 21 bp, Homo sapiens
ctcctggattttaagtagaca

SEQ ID NO: 3363202 - DNA, 12 bp, Homo sapiens
ctcctggccaga

SEQ ID NO: 3363203 - DNA, 19 bp, Homo sapiens
ctcctggcctcaagtgatt

SEQ ID NO: 3363204 - DNA, 23 bp, Homo sapiens
ctcctggcctggccatctccctc

SEQ ID NO: 3363205 - DNA, 12 bp, Homo sapiens
ctcctggctccc

SEQ ID NO: 3363206 - DNA, 16 bp, Homo sapiens
ctcctggctccctccc

SEQ ID NO: 3363207 - DNA, 13 bp, Homo sapiens
ctcctggctgcca

SEQ ID NO: 3363208 - DNA, 15 bp, Homo sapiens
ctcctggctgccagg

SEQ ID NO: 3363209 - DNA, 20 bp, Homo sapiens
ctcctgggagcccccaccac

SEQ ID NO: 3363210 - DNA, 13 bp, Homo sapiens
ctcctgggctcag

SEQ ID NO: 3363211 - DNA, 20 bp, Homo sapiens
ctcctgggggtggcaggcac

SEQ ID NO: 3363212 - DNA, 21 bp, Homo sapiens
ctcctgggggtggcaggcaca

SEQ ID NO: 3363213 - DNA, 14 bp, Homo sapiens
ctcctgggggttct

SEQ ID NO: 3363214 - DNA, 18 bp, Homo sapiens
ctcctgggggttctttct

SEQ ID NO: 3363215 - DNA, 16 bp, Homo sapiens
ctcctggtctgtgaag

SEQ ID NO: 3363216 - DNA, 12 bp, Homo sapiens
ctcctggtgccc

SEQ ID NO: 3363217 - DNA, 13 bp, Homo sapiens
ctcctggtgcccc

SEQ ID NO: 3363218 - DNA, 23 bp, Homo sapiens
ctcctggtgcccctcgccagctt

SEQ ID NO: 3363219 - DNA, 16 bp, Homo sapiens
ctcctggtggccttct

SEQ ID NO: 3363220 - DNA, 22 bp, Homo sapiens
ctcctgtaacatactggcctgg

SEQ ID NO: 3363221 - DNA, 23 bp, Homo sapiens
ctcctgtaacatactggcctgga

SEQ ID NO: 3363222 - DNA, 16 bp, Homo sapiens
ctcctgtacctcagtg

SEQ ID NO: 3363223 - DNA, 20 bp, Homo sapiens
ctcctgtccatcagccagga

SEQ ID NO: 3363224 - DNA, 12 bp, Homo sapiens
ctcctgtcctcc

SEQ ID NO: 3363225 - DNA, 17 bp, Homo sapiens
ctcctgtctgccctctg

SEQ ID NO: 3363226 - DNA, 17 bp, Homo sapiens
ctcctgtgaatggaggc

SEQ ID NO: 3363227 - DNA, 21 bp, Homo sapiens
ctcctgtgcccacatcccagg

SEQ ID NO: 3363228 - DNA, 14 bp, Homo sapiens
ctcctgtgctctgg

SEQ ID NO: 3363229 - DNA, 13 bp, Homo sapiens
ctcctgtgctggg

SEQ ID NO: 3363230 - DNA, 16 bp, Homo sapiens
ctcctgtggaacccag

SEQ ID NO: 3363231 - DNA, 20 bp, Homo sapiens
ctcctgtggccccaccctgg

SEQ ID NO: 3363232 - DNA, 21 bp, Homo sapiens
ctcctgtggccccaccctggg

SEQ ID NO: 3363233 - DNA, 22 bp, Homo sapiens
ctcctgtggccccaccctgggc

SEQ ID NO: 3363234 - DNA, 16 bp, Homo sapiens
ctcctgtggggaaagg

SEQ ID NO: 3363235 - DNA, 15 bp, Homo sapiens
ctcctgtgtcttgca

SEQ ID NO: 3363236 - DNA, 23 bp, Homo sapiens
ctcctgtgtcttgcaatggcagc

SEQ ID NO: 3363237 - DNA, 16 bp, Homo sapiens
ctcctgtgtgtgcgcc

SEQ ID NO: 3363238 - DNA, 23 bp, Homo sapiens
ctcctgtgtgtgcgcctacagga

SEQ ID NO: 3363239 - DNA, 13 bp, Homo sapiens
ctcctgttttata

SEQ ID NO: 3363240 - DNA, 15 bp, Homo sapiens
ctcctgttttatata

SEQ ID NO: 3363241 - DNA, 18 bp, Homo sapiens
ctcctgttttatatatta

SEQ ID NO: 3363242 - DNA, 19 bp, Homo sapiens
ctcctgttttgcacagcca

SEQ ID NO: 3363243 - DNA, 14 bp, Homo sapiens
ctccttactctgag

SEQ ID NO: 3363244 - DNA, 15 bp, Homo sapiens
ctccttactctgagc

SEQ ID NO: 3363245 - DNA, 16 bp, Homo sapiens
ctccttactctgagcc

SEQ ID NO: 3363246 - DNA, 18 bp, Homo sapiens
ctccttagtccccctggt

SEQ ID NO: 3363247 - DNA, 17 bp, Homo sapiens
ctccttagtcttctcat

SEQ ID NO: 3363248 - DNA, 19 bp, Homo sapiens
ctccttagtcttctcatag

SEQ ID NO: 3363249 - DNA, 19 bp, Homo sapiens
ctccttatagacacttgct

SEQ ID NO: 3363250 - DNA, 21 bp, Homo sapiens
ctccttatagacacttgctcc

SEQ ID NO: 3363251 - DNA, 13 bp, Homo sapiens
ctccttcactgtt

SEQ ID NO: 3363252 - DNA, 23 bp, Homo sapiens
ctccttcactgttccctctggct

SEQ ID NO: 3363253 - DNA, 12 bp, Homo sapiens
ctccttcagaca

SEQ ID NO: 3363254 - DNA, 13 bp, Homo sapiens
ctccttcagacac

SEQ ID NO: 3363255 - DNA, 19 bp, Homo sapiens
ctccttcagacaccctcaa

SEQ ID NO: 3363256 - DNA, 10 bp, Homo sapiens
ctccttccac

SEQ ID NO: 3363257 - DNA, 13 bp, Homo sapiens
ctccttcccatgc

SEQ ID NO: 3363258 - DNA, 15 bp, Homo sapiens
ctccttccccaggat

SEQ ID NO: 3363259 - DNA, 22 bp, Homo sapiens
ctccttccttgctgtcctaggc

SEQ ID NO: 3363260 - DNA, 15 bp, Homo sapiens
ctccttcgtgtctct

SEQ ID NO: 3363261 - DNA, 11 bp, Homo sapiens
ctccttggcct

SEQ ID NO: 3363262 - DNA, 12 bp, Homo sapiens
ctccttggccta

SEQ ID NO: 3363263 - DNA, 14 bp, Homo sapiens
ctccttggcctagc

SEQ ID NO: 3363264 - DNA, 13 bp, Homo sapiens
ctccttggcttac

SEQ ID NO: 3363265 - DNA, 15 bp, Homo sapiens
ctccttgggcacttt

SEQ ID NO: 3363266 - DNA, 21 bp, Homo sapiens
ctccttgggcactttttaatt

SEQ ID NO: 3363267 - DNA, 15 bp, Homo sapiens
ctccttggtgcctgg

SEQ ID NO: 3363268 - DNA, 19 bp, Homo sapiens
ctccttggtgcctggcctg

SEQ ID NO: 3363269 - DNA, 22 bp, Homo sapiens
ctccttggtgcctggcctggca

SEQ ID NO: 3363270 - DNA, 15 bp, Homo sapiens
ctcctttcaccacat

SEQ ID NO: 3363271 - DNA, 14 bp, Homo sapiens
ctcctttctcctcc

SEQ ID NO: 3363272 - DNA, 14 bp, Homo sapiens
ctcctttctcctgt

SEQ ID NO: 3363273 - DNA, 18 bp, Homo sapiens
ctcctttctcctgtgaat

SEQ ID NO: 3363274 - DNA, 17 bp, Homo sapiens
ctcctttctgtgcccta

SEQ ID NO: 3363275 - DNA, 20 bp, Homo sapiens
ctcctttctttttcttcttc

SEQ ID NO: 3363276 - DNA, 21 bp, Homo sapiens
ctcctttctttttcttcttcc

SEQ ID NO: 3363277 - DNA, 19 bp, Homo sapiens
ctcctttgaaacctgctct

SEQ ID NO: 3363278 - DNA, 16 bp, Homo sapiens
ctcctttgcaatagca

SEQ ID NO: 3363279 - DNA, 20 bp, Homo sapiens
ctcctttgcaatagcagtta

SEQ ID NO: 3363280 - DNA, 18 bp, Homo sapiens
ctcctttgcactgagggc

SEQ ID NO: 3363281 - DNA, 20 bp, Homo sapiens
ctcctttgcactgagggcca

SEQ ID NO: 3363282 - DNA, 16 bp, Homo sapiens
ctcctttgctcttgcc

SEQ ID NO: 3363283 - DNA, 17 bp, Homo sapiens
ctcctttggccattcca

SEQ ID NO: 3363284 - DNA, 18 bp, Homo sapiens
ctccttttatctggtgcc

SEQ ID NO: 3363285 - DNA, 20 bp, Homo sapiens
ctccttttatctggtgcctc

SEQ ID NO: 3363286 - DNA, 16 bp, Homo sapiens
ctccttttccttacca

SEQ ID NO: 3363287 - DNA, 11 bp, Homo sapiens
ctccttttctt

SEQ ID NO: 3363288 - DNA, 17 bp, Homo sapiens
ctccttttcttttgtta

SEQ ID NO: 3363289 - DNA, 22 bp, Homo sapiens
ctccttttcttttgttactgtt

SEQ ID NO: 3363290 - DNA, 16 bp, Homo sapiens
ctccttttggaacccc

SEQ ID NO: 3363291 - DNA, 19 bp, Homo sapiens
ctccttttgtatcttcctt

SEQ ID NO: 3363292 - DNA, 21 bp, Homo sapiens
ctccttttgtccccagggccc

SEQ ID NO: 3363293 - DNA, 21 bp, Homo sapiens
ctcctttttattttaggcact

SEQ ID NO: 3363294 - DNA, 19 bp, Homo sapiens
ctcgaaacacagaaacctt

SEQ ID NO: 3363295 - DNA, 14 bp, Homo sapiens
ctcgaaccaaggca

SEQ ID NO: 3363296 - DNA, 15 bp, Homo sapiens
ctcgaaccaaggcag

SEQ ID NO: 3363297 - DNA, 18 bp, Homo sapiens
ctcgaaccaaggcagcct

SEQ ID NO: 3363298 - DNA, 19 bp, Homo sapiens
ctcgaaccaaggcagcctc

SEQ ID NO: 3363299 - DNA, 15 bp, Homo sapiens
ctcgaactcctggcc

SEQ ID NO: 3363300 - DNA, 16 bp, Homo sapiens
ctcgaactggctgcaa

SEQ ID NO: 3363301 - DNA, 20 bp, Homo sapiens
ctcgaagcgcgccactcgct

SEQ ID NO: 3363302 - DNA, 18 bp, Homo sapiens
ctcgaatctctgtgcctt

SEQ ID NO: 3363303 - DNA, 21 bp, Homo sapiens
ctcgaatgaaaagctgctggt

SEQ ID NO: 3363304 - DNA, 20 bp, Homo sapiens
ctcgacagcgcccctgctgt

SEQ ID NO: 3363305 - DNA, 22 bp, Homo sapiens
ctcgacagcgcccctgctgtct

SEQ ID NO: 3363306 - DNA, 13 bp, Homo sapiens
ctcgacccagaat

SEQ ID NO: 3363307 - DNA, 19 bp, Homo sapiens
ctcgacccagaatggagcc

SEQ ID NO: 3363308 - DNA, 17 bp, Homo sapiens
ctcgagcagtcctgcct

SEQ ID NO: 3363309 - DNA, 23 bp, Homo sapiens
ctcgagcagtcctgcctcagcct

SEQ ID NO: 3363310 - DNA, 17 bp, Homo sapiens
ctcgagcccagatggaa

SEQ ID NO: 3363311 - DNA, 12 bp, Homo sapiens
ctcgaggcctgc

SEQ ID NO: 3363312 - DNA, 13 bp, Homo sapiens
ctcgaggcctgca

SEQ ID NO: 3363313 - DNA, 12 bp, Homo sapiens
ctcgaggctggt

SEQ ID NO: 3363314 - DNA, 15 bp, Homo sapiens
ctcgaggctggtgcc

SEQ ID NO: 3363315 - DNA, 16 bp, Homo sapiens
ctcgaggctggtgcca

SEQ ID NO: 3363316 - DNA, 14 bp, Homo sapiens
ctcgaggggtgggc

SEQ ID NO: 3363317 - DNA, 23 bp, Homo sapiens
ctcgatcatatttccccttggac

SEQ ID NO: 3363318 - DNA, 23 bp, Homo sapiens
ctcgcaaaaacgtatctcctaat

SEQ ID NO: 3363319 - DNA, 17 bp, Homo sapiens
ctcgcacccccctgttc

SEQ ID NO: 3363320 - DNA, 14 bp, Homo sapiens
ctcgcacctttcca

SEQ ID NO: 3363321 - DNA, 15 bp, Homo sapiens
ctcgcacctttccaa

SEQ ID NO: 3363322 - DNA, 18 bp, Homo sapiens
ctcgcataggacctttcc

SEQ ID NO: 3363323 - DNA, 19 bp, Homo sapiens
ctcgcataggacctttcca

SEQ ID NO: 3363324 - DNA, 22 bp, Homo sapiens
ctcgcataggacctttccacca

SEQ ID NO: 3363325 - DNA, 21 bp, Homo sapiens
ctcgcatttgtcaatgacagt

SEQ ID NO: 3363326 - DNA, 22 bp, Homo sapiens
ctcgcatttgtcaatgacagtt

SEQ ID NO: 3363327 - DNA, 16 bp, Homo sapiens
ctcgccagcttctcct

SEQ ID NO: 3363328 - DNA, 13 bp, Homo sapiens
ctcgccatgccgg

SEQ ID NO: 3363329 - DNA, 12 bp, Homo sapiens
ctcgcccagcag

SEQ ID NO: 3363330 - DNA, 13 bp, Homo sapiens
ctcgcccagcagg

SEQ ID NO: 3363331 - DNA, 17 bp, Homo sapiens
ctcgccctcctttctgt

SEQ ID NO: 3363332 - DNA, 16 bp, Homo sapiens
ctcgccggccttgttt

SEQ ID NO: 3363333 - DNA, 17 bp, Homo sapiens
ctcgcctcactttccac

SEQ ID NO: 3363334 - DNA, 18 bp, Homo sapiens
ctcgcgggcagcgggcca

SEQ ID NO: 3363335 - DNA, 19 bp, Homo sapiens
ctcgcgggcagcgggccag

SEQ ID NO: 3363336 - DNA, 20 bp, Homo sapiens
ctcgcgggcagcgggccagg

SEQ ID NO: 3363337 - DNA, 22 bp, Homo sapiens
ctcgcgggcagcgggccaggcc

SEQ ID NO: 3363338 - DNA, 13 bp, Homo sapiens
ctcgctctgggat

SEQ ID NO: 3363339 - DNA, 15 bp, Homo sapiens
ctcgctctgggatgc

SEQ ID NO: 3363340 - DNA, 22 bp, Homo sapiens
ctcgctgagggcagactggggc

SEQ ID NO: 3363341 - DNA, 19 bp, Homo sapiens
ctcgctgccatcaccgctg

SEQ ID NO: 3363342 - DNA, 18 bp, Homo sapiens
ctcgctgtcactggctgg

SEQ ID NO: 3363343 - DNA, 21 bp, Homo sapiens
ctcgctgtcactggctggctc

SEQ ID NO: 3363344 - DNA, 14 bp, Homo sapiens
ctcgcttcccccat

SEQ ID NO: 3363345 - DNA, 19 bp, Homo sapiens
ctcgcttcccccatagcca

SEQ ID NO: 3363346 - DNA, 12 bp, Homo sapiens
ctcgcttgtaaa

SEQ ID NO: 3363347 - DNA, 13 bp, Homo sapiens
ctcgcttgtaaat

SEQ ID NO: 3363348 - DNA, 20 bp, Homo sapiens
ctcgcttgtaaataccagga

SEQ ID NO: 3363349 - DNA, 21 bp, Homo sapiens
ctcgcttgtaaataccaggat

SEQ ID NO: 3363350 - DNA, 17 bp, Homo sapiens
ctcggaagccgtctgac

SEQ ID NO: 3363351 - DNA, 17 bp, Homo sapiens
ctcggacagcccatctg

SEQ ID NO: 3363352 - DNA, 19 bp, Homo sapiens
ctcggagcatggtgttttc

SEQ ID NO: 3363353 - DNA, 18 bp, Homo sapiens
ctcggaggccccaaagga

SEQ ID NO: 3363354 - DNA, 21 bp, Homo sapiens
ctcggagggatggagaaagaa

SEQ ID NO: 3363355 - DNA, 14 bp, Homo sapiens
ctcggcaggaagga

SEQ ID NO: 3363356 - DNA, 13 bp, Homo sapiens
ctcggccaggcat

SEQ ID NO: 3363357 - DNA, 17 bp, Homo sapiens
ctcggccccctccatcg

SEQ ID NO: 3363358 - DNA, 18 bp, Homo sapiens
ctcggcctcccaaagtgc

SEQ ID NO: 3363359 - DNA, 13 bp, Homo sapiens
ctcggctcaggct

SEQ ID NO: 3363360 - DNA, 20 bp, Homo sapiens
ctcggcttgtgggctggtgc

SEQ ID NO: 3363361 - DNA, 17 bp, Homo sapiens
ctcgggaagcagccagc

SEQ ID NO: 3363362 - DNA, 19 bp, Homo sapiens
ctcgggaagcagccagctc

SEQ ID NO: 3363363 - DNA, 15 bp, Homo sapiens
ctcgggacacctgcc

SEQ ID NO: 3363364 - DNA, 14 bp, Homo sapiens
ctcgggcccacctg

SEQ ID NO: 3363365 - DNA, 19 bp, Homo sapiens
ctcgggcccacctggccac

SEQ ID NO: 3363366 - DNA, 20 bp, Homo sapiens
ctcggggcccttggggcctg

SEQ ID NO: 3363367 - DNA, 20 bp, Homo sapiens
ctcggggctccaggctggct

SEQ ID NO: 3363368 - DNA, 18 bp, Homo sapiens
ctcggggggtcacaggcc

SEQ ID NO: 3363369 - DNA, 20 bp, Homo sapiens
ctcggggggtcacaggccca

SEQ ID NO: 3363370 - DNA, 22 bp, Homo sapiens
ctcggggggtcacaggcccaga

SEQ ID NO: 3363371 - DNA, 23 bp, Homo sapiens
ctcgggggtggagtgagactgac

SEQ ID NO: 3363372 - DNA, 19 bp, Homo sapiens
ctcggtagcagaggccctg

SEQ ID NO: 3363373 - DNA, 15 bp, Homo sapiens
ctcggtgtggcgtga

SEQ ID NO: 3363374 - DNA, 15 bp, Homo sapiens
ctcgtccacaggggc

SEQ ID NO: 3363375 - DNA, 22 bp, Homo sapiens
ctcgtccacaggggcaggcctg

SEQ ID NO: 3363376 - DNA, 13 bp, Homo sapiens
ctcgtcctgtccc

SEQ ID NO: 3363377 - DNA, 17 bp, Homo sapiens
ctcgtgccatgatctgt

SEQ ID NO: 3363378 - DNA, 14 bp, Homo sapiens
ctcgtggccagccc

SEQ ID NO: 3363379 - DNA, 17 bp, Homo sapiens
ctcgtggccagcccggc

SEQ ID NO: 3363380 - DNA, 18 bp, Homo sapiens
ctcgtggccagcccggct

SEQ ID NO: 3363381 - DNA, 16 bp, Homo sapiens
ctcgtgtcagctcagg

SEQ ID NO: 3363382 - DNA, 16 bp, Homo sapiens
ctcgtgtcatctccgg

SEQ ID NO: 3363383 - DNA, 14 bp, Homo sapiens
ctcgttcctttctc

SEQ ID NO: 3363384 - DNA, 17 bp, Homo sapiens
ctcgttcctttctcctg

SEQ ID NO: 3363385 - DNA, 23 bp, Homo sapiens
ctcgtttttcagcacccccaccc

SEQ ID NO: 3363386 - DNA, 18 bp, Homo sapiens
ctctaaaaaacattttta

SEQ ID NO: 3363387 - DNA, 23 bp, Homo sapiens
ctctaaaaaacatttttaattta

SEQ ID NO: 3363388 - DNA, 22 bp, Homo sapiens
ctctaaaaggtaatgtgtggat

SEQ ID NO: 3363389 - DNA, 15 bp, Homo sapiens
ctctaaaattataaa

SEQ ID NO: 3363390 - DNA, 17 bp, Homo sapiens
ctctaaaattataaatg

SEQ ID NO: 3363391 - DNA, 20 bp, Homo sapiens
ctctaaagaccaaacttcac

SEQ ID NO: 3363392 - DNA, 14 bp, Homo sapiens
ctctaacagccctc

SEQ ID NO: 3363393 - DNA, 14 bp, Homo sapiens
ctctaacaggcact

SEQ ID NO: 3363394 - DNA, 18 bp, Homo sapiens
ctctaacaggcactttga

SEQ ID NO: 3363395 - DNA, 14 bp, Homo sapiens
ctctaagatcttag

SEQ ID NO: 3363396 - DNA, 16 bp, Homo sapiens
ctctaagatcttagat

SEQ ID NO: 3363397 - DNA, 13 bp, Homo sapiens
ctctaagctgtgt

SEQ ID NO: 3363398 - DNA, 16 bp, Homo sapiens
ctctaagctgtgtgca

SEQ ID NO: 3363399 - DNA, 17 bp, Homo sapiens
ctctaagctgtgtgcag

SEQ ID NO: 3363400 - DNA, 18 bp, Homo sapiens
ctctaatatgattataca

SEQ ID NO: 3363401 - DNA, 17 bp, Homo sapiens
ctctaatattgcttctt

SEQ ID NO: 3363402 - DNA, 18 bp, Homo sapiens
ctctaatattgcttcttg

SEQ ID NO: 3363403 - DNA, 15 bp, Homo sapiens
ctctaattcacagtg

SEQ ID NO: 3363404 - DNA, 23 bp, Homo sapiens
ctctaattttggataatattcat

SEQ ID NO: 3363405 - DNA, 17 bp, Homo sapiens
ctctacaaactcccact

SEQ ID NO: 3363406 - DNA, 14 bp, Homo sapiens
ctctacactaaggg

SEQ ID NO: 3363407 - DNA, 15 bp, Homo sapiens
ctctacatcttctgc

SEQ ID NO: 3363408 - DNA, 14 bp, Homo sapiens
ctctacatgctctt

SEQ ID NO: 3363409 - DNA, 16 bp, Homo sapiens
ctctacccatattaca

SEQ ID NO: 3363410 - DNA, 16 bp, Homo sapiens
ctctacccatgagcct

SEQ ID NO: 3363411 - DNA, 18 bp, Homo sapiens
ctctacccatgagcctgc

SEQ ID NO: 3363412 - DNA, 19 bp, Homo sapiens
ctctacccatgagcctgcc

SEQ ID NO: 3363413 - DNA, 14 bp, Homo sapiens
ctctaccccaattt

SEQ ID NO: 3363414 - DNA, 13 bp, Homo sapiens
ctctacccctgct

SEQ ID NO: 3363415 - DNA, 16 bp, Homo sapiens
ctctacccctgctccc

SEQ ID NO: 3363416 - DNA, 22 bp, Homo sapiens
ctctacccctgctcccattcct

SEQ ID NO: 3363417 - DNA, 14 bp, Homo sapiens
ctctacccctttct

SEQ ID NO: 3363418 - DNA, 15 bp, Homo sapiens
ctctaccctcccacc

SEQ ID NO: 3363419 - DNA, 16 bp, Homo sapiens
ctctaccctcccaccc

SEQ ID NO: 3363420 - DNA, 18 bp, Homo sapiens
ctctaccctcccaccccc

SEQ ID NO: 3363421 - DNA, 13 bp, Homo sapiens
ctctaccctgctc

SEQ ID NO: 3363422 - DNA, 17 bp, Homo sapiens
ctctacctaatgtctca

SEQ ID NO: 3363423 - DNA, 20 bp, Homo sapiens
ctctacctcatatcagtttg

SEQ ID NO: 3363424 - DNA, 16 bp, Homo sapiens
ctctacctccttagct

SEQ ID NO: 3363425 - DNA, 18 bp, Homo sapiens
ctctacttaatccaatgg

SEQ ID NO: 3363426 - DNA, 15 bp, Homo sapiens
ctctacttaatgaga

SEQ ID NO: 3363427 - DNA, 17 bp, Homo sapiens
ctctacttagcatgtcc

SEQ ID NO: 3363428 - DNA, 20 bp, Homo sapiens
ctctacttagcatgtcccta

SEQ ID NO: 3363429 - DNA, 12 bp, Homo sapiens
ctctagaatctg

SEQ ID NO: 3363430 - DNA, 16 bp, Homo sapiens
ctctagacactgccac

SEQ ID NO: 3363431 - DNA, 21 bp, Homo sapiens
ctctagacactgccacacagg

SEQ ID NO: 3363432 - DNA, 13 bp, Homo sapiens
ctctagagtccaa

SEQ ID NO: 3363433 - DNA, 22 bp, Homo sapiens
ctctagatgtgtagggctgagg

SEQ ID NO: 3363434 - DNA, 15 bp, Homo sapiens
ctctagccaggagtc

SEQ ID NO: 3363435 - DNA, 22 bp, Homo sapiens
ctctagccaggagtctgtgctc

SEQ ID NO: 3363436 - DNA, 23 bp, Homo sapiens
ctctagccaggagtctgtgctct

SEQ ID NO: 3363437 - DNA, 20 bp, Homo sapiens
ctctagcctgggccagagaa

SEQ ID NO: 3363438 - DNA, 15 bp, Homo sapiens
ctctagctggcagga

SEQ ID NO: 3363439 - DNA, 17 bp, Homo sapiens
ctctagctggcaggaca

SEQ ID NO: 3363440 - DNA, 19 bp, Homo sapiens
ctctagctggcaggacaca

SEQ ID NO: 3363441 - DNA, 13 bp, Homo sapiens
ctctagctggtgg

SEQ ID NO: 3363442 - DNA, 16 bp, Homo sapiens
ctctagctgtgggggt

SEQ ID NO: 3363443 - DNA, 22 bp, Homo sapiens
ctctaggagggagccttgtgag

SEQ ID NO: 3363444 - DNA, 16 bp, Homo sapiens
ctctaggatgtatatt

SEQ ID NO: 3363445 - DNA, 17 bp, Homo sapiens
ctctagggaatctggat

SEQ ID NO: 3363446 - DNA, 14 bp, Homo sapiens
ctctagggttgctg

SEQ ID NO: 3363447 - DNA, 19 bp, Homo sapiens
ctctagggttgctggagcc

SEQ ID NO: 3363448 - DNA, 17 bp, Homo sapiens
ctctaggttatacaata

SEQ ID NO: 3363449 - DNA, 19 bp, Homo sapiens
ctctagtaagatgcactga

SEQ ID NO: 3363450 - DNA, 19 bp, Homo sapiens
ctctagtgggacagcccag

SEQ ID NO: 3363451 - DNA, 22 bp, Homo sapiens
ctctagtgggacagcccagagc

SEQ ID NO: 3363452 - DNA, 18 bp, Homo sapiens
ctctagttctttgttcat

SEQ ID NO: 3363453 - DNA, 21 bp, Homo sapiens
ctctagttttcagccttggga

SEQ ID NO: 3363454 - DNA, 20 bp, Homo sapiens
ctctataattagttatgaca

SEQ ID NO: 3363455 - DNA, 23 bp, Homo sapiens
ctctattgatgtacagtctgtca

SEQ ID NO: 3363456 - DNA, 12 bp, Homo sapiens
ctctatttaata

SEQ ID NO: 3363457 - DNA, 16 bp, Homo sapiens
ctctatttatgtttgc

SEQ ID NO: 3363458 - DNA, 20 bp, Homo sapiens
ctctatttattagccaactg

SEQ ID NO: 3363459 - DNA, 13 bp, Homo sapiens
ctctatttattgg

SEQ ID NO: 3363460 - DNA, 14 bp, Homo sapiens
ctctatttattggg

SEQ ID NO: 3363461 - DNA, 15 bp, Homo sapiens
ctctatttattgggg

SEQ ID NO: 3363462 - DNA, 13 bp, Homo sapiens
ctctatttctcta

SEQ ID NO: 3363463 - DNA, 17 bp, Homo sapiens
ctctatttgaattattt

SEQ ID NO: 3363464 - DNA, 11 bp, Homo sapiens
ctctattttgt

SEQ ID NO: 3363465 - DNA, 19 bp, Homo sapiens
ctctcaaaagtctattttt

SEQ ID NO: 3363466 - DNA, 15 bp, Homo sapiens
ctctcaatatgctta

SEQ ID NO: 3363467 - DNA, 21 bp, Homo sapiens
ctctcacacacatagattaat

SEQ ID NO: 3363468 - DNA, 15 bp, Homo sapiens
ctctcactaaacttt

SEQ ID NO: 3363469 - DNA, 12 bp, Homo sapiens
ctctcactcccc

SEQ ID NO: 3363470 - DNA, 19 bp, Homo sapiens
ctctcactccccagcccca

SEQ ID NO: 3363471 - DNA, 19 bp, Homo sapiens
ctctcactccccatgccac

SEQ ID NO: 3363472 - DNA, 15 bp, Homo sapiens
ctctcactcctgcct

SEQ ID NO: 3363473 - DNA, 18 bp, Homo sapiens
ctctcagagcatctggct

SEQ ID NO: 3363474 - DNA, 21 bp, Homo sapiens
ctctcagcagaaacacacagt

SEQ ID NO: 3363475 - DNA, 13 bp, Homo sapiens
ctctcagcccaga

SEQ ID NO: 3363476 - DNA, 14 bp, Homo sapiens
ctctcagcccagaa

SEQ ID NO: 3363477 - DNA, 16 bp, Homo sapiens
ctctcagcctcccaca

SEQ ID NO: 3363478 - DNA, 17 bp, Homo sapiens
ctctcagccttacattt

SEQ ID NO: 3363479 - DNA, 17 bp, Homo sapiens
ctctcagctcagcgcca

SEQ ID NO: 3363480 - DNA, 12 bp, Homo sapiens
ctctcagctcca

SEQ ID NO: 3363481 - DNA, 13 bp, Homo sapiens
ctctcagctccag

SEQ ID NO: 3363482 - DNA, 15 bp, Homo sapiens
ctctcagctccaggt

SEQ ID NO: 3363483 - DNA, 19 bp, Homo sapiens
ctctcaggagcacaggcag

SEQ ID NO: 3363484 - DNA, 14 bp, Homo sapiens
ctctcaggatccaa

SEQ ID NO: 3363485 - DNA, 16 bp, Homo sapiens
ctctcaggatccaagc

SEQ ID NO: 3363486 - DNA, 16 bp, Homo sapiens
ctctcagggcctggca

SEQ ID NO: 3363487 - DNA, 19 bp, Homo sapiens
ctctcagggcctggcaggc

SEQ ID NO: 3363488 - DNA, 21 bp, Homo sapiens
ctctcagggcctggcaggcca

SEQ ID NO: 3363489 - DNA, 15 bp, Homo sapiens
ctctcagttctctcc

SEQ ID NO: 3363490 - DNA, 18 bp, Homo sapiens
ctctcatcaactgaatga

SEQ ID NO: 3363491 - DNA, 13 bp, Homo sapiens
ctctcatctcagg

SEQ ID NO: 3363492 - DNA, 16 bp, Homo sapiens
ctctcatctgatcact

SEQ ID NO: 3363493 - DNA, 18 bp, Homo sapiens
ctctccaaaggggctgct

SEQ ID NO: 3363494 - DNA, 19 bp, Homo sapiens
ctctccaaaggggctgctg

SEQ ID NO: 3363495 - DNA, 15 bp, Homo sapiens
ctctccaagggcttc

SEQ ID NO: 3363496 - DNA, 17 bp, Homo sapiens
ctctccaagggcttctg

SEQ ID NO: 3363497 - DNA, 21 bp, Homo sapiens
ctctccaagggcttctgcacc

SEQ ID NO: 3363498 - DNA, 18 bp, Homo sapiens
ctctccaagtctctctgt

SEQ ID NO: 3363499 - DNA, 19 bp, Homo sapiens
ctctccaagtctctctgtg

SEQ ID NO: 3363500 - DNA, 22 bp, Homo sapiens
ctctccaagtctctctgtgaat

SEQ ID NO: 3363501 - DNA, 20 bp, Homo sapiens
ctctccaagtgccagaggtg

SEQ ID NO: 3363502 - DNA, 22 bp, Homo sapiens
ctctccaagtgccagaggtggg

SEQ ID NO: 3363503 - DNA, 15 bp, Homo sapiens
ctctccaccctggct

SEQ ID NO: 3363504 - DNA, 14 bp, Homo sapiens
ctctccactgcctt

SEQ ID NO: 3363505 - DNA, 20 bp, Homo sapiens
ctctccagatgtttccagac

SEQ ID NO: 3363506 - DNA, 15 bp, Homo sapiens
ctctccagccgaagc

SEQ ID NO: 3363507 - DNA, 14 bp, Homo sapiens
ctctccagctccaa

SEQ ID NO: 3363508 - DNA, 14 bp, Homo sapiens
ctctccagctgact

SEQ ID NO: 3363509 - DNA, 13 bp, Homo sapiens
ctctccaggcacc

SEQ ID NO: 3363510 - DNA, 19 bp, Homo sapiens
ctctccaggcacccttctt

SEQ ID NO: 3363511 - DNA, 19 bp, Homo sapiens
ctctccagggagctgatgt

SEQ ID NO: 3363512 - DNA, 17 bp, Homo sapiens
ctctccagtttgcacct

SEQ ID NO: 3363513 - DNA, 22 bp, Homo sapiens
ctctccagtttgcacctgtccc

SEQ ID NO: 3363514 - DNA, 20 bp, Homo sapiens
ctctccatatcccttcctct

SEQ ID NO: 3363515 - DNA, 22 bp, Homo sapiens
ctctcccacagagtgctggact

SEQ ID NO: 3363516 - DNA, 13 bp, Homo sapiens
ctctcccaccccg

SEQ ID NO: 3363517 - DNA, 22 bp, Homo sapiens
ctctcccaccccggcctccact

SEQ ID NO: 3363518 - DNA, 13 bp, Homo sapiens
ctctcccaggccc

SEQ ID NO: 3363519 - DNA, 14 bp, Homo sapiens
ctctcccaggcccg

SEQ ID NO: 3363520 - DNA, 13 bp, Homo sapiens
ctctcccatcact

SEQ ID NO: 3363521 - DNA, 18 bp, Homo sapiens
ctctcccatcacttccct

SEQ ID NO: 3363522 - DNA, 18 bp, Homo sapiens
ctctcccatccccctgcc

SEQ ID NO: 3363523 - DNA, 18 bp, Homo sapiens
ctctcccatcctggggca

SEQ ID NO: 3363524 - DNA, 16 bp, Homo sapiens
ctctcccatttcagga

SEQ ID NO: 3363525 - DNA, 17 bp, Homo sapiens
ctctcccatttcaggaa

SEQ ID NO: 3363526 - DNA, 13 bp, Homo sapiens
ctctccccacact

SEQ ID NO: 3363527 - DNA, 14 bp, Homo sapiens
ctctccccacacta

SEQ ID NO: 3363528 - DNA, 14 bp, Homo sapiens
ctctccccagcaag

SEQ ID NO: 3363529 - DNA, 15 bp, Homo sapiens
ctctccccaggtcca

SEQ ID NO: 3363530 - DNA, 18 bp, Homo sapiens
ctctccccaggtccagct

SEQ ID NO: 3363531 - DNA, 14 bp, Homo sapiens
ctctcccctcaaag

SEQ ID NO: 3363532 - DNA, 16 bp, Homo sapiens
ctctcccctccagcct

SEQ ID NO: 3363533 - DNA, 17 bp, Homo sapiens
ctctcccctccagcctt

SEQ ID NO: 3363534 - DNA, 15 bp, Homo sapiens
ctctcccctcccttg

SEQ ID NO: 3363535 - DNA, 15 bp, Homo sapiens
ctctcccctgccctg

SEQ ID NO: 3363536 - DNA, 17 bp, Homo sapiens
ctctcccggctgcctgc

SEQ ID NO: 3363537 - DNA, 21 bp, Homo sapiens
ctctcccgtcagggcccaagt

SEQ ID NO: 3363538 - DNA, 20 bp, Homo sapiens
ctctccctcgatcatatttc

SEQ ID NO: 3363539 - DNA, 16 bp, Homo sapiens
ctctccctgccagagg

SEQ ID NO: 3363540 - DNA, 22 bp, Homo sapiens
ctctcctaactgccagccccct

SEQ ID NO: 3363541 - DNA, 14 bp, Homo sapiens
ctctcctagagaca

SEQ ID NO: 3363542 - DNA, 11 bp, Homo sapiens
ctctcctcccc

SEQ ID NO: 3363543 - DNA, 10 bp, Homo sapiens
ctctcctctc

SEQ ID NO: 3363544 - DNA, 14 bp, Homo sapiens
ctctcctctctgct

SEQ ID NO: 3363545 - DNA, 19 bp, Homo sapiens
ctctcctgcccaagcactt

SEQ ID NO: 3363546 - DNA, 21 bp, Homo sapiens
ctctcctggcctatccgctgc

SEQ ID NO: 3363547 - DNA, 12 bp, Homo sapiens
ctctcctgtaag

SEQ ID NO: 3363548 - DNA, 19 bp, Homo sapiens
ctctcctgtttcccttccc

SEQ ID NO: 3363549 - DNA, 22 bp, Homo sapiens
ctctccttcatgacagcctcca

SEQ ID NO: 3363550 - DNA, 14 bp, Homo sapiens
ctctccttgagtgt

SEQ ID NO: 3363551 - DNA, 20 bp, Homo sapiens
ctctccttgggctcctggct

SEQ ID NO: 3363552 - DNA, 22 bp, Homo sapiens
ctctccttgggctcctggctgc

SEQ ID NO: 3363553 - DNA, 16 bp, Homo sapiens
ctctcctttctttttc

SEQ ID NO: 3363554 - DNA, 12 bp, Homo sapiens
ctctccttttct

SEQ ID NO: 3363555 - DNA, 18 bp, Homo sapiens
ctctccttttcttttgtt

SEQ ID NO: 3363556 - DNA, 23 bp, Homo sapiens
ctctccttttgaggcttctcctt

SEQ ID NO: 3363557 - DNA, 18 bp, Homo sapiens
ctctcgcacctttccaaa

SEQ ID NO: 3363558 - DNA, 22 bp, Homo sapiens
ctctcggaaggctggctgggca

SEQ ID NO: 3363559 - DNA, 15 bp, Homo sapiens
ctctcggccaggcat

SEQ ID NO: 3363560 - DNA, 14 bp, Homo sapiens
ctctcggctcccca

SEQ ID NO: 3363561 - DNA, 17 bp, Homo sapiens
ctctcggctccccatgt

SEQ ID NO: 3363562 - DNA, 21 bp, Homo sapiens
ctctcggggcccttggggcct

SEQ ID NO: 3363563 - DNA, 19 bp, Homo sapiens
ctctcgggttgtgtgtctg

SEQ ID NO: 3363564 - DNA, 19 bp, Homo sapiens
ctctctacaaactcccact

SEQ ID NO: 3363565 - DNA, 13 bp, Homo sapiens
ctctctattgtca

SEQ ID NO: 3363566 - DNA, 14 bp, Homo sapiens
ctctctattgtcat

SEQ ID NO: 3363567 - DNA, 14 bp, Homo sapiens
ctctctcaaaagag

SEQ ID NO: 3363568 - DNA, 18 bp, Homo sapiens
ctctctcactcacatttt

SEQ ID NO: 3363569 - DNA, 15 bp, Homo sapiens
ctctctcagagcatc

SEQ ID NO: 3363570 - DNA, 15 bp, Homo sapiens
ctctctcatcttgtt

SEQ ID NO: 3363571 - DNA, 14 bp, Homo sapiens
ctctctcccatttc

SEQ ID NO: 3363572 - DNA, 14 bp, Homo sapiens
ctctctcccctcaa

SEQ ID NO: 3363573 - DNA, 17 bp, Homo sapiens
ctctctcctctctgctt

SEQ ID NO: 3363574 - DNA, 21 bp, Homo sapiens
ctctctcgaccttctggtatc

SEQ ID NO: 3363575 - DNA, 15 bp, Homo sapiens
ctctctctctctccc

SEQ ID NO: 3363576 - DNA, 12 bp, Homo sapiens
ctctctctgggc

SEQ ID NO: 3363577 - DNA, 13 bp, Homo sapiens
ctctctctgtgtc

SEQ ID NO: 3363578 - DNA, 12 bp, Homo sapiens
ctctctcttctg

SEQ ID NO: 3363579 - DNA, 14 bp, Homo sapiens
ctctctcttttcat

SEQ ID NO: 3363580 - DNA, 20 bp, Homo sapiens
ctctctgaagatgatcattt

SEQ ID NO: 3363581 - DNA, 16 bp, Homo sapiens
ctctctgagactcttt

SEQ ID NO: 3363582 - DNA, 23 bp, Homo sapiens
ctctctgatcttgtgctcagcat

SEQ ID NO: 3363583 - DNA, 13 bp, Homo sapiens
ctctctgcccctg

SEQ ID NO: 3363584 - DNA, 15 bp, Homo sapiens
ctctctgcctggtgg

SEQ ID NO: 3363585 - DNA, 14 bp, Homo sapiens
ctctctgctctagc

SEQ ID NO: 3363586 - DNA, 16 bp, Homo sapiens
ctctctgctctagcca

SEQ ID NO: 3363587 - DNA, 17 bp, Homo sapiens
ctctctgctctagccag

SEQ ID NO: 3363588 - DNA, 15 bp, Homo sapiens
ctctctgctgagctg

SEQ ID NO: 3363589 - DNA, 11 bp, Homo sapiens
ctctctggcct

SEQ ID NO: 3363590 - DNA, 13 bp, Homo sapiens
ctctctggcctcc

SEQ ID NO: 3363591 - DNA, 19 bp, Homo sapiens
ctctctggcctcccacccg

SEQ ID NO: 3363592 - DNA, 13 bp, Homo sapiens
ctctctggccttc

SEQ ID NO: 3363593 - DNA, 16 bp, Homo sapiens
ctctctggccttcggc

SEQ ID NO: 3363594 - DNA, 22 bp, Homo sapiens
ctctctggccttcggcctccat

SEQ ID NO: 3363595 - DNA, 17 bp, Homo sapiens
ctctctgggacctcctt

SEQ ID NO: 3363596 - DNA, 20 bp, Homo sapiens
ctctctgggcccaggggctg

SEQ ID NO: 3363597 - DNA, 13 bp, Homo sapiens
ctctctgggcctt

SEQ ID NO: 3363598 - DNA, 20 bp, Homo sapiens
ctctctggggccctgggcct

SEQ ID NO: 3363599 - DNA, 22 bp, Homo sapiens
ctctctggggccctgggcctca

SEQ ID NO: 3363600 - DNA, 15 bp, Homo sapiens
ctctctggtggctct

SEQ ID NO: 3363601 - DNA, 18 bp, Homo sapiens
ctctctgtcccttgctgt

SEQ ID NO: 3363602 - DNA, 15 bp, Homo sapiens
ctctctgtgaataca

SEQ ID NO: 3363603 - DNA, 19 bp, Homo sapiens
ctctctgtgggctggcagt

SEQ ID NO: 3363604 - DNA, 23 bp, Homo sapiens
ctctcttatagaatatttattac

SEQ ID NO: 3363605 - DNA, 23 bp, Homo sapiens
ctctcttcagactctcagcccag

SEQ ID NO: 3363606 - DNA, 12 bp, Homo sapiens
ctctcttccctc

SEQ ID NO: 3363607 - DNA, 22 bp, Homo sapiens
ctctcttccctttccccagcat

SEQ ID NO: 3363608 - DNA, 12 bp, Homo sapiens
ctctcttctgct

SEQ ID NO: 3363609 - DNA, 16 bp, Homo sapiens
ctctcttctgctccac

SEQ ID NO: 3363610 - DNA, 17 bp, Homo sapiens
ctctctttatacagctg

SEQ ID NO: 3363611 - DNA, 18 bp, Homo sapiens
ctctctttgttctcagct

SEQ ID NO: 3363612 - DNA, 21 bp, Homo sapiens
ctctctttgttctcagctccc

SEQ ID NO: 3363613 - DNA, 19 bp, Homo sapiens
ctctcttttctgtacttcc

SEQ ID NO: 3363614 - DNA, 22 bp, Homo sapiens
ctctcttttctgtacttcctga

SEQ ID NO: 3363615 - DNA, 18 bp, Homo sapiens
ctctctttttggaggtgc

SEQ ID NO: 3363616 - DNA, 21 bp, Homo sapiens
ctctgaaaagcaattgccctg

SEQ ID NO: 3363617 - DNA, 22 bp, Homo sapiens
ctctgaaaagcaattgccctgt

SEQ ID NO: 3363618 - DNA, 17 bp, Homo sapiens
ctctgaacacaggcagc

SEQ ID NO: 3363619 - DNA, 18 bp, Homo sapiens
ctctgaacacaggcagct

SEQ ID NO: 3363620 - DNA, 15 bp, Homo sapiens
ctctgaacttgcctt

SEQ ID NO: 3363621 - DNA, 13 bp, Homo sapiens
ctctgaactttgg

SEQ ID NO: 3363622 - DNA, 14 bp, Homo sapiens
ctctgaactttgga

SEQ ID NO: 3363623 - DNA, 11 bp, Homo sapiens
ctctgaagcat

SEQ ID NO: 3363624 - DNA, 17 bp, Homo sapiens
ctctgacaagggctgac

SEQ ID NO: 3363625 - DNA, 18 bp, Homo sapiens
ctctgacacacagctctg

SEQ ID NO: 3363626 - DNA, 12 bp, Homo sapiens
ctctgacagctc

SEQ ID NO: 3363627 - DNA, 13 bp, Homo sapiens
ctctgacagctcc

SEQ ID NO: 3363628 - DNA, 13 bp, Homo sapiens
ctctgacatccct

SEQ ID NO: 3363629 - DNA, 15 bp, Homo sapiens
ctctgacatcccttc

SEQ ID NO: 3363630 - DNA, 17 bp, Homo sapiens
ctctgacatcccttcct

SEQ ID NO: 3363631 - DNA, 20 bp, Homo sapiens
ctctgacatcccttcctgga

SEQ ID NO: 3363632 - DNA, 16 bp, Homo sapiens
ctctgacccagtgaga

SEQ ID NO: 3363633 - DNA, 12 bp, Homo sapiens
ctctgacccctc

SEQ ID NO: 3363634 - DNA, 14 bp, Homo sapiens
ctctgacctgcagg

SEQ ID NO: 3363635 - DNA, 15 bp, Homo sapiens
ctctgactctgagtc

SEQ ID NO: 3363636 - DNA, 19 bp, Homo sapiens
ctctgacttaagcaaaaga

SEQ ID NO: 3363637 - DNA, 20 bp, Homo sapiens
ctctgacttaagcaaaagaa

SEQ ID NO: 3363638 - DNA, 22 bp, Homo sapiens
ctctgacttaagcaaaagaaaa

SEQ ID NO: 3363639 - DNA, 18 bp, Homo sapiens
ctctgacttctgcctgga

SEQ ID NO: 3363640 - DNA, 21 bp, Homo sapiens
ctctgacttctgcctggagac

SEQ ID NO: 3363641 - DNA, 16 bp, Homo sapiens
ctctgagaagaggagc

SEQ ID NO: 3363642 - DNA, 23 bp, Homo sapiens
ctctgagactctttagagcagct

SEQ ID NO: 3363643 - DNA, 13 bp, Homo sapiens
ctctgagagtcta

SEQ ID NO: 3363644 - DNA, 17 bp, Homo sapiens
ctctgagagtctagatt

SEQ ID NO: 3363645 - DNA, 16 bp, Homo sapiens
ctctgagatcctggag

SEQ ID NO: 3363646 - DNA, 16 bp, Homo sapiens
ctctgagcaaatgtgg

SEQ ID NO: 3363647 - DNA, 14 bp, Homo sapiens
ctctgagccagatt

SEQ ID NO: 3363648 - DNA, 15 bp, Homo sapiens
ctctgagccagatta

SEQ ID NO: 3363649 - DNA, 14 bp, Homo sapiens
ctctgagcccaagc

SEQ ID NO: 3363650 - DNA, 20 bp, Homo sapiens
ctctgagcccaagctaagcc

SEQ ID NO: 3363651 - DNA, 14 bp, Homo sapiens
ctctgagcccagct

SEQ ID NO: 3363652 - DNA, 17 bp, Homo sapiens
ctctgagcccaggccgt

SEQ ID NO: 3363653 - DNA, 16 bp, Homo sapiens
ctctgagcgggaggca

SEQ ID NO: 3363654 - DNA, 13 bp, Homo sapiens
ctctgaggggagg

SEQ ID NO: 3363655 - DNA, 15 bp, Homo sapiens
ctctgaggtgcctgt

SEQ ID NO: 3363656 - DNA, 18 bp, Homo sapiens
ctctgagtggtggttcct

SEQ ID NO: 3363657 - DNA, 19 bp, Homo sapiens
ctctgagtggtggttcctt

SEQ ID NO: 3363658 - DNA, 16 bp, Homo sapiens
ctctgagttctgtact

SEQ ID NO: 3363659 - DNA, 13 bp, Homo sapiens
ctctgatatggga

SEQ ID NO: 3363660 - DNA, 19 bp, Homo sapiens
ctctgatatgggactgagc

SEQ ID NO: 3363661 - DNA, 19 bp, Homo sapiens
ctctgatattccatgaatg

SEQ ID NO: 3363662 - DNA, 13 bp, Homo sapiens
ctctgatcttgtg

SEQ ID NO: 3363663 - DNA, 17 bp, Homo sapiens
ctctgatcttgtgctca

SEQ ID NO: 3363664 - DNA, 20 bp, Homo sapiens
ctctgatcttgtgctcagca

SEQ ID NO: 3363665 - DNA, 20 bp, Homo sapiens
ctctgattttcaaagctttt

SEQ ID NO: 3363666 - DNA, 17 bp, Homo sapiens
ctctgcaagtgtctgga

SEQ ID NO: 3363667 - DNA, 14 bp, Homo sapiens
ctctgcaatgcttc

SEQ ID NO: 3363668 - DNA, 22 bp, Homo sapiens
ctctgcaatgcttctgtagctt

SEQ ID NO: 3363669 - DNA, 16 bp, Homo sapiens
ctctgcaattcccctc

SEQ ID NO: 3363670 - DNA, 20 bp, Homo sapiens
ctctgcacaccctccagaga

SEQ ID NO: 3363671 - DNA, 10 bp, Homo sapiens
ctctgcacag

SEQ ID NO: 3363672 - DNA, 17 bp, Homo sapiens
ctctgcacagacaagca

SEQ ID NO: 3363673 - DNA, 18 bp, Homo sapiens
ctctgcacagacaagcag

SEQ ID NO: 3363674 - DNA, 20 bp, Homo sapiens
ctctgcacagacaagcagcc

SEQ ID NO: 3363675 - DNA, 20 bp, Homo sapiens
ctctgcacccttatcatggg

SEQ ID NO: 3363676 - DNA, 13 bp, Homo sapiens
ctctgcaccggac

SEQ ID NO: 3363677 - DNA, 14 bp, Homo sapiens
ctctgcactaagag

SEQ ID NO: 3363678 - DNA, 22 bp, Homo sapiens
ctctgcactactcctctgcagt

SEQ ID NO: 3363679 - DNA, 16 bp, Homo sapiens
ctctgcactactgaca

SEQ ID NO: 3363680 - DNA, 22 bp, Homo sapiens
ctctgcactactgacatgtggg

SEQ ID NO: 3363681 - DNA, 23 bp, Homo sapiens
ctctgcactcccacctgacacac

SEQ ID NO: 3363682 - DNA, 18 bp, Homo sapiens
ctctgcagaacagtgaaa

SEQ ID NO: 3363683 - DNA, 17 bp, Homo sapiens
ctctgcagacttcccag

SEQ ID NO: 3363684 - DNA, 19 bp, Homo sapiens
ctctgcagacttcccagct

SEQ ID NO: 3363685 - DNA, 19 bp, Homo sapiens
ctctgcaggcttaataaaa

SEQ ID NO: 3363686 - DNA, 18 bp, Homo sapiens
ctctgcagtaaaacacat

SEQ ID NO: 3363687 - DNA, 19 bp, Homo sapiens
ctctgcagtaaaacacatt

SEQ ID NO: 3363688 - DNA, 13 bp, Homo sapiens
ctctgcagtgcct

SEQ ID NO: 3363689 - DNA, 14 bp, Homo sapiens
ctctgcagtgcctt

SEQ ID NO: 3363690 - DNA, 20 bp, Homo sapiens
ctctgcatcccagcacctgc

SEQ ID NO: 3363691 - DNA, 22 bp, Homo sapiens
ctctgcatcccagcacctgcct

SEQ ID NO: 3363692 - DNA, 19 bp, Homo sapiens
ctctgcatctgactctctt

SEQ ID NO: 3363693 - DNA, 21 bp, Homo sapiens
ctctgccaaaggatgtgatat

SEQ ID NO: 3363694 - DNA, 15 bp, Homo sapiens
ctctgccacactctg

SEQ ID NO: 3363695 - DNA, 18 bp, Homo sapiens
ctctgccaccagagaccg

SEQ ID NO: 3363696 - DNA, 13 bp, Homo sapiens
ctctgccacccac

SEQ ID NO: 3363697 - DNA, 15 bp, Homo sapiens
ctctgccacccactc

SEQ ID NO: 3363698 - DNA, 19 bp, Homo sapiens
ctctgccacccactcagga

SEQ ID NO: 3363699 - DNA, 20 bp, Homo sapiens
ctctgccacccactcaggat

SEQ ID NO: 3363700 - DNA, 14 bp, Homo sapiens
ctctgccagccaca

SEQ ID NO: 3363701 - DNA, 13 bp, Homo sapiens
ctctgccagggca

SEQ ID NO: 3363702 - DNA, 15 bp, Homo sapiens
ctctgccagggcagt

SEQ ID NO: 3363703 - DNA, 13 bp, Homo sapiens
ctctgccagtgac

SEQ ID NO: 3363704 - DNA, 15 bp, Homo sapiens
ctctgccagtgacag

SEQ ID NO: 3363705 - DNA, 16 bp, Homo sapiens
ctctgccagtggatcc

SEQ ID NO: 3363706 - DNA, 22 bp, Homo sapiens
ctctgccagtggatcccctgcg

SEQ ID NO: 3363707 - DNA, 18 bp, Homo sapiens
ctctgccccaagcagcca

SEQ ID NO: 3363708 - DNA, 22 bp, Homo sapiens
ctctgccccaagcagccagcca

SEQ ID NO: 3363709 - DNA, 24 bp, Homo sapiens
ctctgccccaagcagccagccagt

SEQ ID NO: 3363710 - DNA, 19 bp, Homo sapiens
ctctgccccacgctgtggc

SEQ ID NO: 3363711 - DNA, 13 bp, Homo sapiens
ctctgccccagct

SEQ ID NO: 3363712 - DNA, 21 bp, Homo sapiens
ctctgccccagctctggcttc

SEQ ID NO: 3363713 - DNA, 21 bp, Homo sapiens
ctctgcccccatttccccgat

SEQ ID NO: 3363714 - DNA, 20 bp, Homo sapiens
ctctgccccttgggcatcca

SEQ ID NO: 3363715 - DNA, 21 bp, Homo sapiens
ctctgccccttgggcatccac

SEQ ID NO: 3363716 - DNA, 22 bp, Homo sapiens
ctctgccccttgggcatccacc

SEQ ID NO: 3363717 - DNA, 23 bp, Homo sapiens
ctctgccctcattactgggcctt

SEQ ID NO: 3363718 - DNA, 14 bp, Homo sapiens
ctctgccgctacct

SEQ ID NO: 3363719 - DNA, 14 bp, Homo sapiens
ctctgccggctctt

SEQ ID NO: 3363720 - DNA, 23 bp, Homo sapiens
ctctgccggtcgggcagccagca

SEQ ID NO: 3363721 - DNA, 15 bp, Homo sapiens
ctctgcctacagaac

SEQ ID NO: 3363722 - DNA, 20 bp, Homo sapiens
ctctgcctagaatctttatt

SEQ ID NO: 3363723 - DNA, 13 bp, Homo sapiens
ctctgcctcccaa

SEQ ID NO: 3363724 - DNA, 15 bp, Homo sapiens
ctctgcctcccaggt

SEQ ID NO: 3363725 - DNA, 16 bp, Homo sapiens
ctctgcctcctcttca

SEQ ID NO: 3363726 - DNA, 20 bp, Homo sapiens
ctctgcctctgacacacagc

SEQ ID NO: 3363727 - DNA, 18 bp, Homo sapiens
ctctgccttcaggcttct

SEQ ID NO: 3363728 - DNA, 18 bp, Homo sapiens
ctctgcggggcagggcct

SEQ ID NO: 3363729 - DNA, 19 bp, Homo sapiens
ctctgcggggcagggcctt

SEQ ID NO: 3363730 - DNA, 16 bp, Homo sapiens
ctctgctagatttcta

SEQ ID NO: 3363731 - DNA, 18 bp, Homo sapiens
ctctgctagatttctaca

SEQ ID NO: 3363732 - DNA, 19 bp, Homo sapiens
ctctgctatttctcttgct

SEQ ID NO: 3363733 - DNA, 21 bp, Homo sapiens
ctctgctcaccgcccatcagg

SEQ ID NO: 3363734 - DNA, 16 bp, Homo sapiens
ctctgctcagccaagc

SEQ ID NO: 3363735 - DNA, 18 bp, Homo sapiens
ctctgctcctctccccag

SEQ ID NO: 3363736 - DNA, 20 bp, Homo sapiens
ctctgctcgccctcctttct

SEQ ID NO: 3363737 - DNA, 21 bp, Homo sapiens
ctctgctcgccctcctttctg

SEQ ID NO: 3363738 - DNA, 12 bp, Homo sapiens
ctctgctctagc

SEQ ID NO: 3363739 - DNA, 13 bp, Homo sapiens
ctctgctctagcc

SEQ ID NO: 3363740 - DNA, 14 bp, Homo sapiens
ctctgctgaaggtt

SEQ ID NO: 3363741 - DNA, 16 bp, Homo sapiens
ctctgctgaatgtaaa

SEQ ID NO: 3363742 - DNA, 13 bp, Homo sapiens
ctctgctgacaga

SEQ ID NO: 3363743 - DNA, 17 bp, Homo sapiens
ctctgctgacagacaca

SEQ ID NO: 3363744 - DNA, 21 bp, Homo sapiens
ctctgctgacagacacaggcc

SEQ ID NO: 3363745 - DNA, 22 bp, Homo sapiens
ctctgctgacagacacaggccc

SEQ ID NO: 3363746 - DNA, 23 bp, Homo sapiens
ctctgctgacagacacaggcccg

SEQ ID NO: 3363747 - DNA, 15 bp, Homo sapiens
ctctgctgccatggc

SEQ ID NO: 3363748 - DNA, 16 bp, Homo sapiens
ctctgctgctgtccct

SEQ ID NO: 3363749 - DNA, 13 bp, Homo sapiens
ctctgctgcttag

SEQ ID NO: 3363750 - DNA, 23 bp, Homo sapiens
ctctgctgtacatatttgagact

SEQ ID NO: 3363751 - DNA, 16 bp, Homo sapiens
ctctgcttcagtccac

SEQ ID NO: 3363752 - DNA, 15 bp, Homo sapiens
ctctgcttctctgac

SEQ ID NO: 3363753 - DNA, 20 bp, Homo sapiens
ctctgcttttagttcatata

SEQ ID NO: 3363754 - DNA, 21 bp, Homo sapiens
ctctggaaaggggggagctgg

SEQ ID NO: 3363755 - DNA, 15 bp, Homo sapiens
ctctggaataaagtt

SEQ ID NO: 3363756 - DNA, 20 bp, Homo sapiens
ctctggaataaagttgcaga

SEQ ID NO: 3363757 - DNA, 21 bp, Homo sapiens
ctctggaataaagttgcagat

SEQ ID NO: 3363758 - DNA, 18 bp, Homo sapiens
ctctggacggcaggctca

SEQ ID NO: 3363759 - DNA, 16 bp, Homo sapiens
ctctggactctaaaga

SEQ ID NO: 3363760 - DNA, 21 bp, Homo sapiens
ctctggactctaaagaccaaa

SEQ ID NO: 3363761 - DNA, 14 bp, Homo sapiens
ctctggactggcta

SEQ ID NO: 3363762 - DNA, 19 bp, Homo sapiens
ctctggactggctagagtc

SEQ ID NO: 3363763 - DNA, 19 bp, Homo sapiens
ctctggagacagccccaga

SEQ ID NO: 3363764 - DNA, 24 bp, Homo sapiens
ctctggagacagccccagagcagg

SEQ ID NO: 3363765 - DNA, 12 bp, Homo sapiens
ctctggagagaa

SEQ ID NO: 3363766 - DNA, 13 bp, Homo sapiens
ctctggagagaaa

SEQ ID NO: 3363767 - DNA, 13 bp, Homo sapiens
ctctggagcccta

SEQ ID NO: 3363768 - DNA, 16 bp, Homo sapiens
ctctggaggagcaagg

SEQ ID NO: 3363769 - DNA, 15 bp, Homo sapiens
ctctggaggggaggg

SEQ ID NO: 3363770 - DNA, 16 bp, Homo sapiens
ctctggaggggagggg

SEQ ID NO: 3363771 - DNA, 16 bp, Homo sapiens
ctctggatatttgcac

SEQ ID NO: 3363772 - DNA, 15 bp, Homo sapiens
ctctggccaggatgg

SEQ ID NO: 3363773 - DNA, 19 bp, Homo sapiens
ctctggccaggatggaggg

SEQ ID NO: 3363774 - DNA, 16 bp, Homo sapiens
ctctggccaggcatgg

SEQ ID NO: 3363775 - DNA, 13 bp, Homo sapiens
ctctggccctcgg

SEQ ID NO: 3363776 - DNA, 13 bp, Homo sapiens
ctctggccctggc

SEQ ID NO: 3363777 - DNA, 17 bp, Homo sapiens
ctctggcccttggaata

SEQ ID NO: 3363778 - DNA, 18 bp, Homo sapiens
ctctggcctcagccgact

SEQ ID NO: 3363779 - DNA, 17 bp, Homo sapiens
ctctggcctcccacccg

SEQ ID NO: 3363780 - DNA, 21 bp, Homo sapiens
ctctggccttcggcctccatc

SEQ ID NO: 3363781 - DNA, 22 bp, Homo sapiens
ctctggcggcttcctgtccact

SEQ ID NO: 3363782 - DNA, 14 bp, Homo sapiens
ctctggctagaggc

SEQ ID NO: 3363783 - DNA, 19 bp, Homo sapiens
ctctggctagaggccagcc

SEQ ID NO: 3363784 - DNA, 12 bp, Homo sapiens
ctctggctctca

SEQ ID NO: 3363785 - DNA, 23 bp, Homo sapiens
ctctggcttcccatagtggggcc

SEQ ID NO: 3363786 - DNA, 18 bp, Homo sapiens
ctctgggaacctcccaga

SEQ ID NO: 3363787 - DNA, 19 bp, Homo sapiens
ctctgggcacactctgcca

SEQ ID NO: 3363788 - DNA, 14 bp, Homo sapiens
ctctgggcccaggg

SEQ ID NO: 3363789 - DNA, 14 bp, Homo sapiens
ctctgggcctgggg

SEQ ID NO: 3363790 - DNA, 21 bp, Homo sapiens
ctctgggcctttgtttccttg

SEQ ID NO: 3363791 - DNA, 14 bp, Homo sapiens
ctctgggctcaggg

SEQ ID NO: 3363792 - DNA, 18 bp, Homo sapiens
ctctgggctcagggctgg

SEQ ID NO: 3363793 - DNA, 11 bp, Homo sapiens
ctctgggctgt

SEQ ID NO: 3363794 - DNA, 15 bp, Homo sapiens
ctctggggcagatcc

SEQ ID NO: 3363795 - DNA, 16 bp, Homo sapiens
ctctggggcagatccc

SEQ ID NO: 3363796 - DNA, 20 bp, Homo sapiens
ctctggggtcccccatcccc

SEQ ID NO: 3363797 - DNA, 12 bp, Homo sapiens
ctctggtccaca

SEQ ID NO: 3363798 - DNA, 19 bp, Homo sapiens
ctctggtccacactagaaa

SEQ ID NO: 3363799 - DNA, 21 bp, Homo sapiens
ctctggtccacactagaaaga

SEQ ID NO: 3363800 - DNA, 16 bp, Homo sapiens
ctctggtcgctcctgc

SEQ ID NO: 3363801 - DNA, 20 bp, Homo sapiens
ctctggtcgctcctgcccac

SEQ ID NO: 3363802 - DNA, 14 bp, Homo sapiens
ctctggtgcctcca

SEQ ID NO: 3363803 - DNA, 16 bp, Homo sapiens
ctctggtgcctccaga

SEQ ID NO: 3363804 - DNA, 13 bp, Homo sapiens
ctctggttctttg

SEQ ID NO: 3363805 - DNA, 17 bp, Homo sapiens
ctctggttgtttctgtt

SEQ ID NO: 3363806 - DNA, 18 bp, Homo sapiens
ctctggttgtttctgttc

SEQ ID NO: 3363807 - DNA, 22 bp, Homo sapiens
ctctgtacttttcattctcttt

SEQ ID NO: 3363808 - DNA, 22 bp, Homo sapiens
ctctgtagggaactctggggtc

SEQ ID NO: 3363809 - DNA, 20 bp, Homo sapiens
ctctgtagttcctaatggat

SEQ ID NO: 3363810 - DNA, 18 bp, Homo sapiens
ctctgtataaacattaaa

SEQ ID NO: 3363811 - DNA, 21 bp, Homo sapiens
ctctgtataatagagataagt

SEQ ID NO: 3363812 - DNA, 19 bp, Homo sapiens
ctctgtcacccttgtcctt

SEQ ID NO: 3363813 - DNA, 14 bp, Homo sapiens
ctctgtcagccagc

SEQ ID NO: 3363814 - DNA, 17 bp, Homo sapiens
ctctgtcagccagccgc

SEQ ID NO: 3363815 - DNA, 18 bp, Homo sapiens
ctctgtcatcactccctg

SEQ ID NO: 3363816 - DNA, 21 bp, Homo sapiens
ctctgtcatcactccctggat

SEQ ID NO: 3363817 - DNA, 22 bp, Homo sapiens
ctctgtcatcactccctggatg

SEQ ID NO: 3363818 - DNA, 12 bp, Homo sapiens
ctctgtccaggc

SEQ ID NO: 3363819 - DNA, 17 bp, Homo sapiens
ctctgtccaggccactg

SEQ ID NO: 3363820 - DNA, 21 bp, Homo sapiens
ctctgtccatttatccacagg

SEQ ID NO: 3363821 - DNA, 14 bp, Homo sapiens
ctctgtcctgggag

SEQ ID NO: 3363822 - DNA, 15 bp, Homo sapiens
ctctgtcctgggagt

SEQ ID NO: 3363823 - DNA, 17 bp, Homo sapiens
ctctgtcgcccagtctg

SEQ ID NO: 3363824 - DNA, 18 bp, Homo sapiens
ctctgtcgcccagtctgg

SEQ ID NO: 3363825 - DNA, 15 bp, Homo sapiens
ctctgtctacaaata

SEQ ID NO: 3363826 - DNA, 23 bp, Homo sapiens
ctctgtctcagacttttgtacat

SEQ ID NO: 3363827 - DNA, 21 bp, Homo sapiens
ctctgtctcatcctcctggaa

SEQ ID NO: 3363828 - DNA, 22 bp, Homo sapiens
ctctgtctcatcctcctggaac

SEQ ID NO: 3363829 - DNA, 16 bp, Homo sapiens
ctctgtcttgtgtttc

SEQ ID NO: 3363830 - DNA, 21 bp, Homo sapiens
ctctgtgaacgatttagaaag

SEQ ID NO: 3363831 - DNA, 23 bp, Homo sapiens
ctctgtgaacgatttagaaagaa

SEQ ID NO: 3363832 - DNA, 18 bp, Homo sapiens
ctctgtgaatacaattaa

SEQ ID NO: 3363833 - DNA, 21 bp, Homo sapiens
ctctgtgaatacaattaaagg

SEQ ID NO: 3363834 - DNA, 22 bp, Homo sapiens
ctctgtgaatacaattaaaggt

SEQ ID NO: 3363835 - DNA, 16 bp, Homo sapiens
ctctgtgacctcaggc

SEQ ID NO: 3363836 - DNA, 17 bp, Homo sapiens
ctctgtgagggtgctga

SEQ ID NO: 3363837 - DNA, 15 bp, Homo sapiens
ctctgtgccttcttt

SEQ ID NO: 3363838 - DNA, 13 bp, Homo sapiens
ctctgtgctgtgt

SEQ ID NO: 3363839 - DNA, 15 bp, Homo sapiens
ctctgtggaggggcc

SEQ ID NO: 3363840 - DNA, 18 bp, Homo sapiens
ctctgtggaggggccctc

SEQ ID NO: 3363841 - DNA, 16 bp, Homo sapiens
ctctgtggcctgtgtc

SEQ ID NO: 3363842 - DNA, 22 bp, Homo sapiens
ctctgtggcctgtgtccagcag

SEQ ID NO: 3363843 - DNA, 16 bp, Homo sapiens
ctctgtgtatatctct

SEQ ID NO: 3363844 - DNA, 21 bp, Homo sapiens
ctctgtgtcaggtggggcagc

SEQ ID NO: 3363845 - DNA, 14 bp, Homo sapiens
ctctgtgtccttcc

SEQ ID NO: 3363846 - DNA, 16 bp, Homo sapiens
ctctgtgtccttccct

SEQ ID NO: 3363847 - DNA, 17 bp, Homo sapiens
ctctgtgtccttccctg

SEQ ID NO: 3363848 - DNA, 15 bp, Homo sapiens
ctctgtgtctaagat

SEQ ID NO: 3363849 - DNA, 23 bp, Homo sapiens
ctctgtgtctaagattctagatc

SEQ ID NO: 3363850 - DNA, 14 bp, Homo sapiens
ctctgtgtttaaaa

SEQ ID NO: 3363851 - DNA, 14 bp, Homo sapiens
ctctgttaaggttg

SEQ ID NO: 3363852 - DNA, 20 bp, Homo sapiens
ctctgttatgtactgtacta

SEQ ID NO: 3363853 - DNA, 20 bp, Homo sapiens
ctctgttcacaaactacctc

SEQ ID NO: 3363854 - DNA, 19 bp, Homo sapiens
ctctgttcagatgtgcatt

SEQ ID NO: 3363855 - DNA, 20 bp, Homo sapiens
ctctgttcagatgtgcattt

SEQ ID NO: 3363856 - DNA, 14 bp, Homo sapiens
ctctgttgtaagaa

SEQ ID NO: 3363857 - DNA, 18 bp, Homo sapiens
ctcttaaattatatattt

SEQ ID NO: 3363858 - DNA, 21 bp, Homo sapiens
ctcttaaattatatatttatt

SEQ ID NO: 3363859 - DNA, 17 bp, Homo sapiens
ctcttaacaatttctgt

SEQ ID NO: 3363860 - DNA, 22 bp, Homo sapiens
ctcttaagcagcatggaaaaat

SEQ ID NO: 3363861 - DNA, 14 bp, Homo sapiens
ctcttaatctgtgt

SEQ ID NO: 3363862 - DNA, 22 bp, Homo sapiens
ctcttactttcctttccccagc

SEQ ID NO: 3363863 - DNA, 18 bp, Homo sapiens
ctcttagcaaaaacatgt

SEQ ID NO: 3363864 - DNA, 16 bp, Homo sapiens
ctcttagctactgtat

SEQ ID NO: 3363865 - DNA, 13 bp, Homo sapiens
ctcttagctgtct

SEQ ID NO: 3363866 - DNA, 18 bp, Homo sapiens
ctcttagctttctcaggg

SEQ ID NO: 3363867 - DNA, 12 bp, Homo sapiens
ctcttaggatat

SEQ ID NO: 3363868 - DNA, 15 bp, Homo sapiens
ctcttaggatatttg

SEQ ID NO: 3363869 - DNA, 12 bp, Homo sapiens
ctcttaggtcag

SEQ ID NO: 3363870 - DNA, 15 bp, Homo sapiens
ctcttagtgcccgcc

SEQ ID NO: 3363871 - DNA, 20 bp, Homo sapiens
ctcttagtgcccgcctagga

SEQ ID NO: 3363872 - DNA, 18 bp, Homo sapiens
ctcttatagaatatttat

SEQ ID NO: 3363873 - DNA, 20 bp, Homo sapiens
ctcttatagaatatttatta

SEQ ID NO: 3363874 - DNA, 22 bp, Homo sapiens
ctcttatagaatatttattacc

SEQ ID NO: 3363875 - DNA, 16 bp, Homo sapiens
ctcttatgtgtgcctt

SEQ ID NO: 3363876 - DNA, 17 bp, Homo sapiens
ctcttattcctctaggc

SEQ ID NO: 3363877 - DNA, 16 bp, Homo sapiens
ctcttatttctgaatt

SEQ ID NO: 3363878 - DNA, 15 bp, Homo sapiens
ctcttattttacaat

SEQ ID NO: 3363879 - DNA, 17 bp, Homo sapiens
ctcttcaactgaccagc

SEQ ID NO: 3363880 - DNA, 18 bp, Homo sapiens
ctcttcaccccccactca

SEQ ID NO: 3363881 - DNA, 16 bp, Homo sapiens
ctcttcaccccggcag

SEQ ID NO: 3363882 - DNA, 18 bp, Homo sapiens
ctcttcaccccggcaggc

SEQ ID NO: 3363883 - DNA, 17 bp, Homo sapiens
ctcttcactgtggccac

SEQ ID NO: 3363884 - DNA, 21 bp, Homo sapiens
ctcttcactgtggccacagcc

SEQ ID NO: 3363885 - DNA, 15 bp, Homo sapiens
ctcttcacttggcca

SEQ ID NO: 3363886 - DNA, 17 bp, Homo sapiens
ctcttcagactctcagc

SEQ ID NO: 3363887 - DNA, 23 bp, Homo sapiens
ctcttcagactctcagcccagaa

SEQ ID NO: 3363888 - DNA, 13 bp, Homo sapiens
ctcttcaggcctc

SEQ ID NO: 3363889 - DNA, 17 bp, Homo sapiens
ctcttcaggcctccctc

SEQ ID NO: 3363890 - DNA, 15 bp, Homo sapiens
ctcttcaggttctca

SEQ ID NO: 3363891 - DNA, 14 bp, Homo sapiens
ctcttcaggttctt

SEQ ID NO: 3363892 - DNA, 22 bp, Homo sapiens
ctcttcagtgactcctgctggt

SEQ ID NO: 3363893 - DNA, 13 bp, Homo sapiens
ctcttcattcaaa

SEQ ID NO: 3363894 - DNA, 19 bp, Homo sapiens
ctcttcattcaaactgcac

SEQ ID NO: 3363895 - DNA, 18 bp, Homo sapiens
ctcttcatttttttttca

SEQ ID NO: 3363896 - DNA, 22 bp, Homo sapiens
ctcttccagtcttcctgacact

SEQ ID NO: 3363897 - DNA, 13 bp, Homo sapiens
ctcttcccagaaa

SEQ ID NO: 3363898 - DNA, 12 bp, Homo sapiens
ctcttcccatga

SEQ ID NO: 3363899 - DNA, 13 bp, Homo sapiens
ctcttcccatgac

SEQ ID NO: 3363900 - DNA, 15 bp, Homo sapiens
ctcttcccccttcca

SEQ ID NO: 3363901 - DNA, 14 bp, Homo sapiens
ctcttccctttccc

SEQ ID NO: 3363902 - DNA, 18 bp, Homo sapiens
ctcttccgggcagaaaca

SEQ ID NO: 3363903 - DNA, 12 bp, Homo sapiens
ctcttcctaccc

SEQ ID NO: 3363904 - DNA, 23 bp, Homo sapiens
ctcttcgcgcccgcccctgcagc

SEQ ID NO: 3363905 - DNA, 17 bp, Homo sapiens
ctcttctattttgtaaa

SEQ ID NO: 3363906 - DNA, 19 bp, Homo sapiens
ctcttctattttgtaaact

SEQ ID NO: 3363907 - DNA, 18 bp, Homo sapiens
ctcttctcagctcttcca

SEQ ID NO: 3363908 - DNA, 13 bp, Homo sapiens
ctcttctccactg

SEQ ID NO: 3363909 - DNA, 13 bp, Homo sapiens
ctcttctccaggc

SEQ ID NO: 3363910 - DNA, 16 bp, Homo sapiens
ctcttctccaggctgt

SEQ ID NO: 3363911 - DNA, 13 bp, Homo sapiens
ctcttctctccag

SEQ ID NO: 3363912 - DNA, 20 bp, Homo sapiens
ctcttctgacgtgccttttg

SEQ ID NO: 3363913 - DNA, 15 bp, Homo sapiens
ctcttctgctccacc

SEQ ID NO: 3363914 - DNA, 16 bp, Homo sapiens
ctcttctgctccaccc

SEQ ID NO: 3363915 - DNA, 11 bp, Homo sapiens
ctcttctggct

SEQ ID NO: 3363916 - DNA, 15 bp, Homo sapiens
ctcttcttactcatt

SEQ ID NO: 3363917 - DNA, 14 bp, Homo sapiens
ctcttcttctgaag

SEQ ID NO: 3363918 - DNA, 15 bp, Homo sapiens
ctcttcttcttcaga

SEQ ID NO: 3363919 - DNA, 18 bp, Homo sapiens
ctcttcttcttcagaaga

SEQ ID NO: 3363920 - DNA, 21 bp, Homo sapiens
ctcttctttatactgtaattt

SEQ ID NO: 3363921 - DNA, 24 bp, Homo sapiens
ctcttctttatactgtaatttagt

SEQ ID NO: 3363922 - DNA, 19 bp, Homo sapiens
ctcttctttcatctgggga

SEQ ID NO: 3363923 - DNA, 20 bp, Homo sapiens
ctcttctttcatctggggat

SEQ ID NO: 3363924 - DNA, 15 bp, Homo sapiens
ctcttgacctcaggt

SEQ ID NO: 3363925 - DNA, 14 bp, Homo sapiens
ctcttgagctggcc

SEQ ID NO: 3363926 - DNA, 15 bp, Homo sapiens
ctcttgagctggcct

SEQ ID NO: 3363927 - DNA, 22 bp, Homo sapiens
ctcttgagctggcctctctagc

SEQ ID NO: 3363928 - DNA, 14 bp, Homo sapiens
ctcttgagggagct

SEQ ID NO: 3363929 - DNA, 15 bp, Homo sapiens
ctcttgagggagctt

SEQ ID NO: 3363930 - DNA, 23 bp, Homo sapiens
ctcttgatacccccctctgtctt

SEQ ID NO: 3363931 - DNA, 14 bp, Homo sapiens
ctcttgatgtgaag

SEQ ID NO: 3363932 - DNA, 16 bp, Homo sapiens
ctcttgatgtgaagat

SEQ ID NO: 3363933 - DNA, 23 bp, Homo sapiens
ctcttgatgtgaagataatttgc

SEQ ID NO: 3363934 - DNA, 19 bp, Homo sapiens
ctcttgcacccgcctctcc

SEQ ID NO: 3363935 - DNA, 22 bp, Homo sapiens
ctcttgccactgcctcttcctc

SEQ ID NO: 3363936 - DNA, 19 bp, Homo sapiens
ctcttgcccatcctgactg

SEQ ID NO: 3363937 - DNA, 15 bp, Homo sapiens
ctcttgcccttccct

SEQ ID NO: 3363938 - DNA, 16 bp, Homo sapiens
ctcttgccgaggagcc

SEQ ID NO: 3363939 - DNA, 20 bp, Homo sapiens
ctcttgccgaggagccaggc

SEQ ID NO: 3363940 - DNA, 18 bp, Homo sapiens
ctcttgcgtgtcaatttc

SEQ ID NO: 3363941 - DNA, 14 bp, Homo sapiens
ctcttgctaatcag

SEQ ID NO: 3363942 - DNA, 22 bp, Homo sapiens
ctcttgctaatcagtgtctcac

SEQ ID NO: 3363943 - DNA, 20 bp, Homo sapiens
ctcttgctcaaaaatctgtt

SEQ ID NO: 3363944 - DNA, 14 bp, Homo sapiens
ctcttgctctttct

SEQ ID NO: 3363945 - DNA, 13 bp, Homo sapiens
ctcttgctgtctc

SEQ ID NO: 3363946 - DNA, 17 bp, Homo sapiens
ctcttgctgtctctgct

SEQ ID NO: 3363947 - DNA, 17 bp, Homo sapiens
ctcttggaaaataagac

SEQ ID NO: 3363948 - DNA, 15 bp, Homo sapiens
ctcttggcctttgca

SEQ ID NO: 3363949 - DNA, 20 bp, Homo sapiens
ctcttggcctttgcatttat

SEQ ID NO: 3363950 - DNA, 17 bp, Homo sapiens
ctcttggtcagcttttg

SEQ ID NO: 3363951 - DNA, 15 bp, Homo sapiens
ctcttgtaaaaagag

SEQ ID NO: 3363952 - DNA, 14 bp, Homo sapiens
ctcttgtaaagact

SEQ ID NO: 3363953 - DNA, 13 bp, Homo sapiens
ctcttgtaagtca

SEQ ID NO: 3363954 - DNA, 21 bp, Homo sapiens
ctcttgtataagatcctagat

SEQ ID NO: 3363955 - DNA, 20 bp, Homo sapiens
ctcttgtcatttttaatatt

SEQ ID NO: 3363956 - DNA, 13 bp, Homo sapiens
ctcttgttttgtt

SEQ ID NO: 3363957 - DNA, 20 bp, Homo sapiens
ctcttgtttttattaattta

SEQ ID NO: 3363958 - DNA, 17 bp, Homo sapiens
ctctttaaatcaagtcc

SEQ ID NO: 3363959 - DNA, 22 bp, Homo sapiens
ctctttaagggcatgccttgtg

SEQ ID NO: 3363960 - DNA, 17 bp, Homo sapiens
ctctttaataaattgct

SEQ ID NO: 3363961 - DNA, 20 bp, Homo sapiens
ctctttaatgtcacaggcag

SEQ ID NO: 3363962 - DNA, 22 bp, Homo sapiens
ctctttactcccttcctggcct

SEQ ID NO: 3363963 - DNA, 21 bp, Homo sapiens
ctctttagagcagctttggga

SEQ ID NO: 3363964 - DNA, 14 bp, Homo sapiens
ctctttatacagct

SEQ ID NO: 3363965 - DNA, 22 bp, Homo sapiens
ctctttcaagcagtcgtgcctg

SEQ ID NO: 3363966 - DNA, 17 bp, Homo sapiens
ctctttcagagaggtct

SEQ ID NO: 3363967 - DNA, 14 bp, Homo sapiens
ctctttccctgcga

SEQ ID NO: 3363968 - DNA, 20 bp, Homo sapiens
ctctttccctgcgagacgca

SEQ ID NO: 3363969 - DNA, 16 bp, Homo sapiens
ctctttcgtcaccctt

SEQ ID NO: 3363970 - DNA, 20 bp, Homo sapiens
ctctttctacatgactgggc

SEQ ID NO: 3363971 - DNA, 22 bp, Homo sapiens
ctctttctacatgactgggcct

SEQ ID NO: 3363972 - DNA, 18 bp, Homo sapiens
ctctttctccttagtctt

SEQ ID NO: 3363973 - DNA, 12 bp, Homo sapiens
ctctttctctgc

SEQ ID NO: 3363974 - DNA, 13 bp, Homo sapiens
ctctttctctgcc

SEQ ID NO: 3363975 - DNA, 16 bp, Homo sapiens
ctctttctctgccagt

SEQ ID NO: 3363976 - DNA, 17 bp, Homo sapiens
ctctttctggcctgcct

SEQ ID NO: 3363977 - DNA, 23 bp, Homo sapiens
ctctttcttataatactctgttg

SEQ ID NO: 3363978 - DNA, 16 bp, Homo sapiens
ctctttcttcctttct

SEQ ID NO: 3363979 - DNA, 21 bp, Homo sapiens
ctctttgtggggaagaggggc

SEQ ID NO: 3363980 - DNA, 18 bp, Homo sapiens
ctctttgttatttgaaaa

SEQ ID NO: 3363981 - DNA, 17 bp, Homo sapiens
ctctttgttctcagctc

SEQ ID NO: 3363982 - DNA, 19 bp, Homo sapiens
ctctttgttctcagctccc

SEQ ID NO: 3363983 - DNA, 22 bp, Homo sapiens
ctcttttatatttgtaggagaa

SEQ ID NO: 3363984 - DNA, 14 bp, Homo sapiens
ctcttttcaaaaca

SEQ ID NO: 3363985 - DNA, 14 bp, Homo sapiens
ctcttttcattgtg

SEQ ID NO: 3363986 - DNA, 16 bp, Homo sapiens
ctcttttccctctcta

SEQ ID NO: 3363987 - DNA, 14 bp, Homo sapiens
ctcttttctatttt

SEQ ID NO: 3363988 - DNA, 18 bp, Homo sapiens
ctcttttgaggtccctgt

SEQ ID NO: 3363989 - DNA, 20 bp, Homo sapiens
ctcttttgaggtccctgtat

SEQ ID NO: 3363990 - DNA, 11 bp, Homo sapiens
ctctttttaag

SEQ ID NO: 3363991 - DNA, 17 bp, Homo sapiens
ctctttttggactcagc

SEQ ID NO: 3363992 - DNA, 20 bp, Homo sapiens
ctctttttggactcagccca

SEQ ID NO: 3363993 - DNA, 21 bp, Homo sapiens
ctctttttggactcagcccac

SEQ ID NO: 3363994 - DNA, 16 bp, Homo sapiens
ctctttttggaggtgc

SEQ ID NO: 3363995 - DNA, 14 bp, Homo sapiens
ctctttttgttttt

SEQ ID NO: 3363996 - DNA, 18 bp, Homo sapiens
ctcttttttactcattga

SEQ ID NO: 3363997 - DNA, 14 bp, Homo sapiens
ctgaaaaaaagttt

SEQ ID NO: 3363998 - DNA, 18 bp, Homo sapiens
ctgaaaaaaagtttacaa

SEQ ID NO: 3363999 - DNA, 19 bp, Homo sapiens
ctgaaaaagtagattgagt

SEQ ID NO: 3364000 - DNA, 18 bp, Homo sapiens
ctgaaaaccatctggcct

SEQ ID NO: 3364001 - DNA, 20 bp, Homo sapiens
ctgaaaaccatctggcctgg

SEQ ID NO: 3364002 - DNA, 22 bp, Homo sapiens
ctgaaaaccatctggcctggcc

SEQ ID NO: 3364003 - DNA, 15 bp, Homo sapiens
ctgaaaacgaagggg

SEQ ID NO: 3364004 - DNA, 17 bp, Homo sapiens
ctgaaaacgaaggggcc

SEQ ID NO: 3364005 - DNA, 12 bp, Homo sapiens
ctgaaaagaagg

SEQ ID NO: 3364006 - DNA, 21 bp, Homo sapiens
ctgaaaagcaattgccctgta

SEQ ID NO: 3364007 - DNA, 17 bp, Homo sapiens
ctgaaaatatctcttgt

SEQ ID NO: 3364008 - DNA, 20 bp, Homo sapiens
ctgaaaatccaataatcaga

SEQ ID NO: 3364009 - DNA, 20 bp, Homo sapiens
ctgaaaatcgagtttttcct

SEQ ID NO: 3364010 - DNA, 15 bp, Homo sapiens
ctgaaaatctaatat

SEQ ID NO: 3364011 - DNA, 16 bp, Homo sapiens
ctgaaaatctaatatt

SEQ ID NO: 3364012 - DNA, 13 bp, Homo sapiens
ctgaaaatgcaaa

SEQ ID NO: 3364013 - DNA, 18 bp, Homo sapiens
ctgaaaatgcaaagctga

SEQ ID NO: 3364014 - DNA, 16 bp, Homo sapiens
ctgaaaatgtatgtgt

SEQ ID NO: 3364015 - DNA, 16 bp, Homo sapiens
ctgaaaatgtcacatt

SEQ ID NO: 3364016 - DNA, 22 bp, Homo sapiens
ctgaaaatgtttttctgccagg

SEQ ID NO: 3364017 - DNA, 22 bp, Homo sapiens
ctgaaaattccagaaaggatat

SEQ ID NO: 3364018 - DNA, 17 bp, Homo sapiens
ctgaaacaaaaattgtc

SEQ ID NO: 3364019 - DNA, 20 bp, Homo sapiens
ctgaaacaaaaattgtcttt

SEQ ID NO: 3364020 - DNA, 20 bp, Homo sapiens
ctgaaacattcacacagggc

SEQ ID NO: 3364021 - DNA, 12 bp, Homo sapiens
ctgaaaccaaaa

SEQ ID NO: 3364022 - DNA, 13 bp, Homo sapiens
ctgaaaccatttt

SEQ ID NO: 3364023 - DNA, 15 bp, Homo sapiens
ctgaaacccacagat

SEQ ID NO: 3364024 - DNA, 16 bp, Homo sapiens
ctgaaagaaacagtta

SEQ ID NO: 3364025 - DNA, 15 bp, Homo sapiens
ctgaaagcagcagct

SEQ ID NO: 3364026 - DNA, 19 bp, Homo sapiens
ctgaaagcagcagctagga

SEQ ID NO: 3364027 - DNA, 20 bp, Homo sapiens
ctgaaagccttagggaagct

SEQ ID NO: 3364028 - DNA, 21 bp, Homo sapiens
ctgaaaggaaatacacttctt

SEQ ID NO: 3364029 - DNA, 11 bp, Homo sapiens
ctgaaagtgtt

SEQ ID NO: 3364030 - DNA, 15 bp, Homo sapiens
ctgaaagtgttttac

SEQ ID NO: 3364031 - DNA, 21 bp, Homo sapiens
ctgaaagtgttttactctttt

SEQ ID NO: 3364032 - DNA, 18 bp, Homo sapiens
ctgaaataaaaaattatg

SEQ ID NO: 3364033 - DNA, 12 bp, Homo sapiens
ctgaaataaaca

SEQ ID NO: 3364034 - DNA, 16 bp, Homo sapiens
ctgaaataaacactgg

SEQ ID NO: 3364035 - DNA, 19 bp, Homo sapiens
ctgaaatctcagaattcct

SEQ ID NO: 3364036 - DNA, 16 bp, Homo sapiens
ctgaaatctgaagacc

SEQ ID NO: 3364037 - DNA, 18 bp, Homo sapiens
ctgaaatgaaacaaataa

SEQ ID NO: 3364038 - DNA, 19 bp, Homo sapiens
ctgaaatgaaacaaataat

SEQ ID NO: 3364039 - DNA, 12 bp, Homo sapiens
ctgaaattccaa

SEQ ID NO: 3364040 - DNA, 13 bp, Homo sapiens
ctgaaattccaaa

SEQ ID NO: 3364041 - DNA, 22 bp, Homo sapiens
ctgaaatttaaactgcaatgcc

SEQ ID NO: 3364042 - DNA, 18 bp, Homo sapiens
ctgaaatttattcacata

SEQ ID NO: 3364043 - DNA, 21 bp, Homo sapiens
ctgaaatttgttatacttcaa

SEQ ID NO: 3364044 - DNA, 22 bp, Homo sapiens
ctgaaattttagaaatattcac

SEQ ID NO: 3364045 - DNA, 22 bp, Homo sapiens
ctgaaattttatatgcttactg

SEQ ID NO: 3364046 - DNA, 14 bp, Homo sapiens
ctgaacaagaattg

SEQ ID NO: 3364047 - DNA, 16 bp, Homo sapiens
ctgaacaagaattgga

SEQ ID NO: 3364048 - DNA, 19 bp, Homo sapiens
ctgaacaataggctgttcc

SEQ ID NO: 3364049 - DNA, 17 bp, Homo sapiens
ctgaacacaggcagctt

SEQ ID NO: 3364050 - DNA, 18 bp, Homo sapiens
ctgaacacaggcagcttt

SEQ ID NO: 3364051 - DNA, 18 bp, Homo sapiens
ctgaacaccattgaaggc

SEQ ID NO: 3364052 - DNA, 11 bp, Homo sapiens
ctgaacattgt

SEQ ID NO: 3364053 - DNA, 17 bp, Homo sapiens
ctgaaccaaattgcact

SEQ ID NO: 3364054 - DNA, 16 bp, Homo sapiens
ctgaaccatccctgat

SEQ ID NO: 3364055 - DNA, 19 bp, Homo sapiens
ctgaaccccatgggcttgg

SEQ ID NO: 3364056 - DNA, 20 bp, Homo sapiens
ctgaaccccatgggcttgga

SEQ ID NO: 3364057 - DNA, 20 bp, Homo sapiens
ctgaaccctgtgctggtgtc

SEQ ID NO: 3364058 - DNA, 20 bp, Homo sapiens
ctgaacccttgtgcttggtg

SEQ ID NO: 3364059 - DNA, 19 bp, Homo sapiens
ctgaaccgcacagctcagg

SEQ ID NO: 3364060 - DNA, 23 bp, Homo sapiens
ctgaacgcagaagaaagggtgga

SEQ ID NO: 3364061 - DNA, 18 bp, Homo sapiens
ctgaactcaaactgagga

SEQ ID NO: 3364062 - DNA, 17 bp, Homo sapiens
ctgaactcttcagaaca

SEQ ID NO: 3364063 - DNA, 13 bp, Homo sapiens
ctgaactgaacac

SEQ ID NO: 3364064 - DNA, 23 bp, Homo sapiens
ctgaactttcattggatttttgt

SEQ ID NO: 3364065 - DNA, 14 bp, Homo sapiens
ctgaactttggaga

SEQ ID NO: 3364066 - DNA, 23 bp, Homo sapiens
ctgaagacaccgttcattcaggc

SEQ ID NO: 3364067 - DNA, 17 bp, Homo sapiens
ctgaagaccatggattt

SEQ ID NO: 3364068 - DNA, 16 bp, Homo sapiens
ctgaagacctcgagca

SEQ ID NO: 3364069 - DNA, 23 bp, Homo sapiens
ctgaagacgccgtctccatggca

SEQ ID NO: 3364070 - DNA, 21 bp, Homo sapiens
ctgaagactcattcttctgta

SEQ ID NO: 3364071 - DNA, 15 bp, Homo sapiens
ctgaagactgagaac

SEQ ID NO: 3364072 - DNA, 20 bp, Homo sapiens
ctgaagaggaagaggaggag

SEQ ID NO: 3364073 - DNA, 19 bp, Homo sapiens
ctgaagaggcgggccagcc

SEQ ID NO: 3364074 - DNA, 18 bp, Homo sapiens
ctgaagaggcttctcctg

SEQ ID NO: 3364075 - DNA, 20 bp, Homo sapiens
ctgaagagtatccttccttc

SEQ ID NO: 3364076 - DNA, 21 bp, Homo sapiens
ctgaagagtatccttccttca

SEQ ID NO: 3364077 - DNA, 14 bp, Homo sapiens
ctgaagatatattt

SEQ ID NO: 3364078 - DNA, 17 bp, Homo sapiens
ctgaagatgatcatttg

SEQ ID NO: 3364079 - DNA, 20 bp, Homo sapiens
ctgaagcagcctctccccag

SEQ ID NO: 3364080 - DNA, 20 bp, Homo sapiens
ctgaagcatgtttcatgttt

SEQ ID NO: 3364081 - DNA, 14 bp, Homo sapiens
ctgaagccaaatga

SEQ ID NO: 3364082 - DNA, 16 bp, Homo sapiens
ctgaagccaaatgaaa

SEQ ID NO: 3364083 - DNA, 17 bp, Homo sapiens
ctgaagccagccttctt

SEQ ID NO: 3364084 - DNA, 21 bp, Homo sapiens
ctgaagcttcactcactgtca

SEQ ID NO: 3364085 - DNA, 15 bp, Homo sapiens
ctgaagcttgactcc

SEQ ID NO: 3364086 - DNA, 21 bp, Homo sapiens
ctgaagcttgactcccaagtt

SEQ ID NO: 3364087 - DNA, 14 bp, Homo sapiens
ctgaaggaagagaa

SEQ ID NO: 3364088 - DNA, 23 bp, Homo sapiens
ctgaaggacattgcggacagcca

SEQ ID NO: 3364089 - DNA, 14 bp, Homo sapiens
ctgaaggattctgg

SEQ ID NO: 3364090 - DNA, 17 bp, Homo sapiens
ctgaaggcagtggcagg

SEQ ID NO: 3364091 - DNA, 20 bp, Homo sapiens
ctgaagggcattctttccca

SEQ ID NO: 3364092 - DNA, 22 bp, Homo sapiens
ctgaaggggcacaccactgccc

SEQ ID NO: 3364093 - DNA, 17 bp, Homo sapiens
ctgaagtactaacacaa

SEQ ID NO: 3364094 - DNA, 15 bp, Homo sapiens
ctgaagtcacacagt

SEQ ID NO: 3364095 - DNA, 17 bp, Homo sapiens
ctgaagtcacacagtga

SEQ ID NO: 3364096 - DNA, 19 bp, Homo sapiens
ctgaagtcacacagtgagt

SEQ ID NO: 3364097 - DNA, 22 bp, Homo sapiens
ctgaagtcagcgggcccaggcc

SEQ ID NO: 3364098 - DNA, 23 bp, Homo sapiens
ctgaagtcagcgggcccaggcct

SEQ ID NO: 3364099 - DNA, 21 bp, Homo sapiens
ctgaagtgagcacagcctagg

SEQ ID NO: 3364100 - DNA, 23 bp, Homo sapiens
ctgaagtttttttgctgctgcct

SEQ ID NO: 3364101 - DNA, 15 bp, Homo sapiens
ctgaataatttctta

SEQ ID NO: 3364102 - DNA, 13 bp, Homo sapiens
ctgaataccactt

SEQ ID NO: 3364103 - DNA, 14 bp, Homo sapiens
ctgaataccactta

SEQ ID NO: 3364104 - DNA, 18 bp, Homo sapiens
ctgaataccacttacctc

SEQ ID NO: 3364105 - DNA, 19 bp, Homo sapiens
ctgaataccacttacctca

SEQ ID NO: 3364106 - DNA, 21 bp, Homo sapiens
ctgaatatctgttcacttttc

SEQ ID NO: 3364107 - DNA, 17 bp, Homo sapiens
ctgaatattttggaaac

SEQ ID NO: 3364108 - DNA, 19 bp, Homo sapiens
ctgaatattttggaaactg

SEQ ID NO: 3364109 - DNA, 12 bp, Homo sapiens
ctgaatattttt

SEQ ID NO: 3364110 - DNA, 22 bp, Homo sapiens
ctgaatattttttatttctaag

SEQ ID NO: 3364111 - DNA, 20 bp, Homo sapiens
ctgaatccaaactaatccat

SEQ ID NO: 3364112 - DNA, 14 bp, Homo sapiens
ctgaatccacctcg

SEQ ID NO: 3364113 - DNA, 18 bp, Homo sapiens
ctgaatccacctcggagc

SEQ ID NO: 3364114 - DNA, 19 bp, Homo sapiens
ctgaatccacctcggagca

SEQ ID NO: 3364115 - DNA, 12 bp, Homo sapiens
ctgaatctcata

SEQ ID NO: 3364116 - DNA, 18 bp, Homo sapiens
ctgaatctgtgcaaacag

SEQ ID NO: 3364117 - DNA, 18 bp, Homo sapiens
ctgaatgaaaataactga

SEQ ID NO: 3364118 - DNA, 19 bp, Homo sapiens
ctgaatgaaaataactgaa

SEQ ID NO: 3364119 - DNA, 17 bp, Homo sapiens
ctgaatgaaatatcaga

SEQ ID NO: 3364120 - DNA, 18 bp, Homo sapiens
ctgaatgcctcctgtggg

SEQ ID NO: 3364121 - DNA, 20 bp, Homo sapiens
ctgaatgcctcctgtgggga

SEQ ID NO: 3364122 - DNA, 20 bp, Homo sapiens
ctgaatgcctcgctcccttc

SEQ ID NO: 3364123 - DNA, 17 bp, Homo sapiens
ctgaatgctctgtgcga

SEQ ID NO: 3364124 - DNA, 22 bp, Homo sapiens
ctgaatggaaggtttgtatatt

SEQ ID NO: 3364125 - DNA, 20 bp, Homo sapiens
ctgaatgtaaaagaaaattt

SEQ ID NO: 3364126 - DNA, 13 bp, Homo sapiens
ctgaatgtaattt

SEQ ID NO: 3364127 - DNA, 17 bp, Homo sapiens
ctgaatgtaatttgtgt

SEQ ID NO: 3364128 - DNA, 13 bp, Homo sapiens
ctgaatgtattta

SEQ ID NO: 3364129 - DNA, 14 bp, Homo sapiens
ctgaatgtatttat

SEQ ID NO: 3364130 - DNA, 16 bp, Homo sapiens
ctgaatgtatttatgt

SEQ ID NO: 3364131 - DNA, 20 bp, Homo sapiens
ctgaatgtatttatgtgtat

SEQ ID NO: 3364132 - DNA, 22 bp, Homo sapiens
ctgaatgtgcctaatggagaag

SEQ ID NO: 3364133 - DNA, 17 bp, Homo sapiens
ctgaatgtgctgatcat

SEQ ID NO: 3364134 - DNA, 14 bp, Homo sapiens
ctgaatgttctgac

SEQ ID NO: 3364135 - DNA, 16 bp, Homo sapiens
ctgaatgttctgacat

SEQ ID NO: 3364136 - DNA, 17 bp, Homo sapiens
ctgaatgttctgacatt

SEQ ID NO: 3364137 - DNA, 18 bp, Homo sapiens
ctgaatgttctgacatta

SEQ ID NO: 3364138 - DNA, 19 bp, Homo sapiens
ctgaatgttctgacattaa

SEQ ID NO: 3364139 - DNA, 22 bp, Homo sapiens
ctgaatgtttaaagatcatgac

SEQ ID NO: 3364140 - DNA, 14 bp, Homo sapiens
ctgaattaaataaa

SEQ ID NO: 3364141 - DNA, 22 bp, Homo sapiens
ctgaattacagtgaaattttgg

SEQ ID NO: 3364142 - DNA, 17 bp, Homo sapiens
ctgaattcaaagcttgt

SEQ ID NO: 3364143 - DNA, 18 bp, Homo sapiens
ctgaattcaaagcttgtg

SEQ ID NO: 3364144 - DNA, 19 bp, Homo sapiens
ctgaattcaaagcttgtga

SEQ ID NO: 3364145 - DNA, 21 bp, Homo sapiens
ctgaattgcccgtttccatac

SEQ ID NO: 3364146 - DNA, 14 bp, Homo sapiens
ctgacaaatatttt

SEQ ID NO: 3364147 - DNA, 15 bp, Homo sapiens
ctgacaaatatttta

SEQ ID NO: 3364148 - DNA, 21 bp, Homo sapiens
ctgacaaatattttagaagct

SEQ ID NO: 3364149 - DNA, 15 bp, Homo sapiens
ctgacaaatgtgtat

SEQ ID NO: 3364150 - DNA, 20 bp, Homo sapiens
ctgacaaccactggtctgta

SEQ ID NO: 3364151 - DNA, 18 bp, Homo sapiens
ctgacaaccattaaagtc

SEQ ID NO: 3364152 - DNA, 13 bp, Homo sapiens
ctgacaagggctg

SEQ ID NO: 3364153 - DNA, 14 bp, Homo sapiens
ctgacaagggctga

SEQ ID NO: 3364154 - DNA, 15 bp, Homo sapiens
ctgacaatggcagct

SEQ ID NO: 3364155 - DNA, 16 bp, Homo sapiens
ctgacaatggcagcta

SEQ ID NO: 3364156 - DNA, 18 bp, Homo sapiens
ctgacacaaaaaaagttg

SEQ ID NO: 3364157 - DNA, 12 bp, Homo sapiens
ctgacacaaagg

SEQ ID NO: 3364158 - DNA, 13 bp, Homo sapiens
ctgacacaaagga

SEQ ID NO: 3364159 - DNA, 14 bp, Homo sapiens
ctgacacaaaggaa

SEQ ID NO: 3364160 - DNA, 15 bp, Homo sapiens
ctgacacaaaggaag

SEQ ID NO: 3364161 - DNA, 13 bp, Homo sapiens
ctgacacacagct

SEQ ID NO: 3364162 - DNA, 15 bp, Homo sapiens
ctgacacacagctct

SEQ ID NO: 3364163 - DNA, 19 bp, Homo sapiens
ctgacacacagctctgtcc

SEQ ID NO: 3364164 - DNA, 20 bp, Homo sapiens
ctgacacacagctctgtcct

SEQ ID NO: 3364165 - DNA, 21 bp, Homo sapiens
ctgacacacagctctgtcctg

SEQ ID NO: 3364166 - DNA, 23 bp, Homo sapiens
ctgacacacagctctgtcctggg

SEQ ID NO: 3364167 - DNA, 17 bp, Homo sapiens
ctgacacaccaggcgct

SEQ ID NO: 3364168 - DNA, 19 bp, Homo sapiens
ctgacacaccaggcgctaa

SEQ ID NO: 3364169 - DNA, 22 bp, Homo sapiens
ctgacacactaaccaagctgag

SEQ ID NO: 3364170 - DNA, 10 bp, Homo sapiens
ctgacacagg

SEQ ID NO: 3364171 - DNA, 21 bp, Homo sapiens
ctgacacaggaaaccaacacc

SEQ ID NO: 3364172 - DNA, 15 bp, Homo sapiens
ctgacacctaccatg

SEQ ID NO: 3364173 - DNA, 17 bp, Homo sapiens
ctgacacctaccatgct

SEQ ID NO: 3364174 - DNA, 17 bp, Homo sapiens
ctgacactaaccagagt

SEQ ID NO: 3364175 - DNA, 17 bp, Homo sapiens
ctgacagacacaggccc

SEQ ID NO: 3364176 - DNA, 18 bp, Homo sapiens
ctgacagacacaggcccg

SEQ ID NO: 3364177 - DNA, 19 bp, Homo sapiens
ctgacagacacaggcccgg

SEQ ID NO: 3364178 - DNA, 12 bp, Homo sapiens
ctgacagcctcc

SEQ ID NO: 3364179 - DNA, 13 bp, Homo sapiens
ctgacagcctccc

SEQ ID NO: 3364180 - DNA, 17 bp, Homo sapiens
ctgacagctcttcacag

SEQ ID NO: 3364181 - DNA, 16 bp, Homo sapiens
ctgacaggcaatgctg

SEQ ID NO: 3364182 - DNA, 18 bp, Homo sapiens
ctgacaggcaatgctggc

SEQ ID NO: 3364183 - DNA, 21 bp, Homo sapiens
ctgacaggtgaggtctgttcc

SEQ ID NO: 3364184 - DNA, 14 bp, Homo sapiens
ctgacatagagaaa

SEQ ID NO: 3364185 - DNA, 16 bp, Homo sapiens
ctgacatattatgcct

SEQ ID NO: 3364186 - DNA, 20 bp, Homo sapiens
ctgacatattatgcctgaat

SEQ ID NO: 3364187 - DNA, 22 bp, Homo sapiens
ctgacatattatgcctgaatga

SEQ ID NO: 3364188 - DNA, 14 bp, Homo sapiens
ctgacatcacagca

SEQ ID NO: 3364189 - DNA, 17 bp, Homo sapiens
ctgacatcacagcagcc

SEQ ID NO: 3364190 - DNA, 12 bp, Homo sapiens
ctgacatccctt

SEQ ID NO: 3364191 - DNA, 14 bp, Homo sapiens
ctgacatcccttcc

SEQ ID NO: 3364192 - DNA, 17 bp, Homo sapiens
ctgacatcccttcctgg

SEQ ID NO: 3364193 - DNA, 19 bp, Homo sapiens
ctgacatcccttcctggaa

SEQ ID NO: 3364194 - DNA, 23 bp, Homo sapiens
ctgacatgaagctgttgtgtgag

SEQ ID NO: 3364195 - DNA, 14 bp, Homo sapiens
ctgacatggctctg

SEQ ID NO: 3364196 - DNA, 19 bp, Homo sapiens
ctgacatgtggggccaggt

SEQ ID NO: 3364197 - DNA, 14 bp, Homo sapiens
ctgacattaacagt

SEQ ID NO: 3364198 - DNA, 20 bp, Homo sapiens
ctgacattaacagttttcca

SEQ ID NO: 3364199 - DNA, 17 bp, Homo sapiens
ctgacattgttggccaa

SEQ ID NO: 3364200 - DNA, 21 bp, Homo sapiens
ctgacattgttggccaaagcc

SEQ ID NO: 3364201 - DNA, 18 bp, Homo sapiens
ctgaccaacaggctgttc

SEQ ID NO: 3364202 - DNA, 15 bp, Homo sapiens
ctgaccatgctcatc

SEQ ID NO: 3364203 - DNA, 20 bp, Homo sapiens
ctgaccatgctcatctgctg

SEQ ID NO: 3364204 - DNA, 21 bp, Homo sapiens
ctgaccatgctcatctgctgg

SEQ ID NO: 3364205 - DNA, 18 bp, Homo sapiens
ctgaccatttcaggggtc

SEQ ID NO: 3364206 - DNA, 14 bp, Homo sapiens
ctgacccactgctt

SEQ ID NO: 3364207 - DNA, 21 bp, Homo sapiens
ctgacccagattcccttccgg

SEQ ID NO: 3364208 - DNA, 13 bp, Homo sapiens
ctgacccagcatc

SEQ ID NO: 3364209 - DNA, 18 bp, Homo sapiens
ctgacccagcatctccca

SEQ ID NO: 3364210 - DNA, 13 bp, Homo sapiens
ctgacccaggccg

SEQ ID NO: 3364211 - DNA, 16 bp, Homo sapiens
ctgacccaggccgcag

SEQ ID NO: 3364212 - DNA, 19 bp, Homo sapiens
ctgacccaggccgcagctc

SEQ ID NO: 3364213 - DNA, 13 bp, Homo sapiens
ctgacccagtgag

SEQ ID NO: 3364214 - DNA, 21 bp, Homo sapiens
ctgaccccagtggtatcctgt

SEQ ID NO: 3364215 - DNA, 12 bp, Homo sapiens
ctgacccctcct

SEQ ID NO: 3364216 - DNA, 15 bp, Homo sapiens
ctgacccctcctcac

SEQ ID NO: 3364217 - DNA, 14 bp, Homo sapiens
ctgacccctgctca

SEQ ID NO: 3364218 - DNA, 14 bp, Homo sapiens
ctgacccttccaga

SEQ ID NO: 3364219 - DNA, 15 bp, Homo sapiens
ctgacccttccagac

SEQ ID NO: 3364220 - DNA, 16 bp, Homo sapiens
ctgacccttccagaca

SEQ ID NO: 3364221 - DNA, 20 bp, Homo sapiens
ctgacccttgggcctgggcc

SEQ ID NO: 3364222 - DNA, 17 bp, Homo sapiens
ctgacctcaagtgatct

SEQ ID NO: 3364223 - DNA, 23 bp, Homo sapiens
ctgacctcccagccctatggatg

SEQ ID NO: 3364224 - DNA, 21 bp, Homo sapiens
ctgacctccctctaatttatc

SEQ ID NO: 3364225 - DNA, 14 bp, Homo sapiens
ctgacctcttgctg

SEQ ID NO: 3364226 - DNA, 22 bp, Homo sapiens
ctgacctcttgctgtctctgct

SEQ ID NO: 3364227 - DNA, 14 bp, Homo sapiens
ctgacctgcactgg

SEQ ID NO: 3364228 - DNA, 14 bp, Homo sapiens
ctgacctgcctctc

SEQ ID NO: 3364229 - DNA, 22 bp, Homo sapiens
ctgacctgcctctcacacacat

SEQ ID NO: 3364230 - DNA, 20 bp, Homo sapiens
ctgacctgtcatgcccccct

SEQ ID NO: 3364231 - DNA, 20 bp, Homo sapiens
ctgaccttggagagacacag

SEQ ID NO: 3364232 - DNA, 21 bp, Homo sapiens
ctgaccttggctgactggggc

SEQ ID NO: 3364233 - DNA, 13 bp, Homo sapiens
ctgacgccctgcg

SEQ ID NO: 3364234 - DNA, 14 bp, Homo sapiens
ctgacgccctgcgt

SEQ ID NO: 3364235 - DNA, 15 bp, Homo sapiens
ctgacggccctgcaa

SEQ ID NO: 3364236 - DNA, 14 bp, Homo sapiens
ctgacggcgccccc

SEQ ID NO: 3364237 - DNA, 23 bp, Homo sapiens
ctgacgtctgaagcttgactccc

SEQ ID NO: 3364238 - DNA, 17 bp, Homo sapiens
ctgacgtgccttttgca

SEQ ID NO: 3364239 - DNA, 23 bp, Homo sapiens
ctgacgtgccttttgcacccctc

SEQ ID NO: 3364240 - DNA, 22 bp, Homo sapiens
ctgactaaaaatacttaaattt

SEQ ID NO: 3364241 - DNA, 15 bp, Homo sapiens
ctgactaaacttttt

SEQ ID NO: 3364242 - DNA, 17 bp, Homo sapiens
ctgactactggctctca

SEQ ID NO: 3364243 - DNA, 17 bp, Homo sapiens
ctgactagtagatttct

SEQ ID NO: 3364244 - DNA, 17 bp, Homo sapiens
ctgactcaggcgcctgg

SEQ ID NO: 3364245 - DNA, 21 bp, Homo sapiens
ctgactcaggcgcctggcaca

SEQ ID NO: 3364246 - DNA, 14 bp, Homo sapiens
ctgactccagagtc

SEQ ID NO: 3364247 - DNA, 21 bp, Homo sapiens
ctgactcctacctgccctgga

SEQ ID NO: 3364248 - DNA, 16 bp, Homo sapiens
ctgactcggtttctcc

SEQ ID NO: 3364249 - DNA, 16 bp, Homo sapiens
ctgactctctgtgacc

SEQ ID NO: 3364250 - DNA, 18 bp, Homo sapiens
ctgactctctgtgacctg

SEQ ID NO: 3364251 - DNA, 15 bp, Homo sapiens
ctgactctgaaatct

SEQ ID NO: 3364252 - DNA, 20 bp, Homo sapiens
ctgactctgaaatctgaaga

SEQ ID NO: 3364253 - DNA, 22 bp, Homo sapiens
ctgactctttttggactcagcc

SEQ ID NO: 3364254 - DNA, 13 bp, Homo sapiens
ctgactgaatgca

SEQ ID NO: 3364255 - DNA, 14 bp, Homo sapiens
ctgactgaatgcag

SEQ ID NO: 3364256 - DNA, 17 bp, Homo sapiens
ctgactgccaagccaga

SEQ ID NO: 3364257 - DNA, 18 bp, Homo sapiens
ctgactgccaagccagat

SEQ ID NO: 3364258 - DNA, 20 bp, Homo sapiens
ctgactgccaagccagattc

SEQ ID NO: 3364259 - DNA, 21 bp, Homo sapiens
ctgactgcccgctcctcggga

SEQ ID NO: 3364260 - DNA, 20 bp, Homo sapiens
ctgactggcaaaggaccagc

SEQ ID NO: 3364261 - DNA, 15 bp, Homo sapiens
ctgactggccagttg

SEQ ID NO: 3364262 - DNA, 20 bp, Homo sapiens
ctgactggccagttgcccag

SEQ ID NO: 3364263 - DNA, 21 bp, Homo sapiens
ctgactggccagttgcccaga

SEQ ID NO: 3364264 - DNA, 17 bp, Homo sapiens
ctgactgtactcctccc

SEQ ID NO: 3364265 - DNA, 21 bp, Homo sapiens
ctgactgtcctctcccctcca

SEQ ID NO: 3364266 - DNA, 13 bp, Homo sapiens
ctgactgtggccc

SEQ ID NO: 3364267 - DNA, 19 bp, Homo sapiens
ctgactgtggccccctccg

SEQ ID NO: 3364268 - DNA, 14 bp, Homo sapiens
ctgactgttcttgg

SEQ ID NO: 3364269 - DNA, 15 bp, Homo sapiens
ctgactgttcttggt

SEQ ID NO: 3364270 - DNA, 20 bp, Homo sapiens
ctgacttaagcaaaagaaaa

SEQ ID NO: 3364271 - DNA, 22 bp, Homo sapiens
ctgacttcatggaatggacatc

SEQ ID NO: 3364272 - DNA, 22 bp, Homo sapiens
ctgacttccccaaacccagaaa

SEQ ID NO: 3364273 - DNA, 14 bp, Homo sapiens
ctgacttgagtgtt

SEQ ID NO: 3364274 - DNA, 12 bp, Homo sapiens
ctgacttgcttt

SEQ ID NO: 3364275 - DNA, 14 bp, Homo sapiens
ctgacttggcactt

SEQ ID NO: 3364276 - DNA, 22 bp, Homo sapiens
ctgacttggggagatggagttc

SEQ ID NO: 3364277 - DNA, 13 bp, Homo sapiens
ctgactttctccc

SEQ ID NO: 3364278 - DNA, 14 bp, Homo sapiens
ctgactttctcccc

SEQ ID NO: 3364279 - DNA, 10 bp, Homo sapiens
ctgagaaaag

SEQ ID NO: 3364280 - DNA, 23 bp, Homo sapiens
ctgagaaaatgagtgactagacg

SEQ ID NO: 3364281 - DNA, 17 bp, Homo sapiens
ctgagaaaggtgaggag

SEQ ID NO: 3364282 - DNA, 16 bp, Homo sapiens
ctgagaactcctgact

SEQ ID NO: 3364283 - DNA, 21 bp, Homo sapiens
ctgagaagaggagccctcatc

SEQ ID NO: 3364284 - DNA, 13 bp, Homo sapiens
ctgagaagcaaac

SEQ ID NO: 3364285 - DNA, 16 bp, Homo sapiens
ctgagaagctctgaag

SEQ ID NO: 3364286 - DNA, 17 bp, Homo sapiens
ctgagaagctgctccag

SEQ ID NO: 3364287 - DNA, 19 bp, Homo sapiens
ctgagacacgatgccgaga

SEQ ID NO: 3364288 - DNA, 14 bp, Homo sapiens
ctgagaccacagag

SEQ ID NO: 3364289 - DNA, 16 bp, Homo sapiens
ctgagaccatttaaca

SEQ ID NO: 3364290 - DNA, 22 bp, Homo sapiens
ctgagacgggcatcgcaggagt

SEQ ID NO: 3364291 - DNA, 14 bp, Homo sapiens
ctgagactccagaa

SEQ ID NO: 3364292 - DNA, 17 bp, Homo sapiens
ctgagactccagaatct

SEQ ID NO: 3364293 - DNA, 21 bp, Homo sapiens
ctgagactccagaatctgctg

SEQ ID NO: 3364294 - DNA, 12 bp, Homo sapiens
ctgagagaaata

SEQ ID NO: 3364295 - DNA, 12 bp, Homo sapiens
ctgagagccctg

SEQ ID NO: 3364296 - DNA, 16 bp, Homo sapiens
ctgagagccctgctgt

SEQ ID NO: 3364297 - DNA, 19 bp, Homo sapiens
ctgagagccctgctgtggg

SEQ ID NO: 3364298 - DNA, 20 bp, Homo sapiens
ctgagagccctgctgtggga

SEQ ID NO: 3364299 - DNA, 21 bp, Homo sapiens
ctgagaggacttttctttgtg

SEQ ID NO: 3364300 - DNA, 22 bp, Homo sapiens
ctgagaggacttttctttgtgg

SEQ ID NO: 3364301 - DNA, 20 bp, Homo sapiens
ctgagagtatttaggcagat

SEQ ID NO: 3364302 - DNA, 15 bp, Homo sapiens
ctgagagtctagatt

SEQ ID NO: 3364303 - DNA, 15 bp, Homo sapiens
ctgagatatgaacat

SEQ ID NO: 3364304 - DNA, 16 bp, Homo sapiens
ctgagatatgaacata

SEQ ID NO: 3364305 - DNA, 23 bp, Homo sapiens
ctgagatatgaacatattgttga

SEQ ID NO: 3364306 - DNA, 17 bp, Homo sapiens
ctgagatatggcattgc

SEQ ID NO: 3364307 - DNA, 19 bp, Homo sapiens
ctgagatatggcattgcac

SEQ ID NO: 3364308 - DNA, 20 bp, Homo sapiens
ctgagatatggcattgcact

SEQ ID NO: 3364309 - DNA, 21 bp, Homo sapiens
ctgagatcccctgagccccag

SEQ ID NO: 3364310 - DNA, 21 bp, Homo sapiens
ctgagatttcttaaatctttc

SEQ ID NO: 3364311 - DNA, 18 bp, Homo sapiens
ctgagatttttttgtgta

SEQ ID NO: 3364312 - DNA, 20 bp, Homo sapiens
ctgagatttttttgtgtatg

SEQ ID NO: 3364313 - DNA, 15 bp, Homo sapiens
ctgagcaaatgtggc

SEQ ID NO: 3364314 - DNA, 23 bp, Homo sapiens
ctgagcaacagagtgagaccctg

SEQ ID NO: 3364315 - DNA, 17 bp, Homo sapiens
ctgagcacactttagtg

SEQ ID NO: 3364316 - DNA, 12 bp, Homo sapiens
ctgagcacttag

SEQ ID NO: 3364317 - DNA, 15 bp, Homo sapiens
ctgagcacttagcag

SEQ ID NO: 3364318 - DNA, 20 bp, Homo sapiens
ctgagcacttagcaggcacc

SEQ ID NO: 3364319 - DNA, 11 bp, Homo sapiens
ctgagcagccg

SEQ ID NO: 3364320 - DNA, 13 bp, Homo sapiens
ctgagcagccgcc

SEQ ID NO: 3364321 - DNA, 17 bp, Homo sapiens
ctgagcagccgccagct

SEQ ID NO: 3364322 - DNA, 14 bp, Homo sapiens
ctgagcatcaagaa

SEQ ID NO: 3364323 - DNA, 20 bp, Homo sapiens
ctgagcatgatgggaatagg

SEQ ID NO: 3364324 - DNA, 22 bp, Homo sapiens
ctgagcattcgctgtacccttt

SEQ ID NO: 3364325 - DNA, 22 bp, Homo sapiens
ctgagccaaggaggcctgggga

SEQ ID NO: 3364326 - DNA, 15 bp, Homo sapiens
ctgagccactcgcag

SEQ ID NO: 3364327 - DNA, 13 bp, Homo sapiens
ctgagccagatta

SEQ ID NO: 3364328 - DNA, 15 bp, Homo sapiens
ctgagccagattaca

SEQ ID NO: 3364329 - DNA, 16 bp, Homo sapiens
ctgagccagattacag

SEQ ID NO: 3364330 - DNA, 21 bp, Homo sapiens
ctgagcccagctgcctggaga

SEQ ID NO: 3364331 - DNA, 22 bp, Homo sapiens
ctgagcccagctgcctggagag

SEQ ID NO: 3364332 - DNA, 20 bp, Homo sapiens
ctgagcccatgttctgcccc

SEQ ID NO: 3364333 - DNA, 15 bp, Homo sapiens
ctgagccccacctct

SEQ ID NO: 3364334 - DNA, 19 bp, Homo sapiens
ctgagccccagggtgccca

SEQ ID NO: 3364335 - DNA, 22 bp, Homo sapiens
ctgagcccccccaacactgtgc

SEQ ID NO: 3364336 - DNA, 14 bp, Homo sapiens
ctgagcccccggct

SEQ ID NO: 3364337 - DNA, 22 bp, Homo sapiens
ctgagcccccggctagtaccct

SEQ ID NO: 3364338 - DNA, 21 bp, Homo sapiens
ctgagccccgccctcttcctg

SEQ ID NO: 3364339 - DNA, 14 bp, Homo sapiens
ctgagcccgggctg

SEQ ID NO: 3364340 - DNA, 21 bp, Homo sapiens
ctgagcccgggctgcctgggc

SEQ ID NO: 3364341 - DNA, 20 bp, Homo sapiens
ctgagccctactccctgcag

SEQ ID NO: 3364342 - DNA, 21 bp, Homo sapiens
ctgagccctactccctgcaga

SEQ ID NO: 3364343 - DNA, 13 bp, Homo sapiens
ctgagccctggca

SEQ ID NO: 3364344 - DNA, 18 bp, Homo sapiens
ctgagccctggggactgt

SEQ ID NO: 3364345 - DNA, 23 bp, Homo sapiens
ctgagccctggggactgttccaa

SEQ ID NO: 3364346 - DNA, 17 bp, Homo sapiens
ctgagcctacagatgaa

SEQ ID NO: 3364347 - DNA, 14 bp, Homo sapiens
ctgagcctcacttg

SEQ ID NO: 3364348 - DNA, 15 bp, Homo sapiens
ctgagcctctgctcc

SEQ ID NO: 3364349 - DNA, 22 bp, Homo sapiens
ctgagcctggcccatagaaaca

SEQ ID NO: 3364350 - DNA, 14 bp, Homo sapiens
ctgagcctggccct

SEQ ID NO: 3364351 - DNA, 14 bp, Homo sapiens
ctgagcctgtgggt

SEQ ID NO: 3364352 - DNA, 16 bp, Homo sapiens
ctgagcctgtgggtcc

SEQ ID NO: 3364353 - DNA, 22 bp, Homo sapiens
ctgagcctgtgggtccccactc

SEQ ID NO: 3364354 - DNA, 15 bp, Homo sapiens
ctgagccttgtaatt

SEQ ID NO: 3364355 - DNA, 16 bp, Homo sapiens
ctgagccttgtaattc

SEQ ID NO: 3364356 - DNA, 22 bp, Homo sapiens
ctgagcgcctccatccaaggcc

SEQ ID NO: 3364357 - DNA, 21 bp, Homo sapiens
ctgagcggccgcagagactgg

SEQ ID NO: 3364358 - DNA, 18 bp, Homo sapiens
ctgagcgggaggcagagt

SEQ ID NO: 3364359 - DNA, 18 bp, Homo sapiens
ctgagcgtccagaaatgg

SEQ ID NO: 3364360 - DNA, 19 bp, Homo sapiens
ctgagctccccagatctcc

SEQ ID NO: 3364361 - DNA, 18 bp, Homo sapiens
ctgagctcctgctgcgga

SEQ ID NO: 3364362 - DNA, 20 bp, Homo sapiens
ctgagctgagaccactgagt

SEQ ID NO: 3364363 - DNA, 19 bp, Homo sapiens
ctgagctgagtggccagcc

SEQ ID NO: 3364364 - DNA, 10 bp, Homo sapiens
ctgagctggg

SEQ ID NO: 3364365 - DNA, 16 bp, Homo sapiens
ctgagctgggcccagc

SEQ ID NO: 3364366 - DNA, 20 bp, Homo sapiens
ctgagcttagccttgtgccc

SEQ ID NO: 3364367 - DNA, 21 bp, Homo sapiens
ctgagcttagccttgtgccct

SEQ ID NO: 3364368 - DNA, 20 bp, Homo sapiens
ctgagcttcggttctccaga

SEQ ID NO: 3364369 - DNA, 21 bp, Homo sapiens
ctgagcttcggttctccagaa

SEQ ID NO: 3364370 - DNA, 23 bp, Homo sapiens
ctgagcttcggttctccagaatg

SEQ ID NO: 3364371 - DNA, 14 bp, Homo sapiens
ctgagcttgtcttt

SEQ ID NO: 3364372 - DNA, 21 bp, Homo sapiens
ctgagcttgtcttttctgctg

SEQ ID NO: 3364373 - DNA, 21 bp, Homo sapiens
ctgagctttggggacagttgg

SEQ ID NO: 3364374 - DNA, 22 bp, Homo sapiens
ctgagctttggggacagttggc

SEQ ID NO: 3364375 - DNA, 20 bp, Homo sapiens
ctgagcttttcatggaagtg

SEQ ID NO: 3364376 - DNA, 20 bp, Homo sapiens
ctgaggaagcacagcagcat

SEQ ID NO: 3364377 - DNA, 21 bp, Homo sapiens
ctgaggaaggaggggaagctg

SEQ ID NO: 3364378 - DNA, 23 bp, Homo sapiens
ctgaggaaggaggggaagctgca

SEQ ID NO: 3364379 - DNA, 14 bp, Homo sapiens
ctgaggaatccaga

SEQ ID NO: 3364380 - DNA, 21 bp, Homo sapiens
ctgaggaatccagacccggct

SEQ ID NO: 3364381 - DNA, 16 bp, Homo sapiens
ctgaggaattttcttt

SEQ ID NO: 3364382 - DNA, 14 bp, Homo sapiens
ctgaggacaaagtg

SEQ ID NO: 3364383 - DNA, 15 bp, Homo sapiens
ctgaggacaaagtgg

SEQ ID NO: 3364384 - DNA, 21 bp, Homo sapiens
ctgaggacaccagtgaaagaa

SEQ ID NO: 3364385 - DNA, 14 bp, Homo sapiens
ctgaggactgattt

SEQ ID NO: 3364386 - DNA, 15 bp, Homo sapiens
ctgaggactggagac

SEQ ID NO: 3364387 - DNA, 17 bp, Homo sapiens
ctgaggagatgaccagg

SEQ ID NO: 3364388 - DNA, 21 bp, Homo sapiens
ctgaggagatgaccagggatg

SEQ ID NO: 3364389 - DNA, 17 bp, Homo sapiens
ctgaggatttcaagcct

SEQ ID NO: 3364390 - DNA, 12 bp, Homo sapiens
ctgaggcaagag

SEQ ID NO: 3364391 - DNA, 21 bp, Homo sapiens
ctgaggccaggacgtctgggg

SEQ ID NO: 3364392 - DNA, 12 bp, Homo sapiens
ctgaggcctgga

SEQ ID NO: 3364393 - DNA, 19 bp, Homo sapiens
ctgaggcctggactttcct

SEQ ID NO: 3364394 - DNA, 22 bp, Homo sapiens
ctgaggcctggactttcctgca

SEQ ID NO: 3364395 - DNA, 23 bp, Homo sapiens
ctgaggcctgggccgctgccacg

SEQ ID NO: 3364396 - DNA, 16 bp, Homo sapiens
ctgaggcctgtgcctg

SEQ ID NO: 3364397 - DNA, 20 bp, Homo sapiens
ctgaggctctttctgggcca

SEQ ID NO: 3364398 - DNA, 19 bp, Homo sapiens
ctgaggctgtggtcacagc

SEQ ID NO: 3364399 - DNA, 18 bp, Homo sapiens
ctgaggcttagagagagg

SEQ ID NO: 3364400 - DNA, 19 bp, Homo sapiens
ctgaggcttagagagagga

SEQ ID NO: 3364401 - DNA, 19 bp, Homo sapiens
ctgagggaagagtagctgt

SEQ ID NO: 3364402 - DNA, 20 bp, Homo sapiens
ctgagggaccaactgggccc

SEQ ID NO: 3364403 - DNA, 19 bp, Homo sapiens
ctgagggaggaggccacct

SEQ ID NO: 3364404 - DNA, 22 bp, Homo sapiens
ctgagggattgaggggccctgg

SEQ ID NO: 3364405 - DNA, 18 bp, Homo sapiens
ctgaggggcatctgcccc

SEQ ID NO: 3364406 - DNA, 18 bp, Homo sapiens
ctgaggtataaagacaag

SEQ ID NO: 3364407 - DNA, 15 bp, Homo sapiens
ctgaggtgggcccag

SEQ ID NO: 3364408 - DNA, 16 bp, Homo sapiens
ctgaggtgggcccagg

SEQ ID NO: 3364409 - DNA, 17 bp, Homo sapiens
ctgaggtgggcccagga

SEQ ID NO: 3364410 - DNA, 22 bp, Homo sapiens
ctgaggtgggcccaggaccagc

SEQ ID NO: 3364411 - DNA, 23 bp, Homo sapiens
ctgaggtgggcccaggaccagct

SEQ ID NO: 3364412 - DNA, 13 bp, Homo sapiens
ctgaggtgtgggg

SEQ ID NO: 3364413 - DNA, 16 bp, Homo sapiens
ctgaggtgtgggggct

SEQ ID NO: 3364414 - DNA, 18 bp, Homo sapiens
ctgaggtgtgggggctgc

SEQ ID NO: 3364415 - DNA, 19 bp, Homo sapiens
ctgaggtgtgggggctgca

SEQ ID NO: 3364416 - DNA, 18 bp, Homo sapiens
ctgaggttcctctgcctg

SEQ ID NO: 3364417 - DNA, 20 bp, Homo sapiens
ctgaggttcctctgcctgcc

SEQ ID NO: 3364418 - DNA, 22 bp, Homo sapiens
ctgagtacatattgtggtgatg

SEQ ID NO: 3364419 - DNA, 19 bp, Homo sapiens
ctgagtaccaggggctggg

SEQ ID NO: 3364420 - DNA, 21 bp, Homo sapiens
ctgagtaccaggggctgggct

SEQ ID NO: 3364421 - DNA, 20 bp, Homo sapiens
ctgagtagctgggattacag

SEQ ID NO: 3364422 - DNA, 18 bp, Homo sapiens
ctgagtatgtggaaggca

SEQ ID NO: 3364423 - DNA, 20 bp, Homo sapiens
ctgagtatgttaagctcttt

SEQ ID NO: 3364424 - DNA, 16 bp, Homo sapiens
ctgagtcacgctgggg

SEQ ID NO: 3364425 - DNA, 17 bp, Homo sapiens
ctgagtcagggcccaga

SEQ ID NO: 3364426 - DNA, 22 bp, Homo sapiens
ctgagtcagggcccagaggctg

SEQ ID NO: 3364427 - DNA, 21 bp, Homo sapiens
ctgagtccaagagggtccttt

SEQ ID NO: 3364428 - DNA, 18 bp, Homo sapiens
ctgagtccactgctccat

SEQ ID NO: 3364429 - DNA, 23 bp, Homo sapiens
ctgagtcctggtccctctgaggc

SEQ ID NO: 3364430 - DNA, 15 bp, Homo sapiens
ctgagtctcctgtgc

SEQ ID NO: 3364431 - DNA, 14 bp, Homo sapiens
ctgagtctgagtcc

SEQ ID NO: 3364432 - DNA, 16 bp, Homo sapiens
ctgagtctgagtcctg

SEQ ID NO: 3364433 - DNA, 22 bp, Homo sapiens
ctgagtctgagtcctgtctctg

SEQ ID NO: 3364434 - DNA, 15 bp, Homo sapiens
ctgagtgaacctgta

SEQ ID NO: 3364435 - DNA, 18 bp, Homo sapiens
ctgagtggcaggggacag

SEQ ID NO: 3364436 - DNA, 15 bp, Homo sapiens
ctgagtggccagcca

SEQ ID NO: 3364437 - DNA, 18 bp, Homo sapiens
ctgagtggccagccagtg

SEQ ID NO: 3364438 - DNA, 20 bp, Homo sapiens
ctgagtggccagccagtgcc

SEQ ID NO: 3364439 - DNA, 15 bp, Homo sapiens
ctgagtggcgcaagg

SEQ ID NO: 3364440 - DNA, 14 bp, Homo sapiens
ctgagtggggagca

SEQ ID NO: 3364441 - DNA, 16 bp, Homo sapiens
ctgagtggtggttcct

SEQ ID NO: 3364442 - DNA, 19 bp, Homo sapiens
ctgagtggtggttcctttg

SEQ ID NO: 3364443 - DNA, 18 bp, Homo sapiens
ctgagtgtgggcttctga

SEQ ID NO: 3364444 - DNA, 21 bp, Homo sapiens
ctgagttacttgtctgaggcc

SEQ ID NO: 3364445 - DNA, 19 bp, Homo sapiens
ctgagttctggtcaaagaa

SEQ ID NO: 3364446 - DNA, 18 bp, Homo sapiens
ctgagttgccaagacaaa

SEQ ID NO: 3364447 - DNA, 15 bp, Homo sapiens
ctgagttggagctca

SEQ ID NO: 3364448 - DNA, 22 bp, Homo sapiens
ctgagttgggcaaaacccagga

SEQ ID NO: 3364449 - DNA, 15 bp, Homo sapiens
ctgagtttaccattt

SEQ ID NO: 3364450 - DNA, 19 bp, Homo sapiens
ctgagtttaccatttgtaa

SEQ ID NO: 3364451 - DNA, 20 bp, Homo sapiens
ctgagtttaccatttgtaat

SEQ ID NO: 3364452 - DNA, 18 bp, Homo sapiens
ctgagtttatattctgaa

SEQ ID NO: 3364453 - DNA, 20 bp, Homo sapiens
ctgagtttatattctgaaag

SEQ ID NO: 3364454 - DNA, 19 bp, Homo sapiens
ctgagtttcctatgggaac

SEQ ID NO: 3364455 - DNA, 21 bp, Homo sapiens
ctgagttttctctttgtgggg

SEQ ID NO: 3364456 - DNA, 15 bp, Homo sapiens
ctgataccactgcac

SEQ ID NO: 3364457 - DNA, 16 bp, Homo sapiens
ctgatataaattctgt

SEQ ID NO: 3364458 - DNA, 13 bp, Homo sapiens
ctgatataatatc

SEQ ID NO: 3364459 - DNA, 15 bp, Homo sapiens
ctgatatgggactga

SEQ ID NO: 3364460 - DNA, 17 bp, Homo sapiens
ctgatattaatcaaaat

SEQ ID NO: 3364461 - DNA, 21 bp, Homo sapiens
ctgatattaatcaaaattgtc

SEQ ID NO: 3364462 - DNA, 22 bp, Homo sapiens
ctgatattgccgcactagggga

SEQ ID NO: 3364463 - DNA, 22 bp, Homo sapiens
ctgatcaagtcaccggagcttt

SEQ ID NO: 3364464 - DNA, 15 bp, Homo sapiens
ctgatcacccaatgc

SEQ ID NO: 3364465 - DNA, 17 bp, Homo sapiens
ctgatcactcccagcac

SEQ ID NO: 3364466 - DNA, 14 bp, Homo sapiens
ctgatcacttcatg

SEQ ID NO: 3364467 - DNA, 20 bp, Homo sapiens
ctgatcagaggtgtacacta

SEQ ID NO: 3364468 - DNA, 15 bp, Homo sapiens
ctgatcatgcattgt

SEQ ID NO: 3364469 - DNA, 16 bp, Homo sapiens
ctgatcatgcattgtt

SEQ ID NO: 3364470 - DNA, 20 bp, Homo sapiens
ctgatcccattttcctctga

SEQ ID NO: 3364471 - DNA, 18 bp, Homo sapiens
ctgatcgacgtggtgacg

SEQ ID NO: 3364472 - DNA, 18 bp, Homo sapiens
ctgatcgatttctttcct

SEQ ID NO: 3364473 - DNA, 20 bp, Homo sapiens
ctgatcgccaacctttcccc

SEQ ID NO: 3364474 - DNA, 15 bp, Homo sapiens
ctgatcgtagaaaat

SEQ ID NO: 3364475 - DNA, 17 bp, Homo sapiens
ctgatcgtagaaaattt

SEQ ID NO: 3364476 - DNA, 21 bp, Homo sapiens
ctgatcgtgctaaattttcag

SEQ ID NO: 3364477 - DNA, 23 bp, Homo sapiens
ctgatctctactaccacaaggaa

SEQ ID NO: 3364478 - DNA, 21 bp, Homo sapiens
ctgatgaaactcacaaatgat

SEQ ID NO: 3364479 - DNA, 21 bp, Homo sapiens
ctgatgacacccaccctgtgc

SEQ ID NO: 3364480 - DNA, 19 bp, Homo sapiens
ctgatgatcaaaacctgtg

SEQ ID NO: 3364481 - DNA, 20 bp, Homo sapiens
ctgatgatttgtttttgtat

SEQ ID NO: 3364482 - DNA, 21 bp, Homo sapiens
ctgatgcaaggattacagaaa

SEQ ID NO: 3364483 - DNA, 19 bp, Homo sapiens
ctgatgccaatactagtca

SEQ ID NO: 3364484 - DNA, 12 bp, Homo sapiens
ctgatgctccct

SEQ ID NO: 3364485 - DNA, 21 bp, Homo sapiens
ctgatgctccctcccctgccc

SEQ ID NO: 3364486 - DNA, 22 bp, Homo sapiens
ctgatgctccctcccctgccct

SEQ ID NO: 3364487 - DNA, 13 bp, Homo sapiens
ctgatgctgcccc

SEQ ID NO: 3364488 - DNA, 13 bp, Homo sapiens
ctgatgcttgaag

SEQ ID NO: 3364489 - DNA, 20 bp, Homo sapiens
ctgatggaccgggtgggcct

SEQ ID NO: 3364490 - DNA, 21 bp, Homo sapiens
ctgatggaccgggtgggcctg

SEQ ID NO: 3364491 - DNA, 23 bp, Homo sapiens
ctgatggaccgggtgggcctggc

SEQ ID NO: 3364492 - DNA, 17 bp, Homo sapiens
ctgatggaggaaaaagg

SEQ ID NO: 3364493 - DNA, 15 bp, Homo sapiens
ctgatggccaagagc

SEQ ID NO: 3364494 - DNA, 17 bp, Homo sapiens
ctgatggccaagggggt

SEQ ID NO: 3364495 - DNA, 12 bp, Homo sapiens
ctgatggctgcc

SEQ ID NO: 3364496 - DNA, 18 bp, Homo sapiens
ctgatggctgctagattt

SEQ ID NO: 3364497 - DNA, 19 bp, Homo sapiens
ctgatggctgctagatttt

SEQ ID NO: 3364498 - DNA, 23 bp, Homo sapiens
ctgatggctgctagattttaatt

SEQ ID NO: 3364499 - DNA, 14 bp, Homo sapiens
ctgatggcttgaca

SEQ ID NO: 3364500 - DNA, 16 bp, Homo sapiens
ctgatggcttgacatg

SEQ ID NO: 3364501 - DNA, 19 bp, Homo sapiens
ctgatggcttgacatgtgc

SEQ ID NO: 3364502 - DNA, 23 bp, Homo sapiens
ctgatggcttgacatgtgcaatt

SEQ ID NO: 3364503 - DNA, 22 bp, Homo sapiens
ctgatgggaaaactgccaatat

SEQ ID NO: 3364504 - DNA, 18 bp, Homo sapiens
ctgatgggcaacccccag

SEQ ID NO: 3364505 - DNA, 24 bp, Homo sapiens
ctgatgggcaacccccagcctgct

SEQ ID NO: 3364506 - DNA, 14 bp, Homo sapiens
ctgatggtcagctc

SEQ ID NO: 3364507 - DNA, 15 bp, Homo sapiens
ctgatggtgagctgg

SEQ ID NO: 3364508 - DNA, 13 bp, Homo sapiens
ctgatgtatcctt

SEQ ID NO: 3364509 - DNA, 20 bp, Homo sapiens
ctgatgtcaatttctgtgtt

SEQ ID NO: 3364510 - DNA, 12 bp, Homo sapiens
ctgatgtctcta

SEQ ID NO: 3364511 - DNA, 20 bp, Homo sapiens
ctgatgtgtcctcagggagc

SEQ ID NO: 3364512 - DNA, 16 bp, Homo sapiens
ctgatgttactagcct

SEQ ID NO: 3364513 - DNA, 17 bp, Homo sapiens
ctgatgttactagcctc

SEQ ID NO: 3364514 - DNA, 15 bp, Homo sapiens
ctgatgttggaagag

SEQ ID NO: 3364515 - DNA, 21 bp, Homo sapiens
ctgattaagttgtctaaacaa

SEQ ID NO: 3364516 - DNA, 16 bp, Homo sapiens
ctgattacctgccaat

SEQ ID NO: 3364517 - DNA, 14 bp, Homo sapiens
ctgattatgtcttt

SEQ ID NO: 3364518 - DNA, 20 bp, Homo sapiens
ctgattattgagttccagtt

SEQ ID NO: 3364519 - DNA, 13 bp, Homo sapiens
ctgattcactgca

SEQ ID NO: 3364520 - DNA, 15 bp, Homo sapiens
ctgattcccaagctc

SEQ ID NO: 3364521 - DNA, 15 bp, Homo sapiens
ctgattcccctccac

SEQ ID NO: 3364522 - DNA, 22 bp, Homo sapiens
ctgattctggctttaagccttc

SEQ ID NO: 3364523 - DNA, 16 bp, Homo sapiens
ctgattctgggatgct

SEQ ID NO: 3364524 - DNA, 16 bp, Homo sapiens
ctgattgacctgctcc

SEQ ID NO: 3364525 - DNA, 16 bp, Homo sapiens
ctgattgcagaaagga

SEQ ID NO: 3364526 - DNA, 23 bp, Homo sapiens
ctgattggcttgtagaattgtta

SEQ ID NO: 3364527 - DNA, 23 bp, Homo sapiens
ctgattggtgttttatctcctgt

SEQ ID NO: 3364528 - DNA, 23 bp, Homo sapiens
ctgattgtggatcttttcattct

SEQ ID NO: 3364529 - DNA, 17 bp, Homo sapiens
ctgattgtttcattgcg

SEQ ID NO: 3364530 - DNA, 14 bp, Homo sapiens
ctgatttacatgta

SEQ ID NO: 3364531 - DNA, 13 bp, Homo sapiens
ctgatttagaaaa

SEQ ID NO: 3364532 - DNA, 16 bp, Homo sapiens
ctgatttcagaagaga

SEQ ID NO: 3364533 - DNA, 16 bp, Homo sapiens
ctgatttcagtttttc

SEQ ID NO: 3364534 - DNA, 24 bp, Homo sapiens
ctgatttcagtttttcatttgttt

SEQ ID NO: 3364535 - DNA, 14 bp, Homo sapiens
ctgatttccaggcc

SEQ ID NO: 3364536 - DNA, 15 bp, Homo sapiens
ctgatttccaggccc

SEQ ID NO: 3364537 - DNA, 17 bp, Homo sapiens
ctgatttccaggcccct

SEQ ID NO: 3364538 - DNA, 22 bp, Homo sapiens
ctgatttccaggcccctgagga

SEQ ID NO: 3364539 - DNA, 14 bp, Homo sapiens
ctgatttcctttgg

SEQ ID NO: 3364540 - DNA, 20 bp, Homo sapiens
ctgatttctacaactggagt

SEQ ID NO: 3364541 - DNA, 11 bp, Homo sapiens
ctgatttctat

SEQ ID NO: 3364542 - DNA, 14 bp, Homo sapiens
ctgatttgtattaa

SEQ ID NO: 3364543 - DNA, 14 bp, Homo sapiens
ctgatttgttttca

SEQ ID NO: 3364544 - DNA, 14 bp, Homo sapiens
ctgattttaacaat

SEQ ID NO: 3364545 - DNA, 17 bp, Homo sapiens
ctgattttaacaataac

SEQ ID NO: 3364546 - DNA, 22 bp, Homo sapiens
ctgattttaggagctaaggctc

SEQ ID NO: 3364547 - DNA, 18 bp, Homo sapiens
ctgatttttaaagtactt

SEQ ID NO: 3364548 - DNA, 19 bp, Homo sapiens
ctgatttttaaagtacttt

SEQ ID NO: 3364549 - DNA, 21 bp, Homo sapiens
ctgatttttatgatgatgaaa

SEQ ID NO: 3364550 - DNA, 17 bp, Homo sapiens
ctgcaaaaatatttata

SEQ ID NO: 3364551 - DNA, 21 bp, Homo sapiens
ctgcaaaaatggatattatta

SEQ ID NO: 3364552 - DNA, 21 bp, Homo sapiens
ctgcaaaaggcctcttgtaaa

SEQ ID NO: 3364553 - DNA, 23 bp, Homo sapiens
ctgcaaaatttgatgccaggaca

SEQ ID NO: 3364554 - DNA, 13 bp, Homo sapiens
ctgcaaaatttta

SEQ ID NO: 3364555 - DNA, 14 bp, Homo sapiens
ctgcaaacagaaca

SEQ ID NO: 3364556 - DNA, 20 bp, Homo sapiens
ctgcaaacagaacagggtca

SEQ ID NO: 3364557 - DNA, 20 bp, Homo sapiens
ctgcaaactcactgctcaag

SEQ ID NO: 3364558 - DNA, 14 bp, Homo sapiens
ctgcaaagacagta

SEQ ID NO: 3364559 - DNA, 16 bp, Homo sapiens
ctgcaaaggcctgggc

SEQ ID NO: 3364560 - DNA, 22 bp, Homo sapiens
ctgcaaagtgattcactgtgct

SEQ ID NO: 3364561 - DNA, 16 bp, Homo sapiens
ctgcaaataaagcctt

SEQ ID NO: 3364562 - DNA, 22 bp, Homo sapiens
ctgcaaattgattgtctttccc

SEQ ID NO: 3364563 - DNA, 19 bp, Homo sapiens
ctgcaacagagagaaaaag

SEQ ID NO: 3364564 - DNA, 20 bp, Homo sapiens
ctgcaacagagagaaaaaga

SEQ ID NO: 3364565 - DNA, 16 bp, Homo sapiens
ctgcaacctctgcctc

SEQ ID NO: 3364566 - DNA, 15 bp, Homo sapiens
ctgcaactagccaag

SEQ ID NO: 3364567 - DNA, 21 bp, Homo sapiens
ctgcaactagccaaggctagt

SEQ ID NO: 3364568 - DNA, 15 bp, Homo sapiens
ctgcaactcaaggac

SEQ ID NO: 3364569 - DNA, 19 bp, Homo sapiens
ctgcaacttccgctgaggg

SEQ ID NO: 3364570 - DNA, 17 bp, Homo sapiens
ctgcaactttaagcagc

SEQ ID NO: 3364571 - DNA, 19 bp, Homo sapiens
ctgcaactttaagcagctc

SEQ ID NO: 3364572 - DNA, 14 bp, Homo sapiens
ctgcaagcacagcc

SEQ ID NO: 3364573 - DNA, 20 bp, Homo sapiens
ctgcaagcacatctgcattt

SEQ ID NO: 3364574 - DNA, 17 bp, Homo sapiens
ctgcaagccccaccctc

SEQ ID NO: 3364575 - DNA, 15 bp, Homo sapiens
ctgcaagccccaggg

SEQ ID NO: 3364576 - DNA, 13 bp, Homo sapiens
ctgcaagcctgtc

SEQ ID NO: 3364577 - DNA, 17 bp, Homo sapiens
ctgcaaggcccacagga

SEQ ID NO: 3364578 - DNA, 12 bp, Homo sapiens
ctgcaagtcaga

SEQ ID NO: 3364579 - DNA, 23 bp, Homo sapiens
ctgcaagtcagattgctgggagg

SEQ ID NO: 3364580 - DNA, 19 bp, Homo sapiens
ctgcaagtcagtccaggat

SEQ ID NO: 3364581 - DNA, 21 bp, Homo sapiens
ctgcaagtgtctggagcggct

SEQ ID NO: 3364582 - DNA, 16 bp, Homo sapiens
ctgcaatagagactgt

SEQ ID NO: 3364583 - DNA, 20 bp, Homo sapiens
ctgcaatagagactgtagat

SEQ ID NO: 3364584 - DNA, 12 bp, Homo sapiens
ctgcaatatttg

SEQ ID NO: 3364585 - DNA, 19 bp, Homo sapiens
ctgcaatatttgaatttta

SEQ ID NO: 3364586 - DNA, 23 bp, Homo sapiens
ctgcaatcctgtctttctgagca

SEQ ID NO: 3364587 - DNA, 14 bp, Homo sapiens
ctgcaatgcctaga

SEQ ID NO: 3364588 - DNA, 16 bp, Homo sapiens
ctgcaatgcctagact

SEQ ID NO: 3364589 - DNA, 18 bp, Homo sapiens
ctgcaattcaaaagttcc

SEQ ID NO: 3364590 - DNA, 21 bp, Homo sapiens
ctgcaattcaaaagttccaag

SEQ ID NO: 3364591 - DNA, 24 bp, Homo sapiens
ctgcaattcaaaagttccaagagt

SEQ ID NO: 3364592 - DNA, 15 bp, Homo sapiens
ctgcacaataaaaat

SEQ ID NO: 3364593 - DNA, 22 bp, Homo sapiens
ctgcacaataaaaatgtttaac

SEQ ID NO: 3364594 - DNA, 21 bp, Homo sapiens
ctgcacaataaacataacagc

SEQ ID NO: 3364595 - DNA, 17 bp, Homo sapiens
ctgcacacaagcccaca

SEQ ID NO: 3364596 - DNA, 16 bp, Homo sapiens
ctgcacacacagctcc

SEQ ID NO: 3364597 - DNA, 18 bp, Homo sapiens
ctgcacaccctccagaga

SEQ ID NO: 3364598 - DNA, 12 bp, Homo sapiens
ctgcacagaagg

SEQ ID NO: 3364599 - DNA, 17 bp, Homo sapiens
ctgcacagaagggctct

SEQ ID NO: 3364600 - DNA, 18 bp, Homo sapiens
ctgcacagaagggctctt

SEQ ID NO: 3364601 - DNA, 18 bp, Homo sapiens
ctgcacagacaagcagcc

SEQ ID NO: 3364602 - DNA, 21 bp, Homo sapiens
ctgcacagacaagcagccctt

SEQ ID NO: 3364603 - DNA, 19 bp, Homo sapiens
ctgcacagcggcccctgca

SEQ ID NO: 3364604 - DNA, 21 bp, Homo sapiens
ctgcacaggcacacagggccc

SEQ ID NO: 3364605 - DNA, 12 bp, Homo sapiens
ctgcacagggtc

SEQ ID NO: 3364606 - DNA, 18 bp, Homo sapiens
ctgcacagtgcatctcag

SEQ ID NO: 3364607 - DNA, 14 bp, Homo sapiens
ctgcacagtgctgt

SEQ ID NO: 3364608 - DNA, 17 bp, Homo sapiens
ctgcacagtggcacaaa

SEQ ID NO: 3364609 - DNA, 22 bp, Homo sapiens
ctgcacatgaatcccacccaca

SEQ ID NO: 3364610 - DNA, 22 bp, Homo sapiens
ctgcacatgactcgggggtggg

SEQ ID NO: 3364611 - DNA, 12 bp, Homo sapiens
ctgcaccagagc

SEQ ID NO: 3364612 - DNA, 13 bp, Homo sapiens
ctgcaccagagca

SEQ ID NO: 3364613 - DNA, 14 bp, Homo sapiens
ctgcaccagagtga

SEQ ID NO: 3364614 - DNA, 11 bp, Homo sapiens
ctgcaccagga

SEQ ID NO: 3364615 - DNA, 13 bp, Homo sapiens
ctgcaccaggaga

SEQ ID NO: 3364616 - DNA, 14 bp, Homo sapiens
ctgcaccaggagac

SEQ ID NO: 3364617 - DNA, 15 bp, Homo sapiens
ctgcaccaggagaca

SEQ ID NO: 3364618 - DNA, 12 bp, Homo sapiens
ctgcacccaact

SEQ ID NO: 3364619 - DNA, 12 bp, Homo sapiens
ctgcacccagct

SEQ ID NO: 3364620 - DNA, 15 bp, Homo sapiens
ctgcacccagctcca

SEQ ID NO: 3364621 - DNA, 20 bp, Homo sapiens
ctgcaccctccaccctgtcc

SEQ ID NO: 3364622 - DNA, 21 bp, Homo sapiens
ctgcaccctccaccctgtccc

SEQ ID NO: 3364623 - DNA, 15 bp, Homo sapiens
ctgcaccggacagtc

SEQ ID NO: 3364624 - DNA, 14 bp, Homo sapiens
ctgcaccgggccac

SEQ ID NO: 3364625 - DNA, 15 bp, Homo sapiens
ctgcaccgggccaca

SEQ ID NO: 3364626 - DNA, 20 bp, Homo sapiens
ctgcacctgccagcctggct

SEQ ID NO: 3364627 - DNA, 14 bp, Homo sapiens
ctgcacctgctgcg

SEQ ID NO: 3364628 - DNA, 12 bp, Homo sapiens
ctgcacgtcatg

SEQ ID NO: 3364629 - DNA, 19 bp, Homo sapiens
ctgcactaaagccagcctg

SEQ ID NO: 3364630 - DNA, 20 bp, Homo sapiens
ctgcactaaagccagcctga

SEQ ID NO: 3364631 - DNA, 22 bp, Homo sapiens
ctgcactaaagccagcctgacc

SEQ ID NO: 3364632 - DNA, 23 bp, Homo sapiens
ctgcactactcctctgcagtgcc

SEQ ID NO: 3364633 - DNA, 16 bp, Homo sapiens
ctgcactatagcctag

SEQ ID NO: 3364634 - DNA, 19 bp, Homo sapiens
ctgcactccagcctgggcg

SEQ ID NO: 3364635 - DNA, 20 bp, Homo sapiens
ctgcactccagcctggggga

SEQ ID NO: 3364636 - DNA, 16 bp, Homo sapiens
ctgcactcccacctga

SEQ ID NO: 3364637 - DNA, 18 bp, Homo sapiens
ctgcactgaaaaggttct

SEQ ID NO: 3364638 - DNA, 12 bp, Homo sapiens
ctgcactgcagt

SEQ ID NO: 3364639 - DNA, 16 bp, Homo sapiens
ctgcactgcatgcaaa

SEQ ID NO: 3364640 - DNA, 23 bp, Homo sapiens
ctgcacttgcagactctacagag

SEQ ID NO: 3364641 - DNA, 18 bp, Homo sapiens
ctgcacttggcctcagct

SEQ ID NO: 3364642 - DNA, 17 bp, Homo sapiens
ctgcagaaggaaagaag

SEQ ID NO: 3364643 - DNA, 16 bp, Homo sapiens
ctgcagacttcccagc

SEQ ID NO: 3364644 - DNA, 17 bp, Homo sapiens
ctgcagacttcccagct

SEQ ID NO: 3364645 - DNA, 18 bp, Homo sapiens
ctgcagacttcccagcta

SEQ ID NO: 3364646 - DNA, 23 bp, Homo sapiens
ctgcagagatttctcattgactt

SEQ ID NO: 3364647 - DNA, 22 bp, Homo sapiens
ctgcagagcacaaacttcagaa

SEQ ID NO: 3364648 - DNA, 14 bp, Homo sapiens
ctgcagaggaccac

SEQ ID NO: 3364649 - DNA, 16 bp, Homo sapiens
ctgcagaggaccacag

SEQ ID NO: 3364650 - DNA, 11 bp, Homo sapiens
ctgcagaggcc

SEQ ID NO: 3364651 - DNA, 20 bp, Homo sapiens
ctgcagaggccagaggcccc

SEQ ID NO: 3364652 - DNA, 11 bp, Homo sapiens
ctgcagagggg

SEQ ID NO: 3364653 - DNA, 21 bp, Homo sapiens
ctgcagaggggaaaccagtgt

SEQ ID NO: 3364654 - DNA, 18 bp, Homo sapiens
ctgcagatcttccgtggt

SEQ ID NO: 3364655 - DNA, 18 bp, Homo sapiens
ctgcagcaaacactccac

SEQ ID NO: 3364656 - DNA, 18 bp, Homo sapiens
ctgcagcacctccaggcc

SEQ ID NO: 3364657 - DNA, 19 bp, Homo sapiens
ctgcagcacctccaggcct

SEQ ID NO: 3364658 - DNA, 14 bp, Homo sapiens
ctgcagcacggaca

SEQ ID NO: 3364659 - DNA, 19 bp, Homo sapiens
ctgcagcacggacaataaa

SEQ ID NO: 3364660 - DNA, 20 bp, Homo sapiens
ctgcagcacggacaataaac

SEQ ID NO: 3364661 - DNA, 13 bp, Homo sapiens
ctgcagcagagtg

SEQ ID NO: 3364662 - DNA, 22 bp, Homo sapiens
ctgcagcagagtgagcaagggg

SEQ ID NO: 3364663 - DNA, 21 bp, Homo sapiens
ctgcagcaggagtggtgcaga

SEQ ID NO: 3364664 - DNA, 20 bp, Homo sapiens
ctgcagcatgttgctgagga

SEQ ID NO: 3364665 - DNA, 21 bp, Homo sapiens
ctgcagcatgttgctgaggag

SEQ ID NO: 3364666 - DNA, 22 bp, Homo sapiens
ctgcagcatgttgctgaggagt

SEQ ID NO: 3364667 - DNA, 14 bp, Homo sapiens
ctgcagccagctca

SEQ ID NO: 3364668 - DNA, 12 bp, Homo sapiens
ctgcagcccagg

SEQ ID NO: 3364669 - DNA, 24 bp, Homo sapiens
ctgcagcccggcgccaccatcctg

SEQ ID NO: 3364670 - DNA, 15 bp, Homo sapiens
ctgcagcccttgggc

SEQ ID NO: 3364671 - DNA, 18 bp, Homo sapiens
ctgcagcccttgggcagt

SEQ ID NO: 3364672 - DNA, 19 bp, Homo sapiens
ctgcagcccttgggcagtt

SEQ ID NO: 3364673 - DNA, 22 bp, Homo sapiens
ctgcagcctcaacctcctgggc

SEQ ID NO: 3364674 - DNA, 17 bp, Homo sapiens
ctgcagcctcctcctga

SEQ ID NO: 3364675 - DNA, 18 bp, Homo sapiens
ctgcagcctcctcctgac

SEQ ID NO: 3364676 - DNA, 20 bp, Homo sapiens
ctgcagcctcctcctgacca

SEQ ID NO: 3364677 - DNA, 20 bp, Homo sapiens
ctgcagcctttgcctccccg

SEQ ID NO: 3364678 - DNA, 13 bp, Homo sapiens
ctgcagctaaccc

SEQ ID NO: 3364679 - DNA, 20 bp, Homo sapiens
ctgcagctatgcgcaatgtg

SEQ ID NO: 3364680 - DNA, 13 bp, Homo sapiens
ctgcagcttggga

SEQ ID NO: 3364681 - DNA, 12 bp, Homo sapiens
ctgcagctttac

SEQ ID NO: 3364682 - DNA, 18 bp, Homo sapiens
ctgcaggaacgagcactg

SEQ ID NO: 3364683 - DNA, 19 bp, Homo sapiens
ctgcaggaacgagcactgg

SEQ ID NO: 3364684 - DNA, 21 bp, Homo sapiens
ctgcaggaacgagcactggcc

SEQ ID NO: 3364685 - DNA, 23 bp, Homo sapiens
ctgcaggaacgagcactggccag

SEQ ID NO: 3364686 - DNA, 22 bp, Homo sapiens
ctgcaggagtgctggcattacc

SEQ ID NO: 3364687 - DNA, 17 bp, Homo sapiens
ctgcaggagtgtcctgc

SEQ ID NO: 3364688 - DNA, 16 bp, Homo sapiens
ctgcaggagttaaaaa

SEQ ID NO: 3364689 - DNA, 15 bp, Homo sapiens
ctgcaggccaagagc

SEQ ID NO: 3364690 - DNA, 19 bp, Homo sapiens
ctgcaggccaagagcagag

SEQ ID NO: 3364691 - DNA, 23 bp, Homo sapiens
ctgcaggccaagagcagaggcag

SEQ ID NO: 3364692 - DNA, 19 bp, Homo sapiens
ctgcaggccctggcctccc

SEQ ID NO: 3364693 - DNA, 21 bp, Homo sapiens
ctgcaggccctggcctcccct

SEQ ID NO: 3364694 - DNA, 23 bp, Homo sapiens
ctgcaggcctaggtgcagctcct

SEQ ID NO: 3364695 - DNA, 21 bp, Homo sapiens
ctgcaggcctgactactgccc

SEQ ID NO: 3364696 - DNA, 17 bp, Homo sapiens
ctgcagggccaggactg

SEQ ID NO: 3364697 - DNA, 21 bp, Homo sapiens
ctgcagggccaggactgagcc

SEQ ID NO: 3364698 - DNA, 15 bp, Homo sapiens
ctgcagggccatctg

SEQ ID NO: 3364699 - DNA, 21 bp, Homo sapiens
ctgcagggcgcccctgggaga

SEQ ID NO: 3364700 - DNA, 14 bp, Homo sapiens
ctgcagggctccca

SEQ ID NO: 3364701 - DNA, 16 bp, Homo sapiens
ctgcagggctcccatg

SEQ ID NO: 3364702 - DNA, 12 bp, Homo sapiens
ctgcagggctgc

SEQ ID NO: 3364703 - DNA, 13 bp, Homo sapiens
ctgcaggggcagg

SEQ ID NO: 3364704 - DNA, 11 bp, Homo sapiens
ctgcaggggct

SEQ ID NO: 3364705 - DNA, 17 bp, Homo sapiens
ctgcaggggctctggag

SEQ ID NO: 3364706 - DNA, 20 bp, Homo sapiens
ctgcagggggtggacaaact

SEQ ID NO: 3364707 - DNA, 17 bp, Homo sapiens
ctgcaggttggacccca

SEQ ID NO: 3364708 - DNA, 21 bp, Homo sapiens
ctgcaggttggaccccagaga

SEQ ID NO: 3364709 - DNA, 16 bp, Homo sapiens
ctgcagtaaaacacat

SEQ ID NO: 3364710 - DNA, 17 bp, Homo sapiens
ctgcagtaaaacacatt

SEQ ID NO: 3364711 - DNA, 12 bp, Homo sapiens
ctgcagtctggc

SEQ ID NO: 3364712 - DNA, 13 bp, Homo sapiens
ctgcagtcttctg

SEQ ID NO: 3364713 - DNA, 15 bp, Homo sapiens
ctgcagtgtgccccc

SEQ ID NO: 3364714 - DNA, 15 bp, Homo sapiens
ctgcagttacttttg

SEQ ID NO: 3364715 - DNA, 14 bp, Homo sapiens
ctgcagttgacttt

SEQ ID NO: 3364716 - DNA, 15 bp, Homo sapiens
ctgcagttttgctat

SEQ ID NO: 3364717 - DNA, 14 bp, Homo sapiens
ctgcagtttttcag

SEQ ID NO: 3364718 - DNA, 16 bp, Homo sapiens
ctgcatagctctattt

SEQ ID NO: 3364719 - DNA, 18 bp, Homo sapiens
ctgcatagctctatttta

SEQ ID NO: 3364720 - DNA, 14 bp, Homo sapiens
ctgcatatgttgaa

SEQ ID NO: 3364721 - DNA, 21 bp, Homo sapiens
ctgcatcccagcacctgcctc

SEQ ID NO: 3364722 - DNA, 22 bp, Homo sapiens
ctgcatcccaggatgctgggtg

SEQ ID NO: 3364723 - DNA, 17 bp, Homo sapiens
ctgcatctgactctctt

SEQ ID NO: 3364724 - DNA, 14 bp, Homo sapiens
ctgcatctggggcc

SEQ ID NO: 3364725 - DNA, 15 bp, Homo sapiens
ctgcatgaatatcat

SEQ ID NO: 3364726 - DNA, 15 bp, Homo sapiens
ctgcatgacctacca

SEQ ID NO: 3364727 - DNA, 19 bp, Homo sapiens
ctgcatgcaaacaagaaac

SEQ ID NO: 3364728 - DNA, 20 bp, Homo sapiens
ctgcatgcctggtctttcct

SEQ ID NO: 3364729 - DNA, 12 bp, Homo sapiens
ctgcatggacct

SEQ ID NO: 3364730 - DNA, 13 bp, Homo sapiens
ctgcatggaccta

SEQ ID NO: 3364731 - DNA, 18 bp, Homo sapiens
ctgcatggagacgcattt

SEQ ID NO: 3364732 - DNA, 15 bp, Homo sapiens
ctgcatggattcagc

SEQ ID NO: 3364733 - DNA, 17 bp, Homo sapiens
ctgcatggattcagcat

SEQ ID NO: 3364734 - DNA, 20 bp, Homo sapiens
ctgcatgggggcaccgggct

SEQ ID NO: 3364735 - DNA, 21 bp, Homo sapiens
ctgcatgggggcaccgggctc

SEQ ID NO: 3364736 - DNA, 13 bp, Homo sapiens
ctgcatgttacat

SEQ ID NO: 3364737 - DNA, 12 bp, Homo sapiens
ctgcattagaaa

SEQ ID NO: 3364738 - DNA, 15 bp, Homo sapiens
ctgcattcattttta

SEQ ID NO: 3364739 - DNA, 16 bp, Homo sapiens
ctgcattctctcccat

SEQ ID NO: 3364740 - DNA, 15 bp, Homo sapiens
ctgcattgttattgt

SEQ ID NO: 3364741 - DNA, 20 bp, Homo sapiens
ctgcattgttattgtggaag

SEQ ID NO: 3364742 - DNA, 14 bp, Homo sapiens
ctgcatttagcaca

SEQ ID NO: 3364743 - DNA, 23 bp, Homo sapiens
ctgcatttagcacaaaaaaaatt

SEQ ID NO: 3364744 - DNA, 15 bp, Homo sapiens
ctgcatttctcttct

SEQ ID NO: 3364745 - DNA, 21 bp, Homo sapiens
ctgcattttaacaagcacccc

SEQ ID NO: 3364746 - DNA, 18 bp, Homo sapiens
ctgcattttcaccccacc

SEQ ID NO: 3364747 - DNA, 14 bp, Homo sapiens
ctgccaaaggatgt

SEQ ID NO: 3364748 - DNA, 17 bp, Homo sapiens
ctgccaaataaacagct

SEQ ID NO: 3364749 - DNA, 18 bp, Homo sapiens
ctgccaaataaacagcta

SEQ ID NO: 3364750 - DNA, 16 bp, Homo sapiens
ctgccaagactcctca

SEQ ID NO: 3364751 - DNA, 21 bp, Homo sapiens
ctgccaagagtcaacaggtca

SEQ ID NO: 3364752 - DNA, 23 bp, Homo sapiens
ctgccaaggccagagtggcctgg

SEQ ID NO: 3364753 - DNA, 19 bp, Homo sapiens
ctgccaattgctaccgaga

SEQ ID NO: 3364754 - DNA, 20 bp, Homo sapiens
ctgccacaacagaataaagc

SEQ ID NO: 3364755 - DNA, 22 bp, Homo sapiens
ctgccacaacagaataaagcag

SEQ ID NO: 3364756 - DNA, 23 bp, Homo sapiens
ctgccacaacagaataaagcagc

SEQ ID NO: 3364757 - DNA, 20 bp, Homo sapiens
ctgccacaaccagccaggca

SEQ ID NO: 3364758 - DNA, 17 bp, Homo sapiens
ctgccacacttcaggct

SEQ ID NO: 3364759 - DNA, 21 bp, Homo sapiens
ctgccacatacaggtgctcaa

SEQ ID NO: 3364760 - DNA, 15 bp, Homo sapiens
ctgccaccacacaca

SEQ ID NO: 3364761 - DNA, 19 bp, Homo sapiens
ctgccaccacgtctgccag

SEQ ID NO: 3364762 - DNA, 20 bp, Homo sapiens
ctgccaccacgtctgccagg

SEQ ID NO: 3364763 - DNA, 23 bp, Homo sapiens
ctgccaccacgtctgccaggccc

SEQ ID NO: 3364764 - DNA, 12 bp, Homo sapiens
ctgccaccagca

SEQ ID NO: 3364765 - DNA, 16 bp, Homo sapiens
ctgccaccagcatcca

SEQ ID NO: 3364766 - DNA, 17 bp, Homo sapiens
ctgccacccactcagga

SEQ ID NO: 3364767 - DNA, 12 bp, Homo sapiens
ctgccaccctgg

SEQ ID NO: 3364768 - DNA, 16 bp, Homo sapiens
ctgccaccctggggag

SEQ ID NO: 3364769 - DNA, 20 bp, Homo sapiens
ctgccaccctggggagaaag

SEQ ID NO: 3364770 - DNA, 22 bp, Homo sapiens
ctgccactttgcacattttgat

SEQ ID NO: 3364771 - DNA, 19 bp, Homo sapiens
ctgccactttggtacatgg

SEQ ID NO: 3364772 - DNA, 23 bp, Homo sapiens
ctgccactttggtacatggccag

SEQ ID NO: 3364773 - DNA, 10 bp, Homo sapiens
ctgccagagg

SEQ ID NO: 3364774 - DNA, 15 bp, Homo sapiens
ctgccagcacagagc

SEQ ID NO: 3364775 - DNA, 17 bp, Homo sapiens
ctgccagcacgcctggc

SEQ ID NO: 3364776 - DNA, 13 bp, Homo sapiens
ctgccagcagggg

SEQ ID NO: 3364777 - DNA, 15 bp, Homo sapiens
ctgccagcccagaac

SEQ ID NO: 3364778 - DNA, 16 bp, Homo sapiens
ctgccagcccagaaca

SEQ ID NO: 3364779 - DNA, 17 bp, Homo sapiens
ctgccagcccagaacac

SEQ ID NO: 3364780 - DNA, 18 bp, Homo sapiens
ctgccagcccagaacacc

SEQ ID NO: 3364781 - DNA, 15 bp, Homo sapiens
ctgccagccccacac

SEQ ID NO: 3364782 - DNA, 19 bp, Homo sapiens
ctgccagccccacacagct

SEQ ID NO: 3364783 - DNA, 14 bp, Homo sapiens
ctgccagcctggct

SEQ ID NO: 3364784 - DNA, 23 bp, Homo sapiens
ctgccagcctggcttctggagcc

SEQ ID NO: 3364785 - DNA, 17 bp, Homo sapiens
ctgccagccttgagccc

SEQ ID NO: 3364786 - DNA, 13 bp, Homo sapiens
ctgccagctgcct

SEQ ID NO: 3364787 - DNA, 19 bp, Homo sapiens
ctgccaggcacctggcctg

SEQ ID NO: 3364788 - DNA, 15 bp, Homo sapiens
ctgccaggcaggggt

SEQ ID NO: 3364789 - DNA, 13 bp, Homo sapiens
ctgccaggccagc

SEQ ID NO: 3364790 - DNA, 17 bp, Homo sapiens
ctgccaggccagcctcc

SEQ ID NO: 3364791 - DNA, 17 bp, Homo sapiens
ctgccagggcagtgcta

SEQ ID NO: 3364792 - DNA, 16 bp, Homo sapiens
ctgccagtgacagaca

SEQ ID NO: 3364793 - DNA, 17 bp, Homo sapiens
ctgccagtgctggtcac

SEQ ID NO: 3364794 - DNA, 14 bp, Homo sapiens
ctgccagtggatcc

SEQ ID NO: 3364795 - DNA, 21 bp, Homo sapiens
ctgccagtggatcccctgcgg

SEQ ID NO: 3364796 - DNA, 15 bp, Homo sapiens
ctgccataattctaa

SEQ ID NO: 3364797 - DNA, 21 bp, Homo sapiens
ctgccatattctgttggccag

SEQ ID NO: 3364798 - DNA, 23 bp, Homo sapiens
ctgccatattctgttggccagtg

SEQ ID NO: 3364799 - DNA, 18 bp, Homo sapiens
ctgccatccaggttcagc

SEQ ID NO: 3364800 - DNA, 21 bp, Homo sapiens
ctgccatccaggttcagcttg

SEQ ID NO: 3364801 - DNA, 15 bp, Homo sapiens
ctgccatcctcccaa

SEQ ID NO: 3364802 - DNA, 14 bp, Homo sapiens
ctgccatctagcca

SEQ ID NO: 3364803 - DNA, 19 bp, Homo sapiens
ctgccatcttagtttggat

SEQ ID NO: 3364804 - DNA, 16 bp, Homo sapiens
ctgccatgatagctgg

SEQ ID NO: 3364805 - DNA, 18 bp, Homo sapiens
ctgccatgatagctgggg

SEQ ID NO: 3364806 - DNA, 20 bp, Homo sapiens
ctgccatgccactgccaggc

SEQ ID NO: 3364807 - DNA, 21 bp, Homo sapiens
ctgccatgccactgccaggca

SEQ ID NO: 3364808 - DNA, 24 bp, Homo sapiens
ctgccatgccactgccaggcacct

SEQ ID NO: 3364809 - DNA, 15 bp, Homo sapiens
ctgccatgctctgga

SEQ ID NO: 3364810 - DNA, 21 bp, Homo sapiens
ctgccatggcgtgtccctctc

SEQ ID NO: 3364811 - DNA, 17 bp, Homo sapiens
ctgccatgggccagcct

SEQ ID NO: 3364812 - DNA, 18 bp, Homo sapiens
ctgccatgggccagccta

SEQ ID NO: 3364813 - DNA, 22 bp, Homo sapiens
ctgccatgggccagcctagccc

SEQ ID NO: 3364814 - DNA, 13 bp, Homo sapiens
ctgccatgtccat

SEQ ID NO: 3364815 - DNA, 16 bp, Homo sapiens
ctgccatgtccatagc

SEQ ID NO: 3364816 - DNA, 23 bp, Homo sapiens
ctgccattacagaggtattaaaa

SEQ ID NO: 3364817 - DNA, 19 bp, Homo sapiens
ctgccattattttctgtca

SEQ ID NO: 3364818 - DNA, 17 bp, Homo sapiens
ctgccattcacttcata

SEQ ID NO: 3364819 - DNA, 22 bp, Homo sapiens
ctgccattcttctggtgctact

SEQ ID NO: 3364820 - DNA, 14 bp, Homo sapiens
ctgccattgggacc

SEQ ID NO: 3364821 - DNA, 15 bp, Homo sapiens
ctgccatttcccttc

SEQ ID NO: 3364822 - DNA, 19 bp, Homo sapiens
ctgccatttgcaccctccg

SEQ ID NO: 3364823 - DNA, 18 bp, Homo sapiens
ctgcccaaacccttaact

SEQ ID NO: 3364824 - DNA, 17 bp, Homo sapiens
ctgcccaacctgctctc

SEQ ID NO: 3364825 - DNA, 19 bp, Homo sapiens
ctgcccaacctgctctcct

SEQ ID NO: 3364826 - DNA, 19 bp, Homo sapiens
ctgcccaagggcctcccac

SEQ ID NO: 3364827 - DNA, 22 bp, Homo sapiens
ctgcccaagggcctcccaccag

SEQ ID NO: 3364828 - DNA, 19 bp, Homo sapiens
ctgcccacaactcccttgc

SEQ ID NO: 3364829 - DNA, 23 bp, Homo sapiens
ctgcccacaactcccttgcacgt

SEQ ID NO: 3364830 - DNA, 12 bp, Homo sapiens
ctgcccaccccc

SEQ ID NO: 3364831 - DNA, 19 bp, Homo sapiens
ctgcccaccccctcaagcc

SEQ ID NO: 3364832 - DNA, 16 bp, Homo sapiens
ctgcccacgcagagga

SEQ ID NO: 3364833 - DNA, 20 bp, Homo sapiens
ctgcccacgcagaggacgca

SEQ ID NO: 3364834 - DNA, 17 bp, Homo sapiens
ctgcccactcgggtctg

SEQ ID NO: 3364835 - DNA, 16 bp, Homo sapiens
ctgcccactgctgcag

SEQ ID NO: 3364836 - DNA, 15 bp, Homo sapiens
ctgcccacttcccct

SEQ ID NO: 3364837 - DNA, 23 bp, Homo sapiens
ctgcccagacccctctggccagg

SEQ ID NO: 3364838 - DNA, 19 bp, Homo sapiens
ctgcccagatgccctttgg

SEQ ID NO: 3364839 - DNA, 21 bp, Homo sapiens
ctgcccagccccgctcaggcc

SEQ ID NO: 3364840 - DNA, 17 bp, Homo sapiens
ctgcccagcctccaagc

SEQ ID NO: 3364841 - DNA, 19 bp, Homo sapiens
ctgcccaggagacagacca

SEQ ID NO: 3364842 - DNA, 11 bp, Homo sapiens
ctgcccaggcc

SEQ ID NO: 3364843 - DNA, 12 bp, Homo sapiens
ctgcccaggcca

SEQ ID NO: 3364844 - DNA, 13 bp, Homo sapiens
ctgcccaggccac

SEQ ID NO: 3364845 - DNA, 14 bp, Homo sapiens
ctgcccaggccaca

SEQ ID NO: 3364846 - DNA, 18 bp, Homo sapiens
ctgcccaggcccctgcca

SEQ ID NO: 3364847 - DNA, 19 bp, Homo sapiens
ctgcccaggcccctgccac

SEQ ID NO: 3364848 - DNA, 19 bp, Homo sapiens
ctgcccaggcctgcctgtt

SEQ ID NO: 3364849 - DNA, 18 bp, Homo sapiens
ctgcccaggctgtgcagc

SEQ ID NO: 3364850 - DNA, 19 bp, Homo sapiens
ctgcccaggggtgccccct

SEQ ID NO: 3364851 - DNA, 22 bp, Homo sapiens
ctgcccaggggtgccccctcct

SEQ ID NO: 3364852 - DNA, 18 bp, Homo sapiens
ctgcccagtcccccaacc

SEQ ID NO: 3364853 - DNA, 19 bp, Homo sapiens
ctgcccagtcccccaaccc

SEQ ID NO: 3364854 - DNA, 11 bp, Homo sapiens
ctgcccagtgt

SEQ ID NO: 3364855 - DNA, 22 bp, Homo sapiens
ctgcccagtgttgtttgtaaat

SEQ ID NO: 3364856 - DNA, 13 bp, Homo sapiens
ctgcccagttgca

SEQ ID NO: 3364857 - DNA, 22 bp, Homo sapiens
ctgcccatgtcgcgctcagcat

SEQ ID NO: 3364858 - DNA, 20 bp, Homo sapiens
ctgcccatgtgtcccctcac

SEQ ID NO: 3364859 - DNA, 21 bp, Homo sapiens
ctgcccattcaccaaaattat

SEQ ID NO: 3364860 - DNA, 22 bp, Homo sapiens
ctgccccaaataacttcagtcc

SEQ ID NO: 3364861 - DNA, 20 bp, Homo sapiens
ctgccccaagcagccagcca

SEQ ID NO: 3364862 - DNA, 21 bp, Homo sapiens
ctgccccaagcagccagccag

SEQ ID NO: 3364863 - DNA, 16 bp, Homo sapiens
ctgccccacacggact

SEQ ID NO: 3364864 - DNA, 17 bp, Homo sapiens
ctgccccagcccaagtc

SEQ ID NO: 3364865 - DNA, 14 bp, Homo sapiens
ctgccccagctctg

SEQ ID NO: 3364866 - DNA, 16 bp, Homo sapiens
ctgccccagctgactg

SEQ ID NO: 3364867 - DNA, 12 bp, Homo sapiens
ctgccccaggcc

SEQ ID NO: 3364868 - DNA, 14 bp, Homo sapiens
ctgccccaggcctg

SEQ ID NO: 3364869 - DNA, 19 bp, Homo sapiens
ctgccccagggctcccggc

SEQ ID NO: 3364870 - DNA, 19 bp, Homo sapiens
ctgcccccaacactccagg

SEQ ID NO: 3364871 - DNA, 20 bp, Homo sapiens
ctgcccccaacactccaggc

SEQ ID NO: 3364872 - DNA, 23 bp, Homo sapiens
ctgcccccactgtccccctaccc

SEQ ID NO: 3364873 - DNA, 23 bp, Homo sapiens
ctgcccccatctccccaggcctc

SEQ ID NO: 3364874 - DNA, 22 bp, Homo sapiens
ctgccccccaaggttctggttc

SEQ ID NO: 3364875 - DNA, 23 bp, Homo sapiens
ctgccccccaaggttctggttcc

SEQ ID NO: 3364876 - DNA, 12 bp, Homo sapiens
ctgccccccagc

SEQ ID NO: 3364877 - DNA, 15 bp, Homo sapiens
ctgccccccctaaga

SEQ ID NO: 3364878 - DNA, 20 bp, Homo sapiens
ctgccccccctaagagacac

SEQ ID NO: 3364879 - DNA, 21 bp, Homo sapiens
ctgccccccgaggctgctaga

SEQ ID NO: 3364880 - DNA, 12 bp, Homo sapiens
ctgccccctggc

SEQ ID NO: 3364881 - DNA, 15 bp, Homo sapiens
ctgccccctggctga

SEQ ID NO: 3364882 - DNA, 20 bp, Homo sapiens
ctgccccctggctgactggc

SEQ ID NO: 3364883 - DNA, 12 bp, Homo sapiens
ctgccccctggt

SEQ ID NO: 3364884 - DNA, 13 bp, Homo sapiens
ctgccccctggtg

SEQ ID NO: 3364885 - DNA, 18 bp, Homo sapiens
ctgccccgcccccagtcc

SEQ ID NO: 3364886 - DNA, 15 bp, Homo sapiens
ctgccccgttccctg

SEQ ID NO: 3364887 - DNA, 23 bp, Homo sapiens
ctgccccgttccctgtcagaggc

SEQ ID NO: 3364888 - DNA, 21 bp, Homo sapiens
ctgcccctaccctggacttgc

SEQ ID NO: 3364889 - DNA, 13 bp, Homo sapiens
ctgcccctaggat

SEQ ID NO: 3364890 - DNA, 22 bp, Homo sapiens
ctgcccctaggatgctgcagca

SEQ ID NO: 3364891 - DNA, 13 bp, Homo sapiens
ctgcccctgcaaa

SEQ ID NO: 3364892 - DNA, 22 bp, Homo sapiens
ctgcccctgcgtggcctgagtc

SEQ ID NO: 3364893 - DNA, 14 bp, Homo sapiens
ctgcccctgctgtg

SEQ ID NO: 3364894 - DNA, 19 bp, Homo sapiens
ctgccccttgggcatccac

SEQ ID NO: 3364895 - DNA, 17 bp, Homo sapiens
ctgcccgactcaggtcc

SEQ ID NO: 3364896 - DNA, 15 bp, Homo sapiens
ctgcccgagctggtg

SEQ ID NO: 3364897 - DNA, 17 bp, Homo sapiens
ctgcccgcacaccctca

SEQ ID NO: 3364898 - DNA, 15 bp, Homo sapiens
ctgcccgcacagcag

SEQ ID NO: 3364899 - DNA, 14 bp, Homo sapiens
ctgcccgctcccaa

SEQ ID NO: 3364900 - DNA, 21 bp, Homo sapiens
ctgcccgctcccaacccccct

SEQ ID NO: 3364901 - DNA, 18 bp, Homo sapiens
ctgcccgctgcaatgcct

SEQ ID NO: 3364902 - DNA, 19 bp, Homo sapiens
ctgccctcatggcccctct

SEQ ID NO: 3364903 - DNA, 23 bp, Homo sapiens
ctgccctcattactgggccttag

SEQ ID NO: 3364904 - DNA, 21 bp, Homo sapiens
ctgccctccccagagcactgg

SEQ ID NO: 3364905 - DNA, 18 bp, Homo sapiens
ctgccctccctccttcct

SEQ ID NO: 3364906 - DNA, 16 bp, Homo sapiens
ctgccctccctggagc

SEQ ID NO: 3364907 - DNA, 19 bp, Homo sapiens
ctgccctgagaagctgctc

SEQ ID NO: 3364908 - DNA, 14 bp, Homo sapiens
ctgccctgcaccct

SEQ ID NO: 3364909 - DNA, 17 bp, Homo sapiens
ctgccctgcacgtcatg

SEQ ID NO: 3364910 - DNA, 20 bp, Homo sapiens
ctgccctgcacgtcatggga

SEQ ID NO: 3364911 - DNA, 15 bp, Homo sapiens
ctgccctgcctgccc

SEQ ID NO: 3364912 - DNA, 22 bp, Homo sapiens
ctgccctgctgccgcctcccag

SEQ ID NO: 3364913 - DNA, 16 bp, Homo sapiens
ctgccctggcagcagc

SEQ ID NO: 3364914 - DNA, 18 bp, Homo sapiens
ctgccctggcagcagcag

SEQ ID NO: 3364915 - DNA, 16 bp, Homo sapiens
ctgccctggccctgag

SEQ ID NO: 3364916 - DNA, 22 bp, Homo sapiens
ctgccctggccctgaggtgtgg

SEQ ID NO: 3364917 - DNA, 12 bp, Homo sapiens
ctgccctggctg

SEQ ID NO: 3364918 - DNA, 21 bp, Homo sapiens
ctgccctggctgctgccccca

SEQ ID NO: 3364919 - DNA, 20 bp, Homo sapiens
ctgccctggtccagggaagc

SEQ ID NO: 3364920 - DNA, 14 bp, Homo sapiens
ctgccctggtgctg

SEQ ID NO: 3364921 - DNA, 16 bp, Homo sapiens
ctgccctggtgctgcc

SEQ ID NO: 3364922 - DNA, 18 bp, Homo sapiens
ctgccctggtgctgccac

SEQ ID NO: 3364923 - DNA, 14 bp, Homo sapiens
ctgccctgtccctg

SEQ ID NO: 3364924 - DNA, 18 bp, Homo sapiens
ctgccctgttcatgtgcc

SEQ ID NO: 3364925 - DNA, 19 bp, Homo sapiens
ctgccctgttcatgtgcct

SEQ ID NO: 3364926 - DNA, 20 bp, Homo sapiens
ctgccctgttcatgtgcctc

SEQ ID NO: 3364927 - DNA, 23 bp, Homo sapiens
ctgccctgttcatgtgcctctgc

SEQ ID NO: 3364928 - DNA, 19 bp, Homo sapiens
ctgccctgttgtgtataga

SEQ ID NO: 3364929 - DNA, 16 bp, Homo sapiens
ctgcccttgctgcccg

SEQ ID NO: 3364930 - DNA, 13 bp, Homo sapiens
ctgccgaccagag

SEQ ID NO: 3364931 - DNA, 17 bp, Homo sapiens
ctgccgacttggagact

SEQ ID NO: 3364932 - DNA, 21 bp, Homo sapiens
ctgccgcagacgggcacagac

SEQ ID NO: 3364933 - DNA, 18 bp, Homo sapiens
ctgccgcatcatgggagt

SEQ ID NO: 3364934 - DNA, 15 bp, Homo sapiens
ctgccgcccaaagag

SEQ ID NO: 3364935 - DNA, 19 bp, Homo sapiens
ctgccgccccctcctgaac

SEQ ID NO: 3364936 - DNA, 15 bp, Homo sapiens
ctgccgccgcctccc

SEQ ID NO: 3364937 - DNA, 15 bp, Homo sapiens
ctgccgctgcaccac

SEQ ID NO: 3364938 - DNA, 20 bp, Homo sapiens
ctgccggctctttccttgct

SEQ ID NO: 3364939 - DNA, 20 bp, Homo sapiens
ctgccgggttctagtctcct

SEQ ID NO: 3364940 - DNA, 16 bp, Homo sapiens
ctgccggtcgggcagc

SEQ ID NO: 3364941 - DNA, 20 bp, Homo sapiens
ctgccggtcgggcagccagc

SEQ ID NO: 3364942 - DNA, 18 bp, Homo sapiens
ctgccggtgggaccctgt

SEQ ID NO: 3364943 - DNA, 21 bp, Homo sapiens
ctgccggtgggaccctgtccg

SEQ ID NO: 3364944 - DNA, 14 bp, Homo sapiens
ctgccggtttgaaa

SEQ ID NO: 3364945 - DNA, 19 bp, Homo sapiens
ctgcctaaccaggcccagc

SEQ ID NO: 3364946 - DNA, 23 bp, Homo sapiens
ctgcctaattttgccaaaatcct

SEQ ID NO: 3364947 - DNA, 20 bp, Homo sapiens
ctgcctacagaacttcagaa

SEQ ID NO: 3364948 - DNA, 14 bp, Homo sapiens
ctgcctagagtgta

SEQ ID NO: 3364949 - DNA, 20 bp, Homo sapiens
ctgcctagagtgtagcctaa

SEQ ID NO: 3364950 - DNA, 19 bp, Homo sapiens
ctgcctagcaagctggcct

SEQ ID NO: 3364951 - DNA, 19 bp, Homo sapiens
ctgcctaggaattcccagc

SEQ ID NO: 3364952 - DNA, 22 bp, Homo sapiens
ctgcctataatcttatacaaca

SEQ ID NO: 3364953 - DNA, 14 bp, Homo sapiens
ctgcctcagcctcc

SEQ ID NO: 3364954 - DNA, 22 bp, Homo sapiens
ctgcctcaggaggcaggacctt

SEQ ID NO: 3364955 - DNA, 15 bp, Homo sapiens
ctgcctcagtggcag

SEQ ID NO: 3364956 - DNA, 17 bp, Homo sapiens
ctgcctcagtggcagca

SEQ ID NO: 3364957 - DNA, 14 bp, Homo sapiens
ctgcctccagaatg

SEQ ID NO: 3364958 - DNA, 14 bp, Homo sapiens
ctgcctcccaggtt

SEQ ID NO: 3364959 - DNA, 11 bp, Homo sapiens
ctgcctcccat

SEQ ID NO: 3364960 - DNA, 16 bp, Homo sapiens
ctgcctcccatgcctg

SEQ ID NO: 3364961 - DNA, 20 bp, Homo sapiens
ctgcctcccctctccttcct

SEQ ID NO: 3364962 - DNA, 18 bp, Homo sapiens
ctgcctccctctccatat

SEQ ID NO: 3364963 - DNA, 23 bp, Homo sapiens
ctgcctccctctccatatctcct

SEQ ID NO: 3364964 - DNA, 14 bp, Homo sapiens
ctgcctccgctggc

SEQ ID NO: 3364965 - DNA, 16 bp, Homo sapiens
ctgcctccgctggctt

SEQ ID NO: 3364966 - DNA, 18 bp, Homo sapiens
ctgcctccgctggctttg

SEQ ID NO: 3364967 - DNA, 13 bp, Homo sapiens
ctgcctcctggga

SEQ ID NO: 3364968 - DNA, 15 bp, Homo sapiens
ctgcctcctgggaag

SEQ ID NO: 3364969 - DNA, 15 bp, Homo sapiens
ctgcctcgaaacaca

SEQ ID NO: 3364970 - DNA, 14 bp, Homo sapiens
ctgcctcgaactgg

SEQ ID NO: 3364971 - DNA, 17 bp, Homo sapiens
ctgcctcgaactggctg

SEQ ID NO: 3364972 - DNA, 23 bp, Homo sapiens
ctgcctctcccatcacttcccta

SEQ ID NO: 3364973 - DNA, 14 bp, Homo sapiens
ctgcctctctagga

SEQ ID NO: 3364974 - DNA, 23 bp, Homo sapiens
ctgcctctgacacacagctctgt

SEQ ID NO: 3364975 - DNA, 10 bp, Homo sapiens
ctgcctctgc

SEQ ID NO: 3364976 - DNA, 12 bp, Homo sapiens
ctgcctctgcca

SEQ ID NO: 3364977 - DNA, 14 bp, Homo sapiens
ctgcctctgccaca

SEQ ID NO: 3364978 - DNA, 20 bp, Homo sapiens
ctgcctctgccacactctga

SEQ ID NO: 3364979 - DNA, 21 bp, Homo sapiens
ctgcctctgccacactctgac

SEQ ID NO: 3364980 - DNA, 17 bp, Homo sapiens
ctgcctctgccttagag

SEQ ID NO: 3364981 - DNA, 13 bp, Homo sapiens
ctgcctctgctcc

SEQ ID NO: 3364982 - DNA, 12 bp, Homo sapiens
ctgcctcttcct

SEQ ID NO: 3364983 - DNA, 18 bp, Homo sapiens
ctgcctctttccctagga

SEQ ID NO: 3364984 - DNA, 19 bp, Homo sapiens
ctgcctctttccctaggaa

SEQ ID NO: 3364985 - DNA, 17 bp, Homo sapiens
ctgcctgaaacagccat

SEQ ID NO: 3364986 - DNA, 16 bp, Homo sapiens
ctgcctgacactgagc

SEQ ID NO: 3364987 - DNA, 20 bp, Homo sapiens
ctgcctgacactgagcccca

SEQ ID NO: 3364988 - DNA, 21 bp, Homo sapiens
ctgcctgacactgagccccac

SEQ ID NO: 3364989 - DNA, 20 bp, Homo sapiens
ctgcctgcaatatttgaatt

SEQ ID NO: 3364990 - DNA, 14 bp, Homo sapiens
ctgcctgcccaggc

SEQ ID NO: 3364991 - DNA, 15 bp, Homo sapiens
ctgcctgcccaggcc

SEQ ID NO: 3364992 - DNA, 16 bp, Homo sapiens
ctgcctgcccaggccc

SEQ ID NO: 3364993 - DNA, 20 bp, Homo sapiens
ctgcctgcccaggcccctgc

SEQ ID NO: 3364994 - DNA, 21 bp, Homo sapiens
ctgcctgcccaggcccctgcc

SEQ ID NO: 3364995 - DNA, 16 bp, Homo sapiens
ctgcctgccccacacg

SEQ ID NO: 3364996 - DNA, 14 bp, Homo sapiens
ctgcctgccccgcc

SEQ ID NO: 3364997 - DNA, 15 bp, Homo sapiens
ctgcctgccccgccc

SEQ ID NO: 3364998 - DNA, 18 bp, Homo sapiens
ctgcctgccccgccccca

SEQ ID NO: 3364999 - DNA, 23 bp, Homo sapiens
ctgcctgcccgcacagcagcctg

SEQ ID NO: 3365000 - DNA, 17 bp, Homo sapiens
ctgcctgccgcccaaag

SEQ ID NO: 3365001 - DNA, 14 bp, Homo sapiens
ctgcctgcggccca

SEQ ID NO: 3365002 - DNA, 14 bp, Homo sapiens
ctgcctgcttggcc

SEQ ID NO: 3365003 - DNA, 18 bp, Homo sapiens
ctgcctgcttggcccggc

SEQ ID NO: 3365004 - DNA, 12 bp, Homo sapiens
ctgcctggactt

SEQ ID NO: 3365005 - DNA, 13 bp, Homo sapiens
ctgcctggagagg

SEQ ID NO: 3365006 - DNA, 22 bp, Homo sapiens
ctgcctggagagggtctcgctg

SEQ ID NO: 3365007 - DNA, 21 bp, Homo sapiens
ctgcctggccaggcagatctg

SEQ ID NO: 3365008 - DNA, 18 bp, Homo sapiens
ctgcctggcctggctccc

SEQ ID NO: 3365009 - DNA, 12 bp, Homo sapiens
ctgcctgggcct

SEQ ID NO: 3365010 - DNA, 21 bp, Homo sapiens
ctgcctgggcctgtgcagcag

SEQ ID NO: 3365011 - DNA, 24 bp, Homo sapiens
ctgcctgggcctgtgcagcagccc

SEQ ID NO: 3365012 - DNA, 24 bp, Homo sapiens
ctgcctgggctgttggcactcaca

SEQ ID NO: 3365013 - DNA, 19 bp, Homo sapiens
ctgcctggggcgggcccct

SEQ ID NO: 3365014 - DNA, 13 bp, Homo sapiens
ctgcctgggtggg

SEQ ID NO: 3365015 - DNA, 17 bp, Homo sapiens
ctgcctgggtgggacag

SEQ ID NO: 3365016 - DNA, 20 bp, Homo sapiens
ctgcctgggtgggacagcct

SEQ ID NO: 3365017 - DNA, 14 bp, Homo sapiens
ctgcctgggttggg

SEQ ID NO: 3365018 - DNA, 21 bp, Homo sapiens
ctgcctgggttgggggcactc

SEQ ID NO: 3365019 - DNA, 12 bp, Homo sapiens
ctgcctggtggt

SEQ ID NO: 3365020 - DNA, 16 bp, Homo sapiens
ctgcctgtagcagtga

SEQ ID NO: 3365021 - DNA, 16 bp, Homo sapiens
ctgcctgtagttagga

SEQ ID NO: 3365022 - DNA, 20 bp, Homo sapiens
ctgcctgtagttaggaaata

SEQ ID NO: 3365023 - DNA, 21 bp, Homo sapiens
ctgcctgtagttaggaaataa

SEQ ID NO: 3365024 - DNA, 17 bp, Homo sapiens
ctgcctgtatactttag

SEQ ID NO: 3365025 - DNA, 19 bp, Homo sapiens
ctgcctgtatactttagta

SEQ ID NO: 3365026 - DNA, 14 bp, Homo sapiens
ctgcctgtattttc

SEQ ID NO: 3365027 - DNA, 18 bp, Homo sapiens
ctgcctgtgcctgccatg

SEQ ID NO: 3365028 - DNA, 15 bp, Homo sapiens
ctgcctgttcagctc

SEQ ID NO: 3365029 - DNA, 16 bp, Homo sapiens
ctgcctgttctgagga

SEQ ID NO: 3365030 - DNA, 17 bp, Homo sapiens
ctgccttaaaaccaaag

SEQ ID NO: 3365031 - DNA, 18 bp, Homo sapiens
ctgccttaaaaccaaaga

SEQ ID NO: 3365032 - DNA, 22 bp, Homo sapiens
ctgccttaatgacattcccctc

SEQ ID NO: 3365033 - DNA, 23 bp, Homo sapiens
ctgccttactggtttccccaggg

SEQ ID NO: 3365034 - DNA, 16 bp, Homo sapiens
ctgccttagtctcagt

SEQ ID NO: 3365035 - DNA, 23 bp, Homo sapiens
ctgccttagtctcagtttgtgtg

SEQ ID NO: 3365036 - DNA, 15 bp, Homo sapiens
ctgccttatcttgca

SEQ ID NO: 3365037 - DNA, 12 bp, Homo sapiens
ctgccttcctca

SEQ ID NO: 3365038 - DNA, 21 bp, Homo sapiens
ctgccttcgcttcttgcctct

SEQ ID NO: 3365039 - DNA, 20 bp, Homo sapiens
ctgccttctcctctctgggc

SEQ ID NO: 3365040 - DNA, 18 bp, Homo sapiens
ctgccttctggccttgta

SEQ ID NO: 3365041 - DNA, 12 bp, Homo sapiens
ctgccttctgtc

SEQ ID NO: 3365042 - DNA, 13 bp, Homo sapiens
ctgccttctgtcc

SEQ ID NO: 3365043 - DNA, 16 bp, Homo sapiens
ctgccttctgtcctgg

SEQ ID NO: 3365044 - DNA, 21 bp, Homo sapiens
ctgccttcttctttttgctgt

SEQ ID NO: 3365045 - DNA, 14 bp, Homo sapiens
ctgccttgagctaa

SEQ ID NO: 3365046 - DNA, 14 bp, Homo sapiens
ctgccttggcctcc

SEQ ID NO: 3365047 - DNA, 14 bp, Homo sapiens
ctgccttggctcag

SEQ ID NO: 3365048 - DNA, 15 bp, Homo sapiens
ctgccttggctcaga

SEQ ID NO: 3365049 - DNA, 17 bp, Homo sapiens
ctgccttggctcagaca

SEQ ID NO: 3365050 - DNA, 18 bp, Homo sapiens
ctgccttggctcagacat

SEQ ID NO: 3365051 - DNA, 22 bp, Homo sapiens
ctgccttgggccttgctgctgc

SEQ ID NO: 3365052 - DNA, 24 bp, Homo sapiens
ctgccttgggccttgctgctgctg

SEQ ID NO: 3365053 - DNA, 18 bp, Homo sapiens
ctgccttgtccctctcac

SEQ ID NO: 3365054 - DNA, 19 bp, Homo sapiens
ctgccttgtccctctcact

SEQ ID NO: 3365055 - DNA, 23 bp, Homo sapiens
ctgccttgtccctctcactcccc

SEQ ID NO: 3365056 - DNA, 15 bp, Homo sapiens
ctgcctttaagccaa

SEQ ID NO: 3365057 - DNA, 23 bp, Homo sapiens
ctgcctttaagccaaagaaacaa

SEQ ID NO: 3365058 - DNA, 17 bp, Homo sapiens
ctgcctttctcccccga

SEQ ID NO: 3365059 - DNA, 17 bp, Homo sapiens
ctgcctttgacatttaa

SEQ ID NO: 3365060 - DNA, 20 bp, Homo sapiens
ctgcgaagaccctcttgccc

SEQ ID NO: 3365061 - DNA, 21 bp, Homo sapiens
ctgcgaagaccctcttgccca

SEQ ID NO: 3365062 - DNA, 19 bp, Homo sapiens
ctgcgaaggggccctggtc

SEQ ID NO: 3365063 - DNA, 17 bp, Homo sapiens
ctgcgattttgcctgtg

SEQ ID NO: 3365064 - DNA, 16 bp, Homo sapiens
ctgcgcaccaatgccc

SEQ ID NO: 3365065 - DNA, 22 bp, Homo sapiens
ctgcgccccgcccacaccctcg

SEQ ID NO: 3365066 - DNA, 13 bp, Homo sapiens
ctgcgcctcaggc

SEQ ID NO: 3365067 - DNA, 17 bp, Homo sapiens
ctgcgctcggcaggaag

SEQ ID NO: 3365068 - DNA, 19 bp, Homo sapiens
ctgcgctgctttttcaaaa

SEQ ID NO: 3365069 - DNA, 19 bp, Homo sapiens
ctgcggaccaagggactcc

SEQ ID NO: 3365070 - DNA, 16 bp, Homo sapiens
ctgcggaccccagctg

SEQ ID NO: 3365071 - DNA, 20 bp, Homo sapiens
ctgcggaccccagctgtgag

SEQ ID NO: 3365072 - DNA, 20 bp, Homo sapiens
ctgcggagtgaagaggggca

SEQ ID NO: 3365073 - DNA, 22 bp, Homo sapiens
ctgcggagtgaagaggggcagc

SEQ ID NO: 3365074 - DNA, 23 bp, Homo sapiens
ctgcggagtgaagaggggcagcc

SEQ ID NO: 3365075 - DNA, 19 bp, Homo sapiens
ctgcggcagacgggagggg

SEQ ID NO: 3365076 - DNA, 20 bp, Homo sapiens
ctgcgggatggtcctggggc

SEQ ID NO: 3365077 - DNA, 22 bp, Homo sapiens
ctgcgggcgcgggcagccaccc

SEQ ID NO: 3365078 - DNA, 23 bp, Homo sapiens
ctgcgggcgcgggcagccaccca

SEQ ID NO: 3365079 - DNA, 15 bp, Homo sapiens
ctgcgggtctgaagg

SEQ ID NO: 3365080 - DNA, 13 bp, Homo sapiens
ctgcgggtggggc

SEQ ID NO: 3365081 - DNA, 17 bp, Homo sapiens
ctgcggtccacccagga

SEQ ID NO: 3365082 - DNA, 20 bp, Homo sapiens
ctgcggtccacccaggagcc

SEQ ID NO: 3365083 - DNA, 17 bp, Homo sapiens
ctgcgtcctcctcacct

SEQ ID NO: 3365084 - DNA, 18 bp, Homo sapiens
ctgcgtcctcctcacctc

SEQ ID NO: 3365085 - DNA, 18 bp, Homo sapiens
ctgcgtcctgacgccctg

SEQ ID NO: 3365086 - DNA, 20 bp, Homo sapiens
ctgcgtcctgacgccctgcg

SEQ ID NO: 3365087 - DNA, 18 bp, Homo sapiens
ctgcgtctggaggggccc

SEQ ID NO: 3365088 - DNA, 13 bp, Homo sapiens
ctgcgtctgtgtt

SEQ ID NO: 3365089 - DNA, 13 bp, Homo sapiens
ctgcgttctgcaa

SEQ ID NO: 3365090 - DNA, 15 bp, Homo sapiens
ctgcgttctgcaagc

SEQ ID NO: 3365091 - DNA, 14 bp, Homo sapiens
ctgcgttggagcca

SEQ ID NO: 3365092 - DNA, 15 bp, Homo sapiens
ctgcgttggagccac

SEQ ID NO: 3365093 - DNA, 19 bp, Homo sapiens
ctgcgttggagccactcct

SEQ ID NO: 3365094 - DNA, 22 bp, Homo sapiens
ctgcgttggagccactcctgtc

SEQ ID NO: 3365095 - DNA, 18 bp, Homo sapiens
ctgcgttggtccagagcg

SEQ ID NO: 3365096 - DNA, 19 bp, Homo sapiens
ctgcgttggtccagagcgg

SEQ ID NO: 3365097 - DNA, 17 bp, Homo sapiens
ctgctaaatctcctatt

SEQ ID NO: 3365098 - DNA, 20 bp, Homo sapiens
ctgctaaattctatgttaaa

SEQ ID NO: 3365099 - DNA, 15 bp, Homo sapiens
ctgctaacctggaaa

SEQ ID NO: 3365100 - DNA, 16 bp, Homo sapiens
ctgctaaggctcctcc

SEQ ID NO: 3365101 - DNA, 23 bp, Homo sapiens
ctgctaatcatgtgggtgagcca

SEQ ID NO: 3365102 - DNA, 23 bp, Homo sapiens
ctgctaatgcaaattaaaacata

SEQ ID NO: 3365103 - DNA, 14 bp, Homo sapiens
ctgctacaggaggg

SEQ ID NO: 3365104 - DNA, 15 bp, Homo sapiens
ctgctaccctagatg

SEQ ID NO: 3365105 - DNA, 18 bp, Homo sapiens
ctgctaccgccctgggct

SEQ ID NO: 3365106 - DNA, 23 bp, Homo sapiens
ctgctaccgccctgggctggact

SEQ ID NO: 3365107 - DNA, 21 bp, Homo sapiens
ctgctaccgttgacttccagg

SEQ ID NO: 3365108 - DNA, 17 bp, Homo sapiens
ctgctacctctgagaag

SEQ ID NO: 3365109 - DNA, 13 bp, Homo sapiens
ctgctacctgttc

SEQ ID NO: 3365110 - DNA, 21 bp, Homo sapiens
ctgctacctgttcttgggcct

SEQ ID NO: 3365111 - DNA, 19 bp, Homo sapiens
ctgctactcctgtgctctg

SEQ ID NO: 3365112 - DNA, 18 bp, Homo sapiens
ctgctactgtaattttat

SEQ ID NO: 3365113 - DNA, 20 bp, Homo sapiens
ctgctacttcactgtcatct

SEQ ID NO: 3365114 - DNA, 20 bp, Homo sapiens
ctgctagaacttttttaaat

SEQ ID NO: 3365115 - DNA, 21 bp, Homo sapiens
ctgctagaacttttttaaata

SEQ ID NO: 3365116 - DNA, 15 bp, Homo sapiens
ctgctagagcaaccc

SEQ ID NO: 3365117 - DNA, 23 bp, Homo sapiens
ctgctagagcaacccctgtaccc

SEQ ID NO: 3365118 - DNA, 20 bp, Homo sapiens
ctgctagattttaatttatt

SEQ ID NO: 3365119 - DNA, 16 bp, Homo sapiens
ctgctagcaaatggca

SEQ ID NO: 3365120 - DNA, 16 bp, Homo sapiens
ctgctagtgttctgtc

SEQ ID NO: 3365121 - DNA, 20 bp, Homo sapiens
ctgctatccccatctccctg

SEQ ID NO: 3365122 - DNA, 13 bp, Homo sapiens
ctgctatgaaaat

SEQ ID NO: 3365123 - DNA, 22 bp, Homo sapiens
ctgctatgaaaatgagcatcag

SEQ ID NO: 3365124 - DNA, 17 bp, Homo sapiens
ctgctatttattttcct

SEQ ID NO: 3365125 - DNA, 16 bp, Homo sapiens
ctgctatttctcttgc

SEQ ID NO: 3365126 - DNA, 19 bp, Homo sapiens
ctgctcaccgcccatcagg

SEQ ID NO: 3365127 - DNA, 13 bp, Homo sapiens
ctgctcagacaga

SEQ ID NO: 3365128 - DNA, 18 bp, Homo sapiens
ctgctcagcaacctttca

SEQ ID NO: 3365129 - DNA, 18 bp, Homo sapiens
ctgctcagtgcttgggct

SEQ ID NO: 3365130 - DNA, 20 bp, Homo sapiens
ctgctcagtgcttgggctcc

SEQ ID NO: 3365131 - DNA, 14 bp, Homo sapiens
ctgctccaccagca

SEQ ID NO: 3365132 - DNA, 17 bp, Homo sapiens
ctgctccaccagcagca

SEQ ID NO: 3365133 - DNA, 20 bp, Homo sapiens
ctgctccaccagcagcatgg

SEQ ID NO: 3365134 - DNA, 22 bp, Homo sapiens
ctgctccaccagcagcatggca

SEQ ID NO: 3365135 - DNA, 17 bp, Homo sapiens
ctgctccacccttggcc

SEQ ID NO: 3365136 - DNA, 13 bp, Homo sapiens
ctgctccacgcgc

SEQ ID NO: 3365137 - DNA, 22 bp, Homo sapiens
ctgctccagaatttggaaatcc

SEQ ID NO: 3365138 - DNA, 13 bp, Homo sapiens
ctgctccatgact

SEQ ID NO: 3365139 - DNA, 23 bp, Homo sapiens
ctgctccatttataaccccagcc

SEQ ID NO: 3365140 - DNA, 14 bp, Homo sapiens
ctgctcccagcagc

SEQ ID NO: 3365141 - DNA, 22 bp, Homo sapiens
ctgctcccagcagccctaagga

SEQ ID NO: 3365142 - DNA, 14 bp, Homo sapiens
ctgctcccagcctg

SEQ ID NO: 3365143 - DNA, 15 bp, Homo sapiens
ctgctcccattcctc

SEQ ID NO: 3365144 - DNA, 18 bp, Homo sapiens
ctgctcccattcctccct

SEQ ID NO: 3365145 - DNA, 20 bp, Homo sapiens
ctgctccccagccctggctc

SEQ ID NO: 3365146 - DNA, 18 bp, Homo sapiens
ctgctccctgaagccagc

SEQ ID NO: 3365147 - DNA, 21 bp, Homo sapiens
ctgctccctgaagccagcctt

SEQ ID NO: 3365148 - DNA, 13 bp, Homo sapiens
ctgctccctggca

SEQ ID NO: 3365149 - DNA, 14 bp, Homo sapiens
ctgctccgcccgct

SEQ ID NO: 3365150 - DNA, 15 bp, Homo sapiens
ctgctccgctgctcc

SEQ ID NO: 3365151 - DNA, 18 bp, Homo sapiens
ctgctcctcactggagga

SEQ ID NO: 3365152 - DNA, 14 bp, Homo sapiens
ctgctcctccctgc

SEQ ID NO: 3365153 - DNA, 16 bp, Homo sapiens
ctgctcctccctgccc

SEQ ID NO: 3365154 - DNA, 17 bp, Homo sapiens
ctgctcctccctgcccc

SEQ ID NO: 3365155 - DNA, 18 bp, Homo sapiens
ctgctcctccctgccccc

SEQ ID NO: 3365156 - DNA, 16 bp, Homo sapiens
ctgctcctctccaggc

SEQ ID NO: 3365157 - DNA, 17 bp, Homo sapiens
ctgctcctctccaggca

SEQ ID NO: 3365158 - DNA, 18 bp, Homo sapiens
ctgctcctctccccagca

SEQ ID NO: 3365159 - DNA, 20 bp, Homo sapiens
ctgctcctctccccagcaag

SEQ ID NO: 3365160 - DNA, 16 bp, Homo sapiens
ctgctcctgcagcatg

SEQ ID NO: 3365161 - DNA, 13 bp, Homo sapiens
ctgctcctggagc

SEQ ID NO: 3365162 - DNA, 15 bp, Homo sapiens
ctgctcctggagcct

SEQ ID NO: 3365163 - DNA, 12 bp, Homo sapiens
ctgctccttcac

SEQ ID NO: 3365164 - DNA, 19 bp, Homo sapiens
ctgctccttcactgttccc

SEQ ID NO: 3365165 - DNA, 19 bp, Homo sapiens
ctgctccttggcttacctg

SEQ ID NO: 3365166 - DNA, 14 bp, Homo sapiens
ctgctcgcccagga

SEQ ID NO: 3365167 - DNA, 17 bp, Homo sapiens
ctgctcgcccaggaagg

SEQ ID NO: 3365168 - DNA, 14 bp, Homo sapiens
ctgctcgccctcct

SEQ ID NO: 3365169 - DNA, 17 bp, Homo sapiens
ctgctcgccctcctttc

SEQ ID NO: 3365170 - DNA, 19 bp, Homo sapiens
ctgctctaacacctgccta

SEQ ID NO: 3365171 - DNA, 17 bp, Homo sapiens
ctgctctaacagccctc

SEQ ID NO: 3365172 - DNA, 19 bp, Homo sapiens
ctgctctacccatgagcct

SEQ ID NO: 3365173 - DNA, 23 bp, Homo sapiens
ctgctctacccatgagcctgccc

SEQ ID NO: 3365174 - DNA, 15 bp, Homo sapiens
ctgctctagccagga

SEQ ID NO: 3365175 - DNA, 23 bp, Homo sapiens
ctgctctagccaggagtctgtgc

SEQ ID NO: 3365176 - DNA, 17 bp, Homo sapiens
ctgctctagctggcagg

SEQ ID NO: 3365177 - DNA, 18 bp, Homo sapiens
ctgctctagctggcagga

SEQ ID NO: 3365178 - DNA, 22 bp, Homo sapiens
ctgctctagggaatctggatta

SEQ ID NO: 3365179 - DNA, 23 bp, Homo sapiens
ctgctctattgtagcatttcttg

SEQ ID NO: 3365180 - DNA, 16 bp, Homo sapiens
ctgctctcagcctccc

SEQ ID NO: 3365181 - DNA, 19 bp, Homo sapiens
ctgctctcagcctcccaca

SEQ ID NO: 3365182 - DNA, 20 bp, Homo sapiens
ctgctctcatccattcctct

SEQ ID NO: 3365183 - DNA, 19 bp, Homo sapiens
ctgctctcccctcccagtc

SEQ ID NO: 3365184 - DNA, 14 bp, Homo sapiens
ctgctctcctcttg

SEQ ID NO: 3365185 - DNA, 18 bp, Homo sapiens
ctgctctggttgtttctg

SEQ ID NO: 3365186 - DNA, 21 bp, Homo sapiens
ctgctctggttgtttctgttc

SEQ ID NO: 3365187 - DNA, 15 bp, Homo sapiens
ctgctcttaagaaac

SEQ ID NO: 3365188 - DNA, 22 bp, Homo sapiens
ctgctctttctacatgactggg

SEQ ID NO: 3365189 - DNA, 18 bp, Homo sapiens
ctgctctttctctgccag

SEQ ID NO: 3365190 - DNA, 19 bp, Homo sapiens
ctgctctttctctgccagt

SEQ ID NO: 3365191 - DNA, 16 bp, Homo sapiens
ctgctgaatgcctcgc

SEQ ID NO: 3365192 - DNA, 23 bp, Homo sapiens
ctgctgaatgcctcgctcccttc

SEQ ID NO: 3365193 - DNA, 18 bp, Homo sapiens
ctgctgacagacacaggc

SEQ ID NO: 3365194 - DNA, 20 bp, Homo sapiens
ctgctgacagacacaggccc

SEQ ID NO: 3365195 - DNA, 11 bp, Homo sapiens
ctgctgacagt

SEQ ID NO: 3365196 - DNA, 12 bp, Homo sapiens
ctgctgacagtg

SEQ ID NO: 3365197 - DNA, 13 bp, Homo sapiens
ctgctgacagtgt

SEQ ID NO: 3365198 - DNA, 15 bp, Homo sapiens
ctgctgacagtgttg

SEQ ID NO: 3365199 - DNA, 11 bp, Homo sapiens
ctgctgagcca

SEQ ID NO: 3365200 - DNA, 14 bp, Homo sapiens
ctgctgagccactc

SEQ ID NO: 3365201 - DNA, 13 bp, Homo sapiens
ctgctgagctggg

SEQ ID NO: 3365202 - DNA, 14 bp, Homo sapiens
ctgctgagctgggc

SEQ ID NO: 3365203 - DNA, 13 bp, Homo sapiens
ctgctgatataat

SEQ ID NO: 3365204 - DNA, 15 bp, Homo sapiens
ctgctgcaccagagt

SEQ ID NO: 3365205 - DNA, 24 bp, Homo sapiens
ctgctgcacccaactactgagctg

SEQ ID NO: 3365206 - DNA, 22 bp, Homo sapiens
ctgctgcaggccgtgtgtctgt

SEQ ID NO: 3365207 - DNA, 13 bp, Homo sapiens
ctgctgcaggggc

SEQ ID NO: 3365208 - DNA, 15 bp, Homo sapiens
ctgctgcagtagggg

SEQ ID NO: 3365209 - DNA, 17 bp, Homo sapiens
ctgctgccagggcttcc

SEQ ID NO: 3365210 - DNA, 19 bp, Homo sapiens
ctgctgccagtgcagccac

SEQ ID NO: 3365211 - DNA, 13 bp, Homo sapiens
ctgctgcccaggc

SEQ ID NO: 3365212 - DNA, 18 bp, Homo sapiens
ctgctgcccaggccacag

SEQ ID NO: 3365213 - DNA, 13 bp, Homo sapiens
ctgctgccccagc

SEQ ID NO: 3365214 - DNA, 15 bp, Homo sapiens
ctgctgccccagctg

SEQ ID NO: 3365215 - DNA, 16 bp, Homo sapiens
ctgctgccccagctga

SEQ ID NO: 3365216 - DNA, 22 bp, Homo sapiens
ctgctgccccagctgactgtgg

SEQ ID NO: 3365217 - DNA, 12 bp, Homo sapiens
ctgctgcctctt

SEQ ID NO: 3365218 - DNA, 22 bp, Homo sapiens
ctgctgcctctttccctaggaa

SEQ ID NO: 3365219 - DNA, 21 bp, Homo sapiens
ctgctgcctgcccgcacagca

SEQ ID NO: 3365220 - DNA, 22 bp, Homo sapiens
ctgctgcctgcccgcacagcag

SEQ ID NO: 3365221 - DNA, 14 bp, Homo sapiens
ctgctgcggaggag

SEQ ID NO: 3365222 - DNA, 16 bp, Homo sapiens
ctgctgcgtccccact

SEQ ID NO: 3365223 - DNA, 18 bp, Homo sapiens
ctgctgcgtccccactcc

SEQ ID NO: 3365224 - DNA, 19 bp, Homo sapiens
ctgctgcgtccccactccc

SEQ ID NO: 3365225 - DNA, 20 bp, Homo sapiens
ctgctgctctcccctcccag

SEQ ID NO: 3365226 - DNA, 15 bp, Homo sapiens
ctgctgctgcaccca

SEQ ID NO: 3365227 - DNA, 16 bp, Homo sapiens
ctgctggacagagact

SEQ ID NO: 3365228 - DNA, 14 bp, Homo sapiens
ctgctggacagcct

SEQ ID NO: 3365229 - DNA, 15 bp, Homo sapiens
ctgctggacagcctc

SEQ ID NO: 3365230 - DNA, 13 bp, Homo sapiens
ctgctggagtctg

SEQ ID NO: 3365231 - DNA, 21 bp, Homo sapiens
ctgctggagtttcatgtacaa

SEQ ID NO: 3365232 - DNA, 14 bp, Homo sapiens
ctgctggcacccac

SEQ ID NO: 3365233 - DNA, 16 bp, Homo sapiens
ctgctggcccagccaa

SEQ ID NO: 3365234 - DNA, 13 bp, Homo sapiens
ctgctggcctgga

SEQ ID NO: 3365235 - DNA, 16 bp, Homo sapiens
ctgctggcctggccgg

SEQ ID NO: 3365236 - DNA, 11 bp, Homo sapiens
ctgctggctgc

SEQ ID NO: 3365237 - DNA, 12 bp, Homo sapiens
ctgctggctgcc

SEQ ID NO: 3365238 - DNA, 13 bp, Homo sapiens
ctgctggctgcct

SEQ ID NO: 3365239 - DNA, 14 bp, Homo sapiens
ctgctggctgcctt

SEQ ID NO: 3365240 - DNA, 20 bp, Homo sapiens
ctgctgggaaccccgcagcc

SEQ ID NO: 3365241 - DNA, 22 bp, Homo sapiens
ctgctgggaaccccgcagcccg

SEQ ID NO: 3365242 - DNA, 19 bp, Homo sapiens
ctgctgggagttctagaac

SEQ ID NO: 3365243 - DNA, 21 bp, Homo sapiens
ctgctgggagttctagaacca

SEQ ID NO: 3365244 - DNA, 17 bp, Homo sapiens
ctgctggggatccccgc

SEQ ID NO: 3365245 - DNA, 12 bp, Homo sapiens
ctgctggggcat

SEQ ID NO: 3365246 - DNA, 21 bp, Homo sapiens
ctgctggggcatgtgtgcctg

SEQ ID NO: 3365247 - DNA, 23 bp, Homo sapiens
ctgctggggcatgtgtgcctgtg

SEQ ID NO: 3365248 - DNA, 14 bp, Homo sapiens
ctgctggtacctgc

SEQ ID NO: 3365249 - DNA, 16 bp, Homo sapiens
ctgctggtacctgccc

SEQ ID NO: 3365250 - DNA, 21 bp, Homo sapiens
ctgctggtacctgccctctat

SEQ ID NO: 3365251 - DNA, 16 bp, Homo sapiens
ctgctggtccgtggga

SEQ ID NO: 3365252 - DNA, 23 bp, Homo sapiens
ctgctggtggaaagcgattcact

SEQ ID NO: 3365253 - DNA, 15 bp, Homo sapiens
ctgctggttcagggt

SEQ ID NO: 3365254 - DNA, 19 bp, Homo sapiens
ctgctggttcctgactggc

SEQ ID NO: 3365255 - DNA, 21 bp, Homo sapiens
ctgctggttcctgactggcaa

SEQ ID NO: 3365256 - DNA, 19 bp, Homo sapiens
ctgctgtaactgctgagcc

SEQ ID NO: 3365257 - DNA, 20 bp, Homo sapiens
ctgctgtaactgctgagcca

SEQ ID NO: 3365258 - DNA, 21 bp, Homo sapiens
ctgctgtaactgctgagccac

SEQ ID NO: 3365259 - DNA, 22 bp, Homo sapiens
ctgctgtaactgctgagccact

SEQ ID NO: 3365260 - DNA, 15 bp, Homo sapiens
ctgctgtacccagat

SEQ ID NO: 3365261 - DNA, 17 bp, Homo sapiens
ctgctgtacccagatgc

SEQ ID NO: 3365262 - DNA, 18 bp, Homo sapiens
ctgctgtacccagatgcc

SEQ ID NO: 3365263 - DNA, 17 bp, Homo sapiens
ctgctgtagtcctttct

SEQ ID NO: 3365264 - DNA, 23 bp, Homo sapiens
ctgctgtagtcctttctgccttg

SEQ ID NO: 3365265 - DNA, 19 bp, Homo sapiens
ctgctgtatccagaagaaa

SEQ ID NO: 3365266 - DNA, 15 bp, Homo sapiens
ctgctgtcttccaag

SEQ ID NO: 3365267 - DNA, 15 bp, Homo sapiens
ctgctgtcttcccca

SEQ ID NO: 3365268 - DNA, 19 bp, Homo sapiens
ctgctgtgccatgctgggc

SEQ ID NO: 3365269 - DNA, 19 bp, Homo sapiens
ctgctgtgggagagcgaag

SEQ ID NO: 3365270 - DNA, 16 bp, Homo sapiens
ctgctgtgtgtgagca

SEQ ID NO: 3365271 - DNA, 23 bp, Homo sapiens
ctgctgtgtgtgagcagtggaca

SEQ ID NO: 3365272 - DNA, 23 bp, Homo sapiens
ctgcttaaaaggtataattaaac

SEQ ID NO: 3365273 - DNA, 20 bp, Homo sapiens
ctgcttagaatccaaacttg

SEQ ID NO: 3365274 - DNA, 20 bp, Homo sapiens
ctgcttagctgccttgagct

SEQ ID NO: 3365275 - DNA, 18 bp, Homo sapiens
ctgcttaggagagaccga

SEQ ID NO: 3365276 - DNA, 19 bp, Homo sapiens
ctgcttcaaatatttccct

SEQ ID NO: 3365277 - DNA, 19 bp, Homo sapiens
ctgcttcaatcccagccta

SEQ ID NO: 3365278 - DNA, 23 bp, Homo sapiens
ctgcttcagcctcccgagtagct

SEQ ID NO: 3365279 - DNA, 21 bp, Homo sapiens
ctgcttcagtgtatggaaata

SEQ ID NO: 3365280 - DNA, 11 bp, Homo sapiens
ctgcttcccac

SEQ ID NO: 3365281 - DNA, 16 bp, Homo sapiens
ctgcttcccacctccc

SEQ ID NO: 3365282 - DNA, 19 bp, Homo sapiens
ctgcttcccacctccctgc

SEQ ID NO: 3365283 - DNA, 20 bp, Homo sapiens
ctgcttcccacctccctgcc

SEQ ID NO: 3365284 - DNA, 24 bp, Homo sapiens
ctgcttcccacctccctgcccagg

SEQ ID NO: 3365285 - DNA, 12 bp, Homo sapiens
ctgcttcccatc

SEQ ID NO: 3365286 - DNA, 15 bp, Homo sapiens
ctgcttcccttactt

SEQ ID NO: 3365287 - DNA, 21 bp, Homo sapiens
ctgcttcccttactttgctga

SEQ ID NO: 3365288 - DNA, 21 bp, Homo sapiens
ctgcttcctgaaataaacact

SEQ ID NO: 3365289 - DNA, 22 bp, Homo sapiens
ctgcttcctgaaataaacactg

SEQ ID NO: 3365290 - DNA, 13 bp, Homo sapiens
ctgcttctctgac

SEQ ID NO: 3365291 - DNA, 19 bp, Homo sapiens
ctgcttctctgacttctgc

SEQ ID NO: 3365292 - DNA, 23 bp, Homo sapiens
ctgcttctgcccacaccgcaggg

SEQ ID NO: 3365293 - DNA, 17 bp, Homo sapiens
ctgcttgatgaagcaag

SEQ ID NO: 3365294 - DNA, 18 bp, Homo sapiens
ctgcttgatgaagcaagg

SEQ ID NO: 3365295 - DNA, 19 bp, Homo sapiens
ctgctttaaagggcctgcc

SEQ ID NO: 3365296 - DNA, 16 bp, Homo sapiens
ctgctttatcttttca

SEQ ID NO: 3365297 - DNA, 17 bp, Homo sapiens
ctgctttcccctgtggg

SEQ ID NO: 3365298 - DNA, 20 bp, Homo sapiens
ctgctttcccctgtggggat

SEQ ID NO: 3365299 - DNA, 11 bp, Homo sapiens
ctgctttctgt

SEQ ID NO: 3365300 - DNA, 13 bp, Homo sapiens
ctgctttctgttc

SEQ ID NO: 3365301 - DNA, 22 bp, Homo sapiens
ctgctttgccaagttgctgtca

SEQ ID NO: 3365302 - DNA, 14 bp, Homo sapiens
ctgctttggcagtg

SEQ ID NO: 3365303 - DNA, 16 bp, Homo sapiens
ctgctttggctgaggg

SEQ ID NO: 3365304 - DNA, 20 bp, Homo sapiens
ctgctttggctgaggggctt

SEQ ID NO: 3365305 - DNA, 20 bp, Homo sapiens
ctgctttgggctgccctggt

SEQ ID NO: 3365306 - DNA, 23 bp, Homo sapiens
ctgctttgggctgccctggtgct

SEQ ID NO: 3365307 - DNA, 21 bp, Homo sapiens
ctgcttttagttcatatatac

SEQ ID NO: 3365308 - DNA, 15 bp, Homo sapiens
ctgcttttatctcag

SEQ ID NO: 3365309 - DNA, 14 bp, Homo sapiens
ctgcttttccagga

SEQ ID NO: 3365310 - DNA, 18 bp, Homo sapiens
ctgcttttctgccctggc

SEQ ID NO: 3365311 - DNA, 18 bp, Homo sapiens
ctgcttttgagcctcaga

SEQ ID NO: 3365312 - DNA, 19 bp, Homo sapiens
ctgcttttgcataatgcaa

SEQ ID NO: 3365313 - DNA, 17 bp, Homo sapiens
ctgcttttggtctgtgt

SEQ ID NO: 3365314 - DNA, 19 bp, Homo sapiens
ctgcttttgtctatgggac

SEQ ID NO: 3365315 - DNA, 19 bp, Homo sapiens
ctgctttttaaagaatgct

SEQ ID NO: 3365316 - DNA, 22 bp, Homo sapiens
ctgctttttaaagaatgctctt

SEQ ID NO: 3365317 - DNA, 16 bp, Homo sapiens
ctgctttttggaaagt

SEQ ID NO: 3365318 - DNA, 15 bp, Homo sapiens
ctgctttttttctta

SEQ ID NO: 3365319 - DNA, 17 bp, Homo sapiens
ctgctttttttcttaaa

SEQ ID NO: 3365320 - DNA, 17 bp, Homo sapiens
ctgcttttttttttcca

SEQ ID NO: 3365321 - DNA, 22 bp, Homo sapiens
ctgcttttttttttccagcaag

SEQ ID NO: 3365322 - DNA, 16 bp, Homo sapiens
ctggaaacctctggag

SEQ ID NO: 3365323 - DNA, 15 bp, Homo sapiens
ctggaaactaccagg

SEQ ID NO: 3365324 - DNA, 14 bp, Homo sapiens
ctggaaaggctcag

SEQ ID NO: 3365325 - DNA, 20 bp, Homo sapiens
ctggaaaggctcagtctcag

SEQ ID NO: 3365326 - DNA, 23 bp, Homo sapiens
ctggaaaggctcagtctcaggag

SEQ ID NO: 3365327 - DNA, 19 bp, Homo sapiens
ctggaacatttgatatttt

SEQ ID NO: 3365328 - DNA, 17 bp, Homo sapiens
ctggaaccagggaggag

SEQ ID NO: 3365329 - DNA, 19 bp, Homo sapiens
ctggaaccagggaggagag

SEQ ID NO: 3365330 - DNA, 23 bp, Homo sapiens
ctggaaccagggaggagaggaaa

SEQ ID NO: 3365331 - DNA, 19 bp, Homo sapiens
ctggaactggctgtgaaga

SEQ ID NO: 3365332 - DNA, 20 bp, Homo sapiens
ctggaagaaactaaaaatat

SEQ ID NO: 3365333 - DNA, 18 bp, Homo sapiens
ctggaagacacttcagat

SEQ ID NO: 3365334 - DNA, 13 bp, Homo sapiens
ctggaagagagga

SEQ ID NO: 3365335 - DNA, 20 bp, Homo sapiens
ctggaagagttggtctctgc

SEQ ID NO: 3365336 - DNA, 14 bp, Homo sapiens
ctggaagcacagct

SEQ ID NO: 3365337 - DNA, 18 bp, Homo sapiens
ctggaagcacagcttcat

SEQ ID NO: 3365338 - DNA, 18 bp, Homo sapiens
ctggaagcaggtgctaca

SEQ ID NO: 3365339 - DNA, 22 bp, Homo sapiens
ctggaagccaaaatgtaggctt

SEQ ID NO: 3365340 - DNA, 14 bp, Homo sapiens
ctggaagccctgga

SEQ ID NO: 3365341 - DNA, 17 bp, Homo sapiens
ctggaagctaatttgca

SEQ ID NO: 3365342 - DNA, 16 bp, Homo sapiens
ctggaaggcagggcag

SEQ ID NO: 3365343 - DNA, 12 bp, Homo sapiens
ctggaaggctgg

SEQ ID NO: 3365344 - DNA, 17 bp, Homo sapiens
ctggaaggctggctgag

SEQ ID NO: 3365345 - DNA, 23 bp, Homo sapiens
ctggaagtcatctcattccactg

SEQ ID NO: 3365346 - DNA, 16 bp, Homo sapiens
ctggaagtccaatgtg

SEQ ID NO: 3365347 - DNA, 24 bp, Homo sapiens
ctggaagtctacctgctggacagc

SEQ ID NO: 3365348 - DNA, 16 bp, Homo sapiens
ctggaataaagttgca

SEQ ID NO: 3365349 - DNA, 14 bp, Homo sapiens
ctggaataagttca

SEQ ID NO: 3365350 - DNA, 23 bp, Homo sapiens
ctggaatcaagatgtcagactgg

SEQ ID NO: 3365351 - DNA, 23 bp, Homo sapiens
ctggaatcaggaatattttccaa

SEQ ID NO: 3365352 - DNA, 17 bp, Homo sapiens
ctggaattcagcaccct

SEQ ID NO: 3365353 - DNA, 22 bp, Homo sapiens
ctggaattcagcaccctgggtg

SEQ ID NO: 3365354 - DNA, 23 bp, Homo sapiens
ctggaattcagcaccctgggtgc

SEQ ID NO: 3365355 - DNA, 18 bp, Homo sapiens
ctggacaagcagaggtgg

SEQ ID NO: 3365356 - DNA, 15 bp, Homo sapiens
ctggacaagccaact

SEQ ID NO: 3365357 - DNA, 13 bp, Homo sapiens
ctggacacagctc

SEQ ID NO: 3365358 - DNA, 18 bp, Homo sapiens
ctggacacagctcttcat

SEQ ID NO: 3365359 - DNA, 17 bp, Homo sapiens
ctggacacccctgctct

SEQ ID NO: 3365360 - DNA, 17 bp, Homo sapiens
ctggacaccgggccagt

SEQ ID NO: 3365361 - DNA, 13 bp, Homo sapiens
ctggacagaccca

SEQ ID NO: 3365362 - DNA, 17 bp, Homo sapiens
ctggacagacccaggtc

SEQ ID NO: 3365363 - DNA, 18 bp, Homo sapiens
ctggacagacccaggtct

SEQ ID NO: 3365364 - DNA, 20 bp, Homo sapiens
ctggacagacccaggtcttc

SEQ ID NO: 3365365 - DNA, 17 bp, Homo sapiens
ctggacagagactcagc

SEQ ID NO: 3365366 - DNA, 23 bp, Homo sapiens
ctggacagagactcagcgctcct

SEQ ID NO: 3365367 - DNA, 21 bp, Homo sapiens
ctggacagctttgctccgctc

SEQ ID NO: 3365368 - DNA, 16 bp, Homo sapiens
ctggacagtatcccac

SEQ ID NO: 3365369 - DNA, 19 bp, Homo sapiens
ctggacatttaacttttct

SEQ ID NO: 3365370 - DNA, 22 bp, Homo sapiens
ctggacatttaacttttctacc

SEQ ID NO: 3365371 - DNA, 16 bp, Homo sapiens
ctggaccaaggtgaag

SEQ ID NO: 3365372 - DNA, 20 bp, Homo sapiens
ctggaccaaggtgaagcaaa

SEQ ID NO: 3365373 - DNA, 14 bp, Homo sapiens
ctggaccactgggc

SEQ ID NO: 3365374 - DNA, 15 bp, Homo sapiens
ctggaccactgggca

SEQ ID NO: 3365375 - DNA, 19 bp, Homo sapiens
ctggaccccgtttcatttt

SEQ ID NO: 3365376 - DNA, 20 bp, Homo sapiens
ctggaccccgtttcattttt

SEQ ID NO: 3365377 - DNA, 17 bp, Homo sapiens
ctggaccctgcttcacc

SEQ ID NO: 3365378 - DNA, 15 bp, Homo sapiens
ctggaccgtttccaa

SEQ ID NO: 3365379 - DNA, 19 bp, Homo sapiens
ctggaccgtttccaagctg

SEQ ID NO: 3365380 - DNA, 12 bp, Homo sapiens
ctggacctggaa

SEQ ID NO: 3365381 - DNA, 16 bp, Homo sapiens
ctggaccttgaactgg

SEQ ID NO: 3365382 - DNA, 17 bp, Homo sapiens
ctggaccttgaactggg

SEQ ID NO: 3365383 - DNA, 21 bp, Homo sapiens
ctggaccttgaactgggtact

SEQ ID NO: 3365384 - DNA, 14 bp, Homo sapiens
ctggacggcaggct

SEQ ID NO: 3365385 - DNA, 21 bp, Homo sapiens
ctggacggcaggctcactgcc

SEQ ID NO: 3365386 - DNA, 22 bp, Homo sapiens
ctggacggcaggctcactgcca

SEQ ID NO: 3365387 - DNA, 15 bp, Homo sapiens
ctggacggcattcct

SEQ ID NO: 3365388 - DNA, 15 bp, Homo sapiens
ctggacggggactgg

SEQ ID NO: 3365389 - DNA, 18 bp, Homo sapiens
ctggactcctctgtccag

SEQ ID NO: 3365390 - DNA, 23 bp, Homo sapiens
ctggactcctctgtccaggcact

SEQ ID NO: 3365391 - DNA, 23 bp, Homo sapiens
ctggactctgcatcccagcacct

SEQ ID NO: 3365392 - DNA, 24 bp, Homo sapiens
ctggactctgcatcccagcacctg

SEQ ID NO: 3365393 - DNA, 13 bp, Homo sapiens
ctggactctgccc

SEQ ID NO: 3365394 - DNA, 15 bp, Homo sapiens
ctggactctgcccca

SEQ ID NO: 3365395 - DNA, 17 bp, Homo sapiens
ctggactggaggtgggc

SEQ ID NO: 3365396 - DNA, 18 bp, Homo sapiens
ctggactggaggtgggca

SEQ ID NO: 3365397 - DNA, 16 bp, Homo sapiens
ctggactgggaggtag

SEQ ID NO: 3365398 - DNA, 17 bp, Homo sapiens
ctggactgggaggtaga

SEQ ID NO: 3365399 - DNA, 18 bp, Homo sapiens
ctggactgtcatagaaat

SEQ ID NO: 3365400 - DNA, 14 bp, Homo sapiens
ctggactgttccag

SEQ ID NO: 3365401 - DNA, 19 bp, Homo sapiens
ctggactgttccaggccct

SEQ ID NO: 3365402 - DNA, 12 bp, Homo sapiens
ctggacttctgt

SEQ ID NO: 3365403 - DNA, 23 bp, Homo sapiens
ctggacttggtacagttgcagga

SEQ ID NO: 3365404 - DNA, 15 bp, Homo sapiens
ctggactttcctgca

SEQ ID NO: 3365405 - DNA, 24 bp, Homo sapiens
ctggagaaagagctgcctggatga

SEQ ID NO: 3365406 - DNA, 18 bp, Homo sapiens
ctggagaaatgggagctt

SEQ ID NO: 3365407 - DNA, 12 bp, Homo sapiens
ctggagaagaga

SEQ ID NO: 3365408 - DNA, 15 bp, Homo sapiens
ctggagaagagagga

SEQ ID NO: 3365409 - DNA, 16 bp, Homo sapiens
ctggagaagagaggag

SEQ ID NO: 3365410 - DNA, 19 bp, Homo sapiens
ctggagaagagaggagagg

SEQ ID NO: 3365411 - DNA, 13 bp, Homo sapiens
ctggagacagccc

SEQ ID NO: 3365412 - DNA, 15 bp, Homo sapiens
ctggagacagcccca

SEQ ID NO: 3365413 - DNA, 17 bp, Homo sapiens
ctggagacagccccaga

SEQ ID NO: 3365414 - DNA, 17 bp, Homo sapiens
ctggagaccagggagcc

SEQ ID NO: 3365415 - DNA, 17 bp, Homo sapiens
ctggagacccaccccac

SEQ ID NO: 3365416 - DNA, 19 bp, Homo sapiens
ctggagacccaccccacct

SEQ ID NO: 3365417 - DNA, 23 bp, Homo sapiens
ctggagacccaccccacctgcag

SEQ ID NO: 3365418 - DNA, 21 bp, Homo sapiens
ctggagacgggtgggcggctg

SEQ ID NO: 3365419 - DNA, 22 bp, Homo sapiens
ctggagacgtggaacctctgtc

SEQ ID NO: 3365420 - DNA, 14 bp, Homo sapiens
ctggagagcgagga

SEQ ID NO: 3365421 - DNA, 18 bp, Homo sapiens
ctggagagcgaggaggcg

SEQ ID NO: 3365422 - DNA, 12 bp, Homo sapiens
ctggagaggtta

SEQ ID NO: 3365423 - DNA, 17 bp, Homo sapiens
ctggagatcctcctgca

SEQ ID NO: 3365424 - DNA, 18 bp, Homo sapiens
ctggagatcctcctgcag

SEQ ID NO: 3365425 - DNA, 16 bp, Homo sapiens
ctggagcaggagcccc

SEQ ID NO: 3365426 - DNA, 16 bp, Homo sapiens
ctggagcatgcagagg

SEQ ID NO: 3365427 - DNA, 12 bp, Homo sapiens
ctggagcccagg

SEQ ID NO: 3365428 - DNA, 17 bp, Homo sapiens
ctggagcccctgggtgg

SEQ ID NO: 3365429 - DNA, 24 bp, Homo sapiens
ctggagccctgttggcagctctag

SEQ ID NO: 3365430 - DNA, 16 bp, Homo sapiens
ctggagcctgagtcag

SEQ ID NO: 3365431 - DNA, 18 bp, Homo sapiens
ctggagcctgagtcaggg

SEQ ID NO: 3365432 - DNA, 19 bp, Homo sapiens
ctggagcctgagtcagggc

SEQ ID NO: 3365433 - DNA, 23 bp, Homo sapiens
ctggagcctgagtcagggcccag

SEQ ID NO: 3365434 - DNA, 22 bp, Homo sapiens
ctggagcgaagccttctgcagc

SEQ ID NO: 3365435 - DNA, 23 bp, Homo sapiens
ctggagcggctgctcgcccagga

SEQ ID NO: 3365436 - DNA, 20 bp, Homo sapiens
ctggagctcatctgcaaaag

SEQ ID NO: 3365437 - DNA, 22 bp, Homo sapiens
ctggaggaaggggggttgcagt

SEQ ID NO: 3365438 - DNA, 23 bp, Homo sapiens
ctggaggagggtttgggcagagc

SEQ ID NO: 3365439 - DNA, 13 bp, Homo sapiens
ctggaggcccagg

SEQ ID NO: 3365440 - DNA, 13 bp, Homo sapiens
ctggaggcccctg

SEQ ID NO: 3365441 - DNA, 17 bp, Homo sapiens
ctggaggcctctggccc

SEQ ID NO: 3365442 - DNA, 20 bp, Homo sapiens
ctggaggctccaggactcca

SEQ ID NO: 3365443 - DNA, 23 bp, Homo sapiens
ctggaggctccaggactccactg

SEQ ID NO: 3365444 - DNA, 23 bp, Homo sapiens
ctggaggctgcagagctgaccca

SEQ ID NO: 3365445 - DNA, 13 bp, Homo sapiens
ctggaggggaggg

SEQ ID NO: 3365446 - DNA, 12 bp, Homo sapiens
ctggaggggccc

SEQ ID NO: 3365447 - DNA, 16 bp, Homo sapiens
ctggaggggtgtggct

SEQ ID NO: 3365448 - DNA, 20 bp, Homo sapiens
ctggaggggtgtggctcctt

SEQ ID NO: 3365449 - DNA, 16 bp, Homo sapiens
ctggaggtaaggcctt

SEQ ID NO: 3365450 - DNA, 20 bp, Homo sapiens
ctggaggtaaggcctttgag

SEQ ID NO: 3365451 - DNA, 15 bp, Homo sapiens
ctggaggtctccagg

SEQ ID NO: 3365452 - DNA, 23 bp, Homo sapiens
ctggaggtctccaggggcctgca

SEQ ID NO: 3365453 - DNA, 14 bp, Homo sapiens
ctggaggtgggagc

SEQ ID NO: 3365454 - DNA, 21 bp, Homo sapiens
ctggaggtgggagcaggagat

SEQ ID NO: 3365455 - DNA, 22 bp, Homo sapiens
ctggaggtgggagcaggagatt

SEQ ID NO: 3365456 - DNA, 21 bp, Homo sapiens
ctggaggtgggcatgccaccc

SEQ ID NO: 3365457 - DNA, 16 bp, Homo sapiens
ctggaggttgaagcca

SEQ ID NO: 3365458 - DNA, 19 bp, Homo sapiens
ctggaggttgaagccaagt

SEQ ID NO: 3365459 - DNA, 13 bp, Homo sapiens
ctggagtctggag

SEQ ID NO: 3365460 - DNA, 20 bp, Homo sapiens
ctggagtgaggcttccaggc

SEQ ID NO: 3365461 - DNA, 24 bp, Homo sapiens
ctggagtgcgctcttggtccctgg

SEQ ID NO: 3365462 - DNA, 19 bp, Homo sapiens
ctggagtggtaacagctct

SEQ ID NO: 3365463 - DNA, 13 bp, Homo sapiens
ctggagtttaata

SEQ ID NO: 3365464 - DNA, 13 bp, Homo sapiens
ctggataaaatga

SEQ ID NO: 3365465 - DNA, 14 bp, Homo sapiens
ctggatatttgcac

SEQ ID NO: 3365466 - DNA, 20 bp, Homo sapiens
ctggatatttgcacttatgt

SEQ ID NO: 3365467 - DNA, 13 bp, Homo sapiens
ctggatattttca

SEQ ID NO: 3365468 - DNA, 21 bp, Homo sapiens
ctggatcacgacgctgcagag

SEQ ID NO: 3365469 - DNA, 21 bp, Homo sapiens
ctggatcagtcctttgatcag

SEQ ID NO: 3365470 - DNA, 18 bp, Homo sapiens
ctggatcccctctgtcta

SEQ ID NO: 3365471 - DNA, 15 bp, Homo sapiens
ctggatctccccact

SEQ ID NO: 3365472 - DNA, 22 bp, Homo sapiens
ctggatgaaataactccttctt

SEQ ID NO: 3365473 - DNA, 13 bp, Homo sapiens
ctggatgaaattt

SEQ ID NO: 3365474 - DNA, 16 bp, Homo sapiens
ctggatgagaaacagc

SEQ ID NO: 3365475 - DNA, 17 bp, Homo sapiens
ctggatgccaaggagcc

SEQ ID NO: 3365476 - DNA, 20 bp, Homo sapiens
ctggatgccaaggagcccct

SEQ ID NO: 3365477 - DNA, 15 bp, Homo sapiens
ctggatggagcccag

SEQ ID NO: 3365478 - DNA, 15 bp, Homo sapiens
ctggatgggcattgg

SEQ ID NO: 3365479 - DNA, 20 bp, Homo sapiens
ctggatgggcattgggctga

SEQ ID NO: 3365480 - DNA, 17 bp, Homo sapiens
ctggatgtgtggggcat

SEQ ID NO: 3365481 - DNA, 19 bp, Homo sapiens
ctggattctgggaggcaag

SEQ ID NO: 3365482 - DNA, 22 bp, Homo sapiens
ctggattgatcggagcctcctc

SEQ ID NO: 3365483 - DNA, 19 bp, Homo sapiens
ctggattgcagactgttct

SEQ ID NO: 3365484 - DNA, 13 bp, Homo sapiens
ctggatttgatga

SEQ ID NO: 3365485 - DNA, 18 bp, Homo sapiens
ctggattttttaaatcat

SEQ ID NO: 3365486 - DNA, 13 bp, Homo sapiens
ctggcaagaggcc

SEQ ID NO: 3365487 - DNA, 16 bp, Homo sapiens
ctggcaagaggcctca

SEQ ID NO: 3365488 - DNA, 13 bp, Homo sapiens
ctggcaagcaggg

SEQ ID NO: 3365489 - DNA, 14 bp, Homo sapiens
ctggcaagcaggga

SEQ ID NO: 3365490 - DNA, 19 bp, Homo sapiens
ctggcaatagtgtgttctg

SEQ ID NO: 3365491 - DNA, 17 bp, Homo sapiens
ctggcacacacccctcc

SEQ ID NO: 3365492 - DNA, 12 bp, Homo sapiens
ctggcacacatc

SEQ ID NO: 3365493 - DNA, 21 bp, Homo sapiens
ctggcacacatcaggagttca

SEQ ID NO: 3365494 - DNA, 22 bp, Homo sapiens
ctggcacaggactgattctggg

SEQ ID NO: 3365495 - DNA, 14 bp, Homo sapiens
ctggcacatttcag

SEQ ID NO: 3365496 - DNA, 19 bp, Homo sapiens
ctggcacccaccgtggagg

SEQ ID NO: 3365497 - DNA, 20 bp, Homo sapiens
ctggcacccggcccctgctg

SEQ ID NO: 3365498 - DNA, 18 bp, Homo sapiens
ctggcacgccctactcca

SEQ ID NO: 3365499 - DNA, 19 bp, Homo sapiens
ctggcactgaattaatcat

SEQ ID NO: 3365500 - DNA, 18 bp, Homo sapiens
ctggcacttagcccaaga

SEQ ID NO: 3365501 - DNA, 12 bp, Homo sapiens
ctggcagacaca

SEQ ID NO: 3365502 - DNA, 13 bp, Homo sapiens
ctggcagacacaa

SEQ ID NO: 3365503 - DNA, 21 bp, Homo sapiens
ctggcagatcgctcactgttg

SEQ ID NO: 3365504 - DNA, 14 bp, Homo sapiens
ctggcagcacagcc

SEQ ID NO: 3365505 - DNA, 16 bp, Homo sapiens
ctggcagcacagccca

SEQ ID NO: 3365506 - DNA, 17 bp, Homo sapiens
ctggcagcacagcccag

SEQ ID NO: 3365507 - DNA, 23 bp, Homo sapiens
ctggcagcacagcccagggcctg

SEQ ID NO: 3365508 - DNA, 12 bp, Homo sapiens
ctggcagcccag

SEQ ID NO: 3365509 - DNA, 16 bp, Homo sapiens
ctggcagcccagagac

SEQ ID NO: 3365510 - DNA, 20 bp, Homo sapiens
ctggcagccgtgccttcagc

SEQ ID NO: 3365511 - DNA, 19 bp, Homo sapiens
ctggcagctcctctccttg

SEQ ID NO: 3365512 - DNA, 22 bp, Homo sapiens
ctggcagctcctctccttgggc

SEQ ID NO: 3365513 - DNA, 16 bp, Homo sapiens
ctggcagctctccagt

SEQ ID NO: 3365514 - DNA, 17 bp, Homo sapiens
ctggcagctctccagtc

SEQ ID NO: 3365515 - DNA, 23 bp, Homo sapiens
ctggcagctctccagtcaggagg

SEQ ID NO: 3365516 - DNA, 18 bp, Homo sapiens
ctggcagctgagagccct

SEQ ID NO: 3365517 - DNA, 20 bp, Homo sapiens
ctggcagctgagagccctgc

SEQ ID NO: 3365518 - DNA, 12 bp, Homo sapiens
ctggcaggaggg

SEQ ID NO: 3365519 - DNA, 20 bp, Homo sapiens
ctggcaggatgaccctgcga

SEQ ID NO: 3365520 - DNA, 13 bp, Homo sapiens
ctggcagggctgg

SEQ ID NO: 3365521 - DNA, 21 bp, Homo sapiens
ctggcaggggagacaggagcc

SEQ ID NO: 3365522 - DNA, 23 bp, Homo sapiens
ctggcaggggagacaggagccta

SEQ ID NO: 3365523 - DNA, 14 bp, Homo sapiens
ctggcaggtgcaga

SEQ ID NO: 3365524 - DNA, 16 bp, Homo sapiens
ctggcaggtgcagatg

SEQ ID NO: 3365525 - DNA, 21 bp, Homo sapiens
ctggcaggtgcagatgggctg

SEQ ID NO: 3365526 - DNA, 22 bp, Homo sapiens
ctggcaggtgcagatgggctgt

SEQ ID NO: 3365527 - DNA, 23 bp, Homo sapiens
ctggcaggtgcagatgggctgtt

SEQ ID NO: 3365528 - DNA, 15 bp, Homo sapiens
ctggcagtttaaaaa

SEQ ID NO: 3365529 - DNA, 23 bp, Homo sapiens
ctggcatcaagaggtgggagggc

SEQ ID NO: 3365530 - DNA, 18 bp, Homo sapiens
ctggcatcatggtggata

SEQ ID NO: 3365531 - DNA, 19 bp, Homo sapiens
ctggcatcgcaccattctg

SEQ ID NO: 3365532 - DNA, 14 bp, Homo sapiens
ctggcatctctgca

SEQ ID NO: 3365533 - DNA, 19 bp, Homo sapiens
ctggcatctgacacaaaaa

SEQ ID NO: 3365534 - DNA, 18 bp, Homo sapiens
ctggcatcttagacctcc

SEQ ID NO: 3365535 - DNA, 14 bp, Homo sapiens
ctggcatgttttct

SEQ ID NO: 3365536 - DNA, 16 bp, Homo sapiens
ctggcattacagctgg

SEQ ID NO: 3365537 - DNA, 19 bp, Homo sapiens
ctggcattagaattattta

SEQ ID NO: 3365538 - DNA, 13 bp, Homo sapiens
ctggcattgaaat

SEQ ID NO: 3365539 - DNA, 16 bp, Homo sapiens
ctggcattgtccctgt

SEQ ID NO: 3365540 - DNA, 23 bp, Homo sapiens
ctggccaacatcgtgaaaccctg

SEQ ID NO: 3365541 - DNA, 15 bp, Homo sapiens
ctggccaccaggctg

SEQ ID NO: 3365542 - DNA, 19 bp, Homo sapiens
ctggccaccaggctggcgc

SEQ ID NO: 3365543 - DNA, 14 bp, Homo sapiens
ctggccacccctcc

SEQ ID NO: 3365544 - DNA, 20 bp, Homo sapiens
ctggccacccctccccagta

SEQ ID NO: 3365545 - DNA, 17 bp, Homo sapiens
ctggccacctgaggtgg

SEQ ID NO: 3365546 - DNA, 19 bp, Homo sapiens
ctggccactgcacagagct

SEQ ID NO: 3365547 - DNA, 14 bp, Homo sapiens
ctggccagagaggg

SEQ ID NO: 3365548 - DNA, 18 bp, Homo sapiens
ctggccagagagggccca

SEQ ID NO: 3365549 - DNA, 19 bp, Homo sapiens
ctggccagagagggcccag

SEQ ID NO: 3365550 - DNA, 14 bp, Homo sapiens
ctggccagatgcac

SEQ ID NO: 3365551 - DNA, 20 bp, Homo sapiens
ctggccagatgcaccagccc

SEQ ID NO: 3365552 - DNA, 15 bp, Homo sapiens
ctggccagcaaggca

SEQ ID NO: 3365553 - DNA, 21 bp, Homo sapiens
ctggccagcaccctctcctgg

SEQ ID NO: 3365554 - DNA, 19 bp, Homo sapiens
ctggccagcccttcctctc

SEQ ID NO: 3365555 - DNA, 14 bp, Homo sapiens
ctggccagcctggg

SEQ ID NO: 3365556 - DNA, 19 bp, Homo sapiens
ctggccagcctggggcctg

SEQ ID NO: 3365557 - DNA, 23 bp, Homo sapiens
ctggccagcctggggcctggcag

SEQ ID NO: 3365558 - DNA, 12 bp, Homo sapiens
ctggccaggagc

SEQ ID NO: 3365559 - DNA, 13 bp, Homo sapiens
ctggccaggagca

SEQ ID NO: 3365560 - DNA, 22 bp, Homo sapiens
ctggccaggcagatctgtgccc

SEQ ID NO: 3365561 - DNA, 14 bp, Homo sapiens
ctggccaggcatgg

SEQ ID NO: 3365562 - DNA, 15 bp, Homo sapiens
ctggccaggcatggc

SEQ ID NO: 3365563 - DNA, 16 bp, Homo sapiens
ctggccagggcagggc

SEQ ID NO: 3365564 - DNA, 14 bp, Homo sapiens
ctggccagggccac

SEQ ID NO: 3365565 - DNA, 23 bp, Homo sapiens
ctggccagtccaggctgccgtgg

SEQ ID NO: 3365566 - DNA, 17 bp, Homo sapiens
ctggccatccctcgtgg

SEQ ID NO: 3365567 - DNA, 13 bp, Homo sapiens
ctggcccaaagca

SEQ ID NO: 3365568 - DNA, 17 bp, Homo sapiens
ctggcccacgccctccc

SEQ ID NO: 3365569 - DNA, 22 bp, Homo sapiens
ctggcccacgccctccctctcc

SEQ ID NO: 3365570 - DNA, 23 bp, Homo sapiens
ctggcccagccaaaccctgtctg

SEQ ID NO: 3365571 - DNA, 13 bp, Homo sapiens
ctggcccagccgg

SEQ ID NO: 3365572 - DNA, 14 bp, Homo sapiens
ctggcccagccggc

SEQ ID NO: 3365573 - DNA, 19 bp, Homo sapiens
ctggcccagccggcctctc

SEQ ID NO: 3365574 - DNA, 23 bp, Homo sapiens
ctggcccagccggcctctctggc

SEQ ID NO: 3365575 - DNA, 23 bp, Homo sapiens
ctggcccatagaaacatgacact

SEQ ID NO: 3365576 - DNA, 17 bp, Homo sapiens
ctggcccatctcagcct

SEQ ID NO: 3365577 - DNA, 18 bp, Homo sapiens
ctggcccatctcagcctc

SEQ ID NO: 3365578 - DNA, 18 bp, Homo sapiens
ctggccccagccctgctg

SEQ ID NO: 3365579 - DNA, 23 bp, Homo sapiens
ctggccccagccctgctggggat

SEQ ID NO: 3365580 - DNA, 15 bp, Homo sapiens
ctggccccagggcac

SEQ ID NO: 3365581 - DNA, 17 bp, Homo sapiens
ctggcccccaacctcag

SEQ ID NO: 3365582 - DNA, 23 bp, Homo sapiens
ctggcccccaacctcagggctcc

SEQ ID NO: 3365583 - DNA, 11 bp, Homo sapiens
ctggcccccag

SEQ ID NO: 3365584 - DNA, 13 bp, Homo sapiens
ctggccccctccc

SEQ ID NO: 3365585 - DNA, 20 bp, Homo sapiens
ctggccccctccctggatga

SEQ ID NO: 3365586 - DNA, 23 bp, Homo sapiens
ctggccccggatcagagcaggac

SEQ ID NO: 3365587 - DNA, 14 bp, Homo sapiens
ctggcccctcgcct

SEQ ID NO: 3365588 - DNA, 15 bp, Homo sapiens
ctggcccctcgcctg

SEQ ID NO: 3365589 - DNA, 19 bp, Homo sapiens
ctggccctcgacactcacc

SEQ ID NO: 3365590 - DNA, 16 bp, Homo sapiens
ctggccctgccctgag

SEQ ID NO: 3365591 - DNA, 14 bp, Homo sapiens
ctggccctgcctcc

SEQ ID NO: 3365592 - DNA, 16 bp, Homo sapiens
ctggccctgcctcctg

SEQ ID NO: 3365593 - DNA, 21 bp, Homo sapiens
ctggccctgcctcctgggaag

SEQ ID NO: 3365594 - DNA, 21 bp, Homo sapiens
ctggccctgtgtaggggcagg

SEQ ID NO: 3365595 - DNA, 19 bp, Homo sapiens
ctggcccttgcctttgtgg

SEQ ID NO: 3365596 - DNA, 15 bp, Homo sapiens
ctggcccttggaata

SEQ ID NO: 3365597 - DNA, 19 bp, Homo sapiens
ctggcccttggaataaagt

SEQ ID NO: 3365598 - DNA, 18 bp, Homo sapiens
ctggccctttccccttcc

SEQ ID NO: 3365599 - DNA, 20 bp, Homo sapiens
ctggccctttccccttcccc

SEQ ID NO: 3365600 - DNA, 21 bp, Homo sapiens
ctggccgagggtcctggctcc

SEQ ID NO: 3365601 - DNA, 22 bp, Homo sapiens
ctggccgccccctgccccccag

SEQ ID NO: 3365602 - DNA, 16 bp, Homo sapiens
ctggccgggcaggcgt

SEQ ID NO: 3365603 - DNA, 17 bp, Homo sapiens
ctggccgggggaggtgg

SEQ ID NO: 3365604 - DNA, 21 bp, Homo sapiens
ctggccggtctgcaagtcaga

SEQ ID NO: 3365605 - DNA, 16 bp, Homo sapiens
ctggcctaaaatcttg

SEQ ID NO: 3365606 - DNA, 20 bp, Homo sapiens
ctggcctaaaatcttggaag

SEQ ID NO: 3365607 - DNA, 21 bp, Homo sapiens
ctggcctaggagatatctgag

SEQ ID NO: 3365608 - DNA, 22 bp, Homo sapiens
ctggcctcacccacccctgcac

SEQ ID NO: 3365609 - DNA, 19 bp, Homo sapiens
ctggcctcactggctgggg

SEQ ID NO: 3365610 - DNA, 22 bp, Homo sapiens
ctggcctcagttcccagctccc

SEQ ID NO: 3365611 - DNA, 15 bp, Homo sapiens
ctggcctcccacccg

SEQ ID NO: 3365612 - DNA, 17 bp, Homo sapiens
ctggcctctctagcaca

SEQ ID NO: 3365613 - DNA, 17 bp, Homo sapiens
ctggcctctggctctca

SEQ ID NO: 3365614 - DNA, 13 bp, Homo sapiens
ctggcctctgtgc

SEQ ID NO: 3365615 - DNA, 15 bp, Homo sapiens
ctggcctctgtgcct

SEQ ID NO: 3365616 - DNA, 20 bp, Homo sapiens
ctggcctctgtgccttcttt

SEQ ID NO: 3365617 - DNA, 12 bp, Homo sapiens
ctggcctgactt

SEQ ID NO: 3365618 - DNA, 18 bp, Homo sapiens
ctggcctgagctggggcc

SEQ ID NO: 3365619 - DNA, 12 bp, Homo sapiens
ctggcctgctgg

SEQ ID NO: 3365620 - DNA, 14 bp, Homo sapiens
ctggcctgctggga

SEQ ID NO: 3365621 - DNA, 23 bp, Homo sapiens
ctggcctggacagtatcccacat

SEQ ID NO: 3365622 - DNA, 22 bp, Homo sapiens
ctggcctggactgttttctctc

SEQ ID NO: 3365623 - DNA, 16 bp, Homo sapiens
ctggcctggcacacat

SEQ ID NO: 3365624 - DNA, 16 bp, Homo sapiens
ctggcctggccctgcc

SEQ ID NO: 3365625 - DNA, 23 bp, Homo sapiens
ctggcctggccctgccctgagga

SEQ ID NO: 3365626 - DNA, 13 bp, Homo sapiens
ctggcctggcctg

SEQ ID NO: 3365627 - DNA, 14 bp, Homo sapiens
ctggcctggcctgg

SEQ ID NO: 3365628 - DNA, 17 bp, Homo sapiens
ctggcctggcctggccc

SEQ ID NO: 3365629 - DNA, 18 bp, Homo sapiens
ctggcctggcctggccct

SEQ ID NO: 3365630 - DNA, 12 bp, Homo sapiens
ctggcctggctc

SEQ ID NO: 3365631 - DNA, 19 bp, Homo sapiens
ctggcctggctccccacga

SEQ ID NO: 3365632 - DNA, 22 bp, Homo sapiens
ctggccttaaaaggggcccaag

SEQ ID NO: 3365633 - DNA, 19 bp, Homo sapiens
ctggccttaaagagggaca

SEQ ID NO: 3365634 - DNA, 16 bp, Homo sapiens
ctggccttcctgccct

SEQ ID NO: 3365635 - DNA, 17 bp, Homo sapiens
ctggccttcggcctcca

SEQ ID NO: 3365636 - DNA, 21 bp, Homo sapiens
ctggccttcggcctccatcct

SEQ ID NO: 3365637 - DNA, 23 bp, Homo sapiens
ctggccttcggcctccatcctga

SEQ ID NO: 3365638 - DNA, 19 bp, Homo sapiens
ctggccttgaaaccacctt

SEQ ID NO: 3365639 - DNA, 19 bp, Homo sapiens
ctggcctttttcatttatc

SEQ ID NO: 3365640 - DNA, 20 bp, Homo sapiens
ctggcctttttcatttatct

SEQ ID NO: 3365641 - DNA, 21 bp, Homo sapiens
ctggcctttttcatttatcta

SEQ ID NO: 3365642 - DNA, 13 bp, Homo sapiens
ctggcgacacact

SEQ ID NO: 3365643 - DNA, 18 bp, Homo sapiens
ctggcgacacactccgtc

SEQ ID NO: 3365644 - DNA, 19 bp, Homo sapiens
ctggcgcagccaaggccga

SEQ ID NO: 3365645 - DNA, 14 bp, Homo sapiens
ctggcgcaggtggg

SEQ ID NO: 3365646 - DNA, 16 bp, Homo sapiens
ctggcgcaggtgggct

SEQ ID NO: 3365647 - DNA, 13 bp, Homo sapiens
ctggcggcttcct

SEQ ID NO: 3365648 - DNA, 14 bp, Homo sapiens
ctggcggcttcctg

SEQ ID NO: 3365649 - DNA, 13 bp, Homo sapiens
ctggcgggatggg

SEQ ID NO: 3365650 - DNA, 20 bp, Homo sapiens
ctggcgggatgggccaccgc

SEQ ID NO: 3365651 - DNA, 14 bp, Homo sapiens
ctggcgtgcagtgg

SEQ ID NO: 3365652 - DNA, 15 bp, Homo sapiens
ctggcgtgcagtggt

SEQ ID NO: 3365653 - DNA, 16 bp, Homo sapiens
ctggctaagcctctgc

SEQ ID NO: 3365654 - DNA, 19 bp, Homo sapiens
ctggctaagcctctgcttc

SEQ ID NO: 3365655 - DNA, 12 bp, Homo sapiens
ctggctacatcc

SEQ ID NO: 3365656 - DNA, 16 bp, Homo sapiens
ctggctacatcccagc

SEQ ID NO: 3365657 - DNA, 23 bp, Homo sapiens
ctggctagaggccagccccaccc

SEQ ID NO: 3365658 - DNA, 16 bp, Homo sapiens
ctggctagagtcctca

SEQ ID NO: 3365659 - DNA, 17 bp, Homo sapiens
ctggctagagtcctcac

SEQ ID NO: 3365660 - DNA, 19 bp, Homo sapiens
ctggctagagtcctcactc

SEQ ID NO: 3365661 - DNA, 20 bp, Homo sapiens
ctggctagagtcctcactcc

SEQ ID NO: 3365662 - DNA, 21 bp, Homo sapiens
ctggctagagtcctcactccc

SEQ ID NO: 3365663 - DNA, 15 bp, Homo sapiens
ctggctcacagtaca

SEQ ID NO: 3365664 - DNA, 22 bp, Homo sapiens
ctggctcacagtacagcatgtg

SEQ ID NO: 3365665 - DNA, 13 bp, Homo sapiens
ctggctccacacc

SEQ ID NO: 3365666 - DNA, 19 bp, Homo sapiens
ctggctccacacctccacc

SEQ ID NO: 3365667 - DNA, 21 bp, Homo sapiens
ctggctccatgattctctgag

SEQ ID NO: 3365668 - DNA, 22 bp, Homo sapiens
ctggctccatgattctctgagt

SEQ ID NO: 3365669 - DNA, 19 bp, Homo sapiens
ctggctcccacaggccctt

SEQ ID NO: 3365670 - DNA, 22 bp, Homo sapiens
ctggctcccacaggcccttcct

SEQ ID NO: 3365671 - DNA, 16 bp, Homo sapiens
ctggctccccacgagt

SEQ ID NO: 3365672 - DNA, 22 bp, Homo sapiens
ctggctccccacgagtcacctg

SEQ ID NO: 3365673 - DNA, 17 bp, Homo sapiens
ctggctccctcctccag

SEQ ID NO: 3365674 - DNA, 23 bp, Homo sapiens
ctggctccctcctccaggcctgc

SEQ ID NO: 3365675 - DNA, 20 bp, Homo sapiens
ctggctccgtccaggagcct

SEQ ID NO: 3365676 - DNA, 16 bp, Homo sapiens
ctggctcctaggggaa

SEQ ID NO: 3365677 - DNA, 22 bp, Homo sapiens
ctggctcctttacaaaagaaat

SEQ ID NO: 3365678 - DNA, 22 bp, Homo sapiens
ctggctctaattcacagtgctc

SEQ ID NO: 3365679 - DNA, 23 bp, Homo sapiens
ctggctctaattcacagtgctct

SEQ ID NO: 3365680 - DNA, 14 bp, Homo sapiens
ctggctctccaagt

SEQ ID NO: 3365681 - DNA, 17 bp, Homo sapiens
ctggctctccaagtgcc

SEQ ID NO: 3365682 - DNA, 23 bp, Homo sapiens
ctggctctccaagtgccagaggt

SEQ ID NO: 3365683 - DNA, 14 bp, Homo sapiens
ctggctctctccag

SEQ ID NO: 3365684 - DNA, 16 bp, Homo sapiens
ctggctctgagaatca

SEQ ID NO: 3365685 - DNA, 13 bp, Homo sapiens
ctggctctgagcg

SEQ ID NO: 3365686 - DNA, 24 bp, Homo sapiens
ctggctctgcaatgggcactggga

SEQ ID NO: 3365687 - DNA, 14 bp, Homo sapiens
ctggctctgctgtc

SEQ ID NO: 3365688 - DNA, 14 bp, Homo sapiens
ctggctctgtggag

SEQ ID NO: 3365689 - DNA, 15 bp, Homo sapiens
ctggctctgtggagg

SEQ ID NO: 3365690 - DNA, 21 bp, Homo sapiens
ctggctcttgatacccccctc

SEQ ID NO: 3365691 - DNA, 22 bp, Homo sapiens
ctggctgaggatttcaagcctg

SEQ ID NO: 3365692 - DNA, 23 bp, Homo sapiens
ctggctgaggttcctctgcctgc

SEQ ID NO: 3365693 - DNA, 22 bp, Homo sapiens
ctggctgagtggaatgcaggga

SEQ ID NO: 3365694 - DNA, 23 bp, Homo sapiens
ctggctgagtggaatgcagggaa

SEQ ID NO: 3365695 - DNA, 13 bp, Homo sapiens
ctggctgccaggc

SEQ ID NO: 3365696 - DNA, 15 bp, Homo sapiens
ctggctgccaggcgt

SEQ ID NO: 3365697 - DNA, 22 bp, Homo sapiens
ctggctgccaggcgttggtgcc

SEQ ID NO: 3365698 - DNA, 13 bp, Homo sapiens
ctggctgcccaga

SEQ ID NO: 3365699 - DNA, 14 bp, Homo sapiens
ctggctgccctggc

SEQ ID NO: 3365700 - DNA, 12 bp, Homo sapiens
ctggctgctgcc

SEQ ID NO: 3365701 - DNA, 15 bp, Homo sapiens
ctggctgctgccccc

SEQ ID NO: 3365702 - DNA, 19 bp, Homo sapiens
ctggctgctgcccccaccc

SEQ ID NO: 3365703 - DNA, 17 bp, Homo sapiens
ctggctggcccagagtt

SEQ ID NO: 3365704 - DNA, 13 bp, Homo sapiens
ctggctggcctca

SEQ ID NO: 3365705 - DNA, 17 bp, Homo sapiens
ctggctggcctcaccca

SEQ ID NO: 3365706 - DNA, 14 bp, Homo sapiens
ctggctggcctgag

SEQ ID NO: 3365707 - DNA, 16 bp, Homo sapiens
ctggctggctcctagg

SEQ ID NO: 3365708 - DNA, 15 bp, Homo sapiens
ctggctggctgcagt

SEQ ID NO: 3365709 - DNA, 16 bp, Homo sapiens
ctggctgggatcagag

SEQ ID NO: 3365710 - DNA, 15 bp, Homo sapiens
ctggctgggcatgga

SEQ ID NO: 3365711 - DNA, 17 bp, Homo sapiens
ctggctgggttcaggtc

SEQ ID NO: 3365712 - DNA, 15 bp, Homo sapiens
ctggctgtaaggctc

SEQ ID NO: 3365713 - DNA, 16 bp, Homo sapiens
ctggctgtaaggctct

SEQ ID NO: 3365714 - DNA, 19 bp, Homo sapiens
ctggctgtaaggctctaga

SEQ ID NO: 3365715 - DNA, 19 bp, Homo sapiens
ctggctgtcagtatgacat

SEQ ID NO: 3365716 - DNA, 17 bp, Homo sapiens
ctggctgtggaggcctg

SEQ ID NO: 3365717 - DNA, 19 bp, Homo sapiens
ctggctgtggaggcctgat

SEQ ID NO: 3365718 - DNA, 17 bp, Homo sapiens
ctggctgttggctgggg

SEQ ID NO: 3365719 - DNA, 17 bp, Homo sapiens
ctggctgtttagcagaa

SEQ ID NO: 3365720 - DNA, 18 bp, Homo sapiens
ctggctgtttagcagaac

SEQ ID NO: 3365721 - DNA, 14 bp, Homo sapiens
ctggcttagtgcca

SEQ ID NO: 3365722 - DNA, 21 bp, Homo sapiens
ctggcttagtgccacccacct

SEQ ID NO: 3365723 - DNA, 24 bp, Homo sapiens
ctggcttccagcttcaggcaccag

SEQ ID NO: 3365724 - DNA, 22 bp, Homo sapiens
ctggcttcccatagtggggcct

SEQ ID NO: 3365725 - DNA, 14 bp, Homo sapiens
ctggcttctggagc

SEQ ID NO: 3365726 - DNA, 16 bp, Homo sapiens
ctggcttctggagccc

SEQ ID NO: 3365727 - DNA, 21 bp, Homo sapiens
ctggcttgcccgcgctctttc

SEQ ID NO: 3365728 - DNA, 14 bp, Homo sapiens
ctggcttgcttgcc

SEQ ID NO: 3365729 - DNA, 23 bp, Homo sapiens
ctggcttggccacaacctgaaag

SEQ ID NO: 3365730 - DNA, 15 bp, Homo sapiens
ctggcttttcactgc

SEQ ID NO: 3365731 - DNA, 22 bp, Homo sapiens
ctggctttttcctctgagccca

SEQ ID NO: 3365732 - DNA, 17 bp, Homo sapiens
ctgggaaagcataaagc

SEQ ID NO: 3365733 - DNA, 14 bp, Homo sapiens
ctgggaaccactcc

SEQ ID NO: 3365734 - DNA, 16 bp, Homo sapiens
ctgggaaccactccca

SEQ ID NO: 3365735 - DNA, 18 bp, Homo sapiens
ctgggaaccactcccacc

SEQ ID NO: 3365736 - DNA, 13 bp, Homo sapiens
ctgggaaccccgc

SEQ ID NO: 3365737 - DNA, 21 bp, Homo sapiens
ctgggaaccccgcagcccgtg

SEQ ID NO: 3365738 - DNA, 13 bp, Homo sapiens
ctgggaacctccc

SEQ ID NO: 3365739 - DNA, 15 bp, Homo sapiens
ctgggaacctcccag

SEQ ID NO: 3365740 - DNA, 21 bp, Homo sapiens
ctgggaacctcccagaggtcc

SEQ ID NO: 3365741 - DNA, 23 bp, Homo sapiens
ctgggaacctcccagaggtccag

SEQ ID NO: 3365742 - DNA, 22 bp, Homo sapiens
ctgggaagagaagagggcccag

SEQ ID NO: 3365743 - DNA, 23 bp, Homo sapiens
ctgggaagagaagagggcccagc

SEQ ID NO: 3365744 - DNA, 20 bp, Homo sapiens
ctgggaagataggctctgca

SEQ ID NO: 3365745 - DNA, 21 bp, Homo sapiens
ctgggaagctgtactcagagc

SEQ ID NO: 3365746 - DNA, 13 bp, Homo sapiens
ctgggaagggaag

SEQ ID NO: 3365747 - DNA, 15 bp, Homo sapiens
ctgggaatcatgtcc

SEQ ID NO: 3365748 - DNA, 18 bp, Homo sapiens
ctgggaatgggagagggg

SEQ ID NO: 3365749 - DNA, 12 bp, Homo sapiens
ctgggaccagag

SEQ ID NO: 3365750 - DNA, 13 bp, Homo sapiens
ctgggaccagagc

SEQ ID NO: 3365751 - DNA, 16 bp, Homo sapiens
ctgggaccagagccag

SEQ ID NO: 3365752 - DNA, 17 bp, Homo sapiens
ctgggaccagagccaga

SEQ ID NO: 3365753 - DNA, 20 bp, Homo sapiens
ctgggaccagagccagatgc

SEQ ID NO: 3365754 - DNA, 12 bp, Homo sapiens
ctgggacccagc

SEQ ID NO: 3365755 - DNA, 14 bp, Homo sapiens
ctgggacccagcta

SEQ ID NO: 3365756 - DNA, 15 bp, Homo sapiens
ctgggactacaggca

SEQ ID NO: 3365757 - DNA, 17 bp, Homo sapiens
ctgggactacaggcacc

SEQ ID NO: 3365758 - DNA, 21 bp, Homo sapiens
ctgggactacaggcacccacc

SEQ ID NO: 3365759 - DNA, 17 bp, Homo sapiens
ctgggactacaggtgtg

SEQ ID NO: 3365760 - DNA, 13 bp, Homo sapiens
ctgggactcagcc

SEQ ID NO: 3365761 - DNA, 14 bp, Homo sapiens
ctgggactcagcct

SEQ ID NO: 3365762 - DNA, 13 bp, Homo sapiens
ctgggactcctgg

SEQ ID NO: 3365763 - DNA, 14 bp, Homo sapiens
ctgggactcctggt

SEQ ID NO: 3365764 - DNA, 20 bp, Homo sapiens
ctgggactcctggtgcccct

SEQ ID NO: 3365765 - DNA, 13 bp, Homo sapiens
ctgggactggcca

SEQ ID NO: 3365766 - DNA, 14 bp, Homo sapiens
ctgggactggccag

SEQ ID NO: 3365767 - DNA, 16 bp, Homo sapiens
ctgggacttccttgct

SEQ ID NO: 3365768 - DNA, 18 bp, Homo sapiens
ctgggacttccttgctct

SEQ ID NO: 3365769 - DNA, 12 bp, Homo sapiens
ctgggagacaga

SEQ ID NO: 3365770 - DNA, 12 bp, Homo sapiens
ctgggagagaag

SEQ ID NO: 3365771 - DNA, 12 bp, Homo sapiens
ctgggagaggat

SEQ ID NO: 3365772 - DNA, 14 bp, Homo sapiens
ctgggagcagaaac

SEQ ID NO: 3365773 - DNA, 16 bp, Homo sapiens
ctgggagcagaaacag

SEQ ID NO: 3365774 - DNA, 21 bp, Homo sapiens
ctgggagcagaaacagccatt

SEQ ID NO: 3365775 - DNA, 22 bp, Homo sapiens
ctgggagcatagcagaggggcc

SEQ ID NO: 3365776 - DNA, 17 bp, Homo sapiens
ctgggagccacttctcc

SEQ ID NO: 3365777 - DNA, 13 bp, Homo sapiens
ctgggagcccaga

SEQ ID NO: 3365778 - DNA, 22 bp, Homo sapiens
ctgggagcccccaccacaaact

SEQ ID NO: 3365779 - DNA, 11 bp, Homo sapiens
ctgggagcttc

SEQ ID NO: 3365780 - DNA, 13 bp, Homo sapiens
ctgggaggaagca

SEQ ID NO: 3365781 - DNA, 15 bp, Homo sapiens
ctgggaggacaggca

SEQ ID NO: 3365782 - DNA, 17 bp, Homo sapiens
ctgggaggacaggcagg

SEQ ID NO: 3365783 - DNA, 20 bp, Homo sapiens
ctgggaggacaggcaggcca

SEQ ID NO: 3365784 - DNA, 14 bp, Homo sapiens
ctgggaggaggaag

SEQ ID NO: 3365785 - DNA, 16 bp, Homo sapiens
ctgggaggagggagag

SEQ ID NO: 3365786 - DNA, 17 bp, Homo sapiens
ctgggaggcaagaaaag

SEQ ID NO: 3365787 - DNA, 20 bp, Homo sapiens
ctgggaggcaagaggggtgg

SEQ ID NO: 3365788 - DNA, 15 bp, Homo sapiens
ctgggaggcagaggt

SEQ ID NO: 3365789 - DNA, 13 bp, Homo sapiens
ctgggaggcatgg

SEQ ID NO: 3365790 - DNA, 19 bp, Homo sapiens
ctgggaggcatggccctgg

SEQ ID NO: 3365791 - DNA, 20 bp, Homo sapiens
ctgggaggccctgagacagg

SEQ ID NO: 3365792 - DNA, 16 bp, Homo sapiens
ctgggagggttcccct

SEQ ID NO: 3365793 - DNA, 20 bp, Homo sapiens
ctgggagggttcccctggcc

SEQ ID NO: 3365794 - DNA, 22 bp, Homo sapiens
ctgggagggttcccctggcctt

SEQ ID NO: 3365795 - DNA, 15 bp, Homo sapiens
ctgggagtcagagcc

SEQ ID NO: 3365796 - DNA, 21 bp, Homo sapiens
ctgggagtcagagccctggct

SEQ ID NO: 3365797 - DNA, 14 bp, Homo sapiens
ctgggagtcccctt

SEQ ID NO: 3365798 - DNA, 19 bp, Homo sapiens
ctgggagttctagaaccac

SEQ ID NO: 3365799 - DNA, 18 bp, Homo sapiens
ctgggataactgatttct

SEQ ID NO: 3365800 - DNA, 18 bp, Homo sapiens
ctgggatatggctgccca

SEQ ID NO: 3365801 - DNA, 19 bp, Homo sapiens
ctgggatatggctgcccag

SEQ ID NO: 3365802 - DNA, 21 bp, Homo sapiens
ctgggatatggctgcccagga

SEQ ID NO: 3365803 - DNA, 20 bp, Homo sapiens
ctgggatcagagcaggagca

SEQ ID NO: 3365804 - DNA, 22 bp, Homo sapiens
ctgggatgacaggcgcctgcca

SEQ ID NO: 3365805 - DNA, 20 bp, Homo sapiens
ctgggatgctagccccagag

SEQ ID NO: 3365806 - DNA, 21 bp, Homo sapiens
ctgggatgctagccccagaga

SEQ ID NO: 3365807 - DNA, 17 bp, Homo sapiens
ctgggatggaggggagt

SEQ ID NO: 3365808 - DNA, 17 bp, Homo sapiens
ctgggatgggaccaggg

SEQ ID NO: 3365809 - DNA, 14 bp, Homo sapiens
ctgggatgtagaac

SEQ ID NO: 3365810 - DNA, 16 bp, Homo sapiens
ctgggatgtagaactt

SEQ ID NO: 3365811 - DNA, 15 bp, Homo sapiens
ctgggattaagggca

SEQ ID NO: 3365812 - DNA, 20 bp, Homo sapiens
ctgggattacaggcatgagc

SEQ ID NO: 3365813 - DNA, 23 bp, Homo sapiens
ctgggattccttagactcttttc

SEQ ID NO: 3365814 - DNA, 17 bp, Homo sapiens
ctgggattctactttaa

SEQ ID NO: 3365815 - DNA, 21 bp, Homo sapiens
ctgggattctactttaagcac

SEQ ID NO: 3365816 - DNA, 22 bp, Homo sapiens
ctgggattctactttaagcact

SEQ ID NO: 3365817 - DNA, 23 bp, Homo sapiens
ctgggattctactttaagcacta

SEQ ID NO: 3365818 - DNA, 19 bp, Homo sapiens
ctgggatttcttcgctgct

SEQ ID NO: 3365819 - DNA, 22 bp, Homo sapiens
ctgggatttcttcgctgctcta

SEQ ID NO: 3365820 - DNA, 21 bp, Homo sapiens
ctgggcaaagccacaaggctg

SEQ ID NO: 3365821 - DNA, 18 bp, Homo sapiens
ctgggcaccacaaaatat

SEQ ID NO: 3365822 - DNA, 15 bp, Homo sapiens
ctgggcagccaggct

SEQ ID NO: 3365823 - DNA, 16 bp, Homo sapiens
ctgggcagccaggctg

SEQ ID NO: 3365824 - DNA, 17 bp, Homo sapiens
ctgggcagccaggctgc

SEQ ID NO: 3365825 - DNA, 14 bp, Homo sapiens
ctgggcagccccag

SEQ ID NO: 3365826 - DNA, 15 bp, Homo sapiens
ctgggcagccccaga

SEQ ID NO: 3365827 - DNA, 17 bp, Homo sapiens
ctgggcagccccagaga

SEQ ID NO: 3365828 - DNA, 19 bp, Homo sapiens
ctgggcagccccagagaga

SEQ ID NO: 3365829 - DNA, 21 bp, Homo sapiens
ctgggcaggcggtccccatcc

SEQ ID NO: 3365830 - DNA, 14 bp, Homo sapiens
ctgggcatctgttc

SEQ ID NO: 3365831 - DNA, 17 bp, Homo sapiens
ctgggcatctgttctgg

SEQ ID NO: 3365832 - DNA, 19 bp, Homo sapiens
ctgggccaactcacctgag

SEQ ID NO: 3365833 - DNA, 21 bp, Homo sapiens
ctgggccaagttcctctagtg

SEQ ID NO: 3365834 - DNA, 14 bp, Homo sapiens
ctgggccacggagg

SEQ ID NO: 3365835 - DNA, 15 bp, Homo sapiens
ctgggccactgggga

SEQ ID NO: 3365836 - DNA, 21 bp, Homo sapiens
ctgggccaggaggtagtttct

SEQ ID NO: 3365837 - DNA, 15 bp, Homo sapiens
ctgggccagggtctg

SEQ ID NO: 3365838 - DNA, 19 bp, Homo sapiens
ctgggccagggtctgtgtg

SEQ ID NO: 3365839 - DNA, 22 bp, Homo sapiens
ctgggccagggtctgtgtgaat

SEQ ID NO: 3365840 - DNA, 18 bp, Homo sapiens
ctgggccatgtccaaaga

SEQ ID NO: 3365841 - DNA, 12 bp, Homo sapiens
ctgggcccagcc

SEQ ID NO: 3365842 - DNA, 15 bp, Homo sapiens
ctgggccccacctac

SEQ ID NO: 3365843 - DNA, 16 bp, Homo sapiens
ctgggccccatgctct

SEQ ID NO: 3365844 - DNA, 18 bp, Homo sapiens
ctgggccccatgctctgc

SEQ ID NO: 3365845 - DNA, 14 bp, Homo sapiens
ctgggcccctccac

SEQ ID NO: 3365846 - DNA, 17 bp, Homo sapiens
ctgggcccctccacgcc

SEQ ID NO: 3365847 - DNA, 14 bp, Homo sapiens
ctgggccctgggct

SEQ ID NO: 3365848 - DNA, 21 bp, Homo sapiens
ctgggcctcagttcaacctgg

SEQ ID NO: 3365849 - DNA, 18 bp, Homo sapiens
ctgggcctcatcacagca

SEQ ID NO: 3365850 - DNA, 19 bp, Homo sapiens
ctgggcctcccttgggctg

SEQ ID NO: 3365851 - DNA, 21 bp, Homo sapiens
ctgggcctcgtgcgcccgtgg

SEQ ID NO: 3365852 - DNA, 11 bp, Homo sapiens
ctgggcctctg

SEQ ID NO: 3365853 - DNA, 14 bp, Homo sapiens
ctgggcctctgccc

SEQ ID NO: 3365854 - DNA, 21 bp, Homo sapiens
ctgggcctgcttttccaggat

SEQ ID NO: 3365855 - DNA, 13 bp, Homo sapiens
ctgggcctgggct

SEQ ID NO: 3365856 - DNA, 16 bp, Homo sapiens
ctgggcctgggctagg

SEQ ID NO: 3365857 - DNA, 13 bp, Homo sapiens
ctgggcctggggt

SEQ ID NO: 3365858 - DNA, 14 bp, Homo sapiens
ctgggcctggggtg

SEQ ID NO: 3365859 - DNA, 19 bp, Homo sapiens
ctgggcctgtgcagcagcc

SEQ ID NO: 3365860 - DNA, 16 bp, Homo sapiens
ctgggcctttgcaaga

SEQ ID NO: 3365861 - DNA, 17 bp, Homo sapiens
ctgggcctttgtttcct

SEQ ID NO: 3365862 - DNA, 21 bp, Homo sapiens
ctgggcgacagagcgagactc

SEQ ID NO: 3365863 - DNA, 16 bp, Homo sapiens
ctgggctacaatttgt

SEQ ID NO: 3365864 - DNA, 20 bp, Homo sapiens
ctgggctaggggacatcaga

SEQ ID NO: 3365865 - DNA, 12 bp, Homo sapiens
ctgggctcacag

SEQ ID NO: 3365866 - DNA, 17 bp, Homo sapiens
ctgggctcacaggcctc

SEQ ID NO: 3365867 - DNA, 13 bp, Homo sapiens
ctgggctcagggc

SEQ ID NO: 3365868 - DNA, 15 bp, Homo sapiens
ctgggctcagggctg

SEQ ID NO: 3365869 - DNA, 18 bp, Homo sapiens
ctgggctcagggctggag

SEQ ID NO: 3365870 - DNA, 20 bp, Homo sapiens
ctgggctcagggctggagtg

SEQ ID NO: 3365871 - DNA, 17 bp, Homo sapiens
ctgggctgccatgtgaa

SEQ ID NO: 3365872 - DNA, 20 bp, Homo sapiens
ctgggctgccatgtgaagag

SEQ ID NO: 3365873 - DNA, 20 bp, Homo sapiens
ctgggctgcgggaggccctg

SEQ ID NO: 3365874 - DNA, 22 bp, Homo sapiens
ctgggctgcgggaggccctggc

SEQ ID NO: 3365875 - DNA, 12 bp, Homo sapiens
ctgggctggact

SEQ ID NO: 3365876 - DNA, 13 bp, Homo sapiens
ctgggctggactg

SEQ ID NO: 3365877 - DNA, 17 bp, Homo sapiens
ctgggctgggccctctt

SEQ ID NO: 3365878 - DNA, 14 bp, Homo sapiens
ctgggctgggtggc

SEQ ID NO: 3365879 - DNA, 20 bp, Homo sapiens
ctgggctgggtggcacacca

SEQ ID NO: 3365880 - DNA, 13 bp, Homo sapiens
ctgggctgtctgt

SEQ ID NO: 3365881 - DNA, 18 bp, Homo sapiens
ctgggctgtctgtcacca

SEQ ID NO: 3365882 - DNA, 13 bp, Homo sapiens
ctgggctgtgctg

SEQ ID NO: 3365883 - DNA, 12 bp, Homo sapiens
ctgggctgtgtg

SEQ ID NO: 3365884 - DNA, 13 bp, Homo sapiens
ctgggctgttggc

SEQ ID NO: 3365885 - DNA, 15 bp, Homo sapiens
ctgggctgttggcac

SEQ ID NO: 3365886 - DNA, 20 bp, Homo sapiens
ctgggcttcagtggcagctg

SEQ ID NO: 3365887 - DNA, 23 bp, Homo sapiens
ctgggctttttttttctctttct

SEQ ID NO: 3365888 - DNA, 19 bp, Homo sapiens
ctggggaaagacgccttca

SEQ ID NO: 3365889 - DNA, 17 bp, Homo sapiens
ctggggaatgctcccag

SEQ ID NO: 3365890 - DNA, 24 bp, Homo sapiens
ctggggaccccaacctcagaggca

SEQ ID NO: 3365891 - DNA, 14 bp, Homo sapiens
ctggggactcaggg

SEQ ID NO: 3365892 - DNA, 19 bp, Homo sapiens
ctggggactgttccaaagc

SEQ ID NO: 3365893 - DNA, 18 bp, Homo sapiens
ctggggacttgtgtctgc

SEQ ID NO: 3365894 - DNA, 16 bp, Homo sapiens
ctggggagaggaaaga

SEQ ID NO: 3365895 - DNA, 14 bp, Homo sapiens
ctggggaggacctg

SEQ ID NO: 3365896 - DNA, 22 bp, Homo sapiens
ctggggaggccctaggggagca

SEQ ID NO: 3365897 - DNA, 22 bp, Homo sapiens
ctggggatccccgcctggccag

SEQ ID NO: 3365898 - DNA, 23 bp, Homo sapiens
ctggggatccccgcctggccagg

SEQ ID NO: 3365899 - DNA, 16 bp, Homo sapiens
ctggggatgtgggagg

SEQ ID NO: 3365900 - DNA, 22 bp, Homo sapiens
ctggggatgtgggagggagcag

SEQ ID NO: 3365901 - DNA, 17 bp, Homo sapiens
ctggggcagaggggcag

SEQ ID NO: 3365902 - DNA, 22 bp, Homo sapiens
ctggggcagaggggcagccgct

SEQ ID NO: 3365903 - DNA, 18 bp, Homo sapiens
ctggggcagcactcccca

SEQ ID NO: 3365904 - DNA, 16 bp, Homo sapiens
ctggggcaggctgggc

SEQ ID NO: 3365905 - DNA, 18 bp, Homo sapiens
ctggggcaggctgggcca

SEQ ID NO: 3365906 - DNA, 21 bp, Homo sapiens
ctggggcaggctgggccatgt

SEQ ID NO: 3365907 - DNA, 18 bp, Homo sapiens
ctggggcatgtgtgcctg

SEQ ID NO: 3365908 - DNA, 19 bp, Homo sapiens
ctggggcatgtgtgcctgt

SEQ ID NO: 3365909 - DNA, 23 bp, Homo sapiens
ctggggcatgtgtgcctgtggca

SEQ ID NO: 3365910 - DNA, 12 bp, Homo sapiens
ctggggcccagg

SEQ ID NO: 3365911 - DNA, 21 bp, Homo sapiens
ctggggcccaggaagcccaca

SEQ ID NO: 3365912 - DNA, 21 bp, Homo sapiens
ctggggccctcagctcctggg

SEQ ID NO: 3365913 - DNA, 16 bp, Homo sapiens
ctggggccctgggcct

SEQ ID NO: 3365914 - DNA, 19 bp, Homo sapiens
ctggggccgccacggcctg

SEQ ID NO: 3365915 - DNA, 19 bp, Homo sapiens
ctggggcctagactctgta

SEQ ID NO: 3365916 - DNA, 23 bp, Homo sapiens
ctggggcctagcgatctctcctg

SEQ ID NO: 3365917 - DNA, 11 bp, Homo sapiens
ctggggcctcc

SEQ ID NO: 3365918 - DNA, 17 bp, Homo sapiens
ctggggcctccagaact

SEQ ID NO: 3365919 - DNA, 13 bp, Homo sapiens
ctggggcctgaga

SEQ ID NO: 3365920 - DNA, 15 bp, Homo sapiens
ctggggcctgagaga

SEQ ID NO: 3365921 - DNA, 13 bp, Homo sapiens
ctggggcctggca

SEQ ID NO: 3365922 - DNA, 18 bp, Homo sapiens
ctggggcgggcccctcat

SEQ ID NO: 3365923 - DNA, 18 bp, Homo sapiens
ctggggcggggcccagga

SEQ ID NO: 3365924 - DNA, 14 bp, Homo sapiens
ctggggcgtgggga

SEQ ID NO: 3365925 - DNA, 13 bp, Homo sapiens
ctggggctccctc

SEQ ID NO: 3365926 - DNA, 14 bp, Homo sapiens
ctggggctccctct

SEQ ID NO: 3365927 - DNA, 23 bp, Homo sapiens
ctggggctcctttctccagccag

SEQ ID NO: 3365928 - DNA, 14 bp, Homo sapiens
ctggggctctgtgc

SEQ ID NO: 3365929 - DNA, 12 bp, Homo sapiens
ctggggctgggc

SEQ ID NO: 3365930 - DNA, 18 bp, Homo sapiens
ctggggctggggtgagag

SEQ ID NO: 3365931 - DNA, 20 bp, Homo sapiens
ctggggcttctcctgaccca

SEQ ID NO: 3365932 - DNA, 13 bp, Homo sapiens
ctggggctttgcc

SEQ ID NO: 3365933 - DNA, 18 bp, Homo sapiens
ctggggctttgccttgca

SEQ ID NO: 3365934 - DNA, 19 bp, Homo sapiens
ctggggctttgccttgcag

SEQ ID NO: 3365935 - DNA, 20 bp, Homo sapiens
ctgggggacccaatgtagga

SEQ ID NO: 3365936 - DNA, 22 bp, Homo sapiens
ctgggggactgggagtcagagc

SEQ ID NO: 3365937 - DNA, 12 bp, Homo sapiens
ctgggggcagtg

SEQ ID NO: 3365938 - DNA, 20 bp, Homo sapiens
ctgggggcagtgactggcag

SEQ ID NO: 3365939 - DNA, 21 bp, Homo sapiens
ctgggggcagtgactggcagg

SEQ ID NO: 3365940 - DNA, 13 bp, Homo sapiens
ctgggggcctcag

SEQ ID NO: 3365941 - DNA, 18 bp, Homo sapiens
ctgggggcctcagtgcca

SEQ ID NO: 3365942 - DNA, 19 bp, Homo sapiens
ctggggtcaccctctccag

SEQ ID NO: 3365943 - DNA, 13 bp, Homo sapiens
ctggggtccccca

SEQ ID NO: 3365944 - DNA, 13 bp, Homo sapiens
ctggggtctgagc

SEQ ID NO: 3365945 - DNA, 13 bp, Homo sapiens
ctggggtgaatac

SEQ ID NO: 3365946 - DNA, 16 bp, Homo sapiens
ctggggtgagagagga

SEQ ID NO: 3365947 - DNA, 19 bp, Homo sapiens
ctggggtgagagaggaaag

SEQ ID NO: 3365948 - DNA, 16 bp, Homo sapiens
ctggggtggccaccag

SEQ ID NO: 3365949 - DNA, 15 bp, Homo sapiens
ctggggtggcctcaa

SEQ ID NO: 3365950 - DNA, 21 bp, Homo sapiens
ctggggtgggaggtcttgcta

SEQ ID NO: 3365951 - DNA, 23 bp, Homo sapiens
ctgggtaaaagcagggcagcagg

SEQ ID NO: 3365952 - DNA, 14 bp, Homo sapiens
ctgggtaagaagaa

SEQ ID NO: 3365953 - DNA, 19 bp, Homo sapiens
ctgggtacttgtggacaca

SEQ ID NO: 3365954 - DNA, 23 bp, Homo sapiens
ctgggtacttgtggacacagctc

SEQ ID NO: 3365955 - DNA, 16 bp, Homo sapiens
ctgggtatgcgtttca

SEQ ID NO: 3365956 - DNA, 17 bp, Homo sapiens
ctgggtatgttcctaag

SEQ ID NO: 3365957 - DNA, 14 bp, Homo sapiens
ctgggtccaaataa

SEQ ID NO: 3365958 - DNA, 15 bp, Homo sapiens
ctgggtccaaataaa

SEQ ID NO: 3365959 - DNA, 16 bp, Homo sapiens
ctgggtccaaataaaa

SEQ ID NO: 3365960 - DNA, 19 bp, Homo sapiens
ctgggtccaaataaaaact

SEQ ID NO: 3365961 - DNA, 16 bp, Homo sapiens
ctgggtcggccctgcc

SEQ ID NO: 3365962 - DNA, 17 bp, Homo sapiens
ctgggtcggccctgccc

SEQ ID NO: 3365963 - DNA, 22 bp, Homo sapiens
ctgggtctcgctttgttgccca

SEQ ID NO: 3365964 - DNA, 17 bp, Homo sapiens
ctgggtcttttgctact

SEQ ID NO: 3365965 - DNA, 13 bp, Homo sapiens
ctgggtgacagag

SEQ ID NO: 3365966 - DNA, 14 bp, Homo sapiens
ctgggtgacatttg

SEQ ID NO: 3365967 - DNA, 20 bp, Homo sapiens
ctgggtgaccgactacccca

SEQ ID NO: 3365968 - DNA, 22 bp, Homo sapiens
ctgggtgaccgactaccccagt

SEQ ID NO: 3365969 - DNA, 14 bp, Homo sapiens
ctgggtgagaccca

SEQ ID NO: 3365970 - DNA, 18 bp, Homo sapiens
ctgggtgagagaggaata

SEQ ID NO: 3365971 - DNA, 15 bp, Homo sapiens
ctgggtgccattccc

SEQ ID NO: 3365972 - DNA, 14 bp, Homo sapiens
ctgggtgcctccca

SEQ ID NO: 3365973 - DNA, 17 bp, Homo sapiens
ctgggtgcctcccacac

SEQ ID NO: 3365974 - DNA, 15 bp, Homo sapiens
ctgggtgctggctgc

SEQ ID NO: 3365975 - DNA, 13 bp, Homo sapiens
ctgggtggcctcg

SEQ ID NO: 3365976 - DNA, 13 bp, Homo sapiens
ctgggtgggctct

SEQ ID NO: 3365977 - DNA, 12 bp, Homo sapiens
ctgggtgggtgg

SEQ ID NO: 3365978 - DNA, 18 bp, Homo sapiens
ctgggtgggtggtgggga

SEQ ID NO: 3365979 - DNA, 16 bp, Homo sapiens
ctgggtggtaccctct

SEQ ID NO: 3365980 - DNA, 23 bp, Homo sapiens
ctgggttaatggctagtactgta

SEQ ID NO: 3365981 - DNA, 18 bp, Homo sapiens
ctgggttcactgcaacct

SEQ ID NO: 3365982 - DNA, 20 bp, Homo sapiens
ctgggttcactgcaacctcc

SEQ ID NO: 3365983 - DNA, 17 bp, Homo sapiens
ctgggttccaatcctgg

SEQ ID NO: 3365984 - DNA, 14 bp, Homo sapiens
ctgggttccctttc

SEQ ID NO: 3365985 - DNA, 20 bp, Homo sapiens
ctgggttccctttccttcca

SEQ ID NO: 3365986 - DNA, 21 bp, Homo sapiens
ctgggttccctttccttccat

SEQ ID NO: 3365987 - DNA, 17 bp, Homo sapiens
ctgggttcttgttttat

SEQ ID NO: 3365988 - DNA, 14 bp, Homo sapiens
ctgggttgggggca

SEQ ID NO: 3365989 - DNA, 19 bp, Homo sapiens
ctgggttgggggcactcag

SEQ ID NO: 3365990 - DNA, 20 bp, Homo sapiens
ctgggttgggggcactcagc

SEQ ID NO: 3365991 - DNA, 22 bp, Homo sapiens
ctgggttgggggcactcagcca

SEQ ID NO: 3365992 - DNA, 16 bp, Homo sapiens
ctgggttggtgcacag

SEQ ID NO: 3365993 - DNA, 22 bp, Homo sapiens
ctgggttggtgcacagtgattt

SEQ ID NO: 3365994 - DNA, 13 bp, Homo sapiens
ctgggtttcaaga

SEQ ID NO: 3365995 - DNA, 23 bp, Homo sapiens
ctgggtttggaccccagctggga

SEQ ID NO: 3365996 - DNA, 22 bp, Homo sapiens
ctgggtttgtacttccacctcc

SEQ ID NO: 3365997 - DNA, 20 bp, Homo sapiens
ctgggtttttcttgtggtgt

SEQ ID NO: 3365998 - DNA, 19 bp, Homo sapiens
ctggtaaaagggatacaca

SEQ ID NO: 3365999 - DNA, 19 bp, Homo sapiens
ctggtaaactatttgtctt

SEQ ID NO: 3366000 - DNA, 20 bp, Homo sapiens
ctggtaaagttacactttta

SEQ ID NO: 3366001 - DNA, 22 bp, Homo sapiens
ctggtaaagttacacttttatt

SEQ ID NO: 3366002 - DNA, 19 bp, Homo sapiens
ctggtaatattgacttgta

SEQ ID NO: 3366003 - DNA, 13 bp, Homo sapiens
ctggtacccagcc

SEQ ID NO: 3366004 - DNA, 14 bp, Homo sapiens
ctggtacccagcca

SEQ ID NO: 3366005 - DNA, 21 bp, Homo sapiens
ctggtacctgccctctattta

SEQ ID NO: 3366006 - DNA, 18 bp, Homo sapiens
ctggtactccctctcagg

SEQ ID NO: 3366007 - DNA, 16 bp, Homo sapiens
ctggtactctcctaga

SEQ ID NO: 3366008 - DNA, 16 bp, Homo sapiens
ctggtagagaccccca

SEQ ID NO: 3366009 - DNA, 17 bp, Homo sapiens
ctggtagagacccccag

SEQ ID NO: 3366010 - DNA, 19 bp, Homo sapiens
ctggtagagacccccaggc

SEQ ID NO: 3366011 - DNA, 13 bp, Homo sapiens
ctggtagctcagg

SEQ ID NO: 3366012 - DNA, 16 bp, Homo sapiens
ctggtaggttgggaca

SEQ ID NO: 3366013 - DNA, 17 bp, Homo sapiens
ctggtaggttgggacac

SEQ ID NO: 3366014 - DNA, 22 bp, Homo sapiens
ctggtaggttgggacaccaggg

SEQ ID NO: 3366015 - DNA, 15 bp, Homo sapiens
ctggtatctcagaaa

SEQ ID NO: 3366016 - DNA, 23 bp, Homo sapiens
ctggtatctcagaaagtgcctga

SEQ ID NO: 3366017 - DNA, 14 bp, Homo sapiens
ctggtatgaataat

SEQ ID NO: 3366018 - DNA, 15 bp, Homo sapiens
ctggtattctgttct

SEQ ID NO: 3366019 - DNA, 20 bp, Homo sapiens
ctggtattctgttctggagg

SEQ ID NO: 3366020 - DNA, 22 bp, Homo sapiens
ctggtattttaagagaaaactg

SEQ ID NO: 3366021 - DNA, 13 bp, Homo sapiens
ctggtcaaagaaa

SEQ ID NO: 3366022 - DNA, 21 bp, Homo sapiens
ctggtcattaatgtgtcccct

SEQ ID NO: 3366023 - DNA, 15 bp, Homo sapiens
ctggtccaaaagatt

SEQ ID NO: 3366024 - DNA, 14 bp, Homo sapiens
ctggtccacactag

SEQ ID NO: 3366025 - DNA, 16 bp, Homo sapiens
ctggtccagctctgac

SEQ ID NO: 3366026 - DNA, 17 bp, Homo sapiens
ctggtccagggaagctg

SEQ ID NO: 3366027 - DNA, 14 bp, Homo sapiens
ctggtcccactcag

SEQ ID NO: 3366028 - DNA, 13 bp, Homo sapiens
ctggtcccctcct

SEQ ID NO: 3366029 - DNA, 17 bp, Homo sapiens
ctggtcccctcctcagt

SEQ ID NO: 3366030 - DNA, 23 bp, Homo sapiens
ctggtccctcgtccacaggggca

SEQ ID NO: 3366031 - DNA, 14 bp, Homo sapiens
ctggtccctctgag

SEQ ID NO: 3366032 - DNA, 23 bp, Homo sapiens
ctggtccctgttttcccacgagg

SEQ ID NO: 3366033 - DNA, 17 bp, Homo sapiens
ctggtcccttgcagcta

SEQ ID NO: 3366034 - DNA, 21 bp, Homo sapiens
ctggtccgagctgaggactct

SEQ ID NO: 3366035 - DNA, 16 bp, Homo sapiens
ctggtccttccaggcc

SEQ ID NO: 3366036 - DNA, 19 bp, Homo sapiens
ctggtccttccaggccccc

SEQ ID NO: 3366037 - DNA, 22 bp, Homo sapiens
ctggtcctttttggtcgaggag

SEQ ID NO: 3366038 - DNA, 13 bp, Homo sapiens
ctggtcgctcctg

SEQ ID NO: 3366039 - DNA, 14 bp, Homo sapiens
ctggtcgctcctgc

SEQ ID NO: 3366040 - DNA, 15 bp, Homo sapiens
ctggtcgctcctgcc

SEQ ID NO: 3366041 - DNA, 23 bp, Homo sapiens
ctggtcgctcctgcccacggagt

SEQ ID NO: 3366042 - DNA, 15 bp, Homo sapiens
ctggtctaatttatt

SEQ ID NO: 3366043 - DNA, 17 bp, Homo sapiens
ctggtctcgaactcctg

SEQ ID NO: 3366044 - DNA, 21 bp, Homo sapiens
ctggtctggttgggcagccag

SEQ ID NO: 3366045 - DNA, 18 bp, Homo sapiens
ctggtcttgtggaattgg

SEQ ID NO: 3366046 - DNA, 20 bp, Homo sapiens
ctggtcttgttagaaaacaa

SEQ ID NO: 3366047 - DNA, 15 bp, Homo sapiens
ctggtctttcctctg

SEQ ID NO: 3366048 - DNA, 13 bp, Homo sapiens
ctggtgactcctg

SEQ ID NO: 3366049 - DNA, 23 bp, Homo sapiens
ctggtgagtcttggcggcagcag

SEQ ID NO: 3366050 - DNA, 14 bp, Homo sapiens
ctggtgcattacag

SEQ ID NO: 3366051 - DNA, 18 bp, Homo sapiens
ctggtgcattacagagag

SEQ ID NO: 3366052 - DNA, 16 bp, Homo sapiens
ctggtgccaatttcaa

SEQ ID NO: 3366053 - DNA, 12 bp, Homo sapiens
ctggtgccaggc

SEQ ID NO: 3366054 - DNA, 14 bp, Homo sapiens
ctggtgccccacag

SEQ ID NO: 3366055 - DNA, 16 bp, Homo sapiens
ctggtgccccacagct

SEQ ID NO: 3366056 - DNA, 14 bp, Homo sapiens
ctggtgcccggaga

SEQ ID NO: 3366057 - DNA, 15 bp, Homo sapiens
ctggtgccctgagac

SEQ ID NO: 3366058 - DNA, 17 bp, Homo sapiens
ctggtgccctgagacag

SEQ ID NO: 3366059 - DNA, 13 bp, Homo sapiens
ctggtgcctcctc

SEQ ID NO: 3366060 - DNA, 15 bp, Homo sapiens
ctggtgcctggctct

SEQ ID NO: 3366061 - DNA, 15 bp, Homo sapiens
ctggtgctactccat

SEQ ID NO: 3366062 - DNA, 16 bp, Homo sapiens
ctggtgcttagttttt

SEQ ID NO: 3366063 - DNA, 18 bp, Homo sapiens
ctggtggagaaagcactg

SEQ ID NO: 3366064 - DNA, 21 bp, Homo sapiens
ctggtggagaaagcactgacc

SEQ ID NO: 3366065 - DNA, 23 bp, Homo sapiens
ctggtggagaaagcactgacctg

SEQ ID NO: 3366066 - DNA, 13 bp, Homo sapiens
ctggtggcaccag

SEQ ID NO: 3366067 - DNA, 22 bp, Homo sapiens
ctggtggcaccagatgcaacct

SEQ ID NO: 3366068 - DNA, 12 bp, Homo sapiens
ctggtggcagct

SEQ ID NO: 3366069 - DNA, 14 bp, Homo sapiens
ctggtggcagctgc

SEQ ID NO: 3366070 - DNA, 14 bp, Homo sapiens
ctggtggcagtggg

SEQ ID NO: 3366071 - DNA, 23 bp, Homo sapiens
ctggtggcagtgggagctgcctg

SEQ ID NO: 3366072 - DNA, 20 bp, Homo sapiens
ctggtggcatcgtagaagag

SEQ ID NO: 3366073 - DNA, 21 bp, Homo sapiens
ctggtggccccgtttctggtg

SEQ ID NO: 3366074 - DNA, 21 bp, Homo sapiens
ctggtggcccgacagcctggc

SEQ ID NO: 3366075 - DNA, 15 bp, Homo sapiens
ctggtggccttctgc

SEQ ID NO: 3366076 - DNA, 17 bp, Homo sapiens
ctggtgggcagctgagg

SEQ ID NO: 3366077 - DNA, 18 bp, Homo sapiens
ctggtgggcagctgagga

SEQ ID NO: 3366078 - DNA, 14 bp, Homo sapiens
ctggtggtcagatg

SEQ ID NO: 3366079 - DNA, 16 bp, Homo sapiens
ctggtggtcagatgca

SEQ ID NO: 3366080 - DNA, 18 bp, Homo sapiens
ctggtggtctgttggcag

SEQ ID NO: 3366081 - DNA, 23 bp, Homo sapiens
ctggtggtctgttggcaggctgg

SEQ ID NO: 3366082 - DNA, 16 bp, Homo sapiens
ctggtggtttcacggt

SEQ ID NO: 3366083 - DNA, 21 bp, Homo sapiens
ctggtggtttcacggtgccag

SEQ ID NO: 3366084 - DNA, 15 bp, Homo sapiens
ctggtgtcacttact

SEQ ID NO: 3366085 - DNA, 18 bp, Homo sapiens
ctggtgtcacttactgtt

SEQ ID NO: 3366086 - DNA, 20 bp, Homo sapiens
ctggtgtcctgaccaccctc

SEQ ID NO: 3366087 - DNA, 17 bp, Homo sapiens
ctggtgtgaactcaccc

SEQ ID NO: 3366088 - DNA, 21 bp, Homo sapiens
ctggttaaccttgaagtgact

SEQ ID NO: 3366089 - DNA, 15 bp, Homo sapiens
ctggttactcagggt

SEQ ID NO: 3366090 - DNA, 16 bp, Homo sapiens
ctggttactcagggtt

SEQ ID NO: 3366091 - DNA, 14 bp, Homo sapiens
ctggttagaaatgc

SEQ ID NO: 3366092 - DNA, 13 bp, Homo sapiens
ctggttagcagag

SEQ ID NO: 3366093 - DNA, 20 bp, Homo sapiens
ctggttagttaaaagcccat

SEQ ID NO: 3366094 - DNA, 15 bp, Homo sapiens
ctggttccagggtcc

SEQ ID NO: 3366095 - DNA, 20 bp, Homo sapiens
ctggttccatttttcctctg

SEQ ID NO: 3366096 - DNA, 16 bp, Homo sapiens
ctggttctatttaatg

SEQ ID NO: 3366097 - DNA, 17 bp, Homo sapiens
ctggttctatttaatgg

SEQ ID NO: 3366098 - DNA, 21 bp, Homo sapiens
ctggttggctcccgcggtgcc

SEQ ID NO: 3366099 - DNA, 13 bp, Homo sapiens
ctggttgggcagc

SEQ ID NO: 3366100 - DNA, 12 bp, Homo sapiens
ctggttgtattt

SEQ ID NO: 3366101 - DNA, 13 bp, Homo sapiens
ctggttgtatttc

SEQ ID NO: 3366102 - DNA, 16 bp, Homo sapiens
ctggttgtatttctat

SEQ ID NO: 3366103 - DNA, 22 bp, Homo sapiens
ctggttgtatttctatatttat

SEQ ID NO: 3366104 - DNA, 21 bp, Homo sapiens
ctggttgtttctgttccaaat

SEQ ID NO: 3366105 - DNA, 17 bp, Homo sapiens
ctggtttacaggccctg

SEQ ID NO: 3366106 - DNA, 13 bp, Homo sapiens
ctggtttcactgg

SEQ ID NO: 3366107 - DNA, 17 bp, Homo sapiens
ctggtttcactggccca

SEQ ID NO: 3366108 - DNA, 13 bp, Homo sapiens
ctggttttgctat

SEQ ID NO: 3366109 - DNA, 13 bp, Homo sapiens
ctggttttgtaag

SEQ ID NO: 3366110 - DNA, 15 bp, Homo sapiens
ctggttttgtaagat

SEQ ID NO: 3366111 - DNA, 19 bp, Homo sapiens
ctggttttgtaagatgctg

SEQ ID NO: 3366112 - DNA, 17 bp, Homo sapiens
ctggttttgtacactgc

SEQ ID NO: 3366113 - DNA, 21 bp, Homo sapiens
ctggttttgtacactgctgta

SEQ ID NO: 3366114 - DNA, 13 bp, Homo sapiens
ctgtaaaacgctg

SEQ ID NO: 3366115 - DNA, 16 bp, Homo sapiens
ctgtaaaacgctgtca

SEQ ID NO: 3366116 - DNA, 19 bp, Homo sapiens
ctgtaaaagagcctagttt

SEQ ID NO: 3366117 - DNA, 15 bp, Homo sapiens
ctgtaaaatgaaatt

SEQ ID NO: 3366118 - DNA, 16 bp, Homo sapiens
ctgtaaaatgaaatta

SEQ ID NO: 3366119 - DNA, 18 bp, Homo sapiens
ctgtaaaattataaactt

SEQ ID NO: 3366120 - DNA, 20 bp, Homo sapiens
ctgtaaacctctcgagggca

SEQ ID NO: 3366121 - DNA, 23 bp, Homo sapiens
ctgtaaagagacctacctcaggt

SEQ ID NO: 3366122 - DNA, 12 bp, Homo sapiens
ctgtaaagatgt

SEQ ID NO: 3366123 - DNA, 15 bp, Homo sapiens
ctgtaaagtgcctta

SEQ ID NO: 3366124 - DNA, 17 bp, Homo sapiens
ctgtaaataaaatgtgt

SEQ ID NO: 3366125 - DNA, 18 bp, Homo sapiens
ctgtaaataaaatgtgta

SEQ ID NO: 3366126 - DNA, 23 bp, Homo sapiens
ctgtaaataaaatgtgtacagtg

SEQ ID NO: 3366127 - DNA, 12 bp, Homo sapiens
ctgtaaatacca

SEQ ID NO: 3366128 - DNA, 15 bp, Homo sapiens
ctgtaacacagctga

SEQ ID NO: 3366129 - DNA, 17 bp, Homo sapiens
ctgtaactactttataa

SEQ ID NO: 3366130 - DNA, 19 bp, Homo sapiens
ctgtaactactttataact

SEQ ID NO: 3366131 - DNA, 16 bp, Homo sapiens
ctgtaactgctgagcc

SEQ ID NO: 3366132 - DNA, 18 bp, Homo sapiens
ctgtaactgctgagccac

SEQ ID NO: 3366133 - DNA, 16 bp, Homo sapiens
ctgtaacttaaaatag

SEQ ID NO: 3366134 - DNA, 21 bp, Homo sapiens
ctgtaagactcattccctaga

SEQ ID NO: 3366135 - DNA, 23 bp, Homo sapiens
ctgtaagccaaagaaatgaacat

SEQ ID NO: 3366136 - DNA, 16 bp, Homo sapiens
ctgtaagcctgcaagc

SEQ ID NO: 3366137 - DNA, 17 bp, Homo sapiens
ctgtaagcctgcaagcc

SEQ ID NO: 3366138 - DNA, 18 bp, Homo sapiens
ctgtaagcctgcaagcct

SEQ ID NO: 3366139 - DNA, 20 bp, Homo sapiens
ctgtaagctctttgaaacaa

SEQ ID NO: 3366140 - DNA, 15 bp, Homo sapiens
ctgtaaggctctaga

SEQ ID NO: 3366141 - DNA, 17 bp, Homo sapiens
ctgtaaggctctagatc

SEQ ID NO: 3366142 - DNA, 16 bp, Homo sapiens
ctgtaagggcagtgcc

SEQ ID NO: 3366143 - DNA, 17 bp, Homo sapiens
ctgtaataatacctcaa

SEQ ID NO: 3366144 - DNA, 22 bp, Homo sapiens
ctgtaataatacctcaatgttt

SEQ ID NO: 3366145 - DNA, 23 bp, Homo sapiens
ctgtaataatacctcaatgtttg

SEQ ID NO: 3366146 - DNA, 20 bp, Homo sapiens
ctgtaatataaagtattcaa

SEQ ID NO: 3366147 - DNA, 18 bp, Homo sapiens
ctgtaatcagctctcctg

SEQ ID NO: 3366148 - DNA, 21 bp, Homo sapiens
ctgtaatcagctctcctggct

SEQ ID NO: 3366149 - DNA, 14 bp, Homo sapiens
ctgtaatctatgaa

SEQ ID NO: 3366150 - DNA, 18 bp, Homo sapiens
ctgtaatgatactgatta

SEQ ID NO: 3366151 - DNA, 22 bp, Homo sapiens
ctgtaatggaactgaccccctc

SEQ ID NO: 3366152 - DNA, 18 bp, Homo sapiens
ctgtaatggtactgactt

SEQ ID NO: 3366153 - DNA, 12 bp, Homo sapiens
ctgtaattgtgt

SEQ ID NO: 3366154 - DNA, 18 bp, Homo sapiens
ctgtacaagggagaaaag

SEQ ID NO: 3366155 - DNA, 23 bp, Homo sapiens
ctgtacaagggagaaaagctgta

SEQ ID NO: 3366156 - DNA, 16 bp, Homo sapiens
ctgtacacactttatt

SEQ ID NO: 3366157 - DNA, 23 bp, Homo sapiens
ctgtacacattcctgcattcatg

SEQ ID NO: 3366158 - DNA, 20 bp, Homo sapiens
ctgtacaccatagtttacaa

SEQ ID NO: 3366159 - DNA, 17 bp, Homo sapiens
ctgtacacgtgtcctgt

SEQ ID NO: 3366160 - DNA, 19 bp, Homo sapiens
ctgtacactgaatatttat

SEQ ID NO: 3366161 - DNA, 17 bp, Homo sapiens
ctgtacatagcctatat

SEQ ID NO: 3366162 - DNA, 15 bp, Homo sapiens
ctgtacattgtggga

SEQ ID NO: 3366163 - DNA, 17 bp, Homo sapiens
ctgtacattttgttgta

SEQ ID NO: 3366164 - DNA, 21 bp, Homo sapiens
ctgtacattttgttgtaaaaa

SEQ ID NO: 3366165 - DNA, 23 bp, Homo sapiens
ctgtacattttgttgtaaaaaga

SEQ ID NO: 3366166 - DNA, 13 bp, Homo sapiens
ctgtaccaaatct

SEQ ID NO: 3366167 - DNA, 15 bp, Homo sapiens
ctgtaccaaatctga

SEQ ID NO: 3366168 - DNA, 16 bp, Homo sapiens
ctgtaccacagacaca

SEQ ID NO: 3366169 - DNA, 14 bp, Homo sapiens
ctgtaccacatctg

SEQ ID NO: 3366170 - DNA, 18 bp, Homo sapiens
ctgtaccacatctgctct

SEQ ID NO: 3366171 - DNA, 19 bp, Homo sapiens
ctgtaccacatctgctcta

SEQ ID NO: 3366172 - DNA, 18 bp, Homo sapiens
ctgtacccagatgcctac

SEQ ID NO: 3366173 - DNA, 19 bp, Homo sapiens
ctgtacccagatgcctaca

SEQ ID NO: 3366174 - DNA, 13 bp, Homo sapiens
ctgtacccagctc

SEQ ID NO: 3366175 - DNA, 14 bp, Homo sapiens
ctgtacccagctcc

SEQ ID NO: 3366176 - DNA, 14 bp, Homo sapiens
ctgtacctcagtgg

SEQ ID NO: 3366177 - DNA, 21 bp, Homo sapiens
ctgtacctgttccttagacct

SEQ ID NO: 3366178 - DNA, 22 bp, Homo sapiens
ctgtaccttttgaggagcccca

SEQ ID NO: 3366179 - DNA, 23 bp, Homo sapiens
ctgtaccttttgaggagccccag

SEQ ID NO: 3366180 - DNA, 16 bp, Homo sapiens
ctgtacgtctgacagg

SEQ ID NO: 3366181 - DNA, 17 bp, Homo sapiens
ctgtactagagatctgg

SEQ ID NO: 3366182 - DNA, 15 bp, Homo sapiens
ctgtactcagagcag

SEQ ID NO: 3366183 - DNA, 16 bp, Homo sapiens
ctgtactcagagcaga

SEQ ID NO: 3366184 - DNA, 18 bp, Homo sapiens
ctgtactcagagcagagc

SEQ ID NO: 3366185 - DNA, 18 bp, Homo sapiens
ctgtactctggggtgctg

SEQ ID NO: 3366186 - DNA, 22 bp, Homo sapiens
ctgtactggccagtgtcatttt

SEQ ID NO: 3366187 - DNA, 15 bp, Homo sapiens
ctgtacttcaagtta

SEQ ID NO: 3366188 - DNA, 15 bp, Homo sapiens
ctgtactttgccatt

SEQ ID NO: 3366189 - DNA, 14 bp, Homo sapiens
ctgtagaatcaatt

SEQ ID NO: 3366190 - DNA, 15 bp, Homo sapiens
ctgtagagttgctga

SEQ ID NO: 3366191 - DNA, 17 bp, Homo sapiens
ctgtagatgttctagga

SEQ ID NO: 3366192 - DNA, 19 bp, Homo sapiens
ctgtagatgttctaggata

SEQ ID NO: 3366193 - DNA, 20 bp, Homo sapiens
ctgtagatgttctaggatag

SEQ ID NO: 3366194 - DNA, 21 bp, Homo sapiens
ctgtagcagtgagaaaaagct

SEQ ID NO: 3366195 - DNA, 14 bp, Homo sapiens
ctgtagccatctgc

SEQ ID NO: 3366196 - DNA, 18 bp, Homo sapiens
ctgtagccatggctcagg

SEQ ID NO: 3366197 - DNA, 23 bp, Homo sapiens
ctgtagccatggctcaggcaagc

SEQ ID NO: 3366198 - DNA, 15 bp, Homo sapiens
ctgtagctctgcctc

SEQ ID NO: 3366199 - DNA, 14 bp, Homo sapiens
ctgtagctgccatg

SEQ ID NO: 3366200 - DNA, 21 bp, Homo sapiens
ctgtagcttctaatgttcccc

SEQ ID NO: 3366201 - DNA, 14 bp, Homo sapiens
ctgtagctttcctg

SEQ ID NO: 3366202 - DNA, 16 bp, Homo sapiens
ctgtagcttttaggaa

SEQ ID NO: 3366203 - DNA, 18 bp, Homo sapiens
ctgtaggaaggttaatgt

SEQ ID NO: 3366204 - DNA, 22 bp, Homo sapiens
ctgtaggagctacccttttcct

SEQ ID NO: 3366205 - DNA, 14 bp, Homo sapiens
ctgtagggaactct

SEQ ID NO: 3366206 - DNA, 16 bp, Homo sapiens
ctgtagggctggacct

SEQ ID NO: 3366207 - DNA, 17 bp, Homo sapiens
ctgtagggctggaccta

SEQ ID NO: 3366208 - DNA, 21 bp, Homo sapiens
ctgtagggctggacctatgtc

SEQ ID NO: 3366209 - DNA, 20 bp, Homo sapiens
ctgtaggttcatgcccaagc

SEQ ID NO: 3366210 - DNA, 18 bp, Homo sapiens
ctgtagtactccttaaga

SEQ ID NO: 3366211 - DNA, 18 bp, Homo sapiens
ctgtagtagccctttctg

SEQ ID NO: 3366212 - DNA, 16 bp, Homo sapiens
ctgtagtcatttacta

SEQ ID NO: 3366213 - DNA, 14 bp, Homo sapiens
ctgtagtcccagct

SEQ ID NO: 3366214 - DNA, 19 bp, Homo sapiens
ctgtagtgaatcctctgtt

SEQ ID NO: 3366215 - DNA, 13 bp, Homo sapiens
ctgtagttaggaa

SEQ ID NO: 3366216 - DNA, 21 bp, Homo sapiens
ctgtagttaggaaataaaacc

SEQ ID NO: 3366217 - DNA, 19 bp, Homo sapiens
ctgtagttcctaatggatt

SEQ ID NO: 3366218 - DNA, 16 bp, Homo sapiens
ctgtagttctaagact

SEQ ID NO: 3366219 - DNA, 13 bp, Homo sapiens
ctgtataaatagg

SEQ ID NO: 3366220 - DNA, 14 bp, Homo sapiens
ctgtataagcactg

SEQ ID NO: 3366221 - DNA, 15 bp, Homo sapiens
ctgtataagttattt

SEQ ID NO: 3366222 - DNA, 19 bp, Homo sapiens
ctgtatacaaccctggcat

SEQ ID NO: 3366223 - DNA, 12 bp, Homo sapiens
ctgtatacttta

SEQ ID NO: 3366224 - DNA, 19 bp, Homo sapiens
ctgtataggtagatccaga

SEQ ID NO: 3366225 - DNA, 16 bp, Homo sapiens
ctgtatagttaggata

SEQ ID NO: 3366226 - DNA, 14 bp, Homo sapiens
ctgtatatactttt

SEQ ID NO: 3366227 - DNA, 14 bp, Homo sapiens
ctgtatatgtattc

SEQ ID NO: 3366228 - DNA, 15 bp, Homo sapiens
ctgtatatgttgtaa

SEQ ID NO: 3366229 - DNA, 16 bp, Homo sapiens
ctgtatatgttgtaat

SEQ ID NO: 3366230 - DNA, 17 bp, Homo sapiens
ctgtatcggagacagtg

SEQ ID NO: 3366231 - DNA, 12 bp, Homo sapiens
ctgtatgattta

SEQ ID NO: 3366232 - DNA, 13 bp, Homo sapiens
ctgtatgatttgt

SEQ ID NO: 3366233 - DNA, 14 bp, Homo sapiens
ctgtatgcaaagtc

SEQ ID NO: 3366234 - DNA, 17 bp, Homo sapiens
ctgtatgccttctgtat

SEQ ID NO: 3366235 - DNA, 15 bp, Homo sapiens
ctgtatgctgatcat

SEQ ID NO: 3366236 - DNA, 17 bp, Homo sapiens
ctgtatggaaacactga

SEQ ID NO: 3366237 - DNA, 20 bp, Homo sapiens
ctgtatgttgtacaatcaaa

SEQ ID NO: 3366238 - DNA, 14 bp, Homo sapiens
ctgtattaaatctt

SEQ ID NO: 3366239 - DNA, 15 bp, Homo sapiens
ctgtattaaatctta

SEQ ID NO: 3366240 - DNA, 20 bp, Homo sapiens
ctgtattaaatcttaaacaa

SEQ ID NO: 3366241 - DNA, 18 bp, Homo sapiens
ctgtattgggccttttgg

SEQ ID NO: 3366242 - DNA, 14 bp, Homo sapiens
ctgtatttattatt

SEQ ID NO: 3366243 - DNA, 16 bp, Homo sapiens
ctgtatttattatttg

SEQ ID NO: 3366244 - DNA, 14 bp, Homo sapiens
ctgtatttcatgtg

SEQ ID NO: 3366245 - DNA, 22 bp, Homo sapiens
ctgtatttctaagaagttgttt

SEQ ID NO: 3366246 - DNA, 19 bp, Homo sapiens
ctgtattttaacactttgt

SEQ ID NO: 3366247 - DNA, 10 bp, Homo sapiens
ctgtattttc

SEQ ID NO: 3366248 - DNA, 22 bp, Homo sapiens
ctgtatttttttttctaagaga

SEQ ID NO: 3366249 - DNA, 19 bp, Homo sapiens
ctgtcaaaacaagtttttc

SEQ ID NO: 3366250 - DNA, 21 bp, Homo sapiens
ctgtcaaaacaagtttttctg

SEQ ID NO: 3366251 - DNA, 18 bp, Homo sapiens
ctgtcaaaacactgtgga

SEQ ID NO: 3366252 - DNA, 12 bp, Homo sapiens
ctgtcaagaaga

SEQ ID NO: 3366253 - DNA, 14 bp, Homo sapiens
ctgtcaagtacaag

SEQ ID NO: 3366254 - DNA, 19 bp, Homo sapiens
ctgtcaagttaacaaggaa

SEQ ID NO: 3366255 - DNA, 22 bp, Homo sapiens
ctgtcaagttaacaaggaatgc

SEQ ID NO: 3366256 - DNA, 13 bp, Homo sapiens
ctgtcaataaaca

SEQ ID NO: 3366257 - DNA, 19 bp, Homo sapiens
ctgtcaatgattattttca

SEQ ID NO: 3366258 - DNA, 14 bp, Homo sapiens
ctgtcacatagttt

SEQ ID NO: 3366259 - DNA, 14 bp, Homo sapiens
ctgtcactcattgc

SEQ ID NO: 3366260 - DNA, 21 bp, Homo sapiens
ctgtcactcattgctgagcct

SEQ ID NO: 3366261 - DNA, 17 bp, Homo sapiens
ctgtcagaatgctattg

SEQ ID NO: 3366262 - DNA, 12 bp, Homo sapiens
ctgtcagaggct

SEQ ID NO: 3366263 - DNA, 13 bp, Homo sapiens
ctgtcagaggcta

SEQ ID NO: 3366264 - DNA, 18 bp, Homo sapiens
ctgtcagatgagaacaaa

SEQ ID NO: 3366265 - DNA, 19 bp, Homo sapiens
ctgtcagatgagaacaaag

SEQ ID NO: 3366266 - DNA, 22 bp, Homo sapiens
ctgtcagatgagaacaaagctg

SEQ ID NO: 3366267 - DNA, 21 bp, Homo sapiens
ctgtcagatgggaagacatga

SEQ ID NO: 3366268 - DNA, 12 bp, Homo sapiens
ctgtcagattaa

SEQ ID NO: 3366269 - DNA, 14 bp, Homo sapiens
ctgtcagattaaat

SEQ ID NO: 3366270 - DNA, 12 bp, Homo sapiens
ctgtcagccagc

SEQ ID NO: 3366271 - DNA, 16 bp, Homo sapiens
ctgtcagccagccgcc

SEQ ID NO: 3366272 - DNA, 17 bp, Homo sapiens
ctgtcagcgcaggttta

SEQ ID NO: 3366273 - DNA, 19 bp, Homo sapiens
ctgtcaggctctggccctt

SEQ ID NO: 3366274 - DNA, 11 bp, Homo sapiens
ctgtcagtgtt

SEQ ID NO: 3366275 - DNA, 17 bp, Homo sapiens
ctgtcagtgttaaagat

SEQ ID NO: 3366276 - DNA, 18 bp, Homo sapiens
ctgtcagtgttaaagatt

SEQ ID NO: 3366277 - DNA, 16 bp, Homo sapiens
ctgtcagtgtttttga

SEQ ID NO: 3366278 - DNA, 15 bp, Homo sapiens
ctgtcatcaattgaa

SEQ ID NO: 3366279 - DNA, 21 bp, Homo sapiens
ctgtcatcactccctggatgt

SEQ ID NO: 3366280 - DNA, 20 bp, Homo sapiens
ctgtcatgaaatcagcaaga

SEQ ID NO: 3366281 - DNA, 13 bp, Homo sapiens
ctgtcatgccccc

SEQ ID NO: 3366282 - DNA, 17 bp, Homo sapiens
ctgtcatgcccccctca

SEQ ID NO: 3366283 - DNA, 14 bp, Homo sapiens
ctgtcatggtcctt

SEQ ID NO: 3366284 - DNA, 23 bp, Homo sapiens
ctgtcattatattctaattaaaa

SEQ ID NO: 3366285 - DNA, 21 bp, Homo sapiens
ctgtccaaaggaggctggcag

SEQ ID NO: 3366286 - DNA, 20 bp, Homo sapiens
ctgtccacacccagctcagc

SEQ ID NO: 3366287 - DNA, 16 bp, Homo sapiens
ctgtccaccctgccaa

SEQ ID NO: 3366288 - DNA, 12 bp, Homo sapiens
ctgtccactctc

SEQ ID NO: 3366289 - DNA, 23 bp, Homo sapiens
ctgtccactctcggggcccttgg

SEQ ID NO: 3366290 - DNA, 15 bp, Homo sapiens
ctgtccagcctgggc

SEQ ID NO: 3366291 - DNA, 17 bp, Homo sapiens
ctgtccaggcactgctg

SEQ ID NO: 3366292 - DNA, 22 bp, Homo sapiens
ctgtccaggcactgctgcccag

SEQ ID NO: 3366293 - DNA, 23 bp, Homo sapiens
ctgtccaggcactgctgcccagc

SEQ ID NO: 3366294 - DNA, 12 bp, Homo sapiens
ctgtccaggcca

SEQ ID NO: 3366295 - DNA, 13 bp, Homo sapiens
ctgtccaggccac

SEQ ID NO: 3366296 - DNA, 19 bp, Homo sapiens
ctgtccaggccactgtggc

SEQ ID NO: 3366297 - DNA, 16 bp, Homo sapiens
ctgtccatcagccagg

SEQ ID NO: 3366298 - DNA, 15 bp, Homo sapiens
ctgtccatggccttt

SEQ ID NO: 3366299 - DNA, 16 bp, Homo sapiens
ctgtccatggcctttc

SEQ ID NO: 3366300 - DNA, 22 bp, Homo sapiens
ctgtcccagaggttatctgcct

SEQ ID NO: 3366301 - DNA, 18 bp, Homo sapiens
ctgtcccatggacactcc

SEQ ID NO: 3366302 - DNA, 19 bp, Homo sapiens
ctgtcccatggacactcca

SEQ ID NO: 3366303 - DNA, 12 bp, Homo sapiens
ctgtccccaccc

SEQ ID NO: 3366304 - DNA, 15 bp, Homo sapiens
ctgtccccagccctg

SEQ ID NO: 3366305 - DNA, 13 bp, Homo sapiens
ctgtcccccagct

SEQ ID NO: 3366306 - DNA, 18 bp, Homo sapiens
ctgtccccctacccaccg

SEQ ID NO: 3366307 - DNA, 15 bp, Homo sapiens
ctgtcccctctgtca

SEQ ID NO: 3366308 - DNA, 21 bp, Homo sapiens
ctgtcccgccttcctcctcca

SEQ ID NO: 3366309 - DNA, 17 bp, Homo sapiens
ctgtcccggggtcctgt

SEQ ID NO: 3366310 - DNA, 17 bp, Homo sapiens
ctgtccctcccacctct

SEQ ID NO: 3366311 - DNA, 17 bp, Homo sapiens
ctgtccctctagtgcct

SEQ ID NO: 3366312 - DNA, 15 bp, Homo sapiens
ctgtccctgaaacct

SEQ ID NO: 3366313 - DNA, 12 bp, Homo sapiens
ctgtccctgcag

SEQ ID NO: 3366314 - DNA, 18 bp, Homo sapiens
ctgtccctgtccttccct

SEQ ID NO: 3366315 - DNA, 13 bp, Homo sapiens
ctgtcccttccac

SEQ ID NO: 3366316 - DNA, 14 bp, Homo sapiens
ctgtcccttccact

SEQ ID NO: 3366317 - DNA, 21 bp, Homo sapiens
ctgtcccttctcttaatttaa

SEQ ID NO: 3366318 - DNA, 21 bp, Homo sapiens
ctgtcccttgcctcaatgcca

SEQ ID NO: 3366319 - DNA, 18 bp, Homo sapiens
ctgtcccttgctgtatgc

SEQ ID NO: 3366320 - DNA, 17 bp, Homo sapiens
ctgtccggcccagtgcc

SEQ ID NO: 3366321 - DNA, 17 bp, Homo sapiens
ctgtcctaaggaacctt

SEQ ID NO: 3366322 - DNA, 16 bp, Homo sapiens
ctgtcctactctgtgt

SEQ ID NO: 3366323 - DNA, 17 bp, Homo sapiens
ctgtcctactctgtgtc

SEQ ID NO: 3366324 - DNA, 18 bp, Homo sapiens
ctgtcctacttctgactt

SEQ ID NO: 3366325 - DNA, 23 bp, Homo sapiens
ctgtcctacttctgactttactt

SEQ ID NO: 3366326 - DNA, 14 bp, Homo sapiens
ctgtcctcactgct

SEQ ID NO: 3366327 - DNA, 19 bp, Homo sapiens
ctgtcctcccatcccctgg

SEQ ID NO: 3366328 - DNA, 14 bp, Homo sapiens
ctgtcctccctcca

SEQ ID NO: 3366329 - DNA, 20 bp, Homo sapiens
ctgtcctctcccctccagcc

SEQ ID NO: 3366330 - DNA, 12 bp, Homo sapiens
ctgtcctgatct

SEQ ID NO: 3366331 - DNA, 16 bp, Homo sapiens
ctgtcctgatctgtga

SEQ ID NO: 3366332 - DNA, 17 bp, Homo sapiens
ctgtcctgatggtcagc

SEQ ID NO: 3366333 - DNA, 21 bp, Homo sapiens
ctgtcctgatggtcagctccc

SEQ ID NO: 3366334 - DNA, 13 bp, Homo sapiens
ctgtcctgcagca

SEQ ID NO: 3366335 - DNA, 14 bp, Homo sapiens
ctgtcctgcagcaa

SEQ ID NO: 3366336 - DNA, 16 bp, Homo sapiens
ctgtcctgcagcaaac

SEQ ID NO: 3366337 - DNA, 14 bp, Homo sapiens
ctgtcctgggagtg

SEQ ID NO: 3366338 - DNA, 21 bp, Homo sapiens
ctgtcctgggagtgagctggt

SEQ ID NO: 3366339 - DNA, 14 bp, Homo sapiens
ctgtcctgtacatt

SEQ ID NO: 3366340 - DNA, 12 bp, Homo sapiens
ctgtcctgtgaa

SEQ ID NO: 3366341 - DNA, 17 bp, Homo sapiens
ctgtcctgtgaatggaa

SEQ ID NO: 3366342 - DNA, 18 bp, Homo sapiens
ctgtcctgtgaatggaag

SEQ ID NO: 3366343 - DNA, 16 bp, Homo sapiens
ctgtccttcagatgga

SEQ ID NO: 3366344 - DNA, 17 bp, Homo sapiens
ctgtccttcagatggaa

SEQ ID NO: 3366345 - DNA, 21 bp, Homo sapiens
ctgtccttccctgttctccct

SEQ ID NO: 3366346 - DNA, 14 bp, Homo sapiens
ctgtcgagacactt

SEQ ID NO: 3366347 - DNA, 18 bp, Homo sapiens
ctgtcgagacacttgcct

SEQ ID NO: 3366348 - DNA, 23 bp, Homo sapiens
ctgtcgagttcggctctgggtgg

SEQ ID NO: 3366349 - DNA, 15 bp, Homo sapiens
ctgtcgcccagtctg

SEQ ID NO: 3366350 - DNA, 22 bp, Homo sapiens
ctgtcgccccaggccctccctg

SEQ ID NO: 3366351 - DNA, 15 bp, Homo sapiens
ctgtcgctctcagtt

SEQ ID NO: 3366352 - DNA, 11 bp, Homo sapiens
ctgtctacatt

SEQ ID NO: 3366353 - DNA, 14 bp, Homo sapiens
ctgtctacatttct

SEQ ID NO: 3366354 - DNA, 20 bp, Homo sapiens
ctgtctacatttctgcagat

SEQ ID NO: 3366355 - DNA, 16 bp, Homo sapiens
ctgtctagtctctcct

SEQ ID NO: 3366356 - DNA, 18 bp, Homo sapiens
ctgtctatgcagcctgct

SEQ ID NO: 3366357 - DNA, 20 bp, Homo sapiens
ctgtctatgcagcctgctct

SEQ ID NO: 3366358 - DNA, 21 bp, Homo sapiens
ctgtctatgcagcctgctctt

SEQ ID NO: 3366359 - DNA, 14 bp, Homo sapiens
ctgtctcaaaagga

SEQ ID NO: 3366360 - DNA, 21 bp, Homo sapiens
ctgtctcaagagggcactggt

SEQ ID NO: 3366361 - DNA, 12 bp, Homo sapiens
ctgtctcacctg

SEQ ID NO: 3366362 - DNA, 23 bp, Homo sapiens
ctgtctcactttttacccagaac

SEQ ID NO: 3366363 - DNA, 22 bp, Homo sapiens
ctgtctcagacttttgtacatc

SEQ ID NO: 3366364 - DNA, 14 bp, Homo sapiens
ctgtctcagcctcc

SEQ ID NO: 3366365 - DNA, 16 bp, Homo sapiens
ctgtctcatccccagg

SEQ ID NO: 3366366 - DNA, 21 bp, Homo sapiens
ctgtctcatccccaggggtcc

SEQ ID NO: 3366367 - DNA, 15 bp, Homo sapiens
ctgtctcatcctcct

SEQ ID NO: 3366368 - DNA, 16 bp, Homo sapiens
ctgtctcatcctcctg

SEQ ID NO: 3366369 - DNA, 18 bp, Homo sapiens
ctgtctcatcctcctgga

SEQ ID NO: 3366370 - DNA, 22 bp, Homo sapiens
ctgtctcatcctcctggaacct

SEQ ID NO: 3366371 - DNA, 15 bp, Homo sapiens
ctgtctccactgtgc

SEQ ID NO: 3366372 - DNA, 24 bp, Homo sapiens
ctgtctcgggggggttttcatcta

SEQ ID NO: 3366373 - DNA, 16 bp, Homo sapiens
ctgtctctaacttatt

SEQ ID NO: 3366374 - DNA, 12 bp, Homo sapiens
ctgtctctgcat

SEQ ID NO: 3366375 - DNA, 14 bp, Homo sapiens
ctgtctctgcatct

SEQ ID NO: 3366376 - DNA, 15 bp, Homo sapiens
ctgtctcttgaaaaa

SEQ ID NO: 3366377 - DNA, 23 bp, Homo sapiens
ctgtctctttaagggcatgcctt

SEQ ID NO: 3366378 - DNA, 21 bp, Homo sapiens
ctgtctgaagccatagcctcc

SEQ ID NO: 3366379 - DNA, 16 bp, Homo sapiens
ctgtctgccctctggg

SEQ ID NO: 3366380 - DNA, 15 bp, Homo sapiens
ctgtctggccaggcc

SEQ ID NO: 3366381 - DNA, 13 bp, Homo sapiens
ctgtctgggatta

SEQ ID NO: 3366382 - DNA, 14 bp, Homo sapiens
ctgtctggggcctt

SEQ ID NO: 3366383 - DNA, 17 bp, Homo sapiens
ctgtctggttttaacaa

SEQ ID NO: 3366384 - DNA, 13 bp, Homo sapiens
ctgtctgtcacca

SEQ ID NO: 3366385 - DNA, 19 bp, Homo sapiens
ctgtctgtcaccagctatc

SEQ ID NO: 3366386 - DNA, 22 bp, Homo sapiens
ctgtctgtcaccagctatctgt

SEQ ID NO: 3366387 - DNA, 21 bp, Homo sapiens
ctgtcttatagggtaaaaaaa

SEQ ID NO: 3366388 - DNA, 19 bp, Homo sapiens
ctgtcttcacagctctgtg

SEQ ID NO: 3366389 - DNA, 23 bp, Homo sapiens
ctgtcttcacagctctgtgttgc

SEQ ID NO: 3366390 - DNA, 16 bp, Homo sapiens
ctgtcttcacctgcca

SEQ ID NO: 3366391 - DNA, 17 bp, Homo sapiens
ctgtcttcacctgccac

SEQ ID NO: 3366392 - DNA, 19 bp, Homo sapiens
ctgtcttcatagcagattt

SEQ ID NO: 3366393 - DNA, 22 bp, Homo sapiens
ctgtcttcatagcagattttaa

SEQ ID NO: 3366394 - DNA, 13 bp, Homo sapiens
ctgtcttctgggc

SEQ ID NO: 3366395 - DNA, 19 bp, Homo sapiens
ctgtcttctggtctgtgtg

SEQ ID NO: 3366396 - DNA, 20 bp, Homo sapiens
ctgtcttctggtctgtgtgt

SEQ ID NO: 3366397 - DNA, 16 bp, Homo sapiens
ctgtctttaattctgt

SEQ ID NO: 3366398 - DNA, 13 bp, Homo sapiens
ctgtctttattct

SEQ ID NO: 3366399 - DNA, 14 bp, Homo sapiens
ctgtctttattctt

SEQ ID NO: 3366400 - DNA, 20 bp, Homo sapiens
ctgtctttggaaaaatgttt

SEQ ID NO: 3366401 - DNA, 24 bp, Homo sapiens
ctgtgaaataccacaagcctgaga

SEQ ID NO: 3366402 - DNA, 15 bp, Homo sapiens
ctgtgaaatataatt

SEQ ID NO: 3366403 - DNA, 16 bp, Homo sapiens
ctgtgaacgatttaga

SEQ ID NO: 3366404 - DNA, 18 bp, Homo sapiens
ctgtgaacgatttagaaa

SEQ ID NO: 3366405 - DNA, 21 bp, Homo sapiens
ctgtgaagagccggtggtgcc

SEQ ID NO: 3366406 - DNA, 23 bp, Homo sapiens
ctgtgaagtttacattgtaaata

SEQ ID NO: 3366407 - DNA, 15 bp, Homo sapiens
ctgtgaatacaatta

SEQ ID NO: 3366408 - DNA, 16 bp, Homo sapiens
ctgtgaatacaattaa

SEQ ID NO: 3366409 - DNA, 20 bp, Homo sapiens
ctgtgaatacaattaaaggt

SEQ ID NO: 3366410 - DNA, 13 bp, Homo sapiens
ctgtgaatgctaa

SEQ ID NO: 3366411 - DNA, 21 bp, Homo sapiens
ctgtgaatggaagcaaagtgc

SEQ ID NO: 3366412 - DNA, 15 bp, Homo sapiens
ctgtgaatggaggca

SEQ ID NO: 3366413 - DNA, 23 bp, Homo sapiens
ctgtgaatggaggcagagacctc

SEQ ID NO: 3366414 - DNA, 21 bp, Homo sapiens
ctgtgacaaaggatgaagaac

SEQ ID NO: 3366415 - DNA, 18 bp, Homo sapiens
ctgtgacaataagtttga

SEQ ID NO: 3366416 - DNA, 13 bp, Homo sapiens
ctgtgacatgtaa

SEQ ID NO: 3366417 - DNA, 23 bp, Homo sapiens
ctgtgacctgatttcagaagaga

SEQ ID NO: 3366418 - DNA, 16 bp, Homo sapiens
ctgtgacctgccccgc

SEQ ID NO: 3366419 - DNA, 23 bp, Homo sapiens
ctgtgagacccccacacctcagt

SEQ ID NO: 3366420 - DNA, 13 bp, Homo sapiens
ctgtgagcccctg

SEQ ID NO: 3366421 - DNA, 15 bp, Homo sapiens
ctgtgagcccctggt

SEQ ID NO: 3366422 - DNA, 12 bp, Homo sapiens
ctgtgaggctgt

SEQ ID NO: 3366423 - DNA, 15 bp, Homo sapiens
ctgtgaggctgtcct

SEQ ID NO: 3366424 - DNA, 16 bp, Homo sapiens
ctgtgaggctgtcctg

SEQ ID NO: 3366425 - DNA, 19 bp, Homo sapiens
ctgtgagtgcgtctgaggg

SEQ ID NO: 3366426 - DNA, 17 bp, Homo sapiens
ctgtgagttctccctgt

SEQ ID NO: 3366427 - DNA, 17 bp, Homo sapiens
ctgtgataactctgcaa

SEQ ID NO: 3366428 - DNA, 19 bp, Homo sapiens
ctgtgatagttcaccccct

SEQ ID NO: 3366429 - DNA, 20 bp, Homo sapiens
ctgtgatcaatatttttata

SEQ ID NO: 3366430 - DNA, 16 bp, Homo sapiens
ctgtgatgagctgatc

SEQ ID NO: 3366431 - DNA, 22 bp, Homo sapiens
ctgtgatgaggggaggggggca

SEQ ID NO: 3366432 - DNA, 17 bp, Homo sapiens
ctgtgatgatcctcata

SEQ ID NO: 3366433 - DNA, 17 bp, Homo sapiens
ctgtgatgccacacaga

SEQ ID NO: 3366434 - DNA, 15 bp, Homo sapiens
ctgtgcacacacaca

SEQ ID NO: 3366435 - DNA, 12 bp, Homo sapiens
ctgtgcactgcc

SEQ ID NO: 3366436 - DNA, 14 bp, Homo sapiens
ctgtgcactgccct

SEQ ID NO: 3366437 - DNA, 13 bp, Homo sapiens
ctgtgcagaataa

SEQ ID NO: 3366438 - DNA, 14 bp, Homo sapiens
ctgtgcagaataat

SEQ ID NO: 3366439 - DNA, 21 bp, Homo sapiens
ctgtgcagaataatggaaaca

SEQ ID NO: 3366440 - DNA, 17 bp, Homo sapiens
ctgtgcagcagcccagc

SEQ ID NO: 3366441 - DNA, 23 bp, Homo sapiens
ctgtgcagcagcccagcttcctg

SEQ ID NO: 3366442 - DNA, 21 bp, Homo sapiens
ctgtgcagcgcagctggactc

SEQ ID NO: 3366443 - DNA, 13 bp, Homo sapiens
ctgtgcagggagg

SEQ ID NO: 3366444 - DNA, 22 bp, Homo sapiens
ctgtgcagggaggaggtggcag

SEQ ID NO: 3366445 - DNA, 16 bp, Homo sapiens
ctgtgcatagtgctgg

SEQ ID NO: 3366446 - DNA, 22 bp, Homo sapiens
ctgtgcatgggtgaagggagag

SEQ ID NO: 3366447 - DNA, 17 bp, Homo sapiens
ctgtgcatgtatgtctt

SEQ ID NO: 3366448 - DNA, 17 bp, Homo sapiens
ctgtgcatttctggttg

SEQ ID NO: 3366449 - DNA, 19 bp, Homo sapiens
ctgtgccactttgactcag

SEQ ID NO: 3366450 - DNA, 22 bp, Homo sapiens
ctgtgccagaggaaggaaaagg

SEQ ID NO: 3366451 - DNA, 16 bp, Homo sapiens
ctgtgccatgctgggc

SEQ ID NO: 3366452 - DNA, 20 bp, Homo sapiens
ctgtgccatgctgggccact

SEQ ID NO: 3366453 - DNA, 15 bp, Homo sapiens
ctgtgccatggattt

SEQ ID NO: 3366454 - DNA, 19 bp, Homo sapiens
ctgtgcccacatcccaggc

SEQ ID NO: 3366455 - DNA, 21 bp, Homo sapiens
ctgtgccccatgcctgtccag

SEQ ID NO: 3366456 - DNA, 13 bp, Homo sapiens
ctgtgccctcacc

SEQ ID NO: 3366457 - DNA, 11 bp, Homo sapiens
ctgtgccctgg

SEQ ID NO: 3366458 - DNA, 15 bp, Homo sapiens
ctgtgccctggtgga

SEQ ID NO: 3366459 - DNA, 16 bp, Homo sapiens
ctgtgccctggtggag

SEQ ID NO: 3366460 - DNA, 12 bp, Homo sapiens
ctgtgcctgcca

SEQ ID NO: 3366461 - DNA, 13 bp, Homo sapiens
ctgtgcctgccat

SEQ ID NO: 3366462 - DNA, 20 bp, Homo sapiens
ctgtgcctgccatgggccag

SEQ ID NO: 3366463 - DNA, 12 bp, Homo sapiens
ctgtgcctgcta

SEQ ID NO: 3366464 - DNA, 18 bp, Homo sapiens
ctgtgcctgctagagcaa

SEQ ID NO: 3366465 - DNA, 19 bp, Homo sapiens
ctgtgcctgctagagcaac

SEQ ID NO: 3366466 - DNA, 23 bp, Homo sapiens
ctgtgccttgttttttgtttgtt

SEQ ID NO: 3366467 - DNA, 16 bp, Homo sapiens
ctgtgccttttcccca

SEQ ID NO: 3366468 - DNA, 14 bp, Homo sapiens
ctgtgcgtgaaaca

SEQ ID NO: 3366469 - DNA, 18 bp, Homo sapiens
ctgtgctaataacagtgc

SEQ ID NO: 3366470 - DNA, 21 bp, Homo sapiens
ctgtgctcggaggccatctcg

SEQ ID NO: 3366471 - DNA, 16 bp, Homo sapiens
ctgtgctctcaccagc

SEQ ID NO: 3366472 - DNA, 14 bp, Homo sapiens
ctgtgctctctgtg

SEQ ID NO: 3366473 - DNA, 19 bp, Homo sapiens
ctgtgctctggacaggcat

SEQ ID NO: 3366474 - DNA, 18 bp, Homo sapiens
ctgtgctctttgaagaga

SEQ ID NO: 3366475 - DNA, 12 bp, Homo sapiens
ctgtgctgctca

SEQ ID NO: 3366476 - DNA, 22 bp, Homo sapiens
ctgtgctgcttttgagcctcag

SEQ ID NO: 3366477 - DNA, 13 bp, Homo sapiens
ctgtgctggggga

SEQ ID NO: 3366478 - DNA, 23 bp, Homo sapiens
ctgtgctgggggaatgagcccag

SEQ ID NO: 3366479 - DNA, 13 bp, Homo sapiens
ctgtgctgtgcct

SEQ ID NO: 3366480 - DNA, 14 bp, Homo sapiens
ctgtgctgtggaga

SEQ ID NO: 3366481 - DNA, 18 bp, Homo sapiens
ctgtgctgtggcatagac

SEQ ID NO: 3366482 - DNA, 18 bp, Homo sapiens
ctgtgctgtgtgtgacgt

SEQ ID NO: 3366483 - DNA, 17 bp, Homo sapiens
ctgtgcttttaaatgca

SEQ ID NO: 3366484 - DNA, 22 bp, Homo sapiens
ctgtggaacccagcagttctgt

SEQ ID NO: 3366485 - DNA, 19 bp, Homo sapiens
ctgtggaaggcagagaaat

SEQ ID NO: 3366486 - DNA, 15 bp, Homo sapiens
ctgtggacggggagg

SEQ ID NO: 3366487 - DNA, 14 bp, Homo sapiens
ctgtggagctgcca

SEQ ID NO: 3366488 - DNA, 22 bp, Homo sapiens
ctgtggagctgccacagagaag

SEQ ID NO: 3366489 - DNA, 23 bp, Homo sapiens
ctgtggagctgccacagagaagt

SEQ ID NO: 3366490 - DNA, 15 bp, Homo sapiens
ctgtggaggaaggat

SEQ ID NO: 3366491 - DNA, 16 bp, Homo sapiens
ctgtggaggaaggatt

SEQ ID NO: 3366492 - DNA, 13 bp, Homo sapiens
ctgtggaggcctg

SEQ ID NO: 3366493 - DNA, 14 bp, Homo sapiens
ctgtggaggcctga

SEQ ID NO: 3366494 - DNA, 21 bp, Homo sapiens
ctgtggaggcctgatgctgcc

SEQ ID NO: 3366495 - DNA, 22 bp, Homo sapiens
ctgtggaggcctgatgctgccc

SEQ ID NO: 3366496 - DNA, 20 bp, Homo sapiens
ctgtggatacccttaccctt

SEQ ID NO: 3366497 - DNA, 12 bp, Homo sapiens
ctgtggcacaga

SEQ ID NO: 3366498 - DNA, 17 bp, Homo sapiens
ctgtggcagagttacag

SEQ ID NO: 3366499 - DNA, 23 bp, Homo sapiens
ctgtggcagagttacagttctgt

SEQ ID NO: 3366500 - DNA, 21 bp, Homo sapiens
ctgtggcaggcagcgccaagc

SEQ ID NO: 3366501 - DNA, 15 bp, Homo sapiens
ctgtggcagtaaaga

SEQ ID NO: 3366502 - DNA, 20 bp, Homo sapiens
ctgtggcagtaaagagaaac

SEQ ID NO: 3366503 - DNA, 23 bp, Homo sapiens
ctgtggcagtaaagagaaacttt

SEQ ID NO: 3366504 - DNA, 14 bp, Homo sapiens
ctgtggcataaatt

SEQ ID NO: 3366505 - DNA, 17 bp, Homo sapiens
ctgtggcataaattgca

SEQ ID NO: 3366506 - DNA, 18 bp, Homo sapiens
ctgtggcatagacatgga

SEQ ID NO: 3366507 - DNA, 21 bp, Homo sapiens
ctgtggcatagacatggatgc

SEQ ID NO: 3366508 - DNA, 16 bp, Homo sapiens
ctgtggcattgaaatg

SEQ ID NO: 3366509 - DNA, 18 bp, Homo sapiens
ctgtggccacagccccct

SEQ ID NO: 3366510 - DNA, 17 bp, Homo sapiens
ctgtggccagagctgga

SEQ ID NO: 3366511 - DNA, 19 bp, Homo sapiens
ctgtggccagagctggaag

SEQ ID NO: 3366512 - DNA, 20 bp, Homo sapiens
ctgtggccagagctggaagg

SEQ ID NO: 3366513 - DNA, 22 bp, Homo sapiens
ctgtggccagcttgttatttat

SEQ ID NO: 3366514 - DNA, 23 bp, Homo sapiens
ctgtggccagcttgttatttata

SEQ ID NO: 3366515 - DNA, 20 bp, Homo sapiens
ctgtggccccaccctgggcc

SEQ ID NO: 3366516 - DNA, 21 bp, Homo sapiens
ctgtggccccaccctgggccc

SEQ ID NO: 3366517 - DNA, 15 bp, Homo sapiens
ctgtggccccctccg

SEQ ID NO: 3366518 - DNA, 14 bp, Homo sapiens
ctgtggccctggag

SEQ ID NO: 3366519 - DNA, 15 bp, Homo sapiens
ctgtggccgtctcct

SEQ ID NO: 3366520 - DNA, 14 bp, Homo sapiens
ctgtggcctgtgtc

SEQ ID NO: 3366521 - DNA, 24 bp, Homo sapiens
ctgtggcctgtgtccagcagctgc

SEQ ID NO: 3366522 - DNA, 17 bp, Homo sapiens
ctgtggcctgtgtccca

SEQ ID NO: 3366523 - DNA, 20 bp, Homo sapiens
ctgtggcctgtgtcccatga

SEQ ID NO: 3366524 - DNA, 22 bp, Homo sapiens
ctgtggcctgtgtcccatgacc

SEQ ID NO: 3366525 - DNA, 17 bp, Homo sapiens
ctgtggcgccgtctcca

SEQ ID NO: 3366526 - DNA, 24 bp, Homo sapiens
ctgtggcgccgtctccaggggctg

SEQ ID NO: 3366527 - DNA, 14 bp, Homo sapiens
ctgtggctctgcat

SEQ ID NO: 3366528 - DNA, 15 bp, Homo sapiens
ctgtggctgcaggtg

SEQ ID NO: 3366529 - DNA, 15 bp, Homo sapiens
ctgtgggaaggccag

SEQ ID NO: 3366530 - DNA, 18 bp, Homo sapiens
ctgtgggaaggccagctg

SEQ ID NO: 3366531 - DNA, 20 bp, Homo sapiens
ctgtgggaaggccagctgcc

SEQ ID NO: 3366532 - DNA, 20 bp, Homo sapiens
ctgtgggagggactttgctg

SEQ ID NO: 3366533 - DNA, 16 bp, Homo sapiens
ctgtgggattctgatt

SEQ ID NO: 3366534 - DNA, 13 bp, Homo sapiens
ctgtgggcagcac

SEQ ID NO: 3366535 - DNA, 21 bp, Homo sapiens
ctgtgggcaggcaagcccttc

SEQ ID NO: 3366536 - DNA, 15 bp, Homo sapiens
ctgtgggccagattg

SEQ ID NO: 3366537 - DNA, 23 bp, Homo sapiens
ctgtgggctacatgctggggtca

SEQ ID NO: 3366538 - DNA, 16 bp, Homo sapiens
ctgtggggatctcagg

SEQ ID NO: 3366539 - DNA, 17 bp, Homo sapiens
ctgtggggctggtagct

SEQ ID NO: 3366540 - DNA, 14 bp, Homo sapiens
ctgtgggggtggcc

SEQ ID NO: 3366541 - DNA, 19 bp, Homo sapiens
ctgtgggggtgtgccccct

SEQ ID NO: 3366542 - DNA, 16 bp, Homo sapiens
ctgtgggtctgggagt

SEQ ID NO: 3366543 - DNA, 22 bp, Homo sapiens
ctgtgggtctgggagtcacaca

SEQ ID NO: 3366544 - DNA, 16 bp, Homo sapiens
ctgtggtcacagcgga

SEQ ID NO: 3366545 - DNA, 23 bp, Homo sapiens
ctgtggttacagtgcagacaggc

SEQ ID NO: 3366546 - DNA, 16 bp, Homo sapiens
ctgtggtttcatgtta

SEQ ID NO: 3366547 - DNA, 18 bp, Homo sapiens
ctgtggtttcatgttagt

SEQ ID NO: 3366548 - DNA, 15 bp, Homo sapiens
ctgtgtaacactgtt

SEQ ID NO: 3366549 - DNA, 23 bp, Homo sapiens
ctgtgtacataactctgtaaaaa

SEQ ID NO: 3366550 - DNA, 20 bp, Homo sapiens
ctgtgtacataactgaaaat

SEQ ID NO: 3366551 - DNA, 13 bp, Homo sapiens
ctgtgtacatttt

SEQ ID NO: 3366552 - DNA, 12 bp, Homo sapiens
ctgtgtactgtg

SEQ ID NO: 3366553 - DNA, 13 bp, Homo sapiens
ctgtgtactgtgt

SEQ ID NO: 3366554 - DNA, 14 bp, Homo sapiens
ctgtgtatatctct

SEQ ID NO: 3366555 - DNA, 16 bp, Homo sapiens
ctgtgtatatctcttg

SEQ ID NO: 3366556 - DNA, 22 bp, Homo sapiens
ctgtgtatatctcttggaaaat

SEQ ID NO: 3366557 - DNA, 12 bp, Homo sapiens
ctgtgtatatta

SEQ ID NO: 3366558 - DNA, 19 bp, Homo sapiens
ctgtgtatattatttggca

SEQ ID NO: 3366559 - DNA, 20 bp, Homo sapiens
ctgtgtatattatttggcag

SEQ ID NO: 3366560 - DNA, 19 bp, Homo sapiens
ctgtgtatggaaaaaccat

SEQ ID NO: 3366561 - DNA, 20 bp, Homo sapiens
ctgtgtatttaattgtaaac

SEQ ID NO: 3366562 - DNA, 22 bp, Homo sapiens
ctgtgtatttaattgtaaactg

SEQ ID NO: 3366563 - DNA, 13 bp, Homo sapiens
ctgtgtcagaaac

SEQ ID NO: 3366564 - DNA, 17 bp, Homo sapiens
ctgtgtccacctgtggg

SEQ ID NO: 3366565 - DNA, 15 bp, Homo sapiens
ctgtgtccagcagct

SEQ ID NO: 3366566 - DNA, 19 bp, Homo sapiens
ctgtgtccatgcgctcagg

SEQ ID NO: 3366567 - DNA, 22 bp, Homo sapiens
ctgtgtccatgcgctcagggcc

SEQ ID NO: 3366568 - DNA, 23 bp, Homo sapiens
ctgtgtccatgcgctcagggcca

SEQ ID NO: 3366569 - DNA, 13 bp, Homo sapiens
ctgtgtcccatga

SEQ ID NO: 3366570 - DNA, 15 bp, Homo sapiens
ctgtgtcccatgacc

SEQ ID NO: 3366571 - DNA, 17 bp, Homo sapiens
ctgtgtcccatgaccca

SEQ ID NO: 3366572 - DNA, 20 bp, Homo sapiens
ctgtgtcctggttagcagag

SEQ ID NO: 3366573 - DNA, 16 bp, Homo sapiens
ctgtgtcgtagccaag

SEQ ID NO: 3366574 - DNA, 12 bp, Homo sapiens
ctgtgtctaaga

SEQ ID NO: 3366575 - DNA, 17 bp, Homo sapiens
ctgtgtctaagattcta

SEQ ID NO: 3366576 - DNA, 14 bp, Homo sapiens
ctgtgtcttgcaat

SEQ ID NO: 3366577 - DNA, 23 bp, Homo sapiens
ctgtgtctttctctctctctctt

SEQ ID NO: 3366578 - DNA, 20 bp, Homo sapiens
ctgtgtcttttttcactaca

SEQ ID NO: 3366579 - DNA, 14 bp, Homo sapiens
ctgtgtgaatgtgg

SEQ ID NO: 3366580 - DNA, 17 bp, Homo sapiens
ctgtgtgaatgtgggca

SEQ ID NO: 3366581 - DNA, 19 bp, Homo sapiens
ctgtgtgatgaactttctc

SEQ ID NO: 3366582 - DNA, 16 bp, Homo sapiens
ctgtgtgcctggggga

SEQ ID NO: 3366583 - DNA, 23 bp, Homo sapiens
ctgtgtgctcctccttggtgcct

SEQ ID NO: 3366584 - DNA, 12 bp, Homo sapiens
ctgtgtggaact

SEQ ID NO: 3366585 - DNA, 18 bp, Homo sapiens
ctgtgtggcaaattaaac

SEQ ID NO: 3366586 - DNA, 19 bp, Homo sapiens
ctgtgtggcaaattaaaca

SEQ ID NO: 3366587 - DNA, 22 bp, Homo sapiens
ctgtgtgggactgtacacactt

SEQ ID NO: 3366588 - DNA, 15 bp, Homo sapiens
ctgtgtgggatactt

SEQ ID NO: 3366589 - DNA, 20 bp, Homo sapiens
ctgtgtgggatacttagtgg

SEQ ID NO: 3366590 - DNA, 24 bp, Homo sapiens
ctgtgtgggatacttagtggtatg

SEQ ID NO: 3366591 - DNA, 21 bp, Homo sapiens
ctgtgtgtccaaaactgcctc

SEQ ID NO: 3366592 - DNA, 16 bp, Homo sapiens
ctgtgtgtgtgaatga

SEQ ID NO: 3366593 - DNA, 20 bp, Homo sapiens
ctgtgtgtgttcttcaagcc

SEQ ID NO: 3366594 - DNA, 23 bp, Homo sapiens
ctgtgtgtgttcttcaagccagc

SEQ ID NO: 3366595 - DNA, 22 bp, Homo sapiens
ctgtgttactaaaaaaaagatg

SEQ ID NO: 3366596 - DNA, 13 bp, Homo sapiens
ctgtgttcctggc

SEQ ID NO: 3366597 - DNA, 20 bp, Homo sapiens
ctgtgttgaaacagaaaaat

SEQ ID NO: 3366598 - DNA, 13 bp, Homo sapiens
ctgtgttgccaag

SEQ ID NO: 3366599 - DNA, 14 bp, Homo sapiens
ctgtgttgccaagc

SEQ ID NO: 3366600 - DNA, 16 bp, Homo sapiens
ctgtgttgccaagctc

SEQ ID NO: 3366601 - DNA, 19 bp, Homo sapiens
ctgtgttgccaagctccaa

SEQ ID NO: 3366602 - DNA, 13 bp, Homo sapiens
ctgtgttgtatta

SEQ ID NO: 3366603 - DNA, 15 bp, Homo sapiens
ctgtgttgtattaac

SEQ ID NO: 3366604 - DNA, 22 bp, Homo sapiens
ctgtgttgtattaacaaaagtt

SEQ ID NO: 3366605 - DNA, 21 bp, Homo sapiens
ctgtgtttaatttcttcaaaa

SEQ ID NO: 3366606 - DNA, 16 bp, Homo sapiens
ctgtgtttaatttgac

SEQ ID NO: 3366607 - DNA, 15 bp, Homo sapiens
ctgtgtttccatctc

SEQ ID NO: 3366608 - DNA, 16 bp, Homo sapiens
ctgtgttttgaaagaa

SEQ ID NO: 3366609 - DNA, 12 bp, Homo sapiens
ctgttaaaatct

SEQ ID NO: 3366610 - DNA, 19 bp, Homo sapiens
ctgttaaaatctattctgt

SEQ ID NO: 3366611 - DNA, 13 bp, Homo sapiens
ctgttaaacagta

SEQ ID NO: 3366612 - DNA, 12 bp, Homo sapiens
ctgttaaactgt

SEQ ID NO: 3366613 - DNA, 13 bp, Homo sapiens
ctgttaaactgtt

SEQ ID NO: 3366614 - DNA, 14 bp, Homo sapiens
ctgttaaactgtta

SEQ ID NO: 3366615 - DNA, 14 bp, Homo sapiens
ctgttaagagagga

SEQ ID NO: 3366616 - DNA, 22 bp, Homo sapiens
ctgttaaggttgaactttgcca

SEQ ID NO: 3366617 - DNA, 21 bp, Homo sapiens
ctgttaatacacagtacttta

SEQ ID NO: 3366618 - DNA, 18 bp, Homo sapiens
ctgttaatgtatttgttc

SEQ ID NO: 3366619 - DNA, 20 bp, Homo sapiens
ctgttacataacaagaaaat

SEQ ID NO: 3366620 - DNA, 16 bp, Homo sapiens
ctgttaccatgtcact

SEQ ID NO: 3366621 - DNA, 18 bp, Homo sapiens
ctgttacccagagaatat

SEQ ID NO: 3366622 - DNA, 15 bp, Homo sapiens
ctgttactttggcaa

SEQ ID NO: 3366623 - DNA, 23 bp, Homo sapiens
ctgttactttggcaatttcctgg

SEQ ID NO: 3366624 - DNA, 13 bp, Homo sapiens
ctgttagaacact

SEQ ID NO: 3366625 - DNA, 17 bp, Homo sapiens
ctgttagaacactattt

SEQ ID NO: 3366626 - DNA, 21 bp, Homo sapiens
ctgttagaacactattttcag

SEQ ID NO: 3366627 - DNA, 23 bp, Homo sapiens
ctgttagaacactattttcagaa

SEQ ID NO: 3366628 - DNA, 13 bp, Homo sapiens
ctgttagatgctg

SEQ ID NO: 3366629 - DNA, 15 bp, Homo sapiens
ctgttagatgctgaa

SEQ ID NO: 3366630 - DNA, 14 bp, Homo sapiens
ctgttagcactgtt

SEQ ID NO: 3366631 - DNA, 16 bp, Homo sapiens
ctgttagcactgttga

SEQ ID NO: 3366632 - DNA, 19 bp, Homo sapiens
ctgttagctttttaaaaca

SEQ ID NO: 3366633 - DNA, 15 bp, Homo sapiens
ctgttagtcatttgc

SEQ ID NO: 3366634 - DNA, 12 bp, Homo sapiens
ctgttatgtact

SEQ ID NO: 3366635 - DNA, 13 bp, Homo sapiens
ctgttatgtactg

SEQ ID NO: 3366636 - DNA, 14 bp, Homo sapiens
ctgttatgtactgt

SEQ ID NO: 3366637 - DNA, 16 bp, Homo sapiens
ctgttatgtactgtac

SEQ ID NO: 3366638 - DNA, 13 bp, Homo sapiens
ctgttatgtatga

SEQ ID NO: 3366639 - DNA, 14 bp, Homo sapiens
ctgttatttagact

SEQ ID NO: 3366640 - DNA, 17 bp, Homo sapiens
ctgttcaatgtttaatg

SEQ ID NO: 3366641 - DNA, 20 bp, Homo sapiens
ctgttcacagaaaaagcatg

SEQ ID NO: 3366642 - DNA, 15 bp, Homo sapiens
ctgttcactctactt

SEQ ID NO: 3366643 - DNA, 13 bp, Homo sapiens
ctgttcagctcca

SEQ ID NO: 3366644 - DNA, 22 bp, Homo sapiens
ctgttcagctccagctcaccag

SEQ ID NO: 3366645 - DNA, 19 bp, Homo sapiens
ctgttcatgtgcctctgcg

SEQ ID NO: 3366646 - DNA, 16 bp, Homo sapiens
ctgttccaaagccagt

SEQ ID NO: 3366647 - DNA, 11 bp, Homo sapiens
ctgttccaaat

SEQ ID NO: 3366648 - DNA, 14 bp, Homo sapiens
ctgttccaaattca

SEQ ID NO: 3366649 - DNA, 18 bp, Homo sapiens
ctgttccaaattcagttt

SEQ ID NO: 3366650 - DNA, 22 bp, Homo sapiens
ctgttccaaattcagtttcata

SEQ ID NO: 3366651 - DNA, 17 bp, Homo sapiens
ctgttccaggccctcca

SEQ ID NO: 3366652 - DNA, 21 bp, Homo sapiens
ctgttccaggccctccagtgg

SEQ ID NO: 3366653 - DNA, 20 bp, Homo sapiens
ctgttcccatgtagccccct

SEQ ID NO: 3366654 - DNA, 12 bp, Homo sapiens
ctgttcccccgc

SEQ ID NO: 3366655 - DNA, 12 bp, Homo sapiens
ctgttcccctca

SEQ ID NO: 3366656 - DNA, 14 bp, Homo sapiens
ctgttccctctgct

SEQ ID NO: 3366657 - DNA, 15 bp, Homo sapiens
ctgttccttagacct

SEQ ID NO: 3366658 - DNA, 23 bp, Homo sapiens
ctgttccttgtactcttaggata

SEQ ID NO: 3366659 - DNA, 12 bp, Homo sapiens
ctgttcctttta

SEQ ID NO: 3366660 - DNA, 17 bp, Homo sapiens
ctgttctaaagctctga

SEQ ID NO: 3366661 - DNA, 19 bp, Homo sapiens
ctgttctagttttttactt

SEQ ID NO: 3366662 - DNA, 16 bp, Homo sapiens
ctgttctatgccttta

SEQ ID NO: 3366663 - DNA, 18 bp, Homo sapiens
ctgttctccctttctctc

SEQ ID NO: 3366664 - DNA, 20 bp, Homo sapiens
ctgttctccctttctctctc

SEQ ID NO: 3366665 - DNA, 15 bp, Homo sapiens
ctgttctcttcttca

SEQ ID NO: 3366666 - DNA, 22 bp, Homo sapiens
ctgttctgaggattcaggggct

SEQ ID NO: 3366667 - DNA, 20 bp, Homo sapiens
ctgttctgcaaaggtggcaa

SEQ ID NO: 3366668 - DNA, 15 bp, Homo sapiens
ctgttctgcactgaa

SEQ ID NO: 3366669 - DNA, 16 bp, Homo sapiens
ctgttctgcactgaaa

SEQ ID NO: 3366670 - DNA, 14 bp, Homo sapiens
ctgttctgggctct

SEQ ID NO: 3366671 - DNA, 23 bp, Homo sapiens
ctgttctgtttggcacttgtatt

SEQ ID NO: 3366672 - DNA, 14 bp, Homo sapiens
ctgttcttcctcca

SEQ ID NO: 3366673 - DNA, 21 bp, Homo sapiens
ctgttcttcctccagctgcac

SEQ ID NO: 3366674 - DNA, 18 bp, Homo sapiens
ctgttcttgctgctagaa

SEQ ID NO: 3366675 - DNA, 20 bp, Homo sapiens
ctgttcttgctgctagaact

SEQ ID NO: 3366676 - DNA, 18 bp, Homo sapiens
ctgttcttgggcctcagg

SEQ ID NO: 3366677 - DNA, 12 bp, Homo sapiens
ctgttgaaaatt

SEQ ID NO: 3366678 - DNA, 21 bp, Homo sapiens
ctgttgaaaattattttaaac

SEQ ID NO: 3366679 - DNA, 15 bp, Homo sapiens
ctgttgaagattaac

SEQ ID NO: 3366680 - DNA, 15 bp, Homo sapiens
ctgttgagctgtttt

SEQ ID NO: 3366681 - DNA, 20 bp, Homo sapiens
ctgttgagctgttttccctg

SEQ ID NO: 3366682 - DNA, 11 bp, Homo sapiens
ctgttgaggca

SEQ ID NO: 3366683 - DNA, 18 bp, Homo sapiens
ctgttgagggccactttt

SEQ ID NO: 3366684 - DNA, 19 bp, Homo sapiens
ctgttgagggccacttttt

SEQ ID NO: 3366685 - DNA, 16 bp, Homo sapiens
ctgttgcatttacttt

SEQ ID NO: 3366686 - DNA, 13 bp, Homo sapiens
ctgttgccacaac

SEQ ID NO: 3366687 - DNA, 18 bp, Homo sapiens
ctgttgctatagagccta

SEQ ID NO: 3366688 - DNA, 23 bp, Homo sapiens
ctgttgctatagagcctacctgt

SEQ ID NO: 3366689 - DNA, 22 bp, Homo sapiens
ctgttgctcaaatctattcaga

SEQ ID NO: 3366690 - DNA, 15 bp, Homo sapiens
ctgttggcaggctgg

SEQ ID NO: 3366691 - DNA, 22 bp, Homo sapiens
ctgttggcagtgagtgagcctg

SEQ ID NO: 3366692 - DNA, 15 bp, Homo sapiens
ctgttggccagtgtg

SEQ ID NO: 3366693 - DNA, 14 bp, Homo sapiens
ctgttggggagggg

SEQ ID NO: 3366694 - DNA, 14 bp, Homo sapiens
ctgttggttccaag

SEQ ID NO: 3366695 - DNA, 17 bp, Homo sapiens
ctgttgtaacttatgta

SEQ ID NO: 3366696 - DNA, 17 bp, Homo sapiens
ctgttgtaagaattctg

SEQ ID NO: 3366697 - DNA, 19 bp, Homo sapiens
ctgttgtaagaattctgat

SEQ ID NO: 3366698 - DNA, 15 bp, Homo sapiens
ctgttgtacatttat

SEQ ID NO: 3366699 - DNA, 21 bp, Homo sapiens
ctgttgtacgtaaagcttaaa

SEQ ID NO: 3366700 - DNA, 15 bp, Homo sapiens
ctgttgtactatgga

SEQ ID NO: 3366701 - DNA, 17 bp, Homo sapiens
ctgttgtgatcttgcat

SEQ ID NO: 3366702 - DNA, 22 bp, Homo sapiens
ctgttgtgatcttgcattcatt

SEQ ID NO: 3366703 - DNA, 13 bp, Homo sapiens
ctgttgttgttaa

SEQ ID NO: 3366704 - DNA, 23 bp, Homo sapiens
ctgttgttgttaatgaaaatgtc

SEQ ID NO: 3366705 - DNA, 17 bp, Homo sapiens
ctgttgtttctaaacaa

SEQ ID NO: 3366706 - DNA, 20 bp, Homo sapiens
ctgttgttttgttttaaata

SEQ ID NO: 3366707 - DNA, 14 bp, Homo sapiens
ctgtttaatttaca

SEQ ID NO: 3366708 - DNA, 19 bp, Homo sapiens
ctgtttacatccagagttc

SEQ ID NO: 3366709 - DNA, 22 bp, Homo sapiens
ctgtttacatccagagttctgt

SEQ ID NO: 3366710 - DNA, 17 bp, Homo sapiens
ctgtttaccatttttca

SEQ ID NO: 3366711 - DNA, 17 bp, Homo sapiens
ctgtttagaacaccaaa

SEQ ID NO: 3366712 - DNA, 20 bp, Homo sapiens
ctgtttagagtaaataaact

SEQ ID NO: 3366713 - DNA, 22 bp, Homo sapiens
ctgtttagagtaaataaactgt

SEQ ID NO: 3366714 - DNA, 20 bp, Homo sapiens
ctgtttagcagcagccttta

SEQ ID NO: 3366715 - DNA, 18 bp, Homo sapiens
ctgtttaggaagaagtgg

SEQ ID NO: 3366716 - DNA, 16 bp, Homo sapiens
ctgtttatggcctcag

SEQ ID NO: 3366717 - DNA, 16 bp, Homo sapiens
ctgtttatttctgttt

SEQ ID NO: 3366718 - DNA, 11 bp, Homo sapiens
ctgtttcaagg

SEQ ID NO: 3366719 - DNA, 16 bp, Homo sapiens
ctgtttcaatcactgt

SEQ ID NO: 3366720 - DNA, 14 bp, Homo sapiens
ctgtttccagggtc

SEQ ID NO: 3366721 - DNA, 15 bp, Homo sapiens
ctgtttccagggtct

SEQ ID NO: 3366722 - DNA, 15 bp, Homo sapiens
ctgtttccctgctga

SEQ ID NO: 3366723 - DNA, 20 bp, Homo sapiens
ctgtttcctgacattgtctc

SEQ ID NO: 3366724 - DNA, 15 bp, Homo sapiens
ctgtttctcttgagc

SEQ ID NO: 3366725 - DNA, 17 bp, Homo sapiens
ctgtttctcttgagctg

SEQ ID NO: 3366726 - DNA, 13 bp, Homo sapiens
ctgtttctctttg

SEQ ID NO: 3366727 - DNA, 16 bp, Homo sapiens
ctgtttctctttgtct

SEQ ID NO: 3366728 - DNA, 20 bp, Homo sapiens
ctgtttctctttgtctgcct

SEQ ID NO: 3366729 - DNA, 15 bp, Homo sapiens
ctgtttctgcagccc

SEQ ID NO: 3366730 - DNA, 12 bp, Homo sapiens
ctgtttcttcct

SEQ ID NO: 3366731 - DNA, 15 bp, Homo sapiens
ctgtttcttcttgtg

SEQ ID NO: 3366732 - DNA, 15 bp, Homo sapiens
ctgtttgacacctct

SEQ ID NO: 3366733 - DNA, 23 bp, Homo sapiens
ctgtttgaggatatattttcact

SEQ ID NO: 3366734 - DNA, 20 bp, Homo sapiens
ctgtttgatgctatttatgc

SEQ ID NO: 3366735 - DNA, 16 bp, Homo sapiens
ctgtttgatgtatgtg

SEQ ID NO: 3366736 - DNA, 11 bp, Homo sapiens
ctgtttgtcat

SEQ ID NO: 3366737 - DNA, 22 bp, Homo sapiens
ctgtttgtcctgagatggaaaa

SEQ ID NO: 3366738 - DNA, 14 bp, Homo sapiens
ctgttttaattgta

SEQ ID NO: 3366739 - DNA, 15 bp, Homo sapiens
ctgttttaattgtag

SEQ ID NO: 3366740 - DNA, 22 bp, Homo sapiens
ctgttttacaaaaaagaaaaga

SEQ ID NO: 3366741 - DNA, 14 bp, Homo sapiens
ctgttttactgttt

SEQ ID NO: 3366742 - DNA, 15 bp, Homo sapiens
ctgttttactgtttt

SEQ ID NO: 3366743 - DNA, 23 bp, Homo sapiens
ctgttttatatattatgtgaaga

SEQ ID NO: 3366744 - DNA, 16 bp, Homo sapiens
ctgttttctctgtgac

SEQ ID NO: 3366745 - DNA, 15 bp, Homo sapiens
ctgttttctgagccc

SEQ ID NO: 3366746 - DNA, 18 bp, Homo sapiens
ctgttttcttctattcca

SEQ ID NO: 3366747 - DNA, 17 bp, Homo sapiens
ctgttttgaaggcaaaa

SEQ ID NO: 3366748 - DNA, 17 bp, Homo sapiens
ctgttttgtttggcaag

SEQ ID NO: 3366749 - DNA, 21 bp, Homo sapiens
ctgttttgtttggcaaggaaa

SEQ ID NO: 3366750 - DNA, 22 bp, Homo sapiens
ctgttttgtttggcaaggaaag

SEQ ID NO: 3366751 - DNA, 12 bp, Homo sapiens
ctgtttttcaca

SEQ ID NO: 3366752 - DNA, 12 bp, Homo sapiens
ctgtttttgtat

SEQ ID NO: 3366753 - DNA, 15 bp, Homo sapiens
ctgtttttgtatctt

SEQ ID NO: 3366754 - DNA, 15 bp, Homo sapiens
ctgtttttttttcat

SEQ ID NO: 3366755 - DNA, 22 bp, Homo sapiens
cttaaaaaaaaaaaaaaaagac

SEQ ID NO: 3366756 - DNA, 15 bp, Homo sapiens
cttaaaaaaatgaca

SEQ ID NO: 3366757 - DNA, 14 bp, Homo sapiens
cttaaaaaggacta

SEQ ID NO: 3366758 - DNA, 18 bp, Homo sapiens
cttaaaaaggactatatt

SEQ ID NO: 3366759 - DNA, 20 bp, Homo sapiens
cttaaaaatacttaataaat

SEQ ID NO: 3366760 - DNA, 21 bp, Homo sapiens
cttaaaaatcacactgtaaat

SEQ ID NO: 3366761 - DNA, 22 bp, Homo sapiens
cttaaaaatcacactgtaaata

SEQ ID NO: 3366762 - DNA, 15 bp, Homo sapiens
cttaaaaatgtaaat

SEQ ID NO: 3366763 - DNA, 16 bp, Homo sapiens
cttaaaaatgtaaata

SEQ ID NO: 3366764 - DNA, 14 bp, Homo sapiens
cttaaaacaacact

SEQ ID NO: 3366765 - DNA, 14 bp, Homo sapiens
cttaaaaccaaaga

SEQ ID NO: 3366766 - DNA, 20 bp, Homo sapiens
cttaaaaggggcccaagccc

SEQ ID NO: 3366767 - DNA, 20 bp, Homo sapiens
cttaaaaggtataattaaac

SEQ ID NO: 3366768 - DNA, 13 bp, Homo sapiens
cttaaaagtactt

SEQ ID NO: 3366769 - DNA, 17 bp, Homo sapiens
cttaaaagtactttaaa

SEQ ID NO: 3366770 - DNA, 12 bp, Homo sapiens
cttaaaagtatt

SEQ ID NO: 3366771 - DNA, 21 bp, Homo sapiens
cttaaaataaacagttgtgaa

SEQ ID NO: 3366772 - DNA, 23 bp, Homo sapiens
cttaaaataaacagttgtgaacc

SEQ ID NO: 3366773 - DNA, 22 bp, Homo sapiens
cttaaaataggggatatttaag

SEQ ID NO: 3366774 - DNA, 17 bp, Homo sapiens
cttaaaatatatttcag

SEQ ID NO: 3366775 - DNA, 15 bp, Homo sapiens
cttaaaatctctaat

SEQ ID NO: 3366776 - DNA, 12 bp, Homo sapiens
cttaaaatgcat

SEQ ID NO: 3366777 - DNA, 19 bp, Homo sapiens
cttaaaatgcattgaaaga

SEQ ID NO: 3366778 - DNA, 13 bp, Homo sapiens
cttaaacaaagtg

SEQ ID NO: 3366779 - DNA, 16 bp, Homo sapiens
cttaaacaaagtgact

SEQ ID NO: 3366780 - DNA, 19 bp, Homo sapiens
cttaaacactcaccttcta

SEQ ID NO: 3366781 - DNA, 20 bp, Homo sapiens
cttaaaccaacctttaaaat

SEQ ID NO: 3366782 - DNA, 19 bp, Homo sapiens
cttaaacgaagagttccct

SEQ ID NO: 3366783 - DNA, 17 bp, Homo sapiens
cttaaactaaataatga

SEQ ID NO: 3366784 - DNA, 15 bp, Homo sapiens
cttaaactaaatgtg

SEQ ID NO: 3366785 - DNA, 13 bp, Homo sapiens
cttaaagaaacag

SEQ ID NO: 3366786 - DNA, 22 bp, Homo sapiens
cttaaagaaacagctttcaagt

SEQ ID NO: 3366787 - DNA, 15 bp, Homo sapiens
cttaaagactgaaat

SEQ ID NO: 3366788 - DNA, 18 bp, Homo sapiens
cttaaagctgcctgtagt

SEQ ID NO: 3366789 - DNA, 23 bp, Homo sapiens
cttaaagctgcctgtagttagga

SEQ ID NO: 3366790 - DNA, 20 bp, Homo sapiens
cttaaaggcaccatctaata

SEQ ID NO: 3366791 - DNA, 21 bp, Homo sapiens
cttaaaggctgtggtagtact

SEQ ID NO: 3366792 - DNA, 20 bp, Homo sapiens
cttaaagttggtattaataa

SEQ ID NO: 3366793 - DNA, 22 bp, Homo sapiens
cttaaagttggtattaataaaa

SEQ ID NO: 3366794 - DNA, 21 bp, Homo sapiens
cttaaataatgcttcagatat

SEQ ID NO: 3366795 - DNA, 12 bp, Homo sapiens
cttaaatacaga

SEQ ID NO: 3366796 - DNA, 22 bp, Homo sapiens
cttaaatacagataattcattt

SEQ ID NO: 3366797 - DNA, 14 bp, Homo sapiens
cttaaataggaaag

SEQ ID NO: 3366798 - DNA, 13 bp, Homo sapiens
cttaaatctttct

SEQ ID NO: 3366799 - DNA, 22 bp, Homo sapiens
cttaaatgtttatactgtattt

SEQ ID NO: 3366800 - DNA, 18 bp, Homo sapiens
cttaaattatatatttat

SEQ ID NO: 3366801 - DNA, 20 bp, Homo sapiens
cttaaattatatatttattt

SEQ ID NO: 3366802 - DNA, 14 bp, Homo sapiens
cttaacaatgcaac

SEQ ID NO: 3366803 - DNA, 19 bp, Homo sapiens
cttaacaatgcaactttta

SEQ ID NO: 3366804 - DNA, 23 bp, Homo sapiens
cttaacaatttctgtccttcaga

SEQ ID NO: 3366805 - DNA, 17 bp, Homo sapiens
cttaacatatttactaa

SEQ ID NO: 3366806 - DNA, 17 bp, Homo sapiens
cttaacattctgtaaaa

SEQ ID NO: 3366807 - DNA, 13 bp, Homo sapiens
cttaacccaagga

SEQ ID NO: 3366808 - DNA, 14 bp, Homo sapiens
cttaacccaaggag

SEQ ID NO: 3366809 - DNA, 17 bp, Homo sapiens
cttaacccaaggagcac

SEQ ID NO: 3366810 - DNA, 11 bp, Homo sapiens
cttaacctttg

SEQ ID NO: 3366811 - DNA, 19 bp, Homo sapiens
cttaactgcatttttagac

SEQ ID NO: 3366812 - DNA, 15 bp, Homo sapiens
cttaacttcttgctt

SEQ ID NO: 3366813 - DNA, 18 bp, Homo sapiens
cttaacttcttgcttctt

SEQ ID NO: 3366814 - DNA, 12 bp, Homo sapiens
cttaacttgttt

SEQ ID NO: 3366815 - DNA, 17 bp, Homo sapiens
cttaagaacacaaagcg

SEQ ID NO: 3366816 - DNA, 19 bp, Homo sapiens
cttaagaactgcttcatgt

SEQ ID NO: 3366817 - DNA, 23 bp, Homo sapiens
cttaagacctactgttctaaagc

SEQ ID NO: 3366818 - DNA, 14 bp, Homo sapiens
cttaagatttttct

SEQ ID NO: 3366819 - DNA, 18 bp, Homo sapiens
cttaagcaaaagaaaaag

SEQ ID NO: 3366820 - DNA, 18 bp, Homo sapiens
cttaagcagcatggaaaa

SEQ ID NO: 3366821 - DNA, 19 bp, Homo sapiens
cttaagcagcatggaaaaa

SEQ ID NO: 3366822 - DNA, 19 bp, Homo sapiens
cttaagcatccgtgtattt

SEQ ID NO: 3366823 - DNA, 23 bp, Homo sapiens
cttaagcatctggctctaattca

SEQ ID NO: 3366824 - DNA, 23 bp, Homo sapiens
cttaagctaggatgttgctcaga

SEQ ID NO: 3366825 - DNA, 13 bp, Homo sapiens
cttaagctttgga

SEQ ID NO: 3366826 - DNA, 22 bp, Homo sapiens
cttaagctttggacccaaggaa

SEQ ID NO: 3366827 - DNA, 21 bp, Homo sapiens
cttaaggcacagtgggagctg

SEQ ID NO: 3366828 - DNA, 16 bp, Homo sapiens
cttaaggcactctgtt

SEQ ID NO: 3366829 - DNA, 19 bp, Homo sapiens
cttaagggttgaaggcagt

SEQ ID NO: 3366830 - DNA, 20 bp, Homo sapiens
cttaagggttgaaggcagtc

SEQ ID NO: 3366831 - DNA, 12 bp, Homo sapiens
cttaagtcccag

SEQ ID NO: 3366832 - DNA, 15 bp, Homo sapiens
cttaagtgcactttt

SEQ ID NO: 3366833 - DNA, 20 bp, Homo sapiens
cttaagttagcctccaccac

SEQ ID NO: 3366834 - DNA, 14 bp, Homo sapiens
cttaataaaaatga

SEQ ID NO: 3366835 - DNA, 23 bp, Homo sapiens
cttaataaatttaagtttttccc

SEQ ID NO: 3366836 - DNA, 13 bp, Homo sapiens
cttaatagcaaca

SEQ ID NO: 3366837 - DNA, 20 bp, Homo sapiens
cttaatcaggtcctcagaga

SEQ ID NO: 3366838 - DNA, 20 bp, Homo sapiens
cttaatcattttcattccta

SEQ ID NO: 3366839 - DNA, 23 bp, Homo sapiens
cttaatgacattcccctcccacc

SEQ ID NO: 3366840 - DNA, 14 bp, Homo sapiens
cttaatgagatagt

SEQ ID NO: 3366841 - DNA, 19 bp, Homo sapiens
cttaatggtatcctactga

SEQ ID NO: 3366842 - DNA, 14 bp, Homo sapiens
cttaatgtttattc

SEQ ID NO: 3366843 - DNA, 15 bp, Homo sapiens
cttaatgtttattcc

SEQ ID NO: 3366844 - DNA, 13 bp, Homo sapiens
cttaattaatttg

SEQ ID NO: 3366845 - DNA, 14 bp, Homo sapiens
cttaattaatttga

SEQ ID NO: 3366846 - DNA, 19 bp, Homo sapiens
cttaattattataaaaata

SEQ ID NO: 3366847 - DNA, 20 bp, Homo sapiens
cttaattattataaaaatat

SEQ ID NO: 3366848 - DNA, 21 bp, Homo sapiens
cttaattattataaaaatatt

SEQ ID NO: 3366849 - DNA, 15 bp, Homo sapiens
cttaattattatttg

SEQ ID NO: 3366850 - DNA, 14 bp, Homo sapiens
cttaattctttgtt

SEQ ID NO: 3366851 - DNA, 16 bp, Homo sapiens
cttaattctttgttct

SEQ ID NO: 3366852 - DNA, 17 bp, Homo sapiens
cttaattctttgttctg

SEQ ID NO: 3366853 - DNA, 19 bp, Homo sapiens
cttaattctttgttctgtt

SEQ ID NO: 3366854 - DNA, 15 bp, Homo sapiens
cttaattgcactcta

SEQ ID NO: 3366855 - DNA, 14 bp, Homo sapiens
cttaatttatttct

SEQ ID NO: 3366856 - DNA, 15 bp, Homo sapiens
cttaatttgcacagt

SEQ ID NO: 3366857 - DNA, 12 bp, Homo sapiens
cttaatttgtaa

SEQ ID NO: 3366858 - DNA, 20 bp, Homo sapiens
cttaatttgtaaacttctga

SEQ ID NO: 3366859 - DNA, 18 bp, Homo sapiens
cttaattttcagtataat

SEQ ID NO: 3366860 - DNA, 16 bp, Homo sapiens
cttaattttttttaat

SEQ ID NO: 3366861 - DNA, 17 bp, Homo sapiens
cttacaagatattgatg

SEQ ID NO: 3366862 - DNA, 18 bp, Homo sapiens
cttacaagcctaagaatc

SEQ ID NO: 3366863 - DNA, 20 bp, Homo sapiens
cttacaatattgattgggaa

SEQ ID NO: 3366864 - DNA, 18 bp, Homo sapiens
cttacaattgcactgctg

SEQ ID NO: 3366865 - DNA, 16 bp, Homo sapiens
cttacacatacagttt

SEQ ID NO: 3366866 - DNA, 20 bp, Homo sapiens
cttacacatacagttttatg

SEQ ID NO: 3366867 - DNA, 19 bp, Homo sapiens
cttacacatctcagaccct

SEQ ID NO: 3366868 - DNA, 15 bp, Homo sapiens
cttacaccagtttga

SEQ ID NO: 3366869 - DNA, 16 bp, Homo sapiens
cttacactgaaaatgt

SEQ ID NO: 3366870 - DNA, 21 bp, Homo sapiens
cttacactgcctgtatacttt

SEQ ID NO: 3366871 - DNA, 12 bp, Homo sapiens
cttacacttctt

SEQ ID NO: 3366872 - DNA, 16 bp, Homo sapiens
cttacacttggagccc

SEQ ID NO: 3366873 - DNA, 17 bp, Homo sapiens
cttacagtaactaattt

SEQ ID NO: 3366874 - DNA, 14 bp, Homo sapiens
cttacagttaagaa

SEQ ID NO: 3366875 - DNA, 20 bp, Homo sapiens
cttacagttaagaagccctg

SEQ ID NO: 3366876 - DNA, 20 bp, Homo sapiens
cttacataaaccatttttgt

SEQ ID NO: 3366877 - DNA, 22 bp, Homo sapiens
cttacataattttttattcaag

SEQ ID NO: 3366878 - DNA, 20 bp, Homo sapiens
cttacatgtgtaaaggtttc

SEQ ID NO: 3366879 - DNA, 21 bp, Homo sapiens
cttacattagcagtttgcttt

SEQ ID NO: 3366880 - DNA, 13 bp, Homo sapiens
cttacatttgtga

SEQ ID NO: 3366881 - DNA, 18 bp, Homo sapiens
cttacatttgtgagattc

SEQ ID NO: 3366882 - DNA, 17 bp, Homo sapiens
cttacatttttacaata

SEQ ID NO: 3366883 - DNA, 22 bp, Homo sapiens
cttacatttttacaataaataa

SEQ ID NO: 3366884 - DNA, 15 bp, Homo sapiens
cttaccaaaggatag

SEQ ID NO: 3366885 - DNA, 14 bp, Homo sapiens
cttaccaactttct

SEQ ID NO: 3366886 - DNA, 23 bp, Homo sapiens
cttaccatttgctactgtacata

SEQ ID NO: 3366887 - DNA, 16 bp, Homo sapiens
cttacccaatttccca

SEQ ID NO: 3366888 - DNA, 22 bp, Homo sapiens
cttaccccagcctacccttcct

SEQ ID NO: 3366889 - DNA, 18 bp, Homo sapiens
cttaccctagttctctta

SEQ ID NO: 3366890 - DNA, 19 bp, Homo sapiens
cttacctaaacagatataa

SEQ ID NO: 3366891 - DNA, 21 bp, Homo sapiens
cttacctaagtgacatttgta

SEQ ID NO: 3366892 - DNA, 16 bp, Homo sapiens
cttacctactttcttc

SEQ ID NO: 3366893 - DNA, 13 bp, Homo sapiens
cttacctgacaca

SEQ ID NO: 3366894 - DNA, 16 bp, Homo sapiens
cttacctgacacaaga

SEQ ID NO: 3366895 - DNA, 17 bp, Homo sapiens
cttacctgacctcttgc

SEQ ID NO: 3366896 - DNA, 21 bp, Homo sapiens
cttactaaacattttgttatt

SEQ ID NO: 3366897 - DNA, 22 bp, Homo sapiens
cttactaaacattttgttattg

SEQ ID NO: 3366898 - DNA, 12 bp, Homo sapiens
cttactaggaag

SEQ ID NO: 3366899 - DNA, 21 bp, Homo sapiens
cttactattcattaaatgttt

SEQ ID NO: 3366900 - DNA, 23 bp, Homo sapiens
cttactattcattaaatgtttga

SEQ ID NO: 3366901 - DNA, 11 bp, Homo sapiens
cttactatttc

SEQ ID NO: 3366902 - DNA, 13 bp, Homo sapiens
cttactcattact

SEQ ID NO: 3366903 - DNA, 12 bp, Homo sapiens
cttactctaaga

SEQ ID NO: 3366904 - DNA, 18 bp, Homo sapiens
cttactctcctctttcct

SEQ ID NO: 3366905 - DNA, 16 bp, Homo sapiens
cttactctgagcccag

SEQ ID NO: 3366906 - DNA, 20 bp, Homo sapiens
cttactctgagcccaggccg

SEQ ID NO: 3366907 - DNA, 21 bp, Homo sapiens
cttactctgagcccaggccgt

SEQ ID NO: 3366908 - DNA, 17 bp, Homo sapiens
cttactctgtccattta

SEQ ID NO: 3366909 - DNA, 21 bp, Homo sapiens
cttactgatatattttacaat

SEQ ID NO: 3366910 - DNA, 19 bp, Homo sapiens
cttactgggtgaggaaatc

SEQ ID NO: 3366911 - DNA, 12 bp, Homo sapiens
cttactgtatat

SEQ ID NO: 3366912 - DNA, 13 bp, Homo sapiens
cttactgtatatg

SEQ ID NO: 3366913 - DNA, 16 bp, Homo sapiens
cttactgtggaggaag

SEQ ID NO: 3366914 - DNA, 17 bp, Homo sapiens
cttactgtggaggaagg

SEQ ID NO: 3366915 - DNA, 21 bp, Homo sapiens
cttactgtttctgtcaggaga

SEQ ID NO: 3366916 - DNA, 18 bp, Homo sapiens
cttacttagcatgcacaa

SEQ ID NO: 3366917 - DNA, 21 bp, Homo sapiens
cttactttcctttccccagcc

SEQ ID NO: 3366918 - DNA, 21 bp, Homo sapiens
cttacttttcctggacttaaa

SEQ ID NO: 3366919 - DNA, 13 bp, Homo sapiens
cttagaaaatgtg

SEQ ID NO: 3366920 - DNA, 21 bp, Homo sapiens
cttagaaacacataaattatg

SEQ ID NO: 3366921 - DNA, 17 bp, Homo sapiens
cttagaaagcaggggct

SEQ ID NO: 3366922 - DNA, 20 bp, Homo sapiens
cttagaaatgtaaactgcca

SEQ ID NO: 3366923 - DNA, 21 bp, Homo sapiens
cttagaaatgtaaactgccat

SEQ ID NO: 3366924 - DNA, 16 bp, Homo sapiens
cttagaaattgcattt

SEQ ID NO: 3366925 - DNA, 15 bp, Homo sapiens
cttagaacattttaa

SEQ ID NO: 3366926 - DNA, 15 bp, Homo sapiens
cttagaagtcacaca

SEQ ID NO: 3366927 - DNA, 16 bp, Homo sapiens
cttagaatccaaactt

SEQ ID NO: 3366928 - DNA, 14 bp, Homo sapiens
cttagacccatgct

SEQ ID NO: 3366929 - DNA, 18 bp, Homo sapiens
cttagactctagtattta

SEQ ID NO: 3366930 - DNA, 20 bp, Homo sapiens
cttagacttcgactcaggat

SEQ ID NO: 3366931 - DNA, 18 bp, Homo sapiens
cttagaggcaacaggatt

SEQ ID NO: 3366932 - DNA, 12 bp, Homo sapiens
cttagagtgtag

SEQ ID NO: 3366933 - DNA, 14 bp, Homo sapiens
cttagagtgtagct

SEQ ID NO: 3366934 - DNA, 21 bp, Homo sapiens
cttagatttcatagttcagaa

SEQ ID NO: 3366935 - DNA, 16 bp, Homo sapiens
cttagcatgtttgctg

SEQ ID NO: 3366936 - DNA, 17 bp, Homo sapiens
cttagcatgtttgctga

SEQ ID NO: 3366937 - DNA, 18 bp, Homo sapiens
cttagccagttcaaagtg

SEQ ID NO: 3366938 - DNA, 17 bp, Homo sapiens
cttagcccaagaggtct

SEQ ID NO: 3366939 - DNA, 21 bp, Homo sapiens
cttagcccaagaggtctgagc

SEQ ID NO: 3366940 - DNA, 17 bp, Homo sapiens
cttagccgcaccctgca

SEQ ID NO: 3366941 - DNA, 18 bp, Homo sapiens
cttagccgcaccctgcac

SEQ ID NO: 3366942 - DNA, 14 bp, Homo sapiens
cttagcctccctga

SEQ ID NO: 3366943 - DNA, 15 bp, Homo sapiens
cttagcctccctgaa

SEQ ID NO: 3366944 - DNA, 17 bp, Homo sapiens
cttagcctggagcacct

SEQ ID NO: 3366945 - DNA, 16 bp, Homo sapiens
cttagccttgtgccct

SEQ ID NO: 3366946 - DNA, 23 bp, Homo sapiens
cttagccttgtgccctgccccca

SEQ ID NO: 3366947 - DNA, 19 bp, Homo sapiens
cttagctagttttattctt

SEQ ID NO: 3366948 - DNA, 14 bp, Homo sapiens
cttagctcccagct

SEQ ID NO: 3366949 - DNA, 13 bp, Homo sapiens
cttagctccctcc

SEQ ID NO: 3366950 - DNA, 13 bp, Homo sapiens
cttagctgtacta

SEQ ID NO: 3366951 - DNA, 20 bp, Homo sapiens
cttagcttatctttctttcc

SEQ ID NO: 3366952 - DNA, 22 bp, Homo sapiens
cttagctttccctgtgccactt

SEQ ID NO: 3366953 - DNA, 22 bp, Homo sapiens
cttaggaagagaaaccagggag

SEQ ID NO: 3366954 - DNA, 20 bp, Homo sapiens
cttaggagacgctgcacttg

SEQ ID NO: 3366955 - DNA, 15 bp, Homo sapiens
cttaggagagaccga

SEQ ID NO: 3366956 - DNA, 22 bp, Homo sapiens
cttaggatatttgagtcacttg

SEQ ID NO: 3366957 - DNA, 21 bp, Homo sapiens
cttaggatggggctcccagct

SEQ ID NO: 3366958 - DNA, 14 bp, Homo sapiens
cttaggatgtctgt

SEQ ID NO: 3366959 - DNA, 18 bp, Homo sapiens
cttaggatgtgtgcatgt

SEQ ID NO: 3366960 - DNA, 17 bp, Homo sapiens
cttagggaagctggcct

SEQ ID NO: 3366961 - DNA, 13 bp, Homo sapiens
cttagggcactgg

SEQ ID NO: 3366962 - DNA, 15 bp, Homo sapiens
cttaggggaaggaga

SEQ ID NO: 3366963 - DNA, 16 bp, Homo sapiens
cttagggtgaaccact

SEQ ID NO: 3366964 - DNA, 17 bp, Homo sapiens
cttaggttattttgctt

SEQ ID NO: 3366965 - DNA, 15 bp, Homo sapiens
cttagtaaaatttat

SEQ ID NO: 3366966 - DNA, 18 bp, Homo sapiens
cttagtaccagagctagt

SEQ ID NO: 3366967 - DNA, 22 bp, Homo sapiens
cttagtcccccaactctgagcc

SEQ ID NO: 3366968 - DNA, 23 bp, Homo sapiens
cttagtcccccaactctgagccc

SEQ ID NO: 3366969 - DNA, 13 bp, Homo sapiens
cttagtccccctg

SEQ ID NO: 3366970 - DNA, 12 bp, Homo sapiens
cttagtctcagt

SEQ ID NO: 3366971 - DNA, 23 bp, Homo sapiens
cttagtctcagtttgtgtgtctt

SEQ ID NO: 3366972 - DNA, 20 bp, Homo sapiens
cttagtcttctcatagcatt

SEQ ID NO: 3366973 - DNA, 21 bp, Homo sapiens
cttagtcttctcatagcatta

SEQ ID NO: 3366974 - DNA, 22 bp, Homo sapiens
cttagtgatcatttaaaaagct

SEQ ID NO: 3366975 - DNA, 21 bp, Homo sapiens
cttagtgggccagggctgccc

SEQ ID NO: 3366976 - DNA, 11 bp, Homo sapiens
cttagtgtatg

SEQ ID NO: 3366977 - DNA, 15 bp, Homo sapiens
cttagtgtatgatta

SEQ ID NO: 3366978 - DNA, 19 bp, Homo sapiens
cttagtgtggtatttgctg

SEQ ID NO: 3366979 - DNA, 21 bp, Homo sapiens
cttataaatcatattgatgaa

SEQ ID NO: 3366980 - DNA, 17 bp, Homo sapiens
cttataacctagttaaa

SEQ ID NO: 3366981 - DNA, 16 bp, Homo sapiens
cttataatactctgtt

SEQ ID NO: 3366982 - DNA, 12 bp, Homo sapiens
cttatacacatt

SEQ ID NO: 3366983 - DNA, 19 bp, Homo sapiens
cttatacgcttttctttgt

SEQ ID NO: 3366984 - DNA, 13 bp, Homo sapiens
cttatagaatatt

SEQ ID NO: 3366985 - DNA, 16 bp, Homo sapiens
cttatagaatatttat

SEQ ID NO: 3366986 - DNA, 19 bp, Homo sapiens
cttatagacacttgctccc

SEQ ID NO: 3366987 - DNA, 20 bp, Homo sapiens
cttatagcactttgaaatac

SEQ ID NO: 3366988 - DNA, 22 bp, Homo sapiens
cttatagcactttgaaatacct

SEQ ID NO: 3366989 - DNA, 17 bp, Homo sapiens
cttatagttaatatttt

SEQ ID NO: 3366990 - DNA, 14 bp, Homo sapiens
cttatagttactgt

SEQ ID NO: 3366991 - DNA, 15 bp, Homo sapiens
cttatagttctaggc

SEQ ID NO: 3366992 - DNA, 16 bp, Homo sapiens
cttatagttctaggca

SEQ ID NO: 3366993 - DNA, 17 bp, Homo sapiens
cttatataaaatagact

SEQ ID NO: 3366994 - DNA, 19 bp, Homo sapiens
cttatatagcagcaaaaat

SEQ ID NO: 3366995 - DNA, 22 bp, Homo sapiens
cttatatatgcacttaatttgt

SEQ ID NO: 3366996 - DNA, 23 bp, Homo sapiens
cttatatatgcacttaatttgtt

SEQ ID NO: 3366997 - DNA, 13 bp, Homo sapiens
cttatatgccaag

SEQ ID NO: 3366998 - DNA, 18 bp, Homo sapiens
cttatatgccaagctaat

SEQ ID NO: 3366999 - DNA, 13 bp, Homo sapiens
cttatatgtcctt

SEQ ID NO: 3367000 - DNA, 22 bp, Homo sapiens
cttatatgtccttgggttgctg

SEQ ID NO: 3367001 - DNA, 19 bp, Homo sapiens
cttatattttcgtatgaaa

SEQ ID NO: 3367002 - DNA, 20 bp, Homo sapiens
cttatcaactggttgtatat

SEQ ID NO: 3367003 - DNA, 12 bp, Homo sapiens
cttatcaagtgt

SEQ ID NO: 3367004 - DNA, 14 bp, Homo sapiens
cttatcaagtgtct

SEQ ID NO: 3367005 - DNA, 15 bp, Homo sapiens
cttatcaagtgtctt

SEQ ID NO: 3367006 - DNA, 14 bp, Homo sapiens
cttatcccccccag

SEQ ID NO: 3367007 - DNA, 20 bp, Homo sapiens
cttatcccccccagcctggc

SEQ ID NO: 3367008 - DNA, 20 bp, Homo sapiens
cttatcctacagtacaatca

SEQ ID NO: 3367009 - DNA, 19 bp, Homo sapiens
cttatctcagtcatgcata

SEQ ID NO: 3367010 - DNA, 22 bp, Homo sapiens
cttatctcagtcatgcataaat

SEQ ID NO: 3367011 - DNA, 21 bp, Homo sapiens
cttatctcttttatatttgta

SEQ ID NO: 3367012 - DNA, 16 bp, Homo sapiens
cttatcttctggatta

SEQ ID NO: 3367013 - DNA, 15 bp, Homo sapiens
cttatctttctttcc

SEQ ID NO: 3367014 - DNA, 19 bp, Homo sapiens
cttatctttctttccattt

SEQ ID NO: 3367015 - DNA, 22 bp, Homo sapiens
cttatgacatcacttgtacaaa

SEQ ID NO: 3367016 - DNA, 13 bp, Homo sapiens
cttatgagatggg

SEQ ID NO: 3367017 - DNA, 23 bp, Homo sapiens
cttatgattcagattgttatcta

SEQ ID NO: 3367018 - DNA, 22 bp, Homo sapiens
cttatgccacgggaagtttaga

SEQ ID NO: 3367019 - DNA, 18 bp, Homo sapiens
cttatgcggttaattttg

SEQ ID NO: 3367020 - DNA, 12 bp, Homo sapiens
cttatgcttcca

SEQ ID NO: 3367021 - DNA, 14 bp, Homo sapiens
cttatggaattgat

SEQ ID NO: 3367022 - DNA, 16 bp, Homo sapiens
cttatggaattgattt

SEQ ID NO: 3367023 - DNA, 19 bp, Homo sapiens
cttatggaattgatttgca

SEQ ID NO: 3367024 - DNA, 23 bp, Homo sapiens
cttatgtacttgatactgaatgc

SEQ ID NO: 3367025 - DNA, 15 bp, Homo sapiens
cttatgtagatattt

SEQ ID NO: 3367026 - DNA, 16 bp, Homo sapiens
cttatgtagatatttg

SEQ ID NO: 3367027 - DNA, 19 bp, Homo sapiens
cttatgtagatatttggct

SEQ ID NO: 3367028 - DNA, 23 bp, Homo sapiens
cttatgtccaccacttcagggga

SEQ ID NO: 3367029 - DNA, 16 bp, Homo sapiens
cttatgttgaaaaaat

SEQ ID NO: 3367030 - DNA, 17 bp, Homo sapiens
cttatgttgaaaaaatt

SEQ ID NO: 3367031 - DNA, 12 bp, Homo sapiens
cttattaattct

SEQ ID NO: 3367032 - DNA, 23 bp, Homo sapiens
cttattaattcttcacctgttat

SEQ ID NO: 3367033 - DNA, 13 bp, Homo sapiens
cttattacaattt

SEQ ID NO: 3367034 - DNA, 15 bp, Homo sapiens
cttattattgaagga

SEQ ID NO: 3367035 - DNA, 16 bp, Homo sapiens
cttattccacagatat

SEQ ID NO: 3367036 - DNA, 20 bp, Homo sapiens
cttattccacagatatcttt

SEQ ID NO: 3367037 - DNA, 14 bp, Homo sapiens
cttattcctctagg

SEQ ID NO: 3367038 - DNA, 12 bp, Homo sapiens
cttattctgtag

SEQ ID NO: 3367039 - DNA, 14 bp, Homo sapiens
cttattctgtagat

SEQ ID NO: 3367040 - DNA, 13 bp, Homo sapiens
cttattcttttat

SEQ ID NO: 3367041 - DNA, 20 bp, Homo sapiens
cttattgaaaaaaaaaatgt

SEQ ID NO: 3367042 - DNA, 22 bp, Homo sapiens
cttattgaaaaaaaaaatgttg

SEQ ID NO: 3367043 - DNA, 16 bp, Homo sapiens
cttattgaccattttt

SEQ ID NO: 3367044 - DNA, 12 bp, Homo sapiens
cttattgcaaaa

SEQ ID NO: 3367045 - DNA, 18 bp, Homo sapiens
cttattgcccacgctgga

SEQ ID NO: 3367046 - DNA, 15 bp, Homo sapiens
cttattggaactctg

SEQ ID NO: 3367047 - DNA, 17 bp, Homo sapiens
cttattggaactctgct

SEQ ID NO: 3367048 - DNA, 17 bp, Homo sapiens
cttattgggatatcatt

SEQ ID NO: 3367049 - DNA, 19 bp, Homo sapiens
cttattgggatatcatttt

SEQ ID NO: 3367050 - DNA, 18 bp, Homo sapiens
cttattgtaaattttaga

SEQ ID NO: 3367051 - DNA, 13 bp, Homo sapiens
cttattgttccaa

SEQ ID NO: 3367052 - DNA, 20 bp, Homo sapiens
cttattgttccaagacattg

SEQ ID NO: 3367053 - DNA, 16 bp, Homo sapiens
cttatttaaaaatatt

SEQ ID NO: 3367054 - DNA, 18 bp, Homo sapiens
cttatttaaaaatatttc

SEQ ID NO: 3367055 - DNA, 19 bp, Homo sapiens
cttatttaaaaatatttca

SEQ ID NO: 3367056 - DNA, 13 bp, Homo sapiens
cttatttagagat

SEQ ID NO: 3367057 - DNA, 19 bp, Homo sapiens
cttatttctgctctggaat

SEQ ID NO: 3367058 - DNA, 14 bp, Homo sapiens
cttattttagaaat

SEQ ID NO: 3367059 - DNA, 18 bp, Homo sapiens
cttattttattatgagct

SEQ ID NO: 3367060 - DNA, 15 bp, Homo sapiens
cttattttatttcca

SEQ ID NO: 3367061 - DNA, 20 bp, Homo sapiens
cttattttatttccatcatg

SEQ ID NO: 3367062 - DNA, 15 bp, Homo sapiens
cttattttcaagaaa

SEQ ID NO: 3367063 - DNA, 15 bp, Homo sapiens
cttattttgtattac

SEQ ID NO: 3367064 - DNA, 16 bp, Homo sapiens
cttattttgtcttatt

SEQ ID NO: 3367065 - DNA, 18 bp, Homo sapiens
cttattttgtcttattct

SEQ ID NO: 3367066 - DNA, 21 bp, Homo sapiens
cttattttgtcttattcttaa

SEQ ID NO: 3367067 - DNA, 16 bp, Homo sapiens
cttatttttagccata

SEQ ID NO: 3367068 - DNA, 18 bp, Homo sapiens
cttatttttagccataat

SEQ ID NO: 3367069 - DNA, 21 bp, Homo sapiens
cttatttttagccataatttt

SEQ ID NO: 3367070 - DNA, 23 bp, Homo sapiens
cttatttttataacatctttatt

SEQ ID NO: 3367071 - DNA, 14 bp, Homo sapiens
cttcaaaaactaaa

SEQ ID NO: 3367072 - DNA, 21 bp, Homo sapiens
cttcaaaaataaaaaatctga

SEQ ID NO: 3367073 - DNA, 15 bp, Homo sapiens
cttcaaaaataatgt

SEQ ID NO: 3367074 - DNA, 20 bp, Homo sapiens
cttcaaaaggaatgaacttg

SEQ ID NO: 3367075 - DNA, 22 bp, Homo sapiens
cttcaaaatgttatcttctcaa

SEQ ID NO: 3367076 - DNA, 22 bp, Homo sapiens
cttcaaacagaactgcagtcag

SEQ ID NO: 3367077 - DNA, 18 bp, Homo sapiens
cttcaaactttcactttg

SEQ ID NO: 3367078 - DNA, 17 bp, Homo sapiens
cttcaaagaaacttgaa

SEQ ID NO: 3367079 - DNA, 15 bp, Homo sapiens
cttcaaagccttctc

SEQ ID NO: 3367080 - DNA, 17 bp, Homo sapiens
cttcaaatacaaagtaa

SEQ ID NO: 3367081 - DNA, 18 bp, Homo sapiens
cttcaaatacaaagtaaa

SEQ ID NO: 3367082 - DNA, 16 bp, Homo sapiens
cttcaaatccttccaa

SEQ ID NO: 3367083 - DNA, 22 bp, Homo sapiens
cttcaacaacgtgagagaaaga

SEQ ID NO: 3367084 - DNA, 23 bp, Homo sapiens
cttcaacataacccacttgtcac

SEQ ID NO: 3367085 - DNA, 23 bp, Homo sapiens
cttcaactgaccagcctccatgc

SEQ ID NO: 3367086 - DNA, 21 bp, Homo sapiens
cttcaagcagaatcctcagtt

SEQ ID NO: 3367087 - DNA, 18 bp, Homo sapiens
cttcaagccagctctagg

SEQ ID NO: 3367088 - DNA, 14 bp, Homo sapiens
cttcaagctgtccc

SEQ ID NO: 3367089 - DNA, 22 bp, Homo sapiens
cttcaaggatatactgcagctt

SEQ ID NO: 3367090 - DNA, 18 bp, Homo sapiens
cttcaagggaagaaacac

SEQ ID NO: 3367091 - DNA, 19 bp, Homo sapiens
cttcaagtgccaaacagag

SEQ ID NO: 3367092 - DNA, 20 bp, Homo sapiens
cttcaagttagctcaggagg

SEQ ID NO: 3367093 - DNA, 20 bp, Homo sapiens
cttcaataaatctttggaaa

SEQ ID NO: 3367094 - DNA, 17 bp, Homo sapiens
cttcaatacttaaaaat

SEQ ID NO: 3367095 - DNA, 13 bp, Homo sapiens
cttcaatcccagc

SEQ ID NO: 3367096 - DNA, 20 bp, Homo sapiens
cttcaatgatcaaattttga

SEQ ID NO: 3367097 - DNA, 18 bp, Homo sapiens
cttcaatgctagaaaatc

SEQ ID NO: 3367098 - DNA, 20 bp, Homo sapiens
cttcaatgctagaaaatcga

SEQ ID NO: 3367099 - DNA, 18 bp, Homo sapiens
cttcaatgggctcttcca

SEQ ID NO: 3367100 - DNA, 19 bp, Homo sapiens
cttcaatgtgtcatttccg

SEQ ID NO: 3367101 - DNA, 18 bp, Homo sapiens
cttcacaccccaggccct

SEQ ID NO: 3367102 - DNA, 16 bp, Homo sapiens
cttcacagctctgtgt

SEQ ID NO: 3367103 - DNA, 21 bp, Homo sapiens
cttcacaggcagtgcatgtga

SEQ ID NO: 3367104 - DNA, 15 bp, Homo sapiens
cttcacagtagagcc

SEQ ID NO: 3367105 - DNA, 20 bp, Homo sapiens
cttcacagtagagccagctt

SEQ ID NO: 3367106 - DNA, 14 bp, Homo sapiens
cttcacagtcccag

SEQ ID NO: 3367107 - DNA, 16 bp, Homo sapiens
cttcacagtcccaggt

SEQ ID NO: 3367108 - DNA, 14 bp, Homo sapiens
cttcacagtgtttc

SEQ ID NO: 3367109 - DNA, 14 bp, Homo sapiens
cttcaccagtctgt

SEQ ID NO: 3367110 - DNA, 19 bp, Homo sapiens
cttcaccagtctgtctact

SEQ ID NO: 3367111 - DNA, 22 bp, Homo sapiens
cttcacccagctaatctgtagg

SEQ ID NO: 3367112 - DNA, 13 bp, Homo sapiens
cttcacccctgca

SEQ ID NO: 3367113 - DNA, 16 bp, Homo sapiens
cttcacctgccaccac

SEQ ID NO: 3367114 - DNA, 16 bp, Homo sapiens
cttcacctgttatgta

SEQ ID NO: 3367115 - DNA, 13 bp, Homo sapiens
cttcacctttgta

SEQ ID NO: 3367116 - DNA, 15 bp, Homo sapiens
cttcacgcccttggc

SEQ ID NO: 3367117 - DNA, 19 bp, Homo sapiens
cttcactccggtgtgcctg

SEQ ID NO: 3367118 - DNA, 19 bp, Homo sapiens
cttcactgcaattttgtgt

SEQ ID NO: 3367119 - DNA, 17 bp, Homo sapiens
cttcactgtataaatag

SEQ ID NO: 3367120 - DNA, 17 bp, Homo sapiens
cttcactgtggccacag

SEQ ID NO: 3367121 - DNA, 14 bp, Homo sapiens
cttcactgttccct

SEQ ID NO: 3367122 - DNA, 23 bp, Homo sapiens
cttcactgttccctctggcttcc

SEQ ID NO: 3367123 - DNA, 18 bp, Homo sapiens
cttcactgttgaaaatta

SEQ ID NO: 3367124 - DNA, 20 bp, Homo sapiens
cttcagaactgcccttgctg

SEQ ID NO: 3367125 - DNA, 23 bp, Homo sapiens
cttcagaactgcccttgctgccc

SEQ ID NO: 3367126 - DNA, 17 bp, Homo sapiens
cttcagaagctattttt

SEQ ID NO: 3367127 - DNA, 19 bp, Homo sapiens
cttcagactttgcttccca

SEQ ID NO: 3367128 - DNA, 19 bp, Homo sapiens
cttcagacttttatcaaaa

SEQ ID NO: 3367129 - DNA, 11 bp, Homo sapiens
cttcagagagc

SEQ ID NO: 3367130 - DNA, 14 bp, Homo sapiens
cttcagagagctgg

SEQ ID NO: 3367131 - DNA, 18 bp, Homo sapiens
cttcagagataggcctgt

SEQ ID NO: 3367132 - DNA, 13 bp, Homo sapiens
cttcagagctctt

SEQ ID NO: 3367133 - DNA, 10 bp, Homo sapiens
cttcagaggc

SEQ ID NO: 3367134 - DNA, 15 bp, Homo sapiens
cttcagagtttgtgt

SEQ ID NO: 3367135 - DNA, 17 bp, Homo sapiens
cttcagagtttgtgtgt

SEQ ID NO: 3367136 - DNA, 18 bp, Homo sapiens
cttcagagtttgtgtgta

SEQ ID NO: 3367137 - DNA, 18 bp, Homo sapiens
cttcagatattattgctt

SEQ ID NO: 3367138 - DNA, 16 bp, Homo sapiens
cttcagatctgaggtt

SEQ ID NO: 3367139 - DNA, 21 bp, Homo sapiens
cttcagatgggaggaaagaga

SEQ ID NO: 3367140 - DNA, 16 bp, Homo sapiens
cttcagcattccctcc

SEQ ID NO: 3367141 - DNA, 18 bp, Homo sapiens
cttcagcattccctccca

SEQ ID NO: 3367142 - DNA, 21 bp, Homo sapiens
cttcagcattccctcccatca

SEQ ID NO: 3367143 - DNA, 14 bp, Homo sapiens
cttcagcccccagc

SEQ ID NO: 3367144 - DNA, 15 bp, Homo sapiens
cttcagcccccagcc

SEQ ID NO: 3367145 - DNA, 18 bp, Homo sapiens
cttcagcccccagcccct

SEQ ID NO: 3367146 - DNA, 18 bp, Homo sapiens
cttcagccccttctcccc

SEQ ID NO: 3367147 - DNA, 22 bp, Homo sapiens
cttcagcctgaggctgagactg

SEQ ID NO: 3367148 - DNA, 13 bp, Homo sapiens
cttcagctccagg

SEQ ID NO: 3367149 - DNA, 14 bp, Homo sapiens
cttcagctgcctga

SEQ ID NO: 3367150 - DNA, 15 bp, Homo sapiens
cttcagctgcctgaa

SEQ ID NO: 3367151 - DNA, 17 bp, Homo sapiens
cttcaggaacaagtaat

SEQ ID NO: 3367152 - DNA, 17 bp, Homo sapiens
cttcaggaactggggct

SEQ ID NO: 3367153 - DNA, 12 bp, Homo sapiens
cttcaggcctcc

SEQ ID NO: 3367154 - DNA, 22 bp, Homo sapiens
cttcaggctcttctcctttcac

SEQ ID NO: 3367155 - DNA, 16 bp, Homo sapiens
cttcaggcttctgtca

SEQ ID NO: 3367156 - DNA, 17 bp, Homo sapiens
cttcagggcagggctct

SEQ ID NO: 3367157 - DNA, 14 bp, Homo sapiens
cttcagggccagaa

SEQ ID NO: 3367158 - DNA, 18 bp, Homo sapiens
cttcagggccagaaggag

SEQ ID NO: 3367159 - DNA, 17 bp, Homo sapiens
cttcaggggatgggtgt

SEQ ID NO: 3367160 - DNA, 19 bp, Homo sapiens
cttcaggggatgggtgtgg

SEQ ID NO: 3367161 - DNA, 22 bp, Homo sapiens
cttcaggtaaagggcaaataat

SEQ ID NO: 3367162 - DNA, 20 bp, Homo sapiens
cttcaggtggatgaggagac

SEQ ID NO: 3367163 - DNA, 12 bp, Homo sapiens
cttcaggttctc

SEQ ID NO: 3367164 - DNA, 15 bp, Homo sapiens
cttcaggttcttagt

SEQ ID NO: 3367165 - DNA, 19 bp, Homo sapiens
cttcaggttcttagtgtca

SEQ ID NO: 3367166 - DNA, 22 bp, Homo sapiens
cttcagtaccctctcagctcca

SEQ ID NO: 3367167 - DNA, 23 bp, Homo sapiens
cttcagtaccctctcagctccag

SEQ ID NO: 3367168 - DNA, 18 bp, Homo sapiens
cttcagtcatcagccagc

SEQ ID NO: 3367169 - DNA, 12 bp, Homo sapiens
cttcagtcctgc

SEQ ID NO: 3367170 - DNA, 18 bp, Homo sapiens
cttcagtcctgctccaga

SEQ ID NO: 3367171 - DNA, 17 bp, Homo sapiens
cttcagtcttaatactt

SEQ ID NO: 3367172 - DNA, 15 bp, Homo sapiens
cttcagtgactcctg

SEQ ID NO: 3367173 - DNA, 18 bp, Homo sapiens
cttcagtgactcctgctg

SEQ ID NO: 3367174 - DNA, 22 bp, Homo sapiens
cttcagtgcaaattgtatctta

SEQ ID NO: 3367175 - DNA, 14 bp, Homo sapiens
cttcagtggcagct

SEQ ID NO: 3367176 - DNA, 17 bp, Homo sapiens
cttcagtggcagctgct

SEQ ID NO: 3367177 - DNA, 20 bp, Homo sapiens
cttcagttggtgtgtttttg

SEQ ID NO: 3367178 - DNA, 23 bp, Homo sapiens
cttcagtttaatgtctcctttgc

SEQ ID NO: 3367179 - DNA, 15 bp, Homo sapiens
cttcataacaatttt

SEQ ID NO: 3367180 - DNA, 12 bp, Homo sapiens
cttcataatcca

SEQ ID NO: 3367181 - DNA, 14 bp, Homo sapiens
cttcatagctcctt

SEQ ID NO: 3367182 - DNA, 19 bp, Homo sapiens
cttcatcattccctctcat

SEQ ID NO: 3367183 - DNA, 19 bp, Homo sapiens
cttcatccaacttccaaga

SEQ ID NO: 3367184 - DNA, 13 bp, Homo sapiens
cttcatccctttc

SEQ ID NO: 3367185 - DNA, 16 bp, Homo sapiens
cttcatccctttccag

SEQ ID NO: 3367186 - DNA, 13 bp, Homo sapiens
cttcatctggcaa

SEQ ID NO: 3367187 - DNA, 23 bp, Homo sapiens
cttcatctggcaacatctttatc

SEQ ID NO: 3367188 - DNA, 16 bp, Homo sapiens
cttcatgacagcctcc

SEQ ID NO: 3367189 - DNA, 22 bp, Homo sapiens
cttcatgcaatgacatcttcaa

SEQ ID NO: 3367190 - DNA, 17 bp, Homo sapiens
cttcatgcctttgtaag

SEQ ID NO: 3367191 - DNA, 19 bp, Homo sapiens
cttcatgcctttgtaagtt

SEQ ID NO: 3367192 - DNA, 12 bp, Homo sapiens
cttcatgctttt

SEQ ID NO: 3367193 - DNA, 20 bp, Homo sapiens
cttcatggaatggacatcct

SEQ ID NO: 3367194 - DNA, 13 bp, Homo sapiens
cttcatgtgaaca

SEQ ID NO: 3367195 - DNA, 16 bp, Homo sapiens
cttcattatctgagtt

SEQ ID NO: 3367196 - DNA, 21 bp, Homo sapiens
cttcattcaaactgcactttt

SEQ ID NO: 3367197 - DNA, 14 bp, Homo sapiens
cttcattccattga

SEQ ID NO: 3367198 - DNA, 22 bp, Homo sapiens
cttcattctccttgttgttggt

SEQ ID NO: 3367199 - DNA, 14 bp, Homo sapiens
cttcattgagagtt

SEQ ID NO: 3367200 - DNA, 23 bp, Homo sapiens
cttcattgtactacctgtgtata

SEQ ID NO: 3367201 - DNA, 16 bp, Homo sapiens
cttcattgtccctctt

SEQ ID NO: 3367202 - DNA, 19 bp, Homo sapiens
cttcattgtccctcttcac

SEQ ID NO: 3367203 - DNA, 15 bp, Homo sapiens
cttcatttcaatcat

SEQ ID NO: 3367204 - DNA, 17 bp, Homo sapiens
cttcatttcaatcattg

SEQ ID NO: 3367205 - DNA, 18 bp, Homo sapiens
cttcatttcaatcattga

SEQ ID NO: 3367206 - DNA, 18 bp, Homo sapiens
cttcatttcattgtatga

SEQ ID NO: 3367207 - DNA, 11 bp, Homo sapiens
cttcatttgtg

SEQ ID NO: 3367208 - DNA, 13 bp, Homo sapiens
cttcatttgtgtc

SEQ ID NO: 3367209 - DNA, 14 bp, Homo sapiens
cttcatttgtgtca

SEQ ID NO: 3367210 - DNA, 18 bp, Homo sapiens
cttcattttgaggggagg

SEQ ID NO: 3367211 - DNA, 19 bp, Homo sapiens
cttcattttggtttatttt

SEQ ID NO: 3367212 - DNA, 23 bp, Homo sapiens
cttcattttggtttatttttgta

SEQ ID NO: 3367213 - DNA, 19 bp, Homo sapiens
cttccaaaaattattataa

SEQ ID NO: 3367214 - DNA, 15 bp, Homo sapiens
cttccaaaattctta

SEQ ID NO: 3367215 - DNA, 17 bp, Homo sapiens
cttccaaaattcttatt

SEQ ID NO: 3367216 - DNA, 12 bp, Homo sapiens
cttccaaagaaa

SEQ ID NO: 3367217 - DNA, 13 bp, Homo sapiens
cttccaaagcaca

SEQ ID NO: 3367218 - DNA, 19 bp, Homo sapiens
cttccaaatgcaatttgat

SEQ ID NO: 3367219 - DNA, 12 bp, Homo sapiens
cttccaaggaga

SEQ ID NO: 3367220 - DNA, 15 bp, Homo sapiens
cttccaaggagacca

SEQ ID NO: 3367221 - DNA, 16 bp, Homo sapiens
cttccaattaatgctt

SEQ ID NO: 3367222 - DNA, 18 bp, Homo sapiens
cttccacaagagtgaatt

SEQ ID NO: 3367223 - DNA, 13 bp, Homo sapiens
cttccacagcagc

SEQ ID NO: 3367224 - DNA, 17 bp, Homo sapiens
cttccacagcagcagaa

SEQ ID NO: 3367225 - DNA, 12 bp, Homo sapiens
cttccacatttt

SEQ ID NO: 3367226 - DNA, 22 bp, Homo sapiens
cttccacccattcccccatgtg

SEQ ID NO: 3367227 - DNA, 15 bp, Homo sapiens
cttccacctcctaga

SEQ ID NO: 3367228 - DNA, 16 bp, Homo sapiens
cttccacctcctagag

SEQ ID NO: 3367229 - DNA, 15 bp, Homo sapiens
cttccacctgtgccc

SEQ ID NO: 3367230 - DNA, 17 bp, Homo sapiens
cttccactgcctctgcc

SEQ ID NO: 3367231 - DNA, 12 bp, Homo sapiens
cttccagacata

SEQ ID NO: 3367232 - DNA, 21 bp, Homo sapiens
cttccagacctgcttcctgaa

SEQ ID NO: 3367233 - DNA, 13 bp, Homo sapiens
cttccagatcact

SEQ ID NO: 3367234 - DNA, 20 bp, Homo sapiens
cttccagatcactgccacac

SEQ ID NO: 3367235 - DNA, 12 bp, Homo sapiens
cttccagatcct

SEQ ID NO: 3367236 - DNA, 14 bp, Homo sapiens
cttccagcttcagg

SEQ ID NO: 3367237 - DNA, 15 bp, Homo sapiens
cttccagcttcaggc

SEQ ID NO: 3367238 - DNA, 13 bp, Homo sapiens
cttccaggaaact

SEQ ID NO: 3367239 - DNA, 19 bp, Homo sapiens
cttccaggaaactccacat

SEQ ID NO: 3367240 - DNA, 23 bp, Homo sapiens
cttccaggaaactccacatctgc

SEQ ID NO: 3367241 - DNA, 15 bp, Homo sapiens
cttccaggacccctg

SEQ ID NO: 3367242 - DNA, 16 bp, Homo sapiens
cttccaggaggacata

SEQ ID NO: 3367243 - DNA, 19 bp, Homo sapiens
cttccaggcccccaccact

SEQ ID NO: 3367244 - DNA, 12 bp, Homo sapiens
cttccaggctct

SEQ ID NO: 3367245 - DNA, 14 bp, Homo sapiens
cttccaggctcttc

SEQ ID NO: 3367246 - DNA, 21 bp, Homo sapiens
cttccaggctcttcctggacc

SEQ ID NO: 3367247 - DNA, 22 bp, Homo sapiens
cttccaggctcttcctggacct

SEQ ID NO: 3367248 - DNA, 16 bp, Homo sapiens
cttccaggtgttactg

SEQ ID NO: 3367249 - DNA, 19 bp, Homo sapiens
cttccaggtgttactgtaa

SEQ ID NO: 3367250 - DNA, 22 bp, Homo sapiens
cttccaggtgttactgtaattc

SEQ ID NO: 3367251 - DNA, 20 bp, Homo sapiens
cttccagtcttcctgacact

SEQ ID NO: 3367252 - DNA, 22 bp, Homo sapiens
cttccagtggctcgctccctgt

SEQ ID NO: 3367253 - DNA, 21 bp, Homo sapiens
cttccataatctggactcctc

SEQ ID NO: 3367254 - DNA, 23 bp, Homo sapiens
cttccataatgtataaagaacaa

SEQ ID NO: 3367255 - DNA, 14 bp, Homo sapiens
cttccatacagctc

SEQ ID NO: 3367256 - DNA, 23 bp, Homo sapiens
cttccataggacatactgcatgt

SEQ ID NO: 3367257 - DNA, 15 bp, Homo sapiens
cttccatatttggaa

SEQ ID NO: 3367258 - DNA, 19 bp, Homo sapiens
cttccatatttggaagaaa

SEQ ID NO: 3367259 - DNA, 12 bp, Homo sapiens
cttccatcccta

SEQ ID NO: 3367260 - DNA, 14 bp, Homo sapiens
cttccatccctacc

SEQ ID NO: 3367261 - DNA, 14 bp, Homo sapiens
cttccatgattcta

SEQ ID NO: 3367262 - DNA, 20 bp, Homo sapiens
cttccatgccgtcctgcagt

SEQ ID NO: 3367263 - DNA, 14 bp, Homo sapiens
cttccatgcctgta

SEQ ID NO: 3367264 - DNA, 17 bp, Homo sapiens
cttccatgcctgtagct

SEQ ID NO: 3367265 - DNA, 19 bp, Homo sapiens
cttccatgtatcttttgaa

SEQ ID NO: 3367266 - DNA, 16 bp, Homo sapiens
cttccatgtcgcctct

SEQ ID NO: 3367267 - DNA, 18 bp, Homo sapiens
cttccatgtcgcctctgc

SEQ ID NO: 3367268 - DNA, 19 bp, Homo sapiens
cttccatgtcgcctctgca

SEQ ID NO: 3367269 - DNA, 19 bp, Homo sapiens
cttcccaacagccttagct

SEQ ID NO: 3367270 - DNA, 18 bp, Homo sapiens
cttcccaaggccttaagc

SEQ ID NO: 3367271 - DNA, 20 bp, Homo sapiens
cttcccacacgattagcttt

SEQ ID NO: 3367272 - DNA, 17 bp, Homo sapiens
cttcccacctccctgcc

SEQ ID NO: 3367273 - DNA, 17 bp, Homo sapiens
cttcccagaggcagagc

SEQ ID NO: 3367274 - DNA, 19 bp, Homo sapiens
cttcccagagggagcaggc

SEQ ID NO: 3367275 - DNA, 21 bp, Homo sapiens
cttcccagccatgcccaggac

SEQ ID NO: 3367276 - DNA, 16 bp, Homo sapiens
cttcccagctaggaag

SEQ ID NO: 3367277 - DNA, 15 bp, Homo sapiens
cttcccagctctgac

SEQ ID NO: 3367278 - DNA, 22 bp, Homo sapiens
cttcccatagtggggcctggga

SEQ ID NO: 3367279 - DNA, 23 bp, Homo sapiens
cttcccatagtggggcctgggag

SEQ ID NO: 3367280 - DNA, 15 bp, Homo sapiens
cttcccatcctaccc

SEQ ID NO: 3367281 - DNA, 16 bp, Homo sapiens
cttcccatgactgcac

SEQ ID NO: 3367282 - DNA, 14 bp, Homo sapiens
cttcccatgcctgt

SEQ ID NO: 3367283 - DNA, 18 bp, Homo sapiens
cttcccattgtggctcct

SEQ ID NO: 3367284 - DNA, 16 bp, Homo sapiens
cttccccaaataatat

SEQ ID NO: 3367285 - DNA, 16 bp, Homo sapiens
cttccccaacttccct

SEQ ID NO: 3367286 - DNA, 19 bp, Homo sapiens
cttccccagaaaggagact

SEQ ID NO: 3367287 - DNA, 12 bp, Homo sapiens
cttccccaggat

SEQ ID NO: 3367288 - DNA, 12 bp, Homo sapiens
cttccccaggcc

SEQ ID NO: 3367289 - DNA, 19 bp, Homo sapiens
cttccccaggcccaccatc

SEQ ID NO: 3367290 - DNA, 23 bp, Homo sapiens
cttcccccaccggtccagctggc

SEQ ID NO: 3367291 - DNA, 16 bp, Homo sapiens
cttcccccatagccac

SEQ ID NO: 3367292 - DNA, 16 bp, Homo sapiens
cttccccctcccaggg

SEQ ID NO: 3367293 - DNA, 18 bp, Homo sapiens
cttcccccttcctttggt

SEQ ID NO: 3367294 - DNA, 16 bp, Homo sapiens
cttcccctccaagacc

SEQ ID NO: 3367295 - DNA, 14 bp, Homo sapiens
cttcccctcccctc

SEQ ID NO: 3367296 - DNA, 22 bp, Homo sapiens
cttcccctcccctccttgtcta

SEQ ID NO: 3367297 - DNA, 13 bp, Homo sapiens
cttccccttctgt

SEQ ID NO: 3367298 - DNA, 19 bp, Homo sapiens
cttccccttttgcctggct

SEQ ID NO: 3367299 - DNA, 20 bp, Homo sapiens
cttccccttttgcctggctg

SEQ ID NO: 3367300 - DNA, 19 bp, Homo sapiens
cttcccgccagagggcttg

SEQ ID NO: 3367301 - DNA, 19 bp, Homo sapiens
cttcccgcctccctctcag

SEQ ID NO: 3367302 - DNA, 15 bp, Homo sapiens
cttcccgctcagccc

SEQ ID NO: 3367303 - DNA, 16 bp, Homo sapiens
cttccctacctcaggc

SEQ ID NO: 3367304 - DNA, 17 bp, Homo sapiens
cttccctacctcaggca

SEQ ID NO: 3367305 - DNA, 20 bp, Homo sapiens
cttccctacctcaggcagga

SEQ ID NO: 3367306 - DNA, 21 bp, Homo sapiens
cttccctagctttagaccctg

SEQ ID NO: 3367307 - DNA, 23 bp, Homo sapiens
cttccctagctttagaccctggg

SEQ ID NO: 3367308 - DNA, 17 bp, Homo sapiens
cttccctgacttgcttt

SEQ ID NO: 3367309 - DNA, 18 bp, Homo sapiens
cttccctgattgacctgc

SEQ ID NO: 3367310 - DNA, 20 bp, Homo sapiens
cttccctgattgacctgctc

SEQ ID NO: 3367311 - DNA, 22 bp, Homo sapiens
cttccctgattgacctgctccg

SEQ ID NO: 3367312 - DNA, 13 bp, Homo sapiens
cttccctgcacta

SEQ ID NO: 3367313 - DNA, 22 bp, Homo sapiens
cttccctgcagggcgcccctgg

SEQ ID NO: 3367314 - DNA, 13 bp, Homo sapiens
cttccctgggaag

SEQ ID NO: 3367315 - DNA, 15 bp, Homo sapiens
cttccctgggaaggc

SEQ ID NO: 3367316 - DNA, 12 bp, Homo sapiens
cttccctgtccc

SEQ ID NO: 3367317 - DNA, 13 bp, Homo sapiens
cttccctgtccct

SEQ ID NO: 3367318 - DNA, 15 bp, Homo sapiens
cttccctgtccctct

SEQ ID NO: 3367319 - DNA, 15 bp, Homo sapiens
cttcccttccactgc

SEQ ID NO: 3367320 - DNA, 13 bp, Homo sapiens
cttccgacatccc

SEQ ID NO: 3367321 - DNA, 18 bp, Homo sapiens
cttccgaccctctgggaa

SEQ ID NO: 3367322 - DNA, 21 bp, Homo sapiens
cttccgaccctctgggaacct

SEQ ID NO: 3367323 - DNA, 22 bp, Homo sapiens
cttccgatggatgaatctccca

SEQ ID NO: 3367324 - DNA, 19 bp, Homo sapiens
cttccgccccttcccttcc

SEQ ID NO: 3367325 - DNA, 16 bp, Homo sapiens
cttccgctgaggggtc

SEQ ID NO: 3367326 - DNA, 19 bp, Homo sapiens
cttccggtagggaggcagc

SEQ ID NO: 3367327 - DNA, 23 bp, Homo sapiens
cttccggtagggaggcagcctcc

SEQ ID NO: 3367328 - DNA, 12 bp, Homo sapiens
cttcctaaatat

SEQ ID NO: 3367329 - DNA, 22 bp, Homo sapiens
cttcctaatttcccttcttgca

SEQ ID NO: 3367330 - DNA, 21 bp, Homo sapiens
cttcctacaagagcagcctgt

SEQ ID NO: 3367331 - DNA, 19 bp, Homo sapiens
cttcctaccaagtcaaact

SEQ ID NO: 3367332 - DNA, 18 bp, Homo sapiens
cttcctaccctccttcca

SEQ ID NO: 3367333 - DNA, 15 bp, Homo sapiens
cttcctacctatccc

SEQ ID NO: 3367334 - DNA, 17 bp, Homo sapiens
cttcctaggtccaagcc

SEQ ID NO: 3367335 - DNA, 15 bp, Homo sapiens
cttcctagttttctc

SEQ ID NO: 3367336 - DNA, 22 bp, Homo sapiens
cttcctagttttctcctcccag

SEQ ID NO: 3367337 - DNA, 14 bp, Homo sapiens
cttcctataacttg

SEQ ID NO: 3367338 - DNA, 15 bp, Homo sapiens
cttcctataacttga

SEQ ID NO: 3367339 - DNA, 18 bp, Homo sapiens
cttcctatgcccaggtac

SEQ ID NO: 3367340 - DNA, 16 bp, Homo sapiens
cttcctcactgcccaa

SEQ ID NO: 3367341 - DNA, 15 bp, Homo sapiens
cttcctccagctgca

SEQ ID NO: 3367342 - DNA, 17 bp, Homo sapiens
cttcctccagctgcacc

SEQ ID NO: 3367343 - DNA, 20 bp, Homo sapiens
cttcctccagctgcaccaga

SEQ ID NO: 3367344 - DNA, 22 bp, Homo sapiens
cttcctccagctgcaccagagc

SEQ ID NO: 3367345 - DNA, 19 bp, Homo sapiens
cttcctccctgtctctgca

SEQ ID NO: 3367346 - DNA, 22 bp, Homo sapiens
cttcctccgtccacccaggctg

SEQ ID NO: 3367347 - DNA, 23 bp, Homo sapiens
cttcctccgtccacccaggctgc

SEQ ID NO: 3367348 - DNA, 13 bp, Homo sapiens
cttcctcctccac

SEQ ID NO: 3367349 - DNA, 17 bp, Homo sapiens
cttcctcctccccactt

SEQ ID NO: 3367350 - DNA, 10 bp, Homo sapiens
cttcctcctg

SEQ ID NO: 3367351 - DNA, 21 bp, Homo sapiens
cttcctcctgatggccaagag

SEQ ID NO: 3367352 - DNA, 15 bp, Homo sapiens
cttcctctcactcct

SEQ ID NO: 3367353 - DNA, 18 bp, Homo sapiens
cttcctctcactcctgcc

SEQ ID NO: 3367354 - DNA, 19 bp, Homo sapiens
cttcctctcactcctgcct

SEQ ID NO: 3367355 - DNA, 13 bp, Homo sapiens
cttcctctccact

SEQ ID NO: 3367356 - DNA, 14 bp, Homo sapiens
cttcctctccactg

SEQ ID NO: 3367357 - DNA, 14 bp, Homo sapiens
cttcctctggggct

SEQ ID NO: 3367358 - DNA, 15 bp, Homo sapiens
cttcctctggggctc

SEQ ID NO: 3367359 - DNA, 12 bp, Homo sapiens
cttcctgaaata

SEQ ID NO: 3367360 - DNA, 17 bp, Homo sapiens
cttcctgaaataaacac

SEQ ID NO: 3367361 - DNA, 20 bp, Homo sapiens
cttcctgaaataaacactgg

SEQ ID NO: 3367362 - DNA, 21 bp, Homo sapiens
cttcctgaaataaacactggt

SEQ ID NO: 3367363 - DNA, 15 bp, Homo sapiens
cttcctgacacttta

SEQ ID NO: 3367364 - DNA, 17 bp, Homo sapiens
cttcctgacactttaat

SEQ ID NO: 3367365 - DNA, 19 bp, Homo sapiens
cttcctgccctacagaggt

SEQ ID NO: 3367366 - DNA, 18 bp, Homo sapiens
cttcctgcgtcctcctca

SEQ ID NO: 3367367 - DNA, 21 bp, Homo sapiens
cttcctgcgtcctcctcacct

SEQ ID NO: 3367368 - DNA, 18 bp, Homo sapiens
cttcctgctccttttgta

SEQ ID NO: 3367369 - DNA, 15 bp, Homo sapiens
cttcctgctgctgta

SEQ ID NO: 3367370 - DNA, 22 bp, Homo sapiens
cttcctgctgctgtaactgctg

SEQ ID NO: 3367371 - DNA, 13 bp, Homo sapiens
cttcctgctggac

SEQ ID NO: 3367372 - DNA, 19 bp, Homo sapiens
cttcctggaaacagcatga

SEQ ID NO: 3367373 - DNA, 19 bp, Homo sapiens
cttcctgggaggacaggca

SEQ ID NO: 3367374 - DNA, 22 bp, Homo sapiens
cttcctgggaggacaggcaggc

SEQ ID NO: 3367375 - DNA, 21 bp, Homo sapiens
cttcctgggcagcctttccag

SEQ ID NO: 3367376 - DNA, 22 bp, Homo sapiens
cttcctggggccccgctgggat

SEQ ID NO: 3367377 - DNA, 10 bp, Homo sapiens
cttcctgggt

SEQ ID NO: 3367378 - DNA, 23 bp, Homo sapiens
cttcctgggtcaagtgctaacct

SEQ ID NO: 3367379 - DNA, 19 bp, Homo sapiens
cttcctggttttgtacact

SEQ ID NO: 3367380 - DNA, 20 bp, Homo sapiens
cttcctggttttgtacactg

SEQ ID NO: 3367381 - DNA, 21 bp, Homo sapiens
cttcctggttttgtacactgc

SEQ ID NO: 3367382 - DNA, 22 bp, Homo sapiens
cttcctggttttgtacactgct

SEQ ID NO: 3367383 - DNA, 16 bp, Homo sapiens
cttcctgtccactctc

SEQ ID NO: 3367384 - DNA, 13 bp, Homo sapiens
cttcctgtgactt

SEQ ID NO: 3367385 - DNA, 16 bp, Homo sapiens
cttcctgtgatccacc

SEQ ID NO: 3367386 - DNA, 20 bp, Homo sapiens
cttcctgtgccgtaaggatt

SEQ ID NO: 3367387 - DNA, 15 bp, Homo sapiens
cttcctgtgggagca

SEQ ID NO: 3367388 - DNA, 23 bp, Homo sapiens
cttcctgtgtgtccaaaactgcc

SEQ ID NO: 3367389 - DNA, 16 bp, Homo sapiens
cttcctgtttttcaca

SEQ ID NO: 3367390 - DNA, 14 bp, Homo sapiens
cttccttcagggtt

SEQ ID NO: 3367391 - DNA, 13 bp, Homo sapiens
cttccttcctgtt

SEQ ID NO: 3367392 - DNA, 20 bp, Homo sapiens
cttccttcggtcttttgtat

SEQ ID NO: 3367393 - DNA, 13 bp, Homo sapiens
cttccttctggga

SEQ ID NO: 3367394 - DNA, 21 bp, Homo sapiens
cttccttgaagaactgcaggc

SEQ ID NO: 3367395 - DNA, 18 bp, Homo sapiens
cttccttgaccttcctct

SEQ ID NO: 3367396 - DNA, 16 bp, Homo sapiens
cttcctttaaaaaact

SEQ ID NO: 3367397 - DNA, 17 bp, Homo sapiens
cttcctttctccaggac

SEQ ID NO: 3367398 - DNA, 16 bp, Homo sapiens
cttcctttggtgcctc

SEQ ID NO: 3367399 - DNA, 18 bp, Homo sapiens
cttcctttgtgtttatat

SEQ ID NO: 3367400 - DNA, 22 bp, Homo sapiens
cttccttttccctgcttccagg

SEQ ID NO: 3367401 - DNA, 14 bp, Homo sapiens
cttcgagccaactc

SEQ ID NO: 3367402 - DNA, 16 bp, Homo sapiens
cttcgatacaccgggc

SEQ ID NO: 3367403 - DNA, 17 bp, Homo sapiens
cttcgcaaactgatgga

SEQ ID NO: 3367404 - DNA, 16 bp, Homo sapiens
cttcgcaggcatgtcc

SEQ ID NO: 3367405 - DNA, 13 bp, Homo sapiens
cttcgctcctgtg

SEQ ID NO: 3367406 - DNA, 14 bp, Homo sapiens
cttcgctcctgtgt

SEQ ID NO: 3367407 - DNA, 15 bp, Homo sapiens
cttcgctcctgtgtc

SEQ ID NO: 3367408 - DNA, 13 bp, Homo sapiens
cttcgctgctcta

SEQ ID NO: 3367409 - DNA, 15 bp, Homo sapiens
cttcgctggctccta

SEQ ID NO: 3367410 - DNA, 15 bp, Homo sapiens
cttcgcttcttgcct

SEQ ID NO: 3367411 - DNA, 17 bp, Homo sapiens
cttcgcttcttgcctct

SEQ ID NO: 3367412 - DNA, 18 bp, Homo sapiens
cttcgcttcttgcctctg

SEQ ID NO: 3367413 - DNA, 20 bp, Homo sapiens
cttcgcttcttgcctctgtg

SEQ ID NO: 3367414 - DNA, 16 bp, Homo sapiens
cttcgcttggagaccc

SEQ ID NO: 3367415 - DNA, 22 bp, Homo sapiens
cttcggagatgaggagtaaaat

SEQ ID NO: 3367416 - DNA, 18 bp, Homo sapiens
cttcggcctccatcctga

SEQ ID NO: 3367417 - DNA, 20 bp, Homo sapiens
cttcggcctccatcctgagg

SEQ ID NO: 3367418 - DNA, 15 bp, Homo sapiens
cttcgggctgtgccc

SEQ ID NO: 3367419 - DNA, 16 bp, Homo sapiens
cttcgggctgtgcccg

SEQ ID NO: 3367420 - DNA, 16 bp, Homo sapiens
cttcggggaagataca

SEQ ID NO: 3367421 - DNA, 16 bp, Homo sapiens
cttcggggcctgtctg

SEQ ID NO: 3367422 - DNA, 22 bp, Homo sapiens
cttcggggcctgtctgaagcca

SEQ ID NO: 3367423 - DNA, 13 bp, Homo sapiens
cttcggtcacctg

SEQ ID NO: 3367424 - DNA, 22 bp, Homo sapiens
cttcgtctttcccatggggagg

SEQ ID NO: 3367425 - DNA, 22 bp, Homo sapiens
cttcgtgtctctcccaccccgg

SEQ ID NO: 3367426 - DNA, 13 bp, Homo sapiens
cttcgttttggtt

SEQ ID NO: 3367427 - DNA, 22 bp, Homo sapiens
cttctaaacttccccatcttct

SEQ ID NO: 3367428 - DNA, 18 bp, Homo sapiens
cttctaatatatttttat

SEQ ID NO: 3367429 - DNA, 13 bp, Homo sapiens
cttctaattattt

SEQ ID NO: 3367430 - DNA, 19 bp, Homo sapiens
cttctacctgccctcaagg

SEQ ID NO: 3367431 - DNA, 17 bp, Homo sapiens
cttctaccttaaaatgt

SEQ ID NO: 3367432 - DNA, 18 bp, Homo sapiens
cttctagaacctgggctg

SEQ ID NO: 3367433 - DNA, 19 bp, Homo sapiens
cttctagaagataacattt

SEQ ID NO: 3367434 - DNA, 15 bp, Homo sapiens
cttctatattttaat

SEQ ID NO: 3367435 - DNA, 13 bp, Homo sapiens
cttctattctagc

SEQ ID NO: 3367436 - DNA, 14 bp, Homo sapiens
cttctattggtctc

SEQ ID NO: 3367437 - DNA, 20 bp, Homo sapiens
cttctatttatggatatcac

SEQ ID NO: 3367438 - DNA, 14 bp, Homo sapiens
cttctattttgtaa

SEQ ID NO: 3367439 - DNA, 16 bp, Homo sapiens
cttctattttgtaaac

SEQ ID NO: 3367440 - DNA, 17 bp, Homo sapiens
cttctattttgtaaact

SEQ ID NO: 3367441 - DNA, 20 bp, Homo sapiens
cttctatttttatcatgaat

SEQ ID NO: 3367442 - DNA, 12 bp, Homo sapiens
cttctcaagtgc

SEQ ID NO: 3367443 - DNA, 15 bp, Homo sapiens
cttctcaagtgcctt

SEQ ID NO: 3367444 - DNA, 17 bp, Homo sapiens
cttctcaagtgccttaa

SEQ ID NO: 3367445 - DNA, 14 bp, Homo sapiens
cttctcaagttcta

SEQ ID NO: 3367446 - DNA, 15 bp, Homo sapiens
cttctcaagttctaa

SEQ ID NO: 3367447 - DNA, 18 bp, Homo sapiens
cttctcaagttctaagat

SEQ ID NO: 3367448 - DNA, 15 bp, Homo sapiens
cttctcacagcacat

SEQ ID NO: 3367449 - DNA, 23 bp, Homo sapiens
cttctcacagcacatgctggcca

SEQ ID NO: 3367450 - DNA, 19 bp, Homo sapiens
cttctcaccgtgcagagct

SEQ ID NO: 3367451 - DNA, 16 bp, Homo sapiens
cttctcacctgctcca

SEQ ID NO: 3367452 - DNA, 17 bp, Homo sapiens
cttctcagctcttccat

SEQ ID NO: 3367453 - DNA, 15 bp, Homo sapiens
cttctcatagcatta

SEQ ID NO: 3367454 - DNA, 19 bp, Homo sapiens
cttctccaattctgcccaa

SEQ ID NO: 3367455 - DNA, 15 bp, Homo sapiens
cttctccaccctgct

SEQ ID NO: 3367456 - DNA, 17 bp, Homo sapiens
cttctccaccctgctct

SEQ ID NO: 3367457 - DNA, 15 bp, Homo sapiens
cttctccactggatg

SEQ ID NO: 3367458 - DNA, 12 bp, Homo sapiens
cttctccagcct

SEQ ID NO: 3367459 - DNA, 17 bp, Homo sapiens
cttctccaggctgtatc

SEQ ID NO: 3367460 - DNA, 17 bp, Homo sapiens
cttctcccacatgaggc

SEQ ID NO: 3367461 - DNA, 19 bp, Homo sapiens
cttctccccacagcctctg

SEQ ID NO: 3367462 - DNA, 14 bp, Homo sapiens
cttctccccagaat

SEQ ID NO: 3367463 - DNA, 14 bp, Homo sapiens
cttctcccctcccc

SEQ ID NO: 3367464 - DNA, 19 bp, Homo sapiens
cttctccctagctcctccc

SEQ ID NO: 3367465 - DNA, 13 bp, Homo sapiens
cttctccgccagc

SEQ ID NO: 3367466 - DNA, 24 bp, Homo sapiens
cttctccgccagcctcctctggac

SEQ ID NO: 3367467 - DNA, 15 bp, Homo sapiens
cttctcctctctggg

SEQ ID NO: 3367468 - DNA, 17 bp, Homo sapiens
cttctcctctctgggcc

SEQ ID NO: 3367469 - DNA, 15 bp, Homo sapiens
cttctcctgttttat

SEQ ID NO: 3367470 - DNA, 19 bp, Homo sapiens
cttctcctgttttatatat

SEQ ID NO: 3367471 - DNA, 23 bp, Homo sapiens
cttctcctgttttatatattatg

SEQ ID NO: 3367472 - DNA, 14 bp, Homo sapiens
cttctcctttcaca

SEQ ID NO: 3367473 - DNA, 14 bp, Homo sapiens
cttctcggctcagg

SEQ ID NO: 3367474 - DNA, 15 bp, Homo sapiens
cttctctagctggtg

SEQ ID NO: 3367475 - DNA, 18 bp, Homo sapiens
cttctctccagctgacta

SEQ ID NO: 3367476 - DNA, 13 bp, Homo sapiens
cttctctgaacac

SEQ ID NO: 3367477 - DNA, 15 bp, Homo sapiens
cttctctgaacacag

SEQ ID NO: 3367478 - DNA, 22 bp, Homo sapiens
cttctctgaacacaggcagctt

SEQ ID NO: 3367479 - DNA, 14 bp, Homo sapiens
cttctctgacttct

SEQ ID NO: 3367480 - DNA, 16 bp, Homo sapiens
cttctctgacttctgc

SEQ ID NO: 3367481 - DNA, 21 bp, Homo sapiens
cttctctgacttctgcctgga

SEQ ID NO: 3367482 - DNA, 13 bp, Homo sapiens
cttctctgcagta

SEQ ID NO: 3367483 - DNA, 23 bp, Homo sapiens
cttctctgcctttgacatttaat

SEQ ID NO: 3367484 - DNA, 12 bp, Homo sapiens
cttctctgctcc

SEQ ID NO: 3367485 - DNA, 20 bp, Homo sapiens
cttctcttaaacttgtgaat

SEQ ID NO: 3367486 - DNA, 14 bp, Homo sapiens
cttctcttaattta

SEQ ID NO: 3367487 - DNA, 19 bp, Homo sapiens
cttctcttatctgccatgt

SEQ ID NO: 3367488 - DNA, 13 bp, Homo sapiens
cttctcttgcttt

SEQ ID NO: 3367489 - DNA, 16 bp, Homo sapiens
cttctcttgctttata

SEQ ID NO: 3367490 - DNA, 17 bp, Homo sapiens
cttctcttgctttatac

SEQ ID NO: 3367491 - DNA, 20 bp, Homo sapiens
cttctcttgggaactccact

SEQ ID NO: 3367492 - DNA, 23 bp, Homo sapiens
cttctgaaatgaaacaaataatc

SEQ ID NO: 3367493 - DNA, 12 bp, Homo sapiens
cttctgaagact

SEQ ID NO: 3367494 - DNA, 20 bp, Homo sapiens
cttctgaagactgagaactt

SEQ ID NO: 3367495 - DNA, 16 bp, Homo sapiens
cttctgaatgctgcta

SEQ ID NO: 3367496 - DNA, 22 bp, Homo sapiens
cttctgaccttttggtgaaagc

SEQ ID NO: 3367497 - DNA, 19 bp, Homo sapiens
cttctgacggccctgcaat

SEQ ID NO: 3367498 - DNA, 19 bp, Homo sapiens
cttctgacgtgccttttgc

SEQ ID NO: 3367499 - DNA, 15 bp, Homo sapiens
cttctgactttactt

SEQ ID NO: 3367500 - DNA, 16 bp, Homo sapiens
cttctgactttacttg

SEQ ID NO: 3367501 - DNA, 20 bp, Homo sapiens
cttctgagctatttcatcta

SEQ ID NO: 3367502 - DNA, 22 bp, Homo sapiens
cttctgaggaccgctgataagc

SEQ ID NO: 3367503 - DNA, 23 bp, Homo sapiens
cttctgaggaccgctgataagca

SEQ ID NO: 3367504 - DNA, 18 bp, Homo sapiens
cttctgattcccctccac

SEQ ID NO: 3367505 - DNA, 22 bp, Homo sapiens
cttctgcaaaaatggatattat

SEQ ID NO: 3367506 - DNA, 12 bp, Homo sapiens
cttctgcaccct

SEQ ID NO: 3367507 - DNA, 15 bp, Homo sapiens
cttctgcaccctcca

SEQ ID NO: 3367508 - DNA, 18 bp, Homo sapiens
cttctgcaccctccaccc

SEQ ID NO: 3367509 - DNA, 14 bp, Homo sapiens
cttctgccaagaga

SEQ ID NO: 3367510 - DNA, 15 bp, Homo sapiens
cttctgccatattct

SEQ ID NO: 3367511 - DNA, 18 bp, Homo sapiens
cttctgccctccctggag

SEQ ID NO: 3367512 - DNA, 11 bp, Homo sapiens
cttctgccctt

SEQ ID NO: 3367513 - DNA, 13 bp, Homo sapiens
cttctgcctggag

SEQ ID NO: 3367514 - DNA, 16 bp, Homo sapiens
cttctgcctggagact

SEQ ID NO: 3367515 - DNA, 14 bp, Homo sapiens
cttctgcctgttat

SEQ ID NO: 3367516 - DNA, 16 bp, Homo sapiens
cttctgccttctcatg

SEQ ID NO: 3367517 - DNA, 16 bp, Homo sapiens
cttctgcgcctcaggc

SEQ ID NO: 3367518 - DNA, 12 bp, Homo sapiens
cttctgctccac

SEQ ID NO: 3367519 - DNA, 15 bp, Homo sapiens
cttctgctccaccct

SEQ ID NO: 3367520 - DNA, 17 bp, Homo sapiens
cttctgctccacccttg

SEQ ID NO: 3367521 - DNA, 21 bp, Homo sapiens
cttctgctccacccttggcct

SEQ ID NO: 3367522 - DNA, 17 bp, Homo sapiens
cttctgctgcccaggcc

SEQ ID NO: 3367523 - DNA, 19 bp, Homo sapiens
cttctgctgcccaggccac

SEQ ID NO: 3367524 - DNA, 21 bp, Homo sapiens
cttctgctgcccaggccacag

SEQ ID NO: 3367525 - DNA, 13 bp, Homo sapiens
cttctgcttcagc

SEQ ID NO: 3367526 - DNA, 17 bp, Homo sapiens
cttctgcttcagcctcc

SEQ ID NO: 3367527 - DNA, 17 bp, Homo sapiens
cttctgcttttctgccc

SEQ ID NO: 3367528 - DNA, 20 bp, Homo sapiens
cttctgcttttctgccctgg

SEQ ID NO: 3367529 - DNA, 14 bp, Homo sapiens
cttctggaaggctg

SEQ ID NO: 3367530 - DNA, 22 bp, Homo sapiens
cttctggaaggctggctgagtg

SEQ ID NO: 3367531 - DNA, 16 bp, Homo sapiens
cttctggaatttgttc

SEQ ID NO: 3367532 - DNA, 15 bp, Homo sapiens
cttctggacactgag

SEQ ID NO: 3367533 - DNA, 19 bp, Homo sapiens
cttctggacactgagaggg

SEQ ID NO: 3367534 - DNA, 20 bp, Homo sapiens
cttctggcttccttctctca

SEQ ID NO: 3367535 - DNA, 17 bp, Homo sapiens
cttctgggagcaggaac

SEQ ID NO: 3367536 - DNA, 16 bp, Homo sapiens
cttctgggcacagtgg

SEQ ID NO: 3367537 - DNA, 20 bp, Homo sapiens
cttctgggcatctgttctgg

SEQ ID NO: 3367538 - DNA, 22 bp, Homo sapiens
cttctgggctgcgggaggccct

SEQ ID NO: 3367539 - DNA, 15 bp, Homo sapiens
cttctgggctttttc

SEQ ID NO: 3367540 - DNA, 21 bp, Homo sapiens
cttctggggcaggctgggcca

SEQ ID NO: 3367541 - DNA, 22 bp, Homo sapiens
cttctggggcaggctgggccat

SEQ ID NO: 3367542 - DNA, 17 bp, Homo sapiens
cttctggtactctccta

SEQ ID NO: 3367543 - DNA, 20 bp, Homo sapiens
cttctggtactctcctagag

SEQ ID NO: 3367544 - DNA, 15 bp, Homo sapiens
cttctggtatcttgt

SEQ ID NO: 3367545 - DNA, 16 bp, Homo sapiens
cttctggtctgtgtgt

SEQ ID NO: 3367546 - DNA, 20 bp, Homo sapiens
cttctggtctgtgtgtgttc

SEQ ID NO: 3367547 - DNA, 21 bp, Homo sapiens
cttctggtctgtgtgtgttct

SEQ ID NO: 3367548 - DNA, 15 bp, Homo sapiens
cttctggtgctactc

SEQ ID NO: 3367549 - DNA, 18 bp, Homo sapiens
cttctggttgtatttcta

SEQ ID NO: 3367550 - DNA, 18 bp, Homo sapiens
cttctgtacgtctgacag

SEQ ID NO: 3367551 - DNA, 20 bp, Homo sapiens
cttctgtacgtctgacaggc

SEQ ID NO: 3367552 - DNA, 20 bp, Homo sapiens
cttctgtatttttttttcta

SEQ ID NO: 3367553 - DNA, 14 bp, Homo sapiens
cttctgtccccagc

SEQ ID NO: 3367554 - DNA, 16 bp, Homo sapiens
cttctgtccccagccc

SEQ ID NO: 3367555 - DNA, 17 bp, Homo sapiens
cttctgtcctactctgt

SEQ ID NO: 3367556 - DNA, 21 bp, Homo sapiens
cttctgtcctactctgtgtca

SEQ ID NO: 3367557 - DNA, 17 bp, Homo sapiens
cttctgtgaaatataat

SEQ ID NO: 3367558 - DNA, 19 bp, Homo sapiens
cttctgtgagacccccaca

SEQ ID NO: 3367559 - DNA, 16 bp, Homo sapiens
cttctgtgatgagctg

SEQ ID NO: 3367560 - DNA, 15 bp, Homo sapiens
cttctgtgggcccct

SEQ ID NO: 3367561 - DNA, 17 bp, Homo sapiens
cttctgtgggcccctca

SEQ ID NO: 3367562 - DNA, 21 bp, Homo sapiens
cttctgtgggcccctcaacag

SEQ ID NO: 3367563 - DNA, 14 bp, Homo sapiens
cttctgtgttcatt

SEQ ID NO: 3367564 - DNA, 12 bp, Homo sapiens
cttctgtttcta

SEQ ID NO: 3367565 - DNA, 14 bp, Homo sapiens
cttctgtttctagt

SEQ ID NO: 3367566 - DNA, 17 bp, Homo sapiens
cttcttaaaggcctgga

SEQ ID NO: 3367567 - DNA, 14 bp, Homo sapiens
cttcttaattaatt

SEQ ID NO: 3367568 - DNA, 16 bp, Homo sapiens
cttcttaattaatttg

SEQ ID NO: 3367569 - DNA, 21 bp, Homo sapiens
cttcttaattaatttgattaa

SEQ ID NO: 3367570 - DNA, 22 bp, Homo sapiens
cttcttaattaatttgattaac

SEQ ID NO: 3367571 - DNA, 15 bp, Homo sapiens
cttcttacacttctt

SEQ ID NO: 3367572 - DNA, 22 bp, Homo sapiens
cttcttatggaattgatttgca

SEQ ID NO: 3367573 - DNA, 12 bp, Homo sapiens
cttcttcaaata

SEQ ID NO: 3367574 - DNA, 22 bp, Homo sapiens
cttcttcacccagctaatctgt

SEQ ID NO: 3367575 - DNA, 20 bp, Homo sapiens
cttcttcagaagacactgca

SEQ ID NO: 3367576 - DNA, 15 bp, Homo sapiens
cttcttccatcccag

SEQ ID NO: 3367577 - DNA, 20 bp, Homo sapiens
cttcttccatcccaggacac

SEQ ID NO: 3367578 - DNA, 14 bp, Homo sapiens
cttcttccctccct

SEQ ID NO: 3367579 - DNA, 13 bp, Homo sapiens
cttcttcctgctg

SEQ ID NO: 3367580 - DNA, 19 bp, Homo sapiens
cttcttcctgctggacaga

SEQ ID NO: 3367581 - DNA, 21 bp, Homo sapiens
cttcttcctgctggacagaga

SEQ ID NO: 3367582 - DNA, 22 bp, Homo sapiens
cttcttctgaagatcagaacat

SEQ ID NO: 3367583 - DNA, 22 bp, Homo sapiens
cttcttgaaattttaacctatg

SEQ ID NO: 3367584 - DNA, 20 bp, Homo sapiens
cttcttgcactccttcccta

SEQ ID NO: 3367585 - DNA, 18 bp, Homo sapiens
cttcttgcatccttccta

SEQ ID NO: 3367586 - DNA, 13 bp, Homo sapiens
cttcttgcctctg

SEQ ID NO: 3367587 - DNA, 16 bp, Homo sapiens
cttcttgcctctgtgc

SEQ ID NO: 3367588 - DNA, 18 bp, Homo sapiens
cttcttgcctctgtgctg

SEQ ID NO: 3367589 - DNA, 20 bp, Homo sapiens
cttcttgcttctttctagaa

SEQ ID NO: 3367590 - DNA, 21 bp, Homo sapiens
cttcttgcttctttctagaaa

SEQ ID NO: 3367591 - DNA, 13 bp, Homo sapiens
cttcttggcgctg

SEQ ID NO: 3367592 - DNA, 18 bp, Homo sapiens
cttcttgggccccagacc

SEQ ID NO: 3367593 - DNA, 13 bp, Homo sapiens
cttcttgtcagac

SEQ ID NO: 3367594 - DNA, 14 bp, Homo sapiens
cttcttgtcagaca

SEQ ID NO: 3367595 - DNA, 18 bp, Homo sapiens
cttcttgtcagacataaa

SEQ ID NO: 3367596 - DNA, 22 bp, Homo sapiens
cttcttgtcagacataaagcca

SEQ ID NO: 3367597 - DNA, 21 bp, Homo sapiens
cttcttgtgattgctgccata

SEQ ID NO: 3367598 - DNA, 14 bp, Homo sapiens
cttctttagaacag

SEQ ID NO: 3367599 - DNA, 19 bp, Homo sapiens
cttctttagaccctcgggc

SEQ ID NO: 3367600 - DNA, 14 bp, Homo sapiens
cttctttatactgt

SEQ ID NO: 3367601 - DNA, 15 bp, Homo sapiens
cttctttctggactg

SEQ ID NO: 3367602 - DNA, 15 bp, Homo sapiens
cttctttgcagggct

SEQ ID NO: 3367603 - DNA, 14 bp, Homo sapiens
cttcttttgaacat

SEQ ID NO: 3367604 - DNA, 15 bp, Homo sapiens
cttcttttgaacatc

SEQ ID NO: 3367605 - DNA, 21 bp, Homo sapiens
cttcttttgtggtgtcttcca

SEQ ID NO: 3367606 - DNA, 15 bp, Homo sapiens
cttctttttgctgtt

SEQ ID NO: 3367607 - DNA, 17 bp, Homo sapiens
cttctttttttgtgatg

SEQ ID NO: 3367608 - DNA, 16 bp, Homo sapiens
cttgaaaaaaaacagt

SEQ ID NO: 3367609 - DNA, 14 bp, Homo sapiens
cttgaaaagattct

SEQ ID NO: 3367610 - DNA, 22 bp, Homo sapiens
cttgaaacagattcaggccagc

SEQ ID NO: 3367611 - DNA, 13 bp, Homo sapiens
cttgaaagaaatg

SEQ ID NO: 3367612 - DNA, 18 bp, Homo sapiens
cttgaaagcatccatgtg

SEQ ID NO: 3367613 - DNA, 16 bp, Homo sapiens
cttgaaagttttccag

SEQ ID NO: 3367614 - DNA, 14 bp, Homo sapiens
cttgaaattttaac

SEQ ID NO: 3367615 - DNA, 16 bp, Homo sapiens
cttgaaattttaacct

SEQ ID NO: 3367616 - DNA, 17 bp, Homo sapiens
cttgaacacagtatttt

SEQ ID NO: 3367617 - DNA, 13 bp, Homo sapiens
cttgaactcctgg

SEQ ID NO: 3367618 - DNA, 14 bp, Homo sapiens
cttgaactcctggc

SEQ ID NO: 3367619 - DNA, 19 bp, Homo sapiens
cttgaactctgttccccca

SEQ ID NO: 3367620 - DNA, 22 bp, Homo sapiens
cttgaagaaacagagtggcctc

SEQ ID NO: 3367621 - DNA, 17 bp, Homo sapiens
cttgaagaactgcaggc

SEQ ID NO: 3367622 - DNA, 13 bp, Homo sapiens
cttgaagccaaag

SEQ ID NO: 3367623 - DNA, 14 bp, Homo sapiens
cttgaagccaaaga

SEQ ID NO: 3367624 - DNA, 19 bp, Homo sapiens
cttgaagccaaagaaaaat

SEQ ID NO: 3367625 - DNA, 19 bp, Homo sapiens
cttgaagccactgaagctg

SEQ ID NO: 3367626 - DNA, 16 bp, Homo sapiens
cttgaagctttgtagg

SEQ ID NO: 3367627 - DNA, 19 bp, Homo sapiens
cttgaagtctaaaagcaga

SEQ ID NO: 3367628 - DNA, 18 bp, Homo sapiens
cttgaagtgactgttgta

SEQ ID NO: 3367629 - DNA, 20 bp, Homo sapiens
cttgaatataaaaaatcatg

SEQ ID NO: 3367630 - DNA, 20 bp, Homo sapiens
cttgaatgtggcttgagaaa

SEQ ID NO: 3367631 - DNA, 15 bp, Homo sapiens
cttgacaaatatttt

SEQ ID NO: 3367632 - DNA, 11 bp, Homo sapiens
cttgacaagct

SEQ ID NO: 3367633 - DNA, 22 bp, Homo sapiens
cttgacacctgctgagaaaaca

SEQ ID NO: 3367634 - DNA, 12 bp, Homo sapiens
cttgacctccta

SEQ ID NO: 3367635 - DNA, 21 bp, Homo sapiens
cttgaccttcctctggggctc

SEQ ID NO: 3367636 - DNA, 22 bp, Homo sapiens
cttgaccttcctctggggctct

SEQ ID NO: 3367637 - DNA, 13 bp, Homo sapiens
cttgactctaata

SEQ ID NO: 3367638 - DNA, 17 bp, Homo sapiens
cttgactctaatatgat

SEQ ID NO: 3367639 - DNA, 19 bp, Homo sapiens
cttgactctaatatgatta

SEQ ID NO: 3367640 - DNA, 12 bp, Homo sapiens
cttgagaaacct

SEQ ID NO: 3367641 - DNA, 17 bp, Homo sapiens
cttgagacacggagccc

SEQ ID NO: 3367642 - DNA, 16 bp, Homo sapiens
cttgagcagtggctgg

SEQ ID NO: 3367643 - DNA, 13 bp, Homo sapiens
cttgagccagtaa

SEQ ID NO: 3367644 - DNA, 11 bp, Homo sapiens
cttgagcccag

SEQ ID NO: 3367645 - DNA, 13 bp, Homo sapiens
cttgagcccagga

SEQ ID NO: 3367646 - DNA, 23 bp, Homo sapiens
cttgagcccaggagttcaagacc

SEQ ID NO: 3367647 - DNA, 20 bp, Homo sapiens
cttgagccctggctgttctg

SEQ ID NO: 3367648 - DNA, 19 bp, Homo sapiens
cttgagccgggcccctggg

SEQ ID NO: 3367649 - DNA, 19 bp, Homo sapiens
cttgagcctcccccaaagc

SEQ ID NO: 3367650 - DNA, 12 bp, Homo sapiens
cttgagctggcc

SEQ ID NO: 3367651 - DNA, 17 bp, Homo sapiens
cttgagctggcctctct

SEQ ID NO: 3367652 - DNA, 23 bp, Homo sapiens
cttgagctggcctctctagcaca

SEQ ID NO: 3367653 - DNA, 22 bp, Homo sapiens
cttgaggaataaatgcctttat

SEQ ID NO: 3367654 - DNA, 14 bp, Homo sapiens
cttgaggagtgtga

SEQ ID NO: 3367655 - DNA, 19 bp, Homo sapiens
cttgaggattgtggaaaac

SEQ ID NO: 3367656 - DNA, 19 bp, Homo sapiens
cttgagggttgggctggtg

SEQ ID NO: 3367657 - DNA, 23 bp, Homo sapiens
cttgaggtaccagttgtatttaa

SEQ ID NO: 3367658 - DNA, 14 bp, Homo sapiens
cttgagtcagaaaa

SEQ ID NO: 3367659 - DNA, 22 bp, Homo sapiens
cttgagtggggttatctctgtg

SEQ ID NO: 3367660 - DNA, 16 bp, Homo sapiens
cttgagtgtaatgttt

SEQ ID NO: 3367661 - DNA, 22 bp, Homo sapiens
cttgagtgtcaagctgaccttg

SEQ ID NO: 3367662 - DNA, 14 bp, Homo sapiens
cttgagtgttcctt

SEQ ID NO: 3367663 - DNA, 21 bp, Homo sapiens
cttgagttggagtactatatt

SEQ ID NO: 3367664 - DNA, 13 bp, Homo sapiens
cttgagtttgtcg

SEQ ID NO: 3367665 - DNA, 16 bp, Homo sapiens
cttgagttttatttat

SEQ ID NO: 3367666 - DNA, 14 bp, Homo sapiens
cttgataaatatat

SEQ ID NO: 3367667 - DNA, 18 bp, Homo sapiens
cttgataaatatatatga

SEQ ID NO: 3367668 - DNA, 22 bp, Homo sapiens
cttgataaatatatatgatcat

SEQ ID NO: 3367669 - DNA, 16 bp, Homo sapiens
cttgatacccccctct

SEQ ID NO: 3367670 - DNA, 17 bp, Homo sapiens
cttgatacccccctctg

SEQ ID NO: 3367671 - DNA, 19 bp, Homo sapiens
cttgatacccccctctgtc

SEQ ID NO: 3367672 - DNA, 23 bp, Homo sapiens
cttgatactaaaagttcttctcc

SEQ ID NO: 3367673 - DNA, 15 bp, Homo sapiens
cttgatactgaatgc

SEQ ID NO: 3367674 - DNA, 16 bp, Homo sapiens
cttgatactgaatgca

SEQ ID NO: 3367675 - DNA, 22 bp, Homo sapiens
cttgatactgaatgcataaata

SEQ ID NO: 3367676 - DNA, 23 bp, Homo sapiens
cttgatactgaatgcataaataa

SEQ ID NO: 3367677 - DNA, 14 bp, Homo sapiens
cttgatatgtaagt

SEQ ID NO: 3367678 - DNA, 21 bp, Homo sapiens
cttgatgaccaaagtcctttt

SEQ ID NO: 3367679 - DNA, 14 bp, Homo sapiens
cttgatgactgctg

SEQ ID NO: 3367680 - DNA, 17 bp, Homo sapiens
cttgatgactgctgatt

SEQ ID NO: 3367681 - DNA, 21 bp, Homo sapiens
cttgatgatttttaacttttt

SEQ ID NO: 3367682 - DNA, 17 bp, Homo sapiens
cttgatgtgaagataat

SEQ ID NO: 3367683 - DNA, 13 bp, Homo sapiens
cttgattaaatca

SEQ ID NO: 3367684 - DNA, 18 bp, Homo sapiens
cttgattaagattttaca

SEQ ID NO: 3367685 - DNA, 20 bp, Homo sapiens
cttgattaagattttacaaa

SEQ ID NO: 3367686 - DNA, 16 bp, Homo sapiens
cttgattatccatatt

SEQ ID NO: 3367687 - DNA, 21 bp, Homo sapiens
cttgattctgcagtaaatctt

SEQ ID NO: 3367688 - DNA, 12 bp, Homo sapiens
cttgatttgcat

SEQ ID NO: 3367689 - DNA, 13 bp, Homo sapiens
cttgatttgcatg

SEQ ID NO: 3367690 - DNA, 17 bp, Homo sapiens
cttgatttgcatggatt

SEQ ID NO: 3367691 - DNA, 17 bp, Homo sapiens
cttgatttgttcttaca

SEQ ID NO: 3367692 - DNA, 23 bp, Homo sapiens
cttgcaacttctttctgttgaga

SEQ ID NO: 3367693 - DNA, 17 bp, Homo sapiens
cttgcaatcttctactt

SEQ ID NO: 3367694 - DNA, 16 bp, Homo sapiens
cttgcaatggcagcct

SEQ ID NO: 3367695 - DNA, 18 bp, Homo sapiens
cttgcaatggcagccttg

SEQ ID NO: 3367696 - DNA, 16 bp, Homo sapiens
cttgcaattagcattc

SEQ ID NO: 3367697 - DNA, 18 bp, Homo sapiens
cttgcaattagcattctg

SEQ ID NO: 3367698 - DNA, 20 bp, Homo sapiens
cttgcacccctcactctggc

SEQ ID NO: 3367699 - DNA, 13 bp, Homo sapiens
cttgcactccttc

SEQ ID NO: 3367700 - DNA, 13 bp, Homo sapiens
cttgcagaactgc

SEQ ID NO: 3367701 - DNA, 16 bp, Homo sapiens
cttgcagaactgccat

SEQ ID NO: 3367702 - DNA, 17 bp, Homo sapiens
cttgcagccacatggcc

SEQ ID NO: 3367703 - DNA, 18 bp, Homo sapiens
cttgcagccacatggccc

SEQ ID NO: 3367704 - DNA, 23 bp, Homo sapiens
cttgcaggggtcccccctcaaga

SEQ ID NO: 3367705 - DNA, 16 bp, Homo sapiens
cttgcaggggtccctg

SEQ ID NO: 3367706 - DNA, 22 bp, Homo sapiens
cttgcagtacatcaaaggaatg

SEQ ID NO: 3367707 - DNA, 18 bp, Homo sapiens
cttgcagttcagcaccac

SEQ ID NO: 3367708 - DNA, 22 bp, Homo sapiens
cttgcagttcagcaccacccta

SEQ ID NO: 3367709 - DNA, 20 bp, Homo sapiens
cttgcataataagctaaaga

SEQ ID NO: 3367710 - DNA, 21 bp, Homo sapiens
cttgcatattgttggcacaga

SEQ ID NO: 3367711 - DNA, 14 bp, Homo sapiens
cttgcatccttcct

SEQ ID NO: 3367712 - DNA, 15 bp, Homo sapiens
cttgcatccttccta

SEQ ID NO: 3367713 - DNA, 17 bp, Homo sapiens
cttgcatccttcctata

SEQ ID NO: 3367714 - DNA, 20 bp, Homo sapiens
cttgcatgaagagaagcaat

SEQ ID NO: 3367715 - DNA, 15 bp, Homo sapiens
cttgcattcattttc

SEQ ID NO: 3367716 - DNA, 16 bp, Homo sapiens
cttgcattcattttct

SEQ ID NO: 3367717 - DNA, 20 bp, Homo sapiens
cttgccaaagtacagaattt

SEQ ID NO: 3367718 - DNA, 21 bp, Homo sapiens
cttgccaaagtacagaatttg

SEQ ID NO: 3367719 - DNA, 22 bp, Homo sapiens
cttgccaatgaggtctgaaatg

SEQ ID NO: 3367720 - DNA, 14 bp, Homo sapiens
cttgccacatttct

SEQ ID NO: 3367721 - DNA, 17 bp, Homo sapiens
cttgccactgcactcca

SEQ ID NO: 3367722 - DNA, 12 bp, Homo sapiens
cttgccccacag

SEQ ID NO: 3367723 - DNA, 21 bp, Homo sapiens
cttgccccacagttgtgttca

SEQ ID NO: 3367724 - DNA, 15 bp, Homo sapiens
cttgcccccatccct

SEQ ID NO: 3367725 - DNA, 17 bp, Homo sapiens
cttgcccggattctggg

SEQ ID NO: 3367726 - DNA, 20 bp, Homo sapiens
cttgcccggattctgggagg

SEQ ID NO: 3367727 - DNA, 19 bp, Homo sapiens
cttgccctagatagtttat

SEQ ID NO: 3367728 - DNA, 14 bp, Homo sapiens
cttgccctccgcct

SEQ ID NO: 3367729 - DNA, 19 bp, Homo sapiens
cttgccctccgcctgggat

SEQ ID NO: 3367730 - DNA, 14 bp, Homo sapiens
cttgccctgacctc

SEQ ID NO: 3367731 - DNA, 18 bp, Homo sapiens
cttgccctgttctcttca

SEQ ID NO: 3367732 - DNA, 12 bp, Homo sapiens
cttgcccttccc

SEQ ID NO: 3367733 - DNA, 17 bp, Homo sapiens
cttgccctttcccccca

SEQ ID NO: 3367734 - DNA, 22 bp, Homo sapiens
cttgccctttccccccatgttg

SEQ ID NO: 3367735 - DNA, 14 bp, Homo sapiens
cttgccgagcctaa

SEQ ID NO: 3367736 - DNA, 19 bp, Homo sapiens
cttgccgagcctaatgaaa

SEQ ID NO: 3367737 - DNA, 17 bp, Homo sapiens
cttgccgaggagccagg

SEQ ID NO: 3367738 - DNA, 18 bp, Homo sapiens
cttgccgaggagccaggc

SEQ ID NO: 3367739 - DNA, 21 bp, Homo sapiens
cttgcctaaatttaatgctgc

SEQ ID NO: 3367740 - DNA, 23 bp, Homo sapiens
cttgcctaaatttaatgctgcct

SEQ ID NO: 3367741 - DNA, 21 bp, Homo sapiens
cttgcctaactaactggcagg

SEQ ID NO: 3367742 - DNA, 15 bp, Homo sapiens
cttgcctcaatgcca

SEQ ID NO: 3367743 - DNA, 17 bp, Homo sapiens
cttgcctcaatgccagt

SEQ ID NO: 3367744 - DNA, 20 bp, Homo sapiens
cttgcctccccatttcccat

SEQ ID NO: 3367745 - DNA, 14 bp, Homo sapiens
cttgcctctgcaca

SEQ ID NO: 3367746 - DNA, 15 bp, Homo sapiens
cttgcctctgcacac

SEQ ID NO: 3367747 - DNA, 16 bp, Homo sapiens
cttgcctctgtgctgt

SEQ ID NO: 3367748 - DNA, 19 bp, Homo sapiens
cttgcctctgtgctgtgtg

SEQ ID NO: 3367749 - DNA, 18 bp, Homo sapiens
cttgcctggggtctgagc

SEQ ID NO: 3367750 - DNA, 13 bp, Homo sapiens
cttgccttcccct

SEQ ID NO: 3367751 - DNA, 12 bp, Homo sapiens
cttgcctttctc

SEQ ID NO: 3367752 - DNA, 14 bp, Homo sapiens
cttgcgaataacag

SEQ ID NO: 3367753 - DNA, 20 bp, Homo sapiens
cttgcgaatccaagctccct

SEQ ID NO: 3367754 - DNA, 15 bp, Homo sapiens
cttgcgtatgtctgt

SEQ ID NO: 3367755 - DNA, 13 bp, Homo sapiens
cttgcgtcctgca

SEQ ID NO: 3367756 - DNA, 14 bp, Homo sapiens
cttgcgtcctgcag

SEQ ID NO: 3367757 - DNA, 16 bp, Homo sapiens
cttgcgtcctgcagag

SEQ ID NO: 3367758 - DNA, 24 bp, Homo sapiens
cttgcgtcctgcagaggaccacag

SEQ ID NO: 3367759 - DNA, 19 bp, Homo sapiens
cttgctaaagcactttgca

SEQ ID NO: 3367760 - DNA, 20 bp, Homo sapiens
cttgctaataaacactggct

SEQ ID NO: 3367761 - DNA, 24 bp, Homo sapiens
cttgctaataaacactggctctgg

SEQ ID NO: 3367762 - DNA, 15 bp, Homo sapiens
cttgctaatcagtgt

SEQ ID NO: 3367763 - DNA, 21 bp, Homo sapiens
cttgctaatcagtgtctcaca

SEQ ID NO: 3367764 - DNA, 22 bp, Homo sapiens
cttgctaatcagtgtctcacac

SEQ ID NO: 3367765 - DNA, 18 bp, Homo sapiens
cttgctaccagtatttag

SEQ ID NO: 3367766 - DNA, 20 bp, Homo sapiens
cttgctaccagtatttagaa

SEQ ID NO: 3367767 - DNA, 20 bp, Homo sapiens
cttgctagtattcgctgtgt

SEQ ID NO: 3367768 - DNA, 13 bp, Homo sapiens
cttgctccagggt

SEQ ID NO: 3367769 - DNA, 17 bp, Homo sapiens
cttgctccagggtcttg

SEQ ID NO: 3367770 - DNA, 21 bp, Homo sapiens
cttgctccagggtcttgggct

SEQ ID NO: 3367771 - DNA, 15 bp, Homo sapiens
cttgctccctgtgtc

SEQ ID NO: 3367772 - DNA, 20 bp, Homo sapiens
cttgctccctgtgtccacct

SEQ ID NO: 3367773 - DNA, 13 bp, Homo sapiens
cttgctcccttca

SEQ ID NO: 3367774 - DNA, 20 bp, Homo sapiens
cttgctctcccctgccctgc

SEQ ID NO: 3367775 - DNA, 16 bp, Homo sapiens
cttgctctgctgacag

SEQ ID NO: 3367776 - DNA, 17 bp, Homo sapiens
cttgctctgctgacaga

SEQ ID NO: 3367777 - DNA, 20 bp, Homo sapiens
cttgctctttctactctgaa

SEQ ID NO: 3367778 - DNA, 22 bp, Homo sapiens
cttgctctttctactctgaact

SEQ ID NO: 3367779 - DNA, 21 bp, Homo sapiens
cttgctgagtggcgcaaggcc

SEQ ID NO: 3367780 - DNA, 22 bp, Homo sapiens
cttgctgagtggcgcaaggccg

SEQ ID NO: 3367781 - DNA, 15 bp, Homo sapiens
cttgctgatggctgc

SEQ ID NO: 3367782 - DNA, 21 bp, Homo sapiens
cttgctgatggctgctagatt

SEQ ID NO: 3367783 - DNA, 16 bp, Homo sapiens
cttgctgatggcttga

SEQ ID NO: 3367784 - DNA, 18 bp, Homo sapiens
cttgctgatggcttgaca

SEQ ID NO: 3367785 - DNA, 20 bp, Homo sapiens
cttgctgatggcttgacatg

SEQ ID NO: 3367786 - DNA, 21 bp, Homo sapiens
cttgctgcaagcacagccctt

SEQ ID NO: 3367787 - DNA, 12 bp, Homo sapiens
cttgctgctaga

SEQ ID NO: 3367788 - DNA, 17 bp, Homo sapiens
cttgctgctagaacttt

SEQ ID NO: 3367789 - DNA, 18 bp, Homo sapiens
cttgctgctagaactttt

SEQ ID NO: 3367790 - DNA, 13 bp, Homo sapiens
cttgctgctgctg

SEQ ID NO: 3367791 - DNA, 15 bp, Homo sapiens
cttgctgctgctgca

SEQ ID NO: 3367792 - DNA, 15 bp, Homo sapiens
cttgctgctttagtc

SEQ ID NO: 3367793 - DNA, 14 bp, Homo sapiens
cttgctggccccag

SEQ ID NO: 3367794 - DNA, 15 bp, Homo sapiens
cttgctggctctgag

SEQ ID NO: 3367795 - DNA, 17 bp, Homo sapiens
cttgctggctctgagaa

SEQ ID NO: 3367796 - DNA, 13 bp, Homo sapiens
cttgctgtatgct

SEQ ID NO: 3367797 - DNA, 14 bp, Homo sapiens
cttgctgtcctagg

SEQ ID NO: 3367798 - DNA, 15 bp, Homo sapiens
cttgctgtcctaggc

SEQ ID NO: 3367799 - DNA, 20 bp, Homo sapiens
cttgctgtcctaggccacac

SEQ ID NO: 3367800 - DNA, 13 bp, Homo sapiens
cttgctgtctctg

SEQ ID NO: 3367801 - DNA, 14 bp, Homo sapiens
cttgcttattacat

SEQ ID NO: 3367802 - DNA, 18 bp, Homo sapiens
cttgcttattacatttaa

SEQ ID NO: 3367803 - DNA, 20 bp, Homo sapiens
cttgcttcttactgataatt

SEQ ID NO: 3367804 - DNA, 12 bp, Homo sapiens
cttgcttgtcat

SEQ ID NO: 3367805 - DNA, 13 bp, Homo sapiens
cttgcttgtcatt

SEQ ID NO: 3367806 - DNA, 12 bp, Homo sapiens
cttgctttcctg

SEQ ID NO: 3367807 - DNA, 15 bp, Homo sapiens
cttgctttcggagct

SEQ ID NO: 3367808 - DNA, 18 bp, Homo sapiens
cttgctttcttttttaaa

SEQ ID NO: 3367809 - DNA, 23 bp, Homo sapiens
cttgctttcttttttaaaatcaa

SEQ ID NO: 3367810 - DNA, 17 bp, Homo sapiens
cttgcttttctgtattt

SEQ ID NO: 3367811 - DNA, 20 bp, Homo sapiens
cttggaaaaatccagaaaga

SEQ ID NO: 3367812 - DNA, 14 bp, Homo sapiens
cttggaaaataaga

SEQ ID NO: 3367813 - DNA, 19 bp, Homo sapiens
cttggaaaataagacaata

SEQ ID NO: 3367814 - DNA, 23 bp, Homo sapiens
cttggaaagcatcacctcaggcc

SEQ ID NO: 3367815 - DNA, 24 bp, Homo sapiens
cttggaaagctgatgatgtctctt

SEQ ID NO: 3367816 - DNA, 14 bp, Homo sapiens
cttggaaattcctt

SEQ ID NO: 3367817 - DNA, 18 bp, Homo sapiens
cttggaaattccttgccc

SEQ ID NO: 3367818 - DNA, 15 bp, Homo sapiens
cttggaagccaggta

SEQ ID NO: 3367819 - DNA, 14 bp, Homo sapiens
cttggaagctccgc

SEQ ID NO: 3367820 - DNA, 20 bp, Homo sapiens
cttggaattacaagccctgg

SEQ ID NO: 3367821 - DNA, 22 bp, Homo sapiens
cttggaatttgtaacctcagct

SEQ ID NO: 3367822 - DNA, 19 bp, Homo sapiens
cttggacaggagtcagtgt

SEQ ID NO: 3367823 - DNA, 14 bp, Homo sapiens
cttggactcttgct

SEQ ID NO: 3367824 - DNA, 13 bp, Homo sapiens
cttggacttcctg

SEQ ID NO: 3367825 - DNA, 14 bp, Homo sapiens
cttggagactcctg

SEQ ID NO: 3367826 - DNA, 16 bp, Homo sapiens
cttggagactcctggt

SEQ ID NO: 3367827 - DNA, 15 bp, Homo sapiens
cttggagagaatcat

SEQ ID NO: 3367828 - DNA, 16 bp, Homo sapiens
cttggagagacacagc

SEQ ID NO: 3367829 - DNA, 20 bp, Homo sapiens
cttggagagtcttgggcctg

SEQ ID NO: 3367830 - DNA, 23 bp, Homo sapiens
cttggagctgtgagttctccctg

SEQ ID NO: 3367831 - DNA, 22 bp, Homo sapiens
cttggaggaaacttaagatgaa

SEQ ID NO: 3367832 - DNA, 14 bp, Homo sapiens
cttggaggagagag

SEQ ID NO: 3367833 - DNA, 15 bp, Homo sapiens
cttggaggagagaga

SEQ ID NO: 3367834 - DNA, 14 bp, Homo sapiens
cttggagggaccaa

SEQ ID NO: 3367835 - DNA, 15 bp, Homo sapiens
cttggagggataagc

SEQ ID NO: 3367836 - DNA, 23 bp, Homo sapiens
cttggagggatggagaggcggcc

SEQ ID NO: 3367837 - DNA, 19 bp, Homo sapiens
cttggagggcccacttgta

SEQ ID NO: 3367838 - DNA, 22 bp, Homo sapiens
cttggagtattggggtctgacc

SEQ ID NO: 3367839 - DNA, 16 bp, Homo sapiens
cttggatacttggatt

SEQ ID NO: 3367840 - DNA, 21 bp, Homo sapiens
cttggatcgctaagctggctc

SEQ ID NO: 3367841 - DNA, 15 bp, Homo sapiens
cttggattctctaac

SEQ ID NO: 3367842 - DNA, 12 bp, Homo sapiens
cttggcacttaa

SEQ ID NO: 3367843 - DNA, 21 bp, Homo sapiens
cttggcacttaagtgcacttt

SEQ ID NO: 3367844 - DNA, 11 bp, Homo sapiens
cttggcacttt

SEQ ID NO: 3367845 - DNA, 14 bp, Homo sapiens
cttggcactttttc

SEQ ID NO: 3367846 - DNA, 21 bp, Homo sapiens
cttggcatgggcgcaggccca

SEQ ID NO: 3367847 - DNA, 12 bp, Homo sapiens
cttggcatttct

SEQ ID NO: 3367848 - DNA, 23 bp, Homo sapiens
cttggccacaacctgaaagacaa

SEQ ID NO: 3367849 - DNA, 16 bp, Homo sapiens
cttggccccagacgca

SEQ ID NO: 3367850 - DNA, 14 bp, Homo sapiens
cttggccctttcct

SEQ ID NO: 3367851 - DNA, 19 bp, Homo sapiens
cttggccggctgtgctcag

SEQ ID NO: 3367852 - DNA, 17 bp, Homo sapiens
cttggcctcagctggct

SEQ ID NO: 3367853 - DNA, 14 bp, Homo sapiens
cttggcctcccaag

SEQ ID NO: 3367854 - DNA, 12 bp, Homo sapiens
cttggccttggc

SEQ ID NO: 3367855 - DNA, 16 bp, Homo sapiens
cttggccttggcatgg

SEQ ID NO: 3367856 - DNA, 15 bp, Homo sapiens
cttggcggcagcagc

SEQ ID NO: 3367857 - DNA, 18 bp, Homo sapiens
cttggcggcagcagccat

SEQ ID NO: 3367858 - DNA, 18 bp, Homo sapiens
cttggcgtggagccaggg

SEQ ID NO: 3367859 - DNA, 14 bp, Homo sapiens
cttggctcagacat

SEQ ID NO: 3367860 - DNA, 22 bp, Homo sapiens
cttggctcgaatctctgtgcct

SEQ ID NO: 3367861 - DNA, 23 bp, Homo sapiens
cttggctcgatgctgtgggggac

SEQ ID NO: 3367862 - DNA, 14 bp, Homo sapiens
cttggctctgccag

SEQ ID NO: 3367863 - DNA, 16 bp, Homo sapiens
cttggctgactggggc

SEQ ID NO: 3367864 - DNA, 17 bp, Homo sapiens
cttggctgactggggct

SEQ ID NO: 3367865 - DNA, 14 bp, Homo sapiens
cttggcttaatcat

SEQ ID NO: 3367866 - DNA, 17 bp, Homo sapiens
cttggcttacctgacct

SEQ ID NO: 3367867 - DNA, 18 bp, Homo sapiens
cttggcttacctgacctc

SEQ ID NO: 3367868 - DNA, 21 bp, Homo sapiens
cttggcttctgtgatgagctg

SEQ ID NO: 3367869 - DNA, 22 bp, Homo sapiens
cttggctttcattattagtact

SEQ ID NO: 3367870 - DNA, 17 bp, Homo sapiens
cttggctttcctgtttc

SEQ ID NO: 3367871 - DNA, 21 bp, Homo sapiens
cttgggaaaaaaacttggcac

SEQ ID NO: 3367872 - DNA, 16 bp, Homo sapiens
cttgggaactccactc

SEQ ID NO: 3367873 - DNA, 22 bp, Homo sapiens
cttgggaagctgaggcgggaga

SEQ ID NO: 3367874 - DNA, 18 bp, Homo sapiens
cttgggacagccagagct

SEQ ID NO: 3367875 - DNA, 17 bp, Homo sapiens
cttgggactgggtttgg

SEQ ID NO: 3367876 - DNA, 18 bp, Homo sapiens
cttgggagagcccctggg

SEQ ID NO: 3367877 - DNA, 14 bp, Homo sapiens
cttgggaggctgag

SEQ ID NO: 3367878 - DNA, 16 bp, Homo sapiens
cttgggaggctgaggc

SEQ ID NO: 3367879 - DNA, 14 bp, Homo sapiens
cttgggagttttga

SEQ ID NO: 3367880 - DNA, 17 bp, Homo sapiens
cttgggatttgctgtgt

SEQ ID NO: 3367881 - DNA, 13 bp, Homo sapiens
cttgggcagagct

SEQ ID NO: 3367882 - DNA, 18 bp, Homo sapiens
cttgggcagagctggctc

SEQ ID NO: 3367883 - DNA, 23 bp, Homo sapiens
cttgggcatccacccagtgctgc

SEQ ID NO: 3367884 - DNA, 14 bp, Homo sapiens
cttgggcctggccc

SEQ ID NO: 3367885 - DNA, 12 bp, Homo sapiens
cttgggcctggg

SEQ ID NO: 3367886 - DNA, 21 bp, Homo sapiens
cttgggcctgggcctctgccc

SEQ ID NO: 3367887 - DNA, 20 bp, Homo sapiens
cttgggctactggcagctcc

SEQ ID NO: 3367888 - DNA, 21 bp, Homo sapiens
cttgggctatttggactcagg

SEQ ID NO: 3367889 - DNA, 18 bp, Homo sapiens
cttggggaatttcctcta

SEQ ID NO: 3367890 - DNA, 19 bp, Homo sapiens
cttggggaggacaaaactt

SEQ ID NO: 3367891 - DNA, 23 bp, Homo sapiens
cttggggaggacaaaacttcttg

SEQ ID NO: 3367892 - DNA, 13 bp, Homo sapiens
cttggggcctggc

SEQ ID NO: 3367893 - DNA, 14 bp, Homo sapiens
cttggggcctggct

SEQ ID NO: 3367894 - DNA, 19 bp, Homo sapiens
cttggggcctggcttgctc

SEQ ID NO: 3367895 - DNA, 15 bp, Homo sapiens
cttggggctatttgt

SEQ ID NO: 3367896 - DNA, 18 bp, Homo sapiens
cttggggctcacacacct

SEQ ID NO: 3367897 - DNA, 14 bp, Homo sapiens
cttggggcttccta

SEQ ID NO: 3367898 - DNA, 21 bp, Homo sapiens
cttgggggaacgatgtgtctg

SEQ ID NO: 3367899 - DNA, 18 bp, Homo sapiens
cttgggggttcaggcccg

SEQ ID NO: 3367900 - DNA, 14 bp, Homo sapiens
cttgggtcattgac

SEQ ID NO: 3367901 - DNA, 16 bp, Homo sapiens
cttgggtcattgacct

SEQ ID NO: 3367902 - DNA, 22 bp, Homo sapiens
cttgggtcattgacctctcagg

SEQ ID NO: 3367903 - DNA, 18 bp, Homo sapiens
cttgggtctgaatttatt

SEQ ID NO: 3367904 - DNA, 21 bp, Homo sapiens
cttgggtggttcctaagggaa

SEQ ID NO: 3367905 - DNA, 14 bp, Homo sapiens
cttgggttctgata

SEQ ID NO: 3367906 - DNA, 23 bp, Homo sapiens
cttggtactactagatgtcttta

SEQ ID NO: 3367907 - DNA, 13 bp, Homo sapiens
cttggtccctggt

SEQ ID NO: 3367908 - DNA, 16 bp, Homo sapiens
cttggtctgtgagatg

SEQ ID NO: 3367909 - DNA, 15 bp, Homo sapiens
cttggtgactgtccc

SEQ ID NO: 3367910 - DNA, 21 bp, Homo sapiens
cttggtgcggggttaacacct

SEQ ID NO: 3367911 - DNA, 15 bp, Homo sapiens
cttggtgtgattgca

SEQ ID NO: 3367912 - DNA, 18 bp, Homo sapiens
cttggtgtgattgcacag

SEQ ID NO: 3367913 - DNA, 19 bp, Homo sapiens
cttggtgtgattgcacaga

SEQ ID NO: 3367914 - DNA, 21 bp, Homo sapiens
cttggttagacgccttccagg

SEQ ID NO: 3367915 - DNA, 22 bp, Homo sapiens
cttggttggctggcagctgaga

SEQ ID NO: 3367916 - DNA, 20 bp, Homo sapiens
cttggtttctctctacagtg

SEQ ID NO: 3367917 - DNA, 21 bp, Homo sapiens
cttggtttgttatatcaggga

SEQ ID NO: 3367918 - DNA, 22 bp, Homo sapiens
cttggtttgttatatcagggaa

SEQ ID NO: 3367919 - DNA, 17 bp, Homo sapiens
cttgtaaaaaaagcaaa

SEQ ID NO: 3367920 - DNA, 23 bp, Homo sapiens
cttgtaaagactggttttctgcc

SEQ ID NO: 3367921 - DNA, 13 bp, Homo sapiens
cttgtaaatacac

SEQ ID NO: 3367922 - DNA, 13 bp, Homo sapiens
cttgtaaatgttt

SEQ ID NO: 3367923 - DNA, 14 bp, Homo sapiens
cttgtaaatgtttc

SEQ ID NO: 3367924 - DNA, 15 bp, Homo sapiens
cttgtaaatgtttct

SEQ ID NO: 3367925 - DNA, 24 bp, Homo sapiens
cttgtaaattgatgggagaaatga

SEQ ID NO: 3367926 - DNA, 19 bp, Homo sapiens
cttgtaaccagtgcagaaa

SEQ ID NO: 3367927 - DNA, 22 bp, Homo sapiens
cttgtaaccagtgcagaaatga

SEQ ID NO: 3367928 - DNA, 18 bp, Homo sapiens
cttgtaataaatttctaa

SEQ ID NO: 3367929 - DNA, 15 bp, Homo sapiens
cttgtaattctaaat

SEQ ID NO: 3367930 - DNA, 13 bp, Homo sapiens
cttgtacatgtgt

SEQ ID NO: 3367931 - DNA, 19 bp, Homo sapiens
cttgtacatgtgtagcctg

SEQ ID NO: 3367932 - DNA, 22 bp, Homo sapiens
cttgtacatgtgtagcctgtgc

SEQ ID NO: 3367933 - DNA, 22 bp, Homo sapiens
cttgtacccccaggtggaaggc

SEQ ID NO: 3367934 - DNA, 20 bp, Homo sapiens
cttgtactcttaggatattt

SEQ ID NO: 3367935 - DNA, 13 bp, Homo sapiens
cttgtactgggac

SEQ ID NO: 3367936 - DNA, 13 bp, Homo sapiens
cttgtacttctgt

SEQ ID NO: 3367937 - DNA, 21 bp, Homo sapiens
cttgtacttctgtgttcattt

SEQ ID NO: 3367938 - DNA, 18 bp, Homo sapiens
cttgtagaactcactctg

SEQ ID NO: 3367939 - DNA, 23 bp, Homo sapiens
cttgtagaactcactctgggctg

SEQ ID NO: 3367940 - DNA, 13 bp, Homo sapiens
cttgtagctgtaa

SEQ ID NO: 3367941 - DNA, 17 bp, Homo sapiens
cttgtagggatgccttt

SEQ ID NO: 3367942 - DNA, 21 bp, Homo sapiens
cttgtataaaatccaaaatga

SEQ ID NO: 3367943 - DNA, 17 bp, Homo sapiens
cttgtataaatgtatat

SEQ ID NO: 3367944 - DNA, 15 bp, Homo sapiens
cttgtatagtgtaaa

SEQ ID NO: 3367945 - DNA, 12 bp, Homo sapiens
cttgtatatttg

SEQ ID NO: 3367946 - DNA, 19 bp, Homo sapiens
cttgtatatttgtacaaaa

SEQ ID NO: 3367947 - DNA, 21 bp, Homo sapiens
cttgtatgaaagatggctgtg

SEQ ID NO: 3367948 - DNA, 17 bp, Homo sapiens
cttgtattaaagacaga

SEQ ID NO: 3367949 - DNA, 17 bp, Homo sapiens
cttgtattttgttaaag

SEQ ID NO: 3367950 - DNA, 14 bp, Homo sapiens
cttgtcacaataaa

SEQ ID NO: 3367951 - DNA, 20 bp, Homo sapiens
cttgtcactgacacaaagga

SEQ ID NO: 3367952 - DNA, 21 bp, Homo sapiens
cttgtcactgacacaaaggaa

SEQ ID NO: 3367953 - DNA, 15 bp, Homo sapiens
cttgtcactggtaga

SEQ ID NO: 3367954 - DNA, 15 bp, Homo sapiens
cttgtcagacataaa

SEQ ID NO: 3367955 - DNA, 17 bp, Homo sapiens
cttgtcagacataaagc

SEQ ID NO: 3367956 - DNA, 20 bp, Homo sapiens
cttgtcagacataaagccat

SEQ ID NO: 3367957 - DNA, 19 bp, Homo sapiens
cttgtcctgccagctgcct

SEQ ID NO: 3367958 - DNA, 15 bp, Homo sapiens
cttgtcctttccctt

SEQ ID NO: 3367959 - DNA, 23 bp, Homo sapiens
cttgtccttttgtaccatggtgt

SEQ ID NO: 3367960 - DNA, 13 bp, Homo sapiens
cttgtctctgggc

SEQ ID NO: 3367961 - DNA, 14 bp, Homo sapiens
cttgtctctgggct

SEQ ID NO: 3367962 - DNA, 13 bp, Homo sapiens
cttgtctgaggcc

SEQ ID NO: 3367963 - DNA, 14 bp, Homo sapiens
cttgtctgaggcct

SEQ ID NO: 3367964 - DNA, 21 bp, Homo sapiens
cttgtctgaggcctcatccct

SEQ ID NO: 3367965 - DNA, 22 bp, Homo sapiens
cttgtctgaggcctcatccctc

SEQ ID NO: 3367966 - DNA, 16 bp, Homo sapiens
cttgtctgggaattgt

SEQ ID NO: 3367967 - DNA, 13 bp, Homo sapiens
cttgtcttcgctg

SEQ ID NO: 3367968 - DNA, 14 bp, Homo sapiens
cttgtcttcgctgg

SEQ ID NO: 3367969 - DNA, 13 bp, Homo sapiens
cttgtctttattt

SEQ ID NO: 3367970 - DNA, 14 bp, Homo sapiens
cttgtcttttctgc

SEQ ID NO: 3367971 - DNA, 16 bp, Homo sapiens
cttgtcttttctgctg

SEQ ID NO: 3367972 - DNA, 17 bp, Homo sapiens
cttgtcttttctgctga

SEQ ID NO: 3367973 - DNA, 18 bp, Homo sapiens
cttgtgaaacacagctgt

SEQ ID NO: 3367974 - DNA, 12 bp, Homo sapiens
cttgtgaacaga

SEQ ID NO: 3367975 - DNA, 12 bp, Homo sapiens
cttgtgactgaa

SEQ ID NO: 3367976 - DNA, 15 bp, Homo sapiens
cttgtgagagcccat

SEQ ID NO: 3367977 - DNA, 17 bp, Homo sapiens
cttgtgccacaccctcc

SEQ ID NO: 3367978 - DNA, 11 bp, Homo sapiens
cttgtgccata

SEQ ID NO: 3367979 - DNA, 17 bp, Homo sapiens
cttgtgccctgccccca

SEQ ID NO: 3367980 - DNA, 17 bp, Homo sapiens
cttgtgctcacgctccc

SEQ ID NO: 3367981 - DNA, 23 bp, Homo sapiens
cttgtgctcacgctcccccgcag

SEQ ID NO: 3367982 - DNA, 21 bp, Homo sapiens
cttgtgctggatggagcccag

SEQ ID NO: 3367983 - DNA, 24 bp, Homo sapiens
cttgtgcttggtggggctcgtggc

SEQ ID NO: 3367984 - DNA, 14 bp, Homo sapiens
cttgtgctttgctc

SEQ ID NO: 3367985 - DNA, 16 bp, Homo sapiens
cttgtgctttgctctt

SEQ ID NO: 3367986 - DNA, 22 bp, Homo sapiens
cttgtgcttttttgattttgct

SEQ ID NO: 3367987 - DNA, 21 bp, Homo sapiens
cttgtggaagcaaaaatctga

SEQ ID NO: 3367988 - DNA, 14 bp, Homo sapiens
cttgtggacacagc

SEQ ID NO: 3367989 - DNA, 20 bp, Homo sapiens
cttgtggccccttttacttt

SEQ ID NO: 3367990 - DNA, 18 bp, Homo sapiens
cttgtggggacccaggct

SEQ ID NO: 3367991 - DNA, 15 bp, Homo sapiens
cttgtggtgtaaagc

SEQ ID NO: 3367992 - DNA, 23 bp, Homo sapiens
cttgtggtgtgaccatgttcatt

SEQ ID NO: 3367993 - DNA, 18 bp, Homo sapiens
cttgtgtcaagacatttc

SEQ ID NO: 3367994 - DNA, 18 bp, Homo sapiens
cttgtgtctgtacacgtg

SEQ ID NO: 3367995 - DNA, 21 bp, Homo sapiens
cttgtgtgtgggctgtgagtg

SEQ ID NO: 3367996 - DNA, 18 bp, Homo sapiens
cttgtgtgtttcactttt

SEQ ID NO: 3367997 - DNA, 19 bp, Homo sapiens
cttgtgtgtttcactttta

SEQ ID NO: 3367998 - DNA, 19 bp, Homo sapiens
cttgtgtgttttgagagta

SEQ ID NO: 3367999 - DNA, 16 bp, Homo sapiens
cttgttaagatagtta

SEQ ID NO: 3368000 - DNA, 15 bp, Homo sapiens
cttgttacttctgag

SEQ ID NO: 3368001 - DNA, 23 bp, Homo sapiens
cttgttattcgaaccactgagag

SEQ ID NO: 3368002 - DNA, 17 bp, Homo sapiens
cttgttattgtgaatga

SEQ ID NO: 3368003 - DNA, 13 bp, Homo sapiens
cttgttatttata

SEQ ID NO: 3368004 - DNA, 15 bp, Homo sapiens
cttgttatttataac

SEQ ID NO: 3368005 - DNA, 12 bp, Homo sapiens
cttgttcattta

SEQ ID NO: 3368006 - DNA, 20 bp, Homo sapiens
cttgttccagccctattctg

SEQ ID NO: 3368007 - DNA, 21 bp, Homo sapiens
cttgttccccactgacagcct

SEQ ID NO: 3368008 - DNA, 17 bp, Homo sapiens
cttgttctatttttcaa

SEQ ID NO: 3368009 - DNA, 15 bp, Homo sapiens
cttgttctgggctca

SEQ ID NO: 3368010 - DNA, 14 bp, Homo sapiens
cttgttctgtccct

SEQ ID NO: 3368011 - DNA, 19 bp, Homo sapiens
cttgttctgtcccttccac

SEQ ID NO: 3368012 - DNA, 20 bp, Homo sapiens
cttgttctgtgatgagggga

SEQ ID NO: 3368013 - DNA, 12 bp, Homo sapiens
cttgttcttccc

SEQ ID NO: 3368014 - DNA, 14 bp, Homo sapiens
cttgttggtcagag

SEQ ID NO: 3368015 - DNA, 15 bp, Homo sapiens
cttgttggtcagagg

SEQ ID NO: 3368016 - DNA, 23 bp, Homo sapiens
cttgttggtggagagtggaagga

SEQ ID NO: 3368017 - DNA, 15 bp, Homo sapiens
cttgttgtggctctt

SEQ ID NO: 3368018 - DNA, 23 bp, Homo sapiens
cttgtttacaacatttttgcaaa

SEQ ID NO: 3368019 - DNA, 16 bp, Homo sapiens
cttgtttatgatattt

SEQ ID NO: 3368020 - DNA, 12 bp, Homo sapiens
cttgtttattga

SEQ ID NO: 3368021 - DNA, 19 bp, Homo sapiens
cttgtttattgagtttgta

SEQ ID NO: 3368022 - DNA, 23 bp, Homo sapiens
cttgtttattgagtttgtaggta

SEQ ID NO: 3368023 - DNA, 12 bp, Homo sapiens
cttgtttcaatt

SEQ ID NO: 3368024 - DNA, 22 bp, Homo sapiens
cttgttttataaaattttgctt

SEQ ID NO: 3368025 - DNA, 14 bp, Homo sapiens
cttgttttatatac

SEQ ID NO: 3368026 - DNA, 21 bp, Homo sapiens
cttgttttcaggacaacactt

SEQ ID NO: 3368027 - DNA, 23 bp, Homo sapiens
cttgttttcaggacaacacttca

SEQ ID NO: 3368028 - DNA, 11 bp, Homo sapiens
cttgttttcca

SEQ ID NO: 3368029 - DNA, 17 bp, Homo sapiens
cttgttttcttgccaat

SEQ ID NO: 3368030 - DNA, 20 bp, Homo sapiens
cttgttttctttctttaaat

SEQ ID NO: 3368031 - DNA, 21 bp, Homo sapiens
cttgttttggatggcttgtct

SEQ ID NO: 3368032 - DNA, 15 bp, Homo sapiens
cttgttttgtttgtc

SEQ ID NO: 3368033 - DNA, 22 bp, Homo sapiens
cttgttttgtttgtctctcctt

SEQ ID NO: 3368034 - DNA, 23 bp, Homo sapiens
cttgttttgtttgtctctccttt

SEQ ID NO: 3368035 - DNA, 20 bp, Homo sapiens
cttgtttttattaatttata

SEQ ID NO: 3368036 - DNA, 21 bp, Homo sapiens
cttgttttttttttccactta

SEQ ID NO: 3368037 - DNA, 17 bp, Homo sapiens
ctttaaaaaaatttaag

SEQ ID NO: 3368038 - DNA, 23 bp, Homo sapiens
ctttaaaaaagaaaagtgcatat

SEQ ID NO: 3368039 - DNA, 18 bp, Homo sapiens
ctttaaaaaatatttatt

SEQ ID NO: 3368040 - DNA, 13 bp, Homo sapiens
ctttaaaaactgt

SEQ ID NO: 3368041 - DNA, 13 bp, Homo sapiens
ctttaaaaaggaa

SEQ ID NO: 3368042 - DNA, 20 bp, Homo sapiens
ctttaaaaaggaaatttgtt

SEQ ID NO: 3368043 - DNA, 22 bp, Homo sapiens
ctttaaaaaggtgcactacagt

SEQ ID NO: 3368044 - DNA, 15 bp, Homo sapiens
ctttaaaaggattaa

SEQ ID NO: 3368045 - DNA, 18 bp, Homo sapiens
ctttaaacagtatttcat

SEQ ID NO: 3368046 - DNA, 20 bp, Homo sapiens
ctttaaagcaattgcataat

SEQ ID NO: 3368047 - DNA, 18 bp, Homo sapiens
ctttaaaggcccagcccc

SEQ ID NO: 3368048 - DNA, 22 bp, Homo sapiens
ctttaaatcatttttatattat

SEQ ID NO: 3368049 - DNA, 11 bp, Homo sapiens
ctttaaatgtt

SEQ ID NO: 3368050 - DNA, 12 bp, Homo sapiens
ctttaaattatg

SEQ ID NO: 3368051 - DNA, 18 bp, Homo sapiens
ctttaacaacctctgagc

SEQ ID NO: 3368052 - DNA, 18 bp, Homo sapiens
ctttaacagaaactttca

SEQ ID NO: 3368053 - DNA, 13 bp, Homo sapiens
ctttaacttagta

SEQ ID NO: 3368054 - DNA, 16 bp, Homo sapiens
ctttaagaatagttct

SEQ ID NO: 3368055 - DNA, 23 bp, Homo sapiens
ctttaagacatactccttccatc

SEQ ID NO: 3368056 - DNA, 13 bp, Homo sapiens
ctttaagagactc

SEQ ID NO: 3368057 - DNA, 14 bp, Homo sapiens
ctttaagagactca

SEQ ID NO: 3368058 - DNA, 17 bp, Homo sapiens
ctttaagagagaaatct

SEQ ID NO: 3368059 - DNA, 21 bp, Homo sapiens
ctttaagcagctcttgctaat

SEQ ID NO: 3368060 - DNA, 14 bp, Homo sapiens
ctttaagccaaaga

SEQ ID NO: 3368061 - DNA, 17 bp, Homo sapiens
ctttaagccttcaaaac

SEQ ID NO: 3368062 - DNA, 18 bp, Homo sapiens
ctttaagccttcaaaact

SEQ ID NO: 3368063 - DNA, 13 bp, Homo sapiens
ctttaagctcctt

SEQ ID NO: 3368064 - DNA, 17 bp, Homo sapiens
ctttaagggcatgcctt

SEQ ID NO: 3368065 - DNA, 20 bp, Homo sapiens
ctttaagggcatgccttgtg

SEQ ID NO: 3368066 - DNA, 22 bp, Homo sapiens
ctttaagggcatgccttgtgct

SEQ ID NO: 3368067 - DNA, 17 bp, Homo sapiens
ctttaataaattgctta

SEQ ID NO: 3368068 - DNA, 21 bp, Homo sapiens
ctttaatcttcagttttatct

SEQ ID NO: 3368069 - DNA, 12 bp, Homo sapiens
ctttaatgcttt

SEQ ID NO: 3368070 - DNA, 17 bp, Homo sapiens
ctttaatgtcacaggca

SEQ ID NO: 3368071 - DNA, 17 bp, Homo sapiens
ctttaatgttttttgcc

SEQ ID NO: 3368072 - DNA, 13 bp, Homo sapiens
ctttaattgtata

SEQ ID NO: 3368073 - DNA, 14 bp, Homo sapiens
ctttaattgtataa

SEQ ID NO: 3368074 - DNA, 19 bp, Homo sapiens
ctttaattgtataagtcaa

SEQ ID NO: 3368075 - DNA, 12 bp, Homo sapiens
ctttacaatgtg

SEQ ID NO: 3368076 - DNA, 13 bp, Homo sapiens
ctttacaatgtga

SEQ ID NO: 3368077 - DNA, 14 bp, Homo sapiens
ctttacaatgtgaa

SEQ ID NO: 3368078 - DNA, 15 bp, Homo sapiens
ctttacaatgtgaat

SEQ ID NO: 3368079 - DNA, 17 bp, Homo sapiens
ctttacatgcaatttat

SEQ ID NO: 3368080 - DNA, 13 bp, Homo sapiens
ctttacctgagac

SEQ ID NO: 3368081 - DNA, 17 bp, Homo sapiens
ctttacctgtgaagtgt

SEQ ID NO: 3368082 - DNA, 23 bp, Homo sapiens
ctttacctttttgtatgtgaaca

SEQ ID NO: 3368083 - DNA, 19 bp, Homo sapiens
ctttactctgtgtttaaaa

SEQ ID NO: 3368084 - DNA, 18 bp, Homo sapiens
ctttactggacctgaaat

SEQ ID NO: 3368085 - DNA, 10 bp, Homo sapiens
ctttactgta

SEQ ID NO: 3368086 - DNA, 15 bp, Homo sapiens
ctttacttgtggtgt

SEQ ID NO: 3368087 - DNA, 21 bp, Homo sapiens
ctttacttgtggtgtgaccat

SEQ ID NO: 3368088 - DNA, 14 bp, Homo sapiens
ctttacttttaaac

SEQ ID NO: 3368089 - DNA, 15 bp, Homo sapiens
ctttagaaataaatg

SEQ ID NO: 3368090 - DNA, 16 bp, Homo sapiens
ctttagaaataaatgt

SEQ ID NO: 3368091 - DNA, 15 bp, Homo sapiens
ctttagaagcctgca

SEQ ID NO: 3368092 - DNA, 19 bp, Homo sapiens
ctttagaagtgcatttctg

SEQ ID NO: 3368093 - DNA, 20 bp, Homo sapiens
ctttagaattaatttattaa

SEQ ID NO: 3368094 - DNA, 14 bp, Homo sapiens
ctttagaccctggg

SEQ ID NO: 3368095 - DNA, 13 bp, Homo sapiens
ctttagagtagca

SEQ ID NO: 3368096 - DNA, 17 bp, Homo sapiens
ctttagatgctgatgat

SEQ ID NO: 3368097 - DNA, 13 bp, Homo sapiens
ctttagcacgttt

SEQ ID NO: 3368098 - DNA, 17 bp, Homo sapiens
ctttagcacgtttaaag

SEQ ID NO: 3368099 - DNA, 21 bp, Homo sapiens
ctttagcacgtttaaagttct

SEQ ID NO: 3368100 - DNA, 15 bp, Homo sapiens
ctttagggcagcttg

SEQ ID NO: 3368101 - DNA, 14 bp, Homo sapiens
ctttaggtcaaact

SEQ ID NO: 3368102 - DNA, 14 bp, Homo sapiens
ctttaggtctggtt

SEQ ID NO: 3368103 - DNA, 13 bp, Homo sapiens
ctttaggtttttt

SEQ ID NO: 3368104 - DNA, 13 bp, Homo sapiens
ctttagtataatt

SEQ ID NO: 3368105 - DNA, 21 bp, Homo sapiens
ctttagtccacggacccccag

SEQ ID NO: 3368106 - DNA, 15 bp, Homo sapiens
ctttagtgtatttat

SEQ ID NO: 3368107 - DNA, 23 bp, Homo sapiens
ctttagttttgattttggaaaga

SEQ ID NO: 3368108 - DNA, 21 bp, Homo sapiens
ctttagtttttggttgggaat

SEQ ID NO: 3368109 - DNA, 18 bp, Homo sapiens
ctttataactaacatgtc

SEQ ID NO: 3368110 - DNA, 20 bp, Homo sapiens
ctttataagtcattgtatgt

SEQ ID NO: 3368111 - DNA, 14 bp, Homo sapiens
ctttatacagattt

SEQ ID NO: 3368112 - DNA, 21 bp, Homo sapiens
ctttatagaaggaatttgtac

SEQ ID NO: 3368113 - DNA, 22 bp, Homo sapiens
ctttatagaaggaatttgtact

SEQ ID NO: 3368114 - DNA, 13 bp, Homo sapiens
ctttatagatgta

SEQ ID NO: 3368115 - DNA, 13 bp, Homo sapiens
ctttatatttagt

SEQ ID NO: 3368116 - DNA, 23 bp, Homo sapiens
ctttatcacaaccaccgttacaa

SEQ ID NO: 3368117 - DNA, 15 bp, Homo sapiens
ctttatctcctgctc

SEQ ID NO: 3368118 - DNA, 23 bp, Homo sapiens
ctttatgactgtttttgtagtgg

SEQ ID NO: 3368119 - DNA, 21 bp, Homo sapiens
ctttatgctgtattttaacac

SEQ ID NO: 3368120 - DNA, 20 bp, Homo sapiens
ctttatgtgatataaggatt

SEQ ID NO: 3368121 - DNA, 17 bp, Homo sapiens
ctttatgttgtatgatt

SEQ ID NO: 3368122 - DNA, 21 bp, Homo sapiens
ctttattaaatacaaaacttc

SEQ ID NO: 3368123 - DNA, 15 bp, Homo sapiens
ctttattaatgtttt

SEQ ID NO: 3368124 - DNA, 19 bp, Homo sapiens
ctttattaatgttttcaaa

SEQ ID NO: 3368125 - DNA, 19 bp, Homo sapiens
ctttattacaatttgtatt

SEQ ID NO: 3368126 - DNA, 14 bp, Homo sapiens
ctttattaccccct

SEQ ID NO: 3368127 - DNA, 14 bp, Homo sapiens
ctttattactcccc

SEQ ID NO: 3368128 - DNA, 17 bp, Homo sapiens
ctttattataatcaaag

SEQ ID NO: 3368129 - DNA, 23 bp, Homo sapiens
ctttattatggcttgtgaactgc

SEQ ID NO: 3368130 - DNA, 20 bp, Homo sapiens
ctttattccagaatgctgta

SEQ ID NO: 3368131 - DNA, 23 bp, Homo sapiens
ctttattccagaatgctgtacat

SEQ ID NO: 3368132 - DNA, 19 bp, Homo sapiens
ctttattgcttttttgtat

SEQ ID NO: 3368133 - DNA, 16 bp, Homo sapiens
ctttattggctgagat

SEQ ID NO: 3368134 - DNA, 20 bp, Homo sapiens
ctttattgggtatcaagaca

SEQ ID NO: 3368135 - DNA, 16 bp, Homo sapiens
ctttatttatttatat

SEQ ID NO: 3368136 - DNA, 14 bp, Homo sapiens
ctttatttcacata

SEQ ID NO: 3368137 - DNA, 18 bp, Homo sapiens
ctttattttctggtagat

SEQ ID NO: 3368138 - DNA, 21 bp, Homo sapiens
ctttattttttaagtatttat

SEQ ID NO: 3368139 - DNA, 21 bp, Homo sapiens
ctttcaaaagaagagttttag

SEQ ID NO: 3368140 - DNA, 18 bp, Homo sapiens
ctttcaaaatatattttg

SEQ ID NO: 3368141 - DNA, 14 bp, Homo sapiens
ctttcaaagacaat

SEQ ID NO: 3368142 - DNA, 22 bp, Homo sapiens
ctttcaaagacaatcactgaaa

SEQ ID NO: 3368143 - DNA, 18 bp, Homo sapiens
ctttcaaagctaaaatat

SEQ ID NO: 3368144 - DNA, 22 bp, Homo sapiens
ctttcaagcagtcgtgcctgtg

SEQ ID NO: 3368145 - DNA, 23 bp, Homo sapiens
ctttcaagtgcctttctgcagtt

SEQ ID NO: 3368146 - DNA, 16 bp, Homo sapiens
ctttcacaaccttctg

SEQ ID NO: 3368147 - DNA, 20 bp, Homo sapiens
ctttcacaaggtataataag

SEQ ID NO: 3368148 - DNA, 14 bp, Homo sapiens
ctttcacagctcct

SEQ ID NO: 3368149 - DNA, 15 bp, Homo sapiens
ctttcacagctcctc

SEQ ID NO: 3368150 - DNA, 18 bp, Homo sapiens
ctttcacagctcctccca

SEQ ID NO: 3368151 - DNA, 22 bp, Homo sapiens
ctttcacattgtttgctgctat

SEQ ID NO: 3368152 - DNA, 21 bp, Homo sapiens
ctttcagaaatataacacatt

SEQ ID NO: 3368153 - DNA, 15 bp, Homo sapiens
ctttcagagccagtg

SEQ ID NO: 3368154 - DNA, 20 bp, Homo sapiens
ctttcagagccagtgaagga

SEQ ID NO: 3368155 - DNA, 20 bp, Homo sapiens
ctttcagatgaccttttgga

SEQ ID NO: 3368156 - DNA, 12 bp, Homo sapiens
ctttcagatgtc

SEQ ID NO: 3368157 - DNA, 16 bp, Homo sapiens
ctttcagatgtcttct

SEQ ID NO: 3368158 - DNA, 20 bp, Homo sapiens
ctttcagatgtcttctgcct

SEQ ID NO: 3368159 - DNA, 21 bp, Homo sapiens
ctttcagatgtcttctgcctg

SEQ ID NO: 3368160 - DNA, 13 bp, Homo sapiens
ctttcagatgttt

SEQ ID NO: 3368161 - DNA, 19 bp, Homo sapiens
ctttcagcactcagaaaag

SEQ ID NO: 3368162 - DNA, 20 bp, Homo sapiens
ctttcagggaatttcaggaa

SEQ ID NO: 3368163 - DNA, 17 bp, Homo sapiens
ctttcagggccatggtt

SEQ ID NO: 3368164 - DNA, 14 bp, Homo sapiens
ctttcagtactttt

SEQ ID NO: 3368165 - DNA, 21 bp, Homo sapiens
ctttcagtacttttttaaata

SEQ ID NO: 3368166 - DNA, 16 bp, Homo sapiens
ctttcatcacactggg

SEQ ID NO: 3368167 - DNA, 18 bp, Homo sapiens
ctttcattccttcagatt

SEQ ID NO: 3368168 - DNA, 18 bp, Homo sapiens
ctttcattgccagtgtct

SEQ ID NO: 3368169 - DNA, 13 bp, Homo sapiens
ctttccaaattat

SEQ ID NO: 3368170 - DNA, 18 bp, Homo sapiens
ctttccacatttgtcaca

SEQ ID NO: 3368171 - DNA, 19 bp, Homo sapiens
ctttccacatttgtcacag

SEQ ID NO: 3368172 - DNA, 20 bp, Homo sapiens
ctttccacttcttcctttct

SEQ ID NO: 3368173 - DNA, 20 bp, Homo sapiens
ctttccagcctcctgctggc

SEQ ID NO: 3368174 - DNA, 21 bp, Homo sapiens
ctttccaggcttccctgactt

SEQ ID NO: 3368175 - DNA, 18 bp, Homo sapiens
ctttccatgggagccagc

SEQ ID NO: 3368176 - DNA, 14 bp, Homo sapiens
ctttccatttggta

SEQ ID NO: 3368177 - DNA, 15 bp, Homo sapiens
ctttcccaggccgca

SEQ ID NO: 3368178 - DNA, 14 bp, Homo sapiens
ctttccccagccca

SEQ ID NO: 3368179 - DNA, 15 bp, Homo sapiens
ctttccccagcccag

SEQ ID NO: 3368180 - DNA, 16 bp, Homo sapiens
ctttccccagcccagg

SEQ ID NO: 3368181 - DNA, 18 bp, Homo sapiens
ctttccccgggggaggaa

SEQ ID NO: 3368182 - DNA, 22 bp, Homo sapiens
ctttccccgggggaggaagggg

SEQ ID NO: 3368183 - DNA, 13 bp, Homo sapiens
ctttcccctctct

SEQ ID NO: 3368184 - DNA, 15 bp, Homo sapiens
ctttcccctctctgc

SEQ ID NO: 3368185 - DNA, 17 bp, Homo sapiens
ctttcccctctctgccc

SEQ ID NO: 3368186 - DNA, 13 bp, Homo sapiens
ctttcccctgtgg

SEQ ID NO: 3368187 - DNA, 14 bp, Homo sapiens
ctttcccctgtggg

SEQ ID NO: 3368188 - DNA, 13 bp, Homo sapiens
ctttccccttccc

SEQ ID NO: 3368189 - DNA, 14 bp, Homo sapiens
ctttccccttcccc

SEQ ID NO: 3368190 - DNA, 14 bp, Homo sapiens
ctttccctgtgcca

SEQ ID NO: 3368191 - DNA, 14 bp, Homo sapiens
ctttcccttccagt

SEQ ID NO: 3368192 - DNA, 17 bp, Homo sapiens
ctttcccttttctgttt

SEQ ID NO: 3368193 - DNA, 19 bp, Homo sapiens
ctttccgctgtcgccccag

SEQ ID NO: 3368194 - DNA, 15 bp, Homo sapiens
ctttccggcacactg

SEQ ID NO: 3368195 - DNA, 18 bp, Homo sapiens
ctttccggcacactgcca

SEQ ID NO: 3368196 - DNA, 21 bp, Homo sapiens
ctttccggcacactgccaaat

SEQ ID NO: 3368197 - DNA, 15 bp, Homo sapiens
ctttcctaggcccag

SEQ ID NO: 3368198 - DNA, 20 bp, Homo sapiens
ctttcctaggcccaggcctg

SEQ ID NO: 3368199 - DNA, 14 bp, Homo sapiens
ctttcctcctacct

SEQ ID NO: 3368200 - DNA, 13 bp, Homo sapiens
ctttcctcgcctg

SEQ ID NO: 3368201 - DNA, 19 bp, Homo sapiens
ctttcctcttccccttgcc

SEQ ID NO: 3368202 - DNA, 12 bp, Homo sapiens
ctttcctgcccc

SEQ ID NO: 3368203 - DNA, 23 bp, Homo sapiens
ctttcctggacactcagacctga

SEQ ID NO: 3368204 - DNA, 13 bp, Homo sapiens
ctttcctgggcct

SEQ ID NO: 3368205 - DNA, 18 bp, Homo sapiens
ctttcctgttcagcattc

SEQ ID NO: 3368206 - DNA, 13 bp, Homo sapiens
ctttcctgtttcc

SEQ ID NO: 3368207 - DNA, 13 bp, Homo sapiens
ctttcctgtttct

SEQ ID NO: 3368208 - DNA, 13 bp, Homo sapiens
ctttccttcctaa

SEQ ID NO: 3368209 - DNA, 14 bp, Homo sapiens
ctttccttcctaat

SEQ ID NO: 3368210 - DNA, 16 bp, Homo sapiens
ctttccttctccagga

SEQ ID NO: 3368211 - DNA, 15 bp, Homo sapiens
ctttcgtcacccttg

SEQ ID NO: 3368212 - DNA, 13 bp, Homo sapiens
ctttctaagaaat

SEQ ID NO: 3368213 - DNA, 15 bp, Homo sapiens
ctttctaatgtttct

SEQ ID NO: 3368214 - DNA, 15 bp, Homo sapiens
ctttctacaatgtga

SEQ ID NO: 3368215 - DNA, 18 bp, Homo sapiens
ctttctacaatgtgaact

SEQ ID NO: 3368216 - DNA, 20 bp, Homo sapiens
ctttctacaatgtgaacttt

SEQ ID NO: 3368217 - DNA, 16 bp, Homo sapiens
ctttctacccagcgag

SEQ ID NO: 3368218 - DNA, 14 bp, Homo sapiens
ctttctagctgttg

SEQ ID NO: 3368219 - DNA, 21 bp, Homo sapiens
ctttctagtcctattctattg

SEQ ID NO: 3368220 - DNA, 18 bp, Homo sapiens
ctttctagtggtctttgt

SEQ ID NO: 3368221 - DNA, 21 bp, Homo sapiens
ctttctagtggtctttgtaag

SEQ ID NO: 3368222 - DNA, 17 bp, Homo sapiens
ctttctagttcaatgcc

SEQ ID NO: 3368223 - DNA, 17 bp, Homo sapiens
ctttctatataaaatgt

SEQ ID NO: 3368224 - DNA, 23 bp, Homo sapiens
ctttctattttcacaattattaa

SEQ ID NO: 3368225 - DNA, 13 bp, Homo sapiens
ctttctccagcca

SEQ ID NO: 3368226 - DNA, 13 bp, Homo sapiens
ctttctccaggac

SEQ ID NO: 3368227 - DNA, 14 bp, Homo sapiens
ctttctccaggacc

SEQ ID NO: 3368228 - DNA, 18 bp, Homo sapiens
ctttctcccactgagttt

SEQ ID NO: 3368229 - DNA, 15 bp, Homo sapiens
ctttctccccatccc

SEQ ID NO: 3368230 - DNA, 21 bp, Homo sapiens
ctttctcccccgacactgctg

SEQ ID NO: 3368231 - DNA, 14 bp, Homo sapiens
ctttctccggggtc

SEQ ID NO: 3368232 - DNA, 21 bp, Homo sapiens
ctttctccggggtctgtgctg

SEQ ID NO: 3368233 - DNA, 12 bp, Homo sapiens
ctttctcctgtt

SEQ ID NO: 3368234 - DNA, 22 bp, Homo sapiens
ctttctcctgtttattcccatc

SEQ ID NO: 3368235 - DNA, 22 bp, Homo sapiens
ctttctctcagccttacatttg

SEQ ID NO: 3368236 - DNA, 14 bp, Homo sapiens
ctttctctcagtga

SEQ ID NO: 3368237 - DNA, 14 bp, Homo sapiens
ctttctctcctagt

SEQ ID NO: 3368238 - DNA, 15 bp, Homo sapiens
ctttctctctcctct

SEQ ID NO: 3368239 - DNA, 14 bp, Homo sapiens
ctttctctgccagt

SEQ ID NO: 3368240 - DNA, 13 bp, Homo sapiens
ctttctctgtagt

SEQ ID NO: 3368241 - DNA, 13 bp, Homo sapiens
ctttctctttctc

SEQ ID NO: 3368242 - DNA, 12 bp, Homo sapiens
ctttctcttttc

SEQ ID NO: 3368243 - DNA, 21 bp, Homo sapiens
ctttctgagcacactttagtg

SEQ ID NO: 3368244 - DNA, 16 bp, Homo sapiens
ctttctgcacacaaat

SEQ ID NO: 3368245 - DNA, 19 bp, Homo sapiens
ctttctgcacacaaatatt

SEQ ID NO: 3368246 - DNA, 15 bp, Homo sapiens
ctttctgcagttttt

SEQ ID NO: 3368247 - DNA, 22 bp, Homo sapiens
ctttctgccatctagccagccc

SEQ ID NO: 3368248 - DNA, 15 bp, Homo sapiens
ctttctgccttggcc

SEQ ID NO: 3368249 - DNA, 12 bp, Homo sapiens
ctttctggactg

SEQ ID NO: 3368250 - DNA, 15 bp, Homo sapiens
ctttctggcctgcct

SEQ ID NO: 3368251 - DNA, 13 bp, Homo sapiens
ctttctggctctc

SEQ ID NO: 3368252 - DNA, 17 bp, Homo sapiens
ctttctgggagcagaaa

SEQ ID NO: 3368253 - DNA, 13 bp, Homo sapiens
ctttctgtaaact

SEQ ID NO: 3368254 - DNA, 16 bp, Homo sapiens
ctttctgtaaccataa

SEQ ID NO: 3368255 - DNA, 18 bp, Homo sapiens
ctttctgtatatactttt

SEQ ID NO: 3368256 - DNA, 20 bp, Homo sapiens
ctttctgtatatactttttt

SEQ ID NO: 3368257 - DNA, 15 bp, Homo sapiens
ctttctgtgcttgga

SEQ ID NO: 3368258 - DNA, 12 bp, Homo sapiens
ctttctgttcca

SEQ ID NO: 3368259 - DNA, 15 bp, Homo sapiens
ctttctgttccaaat

SEQ ID NO: 3368260 - DNA, 22 bp, Homo sapiens
ctttctgttccaaattcagttt

SEQ ID NO: 3368261 - DNA, 15 bp, Homo sapiens
ctttctgttggtgta

SEQ ID NO: 3368262 - DNA, 15 bp, Homo sapiens
ctttcttaattttgt

SEQ ID NO: 3368263 - DNA, 14 bp, Homo sapiens
ctttcttataaatt

SEQ ID NO: 3368264 - DNA, 21 bp, Homo sapiens
ctttcttccctcgtgacagtg

SEQ ID NO: 3368265 - DNA, 15 bp, Homo sapiens
ctttcttctgccctt

SEQ ID NO: 3368266 - DNA, 14 bp, Homo sapiens
ctttcttgctccct

SEQ ID NO: 3368267 - DNA, 20 bp, Homo sapiens
ctttcttgctcccttcagcc

SEQ ID NO: 3368268 - DNA, 17 bp, Homo sapiens
ctttcttgctggctctg

SEQ ID NO: 3368269 - DNA, 20 bp, Homo sapiens
ctttcttgctggctctgaga

SEQ ID NO: 3368270 - DNA, 21 bp, Homo sapiens
ctttcttgctggctctgagaa

SEQ ID NO: 3368271 - DNA, 21 bp, Homo sapiens
ctttcttgctggttgtcattt

SEQ ID NO: 3368272 - DNA, 18 bp, Homo sapiens
ctttctttacctgagacc

SEQ ID NO: 3368273 - DNA, 16 bp, Homo sapiens
ctttctttcagatgtt

SEQ ID NO: 3368274 - DNA, 17 bp, Homo sapiens
ctttctttcagatgttt

SEQ ID NO: 3368275 - DNA, 21 bp, Homo sapiens
ctttctttccaaaacatttct

SEQ ID NO: 3368276 - DNA, 18 bp, Homo sapiens
ctttctttggtgcctttc

SEQ ID NO: 3368277 - DNA, 23 bp, Homo sapiens
ctttctttggtgcctttcctgtt

SEQ ID NO: 3368278 - DNA, 14 bp, Homo sapiens
ctttctttttcttc

SEQ ID NO: 3368279 - DNA, 20 bp, Homo sapiens
ctttctttttcttcttccct

SEQ ID NO: 3368280 - DNA, 14 bp, Homo sapiens
ctttgaaagaagca

SEQ ID NO: 3368281 - DNA, 16 bp, Homo sapiens
ctttgaaatacctcat

SEQ ID NO: 3368282 - DNA, 21 bp, Homo sapiens
ctttgaaatacctcatgttta

SEQ ID NO: 3368283 - DNA, 17 bp, Homo sapiens
ctttgaagctgaaaata

SEQ ID NO: 3368284 - DNA, 16 bp, Homo sapiens
ctttgacaactaaaat

SEQ ID NO: 3368285 - DNA, 21 bp, Homo sapiens
ctttgacaattgggagctgcc

SEQ ID NO: 3368286 - DNA, 22 bp, Homo sapiens
ctttgacaattgggagctgcca

SEQ ID NO: 3368287 - DNA, 23 bp, Homo sapiens
ctttgacaattgggagctgccaa

SEQ ID NO: 3368288 - DNA, 20 bp, Homo sapiens
ctttgacgagtcaccttcca

SEQ ID NO: 3368289 - DNA, 18 bp, Homo sapiens
ctttgactcagaggctgg

SEQ ID NO: 3368290 - DNA, 21 bp, Homo sapiens
ctttgactgatgctgagattc

SEQ ID NO: 3368291 - DNA, 20 bp, Homo sapiens
ctttgacttcagctgcctga

SEQ ID NO: 3368292 - DNA, 17 bp, Homo sapiens
ctttgagaagccttcag

SEQ ID NO: 3368293 - DNA, 19 bp, Homo sapiens
ctttgagaagccttcagct

SEQ ID NO: 3368294 - DNA, 13 bp, Homo sapiens
ctttgagacagtt

SEQ ID NO: 3368295 - DNA, 15 bp, Homo sapiens
ctttgagacagtttc

SEQ ID NO: 3368296 - DNA, 23 bp, Homo sapiens
ctttgagatgtgttcctcctgct

SEQ ID NO: 3368297 - DNA, 14 bp, Homo sapiens
ctttgagggactgc

SEQ ID NO: 3368298 - DNA, 18 bp, Homo sapiens
ctttgagggactgcctct

SEQ ID NO: 3368299 - DNA, 20 bp, Homo sapiens
ctttgagggactgcctctgc

SEQ ID NO: 3368300 - DNA, 20 bp, Homo sapiens
ctttgagtcccccagagatg

SEQ ID NO: 3368301 - DNA, 13 bp, Homo sapiens
ctttgagttatag

SEQ ID NO: 3368302 - DNA, 13 bp, Homo sapiens
ctttgataatgtt

SEQ ID NO: 3368303 - DNA, 14 bp, Homo sapiens
ctttgataatgtta

SEQ ID NO: 3368304 - DNA, 15 bp, Homo sapiens
ctttgatcccagaaa

SEQ ID NO: 3368305 - DNA, 18 bp, Homo sapiens
ctttgatctggacagaac

SEQ ID NO: 3368306 - DNA, 23 bp, Homo sapiens
ctttgatctggacagaacattta

SEQ ID NO: 3368307 - DNA, 18 bp, Homo sapiens
ctttgatgagcatttgtt

SEQ ID NO: 3368308 - DNA, 19 bp, Homo sapiens
ctttgattcatagtaactt

SEQ ID NO: 3368309 - DNA, 13 bp, Homo sapiens
ctttgattctcct

SEQ ID NO: 3368310 - DNA, 16 bp, Homo sapiens
ctttgattgaagtatt

SEQ ID NO: 3368311 - DNA, 13 bp, Homo sapiens
ctttgatttacag

SEQ ID NO: 3368312 - DNA, 18 bp, Homo sapiens
ctttgcaatccaaataaa

SEQ ID NO: 3368313 - DNA, 19 bp, Homo sapiens
ctttgcaatccaaataaag

SEQ ID NO: 3368314 - DNA, 17 bp, Homo sapiens
ctttgcacaggaaagag

SEQ ID NO: 3368315 - DNA, 21 bp, Homo sapiens
ctttgcacaggaaagagtcac

SEQ ID NO: 3368316 - DNA, 14 bp, Homo sapiens
ctttgcacattttg

SEQ ID NO: 3368317 - DNA, 14 bp, Homo sapiens
ctttgcaccaaaga

SEQ ID NO: 3368318 - DNA, 15 bp, Homo sapiens
ctttgcaccaaagac

SEQ ID NO: 3368319 - DNA, 18 bp, Homo sapiens
ctttgcaccaaagacatc

SEQ ID NO: 3368320 - DNA, 14 bp, Homo sapiens
ctttgcaccctgta

SEQ ID NO: 3368321 - DNA, 15 bp, Homo sapiens
ctttgcactgagggc

SEQ ID NO: 3368322 - DNA, 22 bp, Homo sapiens
ctttgcactgagggccacacta

SEQ ID NO: 3368323 - DNA, 12 bp, Homo sapiens
ctttgcacttaa

SEQ ID NO: 3368324 - DNA, 14 bp, Homo sapiens
ctttgcagacaggc

SEQ ID NO: 3368325 - DNA, 19 bp, Homo sapiens
ctttgcaggctctgggctc

SEQ ID NO: 3368326 - DNA, 15 bp, Homo sapiens
ctttgcagggcagcc

SEQ ID NO: 3368327 - DNA, 12 bp, Homo sapiens
ctttgcagggct

SEQ ID NO: 3368328 - DNA, 21 bp, Homo sapiens
ctttgcagttggactctcagg

SEQ ID NO: 3368329 - DNA, 22 bp, Homo sapiens
ctttgcagttggactctcaggg

SEQ ID NO: 3368330 - DNA, 21 bp, Homo sapiens
ctttgcatatgagccgtgaac

SEQ ID NO: 3368331 - DNA, 14 bp, Homo sapiens
ctttgccaaaaaaa

SEQ ID NO: 3368332 - DNA, 16 bp, Homo sapiens
ctttgccaaaatacca

SEQ ID NO: 3368333 - DNA, 22 bp, Homo sapiens
ctttgccaaaataccagagcct

SEQ ID NO: 3368334 - DNA, 20 bp, Homo sapiens
ctttgccagcttttcctccc

SEQ ID NO: 3368335 - DNA, 21 bp, Homo sapiens
ctttgccatcaatgatcatat

SEQ ID NO: 3368336 - DNA, 22 bp, Homo sapiens
ctttgcccaacaccagcccctg

SEQ ID NO: 3368337 - DNA, 22 bp, Homo sapiens
ctttgcctttatctctgaggct

SEQ ID NO: 3368338 - DNA, 18 bp, Homo sapiens
ctttgctacaaatttatg

SEQ ID NO: 3368339 - DNA, 20 bp, Homo sapiens
ctttgctacaaatttatgca

SEQ ID NO: 3368340 - DNA, 16 bp, Homo sapiens
ctttgctcttgtccca

SEQ ID NO: 3368341 - DNA, 14 bp, Homo sapiens
ctttgctgccttaa

SEQ ID NO: 3368342 - DNA, 23 bp, Homo sapiens
ctttgctgctatgaaaatgagca

SEQ ID NO: 3368343 - DNA, 18 bp, Homo sapiens
ctttgctggaagaaacta

SEQ ID NO: 3368344 - DNA, 14 bp, Homo sapiens
ctttgctgtactct

SEQ ID NO: 3368345 - DNA, 19 bp, Homo sapiens
ctttgctgtactcttgctg

SEQ ID NO: 3368346 - DNA, 17 bp, Homo sapiens
ctttgctgtgaggctgt

SEQ ID NO: 3368347 - DNA, 23 bp, Homo sapiens
ctttgcttatgaatatttataac

SEQ ID NO: 3368348 - DNA, 14 bp, Homo sapiens
ctttgcttgaacac

SEQ ID NO: 3368349 - DNA, 15 bp, Homo sapiens
ctttgcttgaacaca

SEQ ID NO: 3368350 - DNA, 22 bp, Homo sapiens
ctttgcttgaacacagtatttt

SEQ ID NO: 3368351 - DNA, 13 bp, Homo sapiens
ctttgcttgcttt

SEQ ID NO: 3368352 - DNA, 19 bp, Homo sapiens
ctttgcttgctttgaagta

SEQ ID NO: 3368353 - DNA, 23 bp, Homo sapiens
ctttggaaaaatgggtcttttat

SEQ ID NO: 3368354 - DNA, 24 bp, Homo sapiens
ctttggaaagtacactctgctgtt

SEQ ID NO: 3368355 - DNA, 17 bp, Homo sapiens
ctttggaagtttgtgtt

SEQ ID NO: 3368356 - DNA, 17 bp, Homo sapiens
ctttggacctaatccaa

SEQ ID NO: 3368357 - DNA, 20 bp, Homo sapiens
ctttggagaacgccagtctc

SEQ ID NO: 3368358 - DNA, 14 bp, Homo sapiens
ctttggagtcccct

SEQ ID NO: 3368359 - DNA, 16 bp, Homo sapiens
ctttggagtcccctca

SEQ ID NO: 3368360 - DNA, 14 bp, Homo sapiens
ctttggagttaaaa

SEQ ID NO: 3368361 - DNA, 18 bp, Homo sapiens
ctttggattctaaataca

SEQ ID NO: 3368362 - DNA, 15 bp, Homo sapiens
ctttggatttgacat

SEQ ID NO: 3368363 - DNA, 17 bp, Homo sapiens
ctttggcaatttcctgg

SEQ ID NO: 3368364 - DNA, 18 bp, Homo sapiens
ctttggcaatttcctggc

SEQ ID NO: 3368365 - DNA, 22 bp, Homo sapiens
ctttggcaatttcctggccctc

SEQ ID NO: 3368366 - DNA, 14 bp, Homo sapiens
ctttggctgagggg

SEQ ID NO: 3368367 - DNA, 17 bp, Homo sapiens
ctttggctgaggggctt

SEQ ID NO: 3368368 - DNA, 21 bp, Homo sapiens
ctttgggaaaacatgttaatg

SEQ ID NO: 3368369 - DNA, 18 bp, Homo sapiens
ctttgggaaagcccagac

SEQ ID NO: 3368370 - DNA, 15 bp, Homo sapiens
ctttgggatttaatt

SEQ ID NO: 3368371 - DNA, 20 bp, Homo sapiens
ctttgggatttaatttccag

SEQ ID NO: 3368372 - DNA, 23 bp, Homo sapiens
ctttgggccgaatcccccaggga

SEQ ID NO: 3368373 - DNA, 19 bp, Homo sapiens
ctttgggctgccctggtgc

SEQ ID NO: 3368374 - DNA, 20 bp, Homo sapiens
ctttggggacagttggcaga

SEQ ID NO: 3368375 - DNA, 22 bp, Homo sapiens
ctttggggacagttggcagaga

SEQ ID NO: 3368376 - DNA, 24 bp, Homo sapiens
ctttggggacagttggcagagaag

SEQ ID NO: 3368377 - DNA, 13 bp, Homo sapiens
ctttggggagcag

SEQ ID NO: 3368378 - DNA, 19 bp, Homo sapiens
ctttgggtctacaagtata

SEQ ID NO: 3368379 - DNA, 10 bp, Homo sapiens
ctttggtaat

SEQ ID NO: 3368380 - DNA, 14 bp, Homo sapiens
ctttggtctatttt

SEQ ID NO: 3368381 - DNA, 13 bp, Homo sapiens
ctttggtgcctca

SEQ ID NO: 3368382 - DNA, 15 bp, Homo sapiens
ctttggtgcctcact

SEQ ID NO: 3368383 - DNA, 20 bp, Homo sapiens
ctttggtgcctttcctgttc

SEQ ID NO: 3368384 - DNA, 14 bp, Homo sapiens
ctttggttctaagg

SEQ ID NO: 3368385 - DNA, 15 bp, Homo sapiens
ctttggttctaagga

SEQ ID NO: 3368386 - DNA, 14 bp, Homo sapiens
ctttggttctggcc

SEQ ID NO: 3368387 - DNA, 23 bp, Homo sapiens
ctttggtttttttcttctgtatt

SEQ ID NO: 3368388 - DNA, 16 bp, Homo sapiens
ctttgtaaaaatcttt

SEQ ID NO: 3368389 - DNA, 20 bp, Homo sapiens
ctttgtaagagtgtagaagc

SEQ ID NO: 3368390 - DNA, 21 bp, Homo sapiens
ctttgtaatcactcccatttt

SEQ ID NO: 3368391 - DNA, 19 bp, Homo sapiens
ctttgtaatttaatgaaaa

SEQ ID NO: 3368392 - DNA, 16 bp, Homo sapiens
ctttgtaatttttggg

SEQ ID NO: 3368393 - DNA, 19 bp, Homo sapiens
ctttgtacagagtgctttt

SEQ ID NO: 3368394 - DNA, 19 bp, Homo sapiens
ctttgtaccccccaacccc

SEQ ID NO: 3368395 - DNA, 14 bp, Homo sapiens
ctttgtacttgtgt

SEQ ID NO: 3368396 - DNA, 21 bp, Homo sapiens
ctttgtagatccttagaggtc

SEQ ID NO: 3368397 - DNA, 20 bp, Homo sapiens
ctttgtaggtgagatgcaac

SEQ ID NO: 3368398 - DNA, 22 bp, Homo sapiens
ctttgtaggtgagatgcaacaa

SEQ ID NO: 3368399 - DNA, 15 bp, Homo sapiens
ctttgtcccggggct

SEQ ID NO: 3368400 - DNA, 17 bp, Homo sapiens
ctttgtcgtggttctta

SEQ ID NO: 3368401 - DNA, 18 bp, Homo sapiens
ctttgtcgtggttcttaa

SEQ ID NO: 3368402 - DNA, 20 bp, Homo sapiens
ctttgtctaactcagaatta

SEQ ID NO: 3368403 - DNA, 20 bp, Homo sapiens
ctttgtctcaaaataaagca

SEQ ID NO: 3368404 - DNA, 15 bp, Homo sapiens
ctttgtcttgtactt

SEQ ID NO: 3368405 - DNA, 16 bp, Homo sapiens
ctttgtcttgtacttc

SEQ ID NO: 3368406 - DNA, 22 bp, Homo sapiens
ctttgtgagccaaagcttatgt

SEQ ID NO: 3368407 - DNA, 18 bp, Homo sapiens
ctttgtgattatttcact

SEQ ID NO: 3368408 - DNA, 16 bp, Homo sapiens
ctttgtgcacatttat

SEQ ID NO: 3368409 - DNA, 20 bp, Homo sapiens
ctttgtgctacatgacgaca

SEQ ID NO: 3368410 - DNA, 14 bp, Homo sapiens
ctttgtgcttgggg

SEQ ID NO: 3368411 - DNA, 16 bp, Homo sapiens
ctttgtggatgtcttc

SEQ ID NO: 3368412 - DNA, 22 bp, Homo sapiens
ctttgtggccttcccccttcct

SEQ ID NO: 3368413 - DNA, 18 bp, Homo sapiens
ctttgtgtagctttgctc

SEQ ID NO: 3368414 - DNA, 15 bp, Homo sapiens
ctttgtgtgattgaa

SEQ ID NO: 3368415 - DNA, 12 bp, Homo sapiens
ctttgtgtttat

SEQ ID NO: 3368416 - DNA, 15 bp, Homo sapiens
ctttgtgtttatatg

SEQ ID NO: 3368417 - DNA, 19 bp, Homo sapiens
ctttgttaaaaatattttc

SEQ ID NO: 3368418 - DNA, 15 bp, Homo sapiens
ctttgttacaggcac

SEQ ID NO: 3368419 - DNA, 15 bp, Homo sapiens
ctttgttatgacagt

SEQ ID NO: 3368420 - DNA, 15 bp, Homo sapiens
ctttgttctgagcat

SEQ ID NO: 3368421 - DNA, 17 bp, Homo sapiens
ctttgtttcgtggggag

SEQ ID NO: 3368422 - DNA, 15 bp, Homo sapiens
ctttgtttcttgttt

SEQ ID NO: 3368423 - DNA, 16 bp, Homo sapiens
ctttgttttaataaac

SEQ ID NO: 3368424 - DNA, 24 bp, Homo sapiens
ctttgttttgatgtttgtggcctc

SEQ ID NO: 3368425 - DNA, 22 bp, Homo sapiens
cttttaaaaaatactctgctat

SEQ ID NO: 3368426 - DNA, 21 bp, Homo sapiens
cttttaaaaatgtagaaattc

SEQ ID NO: 3368427 - DNA, 22 bp, Homo sapiens
cttttaaaaatgtagaaattct

SEQ ID NO: 3368428 - DNA, 18 bp, Homo sapiens
cttttaaaacacttccat

SEQ ID NO: 3368429 - DNA, 13 bp, Homo sapiens
cttttaaactgtg

SEQ ID NO: 3368430 - DNA, 22 bp, Homo sapiens
cttttaaagaaaaatatgatac

SEQ ID NO: 3368431 - DNA, 17 bp, Homo sapiens
cttttaaattagaaaat

SEQ ID NO: 3368432 - DNA, 13 bp, Homo sapiens
cttttaacatttt

SEQ ID NO: 3368433 - DNA, 15 bp, Homo sapiens
cttttaacattttgt

SEQ ID NO: 3368434 - DNA, 21 bp, Homo sapiens
cttttaacattttgttcttac

SEQ ID NO: 3368435 - DNA, 14 bp, Homo sapiens
cttttaagaaacac

SEQ ID NO: 3368436 - DNA, 13 bp, Homo sapiens
cttttaagacatt

SEQ ID NO: 3368437 - DNA, 16 bp, Homo sapiens
cttttaagacattttc

SEQ ID NO: 3368438 - DNA, 14 bp, Homo sapiens
cttttaaggataaa

SEQ ID NO: 3368439 - DNA, 16 bp, Homo sapiens
cttttaatacagggta

SEQ ID NO: 3368440 - DNA, 14 bp, Homo sapiens
cttttaatataaaa

SEQ ID NO: 3368441 - DNA, 20 bp, Homo sapiens
cttttaattaaataaaagct

SEQ ID NO: 3368442 - DNA, 19 bp, Homo sapiens
cttttaccattagcataat

SEQ ID NO: 3368443 - DNA, 21 bp, Homo sapiens
cttttagccagagatgcaata

SEQ ID NO: 3368444 - DNA, 14 bp, Homo sapiens
cttttaggaaaatc

SEQ ID NO: 3368445 - DNA, 15 bp, Homo sapiens
cttttagttcatata

SEQ ID NO: 3368446 - DNA, 14 bp, Homo sapiens
cttttataaagcat

SEQ ID NO: 3368447 - DNA, 16 bp, Homo sapiens
cttttataaagcatgt

SEQ ID NO: 3368448 - DNA, 19 bp, Homo sapiens
cttttatactctttctgta

SEQ ID NO: 3368449 - DNA, 12 bp, Homo sapiens
cttttatagcta

SEQ ID NO: 3368450 - DNA, 14 bp, Homo sapiens
cttttatagctatt

SEQ ID NO: 3368451 - DNA, 21 bp, Homo sapiens
cttttataggtgagaaaaaaa

SEQ ID NO: 3368452 - DNA, 13 bp, Homo sapiens
cttttatcaaaca

SEQ ID NO: 3368453 - DNA, 13 bp, Homo sapiens
cttttatctcaga

SEQ ID NO: 3368454 - DNA, 16 bp, Homo sapiens
cttttatctgcagaac

SEQ ID NO: 3368455 - DNA, 21 bp, Homo sapiens
cttttatgcagatagaatcaa

SEQ ID NO: 3368456 - DNA, 20 bp, Homo sapiens
cttttatggatgattaaatt

SEQ ID NO: 3368457 - DNA, 13 bp, Homo sapiens
cttttatgtagca

SEQ ID NO: 3368458 - DNA, 14 bp, Homo sapiens
cttttattaataaa

SEQ ID NO: 3368459 - DNA, 18 bp, Homo sapiens
cttttattgacacagaaa

SEQ ID NO: 3368460 - DNA, 13 bp, Homo sapiens
cttttatttctcc

SEQ ID NO: 3368461 - DNA, 14 bp, Homo sapiens
cttttattttaata

SEQ ID NO: 3368462 - DNA, 15 bp, Homo sapiens
cttttcaaaacattt

SEQ ID NO: 3368463 - DNA, 22 bp, Homo sapiens
cttttcaaatagggtctaactc

SEQ ID NO: 3368464 - DNA, 23 bp, Homo sapiens
cttttcaaggaaaaatgctgctt

SEQ ID NO: 3368465 - DNA, 20 bp, Homo sapiens
cttttcacatagctgtctag

SEQ ID NO: 3368466 - DNA, 21 bp, Homo sapiens
cttttcacctccaactggatg

SEQ ID NO: 3368467 - DNA, 19 bp, Homo sapiens
cttttcactccctccatca

SEQ ID NO: 3368468 - DNA, 17 bp, Homo sapiens
cttttcactgctggctg

SEQ ID NO: 3368469 - DNA, 22 bp, Homo sapiens
cttttcacttcgggctgtgtaa

SEQ ID NO: 3368470 - DNA, 18 bp, Homo sapiens
cttttcagctgagccctg

SEQ ID NO: 3368471 - DNA, 23 bp, Homo sapiens
cttttcataaagggttgaaaatg

SEQ ID NO: 3368472 - DNA, 15 bp, Homo sapiens
cttttcattctcatt

SEQ ID NO: 3368473 - DNA, 17 bp, Homo sapiens
cttttcattctctttta

SEQ ID NO: 3368474 - DNA, 19 bp, Homo sapiens
cttttccactccattgtcg

SEQ ID NO: 3368475 - DNA, 19 bp, Homo sapiens
cttttccaggatcctgcag

SEQ ID NO: 3368476 - DNA, 20 bp, Homo sapiens
cttttccaggatcctgcagg

SEQ ID NO: 3368477 - DNA, 21 bp, Homo sapiens
cttttccaggatcctgcagga

SEQ ID NO: 3368478 - DNA, 20 bp, Homo sapiens
cttttcccctacagaatttt

SEQ ID NO: 3368479 - DNA, 14 bp, Homo sapiens
cttttcccctgtta

SEQ ID NO: 3368480 - DNA, 16 bp, Homo sapiens
cttttcccctgttaaa

SEQ ID NO: 3368481 - DNA, 19 bp, Homo sapiens
cttttcccctgttaaacag

SEQ ID NO: 3368482 - DNA, 14 bp, Homo sapiens
cttttccctctcta

SEQ ID NO: 3368483 - DNA, 13 bp, Homo sapiens
cttttccctgctt

SEQ ID NO: 3368484 - DNA, 23 bp, Homo sapiens
cttttccgttctgttctgctggg

SEQ ID NO: 3368485 - DNA, 14 bp, Homo sapiens
cttttcctcaagca

SEQ ID NO: 3368486 - DNA, 15 bp, Homo sapiens
cttttcctcccttgg

SEQ ID NO: 3368487 - DNA, 22 bp, Homo sapiens
cttttcctgataaagcacagct

SEQ ID NO: 3368488 - DNA, 11 bp, Homo sapiens
cttttcctgtc

SEQ ID NO: 3368489 - DNA, 13 bp, Homo sapiens
cttttcctgtcag

SEQ ID NO: 3368490 - DNA, 18 bp, Homo sapiens
cttttcctgtcagtgttt

SEQ ID NO: 3368491 - DNA, 21 bp, Homo sapiens
cttttcctgtcagtgtttttg

SEQ ID NO: 3368492 - DNA, 16 bp, Homo sapiens
cttttcctgttgtatt

SEQ ID NO: 3368493 - DNA, 16 bp, Homo sapiens
cttttccttccctttt

SEQ ID NO: 3368494 - DNA, 20 bp, Homo sapiens
cttttcgttaacattgacca

SEQ ID NO: 3368495 - DNA, 19 bp, Homo sapiens
cttttctaagaaaagcatt

SEQ ID NO: 3368496 - DNA, 21 bp, Homo sapiens
cttttctattccttctggcct

SEQ ID NO: 3368497 - DNA, 13 bp, Homo sapiens
cttttctgccctg

SEQ ID NO: 3368498 - DNA, 22 bp, Homo sapiens
cttttctggaagggcagcatat

SEQ ID NO: 3368499 - DNA, 21 bp, Homo sapiens
cttttctggggcccaggaagc

SEQ ID NO: 3368500 - DNA, 22 bp, Homo sapiens
cttttctggggcccaggaagcc

SEQ ID NO: 3368501 - DNA, 13 bp, Homo sapiens
cttttctgtattt

SEQ ID NO: 3368502 - DNA, 17 bp, Homo sapiens
cttttctgttctagttt

SEQ ID NO: 3368503 - DNA, 22 bp, Homo sapiens
cttttctgtttaggaagaagtg

SEQ ID NO: 3368504 - DNA, 20 bp, Homo sapiens
cttttcttaaagactgaaat

SEQ ID NO: 3368505 - DNA, 18 bp, Homo sapiens
cttttcttaacaacctgg

SEQ ID NO: 3368506 - DNA, 16 bp, Homo sapiens
cttttcttcattttgg

SEQ ID NO: 3368507 - DNA, 14 bp, Homo sapiens
cttttcttcctggc

SEQ ID NO: 3368508 - DNA, 18 bp, Homo sapiens
cttttctttaaagaagtt

SEQ ID NO: 3368509 - DNA, 14 bp, Homo sapiens
cttttctttaactt

SEQ ID NO: 3368510 - DNA, 20 bp, Homo sapiens
cttttcttttctaccctagc

SEQ ID NO: 3368511 - DNA, 14 bp, Homo sapiens
cttttcttttgtta

SEQ ID NO: 3368512 - DNA, 18 bp, Homo sapiens
cttttcttttgttactgt

SEQ ID NO: 3368513 - DNA, 20 bp, Homo sapiens
cttttcttttgttactgttc

SEQ ID NO: 3368514 - DNA, 21 bp, Homo sapiens
cttttcttttgttactgttct

SEQ ID NO: 3368515 - DNA, 22 bp, Homo sapiens
cttttcttttgttactgttctt

SEQ ID NO: 3368516 - DNA, 21 bp, Homo sapiens
cttttgaactgttagatgctg

SEQ ID NO: 3368517 - DNA, 21 bp, Homo sapiens
cttttgaagcatagataatat

SEQ ID NO: 3368518 - DNA, 13 bp, Homo sapiens
cttttgaatattc

SEQ ID NO: 3368519 - DNA, 13 bp, Homo sapiens
cttttgacatgtg

SEQ ID NO: 3368520 - DNA, 16 bp, Homo sapiens
cttttgaggtccctgt

SEQ ID NO: 3368521 - DNA, 20 bp, Homo sapiens
cttttgagtggtaatcatat

SEQ ID NO: 3368522 - DNA, 18 bp, Homo sapiens
cttttgcaacttaatact

SEQ ID NO: 3368523 - DNA, 12 bp, Homo sapiens
cttttgcacccc

SEQ ID NO: 3368524 - DNA, 14 bp, Homo sapiens
cttttgcagaagag

SEQ ID NO: 3368525 - DNA, 23 bp, Homo sapiens
cttttgcagaagagggtgtgttt

SEQ ID NO: 3368526 - DNA, 21 bp, Homo sapiens
cttttgcatgtcgcacaatgt

SEQ ID NO: 3368527 - DNA, 18 bp, Homo sapiens
cttttgccactgctgtgt

SEQ ID NO: 3368528 - DNA, 13 bp, Homo sapiens
cttttgcctggct

SEQ ID NO: 3368529 - DNA, 16 bp, Homo sapiens
cttttgctgcgcacca

SEQ ID NO: 3368530 - DNA, 24 bp, Homo sapiens
cttttgctttctgtttcttaaggg

SEQ ID NO: 3368531 - DNA, 15 bp, Homo sapiens
cttttgcttttggca

SEQ ID NO: 3368532 - DNA, 14 bp, Homo sapiens
cttttggaacattt

SEQ ID NO: 3368533 - DNA, 18 bp, Homo sapiens
cttttggaacatttcttt

SEQ ID NO: 3368534 - DNA, 19 bp, Homo sapiens
cttttgggcctccttccca

SEQ ID NO: 3368535 - DNA, 15 bp, Homo sapiens
cttttggtctgtgtg

SEQ ID NO: 3368536 - DNA, 15 bp, Homo sapiens
cttttggtgtgttgg

SEQ ID NO: 3368537 - DNA, 12 bp, Homo sapiens
cttttggtttaa

SEQ ID NO: 3368538 - DNA, 22 bp, Homo sapiens
cttttgtaaagaaatttactat

SEQ ID NO: 3368539 - DNA, 16 bp, Homo sapiens
cttttgtaattgtgta

SEQ ID NO: 3368540 - DNA, 21 bp, Homo sapiens
cttttgtaattgtgtaaaaaa

SEQ ID NO: 3368541 - DNA, 12 bp, Homo sapiens
cttttgtacatc

SEQ ID NO: 3368542 - DNA, 23 bp, Homo sapiens
cttttgtatacatcctgggtaat

SEQ ID NO: 3368543 - DNA, 15 bp, Homo sapiens
cttttgtatcttcct

SEQ ID NO: 3368544 - DNA, 17 bp, Homo sapiens
cttttgtccccagggcc

SEQ ID NO: 3368545 - DNA, 18 bp, Homo sapiens
cttttgtgcctggcttct

SEQ ID NO: 3368546 - DNA, 17 bp, Homo sapiens
cttttgtggtgtcttcc

SEQ ID NO: 3368547 - DNA, 16 bp, Homo sapiens
cttttgtgtaatgaaa

SEQ ID NO: 3368548 - DNA, 23 bp, Homo sapiens
cttttgtgtgatgcgccttgctg

SEQ ID NO: 3368549 - DNA, 10 bp, Homo sapiens
cttttgttac

SEQ ID NO: 3368550 - DNA, 12 bp, Homo sapiens
cttttgttactg

SEQ ID NO: 3368551 - DNA, 17 bp, Homo sapiens
cttttgttattccatca

SEQ ID NO: 3368552 - DNA, 13 bp, Homo sapiens
cttttgttcgcat

SEQ ID NO: 3368553 - DNA, 15 bp, Homo sapiens
cttttgttcttcccc

SEQ ID NO: 3368554 - DNA, 15 bp, Homo sapiens
cttttgttgtatggg

SEQ ID NO: 3368555 - DNA, 14 bp, Homo sapiens
cttttgttgtttat

SEQ ID NO: 3368556 - DNA, 21 bp, Homo sapiens
cttttgtttcccttgctttgt

SEQ ID NO: 3368557 - DNA, 12 bp, Homo sapiens
cttttgtttggt

SEQ ID NO: 3368558 - DNA, 14 bp, Homo sapiens
cttttgtttggtaa

SEQ ID NO: 3368559 - DNA, 15 bp, Homo sapiens
cttttgtttggtaaa

SEQ ID NO: 3368560 - DNA, 19 bp, Homo sapiens
ctttttaaaaactcttcag

SEQ ID NO: 3368561 - DNA, 19 bp, Homo sapiens
ctttttaaagtgtttctgt

SEQ ID NO: 3368562 - DNA, 20 bp, Homo sapiens
ctttttaaatgtaaagatat

SEQ ID NO: 3368563 - DNA, 21 bp, Homo sapiens
ctttttaaatgtaaagatatt

SEQ ID NO: 3368564 - DNA, 16 bp, Homo sapiens
ctttttaaatgtgaat

SEQ ID NO: 3368565 - DNA, 21 bp, Homo sapiens
ctttttaaatgtgaattttta

SEQ ID NO: 3368566 - DNA, 23 bp, Homo sapiens
ctttttaagatagacttattctt

SEQ ID NO: 3368567 - DNA, 20 bp, Homo sapiens
ctttttaaggtctttcagta

SEQ ID NO: 3368568 - DNA, 15 bp, Homo sapiens
ctttttaatatgctt

SEQ ID NO: 3368569 - DNA, 16 bp, Homo sapiens
ctttttaatatgctta

SEQ ID NO: 3368570 - DNA, 22 bp, Homo sapiens
ctttttaatattgatatgctta

SEQ ID NO: 3368571 - DNA, 16 bp, Homo sapiens
ctttttaatcatgaat

SEQ ID NO: 3368572 - DNA, 18 bp, Homo sapiens
ctttttaatcatgaatat

SEQ ID NO: 3368573 - DNA, 14 bp, Homo sapiens
ctttttaattgttg

SEQ ID NO: 3368574 - DNA, 16 bp, Homo sapiens
ctttttaattgttgtt

SEQ ID NO: 3368575 - DNA, 23 bp, Homo sapiens
ctttttaattgttgtttctttct

SEQ ID NO: 3368576 - DNA, 16 bp, Homo sapiens
ctttttagtaatttct

SEQ ID NO: 3368577 - DNA, 15 bp, Homo sapiens
ctttttataaaaaga

SEQ ID NO: 3368578 - DNA, 17 bp, Homo sapiens
ctttttattccctgccc

SEQ ID NO: 3368579 - DNA, 18 bp, Homo sapiens
ctttttatttaattaaat

SEQ ID NO: 3368580 - DNA, 21 bp, Homo sapiens
ctttttatttaattaaatgta

SEQ ID NO: 3368581 - DNA, 21 bp, Homo sapiens
ctttttatttctaaatgagac

SEQ ID NO: 3368582 - DNA, 13 bp, Homo sapiens
ctttttatttgca

SEQ ID NO: 3368583 - DNA, 14 bp, Homo sapiens
ctttttatttgcat

SEQ ID NO: 3368584 - DNA, 18 bp, Homo sapiens
ctttttattttaggcact

SEQ ID NO: 3368585 - DNA, 20 bp, Homo sapiens
ctttttcaatgaattttata

SEQ ID NO: 3368586 - DNA, 13 bp, Homo sapiens
ctttttcatttgc

SEQ ID NO: 3368587 - DNA, 17 bp, Homo sapiens
ctttttcatttgcctat

SEQ ID NO: 3368588 - DNA, 22 bp, Homo sapiens
ctttttccaactcagaaattca

SEQ ID NO: 3368589 - DNA, 12 bp, Homo sapiens
ctttttccacaa

SEQ ID NO: 3368590 - DNA, 14 bp, Homo sapiens
ctttttccatcatt

SEQ ID NO: 3368591 - DNA, 15 bp, Homo sapiens
ctttttccatcattt

SEQ ID NO: 3368592 - DNA, 17 bp, Homo sapiens
ctttttccatcatttta

SEQ ID NO: 3368593 - DNA, 16 bp, Homo sapiens
ctttttcccaataaat

SEQ ID NO: 3368594 - DNA, 16 bp, Homo sapiens
ctttttcctctgagcc

SEQ ID NO: 3368595 - DNA, 14 bp, Homo sapiens
ctttttctgttgta

SEQ ID NO: 3368596 - DNA, 18 bp, Homo sapiens
ctttttctgttgtaactt

SEQ ID NO: 3368597 - DNA, 14 bp, Homo sapiens
ctttttcttcctca

SEQ ID NO: 3368598 - DNA, 16 bp, Homo sapiens
ctttttcttgtattca

SEQ ID NO: 3368599 - DNA, 14 bp, Homo sapiens
ctttttctttttaa

SEQ ID NO: 3368600 - DNA, 13 bp, Homo sapiens
ctttttgaaatga

SEQ ID NO: 3368601 - DNA, 20 bp, Homo sapiens
ctttttgaggtggcactttt

SEQ ID NO: 3368602 - DNA, 18 bp, Homo sapiens
ctttttggactcagccca

SEQ ID NO: 3368603 - DNA, 22 bp, Homo sapiens
ctttttggctgacttcatctgg

SEQ ID NO: 3368604 - DNA, 23 bp, Homo sapiens
ctttttggctgacttcatctggg

SEQ ID NO: 3368605 - DNA, 16 bp, Homo sapiens
ctttttggtggatgta

SEQ ID NO: 3368606 - DNA, 17 bp, Homo sapiens
ctttttggtggatgtaa

SEQ ID NO: 3368607 - DNA, 17 bp, Homo sapiens
ctttttgtaaatactgc

SEQ ID NO: 3368608 - DNA, 21 bp, Homo sapiens
ctttttgtaaatactgcttga

SEQ ID NO: 3368609 - DNA, 11 bp, Homo sapiens
ctttttgtagg

SEQ ID NO: 3368610 - DNA, 16 bp, Homo sapiens
ctttttgtatgtgaac

SEQ ID NO: 3368611 - DNA, 23 bp, Homo sapiens
ctttttgtcgagtcaaactgtgg

SEQ ID NO: 3368612 - DNA, 17 bp, Homo sapiens
ctttttgttgtaaaaca

SEQ ID NO: 3368613 - DNA, 13 bp, Homo sapiens
cttttttaaataa

SEQ ID NO: 3368614 - DNA, 14 bp, Homo sapiens
cttttttaaataaa

SEQ ID NO: 3368615 - DNA, 17 bp, Homo sapiens
cttttttaaataaactt

SEQ ID NO: 3368616 - DNA, 18 bp, Homo sapiens
cttttttaaataaacttt

SEQ ID NO: 3368617 - DNA, 17 bp, Homo sapiens
cttttttaaatattttc

SEQ ID NO: 3368618 - DNA, 18 bp, Homo sapiens
cttttttaaattttcttc

SEQ ID NO: 3368619 - DNA, 20 bp, Homo sapiens
cttttttaagatttttctca

SEQ ID NO: 3368620 - DNA, 15 bp, Homo sapiens
cttttttatagctta

SEQ ID NO: 3368621 - DNA, 18 bp, Homo sapiens
cttttttatagcttaact

SEQ ID NO: 3368622 - DNA, 14 bp, Homo sapiens
cttttttcatttct

SEQ ID NO: 3368623 - DNA, 13 bp, Homo sapiens
cttttttcctaat

SEQ ID NO: 3368624 - DNA, 16 bp, Homo sapiens
cttttttcttatttaa

SEQ ID NO: 3368625 - DNA, 23 bp, Homo sapiens
cttttttgagtcattgacttcat

SEQ ID NO: 3368626 - DNA, 14 bp, Homo sapiens
cttttttgtctatg

SEQ ID NO: 3368627 - DNA, 21 bp, Homo sapiens
cttttttgtcttattgaaaaa

SEQ ID NO: 3368628 - DNA, 13 bp, Homo sapiens
cttttttgtgtat

SEQ ID NO: 3368629 - DNA, 16 bp, Homo sapiens
ctttttttacatttca

SEQ ID NO: 3368630 - DNA, 12 bp, Homo sapiens
ctttttttcaat

SEQ ID NO: 3368631 - DNA, 13 bp, Homo sapiens
ctttttttcaatg

SEQ ID NO: 3368632 - DNA, 14 bp, Homo sapiens
ctttttttcaatgt

SEQ ID NO: 3368633 - DNA, 16 bp, Homo sapiens
ctttttttccttttta

SEQ ID NO: 3368634 - DNA, 19 bp, Homo sapiens
ctttttttctgtaccagtt

SEQ ID NO: 3368635 - DNA, 15 bp, Homo sapiens
ctttttttcttttct

SEQ ID NO: 3368636 - DNA, 19 bp, Homo sapiens
ctttttttggaagttattt

SEQ ID NO: 3368637 - DNA, 21 bp, Homo sapiens
ctttttttggaagttatttat

SEQ ID NO: 3368638 - DNA, 15 bp, Homo sapiens
cttttttttccttct

SEQ ID NO: 3368639 - DNA, 12 bp, Homo sapiens
ctttttttttcc

SEQ ID NO: 3368640 - DNA, 13 bp, Homo sapiens
ctttttttttcct

SEQ ID NO: 3368641 - DNA, 22 bp, Homo sapiens
ctttttttttctctttctctcc

SEQ ID NO: 3368642 - DNA, 17 bp, Homo sapiens
ctttttttttgaaacag

SEQ ID NO: 3368643 - DNA, 16 bp, Homo sapiens
cttttttttttcttgg

SEQ ID NO: 3368644 - DNA, 17 bp, Homo sapiens
gaaaaaaaaaaaagaaa

SEQ ID NO: 3368645 - DNA, 18 bp, Homo sapiens
gaaaaaaaaaaaagaaaa

SEQ ID NO: 3368646 - DNA, 19 bp, Homo sapiens
gaaaaaaaaaaaagaaaag

SEQ ID NO: 3368647 - DNA, 20 bp, Homo sapiens
gaaaaaaaaaaagaagaaga

SEQ ID NO: 3368648 - DNA, 16 bp, Homo sapiens
gaaaaaaaaaatgttg

SEQ ID NO: 3368649 - DNA, 17 bp, Homo sapiens
gaaaaaaaaacagccac

SEQ ID NO: 3368650 - DNA, 13 bp, Homo sapiens
gaaaaaaaacctt

SEQ ID NO: 3368651 - DNA, 14 bp, Homo sapiens
gaaaaaaaaccttg

SEQ ID NO: 3368652 - DNA, 18 bp, Homo sapiens
gaaaaaaaaccttgtaaa

SEQ ID NO: 3368653 - DNA, 15 bp, Homo sapiens
gaaaaaaaagaaagc

SEQ ID NO: 3368654 - DNA, 19 bp, Homo sapiens
gaaaaaaaagtttcagaga

SEQ ID NO: 3368655 - DNA, 22 bp, Homo sapiens
gaaaaaaaagtttcagagaagt

SEQ ID NO: 3368656 - DNA, 18 bp, Homo sapiens
gaaaaaaaccacacaaag

SEQ ID NO: 3368657 - DNA, 21 bp, Homo sapiens
gaaaaaaaccacacaaagaca

SEQ ID NO: 3368658 - DNA, 13 bp, Homo sapiens
gaaaaaaatcttc

SEQ ID NO: 3368659 - DNA, 16 bp, Homo sapiens
gaaaaaaatgactaaa

SEQ ID NO: 3368660 - DNA, 16 bp, Homo sapiens
gaaaaaaatggcatca

SEQ ID NO: 3368661 - DNA, 22 bp, Homo sapiens
gaaaaaaatgtacatttattca

SEQ ID NO: 3368662 - DNA, 21 bp, Homo sapiens
gaaaaaagaagtgtccgagaa

SEQ ID NO: 3368663 - DNA, 15 bp, Homo sapiens
gaaaaaagagaaaaa

SEQ ID NO: 3368664 - DNA, 12 bp, Homo sapiens
gaaaaaagcaca

SEQ ID NO: 3368665 - DNA, 14 bp, Homo sapiens
gaaaaaagcacata

SEQ ID NO: 3368666 - DNA, 19 bp, Homo sapiens
gaaaaaagcacatacatta

SEQ ID NO: 3368667 - DNA, 17 bp, Homo sapiens
gaaaaaagttccttcct

SEQ ID NO: 3368668 - DNA, 17 bp, Homo sapiens
gaaaaaataacacacat

SEQ ID NO: 3368669 - DNA, 14 bp, Homo sapiens
gaaaaacacaagca

SEQ ID NO: 3368670 - DNA, 17 bp, Homo sapiens
gaaaaacacaagcaaaa

SEQ ID NO: 3368671 - DNA, 23 bp, Homo sapiens
gaaaaaccaatgattcataacaa

SEQ ID NO: 3368672 - DNA, 15 bp, Homo sapiens
gaaaaaccatttgaa

SEQ ID NO: 3368673 - DNA, 14 bp, Homo sapiens
gaaaaagcatgatg

SEQ ID NO: 3368674 - DNA, 21 bp, Homo sapiens
gaaaaagcatgatgggaaaat

SEQ ID NO: 3368675 - DNA, 14 bp, Homo sapiens
gaaaaaggtgatta

SEQ ID NO: 3368676 - DNA, 15 bp, Homo sapiens
gaaaaagtacaatga

SEQ ID NO: 3368677 - DNA, 23 bp, Homo sapiens
gaaaaagtacaatgaactgcttt

SEQ ID NO: 3368678 - DNA, 18 bp, Homo sapiens
gaaaaataaatctgttct

SEQ ID NO: 3368679 - DNA, 16 bp, Homo sapiens
gaaaaataacaactat

SEQ ID NO: 3368680 - DNA, 19 bp, Homo sapiens
gaaaaataacttcaagcaa

SEQ ID NO: 3368681 - DNA, 13 bp, Homo sapiens
gaaaaataatcaa

SEQ ID NO: 3368682 - DNA, 23 bp, Homo sapiens
gaaaaataatcaagattttaggg

SEQ ID NO: 3368683 - DNA, 20 bp, Homo sapiens
gaaaaatctaagtgatataa

SEQ ID NO: 3368684 - DNA, 14 bp, Homo sapiens
gaaaaatcttgtgc

SEQ ID NO: 3368685 - DNA, 21 bp, Homo sapiens
gaaaaatcttgtgctagaata

SEQ ID NO: 3368686 - DNA, 20 bp, Homo sapiens
gaaaaatgcccttaaatcat

SEQ ID NO: 3368687 - DNA, 16 bp, Homo sapiens
gaaaaatgctccccac

SEQ ID NO: 3368688 - DNA, 16 bp, Homo sapiens
gaaaaatggttgatgg

SEQ ID NO: 3368689 - DNA, 18 bp, Homo sapiens
gaaaaatggttgatggaa

SEQ ID NO: 3368690 - DNA, 19 bp, Homo sapiens
gaaaaatgtaatttagaaa

SEQ ID NO: 3368691 - DNA, 12 bp, Homo sapiens
gaaaaatgtttg

SEQ ID NO: 3368692 - DNA, 14 bp, Homo sapiens
gaaaaatgtttgtc

SEQ ID NO: 3368693 - DNA, 16 bp, Homo sapiens
gaaaaatttaagcatt

SEQ ID NO: 3368694 - DNA, 17 bp, Homo sapiens
gaaaaatttaagcattg

SEQ ID NO: 3368695 - DNA, 22 bp, Homo sapiens
gaaaaatttaagcattgtttgc

SEQ ID NO: 3368696 - DNA, 14 bp, Homo sapiens
gaaaacaaaatcta

SEQ ID NO: 3368697 - DNA, 19 bp, Homo sapiens
gaaaacaaaatctaaaaca

SEQ ID NO: 3368698 - DNA, 23 bp, Homo sapiens
gaaaacaacttggcatttctata

SEQ ID NO: 3368699 - DNA, 16 bp, Homo sapiens
gaaaacacactcaaaa

SEQ ID NO: 3368700 - DNA, 21 bp, Homo sapiens
gaaaacagaacatcattagaa

SEQ ID NO: 3368701 - DNA, 15 bp, Homo sapiens
gaaaacatgtaataa

SEQ ID NO: 3368702 - DNA, 18 bp, Homo sapiens
gaaaaccatctggcctgg

SEQ ID NO: 3368703 - DNA, 13 bp, Homo sapiens
gaaaacctgttca

SEQ ID NO: 3368704 - DNA, 14 bp, Homo sapiens
gaaaacggagctga

SEQ ID NO: 3368705 - DNA, 14 bp, Homo sapiens
gaaaacgttttatt

SEQ ID NO: 3368706 - DNA, 17 bp, Homo sapiens
gaaaacgttttgtttga

SEQ ID NO: 3368707 - DNA, 16 bp, Homo sapiens
gaaaactaaggatttt

SEQ ID NO: 3368708 - DNA, 22 bp, Homo sapiens
gaaaactatcctgcgggtttta

SEQ ID NO: 3368709 - DNA, 20 bp, Homo sapiens
gaaaactatgtattaattta

SEQ ID NO: 3368710 - DNA, 18 bp, Homo sapiens
gaaaactcccatttacgt

SEQ ID NO: 3368711 - DNA, 22 bp, Homo sapiens
gaaaactgcctgacctttggga

SEQ ID NO: 3368712 - DNA, 23 bp, Homo sapiens
gaaaacttatgacctcttccttt

SEQ ID NO: 3368713 - DNA, 22 bp, Homo sapiens
gaaaactttaaaaaatatttat

SEQ ID NO: 3368714 - DNA, 14 bp, Homo sapiens
gaaaagaccctgag

SEQ ID NO: 3368715 - DNA, 13 bp, Homo sapiens
gaaaagataaacc

SEQ ID NO: 3368716 - DNA, 13 bp, Homo sapiens
gaaaagataaaga

SEQ ID NO: 3368717 - DNA, 16 bp, Homo sapiens
gaaaagatacgacttt

SEQ ID NO: 3368718 - DNA, 14 bp, Homo sapiens
gaaaagcacttttg

SEQ ID NO: 3368719 - DNA, 18 bp, Homo sapiens
gaaaagcacttttgttat

SEQ ID NO: 3368720 - DNA, 22 bp, Homo sapiens
gaaaagcacttttgttattcca

SEQ ID NO: 3368721 - DNA, 14 bp, Homo sapiens
gaaaagcattttca

SEQ ID NO: 3368722 - DNA, 16 bp, Homo sapiens
gaaaagcattttcagt

SEQ ID NO: 3368723 - DNA, 22 bp, Homo sapiens
gaaaagcattttcagtcttgta

SEQ ID NO: 3368724 - DNA, 12 bp, Homo sapiens
gaaaagcgtctt

SEQ ID NO: 3368725 - DNA, 18 bp, Homo sapiens
gaaaagcgtctttaagag

SEQ ID NO: 3368726 - DNA, 19 bp, Homo sapiens
gaaaagcgtctttaagaga

SEQ ID NO: 3368727 - DNA, 22 bp, Homo sapiens
gaaaagctagtgtacctcctct

SEQ ID NO: 3368728 - DNA, 17 bp, Homo sapiens
gaaaagctattagccag

SEQ ID NO: 3368729 - DNA, 19 bp, Homo sapiens
gaaaagctgctgacagtgt

SEQ ID NO: 3368730 - DNA, 14 bp, Homo sapiens
gaaaagctgtacgc

SEQ ID NO: 3368731 - DNA, 16 bp, Homo sapiens
gaaaagcttcttaatt

SEQ ID NO: 3368732 - DNA, 20 bp, Homo sapiens
gaaaaggctggagagagatt

SEQ ID NO: 3368733 - DNA, 13 bp, Homo sapiens
gaaaaggttgaat

SEQ ID NO: 3368734 - DNA, 21 bp, Homo sapiens
gaaaagtaaggtgcagttccc

SEQ ID NO: 3368735 - DNA, 19 bp, Homo sapiens
gaaaagtaattttgtcaca

SEQ ID NO: 3368736 - DNA, 23 bp, Homo sapiens
gaaaagtaattttgtcacattat

SEQ ID NO: 3368737 - DNA, 19 bp, Homo sapiens
gaaaagtgcatatttatcc

SEQ ID NO: 3368738 - DNA, 21 bp, Homo sapiens
gaaaagttatttatgctataa

SEQ ID NO: 3368739 - DNA, 14 bp, Homo sapiens
gaaaagttgcagat

SEQ ID NO: 3368740 - DNA, 12 bp, Homo sapiens
gaaaataaacat

SEQ ID NO: 3368741 - DNA, 11 bp, Homo sapiens
gaaaataaagt

SEQ ID NO: 3368742 - DNA, 14 bp, Homo sapiens
gaaaataaatttaa

SEQ ID NO: 3368743 - DNA, 23 bp, Homo sapiens
gaaaataactgaaccaaattgca

SEQ ID NO: 3368744 - DNA, 15 bp, Homo sapiens
gaaaataactgaatt

SEQ ID NO: 3368745 - DNA, 18 bp, Homo sapiens
gaaaataagaatagaaat

SEQ ID NO: 3368746 - DNA, 23 bp, Homo sapiens
gaaaataagacaatagtatttct

SEQ ID NO: 3368747 - DNA, 21 bp, Homo sapiens
gaaaataatattatttaaact

SEQ ID NO: 3368748 - DNA, 14 bp, Homo sapiens
gaaaatacaataaa

SEQ ID NO: 3368749 - DNA, 15 bp, Homo sapiens
gaaaatacaataaac

SEQ ID NO: 3368750 - DNA, 19 bp, Homo sapiens
gaaaatacctaattgtgga

SEQ ID NO: 3368751 - DNA, 21 bp, Homo sapiens
gaaaatataaaacaaataaaa

SEQ ID NO: 3368752 - DNA, 17 bp, Homo sapiens
gaaaatattatgtgttt

SEQ ID NO: 3368753 - DNA, 13 bp, Homo sapiens
gaaaatattctct

SEQ ID NO: 3368754 - DNA, 21 bp, Homo sapiens
gaaaatatttcctgacttgag

SEQ ID NO: 3368755 - DNA, 17 bp, Homo sapiens
gaaaatcactttgtcta

SEQ ID NO: 3368756 - DNA, 15 bp, Homo sapiens
gaaaatccaggtcat

SEQ ID NO: 3368757 - DNA, 16 bp, Homo sapiens
gaaaatccaggtcatg

SEQ ID NO: 3368758 - DNA, 16 bp, Homo sapiens
gaaaatctttgttgaa

SEQ ID NO: 3368759 - DNA, 21 bp, Homo sapiens
gaaaatctttgttgaagtttg

SEQ ID NO: 3368760 - DNA, 14 bp, Homo sapiens
gaaaatgaaaaaca

SEQ ID NO: 3368761 - DNA, 15 bp, Homo sapiens
gaaaatgaagaagga

SEQ ID NO: 3368762 - DNA, 22 bp, Homo sapiens
gaaaatgaatatctattaatat

SEQ ID NO: 3368763 - DNA, 14 bp, Homo sapiens
gaaaatgacttatt

SEQ ID NO: 3368764 - DNA, 16 bp, Homo sapiens
gaaaatgacttatttc

SEQ ID NO: 3368765 - DNA, 18 bp, Homo sapiens
gaaaatgacttatttctg

SEQ ID NO: 3368766 - DNA, 18 bp, Homo sapiens
gaaaatgatgagttttta

SEQ ID NO: 3368767 - DNA, 21 bp, Homo sapiens
gaaaatgattcctggacatca

SEQ ID NO: 3368768 - DNA, 22 bp, Homo sapiens
gaaaatgcagtcctgaggagag

SEQ ID NO: 3368769 - DNA, 15 bp, Homo sapiens
gaaaatgcggttata

SEQ ID NO: 3368770 - DNA, 17 bp, Homo sapiens
gaaaatggctaataaac

SEQ ID NO: 3368771 - DNA, 21 bp, Homo sapiens
gaaaatggctaataaactgta

SEQ ID NO: 3368772 - DNA, 22 bp, Homo sapiens
gaaaatggctaataaactgtat

SEQ ID NO: 3368773 - DNA, 23 bp, Homo sapiens
gaaaatggctaataaactgtatt

SEQ ID NO: 3368774 - DNA, 23 bp, Homo sapiens
gaaaatggtccaattagtttcct

SEQ ID NO: 3368775 - DNA, 21 bp, Homo sapiens
gaaaatgtaaaaaacaaaaac

SEQ ID NO: 3368776 - DNA, 18 bp, Homo sapiens
gaaaatgtaagctgttta

SEQ ID NO: 3368777 - DNA, 19 bp, Homo sapiens
gaaaatgtactgagatttt

SEQ ID NO: 3368778 - DNA, 23 bp, Homo sapiens
gaaaatgtctattcaaaatatca

SEQ ID NO: 3368779 - DNA, 14 bp, Homo sapiens
gaaaattagactgt

SEQ ID NO: 3368780 - DNA, 18 bp, Homo sapiens
gaaaattagactgtgatt

SEQ ID NO: 3368781 - DNA, 17 bp, Homo sapiens
gaaaattcaaaaagtgt

SEQ ID NO: 3368782 - DNA, 19 bp, Homo sapiens
gaaaattcaaaaagtgttt

SEQ ID NO: 3368783 - DNA, 22 bp, Homo sapiens
gaaaattcaaaaagtgtttatt

SEQ ID NO: 3368784 - DNA, 13 bp, Homo sapiens
gaaaattcatttt

SEQ ID NO: 3368785 - DNA, 20 bp, Homo sapiens
gaaaattccagaaaggatat

SEQ ID NO: 3368786 - DNA, 22 bp, Homo sapiens
gaaaattctgtgccttgttttt

SEQ ID NO: 3368787 - DNA, 24 bp, Homo sapiens
gaaaattgaggtttggaagagtga

SEQ ID NO: 3368788 - DNA, 18 bp, Homo sapiens
gaaaatttagccctttaa

SEQ ID NO: 3368789 - DNA, 22 bp, Homo sapiens
gaaaatttagccctttaaaacg

SEQ ID NO: 3368790 - DNA, 18 bp, Homo sapiens
gaaaatttttacattcat

SEQ ID NO: 3368791 - DNA, 19 bp, Homo sapiens
gaaacaaaaacactaaaaa

SEQ ID NO: 3368792 - DNA, 17 bp, Homo sapiens
gaaacaaaaagagcttt

SEQ ID NO: 3368793 - DNA, 21 bp, Homo sapiens
gaaacaaaaagagctttcctt

SEQ ID NO: 3368794 - DNA, 21 bp, Homo sapiens
gaaacaaaaattgtctttatg

SEQ ID NO: 3368795 - DNA, 13 bp, Homo sapiens
gaaacaaagaagt

SEQ ID NO: 3368796 - DNA, 14 bp, Homo sapiens
gaaacaaataatca

SEQ ID NO: 3368797 - DNA, 19 bp, Homo sapiens
gaaacaaataatcacattg

SEQ ID NO: 3368798 - DNA, 16 bp, Homo sapiens
gaaacaacatttatat

SEQ ID NO: 3368799 - DNA, 14 bp, Homo sapiens
gaaacaagctgtgc

SEQ ID NO: 3368800 - DNA, 15 bp, Homo sapiens
gaaacaagctgtgca

SEQ ID NO: 3368801 - DNA, 22 bp, Homo sapiens
gaaacaagctgtgcaggcatgg

SEQ ID NO: 3368802 - DNA, 9 bp, Homo sapiens
gaaacacaa

SEQ ID NO: 3368803 - DNA, 22 bp, Homo sapiens
gaaacacaatacctacaataaa

SEQ ID NO: 3368804 - DNA, 13 bp, Homo sapiens
gaaacacacagtc

SEQ ID NO: 3368805 - DNA, 15 bp, Homo sapiens
gaaacacagctgttc

SEQ ID NO: 3368806 - DNA, 15 bp, Homo sapiens
gaaacacgaaacttg

SEQ ID NO: 3368807 - DNA, 19 bp, Homo sapiens
gaaacactttgcctcctgt

SEQ ID NO: 3368808 - DNA, 22 bp, Homo sapiens
gaaacagaaacaaaaacactaa

SEQ ID NO: 3368809 - DNA, 16 bp, Homo sapiens
gaaacagagtccaatt

SEQ ID NO: 3368810 - DNA, 22 bp, Homo sapiens
gaaacagagtccaatttaagga

SEQ ID NO: 3368811 - DNA, 14 bp, Homo sapiens
gaaacagataccat

SEQ ID NO: 3368812 - DNA, 15 bp, Homo sapiens
gaaacagataccata

SEQ ID NO: 3368813 - DNA, 21 bp, Homo sapiens
gaaacagataccatactcatt

SEQ ID NO: 3368814 - DNA, 16 bp, Homo sapiens
gaaacagatttcatac

SEQ ID NO: 3368815 - DNA, 16 bp, Homo sapiens
gaaacagcagtcccag

SEQ ID NO: 3368816 - DNA, 14 bp, Homo sapiens
gaaacagcatgaat

SEQ ID NO: 3368817 - DNA, 16 bp, Homo sapiens
gaaacagcatgaataa

SEQ ID NO: 3368818 - DNA, 15 bp, Homo sapiens
gaaacagccagcaag

SEQ ID NO: 3368819 - DNA, 16 bp, Homo sapiens
gaaacagctttcaagt

SEQ ID NO: 3368820 - DNA, 18 bp, Homo sapiens
gaaacagctttcaagtgc

SEQ ID NO: 3368821 - DNA, 17 bp, Homo sapiens
gaaacagttccatttat

SEQ ID NO: 3368822 - DNA, 23 bp, Homo sapiens
gaaacagttggtaacttttgtga

SEQ ID NO: 3368823 - DNA, 19 bp, Homo sapiens
gaaacattagtgaaaattc

SEQ ID NO: 3368824 - DNA, 21 bp, Homo sapiens
gaaacattagtgaaaattctg

SEQ ID NO: 3368825 - DNA, 18 bp, Homo sapiens
gaaacattccgaagaggg

SEQ ID NO: 3368826 - DNA, 19 bp, Homo sapiens
gaaacattccgaagaggga

SEQ ID NO: 3368827 - DNA, 12 bp, Homo sapiens
gaaacattgtaa

SEQ ID NO: 3368828 - DNA, 15 bp, Homo sapiens
gaaaccaaaacataa

SEQ ID NO: 3368829 - DNA, 13 bp, Homo sapiens
gaaaccagaaaag

SEQ ID NO: 3368830 - DNA, 13 bp, Homo sapiens
gaaacccaagctc

SEQ ID NO: 3368831 - DNA, 14 bp, Homo sapiens
gaaacccaagctcc

SEQ ID NO: 3368832 - DNA, 23 bp, Homo sapiens
gaaacccaagctcctcctcggaa

SEQ ID NO: 3368833 - DNA, 16 bp, Homo sapiens
gaaacccggcttcctg

SEQ ID NO: 3368834 - DNA, 17 bp, Homo sapiens
gaaacccggcttcctgt

SEQ ID NO: 3368835 - DNA, 12 bp, Homo sapiens
gaaaccgaggcg

SEQ ID NO: 3368836 - DNA, 17 bp, Homo sapiens
gaaaccgtcctcttttt

SEQ ID NO: 3368837 - DNA, 21 bp, Homo sapiens
gaaacctacagacaaggagga

SEQ ID NO: 3368838 - DNA, 17 bp, Homo sapiens
gaaacctagtactgccc

SEQ ID NO: 3368839 - DNA, 13 bp, Homo sapiens
gaaacctgaaaaa

SEQ ID NO: 3368840 - DNA, 18 bp, Homo sapiens
gaaacctgtcattgtatt

SEQ ID NO: 3368841 - DNA, 19 bp, Homo sapiens
gaaaccttattgtacctct

SEQ ID NO: 3368842 - DNA, 20 bp, Homo sapiens
gaaaccttattgtacctctc

SEQ ID NO: 3368843 - DNA, 14 bp, Homo sapiens
gaaaccttttttaa

SEQ ID NO: 3368844 - DNA, 13 bp, Homo sapiens
gaaacgctacctc

SEQ ID NO: 3368845 - DNA, 20 bp, Homo sapiens
gaaacggaagctgacataat

SEQ ID NO: 3368846 - DNA, 16 bp, Homo sapiens
gaaacgtgtcacactt

SEQ ID NO: 3368847 - DNA, 18 bp, Homo sapiens
gaaacgtgtcacacttgt

SEQ ID NO: 3368848 - DNA, 20 bp, Homo sapiens
gaaactaaaaatatagcaaa

SEQ ID NO: 3368849 - DNA, 14 bp, Homo sapiens
gaaactatgtgttt

SEQ ID NO: 3368850 - DNA, 17 bp, Homo sapiens
gaaactatgtgtttttc

SEQ ID NO: 3368851 - DNA, 20 bp, Homo sapiens
gaaactcaccatgtaaaaga

SEQ ID NO: 3368852 - DNA, 14 bp, Homo sapiens
gaaactccaaagtc

SEQ ID NO: 3368853 - DNA, 16 bp, Homo sapiens
gaaactccaaagtcca

SEQ ID NO: 3368854 - DNA, 20 bp, Homo sapiens
gaaactccaaagtccacaca

SEQ ID NO: 3368855 - DNA, 15 bp, Homo sapiens
gaaactcccctgggg

SEQ ID NO: 3368856 - DNA, 18 bp, Homo sapiens
gaaactccgaagaaaaga

SEQ ID NO: 3368857 - DNA, 15 bp, Homo sapiens
gaaactcttatctca

SEQ ID NO: 3368858 - DNA, 16 bp, Homo sapiens
gaaactcttatctcag

SEQ ID NO: 3368859 - DNA, 21 bp, Homo sapiens
gaaactgaaagtgttttactc

SEQ ID NO: 3368860 - DNA, 18 bp, Homo sapiens
gaaactgaggaattttct

SEQ ID NO: 3368861 - DNA, 16 bp, Homo sapiens
gaaactgatttcttca

SEQ ID NO: 3368862 - DNA, 14 bp, Homo sapiens
gaaactgctaaatt

SEQ ID NO: 3368863 - DNA, 17 bp, Homo sapiens
gaaactgctaaattcta

SEQ ID NO: 3368864 - DNA, 12 bp, Homo sapiens
gaaactggcccc

SEQ ID NO: 3368865 - DNA, 14 bp, Homo sapiens
gaaacttttaactg

SEQ ID NO: 3368866 - DNA, 16 bp, Homo sapiens
gaaacttttgtaaaga

SEQ ID NO: 3368867 - DNA, 21 bp, Homo sapiens
gaaacttttgtaaagaaattt

SEQ ID NO: 3368868 - DNA, 19 bp, Homo sapiens
gaaagaaaagaccctgaga

SEQ ID NO: 3368869 - DNA, 16 bp, Homo sapiens
gaaagaaagctgagaa

SEQ ID NO: 3368870 - DNA, 13 bp, Homo sapiens
gaaagaacaagtt

SEQ ID NO: 3368871 - DNA, 22 bp, Homo sapiens
gaaagaagaaactccgaagaaa

SEQ ID NO: 3368872 - DNA, 11 bp, Homo sapiens
gaaagaagcaa

SEQ ID NO: 3368873 - DNA, 14 bp, Homo sapiens
gaaagaagcaagac

SEQ ID NO: 3368874 - DNA, 23 bp, Homo sapiens
gaaagaagctcgccccacctcca

SEQ ID NO: 3368875 - DNA, 16 bp, Homo sapiens
gaaagaagggggccct

SEQ ID NO: 3368876 - DNA, 20 bp, Homo sapiens
gaaagaagtgtggggatttt

SEQ ID NO: 3368877 - DNA, 13 bp, Homo sapiens
gaaagagagcagg

SEQ ID NO: 3368878 - DNA, 14 bp, Homo sapiens
gaaagagctgcctg

SEQ ID NO: 3368879 - DNA, 16 bp, Homo sapiens
gaaagagctgcctgga

SEQ ID NO: 3368880 - DNA, 18 bp, Homo sapiens
gaaagagttaagaatgtc

SEQ ID NO: 3368881 - DNA, 22 bp, Homo sapiens
gaaagatggataaactgagcct

SEQ ID NO: 3368882 - DNA, 22 bp, Homo sapiens
gaaagatggctgtgcctctgcc

SEQ ID NO: 3368883 - DNA, 19 bp, Homo sapiens
gaaagatgttaagcattta

SEQ ID NO: 3368884 - DNA, 23 bp, Homo sapiens
gaaagatttgtgaactggaagaa

SEQ ID NO: 3368885 - DNA, 12 bp, Homo sapiens
gaaagattttat

SEQ ID NO: 3368886 - DNA, 13 bp, Homo sapiens
gaaagattttctc

SEQ ID NO: 3368887 - DNA, 14 bp, Homo sapiens
gaaagcaataaatg

SEQ ID NO: 3368888 - DNA, 12 bp, Homo sapiens
gaaagcagcagc

SEQ ID NO: 3368889 - DNA, 14 bp, Homo sapiens
gaaagcagcagcta

SEQ ID NO: 3368890 - DNA, 22 bp, Homo sapiens
gaaagcagcagctaggactgag

SEQ ID NO: 3368891 - DNA, 14 bp, Homo sapiens
gaaagcaggggcta

SEQ ID NO: 3368892 - DNA, 18 bp, Homo sapiens
gaaagcataaagctcaaa

SEQ ID NO: 3368893 - DNA, 22 bp, Homo sapiens
gaaagcataaagctcaaatgaa

SEQ ID NO: 3368894 - DNA, 19 bp, Homo sapiens
gaaagcatcacctcaggcc

SEQ ID NO: 3368895 - DNA, 13 bp, Homo sapiens
gaaagccacctct

SEQ ID NO: 3368896 - DNA, 14 bp, Homo sapiens
gaaagccctccccc

SEQ ID NO: 3368897 - DNA, 22 bp, Homo sapiens
gaaagcctgtaagcctgcaagc

SEQ ID NO: 3368898 - DNA, 14 bp, Homo sapiens
gaaagcgattcact

SEQ ID NO: 3368899 - DNA, 22 bp, Homo sapiens
gaaagctccacggtgcgtggct

SEQ ID NO: 3368900 - DNA, 17 bp, Homo sapiens
gaaagctgagaactcct

SEQ ID NO: 3368901 - DNA, 22 bp, Homo sapiens
gaaagctgagaactcctgactg

SEQ ID NO: 3368902 - DNA, 23 bp, Homo sapiens
gaaagctgattactgtcaataaa

SEQ ID NO: 3368903 - DNA, 17 bp, Homo sapiens
gaaagctgcctggtata

SEQ ID NO: 3368904 - DNA, 21 bp, Homo sapiens
gaaagctggtaaactatttgt

SEQ ID NO: 3368905 - DNA, 17 bp, Homo sapiens
gaaagcttcaaactgca

SEQ ID NO: 3368906 - DNA, 22 bp, Homo sapiens
gaaagcttgaaaagattctgaa

SEQ ID NO: 3368907 - DNA, 18 bp, Homo sapiens
gaaaggaaaacctgaaga

SEQ ID NO: 3368908 - DNA, 14 bp, Homo sapiens
gaaaggaaaagaaa

SEQ ID NO: 3368909 - DNA, 13 bp, Homo sapiens
gaaaggacccacc

SEQ ID NO: 3368910 - DNA, 20 bp, Homo sapiens
gaaaggaggcatgcctctga

SEQ ID NO: 3368911 - DNA, 21 bp, Homo sapiens
gaaaggaggcatgcctctgat

SEQ ID NO: 3368912 - DNA, 14 bp, Homo sapiens
gaaaggatatttaa

SEQ ID NO: 3368913 - DNA, 17 bp, Homo sapiens
gaaaggatatttaagaa

SEQ ID NO: 3368914 - DNA, 21 bp, Homo sapiens
gaaaggatatttaagaaaata

SEQ ID NO: 3368915 - DNA, 22 bp, Homo sapiens
gaaaggatatttaagaaaatac

SEQ ID NO: 3368916 - DNA, 20 bp, Homo sapiens
gaaaggatgtggaagagcat

SEQ ID NO: 3368917 - DNA, 13 bp, Homo sapiens
gaaaggattttac

SEQ ID NO: 3368918 - DNA, 14 bp, Homo sapiens
gaaaggattttacc

SEQ ID NO: 3368919 - DNA, 15 bp, Homo sapiens
gaaaggcctgcacac

SEQ ID NO: 3368920 - DNA, 19 bp, Homo sapiens
gaaaggctcagtctcagga

SEQ ID NO: 3368921 - DNA, 22 bp, Homo sapiens
gaaaggctcagtctcaggagca

SEQ ID NO: 3368922 - DNA, 22 bp, Homo sapiens
gaaagggacttggaagctccgc

SEQ ID NO: 3368923 - DNA, 22 bp, Homo sapiens
gaaagggagctatcaggaacag

SEQ ID NO: 3368924 - DNA, 14 bp, Homo sapiens
gaaagggaggaaga

SEQ ID NO: 3368925 - DNA, 22 bp, Homo sapiens
gaaagggcacttaatttgtaaa

SEQ ID NO: 3368926 - DNA, 15 bp, Homo sapiens
gaaagggcccagaga

SEQ ID NO: 3368927 - DNA, 15 bp, Homo sapiens
gaaaggggaaagaaa

SEQ ID NO: 3368928 - DNA, 18 bp, Homo sapiens
gaaaggggagagcctgct

SEQ ID NO: 3368929 - DNA, 20 bp, Homo sapiens
gaaaggggagagcctgctgg

SEQ ID NO: 3368930 - DNA, 16 bp, Homo sapiens
gaaagggggtcccagt

SEQ ID NO: 3368931 - DNA, 17 bp, Homo sapiens
gaaaggggtcggctgac

SEQ ID NO: 3368932 - DNA, 21 bp, Homo sapiens
gaaaggggttggggtgacagt

SEQ ID NO: 3368933 - DNA, 22 bp, Homo sapiens
gaaaggtgagtttgagctgcct

SEQ ID NO: 3368934 - DNA, 16 bp, Homo sapiens
gaaagtaagaaaacaa

SEQ ID NO: 3368935 - DNA, 17 bp, Homo sapiens
gaaagtacactctgctg

SEQ ID NO: 3368936 - DNA, 21 bp, Homo sapiens
gaaagtacttctccaccctgc

SEQ ID NO: 3368937 - DNA, 15 bp, Homo sapiens
gaaagtcaccaggac

SEQ ID NO: 3368938 - DNA, 22 bp, Homo sapiens
gaaagtgatttctagaaagcct

SEQ ID NO: 3368939 - DNA, 21 bp, Homo sapiens
gaaagtgggaggtcaggaaac

SEQ ID NO: 3368940 - DNA, 21 bp, Homo sapiens
gaaagtgggtgagatgctgga

SEQ ID NO: 3368941 - DNA, 15 bp, Homo sapiens
gaaagtgtatttgga

SEQ ID NO: 3368942 - DNA, 23 bp, Homo sapiens
gaaagtgtatttggaaataaagt

SEQ ID NO: 3368943 - DNA, 13 bp, Homo sapiens
gaaagtgtcgtct

SEQ ID NO: 3368944 - DNA, 11 bp, Homo sapiens
gaaagtgtttt

SEQ ID NO: 3368945 - DNA, 20 bp, Homo sapiens
gaaagtgttttactcttttt

SEQ ID NO: 3368946 - DNA, 14 bp, Homo sapiens
gaaagttttccagt

SEQ ID NO: 3368947 - DNA, 18 bp, Homo sapiens
gaaagttttccagtattg

SEQ ID NO: 3368948 - DNA, 14 bp, Homo sapiens
gaaataaaaaagtc

SEQ ID NO: 3368949 - DNA, 15 bp, Homo sapiens
gaaataaaacaggac

SEQ ID NO: 3368950 - DNA, 17 bp, Homo sapiens
gaaataaaacctttcaa

SEQ ID NO: 3368951 - DNA, 21 bp, Homo sapiens
gaaataaaatacacaacacaa

SEQ ID NO: 3368952 - DNA, 11 bp, Homo sapiens
gaaataaacac

SEQ ID NO: 3368953 - DNA, 14 bp, Homo sapiens
gaaataaacactgg

SEQ ID NO: 3368954 - DNA, 17 bp, Homo sapiens
gaaataaagaatttaaa

SEQ ID NO: 3368955 - DNA, 20 bp, Homo sapiens
gaaataaaggatgtgattgt

SEQ ID NO: 3368956 - DNA, 14 bp, Homo sapiens
gaaataaagtcaga

SEQ ID NO: 3368957 - DNA, 17 bp, Homo sapiens
gaaataaagtttgctta

SEQ ID NO: 3368958 - DNA, 15 bp, Homo sapiens
gaaataaatagctat

SEQ ID NO: 3368959 - DNA, 17 bp, Homo sapiens
gaaataaatagctatat

SEQ ID NO: 3368960 - DNA, 21 bp, Homo sapiens
gaaataaatagctatatccat

SEQ ID NO: 3368961 - DNA, 16 bp, Homo sapiens
gaaataaatcagagag

SEQ ID NO: 3368962 - DNA, 20 bp, Homo sapiens
gaaataaatgtacctgatgt

SEQ ID NO: 3368963 - DNA, 23 bp, Homo sapiens
gaaataaattggtgataagtgga

SEQ ID NO: 3368964 - DNA, 17 bp, Homo sapiens
gaaataacaatgttaag

SEQ ID NO: 3368965 - DNA, 22 bp, Homo sapiens
gaaataactccttcttgtagta

SEQ ID NO: 3368966 - DNA, 15 bp, Homo sapiens
gaaataatatgcatt

SEQ ID NO: 3368967 - DNA, 21 bp, Homo sapiens
gaaatacaattctacattgtc

SEQ ID NO: 3368968 - DNA, 17 bp, Homo sapiens
gaaatacagttctgctc

SEQ ID NO: 3368969 - DNA, 16 bp, Homo sapiens
gaaataccacaagcct

SEQ ID NO: 3368970 - DNA, 21 bp, Homo sapiens
gaaatacccttcttttatgag

SEQ ID NO: 3368971 - DNA, 17 bp, Homo sapiens
gaaatacctcatgttta

SEQ ID NO: 3368972 - DNA, 21 bp, Homo sapiens
gaaatacctcatgtttatgaa

SEQ ID NO: 3368973 - DNA, 14 bp, Homo sapiens
gaaatactatttaa

SEQ ID NO: 3368974 - DNA, 15 bp, Homo sapiens
gaaatagaaaaggaa

SEQ ID NO: 3368975 - DNA, 21 bp, Homo sapiens
gaaatagacaaaaagtatatt

SEQ ID NO: 3368976 - DNA, 17 bp, Homo sapiens
gaaatataacacatttt

SEQ ID NO: 3368977 - DNA, 20 bp, Homo sapiens
gaaatataataaaatgtgtt

SEQ ID NO: 3368978 - DNA, 13 bp, Homo sapiens
gaaatataattga

SEQ ID NO: 3368979 - DNA, 15 bp, Homo sapiens
gaaatatatatacat

SEQ ID NO: 3368980 - DNA, 19 bp, Homo sapiens
gaaatatatatacatatgt

SEQ ID NO: 3368981 - DNA, 13 bp, Homo sapiens
gaaatattttgat

SEQ ID NO: 3368982 - DNA, 20 bp, Homo sapiens
gaaatattttgataataaat

SEQ ID NO: 3368983 - DNA, 21 bp, Homo sapiens
gaaatattttttaatttaaag

SEQ ID NO: 3368984 - DNA, 16 bp, Homo sapiens
gaaatcaaccctctcc

SEQ ID NO: 3368985 - DNA, 17 bp, Homo sapiens
gaaatcacaggggcggg

SEQ ID NO: 3368986 - DNA, 19 bp, Homo sapiens
gaaatcacaggggcggggc

SEQ ID NO: 3368987 - DNA, 16 bp, Homo sapiens
gaaatcacataacctt

SEQ ID NO: 3368988 - DNA, 17 bp, Homo sapiens
gaaatcatcaaaaagaa

SEQ ID NO: 3368989 - DNA, 21 bp, Homo sapiens
gaaatcatcaaaaagaaaaat

SEQ ID NO: 3368990 - DNA, 20 bp, Homo sapiens
gaaatcatcctgttttctct

SEQ ID NO: 3368991 - DNA, 18 bp, Homo sapiens
gaaatcatcgaaaattca

SEQ ID NO: 3368992 - DNA, 18 bp, Homo sapiens
gaaatccattgtttaaag

SEQ ID NO: 3368993 - DNA, 22 bp, Homo sapiens
gaaatccgagcggctacaaagc

SEQ ID NO: 3368994 - DNA, 20 bp, Homo sapiens
gaaatcctagtttcctctcc

SEQ ID NO: 3368995 - DNA, 22 bp, Homo sapiens
gaaatcctagtttcctctcctt

SEQ ID NO: 3368996 - DNA, 18 bp, Homo sapiens
gaaatcctgccctggagg

SEQ ID NO: 3368997 - DNA, 19 bp, Homo sapiens
gaaatccttgactggacct

SEQ ID NO: 3368998 - DNA, 20 bp, Homo sapiens
gaaatcgcttatatgtcctt

SEQ ID NO: 3368999 - DNA, 13 bp, Homo sapiens
gaaatcttgtctt

SEQ ID NO: 3369000 - DNA, 14 bp, Homo sapiens
gaaatcttgtctta

SEQ ID NO: 3369001 - DNA, 13 bp, Homo sapiens
gaaatctttccag

SEQ ID NO: 3369002 - DNA, 14 bp, Homo sapiens
gaaatcttttaaaa

SEQ ID NO: 3369003 - DNA, 13 bp, Homo sapiens
gaaatgaacattc

SEQ ID NO: 3369004 - DNA, 19 bp, Homo sapiens
gaaatgaataatttcccaa

SEQ ID NO: 3369005 - DNA, 14 bp, Homo sapiens
gaaatgaccaatat

SEQ ID NO: 3369006 - DNA, 20 bp, Homo sapiens
gaaatgattcaaattgctgc

SEQ ID NO: 3369007 - DNA, 21 bp, Homo sapiens
gaaatgctaaccttgtagcat

SEQ ID NO: 3369008 - DNA, 16 bp, Homo sapiens
gaaatggaaagcagag

SEQ ID NO: 3369009 - DNA, 20 bp, Homo sapiens
gaaatggactggtttgagat

SEQ ID NO: 3369010 - DNA, 21 bp, Homo sapiens
gaaatggatactacatcttta

SEQ ID NO: 3369011 - DNA, 16 bp, Homo sapiens
gaaatgggacggaggt

SEQ ID NO: 3369012 - DNA, 17 bp, Homo sapiens
gaaatgggacttaactc

SEQ ID NO: 3369013 - DNA, 16 bp, Homo sapiens
gaaatgtaccttcttt

SEQ ID NO: 3369014 - DNA, 14 bp, Homo sapiens
gaaatgtacttttg

SEQ ID NO: 3369015 - DNA, 17 bp, Homo sapiens
gaaatgtacttttggat

SEQ ID NO: 3369016 - DNA, 18 bp, Homo sapiens
gaaatgtcccctcaaact

SEQ ID NO: 3369017 - DNA, 22 bp, Homo sapiens
gaaatgtcccctcaaactcatt

SEQ ID NO: 3369018 - DNA, 22 bp, Homo sapiens
gaaatgttattttttaattatt

SEQ ID NO: 3369019 - DNA, 12 bp, Homo sapiens
gaaattaacaca

SEQ ID NO: 3369020 - DNA, 19 bp, Homo sapiens
gaaattaacacaaaggaag

SEQ ID NO: 3369021 - DNA, 18 bp, Homo sapiens
gaaattaagaaggcaaaa

SEQ ID NO: 3369022 - DNA, 23 bp, Homo sapiens
gaaattaagactttatgtagttt

SEQ ID NO: 3369023 - DNA, 15 bp, Homo sapiens
gaaattacctgtgga

SEQ ID NO: 3369024 - DNA, 19 bp, Homo sapiens
gaaattactacaaaatttg

SEQ ID NO: 3369025 - DNA, 13 bp, Homo sapiens
gaaattactgtgt

SEQ ID NO: 3369026 - DNA, 18 bp, Homo sapiens
gaaattatgtatgtttac

SEQ ID NO: 3369027 - DNA, 15 bp, Homo sapiens
gaaattatttaataa

SEQ ID NO: 3369028 - DNA, 21 bp, Homo sapiens
gaaattccttgccccacagtt

SEQ ID NO: 3369029 - DNA, 17 bp, Homo sapiens
gaaattcgtgtgttttt

SEQ ID NO: 3369030 - DNA, 24 bp, Homo sapiens
gaaattctgttaaaatctattctg

SEQ ID NO: 3369031 - DNA, 17 bp, Homo sapiens
gaaattggaacagaatg

SEQ ID NO: 3369032 - DNA, 20 bp, Homo sapiens
gaaattgtctagcagagcag

SEQ ID NO: 3369033 - DNA, 21 bp, Homo sapiens
gaaattgtctagcagagcagg

SEQ ID NO: 3369034 - DNA, 15 bp, Homo sapiens
gaaatttaaacatta

SEQ ID NO: 3369035 - DNA, 13 bp, Homo sapiens
gaaatttactata

SEQ ID NO: 3369036 - DNA, 21 bp, Homo sapiens
gaaatttattagttaatatat

SEQ ID NO: 3369037 - DNA, 16 bp, Homo sapiens
gaaatttattcacata

SEQ ID NO: 3369038 - DNA, 11 bp, Homo sapiens
gaaatttcaga

SEQ ID NO: 3369039 - DNA, 23 bp, Homo sapiens
gaaatttcagattcccagagcaa

SEQ ID NO: 3369040 - DNA, 14 bp, Homo sapiens
gaaatttgatttct

SEQ ID NO: 3369041 - DNA, 16 bp, Homo sapiens
gaaatttgcaactcac

SEQ ID NO: 3369042 - DNA, 17 bp, Homo sapiens
gaaatttgttataatga

SEQ ID NO: 3369043 - DNA, 15 bp, Homo sapiens
gaaatttgtttgtat

SEQ ID NO: 3369044 - DNA, 21 bp, Homo sapiens
gaaattttcaagagtctaata

SEQ ID NO: 3369045 - DNA, 20 bp, Homo sapiens
gaaattttctagactttctg

SEQ ID NO: 3369046 - DNA, 15 bp, Homo sapiens
gaaattttgcaaata

SEQ ID NO: 3369047 - DNA, 24 bp, Homo sapiens
gaaattttgcaaatataaacatct

SEQ ID NO: 3369048 - DNA, 18 bp, Homo sapiens
gaaatttttattaaatta

SEQ ID NO: 3369049 - DNA, 17 bp, Homo sapiens
gaaatttttcagatgct

SEQ ID NO: 3369050 - DNA, 22 bp, Homo sapiens
gaaatttttcagatgcttctgg

SEQ ID NO: 3369051 - DNA, 18 bp, Homo sapiens
gaacaaaaaaaccacaaa

SEQ ID NO: 3369052 - DNA, 15 bp, Homo sapiens
gaacaaaaagaaatc

SEQ ID NO: 3369053 - DNA, 15 bp, Homo sapiens
gaacaactactgtga

SEQ ID NO: 3369054 - DNA, 21 bp, Homo sapiens
gaacaactaggcttcagcata

SEQ ID NO: 3369055 - DNA, 18 bp, Homo sapiens
gaacaagtaatgtattag

SEQ ID NO: 3369056 - DNA, 19 bp, Homo sapiens
gaacaagtcacagctgcag

SEQ ID NO: 3369057 - DNA, 23 bp, Homo sapiens
gaacaagtgcctcctggactgtt

SEQ ID NO: 3369058 - DNA, 12 bp, Homo sapiens
gaacaagtttta

SEQ ID NO: 3369059 - DNA, 19 bp, Homo sapiens
gaacacaaactgtaaataa

SEQ ID NO: 3369060 - DNA, 16 bp, Homo sapiens
gaacacagcatgtgcc

SEQ ID NO: 3369061 - DNA, 17 bp, Homo sapiens
gaacacagcatgtgcca

SEQ ID NO: 3369062 - DNA, 17 bp, Homo sapiens
gaacacaggcaaaatcc

SEQ ID NO: 3369063 - DNA, 13 bp, Homo sapiens
gaacacaggcagc

SEQ ID NO: 3369064 - DNA, 15 bp, Homo sapiens
gaacacagtattttc

SEQ ID NO: 3369065 - DNA, 22 bp, Homo sapiens
gaacacataaggacgtgtgtaa

SEQ ID NO: 3369066 - DNA, 18 bp, Homo sapiens
gaacacgtgtgcacatgc

SEQ ID NO: 3369067 - DNA, 19 bp, Homo sapiens
gaacactaactcaccagcc

SEQ ID NO: 3369068 - DNA, 22 bp, Homo sapiens
gaacactaactcaccagcccca

SEQ ID NO: 3369069 - DNA, 21 bp, Homo sapiens
gaacactactgctaaatcctc

SEQ ID NO: 3369070 - DNA, 13 bp, Homo sapiens
gaacactattttc

SEQ ID NO: 3369071 - DNA, 16 bp, Homo sapiens
gaacactattttcaga

SEQ ID NO: 3369072 - DNA, 21 bp, Homo sapiens
gaacactattttcagaatctg

SEQ ID NO: 3369073 - DNA, 16 bp, Homo sapiens
gaacactcttttgctt

SEQ ID NO: 3369074 - DNA, 14 bp, Homo sapiens
gaacagaccagtga

SEQ ID NO: 3369075 - DNA, 23 bp, Homo sapiens
gaacagacctgaggcttatcttt

SEQ ID NO: 3369076 - DNA, 19 bp, Homo sapiens
gaacagactggaagcacag

SEQ ID NO: 3369077 - DNA, 18 bp, Homo sapiens
gaacagataatcagtgtg

SEQ ID NO: 3369078 - DNA, 21 bp, Homo sapiens
gaacagcgaagtagcttgctc

SEQ ID NO: 3369079 - DNA, 21 bp, Homo sapiens
gaacagcgggagacctgtgct

SEQ ID NO: 3369080 - DNA, 22 bp, Homo sapiens
gaacagctatgggagccccagg

SEQ ID NO: 3369081 - DNA, 14 bp, Homo sapiens
gaacagctctgaga

SEQ ID NO: 3369082 - DNA, 15 bp, Homo sapiens
gaacagctgtaatct

SEQ ID NO: 3369083 - DNA, 14 bp, Homo sapiens
gaacagcttcaggt

SEQ ID NO: 3369084 - DNA, 14 bp, Homo sapiens
gaacaggctgggct

SEQ ID NO: 3369085 - DNA, 18 bp, Homo sapiens
gaacagtggctgggtggg

SEQ ID NO: 3369086 - DNA, 18 bp, Homo sapiens
gaacagtggttgcctggg

SEQ ID NO: 3369087 - DNA, 18 bp, Homo sapiens
gaacagtgtttcccataa

SEQ ID NO: 3369088 - DNA, 21 bp, Homo sapiens
gaacatagactagagaaaccg

SEQ ID NO: 3369089 - DNA, 19 bp, Homo sapiens
gaacatcataaaattttta

SEQ ID NO: 3369090 - DNA, 17 bp, Homo sapiens
gaacatccaaccttccc

SEQ ID NO: 3369091 - DNA, 17 bp, Homo sapiens
gaacatccctttttcaa

SEQ ID NO: 3369092 - DNA, 21 bp, Homo sapiens
gaacatcctttgcagggcagc

SEQ ID NO: 3369093 - DNA, 19 bp, Homo sapiens
gaacatctaacccactaga

SEQ ID NO: 3369094 - DNA, 23 bp, Homo sapiens
gaacatgcagttcattattttgt

SEQ ID NO: 3369095 - DNA, 13 bp, Homo sapiens
gaacatgccccct

SEQ ID NO: 3369096 - DNA, 17 bp, Homo sapiens
gaacatggacttgtata

SEQ ID NO: 3369097 - DNA, 19 bp, Homo sapiens
gaacatgtgccttttctga

SEQ ID NO: 3369098 - DNA, 20 bp, Homo sapiens
gaacatgtgccttttctgaa

SEQ ID NO: 3369099 - DNA, 17 bp, Homo sapiens
gaacatttaataatgta

SEQ ID NO: 3369100 - DNA, 21 bp, Homo sapiens
gaacatttaataatgtatgta

SEQ ID NO: 3369101 - DNA, 10 bp, Homo sapiens
gaacatttct

SEQ ID NO: 3369102 - DNA, 17 bp, Homo sapiens
gaacatttgatattttt

SEQ ID NO: 3369103 - DNA, 13 bp, Homo sapiens
gaacatttgcttt

SEQ ID NO: 3369104 - DNA, 13 bp, Homo sapiens
gaaccaaagctca

SEQ ID NO: 3369105 - DNA, 14 bp, Homo sapiens
gaaccaaattgcac

SEQ ID NO: 3369106 - DNA, 20 bp, Homo sapiens
gaaccaaattgcactgaagt

SEQ ID NO: 3369107 - DNA, 20 bp, Homo sapiens
gaaccaagcaggagacgaca

SEQ ID NO: 3369108 - DNA, 14 bp, Homo sapiens
gaaccaaggcagcc

SEQ ID NO: 3369109 - DNA, 15 bp, Homo sapiens
gaaccaaggcagcct

SEQ ID NO: 3369110 - DNA, 17 bp, Homo sapiens
gaaccaaggcagcctcc

SEQ ID NO: 3369111 - DNA, 21 bp, Homo sapiens
gaaccaaggcagcctccagag

SEQ ID NO: 3369112 - DNA, 15 bp, Homo sapiens
gaaccacagggccag

SEQ ID NO: 3369113 - DNA, 20 bp, Homo sapiens
gaaccacatcttgctctgct

SEQ ID NO: 3369114 - DNA, 18 bp, Homo sapiens
gaaccaccacacccagcc

SEQ ID NO: 3369115 - DNA, 22 bp, Homo sapiens
gaaccaccacacccagcccact

SEQ ID NO: 3369116 - DNA, 23 bp, Homo sapiens
gaaccaccacacccagcccactt

SEQ ID NO: 3369117 - DNA, 15 bp, Homo sapiens
gaaccaccactgcct

SEQ ID NO: 3369118 - DNA, 13 bp, Homo sapiens
gaaccactgagag

SEQ ID NO: 3369119 - DNA, 16 bp, Homo sapiens
gaaccagccgtatttt

SEQ ID NO: 3369120 - DNA, 20 bp, Homo sapiens
gaaccagccgtattttacat

SEQ ID NO: 3369121 - DNA, 17 bp, Homo sapiens
gaaccagctcatctcca

SEQ ID NO: 3369122 - DNA, 16 bp, Homo sapiens
gaaccagggaggagag

SEQ ID NO: 3369123 - DNA, 15 bp, Homo sapiens
gaaccataaattcaa

SEQ ID NO: 3369124 - DNA, 17 bp, Homo sapiens
gaaccatgaagacagga

SEQ ID NO: 3369125 - DNA, 18 bp, Homo sapiens
gaaccatgaagacaggat

SEQ ID NO: 3369126 - DNA, 14 bp, Homo sapiens
gaaccattatactt

SEQ ID NO: 3369127 - DNA, 18 bp, Homo sapiens
gaaccattatactttata

SEQ ID NO: 3369128 - DNA, 23 bp, Homo sapiens
gaaccattatactttatatctgt

SEQ ID NO: 3369129 - DNA, 13 bp, Homo sapiens
gaaccatttgcaa

SEQ ID NO: 3369130 - DNA, 17 bp, Homo sapiens
gaacccaggacgcttct

SEQ ID NO: 3369131 - DNA, 12 bp, Homo sapiens
gaacccagggct

SEQ ID NO: 3369132 - DNA, 15 bp, Homo sapiens
gaaccccatgggctt

SEQ ID NO: 3369133 - DNA, 17 bp, Homo sapiens
gaaccccatgggcttgg

SEQ ID NO: 3369134 - DNA, 14 bp, Homo sapiens
gaaccccgcagccc

SEQ ID NO: 3369135 - DNA, 16 bp, Homo sapiens
gaaccccgcagcccgt

SEQ ID NO: 3369136 - DNA, 10 bp, Homo sapiens
gaacccctgt

SEQ ID NO: 3369137 - DNA, 13 bp, Homo sapiens
gaaccctgtgctg

SEQ ID NO: 3369138 - DNA, 23 bp, Homo sapiens
gaaccctgtgctggtgtcctgac

SEQ ID NO: 3369139 - DNA, 22 bp, Homo sapiens
gaacccttgcatccattgttgt

SEQ ID NO: 3369140 - DNA, 23 bp, Homo sapiens
gaaccgagcaaagatcaaaataa

SEQ ID NO: 3369141 - DNA, 17 bp, Homo sapiens
gaaccgctcacctagag

SEQ ID NO: 3369142 - DNA, 17 bp, Homo sapiens
gaaccgttttgaagcta

SEQ ID NO: 3369143 - DNA, 19 bp, Homo sapiens
gaacctactgttcctttca

SEQ ID NO: 3369144 - DNA, 21 bp, Homo sapiens
gaacctactgttcctttcaga

SEQ ID NO: 3369145 - DNA, 16 bp, Homo sapiens
gaacctattttcattt

SEQ ID NO: 3369146 - DNA, 18 bp, Homo sapiens
gaacctattttcatttgt

SEQ ID NO: 3369147 - DNA, 22 bp, Homo sapiens
gaacctattttcatttgtacaa

SEQ ID NO: 3369148 - DNA, 14 bp, Homo sapiens
gaacctcaggcttc

SEQ ID NO: 3369149 - DNA, 18 bp, Homo sapiens
gaacctcccagaggtcca

SEQ ID NO: 3369150 - DNA, 14 bp, Homo sapiens
gaacctctgtctca

SEQ ID NO: 3369151 - DNA, 22 bp, Homo sapiens
gaacctctgtctcatcctcctg

SEQ ID NO: 3369152 - DNA, 19 bp, Homo sapiens
gaacctggatgtacttaag

SEQ ID NO: 3369153 - DNA, 21 bp, Homo sapiens
gaacctgggctgtgctgcttt

SEQ ID NO: 3369154 - DNA, 21 bp, Homo sapiens
gaaccttaatgacaacactta

SEQ ID NO: 3369155 - DNA, 19 bp, Homo sapiens
gaaccttccttcctgcttg

SEQ ID NO: 3369156 - DNA, 22 bp, Homo sapiens
gaaccttctagaacctgggctg

SEQ ID NO: 3369157 - DNA, 14 bp, Homo sapiens
gaaccttgctgtcc

SEQ ID NO: 3369158 - DNA, 15 bp, Homo sapiens
gaaccttgctgtcct

SEQ ID NO: 3369159 - DNA, 23 bp, Homo sapiens
gaacctttttttttgaaacagca

SEQ ID NO: 3369160 - DNA, 18 bp, Homo sapiens
gaacgagcactggccaga

SEQ ID NO: 3369161 - DNA, 16 bp, Homo sapiens
gaacgcagaagaaagg

SEQ ID NO: 3369162 - DNA, 22 bp, Homo sapiens
gaacgccagtctcccaggcccc

SEQ ID NO: 3369163 - DNA, 23 bp, Homo sapiens
gaacggagccccaggcctctgtg

SEQ ID NO: 3369164 - DNA, 13 bp, Homo sapiens
gaactaaactagt

SEQ ID NO: 3369165 - DNA, 19 bp, Homo sapiens
gaactaaactagtttttcc

SEQ ID NO: 3369166 - DNA, 14 bp, Homo sapiens
gaactaaatgttct

SEQ ID NO: 3369167 - DNA, 23 bp, Homo sapiens
gaactaatgataatcccaccacc

SEQ ID NO: 3369168 - DNA, 22 bp, Homo sapiens
gaactacgcttgctcatttttt

SEQ ID NO: 3369169 - DNA, 21 bp, Homo sapiens
gaactactgtactttgccatt

SEQ ID NO: 3369170 - DNA, 17 bp, Homo sapiens
gaactagagatgtgcaa

SEQ ID NO: 3369171 - DNA, 14 bp, Homo sapiens
gaactatgaaatca

SEQ ID NO: 3369172 - DNA, 15 bp, Homo sapiens
gaactattggagggt

SEQ ID NO: 3369173 - DNA, 21 bp, Homo sapiens
gaactcaccctgggagccagt

SEQ ID NO: 3369174 - DNA, 16 bp, Homo sapiens
gaactcactctgggct

SEQ ID NO: 3369175 - DNA, 17 bp, Homo sapiens
gaactcactctgggctg

SEQ ID NO: 3369176 - DNA, 18 bp, Homo sapiens
gaactcactctgggctgt

SEQ ID NO: 3369177 - DNA, 14 bp, Homo sapiens
gaactcactggggc

SEQ ID NO: 3369178 - DNA, 23 bp, Homo sapiens
gaactccaggccctcctctccca

SEQ ID NO: 3369179 - DNA, 11 bp, Homo sapiens
gaactcctgcc

SEQ ID NO: 3369180 - DNA, 15 bp, Homo sapiens
gaactcctggcctca

SEQ ID NO: 3369181 - DNA, 20 bp, Homo sapiens
gaactccttattttgtatta

SEQ ID NO: 3369182 - DNA, 14 bp, Homo sapiens
gaactccttggcct

SEQ ID NO: 3369183 - DNA, 15 bp, Homo sapiens
gaactccttggccta

SEQ ID NO: 3369184 - DNA, 21 bp, Homo sapiens
gaactctatctgggcctgggc

SEQ ID NO: 3369185 - DNA, 17 bp, Homo sapiens
gaactctgaactttgga

SEQ ID NO: 3369186 - DNA, 20 bp, Homo sapiens
gaactctgaactttggagag

SEQ ID NO: 3369187 - DNA, 18 bp, Homo sapiens
gaactctgggctgccatg

SEQ ID NO: 3369188 - DNA, 18 bp, Homo sapiens
gaactctggtggcacagg

SEQ ID NO: 3369189 - DNA, 16 bp, Homo sapiens
gaactctgttccccca

SEQ ID NO: 3369190 - DNA, 18 bp, Homo sapiens
gaactctttctggcctgc

SEQ ID NO: 3369191 - DNA, 21 bp, Homo sapiens
gaactgaaataaaaaattatg

SEQ ID NO: 3369192 - DNA, 12 bp, Homo sapiens
gaactgaactca

SEQ ID NO: 3369193 - DNA, 14 bp, Homo sapiens
gaactgactttctc

SEQ ID NO: 3369194 - DNA, 15 bp, Homo sapiens
gaactgactttctcc

SEQ ID NO: 3369195 - DNA, 21 bp, Homo sapiens
gaactgaggagatgaccaggg

SEQ ID NO: 3369196 - DNA, 18 bp, Homo sapiens
gaactgagtcacgctggg

SEQ ID NO: 3369197 - DNA, 14 bp, Homo sapiens
gaactgcaggccct

SEQ ID NO: 3369198 - DNA, 16 bp, Homo sapiens
gaactgcaggccctgg

SEQ ID NO: 3369199 - DNA, 19 bp, Homo sapiens
gaactgcaggccctggcct

SEQ ID NO: 3369200 - DNA, 21 bp, Homo sapiens
gaactgcaggccctggcctcc

SEQ ID NO: 3369201 - DNA, 23 bp, Homo sapiens
gaactgcaggccctggcctcccc

SEQ ID NO: 3369202 - DNA, 13 bp, Homo sapiens
gaactgcccccac

SEQ ID NO: 3369203 - DNA, 15 bp, Homo sapiens
gaactgcccccactg

SEQ ID NO: 3369204 - DNA, 16 bp, Homo sapiens
gaactgcccttgctgc

SEQ ID NO: 3369205 - DNA, 22 bp, Homo sapiens
gaactgctggagtctggcttta

SEQ ID NO: 3369206 - DNA, 14 bp, Homo sapiens
gaactgctttcaag

SEQ ID NO: 3369207 - DNA, 13 bp, Homo sapiens
gaactgcttttcc

SEQ ID NO: 3369208 - DNA, 17 bp, Homo sapiens
gaactgggcctgttgcc

SEQ ID NO: 3369209 - DNA, 16 bp, Homo sapiens
gaactggggctttgcc

SEQ ID NO: 3369210 - DNA, 17 bp, Homo sapiens
gaactgtctgtgaacag

SEQ ID NO: 3369211 - DNA, 20 bp, Homo sapiens
gaactgtgtttcaagttcaa

SEQ ID NO: 3369212 - DNA, 18 bp, Homo sapiens
gaactgttgcctaattgg

SEQ ID NO: 3369213 - DNA, 22 bp, Homo sapiens
gaactgttgcctaattggaaag

SEQ ID NO: 3369214 - DNA, 23 bp, Homo sapiens
gaacttccaggtgttactgtaat

SEQ ID NO: 3369215 - DNA, 22 bp, Homo sapiens
gaacttcccacacgattagctt

SEQ ID NO: 3369216 - DNA, 15 bp, Homo sapiens
gaacttctaatatat

SEQ ID NO: 3369217 - DNA, 16 bp, Homo sapiens
gaacttctgactactt

SEQ ID NO: 3369218 - DNA, 15 bp, Homo sapiens
gaacttgcattgtga

SEQ ID NO: 3369219 - DNA, 23 bp, Homo sapiens
gaacttgcattgtgattggcctg

SEQ ID NO: 3369220 - DNA, 17 bp, Homo sapiens
gaacttgtagctgtaaa

SEQ ID NO: 3369221 - DNA, 20 bp, Homo sapiens
gaacttgtgtccctaatgtg

SEQ ID NO: 3369222 - DNA, 14 bp, Homo sapiens
gaacttgtttacaa

SEQ ID NO: 3369223 - DNA, 15 bp, Homo sapiens
gaactttccattttg

SEQ ID NO: 3369224 - DNA, 21 bp, Homo sapiens
gaactttctcttcatactttt

SEQ ID NO: 3369225 - DNA, 23 bp, Homo sapiens
gaactttctcttcatactttttt

SEQ ID NO: 3369226 - DNA, 21 bp, Homo sapiens
gaacttttggctaacagaaat

SEQ ID NO: 3369227 - DNA, 15 bp, Homo sapiens
gaacttttttaaata

SEQ ID NO: 3369228 - DNA, 17 bp, Homo sapiens
gaacttttttaaataaa

SEQ ID NO: 3369229 - DNA, 22 bp, Homo sapiens
gaacttttttaaataaactttt

SEQ ID NO: 3369230 - DNA, 23 bp, Homo sapiens
gaacttttttaaataaacttttt

SEQ ID NO: 3369231 - DNA, 10 bp, Homo sapiens
gaagaaaaaa

SEQ ID NO: 3369232 - DNA, 16 bp, Homo sapiens
gaagaaaaaaatcttc

SEQ ID NO: 3369233 - DNA, 21 bp, Homo sapiens
gaagaaaaaaatcttctccag

SEQ ID NO: 3369234 - DNA, 14 bp, Homo sapiens
gaagaaaactatcc

SEQ ID NO: 3369235 - DNA, 16 bp, Homo sapiens
gaagaaaatggtttat

SEQ ID NO: 3369236 - DNA, 21 bp, Homo sapiens
gaagaaacacgtggtcatgaa

SEQ ID NO: 3369237 - DNA, 20 bp, Homo sapiens
gaagaaactccgaagaaaag

SEQ ID NO: 3369238 - DNA, 16 bp, Homo sapiens
gaagaaatgtcagatg

SEQ ID NO: 3369239 - DNA, 19 bp, Homo sapiens
gaagaacacagcatgtgcc

SEQ ID NO: 3369240 - DNA, 17 bp, Homo sapiens
gaagaacatccaaggag

SEQ ID NO: 3369241 - DNA, 22 bp, Homo sapiens
gaagaacgaacacaagaaaaag

SEQ ID NO: 3369242 - DNA, 14 bp, Homo sapiens
gaagaactgcaggc

SEQ ID NO: 3369243 - DNA, 17 bp, Homo sapiens
gaagaaggaaacggaag

SEQ ID NO: 3369244 - DNA, 18 bp, Homo sapiens
gaagaaggaaacggaagc

SEQ ID NO: 3369245 - DNA, 12 bp, Homo sapiens
gaagaaggcagt

SEQ ID NO: 3369246 - DNA, 13 bp, Homo sapiens
gaagaaggcagtg

SEQ ID NO: 3369247 - DNA, 16 bp, Homo sapiens
gaagaagggcacccta

SEQ ID NO: 3369248 - DNA, 12 bp, Homo sapiens
gaagaatattta

SEQ ID NO: 3369249 - DNA, 14 bp, Homo sapiens
gaagaatatttaag

SEQ ID NO: 3369250 - DNA, 22 bp, Homo sapiens
gaagaatatttaagaaaagcac

SEQ ID NO: 3369251 - DNA, 23 bp, Homo sapiens
gaagaatatttaagaaaagcact

SEQ ID NO: 3369252 - DNA, 20 bp, Homo sapiens
gaagaatgcacaagaatgga

SEQ ID NO: 3369253 - DNA, 16 bp, Homo sapiens
gaagaatgcattcaaa

SEQ ID NO: 3369254 - DNA, 17 bp, Homo sapiens
gaagaatgcattcaaaa

SEQ ID NO: 3369255 - DNA, 17 bp, Homo sapiens
gaagaatggagaggaac

SEQ ID NO: 3369256 - DNA, 16 bp, Homo sapiens
gaagaattaagataca

SEQ ID NO: 3369257 - DNA, 12 bp, Homo sapiens
gaagaattccag

SEQ ID NO: 3369258 - DNA, 17 bp, Homo sapiens
gaagaattgaaaagttt

SEQ ID NO: 3369259 - DNA, 22 bp, Homo sapiens
gaagaattgaaaagtttttgtt

SEQ ID NO: 3369260 - DNA, 15 bp, Homo sapiens
gaagacaaaaagaca

SEQ ID NO: 3369261 - DNA, 16 bp, Homo sapiens
gaagacactgatgggc

SEQ ID NO: 3369262 - DNA, 14 bp, Homo sapiens
gaagacacttcaga

SEQ ID NO: 3369263 - DNA, 15 bp, Homo sapiens
gaagacaggacagtg

SEQ ID NO: 3369264 - DNA, 18 bp, Homo sapiens
gaagacatgaaccaagtg

SEQ ID NO: 3369265 - DNA, 15 bp, Homo sapiens
gaagacatggagact

SEQ ID NO: 3369266 - DNA, 15 bp, Homo sapiens
gaagacattttttgc

SEQ ID NO: 3369267 - DNA, 20 bp, Homo sapiens
gaagacccaggagagacaga

SEQ ID NO: 3369268 - DNA, 14 bp, Homo sapiens
gaagaccctccccg

SEQ ID NO: 3369269 - DNA, 17 bp, Homo sapiens
gaagaccctcttgccca

SEQ ID NO: 3369270 - DNA, 22 bp, Homo sapiens
gaagaccgtttacctagaagaa

SEQ ID NO: 3369271 - DNA, 20 bp, Homo sapiens
gaagacctcacctagaaatt

SEQ ID NO: 3369272 - DNA, 19 bp, Homo sapiens
gaagactcattcttctgta

SEQ ID NO: 3369273 - DNA, 12 bp, Homo sapiens
gaagactggaag

SEQ ID NO: 3369274 - DNA, 17 bp, Homo sapiens
gaagactggaagctaat

SEQ ID NO: 3369275 - DNA, 19 bp, Homo sapiens
gaagactttaattatatat

SEQ ID NO: 3369276 - DNA, 12 bp, Homo sapiens
gaagagaaattt

SEQ ID NO: 3369277 - DNA, 12 bp, Homo sapiens
gaagagaaggaa

SEQ ID NO: 3369278 - DNA, 23 bp, Homo sapiens
gaagagacagagacaagtaattt

SEQ ID NO: 3369279 - DNA, 12 bp, Homo sapiens
gaagagagccag

SEQ ID NO: 3369280 - DNA, 14 bp, Homo sapiens
gaagagaggagagg

SEQ ID NO: 3369281 - DNA, 19 bp, Homo sapiens
gaagagaggagaggagaga

SEQ ID NO: 3369282 - DNA, 21 bp, Homo sapiens
gaagagcaaaaatatcccttc

SEQ ID NO: 3369283 - DNA, 12 bp, Homo sapiens
gaagagcagcct

SEQ ID NO: 3369284 - DNA, 13 bp, Homo sapiens
gaagagcagcctg

SEQ ID NO: 3369285 - DNA, 22 bp, Homo sapiens
gaagagcgagagatcaaagatg

SEQ ID NO: 3369286 - DNA, 14 bp, Homo sapiens
gaagagcttgcttt

SEQ ID NO: 3369287 - DNA, 22 bp, Homo sapiens
gaagaggcatcctgcctgggtg

SEQ ID NO: 3369288 - DNA, 16 bp, Homo sapiens
gaagaggcgggccagc

SEQ ID NO: 3369289 - DNA, 20 bp, Homo sapiens
gaagagggagaagcatgaaa

SEQ ID NO: 3369290 - DNA, 14 bp, Homo sapiens
gaagaggggcagcc

SEQ ID NO: 3369291 - DNA, 17 bp, Homo sapiens
gaagaggggcagccctt

SEQ ID NO: 3369292 - DNA, 14 bp, Homo sapiens
gaagaggggcagct

SEQ ID NO: 3369293 - DNA, 19 bp, Homo sapiens
gaagagggtgaaaggcagg

SEQ ID NO: 3369294 - DNA, 17 bp, Homo sapiens
gaagagggttttaggta

SEQ ID NO: 3369295 - DNA, 22 bp, Homo sapiens
gaagaggttgggcttccatgcc

SEQ ID NO: 3369296 - DNA, 16 bp, Homo sapiens
gaagagtagcatttca

SEQ ID NO: 3369297 - DNA, 22 bp, Homo sapiens
gaagagtcttggtttctctcta

SEQ ID NO: 3369298 - DNA, 13 bp, Homo sapiens
gaagagtgtgtgt

SEQ ID NO: 3369299 - DNA, 20 bp, Homo sapiens
gaagagtttttgtgatgggg

SEQ ID NO: 3369300 - DNA, 16 bp, Homo sapiens
gaagataacattttca

SEQ ID NO: 3369301 - DNA, 21 bp, Homo sapiens
gaagataagtgtatttttcaa

SEQ ID NO: 3369302 - DNA, 23 bp, Homo sapiens
gaagataatgttctttaatgttg

SEQ ID NO: 3369303 - DNA, 16 bp, Homo sapiens
gaagataattgttgaa

SEQ ID NO: 3369304 - DNA, 16 bp, Homo sapiens
gaagataatttgcata

SEQ ID NO: 3369305 - DNA, 16 bp, Homo sapiens
gaagataggctctgca

SEQ ID NO: 3369306 - DNA, 17 bp, Homo sapiens
gaagataggctctgcac

SEQ ID NO: 3369307 - DNA, 15 bp, Homo sapiens
gaagatatacatgaa

SEQ ID NO: 3369308 - DNA, 21 bp, Homo sapiens
gaagatcagcaccctaagaga

SEQ ID NO: 3369309 - DNA, 17 bp, Homo sapiens
gaagatcctagtgacca

SEQ ID NO: 3369310 - DNA, 14 bp, Homo sapiens
gaagatgaagaagc

SEQ ID NO: 3369311 - DNA, 24 bp, Homo sapiens
gaagatgcgagcgctatcttcaca

SEQ ID NO: 3369312 - DNA, 16 bp, Homo sapiens
gaagatgctgtagtaa

SEQ ID NO: 3369313 - DNA, 22 bp, Homo sapiens
gaagatggtttcaattcagatt

SEQ ID NO: 3369314 - DNA, 23 bp, Homo sapiens
gaagatgttgaagaatacagtta

SEQ ID NO: 3369315 - DNA, 13 bp, Homo sapiens
gaagatgtttact

SEQ ID NO: 3369316 - DNA, 19 bp, Homo sapiens
gaagattaggagaaacaca

SEQ ID NO: 3369317 - DNA, 12 bp, Homo sapiens
gaagatttacct

SEQ ID NO: 3369318 - DNA, 19 bp, Homo sapiens
gaagcaagacacgtggcct

SEQ ID NO: 3369319 - DNA, 13 bp, Homo sapiens
gaagcaaggaaga

SEQ ID NO: 3369320 - DNA, 20 bp, Homo sapiens
gaagcaaggaagatatacat

SEQ ID NO: 3369321 - DNA, 12 bp, Homo sapiens
gaagcaatctcc

SEQ ID NO: 3369322 - DNA, 14 bp, Homo sapiens
gaagcacagcttca

SEQ ID NO: 3369323 - DNA, 16 bp, Homo sapiens
gaagcaccccatgcca

SEQ ID NO: 3369324 - DNA, 22 bp, Homo sapiens
gaagcacctactatgtgctggg

SEQ ID NO: 3369325 - DNA, 14 bp, Homo sapiens
gaagcagccagctc

SEQ ID NO: 3369326 - DNA, 22 bp, Homo sapiens
gaagcagcctctccccaggtcc

SEQ ID NO: 3369327 - DNA, 12 bp, Homo sapiens
gaagcaggctgg

SEQ ID NO: 3369328 - DNA, 12 bp, Homo sapiens
gaagcaggtgtc

SEQ ID NO: 3369329 - DNA, 22 bp, Homo sapiens
gaagcaggttgaggggctcctg

SEQ ID NO: 3369330 - DNA, 20 bp, Homo sapiens
gaagcagtgcctcgaggcac

SEQ ID NO: 3369331 - DNA, 13 bp, Homo sapiens
gaagcagttgtgt

SEQ ID NO: 3369332 - DNA, 16 bp, Homo sapiens
gaagcagttgtgtcag

SEQ ID NO: 3369333 - DNA, 14 bp, Homo sapiens
gaagcatcctccac

SEQ ID NO: 3369334 - DNA, 13 bp, Homo sapiens
gaagcatgaaaaa

SEQ ID NO: 3369335 - DNA, 18 bp, Homo sapiens
gaagcatgctttgctgct

SEQ ID NO: 3369336 - DNA, 19 bp, Homo sapiens
gaagcatgctttgctgcta

SEQ ID NO: 3369337 - DNA, 22 bp, Homo sapiens
gaagcatgctttgctgctatga

SEQ ID NO: 3369338 - DNA, 14 bp, Homo sapiens
gaagcatgtttcat

SEQ ID NO: 3369339 - DNA, 19 bp, Homo sapiens
gaagcatgtttcatgtttt

SEQ ID NO: 3369340 - DNA, 20 bp, Homo sapiens
gaagcattaacttctctgga

SEQ ID NO: 3369341 - DNA, 18 bp, Homo sapiens
gaagcattccttctttga

SEQ ID NO: 3369342 - DNA, 15 bp, Homo sapiens
gaagcatttgtattt

SEQ ID NO: 3369343 - DNA, 16 bp, Homo sapiens
gaagcatttgtatttt

SEQ ID NO: 3369344 - DNA, 20 bp, Homo sapiens
gaagcatttgtattttgtgt

SEQ ID NO: 3369345 - DNA, 14 bp, Homo sapiens
gaagccaaagaaaa

SEQ ID NO: 3369346 - DNA, 13 bp, Homo sapiens
gaagccaaatgaa

SEQ ID NO: 3369347 - DNA, 21 bp, Homo sapiens
gaagccaagctccctggagcc

SEQ ID NO: 3369348 - DNA, 14 bp, Homo sapiens
gaagccaagggaaa

SEQ ID NO: 3369349 - DNA, 17 bp, Homo sapiens
gaagccaagggaaaggg

SEQ ID NO: 3369350 - DNA, 20 bp, Homo sapiens
gaagccaagggaaaggggtg

SEQ ID NO: 3369351 - DNA, 19 bp, Homo sapiens
gaagccaagtggggtgctg

SEQ ID NO: 3369352 - DNA, 18 bp, Homo sapiens
gaagccacgctgtcctct

SEQ ID NO: 3369353 - DNA, 11 bp, Homo sapiens
gaagccagcca

SEQ ID NO: 3369354 - DNA, 20 bp, Homo sapiens
gaagccagccttcttccatc

SEQ ID NO: 3369355 - DNA, 14 bp, Homo sapiens
gaagccaggtacag

SEQ ID NO: 3369356 - DNA, 17 bp, Homo sapiens
gaagccaggtacaggag

SEQ ID NO: 3369357 - DNA, 24 bp, Homo sapiens
gaagccaggtacaggagaggcagc

SEQ ID NO: 3369358 - DNA, 22 bp, Homo sapiens
gaagccatccctttttttacat

SEQ ID NO: 3369359 - DNA, 18 bp, Homo sapiens
gaagcccaattgctggag

SEQ ID NO: 3369360 - DNA, 21 bp, Homo sapiens
gaagcccacactatgcacaga

SEQ ID NO: 3369361 - DNA, 23 bp, Homo sapiens
gaagcccacactatgcacagagc

SEQ ID NO: 3369362 - DNA, 23 bp, Homo sapiens
gaagcccaggccccttttcactc

SEQ ID NO: 3369363 - DNA, 18 bp, Homo sapiens
gaagcccctgggcccagt

SEQ ID NO: 3369364 - DNA, 13 bp, Homo sapiens
gaagccctcccag

SEQ ID NO: 3369365 - DNA, 13 bp, Homo sapiens
gaagccctggaga

SEQ ID NO: 3369366 - DNA, 16 bp, Homo sapiens
gaagccgactctggcc

SEQ ID NO: 3369367 - DNA, 22 bp, Homo sapiens
gaagccgtctgactccagagtc

SEQ ID NO: 3369368 - DNA, 24 bp, Homo sapiens
gaagccgtctgactccagagtctg

SEQ ID NO: 3369369 - DNA, 20 bp, Homo sapiens
gaagcctccaagcctgcctc

SEQ ID NO: 3369370 - DNA, 22 bp, Homo sapiens
gaagcctccaagcctgcctccc

SEQ ID NO: 3369371 - DNA, 13 bp, Homo sapiens
gaagcctgaggct

SEQ ID NO: 3369372 - DNA, 12 bp, Homo sapiens
gaagcctgccct

SEQ ID NO: 3369373 - DNA, 23 bp, Homo sapiens
gaagcctgcgttggtccagagcg

SEQ ID NO: 3369374 - DNA, 20 bp, Homo sapiens
gaagccttaatttgcacagt

SEQ ID NO: 3369375 - DNA, 15 bp, Homo sapiens
gaagccttctgcagc

SEQ ID NO: 3369376 - DNA, 22 bp, Homo sapiens
gaagccttctgcagcaggaact

SEQ ID NO: 3369377 - DNA, 16 bp, Homo sapiens
gaagcgcttctgcacc

SEQ ID NO: 3369378 - DNA, 18 bp, Homo sapiens
gaagcgttatgtgcagta

SEQ ID NO: 3369379 - DNA, 13 bp, Homo sapiens
gaagcgtttttaa

SEQ ID NO: 3369380 - DNA, 15 bp, Homo sapiens
gaagctaatttgcat

SEQ ID NO: 3369381 - DNA, 17 bp, Homo sapiens
gaagctaatttgcatta

SEQ ID NO: 3369382 - DNA, 21 bp, Homo sapiens
gaagctatttttttaagctat

SEQ ID NO: 3369383 - DNA, 13 bp, Homo sapiens
gaagctccactgt

SEQ ID NO: 3369384 - DNA, 14 bp, Homo sapiens
gaagctccactgtc

SEQ ID NO: 3369385 - DNA, 16 bp, Homo sapiens
gaagctccactgtcac

SEQ ID NO: 3369386 - DNA, 18 bp, Homo sapiens
gaagctccactgtcaccc

SEQ ID NO: 3369387 - DNA, 23 bp, Homo sapiens
gaagctccactgtcaccctccac

SEQ ID NO: 3369388 - DNA, 19 bp, Homo sapiens
gaagctcgccccacctcca

SEQ ID NO: 3369389 - DNA, 21 bp, Homo sapiens
gaagctgaaaggatgatcctg

SEQ ID NO: 3369390 - DNA, 15 bp, Homo sapiens
gaagctgcagatctt

SEQ ID NO: 3369391 - DNA, 18 bp, Homo sapiens
gaagctgcagcttgggag

SEQ ID NO: 3369392 - DNA, 18 bp, Homo sapiens
gaagctgcaggggcagga

SEQ ID NO: 3369393 - DNA, 16 bp, Homo sapiens
gaagctgccagcccag

SEQ ID NO: 3369394 - DNA, 14 bp, Homo sapiens
gaagctggtgccct

SEQ ID NO: 3369395 - DNA, 13 bp, Homo sapiens
gaagctgttgtac

SEQ ID NO: 3369396 - DNA, 18 bp, Homo sapiens
gaagctgtttggaaaaga

SEQ ID NO: 3369397 - DNA, 15 bp, Homo sapiens
gaagcttgactccca

SEQ ID NO: 3369398 - DNA, 15 bp, Homo sapiens
gaaggaaaagcaaga

SEQ ID NO: 3369399 - DNA, 14 bp, Homo sapiens
gaaggaaaatgata

SEQ ID NO: 3369400 - DNA, 14 bp, Homo sapiens
gaaggaaacggaag

SEQ ID NO: 3369401 - DNA, 22 bp, Homo sapiens
gaaggaaagaagggggccctgc

SEQ ID NO: 3369402 - DNA, 17 bp, Homo sapiens
gaaggaaataaaaaagt

SEQ ID NO: 3369403 - DNA, 22 bp, Homo sapiens
gaaggaagccaaatttatcaaa

SEQ ID NO: 3369404 - DNA, 21 bp, Homo sapiens
gaaggaagctgtgttgaaaca

SEQ ID NO: 3369405 - DNA, 23 bp, Homo sapiens
gaaggaagctgtgttgaaacaga

SEQ ID NO: 3369406 - DNA, 19 bp, Homo sapiens
gaaggaatagccagagagg

SEQ ID NO: 3369407 - DNA, 15 bp, Homo sapiens
gaaggacagaaagga

SEQ ID NO: 3369408 - DNA, 17 bp, Homo sapiens
gaaggacagaaaggaga

SEQ ID NO: 3369409 - DNA, 14 bp, Homo sapiens
gaaggacaggaccc

SEQ ID NO: 3369410 - DNA, 20 bp, Homo sapiens
gaaggacaggaccctcagga

SEQ ID NO: 3369411 - DNA, 16 bp, Homo sapiens
gaaggaccacatttta

SEQ ID NO: 3369412 - DNA, 22 bp, Homo sapiens
gaaggacccggaggggcctggc

SEQ ID NO: 3369413 - DNA, 23 bp, Homo sapiens
gaaggacccggaggggcctggca

SEQ ID NO: 3369414 - DNA, 17 bp, Homo sapiens
gaaggacttagccgact

SEQ ID NO: 3369415 - DNA, 19 bp, Homo sapiens
gaaggagattccacacagg

SEQ ID NO: 3369416 - DNA, 14 bp, Homo sapiens
gaaggagcggcgcc

SEQ ID NO: 3369417 - DNA, 22 bp, Homo sapiens
gaaggagcggcgccctggactt

SEQ ID NO: 3369418 - DNA, 20 bp, Homo sapiens
gaaggaggccaaccagcccg

SEQ ID NO: 3369419 - DNA, 13 bp, Homo sapiens
gaaggagggcaga

SEQ ID NO: 3369420 - DNA, 15 bp, Homo sapiens
gaaggagggcagagc

SEQ ID NO: 3369421 - DNA, 16 bp, Homo sapiens
gaaggagggcagagcc

SEQ ID NO: 3369422 - DNA, 14 bp, Homo sapiens
gaaggaggggaagc

SEQ ID NO: 3369423 - DNA, 16 bp, Homo sapiens
gaaggaggggaagctg

SEQ ID NO: 3369424 - DNA, 19 bp, Homo sapiens
gaaggaggggaagctgcag

SEQ ID NO: 3369425 - DNA, 20 bp, Homo sapiens
gaaggaggggaagctgcagc

SEQ ID NO: 3369426 - DNA, 20 bp, Homo sapiens
gaaggagggtacagctgggc

SEQ ID NO: 3369427 - DNA, 14 bp, Homo sapiens
gaaggatccaggaa

SEQ ID NO: 3369428 - DNA, 14 bp, Homo sapiens
gaaggattgtaaaa

SEQ ID NO: 3369429 - DNA, 19 bp, Homo sapiens
gaaggattttttaaagttt

SEQ ID NO: 3369430 - DNA, 17 bp, Homo sapiens
gaaggcaagagggggtg

SEQ ID NO: 3369431 - DNA, 13 bp, Homo sapiens
gaaggcagacagc

SEQ ID NO: 3369432 - DNA, 15 bp, Homo sapiens
gaaggcagacagcag

SEQ ID NO: 3369433 - DNA, 16 bp, Homo sapiens
gaaggcagacagcagg

SEQ ID NO: 3369434 - DNA, 21 bp, Homo sapiens
gaaggcagacagcaggcagcg

SEQ ID NO: 3369435 - DNA, 18 bp, Homo sapiens
gaaggcagagaaatctaa

SEQ ID NO: 3369436 - DNA, 14 bp, Homo sapiens
gaaggcagctgctc

SEQ ID NO: 3369437 - DNA, 15 bp, Homo sapiens
gaaggcagctgctct

SEQ ID NO: 3369438 - DNA, 13 bp, Homo sapiens
gaaggcagggaaa

SEQ ID NO: 3369439 - DNA, 15 bp, Homo sapiens
gaaggcagggcagag

SEQ ID NO: 3369440 - DNA, 13 bp, Homo sapiens
gaaggcagtggca

SEQ ID NO: 3369441 - DNA, 17 bp, Homo sapiens
gaaggcatttgcagggt

SEQ ID NO: 3369442 - DNA, 24 bp, Homo sapiens
gaaggcctaggctaggacgttggc

SEQ ID NO: 3369443 - DNA, 18 bp, Homo sapiens
gaaggcctcttgtgctca

SEQ ID NO: 3369444 - DNA, 14 bp, Homo sapiens
gaaggcgaggagag

SEQ ID NO: 3369445 - DNA, 13 bp, Homo sapiens
gaaggctggctgg

SEQ ID NO: 3369446 - DNA, 16 bp, Homo sapiens
gaaggctggctgggca

SEQ ID NO: 3369447 - DNA, 17 bp, Homo sapiens
gaaggcttaagaactgc

SEQ ID NO: 3369448 - DNA, 15 bp, Homo sapiens
gaaggcttgggattt

SEQ ID NO: 3369449 - DNA, 17 bp, Homo sapiens
gaaggcttgggatttgc

SEQ ID NO: 3369450 - DNA, 16 bp, Homo sapiens
gaagggaaacaaagaa

SEQ ID NO: 3369451 - DNA, 15 bp, Homo sapiens
gaagggaagagacag

SEQ ID NO: 3369452 - DNA, 23 bp, Homo sapiens
gaagggaattgctcagagaagga

SEQ ID NO: 3369453 - DNA, 22 bp, Homo sapiens
gaagggaccaaggcaaggcagg

SEQ ID NO: 3369454 - DNA, 23 bp, Homo sapiens
gaagggagaagacactgcagtga

SEQ ID NO: 3369455 - DNA, 16 bp, Homo sapiens
gaagggaggggctgtg

SEQ ID NO: 3369456 - DNA, 21 bp, Homo sapiens
gaagggcataaaacagctttg

SEQ ID NO: 3369457 - DNA, 22 bp, Homo sapiens
gaagggccagtcctgcctggcc

SEQ ID NO: 3369458 - DNA, 18 bp, Homo sapiens
gaagggccagtctgggct

SEQ ID NO: 3369459 - DNA, 23 bp, Homo sapiens
gaaggggaggcagccggcaccca

SEQ ID NO: 3369460 - DNA, 13 bp, Homo sapiens
gaaggggcacacc

SEQ ID NO: 3369461 - DNA, 13 bp, Homo sapiens
gaaggggccatca

SEQ ID NO: 3369462 - DNA, 14 bp, Homo sapiens
gaaggggccccggg

SEQ ID NO: 3369463 - DNA, 20 bp, Homo sapiens
gaaggggccccggggctggc

SEQ ID NO: 3369464 - DNA, 22 bp, Homo sapiens
gaaggggcctcaccgagtgggg

SEQ ID NO: 3369465 - DNA, 23 bp, Homo sapiens
gaaggggggttgcagtggagagg

SEQ ID NO: 3369466 - DNA, 13 bp, Homo sapiens
gaagggtcctgcc

SEQ ID NO: 3369467 - DNA, 20 bp, Homo sapiens
gaagggttttccaccctgga

SEQ ID NO: 3369468 - DNA, 13 bp, Homo sapiens
gaaggtaattaaa

SEQ ID NO: 3369469 - DNA, 14 bp, Homo sapiens
gaaggtcaaggtca

SEQ ID NO: 3369470 - DNA, 17 bp, Homo sapiens
gaaggtcacctgagccc

SEQ ID NO: 3369471 - DNA, 17 bp, Homo sapiens
gaaggtgataagggaaa

SEQ ID NO: 3369472 - DNA, 23 bp, Homo sapiens
gaaggtgataagggaaaagataa

SEQ ID NO: 3369473 - DNA, 22 bp, Homo sapiens
gaaggtgcctcagactccgccc

SEQ ID NO: 3369474 - DNA, 18 bp, Homo sapiens
gaaggtgctggaggtggg

SEQ ID NO: 3369475 - DNA, 21 bp, Homo sapiens
gaaggtgctggaggtgggagc

SEQ ID NO: 3369476 - DNA, 20 bp, Homo sapiens
gaaggtggggccctgcccct

SEQ ID NO: 3369477 - DNA, 16 bp, Homo sapiens
gaaggtttgtatattg

SEQ ID NO: 3369478 - DNA, 13 bp, Homo sapiens
gaaggttttaagt

SEQ ID NO: 3369479 - DNA, 13 bp, Homo sapiens
gaagtaaactttt

SEQ ID NO: 3369480 - DNA, 16 bp, Homo sapiens
gaagtaaactttttgt

SEQ ID NO: 3369481 - DNA, 19 bp, Homo sapiens
gaagtaaccatttgcactg

SEQ ID NO: 3369482 - DNA, 22 bp, Homo sapiens
gaagtaagtttatccaaatctt

SEQ ID NO: 3369483 - DNA, 21 bp, Homo sapiens
gaagtacgttattgttgactt

SEQ ID NO: 3369484 - DNA, 18 bp, Homo sapiens
gaagtatacttttcccct

SEQ ID NO: 3369485 - DNA, 15 bp, Homo sapiens
gaagtcatcttgcta

SEQ ID NO: 3369486 - DNA, 18 bp, Homo sapiens
gaagtcatcttgctacca

SEQ ID NO: 3369487 - DNA, 22 bp, Homo sapiens
gaagtctacctgctggacagcc

SEQ ID NO: 3369488 - DNA, 15 bp, Homo sapiens
gaagtcttagatgta

SEQ ID NO: 3369489 - DNA, 18 bp, Homo sapiens
gaagtctttgccttctct

SEQ ID NO: 3369490 - DNA, 16 bp, Homo sapiens
gaagtgaatgctggga

SEQ ID NO: 3369491 - DNA, 17 bp, Homo sapiens
gaagtgaatgctgggac

SEQ ID NO: 3369492 - DNA, 16 bp, Homo sapiens
gaagtgagcacagcct

SEQ ID NO: 3369493 - DNA, 22 bp, Homo sapiens
gaagtgatactatccagttact

SEQ ID NO: 3369494 - DNA, 14 bp, Homo sapiens
gaagtgcatttctg

SEQ ID NO: 3369495 - DNA, 23 bp, Homo sapiens
gaagtgcatttctgaatagaaat

SEQ ID NO: 3369496 - DNA, 16 bp, Homo sapiens
gaagtgccccctcccc

SEQ ID NO: 3369497 - DNA, 20 bp, Homo sapiens
gaagtgctgtttattaatct

SEQ ID NO: 3369498 - DNA, 10 bp, Homo sapiens
gaagtggaag

SEQ ID NO: 3369499 - DNA, 16 bp, Homo sapiens
gaagtggctgtccctg

SEQ ID NO: 3369500 - DNA, 14 bp, Homo sapiens
gaagtgtaacagct

SEQ ID NO: 3369501 - DNA, 15 bp, Homo sapiens
gaagtgtaacagctg

SEQ ID NO: 3369502 - DNA, 17 bp, Homo sapiens
gaagtgttcaagaaata

SEQ ID NO: 3369503 - DNA, 13 bp, Homo sapiens
gaagttactttgt

SEQ ID NO: 3369504 - DNA, 20 bp, Homo sapiens
gaagttactttgtaattttt

SEQ ID NO: 3369505 - DNA, 15 bp, Homo sapiens
gaagttagtggaaat

SEQ ID NO: 3369506 - DNA, 21 bp, Homo sapiens
gaagttattttctacagtggt

SEQ ID NO: 3369507 - DNA, 20 bp, Homo sapiens
gaagttgcattcctttgtct

SEQ ID NO: 3369508 - DNA, 14 bp, Homo sapiens
gaagttggcacatt

SEQ ID NO: 3369509 - DNA, 17 bp, Homo sapiens
gaagtttattctcattt

SEQ ID NO: 3369510 - DNA, 22 bp, Homo sapiens
gaagtttcaagttttaaagttc

SEQ ID NO: 3369511 - DNA, 16 bp, Homo sapiens
gaagtttgtccatttg

SEQ ID NO: 3369512 - DNA, 21 bp, Homo sapiens
gaagtttgtccatttgtaaaa

SEQ ID NO: 3369513 - DNA, 17 bp, Homo sapiens
gaagttttgcatttatg

SEQ ID NO: 3369514 - DNA, 18 bp, Homo sapiens
gaagtttttgaaatacct

SEQ ID NO: 3369515 - DNA, 18 bp, Homo sapiens
gaagtttttgtactgtaa

SEQ ID NO: 3369516 - DNA, 19 bp, Homo sapiens
gaagtttttgtactgtaaa

SEQ ID NO: 3369517 - DNA, 22 bp, Homo sapiens
gaataaaaaatagacatgtagt

SEQ ID NO: 3369518 - DNA, 18 bp, Homo sapiens
gaataaaacactcatccc

SEQ ID NO: 3369519 - DNA, 12 bp, Homo sapiens
gaataaagcagc

SEQ ID NO: 3369520 - DNA, 15 bp, Homo sapiens
gaataaagcagcctg

SEQ ID NO: 3369521 - DNA, 20 bp, Homo sapiens
gaataaagcagcctgattga

SEQ ID NO: 3369522 - DNA, 15 bp, Homo sapiens
gaataaagtattcta

SEQ ID NO: 3369523 - DNA, 13 bp, Homo sapiens
gaataaagtattg

SEQ ID NO: 3369524 - DNA, 15 bp, Homo sapiens
gaataaagtattgtc

SEQ ID NO: 3369525 - DNA, 14 bp, Homo sapiens
gaataaagttctga

SEQ ID NO: 3369526 - DNA, 14 bp, Homo sapiens
gaataaagttgaag

SEQ ID NO: 3369527 - DNA, 16 bp, Homo sapiens
gaataaagttgaagct

SEQ ID NO: 3369528 - DNA, 15 bp, Homo sapiens
gaataaagttgcaga

SEQ ID NO: 3369529 - DNA, 15 bp, Homo sapiens
gaataaattgctcct

SEQ ID NO: 3369530 - DNA, 18 bp, Homo sapiens
gaataacatgtaattaag

SEQ ID NO: 3369531 - DNA, 20 bp, Homo sapiens
gaataactcagaatattgtc

SEQ ID NO: 3369532 - DNA, 13 bp, Homo sapiens
gaataagctttct

SEQ ID NO: 3369533 - DNA, 12 bp, Homo sapiens
gaataaggagga

SEQ ID NO: 3369534 - DNA, 13 bp, Homo sapiens
gaataaggaggag

SEQ ID NO: 3369535 - DNA, 14 bp, Homo sapiens
gaataaggaggagg

SEQ ID NO: 3369536 - DNA, 15 bp, Homo sapiens
gaataaggaggagga

SEQ ID NO: 3369537 - DNA, 12 bp, Homo sapiens
gaataatagaag

SEQ ID NO: 3369538 - DNA, 15 bp, Homo sapiens
gaataatagaagaac

SEQ ID NO: 3369539 - DNA, 18 bp, Homo sapiens
gaataatcacgctttcct

SEQ ID NO: 3369540 - DNA, 19 bp, Homo sapiens
gaataatcacgctttcctg

SEQ ID NO: 3369541 - DNA, 20 bp, Homo sapiens
gaataatcacgctttcctga

SEQ ID NO: 3369542 - DNA, 15 bp, Homo sapiens
gaataatggaaacat

SEQ ID NO: 3369543 - DNA, 16 bp, Homo sapiens
gaataatggaaacatt

SEQ ID NO: 3369544 - DNA, 20 bp, Homo sapiens
gaataatggaaacattacag

SEQ ID NO: 3369545 - DNA, 22 bp, Homo sapiens
gaataatgtaaaatgttgaata

SEQ ID NO: 3369546 - DNA, 13 bp, Homo sapiens
gaataatgtgtta

SEQ ID NO: 3369547 - DNA, 23 bp, Homo sapiens
gaataatttcccaattaggaagt

SEQ ID NO: 3369548 - DNA, 17 bp, Homo sapiens
gaatacaattaaaggtc

SEQ ID NO: 3369549 - DNA, 21 bp, Homo sapiens
gaatacagtaagctgctctat

SEQ ID NO: 3369550 - DNA, 20 bp, Homo sapiens
gaatacagtgttattttctt

SEQ ID NO: 3369551 - DNA, 21 bp, Homo sapiens
gaataccattaaaactgcttt

SEQ ID NO: 3369552 - DNA, 13 bp, Homo sapiens
gaatactgctaca

SEQ ID NO: 3369553 - DNA, 16 bp, Homo sapiens
gaatactgcttgctta

SEQ ID NO: 3369554 - DNA, 23 bp, Homo sapiens
gaatactgcttgcttacaatctt

SEQ ID NO: 3369555 - DNA, 17 bp, Homo sapiens
gaatacttactataatt

SEQ ID NO: 3369556 - DNA, 17 bp, Homo sapiens
gaatactttcttagatt

SEQ ID NO: 3369557 - DNA, 14 bp, Homo sapiens
gaatactttttaca

SEQ ID NO: 3369558 - DNA, 23 bp, Homo sapiens
gaatagaaataaaggatgtgatt

SEQ ID NO: 3369559 - DNA, 13 bp, Homo sapiens
gaatagaggaaga

SEQ ID NO: 3369560 - DNA, 15 bp, Homo sapiens
gaatagaggaagaaa

SEQ ID NO: 3369561 - DNA, 15 bp, Homo sapiens
gaatagatgctgact

SEQ ID NO: 3369562 - DNA, 19 bp, Homo sapiens
gaatagatgtgatcactga

SEQ ID NO: 3369563 - DNA, 15 bp, Homo sapiens
gaatagccagagagg

SEQ ID NO: 3369564 - DNA, 22 bp, Homo sapiens
gaatagctgggactacaggtgt

SEQ ID NO: 3369565 - DNA, 17 bp, Homo sapiens
gaatataacatgtaaaa

SEQ ID NO: 3369566 - DNA, 13 bp, Homo sapiens
gaatataagaaaa

SEQ ID NO: 3369567 - DNA, 12 bp, Homo sapiens
gaatataattat

SEQ ID NO: 3369568 - DNA, 15 bp, Homo sapiens
gaatatatatatata

SEQ ID NO: 3369569 - DNA, 22 bp, Homo sapiens
gaatatcatctgtcattatatt

SEQ ID NO: 3369570 - DNA, 19 bp, Homo sapiens
gaatatccatgtacttgtt

SEQ ID NO: 3369571 - DNA, 14 bp, Homo sapiens
gaatattaaaaaac

SEQ ID NO: 3369572 - DNA, 20 bp, Homo sapiens
gaatattcagagaatatcaa

SEQ ID NO: 3369573 - DNA, 15 bp, Homo sapiens
gaatattcaggactt

SEQ ID NO: 3369574 - DNA, 20 bp, Homo sapiens
gaatatttaagaaaagcact

SEQ ID NO: 3369575 - DNA, 10 bp, Homo sapiens
gaatatttat

SEQ ID NO: 3369576 - DNA, 15 bp, Homo sapiens
gaatatttatactat

SEQ ID NO: 3369577 - DNA, 19 bp, Homo sapiens
gaatatttattacctctga

SEQ ID NO: 3369578 - DNA, 11 bp, Homo sapiens
gaatatttgaa

SEQ ID NO: 3369579 - DNA, 12 bp, Homo sapiens
gaatatttgaat

SEQ ID NO: 3369580 - DNA, 13 bp, Homo sapiens
gaatatttgaata

SEQ ID NO: 3369581 - DNA, 15 bp, Homo sapiens
gaatatttgaataat

SEQ ID NO: 3369582 - DNA, 18 bp, Homo sapiens
gaatattttggaaactgc

SEQ ID NO: 3369583 - DNA, 20 bp, Homo sapiens
gaatattttggaaactgcta

SEQ ID NO: 3369584 - DNA, 22 bp, Homo sapiens
gaatattttggaaactgctaaa

SEQ ID NO: 3369585 - DNA, 23 bp, Homo sapiens
gaatattttgttttgtgcagaga

SEQ ID NO: 3369586 - DNA, 21 bp, Homo sapiens
gaatattttttatttctaagt

SEQ ID NO: 3369587 - DNA, 14 bp, Homo sapiens
gaatcaaaactctc

SEQ ID NO: 3369588 - DNA, 20 bp, Homo sapiens
gaatcaagatgtcagactgg

SEQ ID NO: 3369589 - DNA, 13 bp, Homo sapiens
gaatcaatgaaaa

SEQ ID NO: 3369590 - DNA, 13 bp, Homo sapiens
gaatcagaaacag

SEQ ID NO: 3369591 - DNA, 16 bp, Homo sapiens
gaatcagagtagaaat

SEQ ID NO: 3369592 - DNA, 23 bp, Homo sapiens
gaatcaggaatattttccaaaga

SEQ ID NO: 3369593 - DNA, 13 bp, Homo sapiens
gaatcaggagagg

SEQ ID NO: 3369594 - DNA, 18 bp, Homo sapiens
gaatcagggaccagcttt

SEQ ID NO: 3369595 - DNA, 20 bp, Homo sapiens
gaatcagggaccagctttac

SEQ ID NO: 3369596 - DNA, 19 bp, Homo sapiens
gaatcagtataaacaaagt

SEQ ID NO: 3369597 - DNA, 19 bp, Homo sapiens
gaatcatgtgaacccggga

SEQ ID NO: 3369598 - DNA, 13 bp, Homo sapiens
gaatccaaacttg

SEQ ID NO: 3369599 - DNA, 15 bp, Homo sapiens
gaatccaagattggt

SEQ ID NO: 3369600 - DNA, 14 bp, Homo sapiens
gaatccaagcctcc

SEQ ID NO: 3369601 - DNA, 17 bp, Homo sapiens
gaatccaagcctccaca

SEQ ID NO: 3369602 - DNA, 16 bp, Homo sapiens
gaatccaagctccctg

SEQ ID NO: 3369603 - DNA, 18 bp, Homo sapiens
gaatccaagctccctgcc

SEQ ID NO: 3369604 - DNA, 16 bp, Homo sapiens
gaatccacatttctaa

SEQ ID NO: 3369605 - DNA, 18 bp, Homo sapiens
gaatccagacccggctgc

SEQ ID NO: 3369606 - DNA, 20 bp, Homo sapiens
gaatccagacccggctgcgt

SEQ ID NO: 3369607 - DNA, 13 bp, Homo sapiens
gaatccagctccc

SEQ ID NO: 3369608 - DNA, 22 bp, Homo sapiens
gaatccagctccctagactgca

SEQ ID NO: 3369609 - DNA, 15 bp, Homo sapiens
gaatccataaatgtg

SEQ ID NO: 3369610 - DNA, 18 bp, Homo sapiens
gaatccataaatgtgttc

SEQ ID NO: 3369611 - DNA, 20 bp, Homo sapiens
gaatccataaatgtgttcct

SEQ ID NO: 3369612 - DNA, 19 bp, Homo sapiens
gaatcccaaatttgattga

SEQ ID NO: 3369613 - DNA, 16 bp, Homo sapiens
gaatcccactgtatga

SEQ ID NO: 3369614 - DNA, 15 bp, Homo sapiens
gaatcccccagggaa

SEQ ID NO: 3369615 - DNA, 18 bp, Homo sapiens
gaatcctcagttggaatc

SEQ ID NO: 3369616 - DNA, 16 bp, Homo sapiens
gaatcctggcagccca

SEQ ID NO: 3369617 - DNA, 19 bp, Homo sapiens
gaatcctttggtgccaact

SEQ ID NO: 3369618 - DNA, 22 bp, Homo sapiens
gaatctaaggataatgaaataa

SEQ ID NO: 3369619 - DNA, 22 bp, Homo sapiens
gaatctacccccagatccaagc

SEQ ID NO: 3369620 - DNA, 15 bp, Homo sapiens
gaatctactaattcc

SEQ ID NO: 3369621 - DNA, 13 bp, Homo sapiens
gaatctatattta

SEQ ID NO: 3369622 - DNA, 18 bp, Homo sapiens
gaatctcataattggaat

SEQ ID NO: 3369623 - DNA, 15 bp, Homo sapiens
gaatctctgtgcctt

SEQ ID NO: 3369624 - DNA, 13 bp, Homo sapiens
gaatctgaatgta

SEQ ID NO: 3369625 - DNA, 15 bp, Homo sapiens
gaatctgctcacttt

SEQ ID NO: 3369626 - DNA, 21 bp, Homo sapiens
gaatctgctgttgccatagcc

SEQ ID NO: 3369627 - DNA, 16 bp, Homo sapiens
gaatctgtgcaaacag

SEQ ID NO: 3369628 - DNA, 20 bp, Homo sapiens
gaatctgtgggtctgggagt

SEQ ID NO: 3369629 - DNA, 14 bp, Homo sapiens
gaatctgtgtgaaa

SEQ ID NO: 3369630 - DNA, 16 bp, Homo sapiens
gaatcttctccagtat

SEQ ID NO: 3369631 - DNA, 20 bp, Homo sapiens
gaatcttgttttgaaaataa

SEQ ID NO: 3369632 - DNA, 15 bp, Homo sapiens
gaatgaaaaaacagt

SEQ ID NO: 3369633 - DNA, 15 bp, Homo sapiens
gaatgaaaaatttaa

SEQ ID NO: 3369634 - DNA, 19 bp, Homo sapiens
gaatgaaaaatttaagcat

SEQ ID NO: 3369635 - DNA, 23 bp, Homo sapiens
gaatgaaaaatttaagcattgtt

SEQ ID NO: 3369636 - DNA, 16 bp, Homo sapiens
gaatgaaaacatttta

SEQ ID NO: 3369637 - DNA, 23 bp, Homo sapiens
gaatgaaaataactgaatttgga

SEQ ID NO: 3369638 - DNA, 20 bp, Homo sapiens
gaatgaacactcttttgctt

SEQ ID NO: 3369639 - DNA, 16 bp, Homo sapiens
gaatgacaacagaagc

SEQ ID NO: 3369640 - DNA, 17 bp, Homo sapiens
gaatgactataaacatt

SEQ ID NO: 3369641 - DNA, 11 bp, Homo sapiens
gaatgagagag

SEQ ID NO: 3369642 - DNA, 14 bp, Homo sapiens
gaatgagcccagag

SEQ ID NO: 3369643 - DNA, 16 bp, Homo sapiens
gaatgagcccagagaa

SEQ ID NO: 3369644 - DNA, 11 bp, Homo sapiens
gaatgagcctc

SEQ ID NO: 3369645 - DNA, 13 bp, Homo sapiens
gaatgagcctcgg

SEQ ID NO: 3369646 - DNA, 14 bp, Homo sapiens
gaatgaggaaaatt

SEQ ID NO: 3369647 - DNA, 14 bp, Homo sapiens
gaatgaggtgggag

SEQ ID NO: 3369648 - DNA, 22 bp, Homo sapiens
gaatgaggtgggaggtggaaga

SEQ ID NO: 3369649 - DNA, 14 bp, Homo sapiens
gaatgagtgtgcat

SEQ ID NO: 3369650 - DNA, 16 bp, Homo sapiens
gaatgatctcttcttt

SEQ ID NO: 3369651 - DNA, 15 bp, Homo sapiens
gaatgattcatgtta

SEQ ID NO: 3369652 - DNA, 14 bp, Homo sapiens
gaatgatttcatgc

SEQ ID NO: 3369653 - DNA, 16 bp, Homo sapiens
gaatgatttttagatg

SEQ ID NO: 3369654 - DNA, 22 bp, Homo sapiens
gaatgcagattcctgggcctgt

SEQ ID NO: 3369655 - DNA, 19 bp, Homo sapiens
gaatgccatctatctagtt

SEQ ID NO: 3369656 - DNA, 13 bp, Homo sapiens
gaatgcctcctcc

SEQ ID NO: 3369657 - DNA, 14 bp, Homo sapiens
gaatgcctcctgtg

SEQ ID NO: 3369658 - DNA, 19 bp, Homo sapiens
gaatgcctcgctcccttca

SEQ ID NO: 3369659 - DNA, 21 bp, Homo sapiens
gaatgcctcgctcccttcaag

SEQ ID NO: 3369660 - DNA, 12 bp, Homo sapiens
gaatgcctgtgc

SEQ ID NO: 3369661 - DNA, 13 bp, Homo sapiens
gaatgcctgtgcc

SEQ ID NO: 3369662 - DNA, 15 bp, Homo sapiens
gaatgcgctttattg

SEQ ID NO: 3369663 - DNA, 20 bp, Homo sapiens
gaatgcgctttattgcccat

SEQ ID NO: 3369664 - DNA, 14 bp, Homo sapiens
gaatgctaagtcca

SEQ ID NO: 3369665 - DNA, 15 bp, Homo sapiens
gaatgctctgtgcca

SEQ ID NO: 3369666 - DNA, 21 bp, Homo sapiens
gaatgctgcaggacttgagaa

SEQ ID NO: 3369667 - DNA, 17 bp, Homo sapiens
gaatgctgggactcagc

SEQ ID NO: 3369668 - DNA, 18 bp, Homo sapiens
gaatgctgggactcagcc

SEQ ID NO: 3369669 - DNA, 17 bp, Homo sapiens
gaatgctgtacatctat

SEQ ID NO: 3369670 - DNA, 19 bp, Homo sapiens
gaatggaaaaatccttgaa

SEQ ID NO: 3369671 - DNA, 16 bp, Homo sapiens
gaatggaaagcggagt

SEQ ID NO: 3369672 - DNA, 18 bp, Homo sapiens
gaatggaagcaaagtgct

SEQ ID NO: 3369673 - DNA, 11 bp, Homo sapiens
gaatggagcag

SEQ ID NO: 3369674 - DNA, 17 bp, Homo sapiens
gaatggaggatattcta

SEQ ID NO: 3369675 - DNA, 17 bp, Homo sapiens
gaatggaggcagagacc

SEQ ID NO: 3369676 - DNA, 17 bp, Homo sapiens
gaatggatcacaagatg

SEQ ID NO: 3369677 - DNA, 14 bp, Homo sapiens
gaatggatggggag

SEQ ID NO: 3369678 - DNA, 15 bp, Homo sapiens
gaatggatggggaga

SEQ ID NO: 3369679 - DNA, 19 bp, Homo sapiens
gaatggattggattattta

SEQ ID NO: 3369680 - DNA, 20 bp, Homo sapiens
gaatggattggattatttaa

SEQ ID NO: 3369681 - DNA, 18 bp, Homo sapiens
gaatggccctagaactgt

SEQ ID NO: 3369682 - DNA, 17 bp, Homo sapiens
gaatggctgggtcaggg

SEQ ID NO: 3369683 - DNA, 17 bp, Homo sapiens
gaatggtgcattgtata

SEQ ID NO: 3369684 - DNA, 19 bp, Homo sapiens
gaatggtgtgaacccggga

SEQ ID NO: 3369685 - DNA, 16 bp, Homo sapiens
gaatgtaaaagaaaat

SEQ ID NO: 3369686 - DNA, 22 bp, Homo sapiens
gaatgtaaaagaacttactgat

SEQ ID NO: 3369687 - DNA, 13 bp, Homo sapiens
gaatgtaatttgt

SEQ ID NO: 3369688 - DNA, 14 bp, Homo sapiens
gaatgtaatttgtg

SEQ ID NO: 3369689 - DNA, 23 bp, Homo sapiens
gaatgtaatttgtgtaataaagt

SEQ ID NO: 3369690 - DNA, 23 bp, Homo sapiens
gaatgtagcagccccgggagggc

SEQ ID NO: 3369691 - DNA, 19 bp, Homo sapiens
gaatgtattattctgcagc

SEQ ID NO: 3369692 - DNA, 18 bp, Homo sapiens
gaatgtatttatgtgtat

SEQ ID NO: 3369693 - DNA, 16 bp, Homo sapiens
gaatgtatttatttgg

SEQ ID NO: 3369694 - DNA, 19 bp, Homo sapiens
gaatgtcagattcctttcc

SEQ ID NO: 3369695 - DNA, 18 bp, Homo sapiens
gaatgtctgccttactgg

SEQ ID NO: 3369696 - DNA, 22 bp, Homo sapiens
gaatgtctttgttggaaaagaa

SEQ ID NO: 3369697 - DNA, 15 bp, Homo sapiens
gaatgtgcaggtttg

SEQ ID NO: 3369698 - DNA, 21 bp, Homo sapiens
gaatgtgcaggtttgttacat

SEQ ID NO: 3369699 - DNA, 13 bp, Homo sapiens
gaatgtgcccctg

SEQ ID NO: 3369700 - DNA, 21 bp, Homo sapiens
gaatgtgctttgtaagatcca

SEQ ID NO: 3369701 - DNA, 21 bp, Homo sapiens
gaatgtgggcactggcccagg

SEQ ID NO: 3369702 - DNA, 21 bp, Homo sapiens
gaatgtgggtagtcattctta

SEQ ID NO: 3369703 - DNA, 14 bp, Homo sapiens
gaatgtggtctcag

SEQ ID NO: 3369704 - DNA, 15 bp, Homo sapiens
gaatgtggtctcagg

SEQ ID NO: 3369705 - DNA, 16 bp, Homo sapiens
gaatgtggtctcagga

SEQ ID NO: 3369706 - DNA, 12 bp, Homo sapiens
gaatgtgtcagg

SEQ ID NO: 3369707 - DNA, 17 bp, Homo sapiens
gaatgtgtgtgtgtggc

SEQ ID NO: 3369708 - DNA, 13 bp, Homo sapiens
gaatgttaaaggg

SEQ ID NO: 3369709 - DNA, 14 bp, Homo sapiens
gaatgttaagcaga

SEQ ID NO: 3369710 - DNA, 22 bp, Homo sapiens
gaatgttactttggaatgacta

SEQ ID NO: 3369711 - DNA, 22 bp, Homo sapiens
gaatgttccctgcaccctggaa

SEQ ID NO: 3369712 - DNA, 14 bp, Homo sapiens
gaatgttctcagat

SEQ ID NO: 3369713 - DNA, 17 bp, Homo sapiens
gaatgttctgacattaa

SEQ ID NO: 3369714 - DNA, 22 bp, Homo sapiens
gaatgttggtttactttcaaat

SEQ ID NO: 3369715 - DNA, 21 bp, Homo sapiens
gaatgtttacactctttgtaa

SEQ ID NO: 3369716 - DNA, 16 bp, Homo sapiens
gaatgtttatagcaaa

SEQ ID NO: 3369717 - DNA, 15 bp, Homo sapiens
gaatgtttcttaact

SEQ ID NO: 3369718 - DNA, 17 bp, Homo sapiens
gaatgtttgcctctgcc

SEQ ID NO: 3369719 - DNA, 15 bp, Homo sapiens
gaatgttttaaattc

SEQ ID NO: 3369720 - DNA, 21 bp, Homo sapiens
gaattaaaaggatagtatttt

SEQ ID NO: 3369721 - DNA, 22 bp, Homo sapiens
gaattaaagtggaccaataggg

SEQ ID NO: 3369722 - DNA, 15 bp, Homo sapiens
gaattaacctggtgc

SEQ ID NO: 3369723 - DNA, 16 bp, Homo sapiens
gaattaacctggtgct

SEQ ID NO: 3369724 - DNA, 17 bp, Homo sapiens
gaattaagatacaaatt

SEQ ID NO: 3369725 - DNA, 15 bp, Homo sapiens
gaattaagttatctt

SEQ ID NO: 3369726 - DNA, 18 bp, Homo sapiens
gaattaattaatttggag

SEQ ID NO: 3369727 - DNA, 20 bp, Homo sapiens
gaattaccattaattacata

SEQ ID NO: 3369728 - DNA, 19 bp, Homo sapiens
gaattagaagtctttcagt

SEQ ID NO: 3369729 - DNA, 15 bp, Homo sapiens
gaattaggctgtaac

SEQ ID NO: 3369730 - DNA, 19 bp, Homo sapiens
gaattaggctgtaactact

SEQ ID NO: 3369731 - DNA, 18 bp, Homo sapiens
gaattagtatgtctgttt

SEQ ID NO: 3369732 - DNA, 12 bp, Homo sapiens
gaattataacag

SEQ ID NO: 3369733 - DNA, 14 bp, Homo sapiens
gaattataacagtt

SEQ ID NO: 3369734 - DNA, 22 bp, Homo sapiens
gaattatctatacatatcttta

SEQ ID NO: 3369735 - DNA, 17 bp, Homo sapiens
gaattattatgtctcaa

SEQ ID NO: 3369736 - DNA, 20 bp, Homo sapiens
gaattattctgattcttttt

SEQ ID NO: 3369737 - DNA, 14 bp, Homo sapiens
gaattatttctgtc

SEQ ID NO: 3369738 - DNA, 20 bp, Homo sapiens
gaattattttgaatgtcaca

SEQ ID NO: 3369739 - DNA, 16 bp, Homo sapiens
gaattcaaactggggc

SEQ ID NO: 3369740 - DNA, 22 bp, Homo sapiens
gaattcaaactggggcctccag

SEQ ID NO: 3369741 - DNA, 17 bp, Homo sapiens
gaattcagcaccctggg

SEQ ID NO: 3369742 - DNA, 14 bp, Homo sapiens
gaattcagtgcctt

SEQ ID NO: 3369743 - DNA, 17 bp, Homo sapiens
gaattcagtgccttcaa

SEQ ID NO: 3369744 - DNA, 24 bp, Homo sapiens
gaattcagtgccttcaacaacgtg

SEQ ID NO: 3369745 - DNA, 22 bp, Homo sapiens
gaattcattttcatcactggga

SEQ ID NO: 3369746 - DNA, 22 bp, Homo sapiens
gaattcgaaggctctctctttc

SEQ ID NO: 3369747 - DNA, 15 bp, Homo sapiens
gaattctatttgctg

SEQ ID NO: 3369748 - DNA, 21 bp, Homo sapiens
gaattcttatgcttataatat

SEQ ID NO: 3369749 - DNA, 23 bp, Homo sapiens
gaattcttgaaggaaaatgatac

SEQ ID NO: 3369750 - DNA, 17 bp, Homo sapiens
gaattgaaaagtttttg

SEQ ID NO: 3369751 - DNA, 22 bp, Homo sapiens
gaattgaaaagtttttgtttgg

SEQ ID NO: 3369752 - DNA, 18 bp, Homo sapiens
gaattgaggggattaata

SEQ ID NO: 3369753 - DNA, 22 bp, Homo sapiens
gaattgaggggattaatatgaa

SEQ ID NO: 3369754 - DNA, 14 bp, Homo sapiens
gaattgagtaatgg

SEQ ID NO: 3369755 - DNA, 15 bp, Homo sapiens
gaattgatttgcatt

SEQ ID NO: 3369756 - DNA, 16 bp, Homo sapiens
gaattgggagcttggg

SEQ ID NO: 3369757 - DNA, 16 bp, Homo sapiens
gaattgtagactgatg

SEQ ID NO: 3369758 - DNA, 14 bp, Homo sapiens
gaattgtatcattt

SEQ ID NO: 3369759 - DNA, 14 bp, Homo sapiens
gaatttaaatataa

SEQ ID NO: 3369760 - DNA, 23 bp, Homo sapiens
gaatttaaatataattctgtaaa

SEQ ID NO: 3369761 - DNA, 18 bp, Homo sapiens
gaatttagatcttatatt

SEQ ID NO: 3369762 - DNA, 22 bp, Homo sapiens
gaatttagatcttatattggtt

SEQ ID NO: 3369763 - DNA, 20 bp, Homo sapiens
gaatttatcacacttctgtg

SEQ ID NO: 3369764 - DNA, 21 bp, Homo sapiens
gaatttatccctttacaatgt

SEQ ID NO: 3369765 - DNA, 23 bp, Homo sapiens
gaatttatctcccttagaagaga

SEQ ID NO: 3369766 - DNA, 13 bp, Homo sapiens
gaatttcctctat

SEQ ID NO: 3369767 - DNA, 21 bp, Homo sapiens
gaatttcctctattgatgtac

SEQ ID NO: 3369768 - DNA, 16 bp, Homo sapiens
gaatttctaaatgttg

SEQ ID NO: 3369769 - DNA, 13 bp, Homo sapiens
gaatttcttaact

SEQ ID NO: 3369770 - DNA, 19 bp, Homo sapiens
gaatttcttcactgttgaa

SEQ ID NO: 3369771 - DNA, 19 bp, Homo sapiens
gaatttgaagctgcagtga

SEQ ID NO: 3369772 - DNA, 17 bp, Homo sapiens
gaatttgaatgaaaaat

SEQ ID NO: 3369773 - DNA, 23 bp, Homo sapiens
gaatttgatcgttccagttccca

SEQ ID NO: 3369774 - DNA, 14 bp, Homo sapiens
gaatttggaaatcc

SEQ ID NO: 3369775 - DNA, 23 bp, Homo sapiens
gaatttgggaggaggaaaagaaa

SEQ ID NO: 3369776 - DNA, 17 bp, Homo sapiens
gaatttgtaacctcagc

SEQ ID NO: 3369777 - DNA, 19 bp, Homo sapiens
gaatttgtaacctcagctc

SEQ ID NO: 3369778 - DNA, 13 bp, Homo sapiens
gaatttgtacttc

SEQ ID NO: 3369779 - DNA, 14 bp, Homo sapiens
gaatttgtattttg

SEQ ID NO: 3369780 - DNA, 13 bp, Homo sapiens
gaatttgttatca

SEQ ID NO: 3369781 - DNA, 15 bp, Homo sapiens
gaattttacatggta

SEQ ID NO: 3369782 - DNA, 14 bp, Homo sapiens
gaattttaggaact

SEQ ID NO: 3369783 - DNA, 12 bp, Homo sapiens
gaattttatatt

SEQ ID NO: 3369784 - DNA, 16 bp, Homo sapiens
gaattttattttgctg

SEQ ID NO: 3369785 - DNA, 19 bp, Homo sapiens
gacaaaaaaatttaaaatt

SEQ ID NO: 3369786 - DNA, 22 bp, Homo sapiens
gacaaaaagtatattaaacaaa

SEQ ID NO: 3369787 - DNA, 16 bp, Homo sapiens
gacaaaaagtttccat

SEQ ID NO: 3369788 - DNA, 12 bp, Homo sapiens
gacaaaacttct

SEQ ID NO: 3369789 - DNA, 14 bp, Homo sapiens
gacaaaacttcttg

SEQ ID NO: 3369790 - DNA, 17 bp, Homo sapiens
gacaaaagtctgtcttt

SEQ ID NO: 3369791 - DNA, 16 bp, Homo sapiens
gacaaaatatttccca

SEQ ID NO: 3369792 - DNA, 17 bp, Homo sapiens
gacaaagactcctctgg

SEQ ID NO: 3369793 - DNA, 20 bp, Homo sapiens
gacaaagccaaactctgcca

SEQ ID NO: 3369794 - DNA, 17 bp, Homo sapiens
gacaaaggacatttgtt

SEQ ID NO: 3369795 - DNA, 15 bp, Homo sapiens
gacaaagggagggag

SEQ ID NO: 3369796 - DNA, 19 bp, Homo sapiens
gacaaagtggaggagggcc

SEQ ID NO: 3369797 - DNA, 19 bp, Homo sapiens
gacaaatattttagaagct

SEQ ID NO: 3369798 - DNA, 12 bp, Homo sapiens
gacaaatgtgta

SEQ ID NO: 3369799 - DNA, 13 bp, Homo sapiens
gacaaattatatt

SEQ ID NO: 3369800 - DNA, 17 bp, Homo sapiens
gacaacacttaatagca

SEQ ID NO: 3369801 - DNA, 17 bp, Homo sapiens
gacaacagaaaaacaat

SEQ ID NO: 3369802 - DNA, 23 bp, Homo sapiens
gacaacatcgcaatagtttttta

SEQ ID NO: 3369803 - DNA, 14 bp, Homo sapiens
gacaaccaaaacat

SEQ ID NO: 3369804 - DNA, 17 bp, Homo sapiens
gacaaccactggtctgt

SEQ ID NO: 3369805 - DNA, 12 bp, Homo sapiens
gacaaccatgac

SEQ ID NO: 3369806 - DNA, 15 bp, Homo sapiens
gacaaccattaaagt

SEQ ID NO: 3369807 - DNA, 18 bp, Homo sapiens
gacaaccattaaagtcag

SEQ ID NO: 3369808 - DNA, 19 bp, Homo sapiens
gacaaccattaaagtcaga

SEQ ID NO: 3369809 - DNA, 14 bp, Homo sapiens
gacaacgatgaatt

SEQ ID NO: 3369810 - DNA, 15 bp, Homo sapiens
gacaactagatttgt

SEQ ID NO: 3369811 - DNA, 12 bp, Homo sapiens
gacaactgtgac

SEQ ID NO: 3369812 - DNA, 21 bp, Homo sapiens
gacaacttatttaaaaatatt

SEQ ID NO: 3369813 - DNA, 18 bp, Homo sapiens
gacaactttgccagcttt

SEQ ID NO: 3369814 - DNA, 13 bp, Homo sapiens
gacaagaagcaaa

SEQ ID NO: 3369815 - DNA, 18 bp, Homo sapiens
gacaagaatggaatagaa

SEQ ID NO: 3369816 - DNA, 14 bp, Homo sapiens
gacaagagatggga

SEQ ID NO: 3369817 - DNA, 20 bp, Homo sapiens
gacaagagatgggaatgagg

SEQ ID NO: 3369818 - DNA, 20 bp, Homo sapiens
gacaagatttcctactttct

SEQ ID NO: 3369819 - DNA, 22 bp, Homo sapiens
gacaagcactattttatattta

SEQ ID NO: 3369820 - DNA, 12 bp, Homo sapiens
gacaagcagagg

SEQ ID NO: 3369821 - DNA, 14 bp, Homo sapiens
gacaagcagccctt

SEQ ID NO: 3369822 - DNA, 15 bp, Homo sapiens
gacaagcagcccttg

SEQ ID NO: 3369823 - DNA, 19 bp, Homo sapiens
gacaagccaacttgtaaat

SEQ ID NO: 3369824 - DNA, 22 bp, Homo sapiens
gacaagccaacttgtaaataca

SEQ ID NO: 3369825 - DNA, 23 bp, Homo sapiens
gacaagccaacttgtaaatacac

SEQ ID NO: 3369826 - DNA, 20 bp, Homo sapiens
gacaagccctggagaaatgg

SEQ ID NO: 3369827 - DNA, 14 bp, Homo sapiens
gacaagccctggca

SEQ ID NO: 3369828 - DNA, 19 bp, Homo sapiens
gacaagctgacttggcact

SEQ ID NO: 3369829 - DNA, 22 bp, Homo sapiens
gacaagctgacttggcacttaa

SEQ ID NO: 3369830 - DNA, 15 bp, Homo sapiens
gacaaggaggtagag

SEQ ID NO: 3369831 - DNA, 18 bp, Homo sapiens
gacaaggattgctactgt

SEQ ID NO: 3369832 - DNA, 22 bp, Homo sapiens
gacaaggattgctactgtccta

SEQ ID NO: 3369833 - DNA, 15 bp, Homo sapiens
gacaagggattctgg

SEQ ID NO: 3369834 - DNA, 16 bp, Homo sapiens
gacaagggattctggg

SEQ ID NO: 3369835 - DNA, 13 bp, Homo sapiens
gacaagggctgac

SEQ ID NO: 3369836 - DNA, 21 bp, Homo sapiens
gacaagggctgacctgcctct

SEQ ID NO: 3369837 - DNA, 22 bp, Homo sapiens
gacaagggctgacctgcctctc

SEQ ID NO: 3369838 - DNA, 23 bp, Homo sapiens
gacaagtatgaatattactctca

SEQ ID NO: 3369839 - DNA, 16 bp, Homo sapiens
gacaagtgaagaacac

SEQ ID NO: 3369840 - DNA, 19 bp, Homo sapiens
gacaataagtttgaacctt

SEQ ID NO: 3369841 - DNA, 21 bp, Homo sapiens
gacaataatattgttgtataa

SEQ ID NO: 3369842 - DNA, 12 bp, Homo sapiens
gacaatagtatt

SEQ ID NO: 3369843 - DNA, 19 bp, Homo sapiens
gacaatatgtgagtgcctt

SEQ ID NO: 3369844 - DNA, 17 bp, Homo sapiens
gacaatcaactctaata

SEQ ID NO: 3369845 - DNA, 20 bp, Homo sapiens
gacaatcagtcccctcccat

SEQ ID NO: 3369846 - DNA, 21 bp, Homo sapiens
gacaatcatgaaatatgcatc

SEQ ID NO: 3369847 - DNA, 13 bp, Homo sapiens
gacaatctatttt

SEQ ID NO: 3369848 - DNA, 14 bp, Homo sapiens
gacaatggcagcta

SEQ ID NO: 3369849 - DNA, 21 bp, Homo sapiens
gacaatggcagctagactgga

SEQ ID NO: 3369850 - DNA, 17 bp, Homo sapiens
gacaattcagtgactta

SEQ ID NO: 3369851 - DNA, 13 bp, Homo sapiens
gacaattctgttt

SEQ ID NO: 3369852 - DNA, 17 bp, Homo sapiens
gacacaaaactccgccc

SEQ ID NO: 3369853 - DNA, 22 bp, Homo sapiens
gacacaaaactccgcccccagc

SEQ ID NO: 3369854 - DNA, 23 bp, Homo sapiens
gacacaaacaggaatgtctggag

SEQ ID NO: 3369855 - DNA, 20 bp, Homo sapiens
gacacaaaggtggaataaac

SEQ ID NO: 3369856 - DNA, 19 bp, Homo sapiens
gacacaaggtgatttcaga

SEQ ID NO: 3369857 - DNA, 22 bp, Homo sapiens
gacacaaggtgatttcagactg

SEQ ID NO: 3369858 - DNA, 22 bp, Homo sapiens
gacacaagtggaccttaggcct

SEQ ID NO: 3369859 - DNA, 22 bp, Homo sapiens
gacacaatatgtatgcttttta

SEQ ID NO: 3369860 - DNA, 20 bp, Homo sapiens
gacacaatctcggctcactg

SEQ ID NO: 3369861 - DNA, 21 bp, Homo sapiens
gacacacaattcattggctcc

SEQ ID NO: 3369862 - DNA, 13 bp, Homo sapiens
gacacacacacgc

SEQ ID NO: 3369863 - DNA, 15 bp, Homo sapiens
gacacacacacgcac

SEQ ID NO: 3369864 - DNA, 22 bp, Homo sapiens
gacacacacacgcacgcacaca

SEQ ID NO: 3369865 - DNA, 19 bp, Homo sapiens
gacacacagaaatgtgtca

SEQ ID NO: 3369866 - DNA, 20 bp, Homo sapiens
gacacacagcctcacgcccc

SEQ ID NO: 3369867 - DNA, 14 bp, Homo sapiens
gacacacagctctg

SEQ ID NO: 3369868 - DNA, 21 bp, Homo sapiens
gacacacagctctgtcctggg

SEQ ID NO: 3369869 - DNA, 22 bp, Homo sapiens
gacacacgtatttatatttgga

SEQ ID NO: 3369870 - DNA, 18 bp, Homo sapiens
gacacactaaccaagctg

SEQ ID NO: 3369871 - DNA, 11 bp, Homo sapiens
gacacagaaaa

SEQ ID NO: 3369872 - DNA, 20 bp, Homo sapiens
gacacagactggcaataaac

SEQ ID NO: 3369873 - DNA, 15 bp, Homo sapiens
gacacagcagcttca

SEQ ID NO: 3369874 - DNA, 21 bp, Homo sapiens
gacacagcagcttcaccagag

SEQ ID NO: 3369875 - DNA, 16 bp, Homo sapiens
gacacagctcttctcc

SEQ ID NO: 3369876 - DNA, 17 bp, Homo sapiens
gacacagctcttctcca

SEQ ID NO: 3369877 - DNA, 19 bp, Homo sapiens
gacacaggcccggctccag

SEQ ID NO: 3369878 - DNA, 20 bp, Homo sapiens
gacacaggcccggctccagg

SEQ ID NO: 3369879 - DNA, 15 bp, Homo sapiens
gacacagtcagcatg

SEQ ID NO: 3369880 - DNA, 16 bp, Homo sapiens
gacacagttcctggga

SEQ ID NO: 3369881 - DNA, 16 bp, Homo sapiens
gacacatcccggcctc

SEQ ID NO: 3369882 - DNA, 17 bp, Homo sapiens
gacacatcccggcctct

SEQ ID NO: 3369883 - DNA, 15 bp, Homo sapiens
gacacattacaaagc

SEQ ID NO: 3369884 - DNA, 15 bp, Homo sapiens
gacaccacacccagc

SEQ ID NO: 3369885 - DNA, 19 bp, Homo sapiens
gacaccacacccagcctca

SEQ ID NO: 3369886 - DNA, 21 bp, Homo sapiens
gacaccacacccagcctcagt

SEQ ID NO: 3369887 - DNA, 12 bp, Homo sapiens
gacaccagagca

SEQ ID NO: 3369888 - DNA, 14 bp, Homo sapiens
gacaccagagcaga

SEQ ID NO: 3369889 - DNA, 16 bp, Homo sapiens
gacaccagtgaaagaa

SEQ ID NO: 3369890 - DNA, 16 bp, Homo sapiens
gacacccaccctgtgc

SEQ ID NO: 3369891 - DNA, 17 bp, Homo sapiens
gacacccaccctgtgcc

SEQ ID NO: 3369892 - DNA, 13 bp, Homo sapiens
gacaccctcaacc

SEQ ID NO: 3369893 - DNA, 14 bp, Homo sapiens
gacaccctggcctg

SEQ ID NO: 3369894 - DNA, 23 bp, Homo sapiens
gacaccctggcctgaactgagga

SEQ ID NO: 3369895 - DNA, 19 bp, Homo sapiens
gacaccggctggcagggct

SEQ ID NO: 3369896 - DNA, 19 bp, Homo sapiens
gacaccgggccagtatcta

SEQ ID NO: 3369897 - DNA, 15 bp, Homo sapiens
gacacctaccatgct

SEQ ID NO: 3369898 - DNA, 18 bp, Homo sapiens
gacacctaccatgctgct

SEQ ID NO: 3369899 - DNA, 15 bp, Homo sapiens
gacaccttgacaggg

SEQ ID NO: 3369900 - DNA, 17 bp, Homo sapiens
gacaccttgacagggca

SEQ ID NO: 3369901 - DNA, 20 bp, Homo sapiens
gacaccttgacagggcacac

SEQ ID NO: 3369902 - DNA, 14 bp, Homo sapiens
gacaccttggacat

SEQ ID NO: 3369903 - DNA, 17 bp, Homo sapiens
gacacgccttcccctca

SEQ ID NO: 3369904 - DNA, 14 bp, Homo sapiens
gacacgcgctctcc

SEQ ID NO: 3369905 - DNA, 17 bp, Homo sapiens
gacacgctcgcgggcag

SEQ ID NO: 3369906 - DNA, 23 bp, Homo sapiens
gacacgctcttctattttattcc

SEQ ID NO: 3369907 - DNA, 13 bp, Homo sapiens
gacacgtggcctc

SEQ ID NO: 3369908 - DNA, 17 bp, Homo sapiens
gacacgtggcctcgtga

SEQ ID NO: 3369909 - DNA, 21 bp, Homo sapiens
gacacgtgtggcgggcagtgg

SEQ ID NO: 3369910 - DNA, 16 bp, Homo sapiens
gacactaaccacgctg

SEQ ID NO: 3369911 - DNA, 17 bp, Homo sapiens
gacactaaccacgctgg

SEQ ID NO: 3369912 - DNA, 17 bp, Homo sapiens
gacactaagttatagta

SEQ ID NO: 3369913 - DNA, 16 bp, Homo sapiens
gacactattcactaaa

SEQ ID NO: 3369914 - DNA, 13 bp, Homo sapiens
gacactcagacct

SEQ ID NO: 3369915 - DNA, 14 bp, Homo sapiens
gacactccagtgcc

SEQ ID NO: 3369916 - DNA, 16 bp, Homo sapiens
gacactccagtgccag

SEQ ID NO: 3369917 - DNA, 15 bp, Homo sapiens
gacactctctggaag

SEQ ID NO: 3369918 - DNA, 13 bp, Homo sapiens
gacactgatgggc

SEQ ID NO: 3369919 - DNA, 19 bp, Homo sapiens
gacactgccgacatcagca

SEQ ID NO: 3369920 - DNA, 14 bp, Homo sapiens
gacactgctctaac

SEQ ID NO: 3369921 - DNA, 20 bp, Homo sapiens
gacactgctctaacagccct

SEQ ID NO: 3369922 - DNA, 16 bp, Homo sapiens
gacactgctgcaccag

SEQ ID NO: 3369923 - DNA, 20 bp, Homo sapiens
gacactgctgcaccagagtg

SEQ ID NO: 3369924 - DNA, 14 bp, Homo sapiens
gacactggcccctc

SEQ ID NO: 3369925 - DNA, 15 bp, Homo sapiens
gacactggcccctca

SEQ ID NO: 3369926 - DNA, 18 bp, Homo sapiens
gacacttcagagagctgg

SEQ ID NO: 3369927 - DNA, 19 bp, Homo sapiens
gacacttcagagagctggt

SEQ ID NO: 3369928 - DNA, 23 bp, Homo sapiens
gacacttcagagagctggtagtt

SEQ ID NO: 3369929 - DNA, 18 bp, Homo sapiens
gacacttcagatctgagg

SEQ ID NO: 3369930 - DNA, 22 bp, Homo sapiens
gacacttgccttcttcacccag

SEQ ID NO: 3369931 - DNA, 23 bp, Homo sapiens
gacacttgccttcttcacccagc

SEQ ID NO: 3369932 - DNA, 23 bp, Homo sapiens
gacactttaattaccaacctgtt

SEQ ID NO: 3369933 - DNA, 21 bp, Homo sapiens
gacagaaactggattaaaaca

SEQ ID NO: 3369934 - DNA, 13 bp, Homo sapiens
gacagaagcaggc

SEQ ID NO: 3369935 - DNA, 15 bp, Homo sapiens
gacagaagtctcctc

SEQ ID NO: 3369936 - DNA, 16 bp, Homo sapiens
gacagaagtctcctca

SEQ ID NO: 3369937 - DNA, 22 bp, Homo sapiens
gacagaatggctatcaaaagaa

SEQ ID NO: 3369938 - DNA, 15 bp, Homo sapiens
gacagaatgtatctg

SEQ ID NO: 3369939 - DNA, 18 bp, Homo sapiens
gacagaatgtatctgtga

SEQ ID NO: 3369940 - DNA, 13 bp, Homo sapiens
gacagacacacac

SEQ ID NO: 3369941 - DNA, 14 bp, Homo sapiens
gacagacacaggcc

SEQ ID NO: 3369942 - DNA, 20 bp, Homo sapiens
gacagacacaggcccggctc

SEQ ID NO: 3369943 - DNA, 22 bp, Homo sapiens
gacagacacaggcccggctcca

SEQ ID NO: 3369944 - DNA, 14 bp, Homo sapiens
gacagacaggctct

SEQ ID NO: 3369945 - DNA, 22 bp, Homo sapiens
gacagaccacatctttatctgt

SEQ ID NO: 3369946 - DNA, 16 bp, Homo sapiens
gacagaccacttgcca

SEQ ID NO: 3369947 - DNA, 22 bp, Homo sapiens
gacagacccaggtcttccagac

SEQ ID NO: 3369948 - DNA, 21 bp, Homo sapiens
gacagactggccgggcaggcg

SEQ ID NO: 3369949 - DNA, 18 bp, Homo sapiens
gacagacttgagaacttg

SEQ ID NO: 3369950 - DNA, 12 bp, Homo sapiens
gacagagaaggg

SEQ ID NO: 3369951 - DNA, 13 bp, Homo sapiens
gacagagactcag

SEQ ID NO: 3369952 - DNA, 19 bp, Homo sapiens
gacagagactcagcgctcc

SEQ ID NO: 3369953 - DNA, 22 bp, Homo sapiens
gacagagactcagcgctcctcc

SEQ ID NO: 3369954 - DNA, 14 bp, Homo sapiens
gacagagcaggggc

SEQ ID NO: 3369955 - DNA, 16 bp, Homo sapiens
gacagaggcagcccca

SEQ ID NO: 3369956 - DNA, 14 bp, Homo sapiens
gacagagtctcact

SEQ ID NO: 3369957 - DNA, 22 bp, Homo sapiens
gacagagtgagactctgtctca

SEQ ID NO: 3369958 - DNA, 16 bp, Homo sapiens
gacagagttcacagga

SEQ ID NO: 3369959 - DNA, 13 bp, Homo sapiens
gacagataactct

SEQ ID NO: 3369960 - DNA, 14 bp, Homo sapiens
gacagatatattta

SEQ ID NO: 3369961 - DNA, 15 bp, Homo sapiens
gacagatatatttaa

SEQ ID NO: 3369962 - DNA, 19 bp, Homo sapiens
gacagatgaatgccgtgga

SEQ ID NO: 3369963 - DNA, 20 bp, Homo sapiens
gacagatgaatgccgtggat

SEQ ID NO: 3369964 - DNA, 18 bp, Homo sapiens
gacagatgccccagagct

SEQ ID NO: 3369965 - DNA, 23 bp, Homo sapiens
gacagcaaaatgttgaagaaaaa

SEQ ID NO: 3369966 - DNA, 14 bp, Homo sapiens
gacagcacagggca

SEQ ID NO: 3369967 - DNA, 15 bp, Homo sapiens
gacagcacagggcag

SEQ ID NO: 3369968 - DNA, 14 bp, Homo sapiens
gacagcaggcagcg

SEQ ID NO: 3369969 - DNA, 19 bp, Homo sapiens
gacagcatgccccttggct

SEQ ID NO: 3369970 - DNA, 17 bp, Homo sapiens
gacagccacggccaggc

SEQ ID NO: 3369971 - DNA, 19 bp, Homo sapiens
gacagccacggccaggcca

SEQ ID NO: 3369972 - DNA, 20 bp, Homo sapiens
gacagccacggccaggccag

SEQ ID NO: 3369973 - DNA, 21 bp, Homo sapiens
gacagccacggccaggccaga

SEQ ID NO: 3369974 - DNA, 14 bp, Homo sapiens
gacagccagagctg

SEQ ID NO: 3369975 - DNA, 15 bp, Homo sapiens
gacagcccagagcct

SEQ ID NO: 3369976 - DNA, 17 bp, Homo sapiens
gacagcccagagcctgg

SEQ ID NO: 3369977 - DNA, 22 bp, Homo sapiens
gacagcccaggatactggcaca

SEQ ID NO: 3369978 - DNA, 20 bp, Homo sapiens
gacagccccagagcagggtg

SEQ ID NO: 3369979 - DNA, 11 bp, Homo sapiens
gacagcctccc

SEQ ID NO: 3369980 - DNA, 16 bp, Homo sapiens
gacagcctcccacccc

SEQ ID NO: 3369981 - DNA, 11 bp, Homo sapiens
gacagcctggc

SEQ ID NO: 3369982 - DNA, 12 bp, Homo sapiens
gacagcctggca

SEQ ID NO: 3369983 - DNA, 18 bp, Homo sapiens
gacagctccttctgtcct

SEQ ID NO: 3369984 - DNA, 17 bp, Homo sapiens
gacagctgatacttcat

SEQ ID NO: 3369985 - DNA, 13 bp, Homo sapiens
gacagcttctctg

SEQ ID NO: 3369986 - DNA, 18 bp, Homo sapiens
gacagcttctctgcagta

SEQ ID NO: 3369987 - DNA, 22 bp, Homo sapiens
gacagcttgagccgggcccctg

SEQ ID NO: 3369988 - DNA, 15 bp, Homo sapiens
gacaggaaagccctc

SEQ ID NO: 3369989 - DNA, 20 bp, Homo sapiens
gacaggaaagccctccccct

SEQ ID NO: 3369990 - DNA, 22 bp, Homo sapiens
gacaggacagtgcttcagcctg

SEQ ID NO: 3369991 - DNA, 23 bp, Homo sapiens
gacaggacagtgcttcagcctga

SEQ ID NO: 3369992 - DNA, 18 bp, Homo sapiens
gacaggagacctggcact

SEQ ID NO: 3369993 - DNA, 11 bp, Homo sapiens
gacaggagcct

SEQ ID NO: 3369994 - DNA, 23 bp, Homo sapiens
gacaggagcctagcggagcccag

SEQ ID NO: 3369995 - DNA, 21 bp, Homo sapiens
gacaggaggcggcccggccag

SEQ ID NO: 3369996 - DNA, 16 bp, Homo sapiens
gacaggagtcagtgtc

SEQ ID NO: 3369997 - DNA, 18 bp, Homo sapiens
gacaggcaagcacctcct

SEQ ID NO: 3369998 - DNA, 14 bp, Homo sapiens
gacaggcaatgctg

SEQ ID NO: 3369999 - DNA, 18 bp, Homo sapiens
gacaggcaatgctggctg

SEQ ID NO: 3370000 - DNA, 13 bp, Homo sapiens
gacaggcactcca

SEQ ID NO: 3370001 - DNA, 20 bp, Homo sapiens
gacaggcaggccagatggcc

SEQ ID NO: 3370002 - DNA, 16 bp, Homo sapiens
gacaggcccaagagat

SEQ ID NO: 3370003 - DNA, 18 bp, Homo sapiens
gacaggcccaagagatga

SEQ ID NO: 3370004 - DNA, 21 bp, Homo sapiens
gacaggcccaagagatgaaga

SEQ ID NO: 3370005 - DNA, 22 bp, Homo sapiens
gacaggcccaagagatgaagag

SEQ ID NO: 3370006 - DNA, 22 bp, Homo sapiens
gacaggcccagcgcggccagcg

SEQ ID NO: 3370007 - DNA, 11 bp, Homo sapiens
gacaggcctca

SEQ ID NO: 3370008 - DNA, 20 bp, Homo sapiens
gacaggcctcacctctaccc

SEQ ID NO: 3370009 - DNA, 19 bp, Homo sapiens
gacaggcctgaagatatta

SEQ ID NO: 3370010 - DNA, 15 bp, Homo sapiens
gacaggcgagagagg

SEQ ID NO: 3370011 - DNA, 24 bp, Homo sapiens
gacaggcgagagaggagccagaca

SEQ ID NO: 3370012 - DNA, 13 bp, Homo sapiens
gacaggctgaaga

SEQ ID NO: 3370013 - DNA, 19 bp, Homo sapiens
gacaggctgaagagaggga

SEQ ID NO: 3370014 - DNA, 23 bp, Homo sapiens
gacaggctgaagagagggacagg

SEQ ID NO: 3370015 - DNA, 14 bp, Homo sapiens
gacagggcatggcc

SEQ ID NO: 3370016 - DNA, 22 bp, Homo sapiens
gacagggcatggccaggtggcc

SEQ ID NO: 3370017 - DNA, 12 bp, Homo sapiens
gacagggccagt

SEQ ID NO: 3370018 - DNA, 16 bp, Homo sapiens
gacaggtccctcccct

SEQ ID NO: 3370019 - DNA, 15 bp, Homo sapiens
gacagtatcccacat

SEQ ID NO: 3370020 - DNA, 15 bp, Homo sapiens
gacagtatttattgg

SEQ ID NO: 3370021 - DNA, 19 bp, Homo sapiens
gacagtatttattggtggg

SEQ ID NO: 3370022 - DNA, 21 bp, Homo sapiens
gacagtatttattggtgggtt

SEQ ID NO: 3370023 - DNA, 20 bp, Homo sapiens
gacagtcatcatcagggcct

SEQ ID NO: 3370024 - DNA, 17 bp, Homo sapiens
gacagtccagtgtcacc

SEQ ID NO: 3370025 - DNA, 15 bp, Homo sapiens
gacagtcctgggaga

SEQ ID NO: 3370026 - DNA, 18 bp, Homo sapiens
gacagtcctttcccacca

SEQ ID NO: 3370027 - DNA, 22 bp, Homo sapiens
gacagtctttgatcatcatgta

SEQ ID NO: 3370028 - DNA, 15 bp, Homo sapiens
gacagtgccatcccc

SEQ ID NO: 3370029 - DNA, 16 bp, Homo sapiens
gacagtgcccatgcaa

SEQ ID NO: 3370030 - DNA, 22 bp, Homo sapiens
gacagtgcctgggaatgtatta

SEQ ID NO: 3370031 - DNA, 12 bp, Homo sapiens
gacagtgtacaa

SEQ ID NO: 3370032 - DNA, 14 bp, Homo sapiens
gacagttcaagaaa

SEQ ID NO: 3370033 - DNA, 19 bp, Homo sapiens
gacagttcacaccctgcaa

SEQ ID NO: 3370034 - DNA, 14 bp, Homo sapiens
gacagttctgaaga

SEQ ID NO: 3370035 - DNA, 15 bp, Homo sapiens
gacagttctgaagaa

SEQ ID NO: 3370036 - DNA, 15 bp, Homo sapiens
gacagttggcagaga

SEQ ID NO: 3370037 - DNA, 24 bp, Homo sapiens
gacagttggcagagaaggcctctt

SEQ ID NO: 3370038 - DNA, 18 bp, Homo sapiens
gacagttgtctagagata

SEQ ID NO: 3370039 - DNA, 21 bp, Homo sapiens
gacagtttaccagttgccttt

SEQ ID NO: 3370040 - DNA, 23 bp, Homo sapiens
gacagtttaccagttgcctttta

SEQ ID NO: 3370041 - DNA, 14 bp, Homo sapiens
gacagtttcttagc

SEQ ID NO: 3370042 - DNA, 12 bp, Homo sapiens
gacataaagcca

SEQ ID NO: 3370043 - DNA, 16 bp, Homo sapiens
gacataaatgttcact

SEQ ID NO: 3370044 - DNA, 21 bp, Homo sapiens
gacatactctctgcctggtgg

SEQ ID NO: 3370045 - DNA, 14 bp, Homo sapiens
gacatagatatttt

SEQ ID NO: 3370046 - DNA, 21 bp, Homo sapiens
gacatagcatccaagtggcat

SEQ ID NO: 3370047 - DNA, 16 bp, Homo sapiens
gacatcaaagcctggc

SEQ ID NO: 3370048 - DNA, 20 bp, Homo sapiens
gacatcaaagcctggcctaa

SEQ ID NO: 3370049 - DNA, 13 bp, Homo sapiens
gacatcacagcag

SEQ ID NO: 3370050 - DNA, 23 bp, Homo sapiens
gacatccatgttccgagaagaac

SEQ ID NO: 3370051 - DNA, 17 bp, Homo sapiens
gacatcccagaccagcc

SEQ ID NO: 3370052 - DNA, 14 bp, Homo sapiens
gacatcccttcctg

SEQ ID NO: 3370053 - DNA, 23 bp, Homo sapiens
gacatcccttcctggaaacagca

SEQ ID NO: 3370054 - DNA, 20 bp, Homo sapiens
gacatccgtcattgctgctg

SEQ ID NO: 3370055 - DNA, 21 bp, Homo sapiens
gacatccgtcattgctgctgc

SEQ ID NO: 3370056 - DNA, 16 bp, Homo sapiens
gacatcctcttctgct

SEQ ID NO: 3370057 - DNA, 23 bp, Homo sapiens
gacatcctcttctgcttaggaga

SEQ ID NO: 3370058 - DNA, 19 bp, Homo sapiens
gacatcctgtataagcact

SEQ ID NO: 3370059 - DNA, 13 bp, Homo sapiens
gacatctcagggg

SEQ ID NO: 3370060 - DNA, 15 bp, Homo sapiens
gacatctcaggggcc

SEQ ID NO: 3370061 - DNA, 14 bp, Homo sapiens
gacatctcctggct

SEQ ID NO: 3370062 - DNA, 15 bp, Homo sapiens
gacatctcctggcta

SEQ ID NO: 3370063 - DNA, 14 bp, Homo sapiens
gacatctggaatct

SEQ ID NO: 3370064 - DNA, 21 bp, Homo sapiens
gacatctgtttctaaatgttt

SEQ ID NO: 3370065 - DNA, 16 bp, Homo sapiens
gacatgaaaagttatt

SEQ ID NO: 3370066 - DNA, 17 bp, Homo sapiens
gacatgaaaagttattt

SEQ ID NO: 3370067 - DNA, 15 bp, Homo sapiens
gacatgaaataaaga

SEQ ID NO: 3370068 - DNA, 21 bp, Homo sapiens
gacatgaaataaagaatttaa

SEQ ID NO: 3370069 - DNA, 14 bp, Homo sapiens
gacatgatcttctt

SEQ ID NO: 3370070 - DNA, 21 bp, Homo sapiens
gacatgatggagcgcacctgc

SEQ ID NO: 3370071 - DNA, 20 bp, Homo sapiens
gacatgatttccttgaatgt

SEQ ID NO: 3370072 - DNA, 24 bp, Homo sapiens
gacatgatttccttgaatgtggct

SEQ ID NO: 3370073 - DNA, 17 bp, Homo sapiens
gacatgcaataaaattt

SEQ ID NO: 3370074 - DNA, 20 bp, Homo sapiens
gacatgcaataaaatttaaa

SEQ ID NO: 3370075 - DNA, 13 bp, Homo sapiens
gacatgcactgac

SEQ ID NO: 3370076 - DNA, 14 bp, Homo sapiens
gacatgcactgacc

SEQ ID NO: 3370077 - DNA, 15 bp, Homo sapiens
gacatgcactgaccc

SEQ ID NO: 3370078 - DNA, 16 bp, Homo sapiens
gacatgcactgaccct

SEQ ID NO: 3370079 - DNA, 20 bp, Homo sapiens
gacatgcactgacccttcca

SEQ ID NO: 3370080 - DNA, 14 bp, Homo sapiens
gacatggaaatgaa

SEQ ID NO: 3370081 - DNA, 14 bp, Homo sapiens
gacatggaggttct

SEQ ID NO: 3370082 - DNA, 15 bp, Homo sapiens
gacatggaggttcta

SEQ ID NO: 3370083 - DNA, 20 bp, Homo sapiens
gacatggaggttctaaggcc

SEQ ID NO: 3370084 - DNA, 17 bp, Homo sapiens
gacatggatgcgaggac

SEQ ID NO: 3370085 - DNA, 17 bp, Homo sapiens
gacatggtgcctgagag

SEQ ID NO: 3370086 - DNA, 20 bp, Homo sapiens
gacatggtgcctgagaggca

SEQ ID NO: 3370087 - DNA, 18 bp, Homo sapiens
gacatgtgaaaccttttt

SEQ ID NO: 3370088 - DNA, 18 bp, Homo sapiens
gacatgtttttgttttct

SEQ ID NO: 3370089 - DNA, 17 bp, Homo sapiens
gacattaacagttttcc

SEQ ID NO: 3370090 - DNA, 22 bp, Homo sapiens
gacattaacagttttccatgaa

SEQ ID NO: 3370091 - DNA, 20 bp, Homo sapiens
gacattatgtgtgcatgtgt

SEQ ID NO: 3370092 - DNA, 14 bp, Homo sapiens
gacattccaacaat

SEQ ID NO: 3370093 - DNA, 17 bp, Homo sapiens
gacattccatgacgaca

SEQ ID NO: 3370094 - DNA, 15 bp, Homo sapiens
gacattcccctccca

SEQ ID NO: 3370095 - DNA, 11 bp, Homo sapiens
gacattctgtc

SEQ ID NO: 3370096 - DNA, 23 bp, Homo sapiens
gacattctgtcgccttagcatgt

SEQ ID NO: 3370097 - DNA, 18 bp, Homo sapiens
gacattctgtctttcaaa

SEQ ID NO: 3370098 - DNA, 17 bp, Homo sapiens
gacattgcggacagcca

SEQ ID NO: 3370099 - DNA, 21 bp, Homo sapiens
gacattgcgtttgacctttta

SEQ ID NO: 3370100 - DNA, 16 bp, Homo sapiens
gacattgctctctggg

SEQ ID NO: 3370101 - DNA, 19 bp, Homo sapiens
gacattgtagagcttctgg

SEQ ID NO: 3370102 - DNA, 13 bp, Homo sapiens
gacattgtcaata

SEQ ID NO: 3370103 - DNA, 18 bp, Homo sapiens
gacatttaacttttctac

SEQ ID NO: 3370104 - DNA, 14 bp, Homo sapiens
gacatttagaagaa

SEQ ID NO: 3370105 - DNA, 18 bp, Homo sapiens
gacatttatatttgtgta

SEQ ID NO: 3370106 - DNA, 15 bp, Homo sapiens
gacatttcccaagtc

SEQ ID NO: 3370107 - DNA, 21 bp, Homo sapiens
gacatttgatagaaaggaaca

SEQ ID NO: 3370108 - DNA, 23 bp, Homo sapiens
gacatttgggagacatgtgacat

SEQ ID NO: 3370109 - DNA, 14 bp, Homo sapiens
gaccaaaatcagct

SEQ ID NO: 3370110 - DNA, 16 bp, Homo sapiens
gaccaaaccagccttc

SEQ ID NO: 3370111 - DNA, 20 bp, Homo sapiens
gaccaaccctggggaaggag

SEQ ID NO: 3370112 - DNA, 21 bp, Homo sapiens
gaccaacgttactcagggctc

SEQ ID NO: 3370113 - DNA, 19 bp, Homo sapiens
gaccaactagacattctgt

SEQ ID NO: 3370114 - DNA, 13 bp, Homo sapiens
gaccaactgggcc

SEQ ID NO: 3370115 - DNA, 18 bp, Homo sapiens
gaccaactgtgttgtatt

SEQ ID NO: 3370116 - DNA, 13 bp, Homo sapiens
gaccaagaactgc

SEQ ID NO: 3370117 - DNA, 20 bp, Homo sapiens
gaccaagcatcttggggggg

SEQ ID NO: 3370118 - DNA, 16 bp, Homo sapiens
gaccaaggaacaaaaa

SEQ ID NO: 3370119 - DNA, 14 bp, Homo sapiens
gaccaagggactcc

SEQ ID NO: 3370120 - DNA, 18 bp, Homo sapiens
gaccaaggtgaagcaaat

SEQ ID NO: 3370121 - DNA, 20 bp, Homo sapiens
gaccaattattgatatatat

SEQ ID NO: 3370122 - DNA, 13 bp, Homo sapiens
gaccacacagtcc

SEQ ID NO: 3370123 - DNA, 15 bp, Homo sapiens
gaccacacagtcccc

SEQ ID NO: 3370124 - DNA, 16 bp, Homo sapiens
gaccacacagtcccca

SEQ ID NO: 3370125 - DNA, 17 bp, Homo sapiens
gaccacacagtccccag

SEQ ID NO: 3370126 - DNA, 19 bp, Homo sapiens
gaccacacagtccccagac

SEQ ID NO: 3370127 - DNA, 16 bp, Homo sapiens
gaccacaccctgtact

SEQ ID NO: 3370128 - DNA, 17 bp, Homo sapiens
gaccacacctccctgaa

SEQ ID NO: 3370129 - DNA, 19 bp, Homo sapiens
gaccacagtgggtggcacc

SEQ ID NO: 3370130 - DNA, 21 bp, Homo sapiens
gaccacagtgggtggcacctc

SEQ ID NO: 3370131 - DNA, 22 bp, Homo sapiens
gaccacagtgggtggcacctcc

SEQ ID NO: 3370132 - DNA, 14 bp, Homo sapiens
gaccaccctcccct

SEQ ID NO: 3370133 - DNA, 19 bp, Homo sapiens
gaccaccctcccctctctt

SEQ ID NO: 3370134 - DNA, 13 bp, Homo sapiens
gaccacctgccca

SEQ ID NO: 3370135 - DNA, 14 bp, Homo sapiens
gaccacctgcccaa

SEQ ID NO: 3370136 - DNA, 24 bp, Homo sapiens
gaccaccttctgtccccagccctg

SEQ ID NO: 3370137 - DNA, 16 bp, Homo sapiens
gaccacctttcacaaa

SEQ ID NO: 3370138 - DNA, 22 bp, Homo sapiens
gaccacgcccgtcctgcctgtg

SEQ ID NO: 3370139 - DNA, 20 bp, Homo sapiens
gaccacggacgtttccatca

SEQ ID NO: 3370140 - DNA, 22 bp, Homo sapiens
gaccacggacgtttccatcagg

SEQ ID NO: 3370141 - DNA, 12 bp, Homo sapiens
gaccactcagcc

SEQ ID NO: 3370142 - DNA, 16 bp, Homo sapiens
gaccactcagccccta

SEQ ID NO: 3370143 - DNA, 17 bp, Homo sapiens
gaccactcagcccctag

SEQ ID NO: 3370144 - DNA, 17 bp, Homo sapiens
gaccactcgaggcctgc

SEQ ID NO: 3370145 - DNA, 22 bp, Homo sapiens
gaccactgagtaccaggggctg

SEQ ID NO: 3370146 - DNA, 17 bp, Homo sapiens
gaccactgggtgagaga

SEQ ID NO: 3370147 - DNA, 19 bp, Homo sapiens
gaccactgtctttttctta

SEQ ID NO: 3370148 - DNA, 16 bp, Homo sapiens
gaccacttgccacgct

SEQ ID NO: 3370149 - DNA, 22 bp, Homo sapiens
gaccactttggagactggggtg

SEQ ID NO: 3370150 - DNA, 16 bp, Homo sapiens
gaccagaaatcaaaaa

SEQ ID NO: 3370151 - DNA, 21 bp, Homo sapiens
gaccagacaccttgacagggc

SEQ ID NO: 3370152 - DNA, 22 bp, Homo sapiens
gaccagacaccttgacagggca

SEQ ID NO: 3370153 - DNA, 13 bp, Homo sapiens
gaccagagccaga

SEQ ID NO: 3370154 - DNA, 14 bp, Homo sapiens
gaccagagccagat

SEQ ID NO: 3370155 - DNA, 15 bp, Homo sapiens
gaccagagccagatg

SEQ ID NO: 3370156 - DNA, 16 bp, Homo sapiens
gaccagagccagatgc

SEQ ID NO: 3370157 - DNA, 18 bp, Homo sapiens
gaccagagccagatgcag

SEQ ID NO: 3370158 - DNA, 14 bp, Homo sapiens
gaccagagctgtct

SEQ ID NO: 3370159 - DNA, 17 bp, Homo sapiens
gaccagcactgtctcag

SEQ ID NO: 3370160 - DNA, 12 bp, Homo sapiens
gaccagcccctt

SEQ ID NO: 3370161 - DNA, 17 bp, Homo sapiens
gaccagccccttcctgg

SEQ ID NO: 3370162 - DNA, 12 bp, Homo sapiens
gaccagctgggg

SEQ ID NO: 3370163 - DNA, 17 bp, Homo sapiens
gaccaggactccctcct

SEQ ID NO: 3370164 - DNA, 12 bp, Homo sapiens
gaccaggatccc

SEQ ID NO: 3370165 - DNA, 15 bp, Homo sapiens
gaccaggatttctaa

SEQ ID NO: 3370166 - DNA, 16 bp, Homo sapiens
gaccaggcttggcctt

SEQ ID NO: 3370167 - DNA, 15 bp, Homo sapiens
gaccagggagccttt

SEQ ID NO: 3370168 - DNA, 22 bp, Homo sapiens
gaccagggagcctttggttctg

SEQ ID NO: 3370169 - DNA, 15 bp, Homo sapiens
gaccagggatgctgg

SEQ ID NO: 3370170 - DNA, 18 bp, Homo sapiens
gaccagggatgctgggct

SEQ ID NO: 3370171 - DNA, 19 bp, Homo sapiens
gaccagggccgaggaggtg

SEQ ID NO: 3370172 - DNA, 17 bp, Homo sapiens
gaccagtgaccccagaa

SEQ ID NO: 3370173 - DNA, 22 bp, Homo sapiens
gaccagtggtttccagtcatga

SEQ ID NO: 3370174 - DNA, 17 bp, Homo sapiens
gaccagttgggagcact

SEQ ID NO: 3370175 - DNA, 22 bp, Homo sapiens
gaccataaagggtgtaggggcc

SEQ ID NO: 3370176 - DNA, 20 bp, Homo sapiens
gaccataatgttacattatt

SEQ ID NO: 3370177 - DNA, 19 bp, Homo sapiens
gaccatccactctaccctc

SEQ ID NO: 3370178 - DNA, 23 bp, Homo sapiens
gaccatccactctaccctcccac

SEQ ID NO: 3370179 - DNA, 15 bp, Homo sapiens
gaccatctgctttta

SEQ ID NO: 3370180 - DNA, 18 bp, Homo sapiens
gaccatcttcataatttg

SEQ ID NO: 3370181 - DNA, 21 bp, Homo sapiens
gaccatgctcatctgctggtc

SEQ ID NO: 3370182 - DNA, 22 bp, Homo sapiens
gaccatggttaagagtccaaga

SEQ ID NO: 3370183 - DNA, 23 bp, Homo sapiens
gaccattttttaatttacttgtt

SEQ ID NO: 3370184 - DNA, 14 bp, Homo sapiens
gacccaaaacacag

SEQ ID NO: 3370185 - DNA, 21 bp, Homo sapiens
gacccaagccctgaggcctga

SEQ ID NO: 3370186 - DNA, 18 bp, Homo sapiens
gacccaaggaaaactgca

SEQ ID NO: 3370187 - DNA, 23 bp, Homo sapiens
gacccacaaagagagtgcgccct

SEQ ID NO: 3370188 - DNA, 13 bp, Homo sapiens
gacccaccagtgc

SEQ ID NO: 3370189 - DNA, 18 bp, Homo sapiens
gacccacccatcttcctg

SEQ ID NO: 3370190 - DNA, 21 bp, Homo sapiens
gacccacccatcttcctgctg

SEQ ID NO: 3370191 - DNA, 23 bp, Homo sapiens
gacccacccatcttcctgctgct

SEQ ID NO: 3370192 - DNA, 15 bp, Homo sapiens
gacccacccctgtgc

SEQ ID NO: 3370193 - DNA, 16 bp, Homo sapiens
gacccacccctgtgct

SEQ ID NO: 3370194 - DNA, 16 bp, Homo sapiens
gacccacggagccctc

SEQ ID NO: 3370195 - DNA, 17 bp, Homo sapiens
gacccacggagccctcc

SEQ ID NO: 3370196 - DNA, 18 bp, Homo sapiens
gacccactggttccttct

SEQ ID NO: 3370197 - DNA, 20 bp, Homo sapiens
gacccactggttccttcttc

SEQ ID NO: 3370198 - DNA, 13 bp, Homo sapiens
gacccagagtgga

SEQ ID NO: 3370199 - DNA, 18 bp, Homo sapiens
gacccagagtggagtctg

SEQ ID NO: 3370200 - DNA, 22 bp, Homo sapiens
gacccagagtggagtctgagtc

SEQ ID NO: 3370201 - DNA, 12 bp, Homo sapiens
gacccagcatct

SEQ ID NO: 3370202 - DNA, 23 bp, Homo sapiens
gacccagccccttgagaaacctt

SEQ ID NO: 3370203 - DNA, 15 bp, Homo sapiens
gacccagctactctg

SEQ ID NO: 3370204 - DNA, 16 bp, Homo sapiens
gacccaggctccgccc

SEQ ID NO: 3370205 - DNA, 23 bp, Homo sapiens
gacccaggctccgcccttagtcc

SEQ ID NO: 3370206 - DNA, 13 bp, Homo sapiens
gacccagggggag

SEQ ID NO: 3370207 - DNA, 14 bp, Homo sapiens
gacccaggtcttcc

SEQ ID NO: 3370208 - DNA, 16 bp, Homo sapiens
gacccaggtcttccag

SEQ ID NO: 3370209 - DNA, 21 bp, Homo sapiens
gacccaggtggagggcacagc

SEQ ID NO: 3370210 - DNA, 22 bp, Homo sapiens
gacccagtgagattacagagga

SEQ ID NO: 3370211 - DNA, 23 bp, Homo sapiens
gacccagtgagattacagaggaa

SEQ ID NO: 3370212 - DNA, 18 bp, Homo sapiens
gacccatagatcttctga

SEQ ID NO: 3370213 - DNA, 22 bp, Homo sapiens
gacccatgtaaataccagactg

SEQ ID NO: 3370214 - DNA, 15 bp, Homo sapiens
gaccccaacctcaga

SEQ ID NO: 3370215 - DNA, 17 bp, Homo sapiens
gaccccaggctggacat

SEQ ID NO: 3370216 - DNA, 13 bp, Homo sapiens
gaccccagggcag

SEQ ID NO: 3370217 - DNA, 21 bp, Homo sapiens
gacccccaaccaagtggctcc

SEQ ID NO: 3370218 - DNA, 14 bp, Homo sapiens
gacccccaactcct

SEQ ID NO: 3370219 - DNA, 14 bp, Homo sapiens
gacccccaggcctg

SEQ ID NO: 3370220 - DNA, 22 bp, Homo sapiens
gacccccaggcctgtccaccct

SEQ ID NO: 3370221 - DNA, 17 bp, Homo sapiens
gaccccctggccctgcc

SEQ ID NO: 3370222 - DNA, 17 bp, Homo sapiens
gacccctagttccctct

SEQ ID NO: 3370223 - DNA, 18 bp, Homo sapiens
gacccctagttccctctg

SEQ ID NO: 3370224 - DNA, 13 bp, Homo sapiens
gacccctccatgt

SEQ ID NO: 3370225 - DNA, 14 bp, Homo sapiens
gacccctcctcact

SEQ ID NO: 3370226 - DNA, 13 bp, Homo sapiens
gacccctctggcc

SEQ ID NO: 3370227 - DNA, 15 bp, Homo sapiens
gacccctctggccag

SEQ ID NO: 3370228 - DNA, 16 bp, Homo sapiens
gacccctctggccagg

SEQ ID NO: 3370229 - DNA, 20 bp, Homo sapiens
gacccctctggccaggatgg

SEQ ID NO: 3370230 - DNA, 19 bp, Homo sapiens
gacccctgctcccagcctg

SEQ ID NO: 3370231 - DNA, 20 bp, Homo sapiens
gacccctgctcccagcctgc

SEQ ID NO: 3370232 - DNA, 21 bp, Homo sapiens
gacccctggcttttcactgct

SEQ ID NO: 3370233 - DNA, 13 bp, Homo sapiens
gacccctgtctcc

SEQ ID NO: 3370234 - DNA, 14 bp, Homo sapiens
gaccctacaggaga

SEQ ID NO: 3370235 - DNA, 20 bp, Homo sapiens
gaccctcatggcccccaggg

SEQ ID NO: 3370236 - DNA, 21 bp, Homo sapiens
gaccctcatggcccccagggg

SEQ ID NO: 3370237 - DNA, 22 bp, Homo sapiens
gaccctcatggcccccaggggc

SEQ ID NO: 3370238 - DNA, 23 bp, Homo sapiens
gaccctcatggcccccaggggca

SEQ ID NO: 3370239 - DNA, 13 bp, Homo sapiens
gaccctctgggaa

SEQ ID NO: 3370240 - DNA, 13 bp, Homo sapiens
gaccctcttgccc

SEQ ID NO: 3370241 - DNA, 14 bp, Homo sapiens
gaccctcttgccca

SEQ ID NO: 3370242 - DNA, 19 bp, Homo sapiens
gaccctcttgcccatcctg

SEQ ID NO: 3370243 - DNA, 20 bp, Homo sapiens
gaccctcttgcccatcctga

SEQ ID NO: 3370244 - DNA, 20 bp, Homo sapiens
gaccctgacctccgcccctg

SEQ ID NO: 3370245 - DNA, 13 bp, Homo sapiens
gaccctgagactc

SEQ ID NO: 3370246 - DNA, 18 bp, Homo sapiens
gaccctgcaaacagaaca

SEQ ID NO: 3370247 - DNA, 20 bp, Homo sapiens
gaccctgcaaacagaacagg

SEQ ID NO: 3370248 - DNA, 14 bp, Homo sapiens
gaccctgcttcacc

SEQ ID NO: 3370249 - DNA, 23 bp, Homo sapiens
gaccctggaattcagcaccctgg

SEQ ID NO: 3370250 - DNA, 17 bp, Homo sapiens
gaccctgggagagaagt

SEQ ID NO: 3370251 - DNA, 20 bp, Homo sapiens
gaccctgtgacatggtgcct

SEQ ID NO: 3370252 - DNA, 22 bp, Homo sapiens
gaccctgtgacatggtgcctga

SEQ ID NO: 3370253 - DNA, 16 bp, Homo sapiens
gacccttattgctgtc

SEQ ID NO: 3370254 - DNA, 15 bp, Homo sapiens
gacccttcagggcca

SEQ ID NO: 3370255 - DNA, 20 bp, Homo sapiens
gacccttccagacatacgaa

SEQ ID NO: 3370256 - DNA, 17 bp, Homo sapiens
gacccttgacacctgct

SEQ ID NO: 3370257 - DNA, 21 bp, Homo sapiens
gacccttgacacctgctgaga

SEQ ID NO: 3370258 - DNA, 14 bp, Homo sapiens
gaccgactacccca

SEQ ID NO: 3370259 - DNA, 14 bp, Homo sapiens
gaccgccccctcct

SEQ ID NO: 3370260 - DNA, 22 bp, Homo sapiens
gaccgccctccgcgaaaatagt

SEQ ID NO: 3370261 - DNA, 19 bp, Homo sapiens
gaccgcttcacccctgcac

SEQ ID NO: 3370262 - DNA, 20 bp, Homo sapiens
gaccgcttgtggggacccag

SEQ ID NO: 3370263 - DNA, 22 bp, Homo sapiens
gaccgcttgtggggacccaggc

SEQ ID NO: 3370264 - DNA, 14 bp, Homo sapiens
gaccgggtgggcct

SEQ ID NO: 3370265 - DNA, 21 bp, Homo sapiens
gaccgggtgggcctggcctga

SEQ ID NO: 3370266 - DNA, 17 bp, Homo sapiens
gaccggtgctgcaggag

SEQ ID NO: 3370267 - DNA, 20 bp, Homo sapiens
gaccgtactctcacatgtgg

SEQ ID NO: 3370268 - DNA, 17 bp, Homo sapiens
gaccgtggccctgccct

SEQ ID NO: 3370269 - DNA, 20 bp, Homo sapiens
gacctaaaaaggtctgttaa

SEQ ID NO: 3370270 - DNA, 20 bp, Homo sapiens
gacctaaatggcctcatgtg

SEQ ID NO: 3370271 - DNA, 17 bp, Homo sapiens
gacctacattccctctc

SEQ ID NO: 3370272 - DNA, 12 bp, Homo sapiens
gacctacctcag

SEQ ID NO: 3370273 - DNA, 15 bp, Homo sapiens
gacctacctcaggtt

SEQ ID NO: 3370274 - DNA, 15 bp, Homo sapiens
gacctactgttctaa

SEQ ID NO: 3370275 - DNA, 17 bp, Homo sapiens
gacctactgttctaaag

SEQ ID NO: 3370276 - DNA, 23 bp, Homo sapiens
gacctataaatcattaagacaac

SEQ ID NO: 3370277 - DNA, 21 bp, Homo sapiens
gacctatgtcctaaggacaca

SEQ ID NO: 3370278 - DNA, 23 bp, Homo sapiens
gacctatgtcctaaggacacact

SEQ ID NO: 3370279 - DNA, 16 bp, Homo sapiens
gacctcaagccctgag

SEQ ID NO: 3370280 - DNA, 18 bp, Homo sapiens
gacctcaagccctgaggg

SEQ ID NO: 3370281 - DNA, 22 bp, Homo sapiens
gacctcaagccctgaggggcag

SEQ ID NO: 3370282 - DNA, 18 bp, Homo sapiens
gacctcacagtgaccctt

SEQ ID NO: 3370283 - DNA, 16 bp, Homo sapiens
gacctcactgtgacct

SEQ ID NO: 3370284 - DNA, 18 bp, Homo sapiens
gacctcaggcactagcct

SEQ ID NO: 3370285 - DNA, 21 bp, Homo sapiens
gacctcaggtgatccacccac

SEQ ID NO: 3370286 - DNA, 20 bp, Homo sapiens
gacctcagttttatcatttt

SEQ ID NO: 3370287 - DNA, 10 bp, Homo sapiens
gacctcatca

SEQ ID NO: 3370288 - DNA, 13 bp, Homo sapiens
gacctcatcagga

SEQ ID NO: 3370289 - DNA, 19 bp, Homo sapiens
gacctcatcaggatgaacc

SEQ ID NO: 3370290 - DNA, 20 bp, Homo sapiens
gacctcatctgtggagctgc

SEQ ID NO: 3370291 - DNA, 21 bp, Homo sapiens
gacctcccagccctatggatg

SEQ ID NO: 3370292 - DNA, 23 bp, Homo sapiens
gacctcccagccctatggatgtg

SEQ ID NO: 3370293 - DNA, 14 bp, Homo sapiens
gacctccccagccc

SEQ ID NO: 3370294 - DNA, 14 bp, Homo sapiens
gacctcccttccga

SEQ ID NO: 3370295 - DNA, 23 bp, Homo sapiens
gacctcccttccgaccctctggg

SEQ ID NO: 3370296 - DNA, 16 bp, Homo sapiens
gacctccgcccctgcc

SEQ ID NO: 3370297 - DNA, 21 bp, Homo sapiens
gacctccgcccctgcccccgc

SEQ ID NO: 3370298 - DNA, 12 bp, Homo sapiens
gacctctcaggg

SEQ ID NO: 3370299 - DNA, 13 bp, Homo sapiens
gacctctcagggc

SEQ ID NO: 3370300 - DNA, 15 bp, Homo sapiens
gacctctcagggcct

SEQ ID NO: 3370301 - DNA, 22 bp, Homo sapiens
gacctcttgctgtctctgctcg

SEQ ID NO: 3370302 - DNA, 19 bp, Homo sapiens
gacctgaaattccaaagtc

SEQ ID NO: 3370303 - DNA, 13 bp, Homo sapiens
gacctgaggctgt

SEQ ID NO: 3370304 - DNA, 14 bp, Homo sapiens
gacctgaggctgtg

SEQ ID NO: 3370305 - DNA, 15 bp, Homo sapiens
gacctgaggctgtgg

SEQ ID NO: 3370306 - DNA, 19 bp, Homo sapiens
gacctgccaggcaggggtg

SEQ ID NO: 3370307 - DNA, 21 bp, Homo sapiens
gacctgccaggcaggggtggg

SEQ ID NO: 3370308 - DNA, 18 bp, Homo sapiens
gacctgcctctcacacac

SEQ ID NO: 3370309 - DNA, 20 bp, Homo sapiens
gacctgcctctcacacacat

SEQ ID NO: 3370310 - DNA, 17 bp, Homo sapiens
gacctgctccgctgctc

SEQ ID NO: 3370311 - DNA, 18 bp, Homo sapiens
gacctgcttcctgaaata

SEQ ID NO: 3370312 - DNA, 16 bp, Homo sapiens
gacctggagcccctgg

SEQ ID NO: 3370313 - DNA, 17 bp, Homo sapiens
gacctggtaccctcctg

SEQ ID NO: 3370314 - DNA, 23 bp, Homo sapiens
gacctggtaccctcctggctctt

SEQ ID NO: 3370315 - DNA, 17 bp, Homo sapiens
gacctgtaacttttgta

SEQ ID NO: 3370316 - DNA, 17 bp, Homo sapiens
gacctgtcatgcccccc

SEQ ID NO: 3370317 - DNA, 13 bp, Homo sapiens
gacctgtcttcca

SEQ ID NO: 3370318 - DNA, 17 bp, Homo sapiens
gacctgtcttccaagga

SEQ ID NO: 3370319 - DNA, 19 bp, Homo sapiens
gacctgttggttccaagcc

SEQ ID NO: 3370320 - DNA, 14 bp, Homo sapiens
gacctgtttctctt

SEQ ID NO: 3370321 - DNA, 22 bp, Homo sapiens
gaccttaataaaggcccccact

SEQ ID NO: 3370322 - DNA, 13 bp, Homo sapiens
gaccttagaaatc

SEQ ID NO: 3370323 - DNA, 23 bp, Homo sapiens
gaccttagaaatcattgtagaaa

SEQ ID NO: 3370324 - DNA, 16 bp, Homo sapiens
gaccttaggccttcct

SEQ ID NO: 3370325 - DNA, 22 bp, Homo sapiens
gaccttatctgtgcgtgaaaca

SEQ ID NO: 3370326 - DNA, 18 bp, Homo sapiens
gaccttcatgcccttctg

SEQ ID NO: 3370327 - DNA, 23 bp, Homo sapiens
gaccttccctccgccttctccca

SEQ ID NO: 3370328 - DNA, 23 bp, Homo sapiens
gaccttcctcatccaccccatcc

SEQ ID NO: 3370329 - DNA, 17 bp, Homo sapiens
gaccttcctctggggct

SEQ ID NO: 3370330 - DNA, 18 bp, Homo sapiens
gaccttcctctggggctc

SEQ ID NO: 3370331 - DNA, 18 bp, Homo sapiens
gaccttcgggctgtgccc

SEQ ID NO: 3370332 - DNA, 21 bp, Homo sapiens
gaccttcggggcctgtctgaa

SEQ ID NO: 3370333 - DNA, 16 bp, Homo sapiens
gaccttgcaacttcat

SEQ ID NO: 3370334 - DNA, 18 bp, Homo sapiens
gaccttggggtacaattg

SEQ ID NO: 3370335 - DNA, 13 bp, Homo sapiens
gaccttgtctcta

SEQ ID NO: 3370336 - DNA, 21 bp, Homo sapiens
gacctttaggtcaaactccct

SEQ ID NO: 3370337 - DNA, 13 bp, Homo sapiens
gacctttccacca

SEQ ID NO: 3370338 - DNA, 17 bp, Homo sapiens
gacctttccaccacagc

SEQ ID NO: 3370339 - DNA, 21 bp, Homo sapiens
gacgacaagtgctgaacagtg

SEQ ID NO: 3370340 - DNA, 15 bp, Homo sapiens
gacgattccttctct

SEQ ID NO: 3370341 - DNA, 17 bp, Homo sapiens
gacgattccttctctga

SEQ ID NO: 3370342 - DNA, 17 bp, Homo sapiens
gacgcaccgccgccacc

SEQ ID NO: 3370343 - DNA, 16 bp, Homo sapiens
gacgcacgctcgctgc

SEQ ID NO: 3370344 - DNA, 19 bp, Homo sapiens
gacgcacgctcgctgccat

SEQ ID NO: 3370345 - DNA, 14 bp, Homo sapiens
gacgcagacagagg

SEQ ID NO: 3370346 - DNA, 13 bp, Homo sapiens
gacgcctgagctc

SEQ ID NO: 3370347 - DNA, 18 bp, Homo sapiens
gacgcctgccctccccag

SEQ ID NO: 3370348 - DNA, 23 bp, Homo sapiens
gacgcctgccctccccagagcac

SEQ ID NO: 3370349 - DNA, 16 bp, Homo sapiens
gacgccttccaggtca

SEQ ID NO: 3370350 - DNA, 19 bp, Homo sapiens
gacgccttccaggtcagga

SEQ ID NO: 3370351 - DNA, 15 bp, Homo sapiens
gacgctctctggcct

SEQ ID NO: 3370352 - DNA, 17 bp, Homo sapiens
gacgctctctggccttc

SEQ ID NO: 3370353 - DNA, 18 bp, Homo sapiens
gacgctgccgctgccgct

SEQ ID NO: 3370354 - DNA, 19 bp, Homo sapiens
gacgcttaacctttccgct

SEQ ID NO: 3370355 - DNA, 13 bp, Homo sapiens
gacgctttgtctg

SEQ ID NO: 3370356 - DNA, 15 bp, Homo sapiens
gacggagagaaaaaa

SEQ ID NO: 3370357 - DNA, 14 bp, Homo sapiens
gacggagtcccacc

SEQ ID NO: 3370358 - DNA, 18 bp, Homo sapiens
gacggagtcccaccttgg

SEQ ID NO: 3370359 - DNA, 14 bp, Homo sapiens
gacggagtctctca

SEQ ID NO: 3370360 - DNA, 21 bp, Homo sapiens
gacggagtggggggacagaga

SEQ ID NO: 3370361 - DNA, 19 bp, Homo sapiens
gacggcagaaaacagagcc

SEQ ID NO: 3370362 - DNA, 20 bp, Homo sapiens
gacggcagaaaacagagcct

SEQ ID NO: 3370363 - DNA, 11 bp, Homo sapiens
gacggccctgc

SEQ ID NO: 3370364 - DNA, 20 bp, Homo sapiens
gacggcctgatgctccctcc

SEQ ID NO: 3370365 - DNA, 14 bp, Homo sapiens
gacggcggccaggc

SEQ ID NO: 3370366 - DNA, 16 bp, Homo sapiens
gacggcggccaggcac

SEQ ID NO: 3370367 - DNA, 17 bp, Homo sapiens
gacggcgtttcaccatg

SEQ ID NO: 3370368 - DNA, 21 bp, Homo sapiens
gacgggaggccccagctctga

SEQ ID NO: 3370369 - DNA, 10 bp, Homo sapiens
gacgggcaca

SEQ ID NO: 3370370 - DNA, 13 bp, Homo sapiens
gacgggcacagac

SEQ ID NO: 3370371 - DNA, 16 bp, Homo sapiens
gacggggactggggat

SEQ ID NO: 3370372 - DNA, 13 bp, Homo sapiens
gacggggctcagc

SEQ ID NO: 3370373 - DNA, 16 bp, Homo sapiens
gacggtgcccaagcca

SEQ ID NO: 3370374 - DNA, 19 bp, Homo sapiens
gacggttttttattattgt

SEQ ID NO: 3370375 - DNA, 14 bp, Homo sapiens
gacgtcaagtctcc

SEQ ID NO: 3370376 - DNA, 21 bp, Homo sapiens
gacgtcctatctcccccaacc

SEQ ID NO: 3370377 - DNA, 20 bp, Homo sapiens
gacgtctggggtgtggggat

SEQ ID NO: 3370378 - DNA, 18 bp, Homo sapiens
gacgtgcacctgtactca

SEQ ID NO: 3370379 - DNA, 22 bp, Homo sapiens
gacgtgccttttgcacccctcc

SEQ ID NO: 3370380 - DNA, 23 bp, Homo sapiens
gacgtgccttttgcacccctccc

SEQ ID NO: 3370381 - DNA, 21 bp, Homo sapiens
gacgtggtggctcacacctgc

SEQ ID NO: 3370382 - DNA, 17 bp, Homo sapiens
gacgtgtgtaaatatgt

SEQ ID NO: 3370383 - DNA, 21 bp, Homo sapiens
gacgttggcctcagggccagg

SEQ ID NO: 3370384 - DNA, 22 bp, Homo sapiens
gacgtttaactgcagttgactt

SEQ ID NO: 3370385 - DNA, 13 bp, Homo sapiens
gacgtttccatca

SEQ ID NO: 3370386 - DNA, 20 bp, Homo sapiens
gacgtttttgtgctgtgggc

SEQ ID NO: 3370387 - DNA, 18 bp, Homo sapiens
gactaaaaatattataac

SEQ ID NO: 3370388 - DNA, 18 bp, Homo sapiens
gactaaactttttttctg

SEQ ID NO: 3370389 - DNA, 17 bp, Homo sapiens
gactaaagagagaatgt

SEQ ID NO: 3370390 - DNA, 18 bp, Homo sapiens
gactaaagagagaatgta

SEQ ID NO: 3370391 - DNA, 18 bp, Homo sapiens
gactaacaagatttgtaa

SEQ ID NO: 3370392 - DNA, 22 bp, Homo sapiens
gactaacataaaatctgtgaat

SEQ ID NO: 3370393 - DNA, 21 bp, Homo sapiens
gactaactagacaccaaagtt

SEQ ID NO: 3370394 - DNA, 22 bp, Homo sapiens
gactaattagggtacatttata

SEQ ID NO: 3370395 - DNA, 18 bp, Homo sapiens
gactaatttaaaaaataa

SEQ ID NO: 3370396 - DNA, 15 bp, Homo sapiens
gactacaggcaccca

SEQ ID NO: 3370397 - DNA, 21 bp, Homo sapiens
gactacaggtgtgagtcacca

SEQ ID NO: 3370398 - DNA, 15 bp, Homo sapiens
gactaccccagtccc

SEQ ID NO: 3370399 - DNA, 19 bp, Homo sapiens
gactaccccagtcccaggg

SEQ ID NO: 3370400 - DNA, 21 bp, Homo sapiens
gactaccccagtcccagggaa

SEQ ID NO: 3370401 - DNA, 18 bp, Homo sapiens
gactacttgggagcaccg

SEQ ID NO: 3370402 - DNA, 22 bp, Homo sapiens
gactacttgttgtatctgctgg

SEQ ID NO: 3370403 - DNA, 16 bp, Homo sapiens
gactagacgttcattt

SEQ ID NO: 3370404 - DNA, 12 bp, Homo sapiens
gactagagaaac

SEQ ID NO: 3370405 - DNA, 15 bp, Homo sapiens
gactagaggcaggga

SEQ ID NO: 3370406 - DNA, 16 bp, Homo sapiens
gactagaggcagggag

SEQ ID NO: 3370407 - DNA, 17 bp, Homo sapiens
gactagaggcagggagg

SEQ ID NO: 3370408 - DNA, 20 bp, Homo sapiens
gactagaggcagggagggga

SEQ ID NO: 3370409 - DNA, 16 bp, Homo sapiens
gactagaggcttgcat

SEQ ID NO: 3370410 - DNA, 14 bp, Homo sapiens
gactagatgatgga

SEQ ID NO: 3370411 - DNA, 21 bp, Homo sapiens
gactagatgatggatgccaat

SEQ ID NO: 3370412 - DNA, 17 bp, Homo sapiens
gactagatgtagtattt

SEQ ID NO: 3370413 - DNA, 21 bp, Homo sapiens
gactagcccctgtggagactg

SEQ ID NO: 3370414 - DNA, 24 bp, Homo sapiens
gactaggacctgagcctggtcctg

SEQ ID NO: 3370415 - DNA, 18 bp, Homo sapiens
gactagggattcaggctg

SEQ ID NO: 3370416 - DNA, 19 bp, Homo sapiens
gactagggattcaggctgc

SEQ ID NO: 3370417 - DNA, 13 bp, Homo sapiens
gactagtacaaat

SEQ ID NO: 3370418 - DNA, 17 bp, Homo sapiens
gactagtacaaattata

SEQ ID NO: 3370419 - DNA, 15 bp, Homo sapiens
gactagtagatttct

SEQ ID NO: 3370420 - DNA, 14 bp, Homo sapiens
gactataaacatta

SEQ ID NO: 3370421 - DNA, 12 bp, Homo sapiens
gactatatacat

SEQ ID NO: 3370422 - DNA, 23 bp, Homo sapiens
gactatatacatgtgtgtatata

SEQ ID NO: 3370423 - DNA, 20 bp, Homo sapiens
gactatatagagatgttttt

SEQ ID NO: 3370424 - DNA, 23 bp, Homo sapiens
gactatatagagatgtttttaaa

SEQ ID NO: 3370425 - DNA, 19 bp, Homo sapiens
gactatatatataaatgta

SEQ ID NO: 3370426 - DNA, 20 bp, Homo sapiens
gactatatatataaatgtat

SEQ ID NO: 3370427 - DNA, 20 bp, Homo sapiens
gactatgaacttctctcaga

SEQ ID NO: 3370428 - DNA, 12 bp, Homo sapiens
gactatggagcc

SEQ ID NO: 3370429 - DNA, 18 bp, Homo sapiens
gactatgtatttttctat

SEQ ID NO: 3370430 - DNA, 22 bp, Homo sapiens
gactattaggtgcaatttcaag

SEQ ID NO: 3370431 - DNA, 19 bp, Homo sapiens
gactcaaatctccagtatt

SEQ ID NO: 3370432 - DNA, 15 bp, Homo sapiens
gactcaaatgttcta

SEQ ID NO: 3370433 - DNA, 17 bp, Homo sapiens
gactcaaatgttctaag

SEQ ID NO: 3370434 - DNA, 22 bp, Homo sapiens
gactcaacatgttactgaccag

SEQ ID NO: 3370435 - DNA, 18 bp, Homo sapiens
gactcaagaagtgaagaa

SEQ ID NO: 3370436 - DNA, 15 bp, Homo sapiens
gactcaatccctagg

SEQ ID NO: 3370437 - DNA, 14 bp, Homo sapiens
gactcaatgcactg

SEQ ID NO: 3370438 - DNA, 23 bp, Homo sapiens
gactcacacctgaactgaacacc

SEQ ID NO: 3370439 - DNA, 16 bp, Homo sapiens
gactcacacttgtaat

SEQ ID NO: 3370440 - DNA, 23 bp, Homo sapiens
gactcacttacatcttctgtgaa

SEQ ID NO: 3370441 - DNA, 23 bp, Homo sapiens
gactcacttatcccaagagaatg

SEQ ID NO: 3370442 - DNA, 12 bp, Homo sapiens
gactcagaggct

SEQ ID NO: 3370443 - DNA, 16 bp, Homo sapiens
gactcagaggctggga

SEQ ID NO: 3370444 - DNA, 12 bp, Homo sapiens
gactcagcagtg

SEQ ID NO: 3370445 - DNA, 12 bp, Homo sapiens
gactcagcccac

SEQ ID NO: 3370446 - DNA, 16 bp, Homo sapiens
gactcagcccacctgc

SEQ ID NO: 3370447 - DNA, 18 bp, Homo sapiens
gactcagcccacctgcac

SEQ ID NO: 3370448 - DNA, 13 bp, Homo sapiens
gactcagccctga

SEQ ID NO: 3370449 - DNA, 16 bp, Homo sapiens
gactcagcgctcctcc

SEQ ID NO: 3370450 - DNA, 17 bp, Homo sapiens
gactcagcgctcctcct

SEQ ID NO: 3370451 - DNA, 22 bp, Homo sapiens
gactcagctggaagtctacctg

SEQ ID NO: 3370452 - DNA, 16 bp, Homo sapiens
gactcaggcgcctggc

SEQ ID NO: 3370453 - DNA, 20 bp, Homo sapiens
gactcagggaccggtgctgc

SEQ ID NO: 3370454 - DNA, 12 bp, Homo sapiens
gactcagtgttc

SEQ ID NO: 3370455 - DNA, 20 bp, Homo sapiens
gactcattccctagatcttt

SEQ ID NO: 3370456 - DNA, 16 bp, Homo sapiens
gactccaatctggtaa

SEQ ID NO: 3370457 - DNA, 19 bp, Homo sapiens
gactccacgatcctgccac

SEQ ID NO: 3370458 - DNA, 20 bp, Homo sapiens
gactccacgatcctgccacc

SEQ ID NO: 3370459 - DNA, 17 bp, Homo sapiens
gactccactggacagac

SEQ ID NO: 3370460 - DNA, 18 bp, Homo sapiens
gactccactggacagacc

SEQ ID NO: 3370461 - DNA, 22 bp, Homo sapiens
gactccagaatctgctgttgcc

SEQ ID NO: 3370462 - DNA, 12 bp, Homo sapiens
gactccagagtc

SEQ ID NO: 3370463 - DNA, 15 bp, Homo sapiens
gactccagagtctga

SEQ ID NO: 3370464 - DNA, 17 bp, Homo sapiens
gactccagagtctgagc

SEQ ID NO: 3370465 - DNA, 14 bp, Homo sapiens
gactccaggcccaa

SEQ ID NO: 3370466 - DNA, 18 bp, Homo sapiens
gactccaggcccaaggct

SEQ ID NO: 3370467 - DNA, 21 bp, Homo sapiens
gactccatctctcatcctcca

SEQ ID NO: 3370468 - DNA, 15 bp, Homo sapiens
gactcccaaccctgg

SEQ ID NO: 3370469 - DNA, 17 bp, Homo sapiens
gactcccaagtttccat

SEQ ID NO: 3370470 - DNA, 23 bp, Homo sapiens
gactcccgggccacgccccagcc

SEQ ID NO: 3370471 - DNA, 14 bp, Homo sapiens
gactccctcctcac

SEQ ID NO: 3370472 - DNA, 13 bp, Homo sapiens
gactccctgtggg

SEQ ID NO: 3370473 - DNA, 23 bp, Homo sapiens
gactccctgtgggggtggccatc

SEQ ID NO: 3370474 - DNA, 18 bp, Homo sapiens
gactccggcctgtaatca

SEQ ID NO: 3370475 - DNA, 17 bp, Homo sapiens
gactccgttggccactc

SEQ ID NO: 3370476 - DNA, 16 bp, Homo sapiens
gactcctcctttctcc

SEQ ID NO: 3370477 - DNA, 16 bp, Homo sapiens
gactcctcctttttcc

SEQ ID NO: 3370478 - DNA, 12 bp, Homo sapiens
gactcctctggg

SEQ ID NO: 3370479 - DNA, 18 bp, Homo sapiens
gactcctctgggcctggg

SEQ ID NO: 3370480 - DNA, 11 bp, Homo sapiens
gactcctctgt

SEQ ID NO: 3370481 - DNA, 12 bp, Homo sapiens
gactcctgctgg

SEQ ID NO: 3370482 - DNA, 13 bp, Homo sapiens
gactcctgctggt

SEQ ID NO: 3370483 - DNA, 22 bp, Homo sapiens
gactcctgtggagatgacttgg

SEQ ID NO: 3370484 - DNA, 16 bp, Homo sapiens
gactccttttggaacc

SEQ ID NO: 3370485 - DNA, 13 bp, Homo sapiens
gactcgcttgtaa

SEQ ID NO: 3370486 - DNA, 21 bp, Homo sapiens
gactcggagactatggcctcg

SEQ ID NO: 3370487 - DNA, 14 bp, Homo sapiens
gactctaaagacca

SEQ ID NO: 3370488 - DNA, 17 bp, Homo sapiens
gactctaaagaccaaac

SEQ ID NO: 3370489 - DNA, 19 bp, Homo sapiens
gactctaaagaccaaactt

SEQ ID NO: 3370490 - DNA, 21 bp, Homo sapiens
gactctaaattctttatttct

SEQ ID NO: 3370491 - DNA, 23 bp, Homo sapiens
gactctaaattctttatttctgt

SEQ ID NO: 3370492 - DNA, 15 bp, Homo sapiens
gactctaagctgtgt

SEQ ID NO: 3370493 - DNA, 15 bp, Homo sapiens
gactctacagaggcc

SEQ ID NO: 3370494 - DNA, 19 bp, Homo sapiens
gactctacctcatatcagt

SEQ ID NO: 3370495 - DNA, 19 bp, Homo sapiens
gactctagagtccaaggtt

SEQ ID NO: 3370496 - DNA, 14 bp, Homo sapiens
gactctaggttata

SEQ ID NO: 3370497 - DNA, 21 bp, Homo sapiens
gactctcagcccagaagaaaa

SEQ ID NO: 3370498 - DNA, 14 bp, Homo sapiens
gactctctgtgacc

SEQ ID NO: 3370499 - DNA, 20 bp, Homo sapiens
gactctgaaaaacattccag

SEQ ID NO: 3370500 - DNA, 17 bp, Homo sapiens
gactctgagcgggaggc

SEQ ID NO: 3370501 - DNA, 19 bp, Homo sapiens
gactctgagcgggaggcag

SEQ ID NO: 3370502 - DNA, 22 bp, Homo sapiens
gactctgagcgggaggcagagt

SEQ ID NO: 3370503 - DNA, 18 bp, Homo sapiens
gactctgagtccactgct

SEQ ID NO: 3370504 - DNA, 12 bp, Homo sapiens
gactctgcactc

SEQ ID NO: 3370505 - DNA, 23 bp, Homo sapiens
gactctgcactctccaccctggc

SEQ ID NO: 3370506 - DNA, 21 bp, Homo sapiens
gactctgcatcccagcacctg

SEQ ID NO: 3370507 - DNA, 11 bp, Homo sapiens
gactctgcccc

SEQ ID NO: 3370508 - DNA, 16 bp, Homo sapiens
gactctggcaaagctt

SEQ ID NO: 3370509 - DNA, 12 bp, Homo sapiens
gactctggccct

SEQ ID NO: 3370510 - DNA, 18 bp, Homo sapiens
gactctggccctggccct

SEQ ID NO: 3370511 - DNA, 17 bp, Homo sapiens
gactctgtaacatcact

SEQ ID NO: 3370512 - DNA, 19 bp, Homo sapiens
gactctgtctacctggtct

SEQ ID NO: 3370513 - DNA, 12 bp, Homo sapiens
gactctgtctca

SEQ ID NO: 3370514 - DNA, 16 bp, Homo sapiens
gactctgtctcaaaaa

SEQ ID NO: 3370515 - DNA, 19 bp, Homo sapiens
gactctgtctcaaaaaaac

SEQ ID NO: 3370516 - DNA, 12 bp, Homo sapiens
gactcttgctct

SEQ ID NO: 3370517 - DNA, 19 bp, Homo sapiens
gactcttgggccgtcccca

SEQ ID NO: 3370518 - DNA, 21 bp, Homo sapiens
gactctttaataaattgctta

SEQ ID NO: 3370519 - DNA, 19 bp, Homo sapiens
gactctttctgaaggaaga

SEQ ID NO: 3370520 - DNA, 22 bp, Homo sapiens
gactgaaaaaaaaaaagaagaa

SEQ ID NO: 3370521 - DNA, 23 bp, Homo sapiens
gactgaaaaaaaaaaagaagaag

SEQ ID NO: 3370522 - DNA, 16 bp, Homo sapiens
gactgaaagcagcagc

SEQ ID NO: 3370523 - DNA, 14 bp, Homo sapiens
gactgaaggaaaag

SEQ ID NO: 3370524 - DNA, 13 bp, Homo sapiens
gactgaaggggca

SEQ ID NO: 3370525 - DNA, 12 bp, Homo sapiens
gactgaatgcag

SEQ ID NO: 3370526 - DNA, 15 bp, Homo sapiens
gactgaatgtgccta

SEQ ID NO: 3370527 - DNA, 20 bp, Homo sapiens
gactgagacacgatgccgag

SEQ ID NO: 3370528 - DNA, 18 bp, Homo sapiens
gactgagatttcttaaat

SEQ ID NO: 3370529 - DNA, 12 bp, Homo sapiens
gactgagcagcc

SEQ ID NO: 3370530 - DNA, 19 bp, Homo sapiens
gactgagcagccgccagct

SEQ ID NO: 3370531 - DNA, 17 bp, Homo sapiens
gactgagccaaggaggc

SEQ ID NO: 3370532 - DNA, 12 bp, Homo sapiens
gactgaggacaa

SEQ ID NO: 3370533 - DNA, 13 bp, Homo sapiens
gactgaggagtgg

SEQ ID NO: 3370534 - DNA, 13 bp, Homo sapiens
gactgattttaat

SEQ ID NO: 3370535 - DNA, 22 bp, Homo sapiens
gactgcaaacttttttatatct

SEQ ID NO: 3370536 - DNA, 18 bp, Homo sapiens
gactgcacagcggcccct

SEQ ID NO: 3370537 - DNA, 17 bp, Homo sapiens
gactgcacccagctcca

SEQ ID NO: 3370538 - DNA, 21 bp, Homo sapiens
gactgcacccagctccagggg

SEQ ID NO: 3370539 - DNA, 21 bp, Homo sapiens
gactgcaggttggaccccaga

SEQ ID NO: 3370540 - DNA, 22 bp, Homo sapiens
gactgcaggttggaccccagag

SEQ ID NO: 3370541 - DNA, 23 bp, Homo sapiens
gactgcaggttggaccccagaga

SEQ ID NO: 3370542 - DNA, 18 bp, Homo sapiens
gactgcatttaaatttga

SEQ ID NO: 3370543 - DNA, 23 bp, Homo sapiens
gactgcccctgctgtgctgctca

SEQ ID NO: 3370544 - DNA, 21 bp, Homo sapiens
gactgcgggatggtcctgggg

SEQ ID NO: 3370545 - DNA, 22 bp, Homo sapiens
gactgcgggatggtcctggggc

SEQ ID NO: 3370546 - DNA, 18 bp, Homo sapiens
gactgctacctctgagaa

SEQ ID NO: 3370547 - DNA, 20 bp, Homo sapiens
gactgctagtgttctgtcta

SEQ ID NO: 3370548 - DNA, 21 bp, Homo sapiens
gactgctccccagccctggct

SEQ ID NO: 3370549 - DNA, 12 bp, Homo sapiens
gactgcttccca

SEQ ID NO: 3370550 - DNA, 22 bp, Homo sapiens
gactgcttcccatcctaccctc

SEQ ID NO: 3370551 - DNA, 20 bp, Homo sapiens
gactggaagctaatttgcat

SEQ ID NO: 3370552 - DNA, 19 bp, Homo sapiens
gactggaagttcataccta

SEQ ID NO: 3370553 - DNA, 16 bp, Homo sapiens
gactggaggcccctgg

SEQ ID NO: 3370554 - DNA, 15 bp, Homo sapiens
gactggaggtgggca

SEQ ID NO: 3370555 - DNA, 13 bp, Homo sapiens
gactggcaataaa

SEQ ID NO: 3370556 - DNA, 15 bp, Homo sapiens
gactggccgggcagg

SEQ ID NO: 3370557 - DNA, 17 bp, Homo sapiens
gactggccgggcaggcg

SEQ ID NO: 3370558 - DNA, 22 bp, Homo sapiens
gactggccgggcaggcgtgact

SEQ ID NO: 3370559 - DNA, 21 bp, Homo sapiens
gactggctagagtcctcactc

SEQ ID NO: 3370560 - DNA, 23 bp, Homo sapiens
gactggctagagtcctcactccc

SEQ ID NO: 3370561 - DNA, 14 bp, Homo sapiens
gactggctggctgc

SEQ ID NO: 3370562 - DNA, 19 bp, Homo sapiens
gactgggagccacttctcc

SEQ ID NO: 3370563 - DNA, 15 bp, Homo sapiens
gactgggagtcagag

SEQ ID NO: 3370564 - DNA, 16 bp, Homo sapiens
gactgggagtcagagc

SEQ ID NO: 3370565 - DNA, 20 bp, Homo sapiens
gactgggatgggaacactgg

SEQ ID NO: 3370566 - DNA, 12 bp, Homo sapiens
gactgggcctcc

SEQ ID NO: 3370567 - DNA, 17 bp, Homo sapiens
gactggggatgtgggag

SEQ ID NO: 3370568 - DNA, 20 bp, Homo sapiens
gactggggatgtgggaggga

SEQ ID NO: 3370569 - DNA, 17 bp, Homo sapiens
gactggggtggcctcaa

SEQ ID NO: 3370570 - DNA, 21 bp, Homo sapiens
gactgggtttggaccccagct

SEQ ID NO: 3370571 - DNA, 15 bp, Homo sapiens
gactggtccagctct

SEQ ID NO: 3370572 - DNA, 19 bp, Homo sapiens
gactggtttacaggccctg

SEQ ID NO: 3370573 - DNA, 15 bp, Homo sapiens
gactggttttctgcc

SEQ ID NO: 3370574 - DNA, 16 bp, Homo sapiens
gactggttttctgcca

SEQ ID NO: 3370575 - DNA, 13 bp, Homo sapiens
gactgtaaagatt

SEQ ID NO: 3370576 - DNA, 14 bp, Homo sapiens
gactgtaagatgtt

SEQ ID NO: 3370577 - DNA, 15 bp, Homo sapiens
gactgtaagatgttg

SEQ ID NO: 3370578 - DNA, 16 bp, Homo sapiens
gactgtaccacagaca

SEQ ID NO: 3370579 - DNA, 17 bp, Homo sapiens
gactgtactcctcccag

SEQ ID NO: 3370580 - DNA, 11 bp, Homo sapiens
gactgtactgg

SEQ ID NO: 3370581 - DNA, 20 bp, Homo sapiens
gactgtagatatgtattctt

SEQ ID NO: 3370582 - DNA, 20 bp, Homo sapiens
gactgtagattgcttctgta

SEQ ID NO: 3370583 - DNA, 21 bp, Homo sapiens
gactgtagattgcttctgtag

SEQ ID NO: 3370584 - DNA, 22 bp, Homo sapiens
gactgtagggagggcggcaggg

SEQ ID NO: 3370585 - DNA, 22 bp, Homo sapiens
gactgtcaagtacaagcaagac

SEQ ID NO: 3370586 - DNA, 15 bp, Homo sapiens
gactgtccactcggg

SEQ ID NO: 3370587 - DNA, 11 bp, Homo sapiens
gactgtcccac

SEQ ID NO: 3370588 - DNA, 23 bp, Homo sapiens
gactgtcccaccgggagcctccc

SEQ ID NO: 3370589 - DNA, 22 bp, Homo sapiens
gactgtcctctcccctccagcc

SEQ ID NO: 3370590 - DNA, 17 bp, Homo sapiens
gactgtgaccaccttct

SEQ ID NO: 3370591 - DNA, 13 bp, Homo sapiens
gactgtgatgcca

SEQ ID NO: 3370592 - DNA, 19 bp, Homo sapiens
gactgtgatgccacacaga

SEQ ID NO: 3370593 - DNA, 13 bp, Homo sapiens
gactgtgctactg

SEQ ID NO: 3370594 - DNA, 22 bp, Homo sapiens
gactgtgtattctagttttgtc

SEQ ID NO: 3370595 - DNA, 22 bp, Homo sapiens
gactgttactttggcaatttcc

SEQ ID NO: 3370596 - DNA, 14 bp, Homo sapiens
gactgttccaaagc

SEQ ID NO: 3370597 - DNA, 16 bp, Homo sapiens
gactgttccaggccct

SEQ ID NO: 3370598 - DNA, 22 bp, Homo sapiens
gactgttccaggccctccagtg

SEQ ID NO: 3370599 - DNA, 21 bp, Homo sapiens
gactgttcttggtaactgatt

SEQ ID NO: 3370600 - DNA, 13 bp, Homo sapiens
gactgttgtgatc

SEQ ID NO: 3370601 - DNA, 22 bp, Homo sapiens
gactgtttttaagtaacttaag

SEQ ID NO: 3370602 - DNA, 14 bp, Homo sapiens
gacttaacggctcc

SEQ ID NO: 3370603 - DNA, 16 bp, Homo sapiens
gacttaactccttcca

SEQ ID NO: 3370604 - DNA, 23 bp, Homo sapiens
gacttaatgtgattactgctcta

SEQ ID NO: 3370605 - DNA, 14 bp, Homo sapiens
gacttaccaggaag

SEQ ID NO: 3370606 - DNA, 13 bp, Homo sapiens
gacttagagctgg

SEQ ID NO: 3370607 - DNA, 17 bp, Homo sapiens
gacttagggcaccaggg

SEQ ID NO: 3370608 - DNA, 16 bp, Homo sapiens
gacttagtaacttttt

SEQ ID NO: 3370609 - DNA, 15 bp, Homo sapiens
gacttattacaattt

SEQ ID NO: 3370610 - DNA, 17 bp, Homo sapiens
gacttatttcttcaaat

SEQ ID NO: 3370611 - DNA, 17 bp, Homo sapiens
gacttattttgtcttat

SEQ ID NO: 3370612 - DNA, 15 bp, Homo sapiens
gacttcagctgcctg

SEQ ID NO: 3370613 - DNA, 22 bp, Homo sapiens
gacttcagggcagggctctgat

SEQ ID NO: 3370614 - DNA, 16 bp, Homo sapiens
gacttcagtcttgcct

SEQ ID NO: 3370615 - DNA, 21 bp, Homo sapiens
gacttcatctggggttggcaa

SEQ ID NO: 3370616 - DNA, 23 bp, Homo sapiens
gacttcattgtccctcttcactc

SEQ ID NO: 3370617 - DNA, 12 bp, Homo sapiens
gacttcatttta

SEQ ID NO: 3370618 - DNA, 15 bp, Homo sapiens
gacttcattttatat

SEQ ID NO: 3370619 - DNA, 20 bp, Homo sapiens
gacttcattttatatttaaa

SEQ ID NO: 3370620 - DNA, 13 bp, Homo sapiens
gacttcccagctt

SEQ ID NO: 3370621 - DNA, 20 bp, Homo sapiens
gacttccccaaacccagaaa

SEQ ID NO: 3370622 - DNA, 15 bp, Homo sapiens
gacttcctggggccc

SEQ ID NO: 3370623 - DNA, 14 bp, Homo sapiens
gacttccttgagac

SEQ ID NO: 3370624 - DNA, 15 bp, Homo sapiens
gacttccttgagaca

SEQ ID NO: 3370625 - DNA, 18 bp, Homo sapiens
gacttccttgctctccct

SEQ ID NO: 3370626 - DNA, 19 bp, Homo sapiens
gacttctaatatcattcac

SEQ ID NO: 3370627 - DNA, 14 bp, Homo sapiens
gacttctacccaga

SEQ ID NO: 3370628 - DNA, 15 bp, Homo sapiens
gacttctacctgccc

SEQ ID NO: 3370629 - DNA, 14 bp, Homo sapiens
gacttctccaggtc

SEQ ID NO: 3370630 - DNA, 16 bp, Homo sapiens
gacttctggaaggctg

SEQ ID NO: 3370631 - DNA, 19 bp, Homo sapiens
gacttctggaaggctggct

SEQ ID NO: 3370632 - DNA, 13 bp, Homo sapiens
gacttctgtgggc

SEQ ID NO: 3370633 - DNA, 20 bp, Homo sapiens
gacttcttacccaaagcaca

SEQ ID NO: 3370634 - DNA, 15 bp, Homo sapiens
gacttcttgcttcag

SEQ ID NO: 3370635 - DNA, 13 bp, Homo sapiens
gacttgaaagcat

SEQ ID NO: 3370636 - DNA, 21 bp, Homo sapiens
gacttgaaagcatccatgtgt

SEQ ID NO: 3370637 - DNA, 20 bp, Homo sapiens
gacttgaagcacagagggct

SEQ ID NO: 3370638 - DNA, 13 bp, Homo sapiens
gacttggaagctc

SEQ ID NO: 3370639 - DNA, 16 bp, Homo sapiens
gacttggaagctccgc

SEQ ID NO: 3370640 - DNA, 18 bp, Homo sapiens
gacttggagactcctggt

SEQ ID NO: 3370641 - DNA, 13 bp, Homo sapiens
gacttggcactta

SEQ ID NO: 3370642 - DNA, 16 bp, Homo sapiens
gacttggggtcaggaa

SEQ ID NO: 3370643 - DNA, 20 bp, Homo sapiens
gacttggtacagttgcagga

SEQ ID NO: 3370644 - DNA, 21 bp, Homo sapiens
gacttggtacagttgcaggag

SEQ ID NO: 3370645 - DNA, 15 bp, Homo sapiens
gacttggttggtagg

SEQ ID NO: 3370646 - DNA, 16 bp, Homo sapiens
gacttgtatatttgta

SEQ ID NO: 3370647 - DNA, 13 bp, Homo sapiens
gacttgtttgtgc

SEQ ID NO: 3370648 - DNA, 15 bp, Homo sapiens
gacttgtttgtgcat

SEQ ID NO: 3370649 - DNA, 18 bp, Homo sapiens
gacttgtttttgcacatg

SEQ ID NO: 3370650 - DNA, 13 bp, Homo sapiens
gactttatttatt

SEQ ID NO: 3370651 - DNA, 14 bp, Homo sapiens
gactttatttattt

SEQ ID NO: 3370652 - DNA, 15 bp, Homo sapiens
gactttatttatttc

SEQ ID NO: 3370653 - DNA, 16 bp, Homo sapiens
gactttcaaaatatat

SEQ ID NO: 3370654 - DNA, 11 bp, Homo sapiens
gactttcctgc

SEQ ID NO: 3370655 - DNA, 19 bp, Homo sapiens
gactttctgattactgtcc

SEQ ID NO: 3370656 - DNA, 14 bp, Homo sapiens
gactttctgcctgg

SEQ ID NO: 3370657 - DNA, 15 bp, Homo sapiens
gactttctgcctgga

SEQ ID NO: 3370658 - DNA, 13 bp, Homo sapiens
gactttctgtgac

SEQ ID NO: 3370659 - DNA, 13 bp, Homo sapiens
gactttctgttgg

SEQ ID NO: 3370660 - DNA, 20 bp, Homo sapiens
gactttgcagatggaaagag

SEQ ID NO: 3370661 - DNA, 17 bp, Homo sapiens
gactttgcttgctttga

SEQ ID NO: 3370662 - DNA, 14 bp, Homo sapiens
gactttgtaccccc

SEQ ID NO: 3370663 - DNA, 19 bp, Homo sapiens
gacttttgtacatctggct

SEQ ID NO: 3370664 - DNA, 17 bp, Homo sapiens
gactttttagccagtga

SEQ ID NO: 3370665 - DNA, 19 bp, Homo sapiens
gactttttagccagtgact

SEQ ID NO: 3370666 - DNA, 18 bp, Homo sapiens
gactttttggtggatgta

SEQ ID NO: 3370667 - DNA, 21 bp, Homo sapiens
gactttttggtggatgtaaat

SEQ ID NO: 3370668 - DNA, 23 bp, Homo sapiens
gactttttggtggatgtaaataa

SEQ ID NO: 3370669 - DNA, 23 bp, Homo sapiens
gactttttttggtataatgttta

SEQ ID NO: 3370670 - DNA, 10 bp, Homo sapiens
gagaaaaaaa

SEQ ID NO: 3370671 - DNA, 18 bp, Homo sapiens
gagaaaaaaaaccttgta

SEQ ID NO: 3370672 - DNA, 20 bp, Homo sapiens
gagaaaaaaaaccttgtaaa

SEQ ID NO: 3370673 - DNA, 17 bp, Homo sapiens
gagaaaaagctcctgtc

SEQ ID NO: 3370674 - DNA, 18 bp, Homo sapiens
gagaaaagcacacttgta

SEQ ID NO: 3370675 - DNA, 15 bp, Homo sapiens
gagaaaatccaggtc

SEQ ID NO: 3370676 - DNA, 15 bp, Homo sapiens
gagaaaatgcctcaa

SEQ ID NO: 3370677 - DNA, 13 bp, Homo sapiens
gagaaacagagac

SEQ ID NO: 3370678 - DNA, 15 bp, Homo sapiens
gagaaacagctcagc

SEQ ID NO: 3370679 - DNA, 17 bp, Homo sapiens
gagaaacagctcagcca

SEQ ID NO: 3370680 - DNA, 17 bp, Homo sapiens
gagaaacagttggtaac

SEQ ID NO: 3370681 - DNA, 22 bp, Homo sapiens
gagaaacagttggtaacttttg

SEQ ID NO: 3370682 - DNA, 13 bp, Homo sapiens
gagaaactccaaa

SEQ ID NO: 3370683 - DNA, 19 bp, Homo sapiens
gagaaagaatttgagacgc

SEQ ID NO: 3370684 - DNA, 13 bp, Homo sapiens
gagaaagagagaa

SEQ ID NO: 3370685 - DNA, 17 bp, Homo sapiens
gagaaagagctgcctgg

SEQ ID NO: 3370686 - DNA, 18 bp, Homo sapiens
gagaaagagctgcctgga

SEQ ID NO: 3370687 - DNA, 16 bp, Homo sapiens
gagaaagccaggcagg

SEQ ID NO: 3370688 - DNA, 16 bp, Homo sapiens
gagaaaggttgaagca

SEQ ID NO: 3370689 - DNA, 20 bp, Homo sapiens
gagaaagtgatttctagaaa

SEQ ID NO: 3370690 - DNA, 20 bp, Homo sapiens
gagaaatatggacacttaat

SEQ ID NO: 3370691 - DNA, 22 bp, Homo sapiens
gagaaatcatcctgttttctct

SEQ ID NO: 3370692 - DNA, 13 bp, Homo sapiens
gagaaatgggact

SEQ ID NO: 3370693 - DNA, 17 bp, Homo sapiens
gagaaattctgttaaaa

SEQ ID NO: 3370694 - DNA, 22 bp, Homo sapiens
gagaaattctgttaaaatctat

SEQ ID NO: 3370695 - DNA, 17 bp, Homo sapiens
gagaacaaacagatcga

SEQ ID NO: 3370696 - DNA, 14 bp, Homo sapiens
gagaacaaagctgt

SEQ ID NO: 3370697 - DNA, 15 bp, Homo sapiens
gagaacaaagctgtt

SEQ ID NO: 3370698 - DNA, 22 bp, Homo sapiens
gagaacacctccagcttttctt

SEQ ID NO: 3370699 - DNA, 18 bp, Homo sapiens
gagaacaggtggttttta

SEQ ID NO: 3370700 - DNA, 13 bp, Homo sapiens
gagaacagtggtt

SEQ ID NO: 3370701 - DNA, 21 bp, Homo sapiens
gagaacagtggttgcctgggg

SEQ ID NO: 3370702 - DNA, 22 bp, Homo sapiens
gagaacagttgagagagaatct

SEQ ID NO: 3370703 - DNA, 17 bp, Homo sapiens
gagaaccaaatctggaa

SEQ ID NO: 3370704 - DNA, 19 bp, Homo sapiens
gagaaccactacatgcagc

SEQ ID NO: 3370705 - DNA, 22 bp, Homo sapiens
gagaaccgagcaaagatcaaaa

SEQ ID NO: 3370706 - DNA, 23 bp, Homo sapiens
gagaaccgagcaaagatcaaaat

SEQ ID NO: 3370707 - DNA, 14 bp, Homo sapiens
gagaacctcaggct

SEQ ID NO: 3370708 - DNA, 22 bp, Homo sapiens
gagaacctcaggtacggagaag

SEQ ID NO: 3370709 - DNA, 15 bp, Homo sapiens
gagaacgccagtctc

SEQ ID NO: 3370710 - DNA, 22 bp, Homo sapiens
gagaactaaactagtttttcct

SEQ ID NO: 3370711 - DNA, 13 bp, Homo sapiens
gagaactcctgac

SEQ ID NO: 3370712 - DNA, 20 bp, Homo sapiens
gagaactcgcgctcagtaaa

SEQ ID NO: 3370713 - DNA, 21 bp, Homo sapiens
gagaactgaattttgggactt

SEQ ID NO: 3370714 - DNA, 17 bp, Homo sapiens
gagaactttccattttg

SEQ ID NO: 3370715 - DNA, 14 bp, Homo sapiens
gagaagacactgca

SEQ ID NO: 3370716 - DNA, 18 bp, Homo sapiens
gagaagacactgcagtga

SEQ ID NO: 3370717 - DNA, 14 bp, Homo sapiens
gagaagagaaaatg

SEQ ID NO: 3370718 - DNA, 16 bp, Homo sapiens
gagaagagaggagagg

SEQ ID NO: 3370719 - DNA, 14 bp, Homo sapiens
gagaagagccctgg

SEQ ID NO: 3370720 - DNA, 12 bp, Homo sapiens
gagaagaggagc

SEQ ID NO: 3370721 - DNA, 21 bp, Homo sapiens
gagaagaggcatcctgcctgg

SEQ ID NO: 3370722 - DNA, 19 bp, Homo sapiens
gagaagagggcctgtggga

SEQ ID NO: 3370723 - DNA, 20 bp, Homo sapiens
gagaagccacgctgtcctct

SEQ ID NO: 3370724 - DNA, 14 bp, Homo sapiens
gagaagccagccac

SEQ ID NO: 3370725 - DNA, 15 bp, Homo sapiens
gagaagccatgtact

SEQ ID NO: 3370726 - DNA, 14 bp, Homo sapiens
gagaagcccgtgtg

SEQ ID NO: 3370727 - DNA, 15 bp, Homo sapiens
gagaagcgtttttaa

SEQ ID NO: 3370728 - DNA, 14 bp, Homo sapiens
gagaagctggactt

SEQ ID NO: 3370729 - DNA, 20 bp, Homo sapiens
gagaagctttttttcttgct

SEQ ID NO: 3370730 - DNA, 13 bp, Homo sapiens
gagaaggaagcca

SEQ ID NO: 3370731 - DNA, 12 bp, Homo sapiens
gagaaggaaggg

SEQ ID NO: 3370732 - DNA, 22 bp, Homo sapiens
gagaaggacccggaggggcctg

SEQ ID NO: 3370733 - DNA, 12 bp, Homo sapiens
gagaaggagaga

SEQ ID NO: 3370734 - DNA, 14 bp, Homo sapiens
gagaaggcgaggag

SEQ ID NO: 3370735 - DNA, 23 bp, Homo sapiens
gagaagggtggtaaatattttca

SEQ ID NO: 3370736 - DNA, 19 bp, Homo sapiens
gagaaggtattagcaaagc

SEQ ID NO: 3370737 - DNA, 16 bp, Homo sapiens
gagaagtatacataag

SEQ ID NO: 3370738 - DNA, 14 bp, Homo sapiens
gagaagtcaaacat

SEQ ID NO: 3370739 - DNA, 18 bp, Homo sapiens
gagaagtcaaacatttca

SEQ ID NO: 3370740 - DNA, 20 bp, Homo sapiens
gagaagtgaatgctgggact

SEQ ID NO: 3370741 - DNA, 12 bp, Homo sapiens
gagaagttctca

SEQ ID NO: 3370742 - DNA, 18 bp, Homo sapiens
gagaagttctcaaagtta

SEQ ID NO: 3370743 - DNA, 16 bp, Homo sapiens
gagaagttgtgaaaga

SEQ ID NO: 3370744 - DNA, 22 bp, Homo sapiens
gagaataagagaaagaaaatga

SEQ ID NO: 3370745 - DNA, 14 bp, Homo sapiens
gagaatatatacat

SEQ ID NO: 3370746 - DNA, 15 bp, Homo sapiens
gagaatattaattgt

SEQ ID NO: 3370747 - DNA, 20 bp, Homo sapiens
gagaatattcctacttgcag

SEQ ID NO: 3370748 - DNA, 13 bp, Homo sapiens
gagaatcactgca

SEQ ID NO: 3370749 - DNA, 17 bp, Homo sapiens
gagaatcccttaaaatt

SEQ ID NO: 3370750 - DNA, 22 bp, Homo sapiens
gagaatcccttaaaattaccag

SEQ ID NO: 3370751 - DNA, 15 bp, Homo sapiens
gagaatctatattta

SEQ ID NO: 3370752 - DNA, 15 bp, Homo sapiens
gagaatgaaagggcc

SEQ ID NO: 3370753 - DNA, 23 bp, Homo sapiens
gagaatgaaagggcccagagagg

SEQ ID NO: 3370754 - DNA, 23 bp, Homo sapiens
gagaatgagtccttgatttcaaa

SEQ ID NO: 3370755 - DNA, 16 bp, Homo sapiens
gagaatgcacagatat

SEQ ID NO: 3370756 - DNA, 17 bp, Homo sapiens
gagaatgctggcaaagg

SEQ ID NO: 3370757 - DNA, 19 bp, Homo sapiens
gagaatggaaaccacaact

SEQ ID NO: 3370758 - DNA, 17 bp, Homo sapiens
gagaatggctgggtcag

SEQ ID NO: 3370759 - DNA, 21 bp, Homo sapiens
gagaatgtagatattgtgaag

SEQ ID NO: 3370760 - DNA, 23 bp, Homo sapiens
gagaatgtgtgtgtgtggcaggg

SEQ ID NO: 3370761 - DNA, 14 bp, Homo sapiens
gagaattcacagaa

SEQ ID NO: 3370762 - DNA, 13 bp, Homo sapiens
gagaattggctca

SEQ ID NO: 3370763 - DNA, 14 bp, Homo sapiens
gagaattgggggct

SEQ ID NO: 3370764 - DNA, 13 bp, Homo sapiens
gagaatttctaaa

SEQ ID NO: 3370765 - DNA, 21 bp, Homo sapiens
gagaatttctaccatttcaga

SEQ ID NO: 3370766 - DNA, 22 bp, Homo sapiens
gagacaaacacctcccaggaga

SEQ ID NO: 3370767 - DNA, 18 bp, Homo sapiens
gagacaaatctttaagaa

SEQ ID NO: 3370768 - DNA, 17 bp, Homo sapiens
gagacaagaaatccctg

SEQ ID NO: 3370769 - DNA, 13 bp, Homo sapiens
gagacaagccctg

SEQ ID NO: 3370770 - DNA, 14 bp, Homo sapiens
gagacaagccctgg

SEQ ID NO: 3370771 - DNA, 22 bp, Homo sapiens
gagacaagttccatgggataca

SEQ ID NO: 3370772 - DNA, 16 bp, Homo sapiens
gagacacagcgtccct

SEQ ID NO: 3370773 - DNA, 20 bp, Homo sapiens
gagacactgtgctataaatc

SEQ ID NO: 3370774 - DNA, 15 bp, Homo sapiens
gagacagaagcctgg

SEQ ID NO: 3370775 - DNA, 21 bp, Homo sapiens
gagacagaagcctggactctg

SEQ ID NO: 3370776 - DNA, 14 bp, Homo sapiens
gagacagccccaga

SEQ ID NO: 3370777 - DNA, 14 bp, Homo sapiens
gagacagcttctct

SEQ ID NO: 3370778 - DNA, 16 bp, Homo sapiens
gagacaggagcctagc

SEQ ID NO: 3370779 - DNA, 16 bp, Homo sapiens
gagacagggtaggaaa

SEQ ID NO: 3370780 - DNA, 19 bp, Homo sapiens
gagacagggtttcaccatg

SEQ ID NO: 3370781 - DNA, 22 bp, Homo sapiens
gagacagggttttgccatgttg

SEQ ID NO: 3370782 - DNA, 13 bp, Homo sapiens
gagacagtccagt

SEQ ID NO: 3370783 - DNA, 17 bp, Homo sapiens
gagacagttatttatag

SEQ ID NO: 3370784 - DNA, 18 bp, Homo sapiens
gagacagttatttatagt

SEQ ID NO: 3370785 - DNA, 19 bp, Homo sapiens
gagacataaatgttcactt

SEQ ID NO: 3370786 - DNA, 14 bp, Homo sapiens
gagacattttcata

SEQ ID NO: 3370787 - DNA, 18 bp, Homo sapiens
gagaccaagtcctggcta

SEQ ID NO: 3370788 - DNA, 19 bp, Homo sapiens
gagaccaagtcctggctac

SEQ ID NO: 3370789 - DNA, 13 bp, Homo sapiens
gagaccagcctgg

SEQ ID NO: 3370790 - DNA, 20 bp, Homo sapiens
gagaccagtgtatcaggtca

SEQ ID NO: 3370791 - DNA, 22 bp, Homo sapiens
gagaccagtgtatcaggtcagg

SEQ ID NO: 3370792 - DNA, 21 bp, Homo sapiens
gagaccagttgggagcactgg

SEQ ID NO: 3370793 - DNA, 12 bp, Homo sapiens
gagaccatcctg

SEQ ID NO: 3370794 - DNA, 17 bp, Homo sapiens
gagaccatgcagagcgc

SEQ ID NO: 3370795 - DNA, 22 bp, Homo sapiens
gagacccaaagcggtccctgtc

SEQ ID NO: 3370796 - DNA, 15 bp, Homo sapiens
gagacccaagggcag

SEQ ID NO: 3370797 - DNA, 17 bp, Homo sapiens
gagacccaccccacctg

SEQ ID NO: 3370798 - DNA, 12 bp, Homo sapiens
gagacccccaca

SEQ ID NO: 3370799 - DNA, 15 bp, Homo sapiens
gagacccccacacct

SEQ ID NO: 3370800 - DNA, 19 bp, Homo sapiens
gagaccccgcacccggctc

SEQ ID NO: 3370801 - DNA, 15 bp, Homo sapiens
gagacccctgtctcc

SEQ ID NO: 3370802 - DNA, 23 bp, Homo sapiens
gagaccctcgcccaactccacca

SEQ ID NO: 3370803 - DNA, 21 bp, Homo sapiens
gagaccctctgccaccagaga

SEQ ID NO: 3370804 - DNA, 16 bp, Homo sapiens
gagaccgtcctcaccc

SEQ ID NO: 3370805 - DNA, 23 bp, Homo sapiens
gagacctacctcaggttgctggt

SEQ ID NO: 3370806 - DNA, 16 bp, Homo sapiens
gagaccttaatttata

SEQ ID NO: 3370807 - DNA, 15 bp, Homo sapiens
gagacgacaggcgag

SEQ ID NO: 3370808 - DNA, 19 bp, Homo sapiens
gagacggagtcccaccttg

SEQ ID NO: 3370809 - DNA, 13 bp, Homo sapiens
gagacgggcatcg

SEQ ID NO: 3370810 - DNA, 18 bp, Homo sapiens
gagacgtggaacctctgt

SEQ ID NO: 3370811 - DNA, 22 bp, Homo sapiens
gagacgtggaacctctgtctca

SEQ ID NO: 3370812 - DNA, 20 bp, Homo sapiens
gagacgtttataaacagaaa

SEQ ID NO: 3370813 - DNA, 15 bp, Homo sapiens
gagactcagcgctcc

SEQ ID NO: 3370814 - DNA, 17 bp, Homo sapiens
gagactcagcgctcctc

SEQ ID NO: 3370815 - DNA, 23 bp, Homo sapiens
gagactcagcgctcctcctgtgt

SEQ ID NO: 3370816 - DNA, 20 bp, Homo sapiens
gagactccagaatctgctgt

SEQ ID NO: 3370817 - DNA, 23 bp, Homo sapiens
gagactccagaatctgctgttgc

SEQ ID NO: 3370818 - DNA, 14 bp, Homo sapiens
gagactcctggtct

SEQ ID NO: 3370819 - DNA, 16 bp, Homo sapiens
gagactctagggtcca

SEQ ID NO: 3370820 - DNA, 20 bp, Homo sapiens
gagactctagggtccagtgg

SEQ ID NO: 3370821 - DNA, 18 bp, Homo sapiens
gagactgaaagcagcagc

SEQ ID NO: 3370822 - DNA, 20 bp, Homo sapiens
gagactgaaagcagcagcta

SEQ ID NO: 3370823 - DNA, 17 bp, Homo sapiens
gagactgagcagccgcc

SEQ ID NO: 3370824 - DNA, 19 bp, Homo sapiens
gagactgcgggatggtcct

SEQ ID NO: 3370825 - DNA, 17 bp, Homo sapiens
gagactgcgttctgcaa

SEQ ID NO: 3370826 - DNA, 23 bp, Homo sapiens
gagactgcttcccatcctaccct

SEQ ID NO: 3370827 - DNA, 21 bp, Homo sapiens
gagactgggaagataggctct

SEQ ID NO: 3370828 - DNA, 18 bp, Homo sapiens
gagactggggggcttgaa

SEQ ID NO: 3370829 - DNA, 15 bp, Homo sapiens
gagactggggtggcc

SEQ ID NO: 3370830 - DNA, 19 bp, Homo sapiens
gagactggggtggcctcaa

SEQ ID NO: 3370831 - DNA, 20 bp, Homo sapiens
gagactggggtggcctcaag

SEQ ID NO: 3370832 - DNA, 13 bp, Homo sapiens
gagactgtagatt

SEQ ID NO: 3370833 - DNA, 19 bp, Homo sapiens
gagactgtcggagaggctg

SEQ ID NO: 3370834 - DNA, 22 bp, Homo sapiens
gagactgtctcaagagggcact

SEQ ID NO: 3370835 - DNA, 20 bp, Homo sapiens
gagacttccaaacctgacag

SEQ ID NO: 3370836 - DNA, 21 bp, Homo sapiens
gagacttgtgctcaaggaatc

SEQ ID NO: 3370837 - DNA, 11 bp, Homo sapiens
gagagaaaaag

SEQ ID NO: 3370838 - DNA, 12 bp, Homo sapiens
gagagaaagaga

SEQ ID NO: 3370839 - DNA, 13 bp, Homo sapiens
gagagaaagagag

SEQ ID NO: 3370840 - DNA, 15 bp, Homo sapiens
gagagaaagagagaa

SEQ ID NO: 3370841 - DNA, 17 bp, Homo sapiens
gagagaaagagagaagc

SEQ ID NO: 3370842 - DNA, 18 bp, Homo sapiens
gagagaaagagagaagcc

SEQ ID NO: 3370843 - DNA, 19 bp, Homo sapiens
gagagaaagagagaagcca

SEQ ID NO: 3370844 - DNA, 20 bp, Homo sapiens
gagagaaagagagaagccag

SEQ ID NO: 3370845 - DNA, 16 bp, Homo sapiens
gagagaaagccaggca

SEQ ID NO: 3370846 - DNA, 18 bp, Homo sapiens
gagagaaagccaggcagg

SEQ ID NO: 3370847 - DNA, 17 bp, Homo sapiens
gagagaaagtgggtgag

SEQ ID NO: 3370848 - DNA, 20 bp, Homo sapiens
gagagaaagtgggtgagatg

SEQ ID NO: 3370849 - DNA, 20 bp, Homo sapiens
gagagaagccacgctgtcct

SEQ ID NO: 3370850 - DNA, 15 bp, Homo sapiens
gagagaagccagcca

SEQ ID NO: 3370851 - DNA, 17 bp, Homo sapiens
gagagaagccagccaca

SEQ ID NO: 3370852 - DNA, 22 bp, Homo sapiens
gagagaatgtgtgtgtgtggca

SEQ ID NO: 3370853 - DNA, 17 bp, Homo sapiens
gagagacaagaagcaaa

SEQ ID NO: 3370854 - DNA, 18 bp, Homo sapiens
gagagacacagcgtccct

SEQ ID NO: 3370855 - DNA, 15 bp, Homo sapiens
gagagacctcatcag

SEQ ID NO: 3370856 - DNA, 18 bp, Homo sapiens
gagagacctcatcaggat

SEQ ID NO: 3370857 - DNA, 21 bp, Homo sapiens
gagagacgcagtccgcccagg

SEQ ID NO: 3370858 - DNA, 15 bp, Homo sapiens
gagagactgagcagc

SEQ ID NO: 3370859 - DNA, 13 bp, Homo sapiens
gagagactgtgtg

SEQ ID NO: 3370860 - DNA, 9 bp, Homo sapiens
gagagagag

SEQ ID NO: 3370861 - DNA, 13 bp, Homo sapiens
gagagagagagag

SEQ ID NO: 3370862 - DNA, 14 bp, Homo sapiens
gagagagagagaga

SEQ ID NO: 3370863 - DNA, 22 bp, Homo sapiens
gagagaggaaggagattccaca

SEQ ID NO: 3370864 - DNA, 13 bp, Homo sapiens
gagagaggcagag

SEQ ID NO: 3370865 - DNA, 21 bp, Homo sapiens
gagagagttgttttaataact

SEQ ID NO: 3370866 - DNA, 17 bp, Homo sapiens
gagagcaactctgagat

SEQ ID NO: 3370867 - DNA, 15 bp, Homo sapiens
gagagcaagaaggaa

SEQ ID NO: 3370868 - DNA, 12 bp, Homo sapiens
gagagcagcagc

SEQ ID NO: 3370869 - DNA, 14 bp, Homo sapiens
gagagcagcagcac

SEQ ID NO: 3370870 - DNA, 23 bp, Homo sapiens
gagagcagctttaaactcaggga

SEQ ID NO: 3370871 - DNA, 14 bp, Homo sapiens
gagagcaggctggc

SEQ ID NO: 3370872 - DNA, 21 bp, Homo sapiens
gagagcaggctggcagctctc

SEQ ID NO: 3370873 - DNA, 23 bp, Homo sapiens
gagagcaggctggcagctctcca

SEQ ID NO: 3370874 - DNA, 18 bp, Homo sapiens
gagagccaggatgcccag

SEQ ID NO: 3370875 - DNA, 10 bp, Homo sapiens
gagagcccag

SEQ ID NO: 3370876 - DNA, 21 bp, Homo sapiens
gagagcccagaggtaacagaa

SEQ ID NO: 3370877 - DNA, 11 bp, Homo sapiens
gagagcccagc

SEQ ID NO: 3370878 - DNA, 19 bp, Homo sapiens
gagagcctcttagtgattg

SEQ ID NO: 3370879 - DNA, 17 bp, Homo sapiens
gagagcctggtgctgct

SEQ ID NO: 3370880 - DNA, 19 bp, Homo sapiens
gagagcctggtgctgctgc

SEQ ID NO: 3370881 - DNA, 15 bp, Homo sapiens
gagagcgaggaggcg

SEQ ID NO: 3370882 - DNA, 20 bp, Homo sapiens
gagagctgggtgtcaagagg

SEQ ID NO: 3370883 - DNA, 19 bp, Homo sapiens
gagaggacaatactggggt

SEQ ID NO: 3370884 - DNA, 12 bp, Homo sapiens
gagaggacagag

SEQ ID NO: 3370885 - DNA, 15 bp, Homo sapiens
gagaggacagcttga

SEQ ID NO: 3370886 - DNA, 15 bp, Homo sapiens
gagaggagagaggca

SEQ ID NO: 3370887 - DNA, 12 bp, Homo sapiens
gagaggagcacc

SEQ ID NO: 3370888 - DNA, 13 bp, Homo sapiens
gagaggaggcagc

SEQ ID NO: 3370889 - DNA, 21 bp, Homo sapiens
gagaggatgaatgtatgtgca

SEQ ID NO: 3370890 - DNA, 21 bp, Homo sapiens
gagaggatgagagcccagagg

SEQ ID NO: 3370891 - DNA, 14 bp, Homo sapiens
gagaggatgtgcaa

SEQ ID NO: 3370892 - DNA, 18 bp, Homo sapiens
gagaggcagcatgcttgg

SEQ ID NO: 3370893 - DNA, 12 bp, Homo sapiens
gagaggcaggca

SEQ ID NO: 3370894 - DNA, 21 bp, Homo sapiens
gagaggcaggcatagaggctt

SEQ ID NO: 3370895 - DNA, 17 bp, Homo sapiens
gagaggccaaaggctgg

SEQ ID NO: 3370896 - DNA, 13 bp, Homo sapiens
gagaggcggcctc

SEQ ID NO: 3370897 - DNA, 14 bp, Homo sapiens
gagaggctgggctg

SEQ ID NO: 3370898 - DNA, 19 bp, Homo sapiens
gagagggagagcagagaaa

SEQ ID NO: 3370899 - DNA, 13 bp, Homo sapiens
gagaggggaacag

SEQ ID NO: 3370900 - DNA, 17 bp, Homo sapiens
gagaggggaagggccag

SEQ ID NO: 3370901 - DNA, 21 bp, Homo sapiens
gagaggggaataatagaagaa

SEQ ID NO: 3370902 - DNA, 15 bp, Homo sapiens
gagaggggctgctct

SEQ ID NO: 3370903 - DNA, 15 bp, Homo sapiens
gagaggtctcaggtt

SEQ ID NO: 3370904 - DNA, 16 bp, Homo sapiens
gagagtcaaagctgac

SEQ ID NO: 3370905 - DNA, 20 bp, Homo sapiens
gagagtcccactgcctcagg

SEQ ID NO: 3370906 - DNA, 14 bp, Homo sapiens
gagagtcttgggcc

SEQ ID NO: 3370907 - DNA, 17 bp, Homo sapiens
gagagtggaaggactgt

SEQ ID NO: 3370908 - DNA, 16 bp, Homo sapiens
gagagtggctcctccc

SEQ ID NO: 3370909 - DNA, 20 bp, Homo sapiens
gagagttcaagcctgtggga

SEQ ID NO: 3370910 - DNA, 17 bp, Homo sapiens
gagagttttgtcttgaa

SEQ ID NO: 3370911 - DNA, 22 bp, Homo sapiens
gagagttttgtcttgaatgtct

SEQ ID NO: 3370912 - DNA, 17 bp, Homo sapiens
gagataccaagatgcca

SEQ ID NO: 3370913 - DNA, 21 bp, Homo sapiens
gagataccaagatgccatctg

SEQ ID NO: 3370914 - DNA, 21 bp, Homo sapiens
gagatatctgagggaggaggc

SEQ ID NO: 3370915 - DNA, 19 bp, Homo sapiens
gagatattataagggagag

SEQ ID NO: 3370916 - DNA, 13 bp, Homo sapiens
gagatcaaagatg

SEQ ID NO: 3370917 - DNA, 14 bp, Homo sapiens
gagatcaaagatga

SEQ ID NO: 3370918 - DNA, 20 bp, Homo sapiens
gagatcaaagatgaaaagta

SEQ ID NO: 3370919 - DNA, 15 bp, Homo sapiens
gagatcacagcctcc

SEQ ID NO: 3370920 - DNA, 18 bp, Homo sapiens
gagatcacgccactgcac

SEQ ID NO: 3370921 - DNA, 23 bp, Homo sapiens
gagatcctcctgcagaccacgcc

SEQ ID NO: 3370922 - DNA, 17 bp, Homo sapiens
gagatcgagaccatcct

SEQ ID NO: 3370923 - DNA, 20 bp, Homo sapiens
gagatctaagcctttccata

SEQ ID NO: 3370924 - DNA, 16 bp, Homo sapiens
gagatctggttttgct

SEQ ID NO: 3370925 - DNA, 17 bp, Homo sapiens
gagatctttctttccaa

SEQ ID NO: 3370926 - DNA, 16 bp, Homo sapiens
gagatgaattaaattt

SEQ ID NO: 3370927 - DNA, 14 bp, Homo sapiens
gagatgaccaggga

SEQ ID NO: 3370928 - DNA, 17 bp, Homo sapiens
gagatgaccagggatgc

SEQ ID NO: 3370929 - DNA, 19 bp, Homo sapiens
gagatgaggagtaaaattc

SEQ ID NO: 3370930 - DNA, 20 bp, Homo sapiens
gagatgaggagtaaaattca

SEQ ID NO: 3370931 - DNA, 21 bp, Homo sapiens
gagatgcaccaccaagccaag

SEQ ID NO: 3370932 - DNA, 15 bp, Homo sapiens
gagatgccagccctt

SEQ ID NO: 3370933 - DNA, 15 bp, Homo sapiens
gagatgctggagaag

SEQ ID NO: 3370934 - DNA, 18 bp, Homo sapiens
gagatgctggagaagaga

SEQ ID NO: 3370935 - DNA, 20 bp, Homo sapiens
gagatggaagttgcagtgag

SEQ ID NO: 3370936 - DNA, 14 bp, Homo sapiens
gagatggagggctt

SEQ ID NO: 3370937 - DNA, 21 bp, Homo sapiens
gagatgggaatgaggtgggag

SEQ ID NO: 3370938 - DNA, 14 bp, Homo sapiens
gagatgtaattgtt

SEQ ID NO: 3370939 - DNA, 16 bp, Homo sapiens
gagatgtgacccacca

SEQ ID NO: 3370940 - DNA, 18 bp, Homo sapiens
gagatgtgacccaccagt

SEQ ID NO: 3370941 - DNA, 18 bp, Homo sapiens
gagatgtttttaaaagtt

SEQ ID NO: 3370942 - DNA, 19 bp, Homo sapiens
gagatgtttttaaaagttt

SEQ ID NO: 3370943 - DNA, 18 bp, Homo sapiens
gagattccacacaggggt

SEQ ID NO: 3370944 - DNA, 14 bp, Homo sapiens
gagattgaatttca

SEQ ID NO: 3370945 - DNA, 16 bp, Homo sapiens
gagattgcaccactgc

SEQ ID NO: 3370946 - DNA, 21 bp, Homo sapiens
gagattgcaccactgcactcc

SEQ ID NO: 3370947 - DNA, 17 bp, Homo sapiens
gagattggacggcctga

SEQ ID NO: 3370948 - DNA, 13 bp, Homo sapiens
gagattgggagaa

SEQ ID NO: 3370949 - DNA, 16 bp, Homo sapiens
gagattgggagaaatc

SEQ ID NO: 3370950 - DNA, 17 bp, Homo sapiens
gagattggttttcctgt

SEQ ID NO: 3370951 - DNA, 16 bp, Homo sapiens
gagatttatataaatg

SEQ ID NO: 3370952 - DNA, 14 bp, Homo sapiens
gagatttcaacata

SEQ ID NO: 3370953 - DNA, 17 bp, Homo sapiens
gagatttcttaaatctt

SEQ ID NO: 3370954 - DNA, 14 bp, Homo sapiens
gagatttgccagca

SEQ ID NO: 3370955 - DNA, 19 bp, Homo sapiens
gagatttttttgtgtatgt

SEQ ID NO: 3370956 - DNA, 20 bp, Homo sapiens
gagcaaaaatatcccttccg

SEQ ID NO: 3370957 - DNA, 14 bp, Homo sapiens
gagcaaaaggcagc

SEQ ID NO: 3370958 - DNA, 19 bp, Homo sapiens
gagcaaaatcgatgcagtg

SEQ ID NO: 3370959 - DNA, 22 bp, Homo sapiens
gagcaaagaaacttgtgcttta

SEQ ID NO: 3370960 - DNA, 22 bp, Homo sapiens
gagcaaagatcaaaataaaaag

SEQ ID NO: 3370961 - DNA, 13 bp, Homo sapiens
gagcaacccctgt

SEQ ID NO: 3370962 - DNA, 23 bp, Homo sapiens
gagcaacccctgtacccagctcc

SEQ ID NO: 3370963 - DNA, 21 bp, Homo sapiens
gagcaacctctcactccccat

SEQ ID NO: 3370964 - DNA, 16 bp, Homo sapiens
gagcaatatttatgga

SEQ ID NO: 3370965 - DNA, 18 bp, Homo sapiens
gagcacaaacatttttca

SEQ ID NO: 3370966 - DNA, 15 bp, Homo sapiens
gagcacaggcagctg

SEQ ID NO: 3370967 - DNA, 13 bp, Homo sapiens
gagcacaggtccc

SEQ ID NO: 3370968 - DNA, 18 bp, Homo sapiens
gagcacaggtcccacctc

SEQ ID NO: 3370969 - DNA, 15 bp, Homo sapiens
gagcacatgttcata

SEQ ID NO: 3370970 - DNA, 18 bp, Homo sapiens
gagcacccccaagcctgg

SEQ ID NO: 3370971 - DNA, 15 bp, Homo sapiens
gagcaccccctgctc

SEQ ID NO: 3370972 - DNA, 22 bp, Homo sapiens
gagcaccccctgctccaccagc

SEQ ID NO: 3370973 - DNA, 22 bp, Homo sapiens
gagcaccgcctgtgaaatacca

SEQ ID NO: 3370974 - DNA, 13 bp, Homo sapiens
gagcacctcacct

SEQ ID NO: 3370975 - DNA, 22 bp, Homo sapiens
gagcacctcacctcccgaagcc

SEQ ID NO: 3370976 - DNA, 13 bp, Homo sapiens
gagcacctgaacc

SEQ ID NO: 3370977 - DNA, 19 bp, Homo sapiens
gagcacgagctggaaccca

SEQ ID NO: 3370978 - DNA, 15 bp, Homo sapiens
gagcactaaggtgtg

SEQ ID NO: 3370979 - DNA, 12 bp, Homo sapiens
gagcactggcca

SEQ ID NO: 3370980 - DNA, 13 bp, Homo sapiens
gagcactggccag

SEQ ID NO: 3370981 - DNA, 24 bp, Homo sapiens
gagcactggccagagagggcccag

SEQ ID NO: 3370982 - DNA, 19 bp, Homo sapiens
gagcacttgcgtcctgcag

SEQ ID NO: 3370983 - DNA, 15 bp, Homo sapiens
gagcagaaacagcca

SEQ ID NO: 3370984 - DNA, 22 bp, Homo sapiens
gagcagaaatttatctttcaaa

SEQ ID NO: 3370985 - DNA, 15 bp, Homo sapiens
gagcagacaggagga

SEQ ID NO: 3370986 - DNA, 13 bp, Homo sapiens
gagcagagtctgg

SEQ ID NO: 3370987 - DNA, 14 bp, Homo sapiens
gagcagagtctggg

SEQ ID NO: 3370988 - DNA, 17 bp, Homo sapiens
gagcagagtctgggcct

SEQ ID NO: 3370989 - DNA, 16 bp, Homo sapiens
gagcagatgcagagag

SEQ ID NO: 3370990 - DNA, 19 bp, Homo sapiens
gagcagatgcagagagcca

SEQ ID NO: 3370991 - DNA, 14 bp, Homo sapiens
gagcagcagcacca

SEQ ID NO: 3370992 - DNA, 13 bp, Homo sapiens
gagcagcctgatg

SEQ ID NO: 3370993 - DNA, 14 bp, Homo sapiens
gagcagcctgatgg

SEQ ID NO: 3370994 - DNA, 11 bp, Homo sapiens
gagcagcctgt

SEQ ID NO: 3370995 - DNA, 15 bp, Homo sapiens
gagcagcctgtggca

SEQ ID NO: 3370996 - DNA, 16 bp, Homo sapiens
gagcagcctgtggcat

SEQ ID NO: 3370997 - DNA, 16 bp, Homo sapiens
gagcagcttccttctg

SEQ ID NO: 3370998 - DNA, 19 bp, Homo sapiens
gagcagcttccttctggga

SEQ ID NO: 3370999 - DNA, 16 bp, Homo sapiens
gagcaggaagcattca

SEQ ID NO: 3371000 - DNA, 15 bp, Homo sapiens
gagcaggactccagg

SEQ ID NO: 3371001 - DNA, 16 bp, Homo sapiens
gagcaggactccaggc

SEQ ID NO: 3371002 - DNA, 20 bp, Homo sapiens
gagcaggactccaggcccaa

SEQ ID NO: 3371003 - DNA, 23 bp, Homo sapiens
gagcaggagattgagaaggagag

SEQ ID NO: 3371004 - DNA, 15 bp, Homo sapiens
gagcaggaggccaat

SEQ ID NO: 3371005 - DNA, 21 bp, Homo sapiens
gagcaggcaaaaaagggacag

SEQ ID NO: 3371006 - DNA, 15 bp, Homo sapiens
gagcaggcacatgga

SEQ ID NO: 3371007 - DNA, 19 bp, Homo sapiens
gagcaggcacatggaggag

SEQ ID NO: 3371008 - DNA, 21 bp, Homo sapiens
gagcaggcacgggtggtcccc

SEQ ID NO: 3371009 - DNA, 14 bp, Homo sapiens
gagcaggccggaac

SEQ ID NO: 3371010 - DNA, 15 bp, Homo sapiens
gagcaggccggaacc

SEQ ID NO: 3371011 - DNA, 18 bp, Homo sapiens
gagcaggccggaaccaca

SEQ ID NO: 3371012 - DNA, 18 bp, Homo sapiens
gagcaggctggcagctct

SEQ ID NO: 3371013 - DNA, 21 bp, Homo sapiens
gagcaggctggcagctctcca

SEQ ID NO: 3371014 - DNA, 13 bp, Homo sapiens
gagcagggaaggc

SEQ ID NO: 3371015 - DNA, 14 bp, Homo sapiens
gagcagggaaggcc

SEQ ID NO: 3371016 - DNA, 21 bp, Homo sapiens
gagcaggttccccaagggccc

SEQ ID NO: 3371017 - DNA, 23 bp, Homo sapiens
gagcaggttccccaagggccctg

SEQ ID NO: 3371018 - DNA, 18 bp, Homo sapiens
gagcagtcactgggagag

SEQ ID NO: 3371019 - DNA, 20 bp, Homo sapiens
gagcagtcagggtgggaaga

SEQ ID NO: 3371020 - DNA, 12 bp, Homo sapiens
gagcagtgtctt

SEQ ID NO: 3371021 - DNA, 19 bp, Homo sapiens
gagcagtgtcttccataat

SEQ ID NO: 3371022 - DNA, 21 bp, Homo sapiens
gagcatatttgccaataaagc

SEQ ID NO: 3371023 - DNA, 20 bp, Homo sapiens
gagcatcccggaggaaatct

SEQ ID NO: 3371024 - DNA, 15 bp, Homo sapiens
gagcatcgtgaccct

SEQ ID NO: 3371025 - DNA, 19 bp, Homo sapiens
gagcatgcattttcttgta

SEQ ID NO: 3371026 - DNA, 20 bp, Homo sapiens
gagcatggatgcatttcaaa

SEQ ID NO: 3371027 - DNA, 21 bp, Homo sapiens
gagcatggatgcatttcaaat

SEQ ID NO: 3371028 - DNA, 21 bp, Homo sapiens
gagcatggggataaaggagaa

SEQ ID NO: 3371029 - DNA, 20 bp, Homo sapiens
gagcatggtgttttcattcc

SEQ ID NO: 3371030 - DNA, 17 bp, Homo sapiens
gagcatttaatggcagc

SEQ ID NO: 3371031 - DNA, 12 bp, Homo sapiens
gagcatttgcac

SEQ ID NO: 3371032 - DNA, 14 bp, Homo sapiens
gagccaaagagaat

SEQ ID NO: 3371033 - DNA, 22 bp, Homo sapiens
gagccaaagcttatgtgacatg

SEQ ID NO: 3371034 - DNA, 19 bp, Homo sapiens
gagccaacctcggcttgtg

SEQ ID NO: 3371035 - DNA, 15 bp, Homo sapiens
gagccaactctaaca

SEQ ID NO: 3371036 - DNA, 14 bp, Homo sapiens
gagccaactgctgc

SEQ ID NO: 3371037 - DNA, 14 bp, Homo sapiens
gagccaccagttct

SEQ ID NO: 3371038 - DNA, 15 bp, Homo sapiens
gagccaccgctgcca

SEQ ID NO: 3371039 - DNA, 14 bp, Homo sapiens
gagccacctggatc

SEQ ID NO: 3371040 - DNA, 20 bp, Homo sapiens
gagccactcagtctcttcca

SEQ ID NO: 3371041 - DNA, 16 bp, Homo sapiens
gagccactcctgtccc

SEQ ID NO: 3371042 - DNA, 18 bp, Homo sapiens
gagccactctcttccctt

SEQ ID NO: 3371043 - DNA, 17 bp, Homo sapiens
gagccactgagcctggc

SEQ ID NO: 3371044 - DNA, 18 bp, Homo sapiens
gagccactgcaccgggcc

SEQ ID NO: 3371045 - DNA, 20 bp, Homo sapiens
gagccactgcaccgggccac

SEQ ID NO: 3371046 - DNA, 22 bp, Homo sapiens
gagccactgcaccgggccacag

SEQ ID NO: 3371047 - DNA, 16 bp, Homo sapiens
gagccactgcactcca

SEQ ID NO: 3371048 - DNA, 14 bp, Homo sapiens
gagccacttctccc

SEQ ID NO: 3371049 - DNA, 16 bp, Homo sapiens
gagccacttctcccca

SEQ ID NO: 3371050 - DNA, 15 bp, Homo sapiens
gagccagatgcagga

SEQ ID NO: 3371051 - DNA, 17 bp, Homo sapiens
gagccagatgcaggaca

SEQ ID NO: 3371052 - DNA, 20 bp, Homo sapiens
gagccagatgcaggacagga

SEQ ID NO: 3371053 - DNA, 22 bp, Homo sapiens
gagccagatgcaggacaggagg

SEQ ID NO: 3371054 - DNA, 12 bp, Homo sapiens
gagccagcctgg

SEQ ID NO: 3371055 - DNA, 18 bp, Homo sapiens
gagccagctccctctatt

SEQ ID NO: 3371056 - DNA, 15 bp, Homo sapiens
gagccagctgctttt

SEQ ID NO: 3371057 - DNA, 20 bp, Homo sapiens
gagccagctgctttttgtga

SEQ ID NO: 3371058 - DNA, 20 bp, Homo sapiens
gagccagcttggggccacca

SEQ ID NO: 3371059 - DNA, 12 bp, Homo sapiens
gagccaggcctg

SEQ ID NO: 3371060 - DNA, 21 bp, Homo sapiens
gagccaggcctgggtctgtgt

SEQ ID NO: 3371061 - DNA, 19 bp, Homo sapiens
gagccagggtctcactatg

SEQ ID NO: 3371062 - DNA, 23 bp, Homo sapiens
gagccagtggaacagcgggagac

SEQ ID NO: 3371063 - DNA, 22 bp, Homo sapiens
gagccagttgtcctatggacaa

SEQ ID NO: 3371064 - DNA, 17 bp, Homo sapiens
gagccagtttgccggat

SEQ ID NO: 3371065 - DNA, 20 bp, Homo sapiens
gagccatcactagaagaaaa

SEQ ID NO: 3371066 - DNA, 21 bp, Homo sapiens
gagccatcactagaagaaaag

SEQ ID NO: 3371067 - DNA, 22 bp, Homo sapiens
gagccatcggtgaaactaacag

SEQ ID NO: 3371068 - DNA, 14 bp, Homo sapiens
gagccatgggcctg

SEQ ID NO: 3371069 - DNA, 18 bp, Homo sapiens
gagccatgggcctgggcc

SEQ ID NO: 3371070 - DNA, 21 bp, Homo sapiens
gagccatgggcctgggcctgc

SEQ ID NO: 3371071 - DNA, 14 bp, Homo sapiens
gagccattttgtga

SEQ ID NO: 3371072 - DNA, 19 bp, Homo sapiens
gagcccaagctaagccatc

SEQ ID NO: 3371073 - DNA, 20 bp, Homo sapiens
gagcccaatgcatagagccc

SEQ ID NO: 3371074 - DNA, 15 bp, Homo sapiens
gagcccacactgcca

SEQ ID NO: 3371075 - DNA, 16 bp, Homo sapiens
gagcccacactgccac

SEQ ID NO: 3371076 - DNA, 18 bp, Homo sapiens
gagcccacggctaagagg

SEQ ID NO: 3371077 - DNA, 21 bp, Homo sapiens
gagcccacggctaagaggctg

SEQ ID NO: 3371078 - DNA, 22 bp, Homo sapiens
gagcccacggctaagaggctgc

SEQ ID NO: 3371079 - DNA, 23 bp, Homo sapiens
gagcccacggctaagaggctgct

SEQ ID NO: 3371080 - DNA, 19 bp, Homo sapiens
gagcccactgcccaccccc

SEQ ID NO: 3371081 - DNA, 23 bp, Homo sapiens
gagcccactgcccaccccctcaa

SEQ ID NO: 3371082 - DNA, 14 bp, Homo sapiens
gagcccagagaaca

SEQ ID NO: 3371083 - DNA, 16 bp, Homo sapiens
gagcccagagaacagc

SEQ ID NO: 3371084 - DNA, 18 bp, Homo sapiens
gagcccagccctgttctg

SEQ ID NO: 3371085 - DNA, 15 bp, Homo sapiens
gagcccagctgcctg

SEQ ID NO: 3371086 - DNA, 17 bp, Homo sapiens
gagcccagctgcctgga

SEQ ID NO: 3371087 - DNA, 18 bp, Homo sapiens
gagccccaggcctctgtg

SEQ ID NO: 3371088 - DNA, 12 bp, Homo sapiens
gagccccagggg

SEQ ID NO: 3371089 - DNA, 12 bp, Homo sapiens
gagccccagggt

SEQ ID NO: 3371090 - DNA, 19 bp, Homo sapiens
gagccccagggtcttccct

SEQ ID NO: 3371091 - DNA, 14 bp, Homo sapiens
gagcccccagccct

SEQ ID NO: 3371092 - DNA, 15 bp, Homo sapiens
gagcccccagccctg

SEQ ID NO: 3371093 - DNA, 14 bp, Homo sapiens
gagccccctctgcc

SEQ ID NO: 3371094 - DNA, 14 bp, Homo sapiens
gagccccgaggcct

SEQ ID NO: 3371095 - DNA, 22 bp, Homo sapiens
gagccccgcagacctccccagc

SEQ ID NO: 3371096 - DNA, 18 bp, Homo sapiens
gagccccgccctcttcct

SEQ ID NO: 3371097 - DNA, 21 bp, Homo sapiens
gagccccgccctcttcctgac

SEQ ID NO: 3371098 - DNA, 22 bp, Homo sapiens
gagcccctcctccagcccctgt

SEQ ID NO: 3371099 - DNA, 13 bp, Homo sapiens
gagcccctgggtg

SEQ ID NO: 3371100 - DNA, 14 bp, Homo sapiens
gagcccctgggtgg

SEQ ID NO: 3371101 - DNA, 12 bp, Homo sapiens
gagcccctggtc

SEQ ID NO: 3371102 - DNA, 17 bp, Homo sapiens
gagcccgggctgcctgg

SEQ ID NO: 3371103 - DNA, 19 bp, Homo sapiens
gagccctactccctgcaga

SEQ ID NO: 3371104 - DNA, 18 bp, Homo sapiens
gagccctgaccttggctg

SEQ ID NO: 3371105 - DNA, 17 bp, Homo sapiens
gagccctgaggcctaga

SEQ ID NO: 3371106 - DNA, 12 bp, Homo sapiens
gagccctgccct

SEQ ID NO: 3371107 - DNA, 16 bp, Homo sapiens
gagccctgctgtggga

SEQ ID NO: 3371108 - DNA, 13 bp, Homo sapiens
gagccctggccag

SEQ ID NO: 3371109 - DNA, 17 bp, Homo sapiens
gagccctggccagccct

SEQ ID NO: 3371110 - DNA, 12 bp, Homo sapiens
gagccctgggga

SEQ ID NO: 3371111 - DNA, 14 bp, Homo sapiens
gagccctggtggca

SEQ ID NO: 3371112 - DNA, 17 bp, Homo sapiens
gagccctggtggcagtg

SEQ ID NO: 3371113 - DNA, 17 bp, Homo sapiens
gagccctgttggcagct

SEQ ID NO: 3371114 - DNA, 19 bp, Homo sapiens
gagcccttcactgccatga

SEQ ID NO: 3371115 - DNA, 19 bp, Homo sapiens
gagccgagatcacgccact

SEQ ID NO: 3371116 - DNA, 20 bp, Homo sapiens
gagccgagattgcgccactg

SEQ ID NO: 3371117 - DNA, 18 bp, Homo sapiens
gagccggggagtttcttt

SEQ ID NO: 3371118 - DNA, 18 bp, Homo sapiens
gagccgtgaactgtgcat

SEQ ID NO: 3371119 - DNA, 16 bp, Homo sapiens
gagcctaatgaaaggg

SEQ ID NO: 3371120 - DNA, 20 bp, Homo sapiens
gagcctacctgtatgtcaat

SEQ ID NO: 3371121 - DNA, 20 bp, Homo sapiens
gagcctagcggagcccagcc

SEQ ID NO: 3371122 - DNA, 20 bp, Homo sapiens
gagcctaggaccactcagcc

SEQ ID NO: 3371123 - DNA, 22 bp, Homo sapiens
gagcctaggaccactcagcccc

SEQ ID NO: 3371124 - DNA, 13 bp, Homo sapiens
gagcctcagcatc

SEQ ID NO: 3371125 - DNA, 14 bp, Homo sapiens
gagcctcagcatcc

SEQ ID NO: 3371126 - DNA, 17 bp, Homo sapiens
gagcctcagcatcctgg

SEQ ID NO: 3371127 - DNA, 21 bp, Homo sapiens
gagcctcagcatcctggcacc

SEQ ID NO: 3371128 - DNA, 16 bp, Homo sapiens
gagcctccccctcaga

SEQ ID NO: 3371129 - DNA, 17 bp, Homo sapiens
gagcctccccctcagat

SEQ ID NO: 3371130 - DNA, 12 bp, Homo sapiens
gagcctctgggg

SEQ ID NO: 3371131 - DNA, 20 bp, Homo sapiens
gagcctcttctgccaagaga

SEQ ID NO: 3371132 - DNA, 16 bp, Homo sapiens
gagcctgagtcagggc

SEQ ID NO: 3371133 - DNA, 21 bp, Homo sapiens
gagcctgagtcagggcccaga

SEQ ID NO: 3371134 - DNA, 15 bp, Homo sapiens
gagcctgatctcttc

SEQ ID NO: 3371135 - DNA, 18 bp, Homo sapiens
gagcctgatctcttcctg

SEQ ID NO: 3371136 - DNA, 13 bp, Homo sapiens
gagcctgcctaac

SEQ ID NO: 3371137 - DNA, 19 bp, Homo sapiens
gagcctgcctaaccaggcc

SEQ ID NO: 3371138 - DNA, 21 bp, Homo sapiens
gagcctgcctaaccaggccca

SEQ ID NO: 3371139 - DNA, 18 bp, Homo sapiens
gagcctgctctccgcgcc

SEQ ID NO: 3371140 - DNA, 17 bp, Homo sapiens
gagcctggcacaggact

SEQ ID NO: 3371141 - DNA, 19 bp, Homo sapiens
gagcctggcacaggactga

SEQ ID NO: 3371142 - DNA, 17 bp, Homo sapiens
gagcctggcccatagaa

SEQ ID NO: 3371143 - DNA, 18 bp, Homo sapiens
gagcctggcccatagaaa

SEQ ID NO: 3371144 - DNA, 12 bp, Homo sapiens
gagcctggctct

SEQ ID NO: 3371145 - DNA, 21 bp, Homo sapiens
gagcctggctcttgtgctgga

SEQ ID NO: 3371146 - DNA, 15 bp, Homo sapiens
gagcctggtcctggc

SEQ ID NO: 3371147 - DNA, 18 bp, Homo sapiens
gagcctgtgggtccccac

SEQ ID NO: 3371148 - DNA, 17 bp, Homo sapiens
gagccttcaagtgccaa

SEQ ID NO: 3371149 - DNA, 19 bp, Homo sapiens
gagccttcaagtgccaaac

SEQ ID NO: 3371150 - DNA, 18 bp, Homo sapiens
gagccttggttcatcagt

SEQ ID NO: 3371151 - DNA, 22 bp, Homo sapiens
gagccttgtgagatccttcaca

SEQ ID NO: 3371152 - DNA, 17 bp, Homo sapiens
gagccttgttggtggag

SEQ ID NO: 3371153 - DNA, 23 bp, Homo sapiens
gagcctttggttctggccagaat

SEQ ID NO: 3371154 - DNA, 18 bp, Homo sapiens
gagccttttatctgcaga

SEQ ID NO: 3371155 - DNA, 19 bp, Homo sapiens
gagcgaggaggcgcggcct

SEQ ID NO: 3371156 - DNA, 21 bp, Homo sapiens
gagcgcacagggagtgcacat

SEQ ID NO: 3371157 - DNA, 14 bp, Homo sapiens
gagcgccttggtat

SEQ ID NO: 3371158 - DNA, 17 bp, Homo sapiens
gagcggccgcagagact

SEQ ID NO: 3371159 - DNA, 23 bp, Homo sapiens
gagcggctgctcgcccaggaagg

SEQ ID NO: 3371160 - DNA, 18 bp, Homo sapiens
gagcggggctgggaggaa

SEQ ID NO: 3371161 - DNA, 13 bp, Homo sapiens
gagcgtgaaggac

SEQ ID NO: 3371162 - DNA, 19 bp, Homo sapiens
gagctaaccccaagctgcc

SEQ ID NO: 3371163 - DNA, 20 bp, Homo sapiens
gagctaagggtgggtgctca

SEQ ID NO: 3371164 - DNA, 23 bp, Homo sapiens
gagctaagggtgggtgctcagaa

SEQ ID NO: 3371165 - DNA, 23 bp, Homo sapiens
gagctatgatttttttttccaaa

SEQ ID NO: 3371166 - DNA, 19 bp, Homo sapiens
gagctatttccattccaga

SEQ ID NO: 3371167 - DNA, 15 bp, Homo sapiens
gagctcaagcccttg

SEQ ID NO: 3371168 - DNA, 18 bp, Homo sapiens
gagctcaccctgcccgct

SEQ ID NO: 3371169 - DNA, 23 bp, Homo sapiens
gagctcagccccgagctgtcccc

SEQ ID NO: 3371170 - DNA, 14 bp, Homo sapiens
gagctcattctgtc

SEQ ID NO: 3371171 - DNA, 12 bp, Homo sapiens
gagctccactct

SEQ ID NO: 3371172 - DNA, 14 bp, Homo sapiens
gagctccccagatc

SEQ ID NO: 3371173 - DNA, 19 bp, Homo sapiens
gagctcctctgtcctgctt

SEQ ID NO: 3371174 - DNA, 22 bp, Homo sapiens
gagctcctctgtcctgcttctg

SEQ ID NO: 3371175 - DNA, 14 bp, Homo sapiens
gagctcctgctgcg

SEQ ID NO: 3371176 - DNA, 14 bp, Homo sapiens
gagctcctggccag

SEQ ID NO: 3371177 - DNA, 17 bp, Homo sapiens
gagctctaccctgctcc

SEQ ID NO: 3371178 - DNA, 15 bp, Homo sapiens
gagctctgaaatctt

SEQ ID NO: 3371179 - DNA, 16 bp, Homo sapiens
gagctctgcagagcag

SEQ ID NO: 3371180 - DNA, 20 bp, Homo sapiens
gagctcttcaagctgtcccc

SEQ ID NO: 3371181 - DNA, 22 bp, Homo sapiens
gagctcttcaagctgtcccctc

SEQ ID NO: 3371182 - DNA, 16 bp, Homo sapiens
gagctcttggcctttg

SEQ ID NO: 3371183 - DNA, 18 bp, Homo sapiens
gagctgacgggaggcccc

SEQ ID NO: 3371184 - DNA, 15 bp, Homo sapiens
gagctgaggactctg

SEQ ID NO: 3371185 - DNA, 17 bp, Homo sapiens
gagctgagtggccagcc

SEQ ID NO: 3371186 - DNA, 13 bp, Homo sapiens
gagctgccacaga

SEQ ID NO: 3371187 - DNA, 19 bp, Homo sapiens
gagctgccgacttggagac

SEQ ID NO: 3371188 - DNA, 23 bp, Homo sapiens
gagctgcctggatgagaaacagc

SEQ ID NO: 3371189 - DNA, 21 bp, Homo sapiens
gagctgcctgttcagctccag

SEQ ID NO: 3371190 - DNA, 13 bp, Homo sapiens
gagctgccttccc

SEQ ID NO: 3371191 - DNA, 14 bp, Homo sapiens
gagctgccttccct

SEQ ID NO: 3371192 - DNA, 19 bp, Homo sapiens
gagctgccttccctagctt

SEQ ID NO: 3371193 - DNA, 15 bp, Homo sapiens
gagctgccttggctc

SEQ ID NO: 3371194 - DNA, 14 bp, Homo sapiens
gagctggaaggcag

SEQ ID NO: 3371195 - DNA, 15 bp, Homo sapiens
gagctggaaggcagg

SEQ ID NO: 3371196 - DNA, 17 bp, Homo sapiens
gagctggaaggcagggc

SEQ ID NO: 3371197 - DNA, 15 bp, Homo sapiens
gagctggaaggggcc

SEQ ID NO: 3371198 - DNA, 13 bp, Homo sapiens
gagctggctctga

SEQ ID NO: 3371199 - DNA, 22 bp, Homo sapiens
gagctggctctgagcgcctcca

SEQ ID NO: 3371200 - DNA, 12 bp, Homo sapiens
gagctgggaggc

SEQ ID NO: 3371201 - DNA, 17 bp, Homo sapiens
gagctgggaggcatggc

SEQ ID NO: 3371202 - DNA, 18 bp, Homo sapiens
gagctgggaggcatggcc

SEQ ID NO: 3371203 - DNA, 15 bp, Homo sapiens
gagctgggcccctgc

SEQ ID NO: 3371204 - DNA, 16 bp, Homo sapiens
gagctggggactcagg

SEQ ID NO: 3371205 - DNA, 15 bp, Homo sapiens
gagctggggtacagg

SEQ ID NO: 3371206 - DNA, 16 bp, Homo sapiens
gagctgggtggcctgt

SEQ ID NO: 3371207 - DNA, 21 bp, Homo sapiens
gagctggtgcccggagattgg

SEQ ID NO: 3371208 - DNA, 19 bp, Homo sapiens
gagctgtctatgcagcctg

SEQ ID NO: 3371209 - DNA, 21 bp, Homo sapiens
gagctgtgagttctccctgta

SEQ ID NO: 3371210 - DNA, 18 bp, Homo sapiens
gagctgtgccagcagggg

SEQ ID NO: 3371211 - DNA, 16 bp, Homo sapiens
gagctgttaccattca

SEQ ID NO: 3371212 - DNA, 16 bp, Homo sapiens
gagctgtttatggcct

SEQ ID NO: 3371213 - DNA, 15 bp, Homo sapiens
gagctgtttatgttt

SEQ ID NO: 3371214 - DNA, 17 bp, Homo sapiens
gagctgtttatgttttt

SEQ ID NO: 3371215 - DNA, 17 bp, Homo sapiens
gagcttagccttgtgcc

SEQ ID NO: 3371216 - DNA, 18 bp, Homo sapiens
gagcttagccttgtgccc

SEQ ID NO: 3371217 - DNA, 19 bp, Homo sapiens
gagcttcggttctccagaa

SEQ ID NO: 3371218 - DNA, 20 bp, Homo sapiens
gagcttcggttctccagaat

SEQ ID NO: 3371219 - DNA, 18 bp, Homo sapiens
gagcttgaggtgggagcg

SEQ ID NO: 3371220 - DNA, 20 bp, Homo sapiens
gagcttgggggatgactaga

SEQ ID NO: 3371221 - DNA, 20 bp, Homo sapiens
gagcttgtcttttctgctga

SEQ ID NO: 3371222 - DNA, 23 bp, Homo sapiens
gagctttctgtccttttggcact

SEQ ID NO: 3371223 - DNA, 15 bp, Homo sapiens
gaggaaaaggaaaaa

SEQ ID NO: 3371224 - DNA, 13 bp, Homo sapiens
gaggaaagagagc

SEQ ID NO: 3371225 - DNA, 13 bp, Homo sapiens
gaggaaaggattt

SEQ ID NO: 3371226 - DNA, 21 bp, Homo sapiens
gaggaaagggaggagtggagg

SEQ ID NO: 3371227 - DNA, 18 bp, Homo sapiens
gaggaaatctgcagaggg

SEQ ID NO: 3371228 - DNA, 13 bp, Homo sapiens
gaggaacacctga

SEQ ID NO: 3371229 - DNA, 16 bp, Homo sapiens
gaggaactccttggcc

SEQ ID NO: 3371230 - DNA, 18 bp, Homo sapiens
gaggaactgtccagagag

SEQ ID NO: 3371231 - DNA, 12 bp, Homo sapiens
gaggaagcttgg

SEQ ID NO: 3371232 - DNA, 22 bp, Homo sapiens
gaggaaggaaaaggaggaaatt

SEQ ID NO: 3371233 - DNA, 14 bp, Homo sapiens
gaggaagggatggg

SEQ ID NO: 3371234 - DNA, 13 bp, Homo sapiens
gaggaaggtgctg

SEQ ID NO: 3371235 - DNA, 18 bp, Homo sapiens
gaggaagtggctgtccct

SEQ ID NO: 3371236 - DNA, 21 bp, Homo sapiens
gaggaataattatttatttaa

SEQ ID NO: 3371237 - DNA, 13 bp, Homo sapiens
gaggaatatcaat

SEQ ID NO: 3371238 - DNA, 20 bp, Homo sapiens
gaggaatcatgtcaggcctg

SEQ ID NO: 3371239 - DNA, 22 bp, Homo sapiens
gaggaatcatgtcaggcctgtg

SEQ ID NO: 3371240 - DNA, 14 bp, Homo sapiens
gaggaatccagacc

SEQ ID NO: 3371241 - DNA, 15 bp, Homo sapiens
gaggaatccagaccc

SEQ ID NO: 3371242 - DNA, 17 bp, Homo sapiens
gaggaatcctggcagcc

SEQ ID NO: 3371243 - DNA, 20 bp, Homo sapiens
gaggaatcctggcagcccag

SEQ ID NO: 3371244 - DNA, 21 bp, Homo sapiens
gaggaatctgtgggtctggga

SEQ ID NO: 3371245 - DNA, 20 bp, Homo sapiens
gaggaatgctctgtgccaga

SEQ ID NO: 3371246 - DNA, 17 bp, Homo sapiens
gaggaatgctggactgg

SEQ ID NO: 3371247 - DNA, 18 bp, Homo sapiens
gaggaatgctggactgga

SEQ ID NO: 3371248 - DNA, 17 bp, Homo sapiens
gaggaattcagctcagc

SEQ ID NO: 3371249 - DNA, 14 bp, Homo sapiens
gaggaatttcacct

SEQ ID NO: 3371250 - DNA, 22 bp, Homo sapiens
gaggaattttctttgtgtagct

SEQ ID NO: 3371251 - DNA, 15 bp, Homo sapiens
gaggacaaaacttct

SEQ ID NO: 3371252 - DNA, 23 bp, Homo sapiens
gaggacaaaacttcttgtcagac

SEQ ID NO: 3371253 - DNA, 20 bp, Homo sapiens
gaggacaccagtgaaagaag

SEQ ID NO: 3371254 - DNA, 17 bp, Homo sapiens
gaggacacgtggcctgc

SEQ ID NO: 3371255 - DNA, 18 bp, Homo sapiens
gaggacagcttgagccgg

SEQ ID NO: 3371256 - DNA, 15 bp, Homo sapiens
gaggacaggcaggcc

SEQ ID NO: 3371257 - DNA, 16 bp, Homo sapiens
gaggacaggcaggcca

SEQ ID NO: 3371258 - DNA, 20 bp, Homo sapiens
gaggacaggcgggaggaggt

SEQ ID NO: 3371259 - DNA, 23 bp, Homo sapiens
gaggacagggaggtgaccccagg

SEQ ID NO: 3371260 - DNA, 16 bp, Homo sapiens
gaggacagtctggaga

SEQ ID NO: 3371261 - DNA, 18 bp, Homo sapiens
gaggacatgatggagcgc

SEQ ID NO: 3371262 - DNA, 18 bp, Homo sapiens
gaggaccacagtgggtgg

SEQ ID NO: 3371263 - DNA, 23 bp, Homo sapiens
gaggaccactttggagactgggg

SEQ ID NO: 3371264 - DNA, 22 bp, Homo sapiens
gaggacctgaccctactccctt

SEQ ID NO: 3371265 - DNA, 20 bp, Homo sapiens
gaggacgcacgctcgctgcc

SEQ ID NO: 3371266 - DNA, 17 bp, Homo sapiens
gaggactcccaaccctg

SEQ ID NO: 3371267 - DNA, 21 bp, Homo sapiens
gaggactcccaaccctggctt

SEQ ID NO: 3371268 - DNA, 20 bp, Homo sapiens
gaggactcgcttgtaaatac

SEQ ID NO: 3371269 - DNA, 21 bp, Homo sapiens
gaggactcgcttgtaaatacc

SEQ ID NO: 3371270 - DNA, 17 bp, Homo sapiens
gaggacttgtgtctctg

SEQ ID NO: 3371271 - DNA, 22 bp, Homo sapiens
gaggacttgtgtctctgtgctt

SEQ ID NO: 3371272 - DNA, 13 bp, Homo sapiens
gaggagaaacaca

SEQ ID NO: 3371273 - DNA, 16 bp, Homo sapiens
gaggagaccctggaat

SEQ ID NO: 3371274 - DNA, 15 bp, Homo sapiens
gaggagagagacccc

SEQ ID NO: 3371275 - DNA, 12 bp, Homo sapiens
gaggagagaggc

SEQ ID NO: 3371276 - DNA, 16 bp, Homo sapiens
gaggagagaggcagag

SEQ ID NO: 3371277 - DNA, 13 bp, Homo sapiens
gaggagaggagag

SEQ ID NO: 3371278 - DNA, 14 bp, Homo sapiens
gaggagcagcttcc

SEQ ID NO: 3371279 - DNA, 15 bp, Homo sapiens
gaggagcagcttcct

SEQ ID NO: 3371280 - DNA, 14 bp, Homo sapiens
gaggagcatgtttt

SEQ ID NO: 3371281 - DNA, 13 bp, Homo sapiens
gaggagctgcctg

SEQ ID NO: 3371282 - DNA, 13 bp, Homo sapiens
gaggagctgctgg

SEQ ID NO: 3371283 - DNA, 15 bp, Homo sapiens
gaggagctgctggct

SEQ ID NO: 3371284 - DNA, 14 bp, Homo sapiens
gaggagctgggccc

SEQ ID NO: 3371285 - DNA, 15 bp, Homo sapiens
gaggagcttggggga

SEQ ID NO: 3371286 - DNA, 21 bp, Homo sapiens
gaggagcttgggggatgacta

SEQ ID NO: 3371287 - DNA, 14 bp, Homo sapiens
gaggaggaaaagaa

SEQ ID NO: 3371288 - DNA, 14 bp, Homo sapiens
gaggaggaaaagga

SEQ ID NO: 3371289 - DNA, 14 bp, Homo sapiens
gaggaggagggagg

SEQ ID NO: 3371290 - DNA, 17 bp, Homo sapiens
gaggaggatgactaaca

SEQ ID NO: 3371291 - DNA, 14 bp, Homo sapiens
gaggaggccacctc

SEQ ID NO: 3371292 - DNA, 15 bp, Homo sapiens
gaggaggccacctct

SEQ ID NO: 3371293 - DNA, 16 bp, Homo sapiens
gaggaggccacctctc

SEQ ID NO: 3371294 - DNA, 16 bp, Homo sapiens
gaggaggcgcggcctc

SEQ ID NO: 3371295 - DNA, 13 bp, Homo sapiens
gaggaggctggtg

SEQ ID NO: 3371296 - DNA, 17 bp, Homo sapiens
gaggaggctggtgacag

SEQ ID NO: 3371297 - DNA, 18 bp, Homo sapiens
gaggagggatgctgctcc

SEQ ID NO: 3371298 - DNA, 22 bp, Homo sapiens
gaggagggatgctgctccgccc

SEQ ID NO: 3371299 - DNA, 18 bp, Homo sapiens
gaggaggtcccacttgca

SEQ ID NO: 3371300 - DNA, 11 bp, Homo sapiens
gaggagtaaca

SEQ ID NO: 3371301 - DNA, 21 bp, Homo sapiens
gaggagtaacaatacaaatgg

SEQ ID NO: 3371302 - DNA, 18 bp, Homo sapiens
gaggagtttcctaaaagt

SEQ ID NO: 3371303 - DNA, 22 bp, Homo sapiens
gaggatattcttctcttgcttt

SEQ ID NO: 3371304 - DNA, 19 bp, Homo sapiens
gaggatcactggagcccag

SEQ ID NO: 3371305 - DNA, 14 bp, Homo sapiens
gaggatgagagccc

SEQ ID NO: 3371306 - DNA, 13 bp, Homo sapiens
gaggatggagaga

SEQ ID NO: 3371307 - DNA, 15 bp, Homo sapiens
gaggatggagagagg

SEQ ID NO: 3371308 - DNA, 19 bp, Homo sapiens
gaggatggccagtgtctgt

SEQ ID NO: 3371309 - DNA, 22 bp, Homo sapiens
gaggatgtataaaatggtcatg

SEQ ID NO: 3371310 - DNA, 13 bp, Homo sapiens
gaggatgtccctg

SEQ ID NO: 3371311 - DNA, 12 bp, Homo sapiens
gaggatgttctg

SEQ ID NO: 3371312 - DNA, 17 bp, Homo sapiens
gaggatgttctgggaca

SEQ ID NO: 3371313 - DNA, 14 bp, Homo sapiens
gaggattgtggaaa

SEQ ID NO: 3371314 - DNA, 17 bp, Homo sapiens
gaggatttcaagcctgc

SEQ ID NO: 3371315 - DNA, 14 bp, Homo sapiens
gaggattttccagt

SEQ ID NO: 3371316 - DNA, 17 bp, Homo sapiens
gaggcaaattaactgta

SEQ ID NO: 3371317 - DNA, 23 bp, Homo sapiens
gaggcaacctgattgtaaacttc

SEQ ID NO: 3371318 - DNA, 15 bp, Homo sapiens
gaggcaagcaagctc

SEQ ID NO: 3371319 - DNA, 21 bp, Homo sapiens
gaggcaattagacactttgga

SEQ ID NO: 3371320 - DNA, 21 bp, Homo sapiens
gaggcaccagctctgtggcct

SEQ ID NO: 3371321 - DNA, 15 bp, Homo sapiens
gaggcaccggcgctg

SEQ ID NO: 3371322 - DNA, 18 bp, Homo sapiens
gaggcactgaagtgctta

SEQ ID NO: 3371323 - DNA, 19 bp, Homo sapiens
gaggcagagacctccaata

SEQ ID NO: 3371324 - DNA, 11 bp, Homo sapiens
gaggcagagag

SEQ ID NO: 3371325 - DNA, 17 bp, Homo sapiens
gaggcagccacttcggc

SEQ ID NO: 3371326 - DNA, 21 bp, Homo sapiens
gaggcagccccattctgcctg

SEQ ID NO: 3371327 - DNA, 22 bp, Homo sapiens
gaggcagccccattctgcctgc

SEQ ID NO: 3371328 - DNA, 22 bp, Homo sapiens
gaggcaggccgactgtactaaa

SEQ ID NO: 3371329 - DNA, 15 bp, Homo sapiens
gaggcagggtctcac

SEQ ID NO: 3371330 - DNA, 20 bp, Homo sapiens
gaggcagggtctcactctgt

SEQ ID NO: 3371331 - DNA, 15 bp, Homo sapiens
gaggcatcctgcctg

SEQ ID NO: 3371332 - DNA, 22 bp, Homo sapiens
gaggcatcctgcctgggtggga

SEQ ID NO: 3371333 - DNA, 16 bp, Homo sapiens
gaggcatgggtgagca

SEQ ID NO: 3371334 - DNA, 18 bp, Homo sapiens
gaggcattcggggaagct

SEQ ID NO: 3371335 - DNA, 17 bp, Homo sapiens
gaggccaaaggctggtg

SEQ ID NO: 3371336 - DNA, 18 bp, Homo sapiens
gaggccaaaggctggtgg

SEQ ID NO: 3371337 - DNA, 16 bp, Homo sapiens
gaggccaaccagcccg

SEQ ID NO: 3371338 - DNA, 14 bp, Homo sapiens
gaggccaaggcagg

SEQ ID NO: 3371339 - DNA, 13 bp, Homo sapiens
gaggccaataaaa

SEQ ID NO: 3371340 - DNA, 16 bp, Homo sapiens
gaggccaataaaaagt

SEQ ID NO: 3371341 - DNA, 19 bp, Homo sapiens
gaggccaataaaaagttca

SEQ ID NO: 3371342 - DNA, 20 bp, Homo sapiens
gaggccaataaaaagttcag

SEQ ID NO: 3371343 - DNA, 10 bp, Homo sapiens
gaggccacct

SEQ ID NO: 3371344 - DNA, 20 bp, Homo sapiens
gaggccacctctccaagggc

SEQ ID NO: 3371345 - DNA, 13 bp, Homo sapiens
gaggcccaaatga

SEQ ID NO: 3371346 - DNA, 15 bp, Homo sapiens
gaggcccagcgggca

SEQ ID NO: 3371347 - DNA, 18 bp, Homo sapiens
gaggcccagcgggcagat

SEQ ID NO: 3371348 - DNA, 13 bp, Homo sapiens
gaggcccaggctg

SEQ ID NO: 3371349 - DNA, 17 bp, Homo sapiens
gaggcccaggctgggaa

SEQ ID NO: 3371350 - DNA, 19 bp, Homo sapiens
gaggccccaaaggaaaaag

SEQ ID NO: 3371351 - DNA, 15 bp, Homo sapiens
gaggccccagctctg

SEQ ID NO: 3371352 - DNA, 17 bp, Homo sapiens
gaggcccccagcccagg

SEQ ID NO: 3371353 - DNA, 20 bp, Homo sapiens
gaggcccccagcccagggct

SEQ ID NO: 3371354 - DNA, 17 bp, Homo sapiens
gaggcccctggagccag

SEQ ID NO: 3371355 - DNA, 18 bp, Homo sapiens
gaggcccctggagccaga

SEQ ID NO: 3371356 - DNA, 19 bp, Homo sapiens
gaggccctcctgtgctggg

SEQ ID NO: 3371357 - DNA, 13 bp, Homo sapiens
gaggccctggagg

SEQ ID NO: 3371358 - DNA, 21 bp, Homo sapiens
gaggccctggaggtctccagg

SEQ ID NO: 3371359 - DNA, 15 bp, Homo sapiens
gaggccgaaggtgcc

SEQ ID NO: 3371360 - DNA, 17 bp, Homo sapiens
gaggccgaaggtgcctc

SEQ ID NO: 3371361 - DNA, 15 bp, Homo sapiens
gaggccgtgcagtgg

SEQ ID NO: 3371362 - DNA, 19 bp, Homo sapiens
gaggcctaaaagtaaacat

SEQ ID NO: 3371363 - DNA, 19 bp, Homo sapiens
gaggcctcagtttctccat

SEQ ID NO: 3371364 - DNA, 15 bp, Homo sapiens
gaggcctcatccctc

SEQ ID NO: 3371365 - DNA, 17 bp, Homo sapiens
gaggcctcatgcctgct

SEQ ID NO: 3371366 - DNA, 21 bp, Homo sapiens
gaggcctcatgcctgctgaga

SEQ ID NO: 3371367 - DNA, 18 bp, Homo sapiens
gaggcctctggccctcgg

SEQ ID NO: 3371368 - DNA, 21 bp, Homo sapiens
gaggcctgcaaaccttcctgg

SEQ ID NO: 3371369 - DNA, 13 bp, Homo sapiens
gaggcctggactt

SEQ ID NO: 3371370 - DNA, 20 bp, Homo sapiens
gaggcctggactttcctgca

SEQ ID NO: 3371371 - DNA, 14 bp, Homo sapiens
gaggcctgggccgc

SEQ ID NO: 3371372 - DNA, 18 bp, Homo sapiens
gaggccttctctgaagga

SEQ ID NO: 3371373 - DNA, 15 bp, Homo sapiens
gaggccttgagaggc

SEQ ID NO: 3371374 - DNA, 12 bp, Homo sapiens
gaggcgcggcct

SEQ ID NO: 3371375 - DNA, 21 bp, Homo sapiens
gaggcggcccggccagcgggc

SEQ ID NO: 3371376 - DNA, 15 bp, Homo sapiens
gaggcgggagaatca

SEQ ID NO: 3371377 - DNA, 17 bp, Homo sapiens
gaggcgggccagccagg

SEQ ID NO: 3371378 - DNA, 20 bp, Homo sapiens
gaggcgggccagccaggcgg

SEQ ID NO: 3371379 - DNA, 19 bp, Homo sapiens
gaggcgggtggatcacctg

SEQ ID NO: 3371380 - DNA, 19 bp, Homo sapiens
gaggctaagatgagatttg

SEQ ID NO: 3371381 - DNA, 15 bp, Homo sapiens
gaggctcaacaataa

SEQ ID NO: 3371382 - DNA, 12 bp, Homo sapiens
gaggctccactt

SEQ ID NO: 3371383 - DNA, 18 bp, Homo sapiens
gaggctccacttggtctg

SEQ ID NO: 3371384 - DNA, 23 bp, Homo sapiens
gaggctccacttggtctgtgaga

SEQ ID NO: 3371385 - DNA, 15 bp, Homo sapiens
gaggctccaggactc

SEQ ID NO: 3371386 - DNA, 15 bp, Homo sapiens
gaggctccccagggc

SEQ ID NO: 3371387 - DNA, 17 bp, Homo sapiens
gaggctccccagggctc

SEQ ID NO: 3371388 - DNA, 18 bp, Homo sapiens
gaggctgaggtgggcaga

SEQ ID NO: 3371389 - DNA, 12 bp, Homo sapiens
gaggctggcagg

SEQ ID NO: 3371390 - DNA, 14 bp, Homo sapiens
gaggctgggcacag

SEQ ID NO: 3371391 - DNA, 14 bp, Homo sapiens
gaggctgggcccct

SEQ ID NO: 3371392 - DNA, 16 bp, Homo sapiens
gaggctgggcccctgg

SEQ ID NO: 3371393 - DNA, 14 bp, Homo sapiens
gaggctggtgccag

SEQ ID NO: 3371394 - DNA, 12 bp, Homo sapiens
gaggctgtcctg

SEQ ID NO: 3371395 - DNA, 17 bp, Homo sapiens
gaggctgtctggggcct

SEQ ID NO: 3371396 - DNA, 22 bp, Homo sapiens
gaggcttagagagaggaggcag

SEQ ID NO: 3371397 - DNA, 19 bp, Homo sapiens
gaggcttccaggctcttcc

SEQ ID NO: 3371398 - DNA, 21 bp, Homo sapiens
gaggcttccaggctcttcctg

SEQ ID NO: 3371399 - DNA, 21 bp, Homo sapiens
gaggcttcctgcgtcctcctc

SEQ ID NO: 3371400 - DNA, 18 bp, Homo sapiens
gaggcttcggagtttctt

SEQ ID NO: 3371401 - DNA, 19 bp, Homo sapiens
gaggcttctccgccagcct

SEQ ID NO: 3371402 - DNA, 23 bp, Homo sapiens
gaggcttctccgccagcctcctc

SEQ ID NO: 3371403 - DNA, 14 bp, Homo sapiens
gaggcttctcctgt

SEQ ID NO: 3371404 - DNA, 14 bp, Homo sapiens
gaggcttctccttc

SEQ ID NO: 3371405 - DNA, 16 bp, Homo sapiens
gaggctttggatttga

SEQ ID NO: 3371406 - DNA, 20 bp, Homo sapiens
gaggctttggatttgacatt

SEQ ID NO: 3371407 - DNA, 13 bp, Homo sapiens
gagggaacaaaac

SEQ ID NO: 3371408 - DNA, 23 bp, Homo sapiens
gagggaacatttccgaataaagt

SEQ ID NO: 3371409 - DNA, 16 bp, Homo sapiens
gagggaagtgtgagcg

SEQ ID NO: 3371410 - DNA, 21 bp, Homo sapiens
gagggacaagggattctggga

SEQ ID NO: 3371411 - DNA, 17 bp, Homo sapiens
gagggacatgctcacct

SEQ ID NO: 3371412 - DNA, 19 bp, Homo sapiens
gagggacatgctcacctct

SEQ ID NO: 3371413 - DNA, 18 bp, Homo sapiens
gagggaccaactgggccc

SEQ ID NO: 3371414 - DNA, 21 bp, Homo sapiens
gagggaccatgtgtcacttgt

SEQ ID NO: 3371415 - DNA, 15 bp, Homo sapiens
gagggactgcctctg

SEQ ID NO: 3371416 - DNA, 21 bp, Homo sapiens
gagggagacactggcccctca

SEQ ID NO: 3371417 - DNA, 13 bp, Homo sapiens
gagggagcaagcc

SEQ ID NO: 3371418 - DNA, 18 bp, Homo sapiens
gagggaggaacacctgat

SEQ ID NO: 3371419 - DNA, 17 bp, Homo sapiens
gagggaggaggccacct

SEQ ID NO: 3371420 - DNA, 14 bp, Homo sapiens
gagggaggccaggc

SEQ ID NO: 3371421 - DNA, 23 bp, Homo sapiens
gagggagggggcgctcaggaccc

SEQ ID NO: 3371422 - DNA, 13 bp, Homo sapiens
gagggagtgacag

SEQ ID NO: 3371423 - DNA, 21 bp, Homo sapiens
gagggagtgacagaggcagcc

SEQ ID NO: 3371424 - DNA, 15 bp, Homo sapiens
gagggatgctgcctg

SEQ ID NO: 3371425 - DNA, 20 bp, Homo sapiens
gagggatggagaaagaagtg

SEQ ID NO: 3371426 - DNA, 21 bp, Homo sapiens
gagggatggagaggcggcctc

SEQ ID NO: 3371427 - DNA, 16 bp, Homo sapiens
gagggcacagccctcc

SEQ ID NO: 3371428 - DNA, 17 bp, Homo sapiens
gagggcagactggggca

SEQ ID NO: 3371429 - DNA, 21 bp, Homo sapiens
gagggcagactggggcatcct

SEQ ID NO: 3371430 - DNA, 23 bp, Homo sapiens
gagggcagactggggcatcctgt

SEQ ID NO: 3371431 - DNA, 16 bp, Homo sapiens
gagggcagagccatgg

SEQ ID NO: 3371432 - DNA, 17 bp, Homo sapiens
gagggcagagccatggg

SEQ ID NO: 3371433 - DNA, 21 bp, Homo sapiens
gagggcagagccatgggcctg

SEQ ID NO: 3371434 - DNA, 22 bp, Homo sapiens
gagggcagagccatgggcctgg

SEQ ID NO: 3371435 - DNA, 14 bp, Homo sapiens
gagggcagctgcta

SEQ ID NO: 3371436 - DNA, 22 bp, Homo sapiens
gagggcccagagcaggaagcat

SEQ ID NO: 3371437 - DNA, 14 bp, Homo sapiens
gagggcccagccag

SEQ ID NO: 3371438 - DNA, 21 bp, Homo sapiens
gagggcccagccaggagcaga

SEQ ID NO: 3371439 - DNA, 21 bp, Homo sapiens
gagggcccagcccagagccac

SEQ ID NO: 3371440 - DNA, 23 bp, Homo sapiens
gagggcccagcccagagccacct

SEQ ID NO: 3371441 - DNA, 18 bp, Homo sapiens
gagggcccagctgtagcc

SEQ ID NO: 3371442 - DNA, 16 bp, Homo sapiens
gagggcccaggcaggc

SEQ ID NO: 3371443 - DNA, 19 bp, Homo sapiens
gagggcccctgcgtggggg

SEQ ID NO: 3371444 - DNA, 20 bp, Homo sapiens
gagggcccctgcgtgggggc

SEQ ID NO: 3371445 - DNA, 18 bp, Homo sapiens
gagggccgtaccccaccc

SEQ ID NO: 3371446 - DNA, 13 bp, Homo sapiens
gagggcggcaggg

SEQ ID NO: 3371447 - DNA, 20 bp, Homo sapiens
gagggctgatggaggaaaaa

SEQ ID NO: 3371448 - DNA, 22 bp, Homo sapiens
gagggctgatggaggaaaaagg

SEQ ID NO: 3371449 - DNA, 20 bp, Homo sapiens
gagggctggaggcccaggct

SEQ ID NO: 3371450 - DNA, 13 bp, Homo sapiens
gagggctggctgg

SEQ ID NO: 3371451 - DNA, 19 bp, Homo sapiens
gagggcttcctctagaagc

SEQ ID NO: 3371452 - DNA, 16 bp, Homo sapiens
gagggcttggcccagc

SEQ ID NO: 3371453 - DNA, 17 bp, Homo sapiens
gagggcttggcccagcg

SEQ ID NO: 3371454 - DNA, 14 bp, Homo sapiens
gaggggaaaggctg

SEQ ID NO: 3371455 - DNA, 16 bp, Homo sapiens
gaggggaactgagtca

SEQ ID NO: 3371456 - DNA, 18 bp, Homo sapiens
gaggggaactgagtcacg

SEQ ID NO: 3371457 - DNA, 14 bp, Homo sapiens
gaggggaagggcca

SEQ ID NO: 3371458 - DNA, 16 bp, Homo sapiens
gaggggactgggggac

SEQ ID NO: 3371459 - DNA, 12 bp, Homo sapiens
gaggggagaagc

SEQ ID NO: 3371460 - DNA, 13 bp, Homo sapiens
gaggggaggcaga

SEQ ID NO: 3371461 - DNA, 13 bp, Homo sapiens
gaggggatccagc

SEQ ID NO: 3371462 - DNA, 18 bp, Homo sapiens
gaggggcaacgaagaaaa

SEQ ID NO: 3371463 - DNA, 17 bp, Homo sapiens
gaggggcaagctaggcc

SEQ ID NO: 3371464 - DNA, 15 bp, Homo sapiens
gaggggcagcccttg

SEQ ID NO: 3371465 - DNA, 16 bp, Homo sapiens
gaggggcagcccttgc

SEQ ID NO: 3371466 - DNA, 13 bp, Homo sapiens
gaggggcagcttt

SEQ ID NO: 3371467 - DNA, 13 bp, Homo sapiens
gaggggcaggctg

SEQ ID NO: 3371468 - DNA, 15 bp, Homo sapiens
gaggggcagggaagg

SEQ ID NO: 3371469 - DNA, 20 bp, Homo sapiens
gaggggcagggaaggacagg

SEQ ID NO: 3371470 - DNA, 12 bp, Homo sapiens
gaggggccaggc

SEQ ID NO: 3371471 - DNA, 15 bp, Homo sapiens
gaggggccaggccca

SEQ ID NO: 3371472 - DNA, 19 bp, Homo sapiens
gaggggccaggcccaggca

SEQ ID NO: 3371473 - DNA, 20 bp, Homo sapiens
gaggggccaggcccaggcag

SEQ ID NO: 3371474 - DNA, 23 bp, Homo sapiens
gaggggcccggtggcggcagggc

SEQ ID NO: 3371475 - DNA, 13 bp, Homo sapiens
gaggggcctggca

SEQ ID NO: 3371476 - DNA, 16 bp, Homo sapiens
gaggggcgcccacctc

SEQ ID NO: 3371477 - DNA, 13 bp, Homo sapiens
gaggggcgctggc

SEQ ID NO: 3371478 - DNA, 15 bp, Homo sapiens
gaggggcgctggccc

SEQ ID NO: 3371479 - DNA, 20 bp, Homo sapiens
gaggggcgctggcccagccg

SEQ ID NO: 3371480 - DNA, 13 bp, Homo sapiens
gaggggctcctgg

SEQ ID NO: 3371481 - DNA, 16 bp, Homo sapiens
gaggggctctcagctc

SEQ ID NO: 3371482 - DNA, 19 bp, Homo sapiens
gaggggctctcagctcagc

SEQ ID NO: 3371483 - DNA, 23 bp, Homo sapiens
gaggggctctcagctcagcgcca

SEQ ID NO: 3371484 - DNA, 13 bp, Homo sapiens
gaggggcttggga

SEQ ID NO: 3371485 - DNA, 14 bp, Homo sapiens
gagggggagggggt

SEQ ID NO: 3371486 - DNA, 21 bp, Homo sapiens
gagggggctatagctacagga

SEQ ID NO: 3371487 - DNA, 15 bp, Homo sapiens
gaggggggcacatgc

SEQ ID NO: 3371488 - DNA, 22 bp, Homo sapiens
gaggggggccaaggtcctgctc

SEQ ID NO: 3371489 - DNA, 15 bp, Homo sapiens
gaggggggggtgggg

SEQ ID NO: 3371490 - DNA, 19 bp, Homo sapiens
gagggggttcttcctcacc

SEQ ID NO: 3371491 - DNA, 21 bp, Homo sapiens
gaggggtgtggctccttccca

SEQ ID NO: 3371492 - DNA, 18 bp, Homo sapiens
gaggggttgccacaggcc

SEQ ID NO: 3371493 - DNA, 17 bp, Homo sapiens
gagggtacagctgggct

SEQ ID NO: 3371494 - DNA, 19 bp, Homo sapiens
gagggtccccacctgggac

SEQ ID NO: 3371495 - DNA, 18 bp, Homo sapiens
gagggtgacagcttcctt

SEQ ID NO: 3371496 - DNA, 19 bp, Homo sapiens
gagggtgcccgagtgcggc

SEQ ID NO: 3371497 - DNA, 22 bp, Homo sapiens
gagggtgtcccaaaaagaaagg

SEQ ID NO: 3371498 - DNA, 13 bp, Homo sapiens
gagggtgtttcct

SEQ ID NO: 3371499 - DNA, 15 bp, Homo sapiens
gagggtgtttcctct

SEQ ID NO: 3371500 - DNA, 13 bp, Homo sapiens
gagggttcccctg

SEQ ID NO: 3371501 - DNA, 15 bp, Homo sapiens
gagggttcccctggc

SEQ ID NO: 3371502 - DNA, 12 bp, Homo sapiens
gagggttcctgt

SEQ ID NO: 3371503 - DNA, 15 bp, Homo sapiens
gagggttgggctggt

SEQ ID NO: 3371504 - DNA, 14 bp, Homo sapiens
gagggtttgggcag

SEQ ID NO: 3371505 - DNA, 13 bp, Homo sapiens
gaggtaacagaac

SEQ ID NO: 3371506 - DNA, 14 bp, Homo sapiens
gaggtaacagaaca

SEQ ID NO: 3371507 - DNA, 16 bp, Homo sapiens
gaggtaacagaacagc

SEQ ID NO: 3371508 - DNA, 20 bp, Homo sapiens
gaggtagaccaggatttcta

SEQ ID NO: 3371509 - DNA, 14 bp, Homo sapiens
gaggtagagagggg

SEQ ID NO: 3371510 - DNA, 19 bp, Homo sapiens
gaggtagccgagtcacacc

SEQ ID NO: 3371511 - DNA, 12 bp, Homo sapiens
gaggtcagagcc

SEQ ID NO: 3371512 - DNA, 13 bp, Homo sapiens
gaggtcagagcct

SEQ ID NO: 3371513 - DNA, 14 bp, Homo sapiens
gaggtcaggccctg

SEQ ID NO: 3371514 - DNA, 23 bp, Homo sapiens
gaggtcccacttgcaacttcttt

SEQ ID NO: 3371515 - DNA, 16 bp, Homo sapiens
gaggtcctctggagcc

SEQ ID NO: 3371516 - DNA, 21 bp, Homo sapiens
gaggtccttaggcctctgaga

SEQ ID NO: 3371517 - DNA, 22 bp, Homo sapiens
gaggtcgaccccaaagcccctt

SEQ ID NO: 3371518 - DNA, 21 bp, Homo sapiens
gaggtctcaggttctttccat

SEQ ID NO: 3371519 - DNA, 17 bp, Homo sapiens
gaggtctccaggggcct

SEQ ID NO: 3371520 - DNA, 20 bp, Homo sapiens
gaggtctccaggggcctgca

SEQ ID NO: 3371521 - DNA, 21 bp, Homo sapiens
gaggtctccaggggcctgcag

SEQ ID NO: 3371522 - DNA, 22 bp, Homo sapiens
gaggtctccaggggcctgcaga

SEQ ID NO: 3371523 - DNA, 16 bp, Homo sapiens
gaggtctctgccggct

SEQ ID NO: 3371524 - DNA, 14 bp, Homo sapiens
gaggtctgaaatgg

SEQ ID NO: 3371525 - DNA, 19 bp, Homo sapiens
gaggtctgagccctggtgt

SEQ ID NO: 3371526 - DNA, 20 bp, Homo sapiens
gaggtctgagccctggtgtg

SEQ ID NO: 3371527 - DNA, 12 bp, Homo sapiens
gaggtcttgcta

SEQ ID NO: 3371528 - DNA, 22 bp, Homo sapiens
gaggtcttgctagaatgggaag

SEQ ID NO: 3371529 - DNA, 16 bp, Homo sapiens
gaggtgaggagcagag

SEQ ID NO: 3371530 - DNA, 13 bp, Homo sapiens
gaggtgagggggg

SEQ ID NO: 3371531 - DNA, 13 bp, Homo sapiens
gaggtgcctgtcc

SEQ ID NO: 3371532 - DNA, 20 bp, Homo sapiens
gaggtgcttaagcagaagca

SEQ ID NO: 3371533 - DNA, 22 bp, Homo sapiens
gaggtgcttaagcagaagcatt

SEQ ID NO: 3371534 - DNA, 19 bp, Homo sapiens
gaggtggagattgcagtga

SEQ ID NO: 3371535 - DNA, 21 bp, Homo sapiens
gaggtggccagagctgggagg

SEQ ID NO: 3371536 - DNA, 23 bp, Homo sapiens
gaggtggccagagctgggaggca

SEQ ID NO: 3371537 - DNA, 18 bp, Homo sapiens
gaggtgggagcaggagat

SEQ ID NO: 3371538 - DNA, 18 bp, Homo sapiens
gaggtgggaggtggaaga

SEQ ID NO: 3371539 - DNA, 14 bp, Homo sapiens
gaggtgggcaggtg

SEQ ID NO: 3371540 - DNA, 21 bp, Homo sapiens
gaggtgggcaggtggtggcac

SEQ ID NO: 3371541 - DNA, 12 bp, Homo sapiens
gaggtgggccca

SEQ ID NO: 3371542 - DNA, 23 bp, Homo sapiens
gaggtgggcccaggaccagctgg

SEQ ID NO: 3371543 - DNA, 18 bp, Homo sapiens
gaggtgggtgtgggtgga

SEQ ID NO: 3371544 - DNA, 17 bp, Homo sapiens
gaggtggtctgaatgtt

SEQ ID NO: 3371545 - DNA, 20 bp, Homo sapiens
gaggtggtggagtggagtga

SEQ ID NO: 3371546 - DNA, 17 bp, Homo sapiens
gaggtgtacactaacat

SEQ ID NO: 3371547 - DNA, 20 bp, Homo sapiens
gaggtgtacactaacatttc

SEQ ID NO: 3371548 - DNA, 15 bp, Homo sapiens
gaggtgtccaactgg

SEQ ID NO: 3371549 - DNA, 17 bp, Homo sapiens
gaggtgtgggggctgca

SEQ ID NO: 3371550 - DNA, 14 bp, Homo sapiens
gaggtgtttaaaga

SEQ ID NO: 3371551 - DNA, 14 bp, Homo sapiens
gaggttatctgcct

SEQ ID NO: 3371552 - DNA, 16 bp, Homo sapiens
gaggttatctgcctgg

SEQ ID NO: 3371553 - DNA, 17 bp, Homo sapiens
gaggttatctgcctggc

SEQ ID NO: 3371554 - DNA, 18 bp, Homo sapiens
gaggttcctctgcctgcc

SEQ ID NO: 3371555 - DNA, 14 bp, Homo sapiens
gaggttctaaggcc

SEQ ID NO: 3371556 - DNA, 17 bp, Homo sapiens
gaggttctgagaccagt

SEQ ID NO: 3371557 - DNA, 12 bp, Homo sapiens
gaggttgaggct

SEQ ID NO: 3371558 - DNA, 12 bp, Homo sapiens
gaggttgggctt

SEQ ID NO: 3371559 - DNA, 21 bp, Homo sapiens
gaggtttcacccttaacccaa

SEQ ID NO: 3371560 - DNA, 15 bp, Homo sapiens
gaggtttggaagagt

SEQ ID NO: 3371561 - DNA, 17 bp, Homo sapiens
gaggtttggaagagtga

SEQ ID NO: 3371562 - DNA, 23 bp, Homo sapiens
gaggtttgtcgggcaccagccag

SEQ ID NO: 3371563 - DNA, 18 bp, Homo sapiens
gaggttttattctgactt

SEQ ID NO: 3371564 - DNA, 22 bp, Homo sapiens
gaggtttttaaatatatatttt

SEQ ID NO: 3371565 - DNA, 17 bp, Homo sapiens
gagtaaataaactgttt

SEQ ID NO: 3371566 - DNA, 15 bp, Homo sapiens
gagtaacaatacaaa

SEQ ID NO: 3371567 - DNA, 21 bp, Homo sapiens
gagtaacaatacaaatggatt

SEQ ID NO: 3371568 - DNA, 16 bp, Homo sapiens
gagtaacatttgctgt

SEQ ID NO: 3371569 - DNA, 14 bp, Homo sapiens
gagtaatggtgtag

SEQ ID NO: 3371570 - DNA, 16 bp, Homo sapiens
gagtaccaggggctgg

SEQ ID NO: 3371571 - DNA, 22 bp, Homo sapiens
gagtacctgctgccccagctga

SEQ ID NO: 3371572 - DNA, 14 bp, Homo sapiens
gagtactatattta

SEQ ID NO: 3371573 - DNA, 15 bp, Homo sapiens
gagtactatatttac

SEQ ID NO: 3371574 - DNA, 17 bp, Homo sapiens
gagtagaaataaaagtg

SEQ ID NO: 3371575 - DNA, 14 bp, Homo sapiens
gagtagaattgcat

SEQ ID NO: 3371576 - DNA, 18 bp, Homo sapiens
gagtagatattactttat

SEQ ID NO: 3371577 - DNA, 13 bp, Homo sapiens
gagtagccaagct

SEQ ID NO: 3371578 - DNA, 19 bp, Homo sapiens
gagtagctgggactacagg

SEQ ID NO: 3371579 - DNA, 14 bp, Homo sapiens
gagtagtgtggaat

SEQ ID NO: 3371580 - DNA, 17 bp, Homo sapiens
gagtatcaggtctccca

SEQ ID NO: 3371581 - DNA, 12 bp, Homo sapiens
gagtatctttac

SEQ ID NO: 3371582 - DNA, 19 bp, Homo sapiens
gagtcaaatggtaggcatt

SEQ ID NO: 3371583 - DNA, 15 bp, Homo sapiens
gagtcaccaagccca

SEQ ID NO: 3371584 - DNA, 16 bp, Homo sapiens
gagtcaccaagcccag

SEQ ID NO: 3371585 - DNA, 20 bp, Homo sapiens
gagtcacccatgaagacagg

SEQ ID NO: 3371586 - DNA, 14 bp, Homo sapiens
gagtcacctgcaag

SEQ ID NO: 3371587 - DNA, 15 bp, Homo sapiens
gagtcacctgcaagc

SEQ ID NO: 3371588 - DNA, 17 bp, Homo sapiens
gagtcacctgcaagccc

SEQ ID NO: 3371589 - DNA, 15 bp, Homo sapiens
gagtcaccttccagg

SEQ ID NO: 3371590 - DNA, 21 bp, Homo sapiens
gagtcaccttccaggacccct

SEQ ID NO: 3371591 - DNA, 15 bp, Homo sapiens
gagtcagagccctgg

SEQ ID NO: 3371592 - DNA, 20 bp, Homo sapiens
gagtcagagccctggctggg

SEQ ID NO: 3371593 - DNA, 22 bp, Homo sapiens
gagtcagggcccagaggctgag

SEQ ID NO: 3371594 - DNA, 13 bp, Homo sapiens
gagtcagtctctt

SEQ ID NO: 3371595 - DNA, 15 bp, Homo sapiens
gagtcagtctctttc

SEQ ID NO: 3371596 - DNA, 18 bp, Homo sapiens
gagtcagtctctttctgt

SEQ ID NO: 3371597 - DNA, 21 bp, Homo sapiens
gagtcagtctctttctgtaca

SEQ ID NO: 3371598 - DNA, 14 bp, Homo sapiens
gagtcagtgtctgg

SEQ ID NO: 3371599 - DNA, 14 bp, Homo sapiens
gagtcatggctaat

SEQ ID NO: 3371600 - DNA, 20 bp, Homo sapiens
gagtcatgtgagcctcgtgt

SEQ ID NO: 3371601 - DNA, 21 bp, Homo sapiens
gagtcatgttgaaggtgccca

SEQ ID NO: 3371602 - DNA, 15 bp, Homo sapiens
gagtcattgacttca

SEQ ID NO: 3371603 - DNA, 22 bp, Homo sapiens
gagtcattgacttcattttata

SEQ ID NO: 3371604 - DNA, 13 bp, Homo sapiens
gagtccactttgt

SEQ ID NO: 3371605 - DNA, 15 bp, Homo sapiens
gagtccaggagctca

SEQ ID NO: 3371606 - DNA, 20 bp, Homo sapiens
gagtccattctcccaggtac

SEQ ID NO: 3371607 - DNA, 18 bp, Homo sapiens
gagtccatttcccacatc

SEQ ID NO: 3371608 - DNA, 17 bp, Homo sapiens
gagtcccctactccctc

SEQ ID NO: 3371609 - DNA, 18 bp, Homo sapiens
gagtccctttgaagataa

SEQ ID NO: 3371610 - DNA, 17 bp, Homo sapiens
gagtcctcactcccagt

SEQ ID NO: 3371611 - DNA, 14 bp, Homo sapiens
gagtcctggtccct

SEQ ID NO: 3371612 - DNA, 19 bp, Homo sapiens
gagtcctggtccctctgag

SEQ ID NO: 3371613 - DNA, 23 bp, Homo sapiens
gagtcctggtccctctgaggcag

SEQ ID NO: 3371614 - DNA, 17 bp, Homo sapiens
gagtcctgtctctgcct

SEQ ID NO: 3371615 - DNA, 18 bp, Homo sapiens
gagtcctgtctctgcctg

SEQ ID NO: 3371616 - DNA, 14 bp, Homo sapiens
gagtcgaggacagg

SEQ ID NO: 3371617 - DNA, 15 bp, Homo sapiens
gagtcgaggacaggg

SEQ ID NO: 3371618 - DNA, 16 bp, Homo sapiens
gagtcgaggacaggga

SEQ ID NO: 3371619 - DNA, 12 bp, Homo sapiens
gagtcggcccca

SEQ ID NO: 3371620 - DNA, 17 bp, Homo sapiens
gagtcgtggggtgtgct

SEQ ID NO: 3371621 - DNA, 18 bp, Homo sapiens
gagtcgtggggtgtgctg

SEQ ID NO: 3371622 - DNA, 19 bp, Homo sapiens
gagtcgtggggtgtgctgg

SEQ ID NO: 3371623 - DNA, 17 bp, Homo sapiens
gagtcgttggagactga

SEQ ID NO: 3371624 - DNA, 21 bp, Homo sapiens
gagtctaaagatggagtttct

SEQ ID NO: 3371625 - DNA, 22 bp, Homo sapiens
gagtctaaagatggagtttcta

SEQ ID NO: 3371626 - DNA, 18 bp, Homo sapiens
gagtctaatagtctttgc

SEQ ID NO: 3371627 - DNA, 23 bp, Homo sapiens
gagtctagattcaaaggttctag

SEQ ID NO: 3371628 - DNA, 13 bp, Homo sapiens
gagtctagattct

SEQ ID NO: 3371629 - DNA, 14 bp, Homo sapiens
gagtctagattctc

SEQ ID NO: 3371630 - DNA, 22 bp, Homo sapiens
gagtctcactgttgcccaggct

SEQ ID NO: 3371631 - DNA, 21 bp, Homo sapiens
gagtctcagaaactcccctgg

SEQ ID NO: 3371632 - DNA, 17 bp, Homo sapiens
gagtctctgccacccac

SEQ ID NO: 3371633 - DNA, 15 bp, Homo sapiens
gagtctcttctccac

SEQ ID NO: 3371634 - DNA, 16 bp, Homo sapiens
gagtctcttctccact

SEQ ID NO: 3371635 - DNA, 17 bp, Homo sapiens
gagtctcttctccactg

SEQ ID NO: 3371636 - DNA, 18 bp, Homo sapiens
gagtctgagtcctgtctc

SEQ ID NO: 3371637 - DNA, 14 bp, Homo sapiens
gagtctgagtctga

SEQ ID NO: 3371638 - DNA, 17 bp, Homo sapiens
gagtctggagtgggcag

SEQ ID NO: 3371639 - DNA, 13 bp, Homo sapiens
gagtctggcttta

SEQ ID NO: 3371640 - DNA, 15 bp, Homo sapiens
gagtcttgggcctgg

SEQ ID NO: 3371641 - DNA, 16 bp, Homo sapiens
gagtcttgggcctggc

SEQ ID NO: 3371642 - DNA, 19 bp, Homo sapiens
gagtcttggtttctctcta

SEQ ID NO: 3371643 - DNA, 15 bp, Homo sapiens
gagtctttggttcta

SEQ ID NO: 3371644 - DNA, 22 bp, Homo sapiens
gagtgaaaccatgactgtgacc

SEQ ID NO: 3371645 - DNA, 20 bp, Homo sapiens
gagtgaaacctttagggcag

SEQ ID NO: 3371646 - DNA, 22 bp, Homo sapiens
gagtgaaacctttagggcagct

SEQ ID NO: 3371647 - DNA, 18 bp, Homo sapiens
gagtgaaagggctatggc

SEQ ID NO: 3371648 - DNA, 12 bp, Homo sapiens
gagtgaaccaga

SEQ ID NO: 3371649 - DNA, 15 bp, Homo sapiens
gagtgaaccatcatt

SEQ ID NO: 3371650 - DNA, 16 bp, Homo sapiens
gagtgaagaggggcag

SEQ ID NO: 3371651 - DNA, 17 bp, Homo sapiens
gagtgaagaggggcagc

SEQ ID NO: 3371652 - DNA, 18 bp, Homo sapiens
gagtgaagaggggcagcc

SEQ ID NO: 3371653 - DNA, 20 bp, Homo sapiens
gagtgaagaggggcagccct

SEQ ID NO: 3371654 - DNA, 15 bp, Homo sapiens
gagtgaataaatgtc

SEQ ID NO: 3371655 - DNA, 15 bp, Homo sapiens
gagtgacagaggcag

SEQ ID NO: 3371656 - DNA, 16 bp, Homo sapiens
gagtgacagaggcagc

SEQ ID NO: 3371657 - DNA, 19 bp, Homo sapiens
gagtgacagtggattgcat

SEQ ID NO: 3371658 - DNA, 23 bp, Homo sapiens
gagtgactcaagaagtgaagaat

SEQ ID NO: 3371659 - DNA, 19 bp, Homo sapiens
gagtgagacaaaattttag

SEQ ID NO: 3371660 - DNA, 12 bp, Homo sapiens
gagtgagactga

SEQ ID NO: 3371661 - DNA, 17 bp, Homo sapiens
gagtgagcaagggggcc

SEQ ID NO: 3371662 - DNA, 22 bp, Homo sapiens
gagtgaggaatagttgagcccc

SEQ ID NO: 3371663 - DNA, 13 bp, Homo sapiens
gagtgcagtgagc

SEQ ID NO: 3371664 - DNA, 23 bp, Homo sapiens
gagtgcgctcttggtccctggtc

SEQ ID NO: 3371665 - DNA, 14 bp, Homo sapiens
gagtgcggcgtgga

SEQ ID NO: 3371666 - DNA, 19 bp, Homo sapiens
gagtgctggactgttccag

SEQ ID NO: 3371667 - DNA, 14 bp, Homo sapiens
gagtgctggctcac

SEQ ID NO: 3371668 - DNA, 21 bp, Homo sapiens
gagtgctggctcacagtacag

SEQ ID NO: 3371669 - DNA, 20 bp, Homo sapiens
gagtgcttgttagagagaaa

SEQ ID NO: 3371670 - DNA, 16 bp, Homo sapiens
gagtggaatgcaggga

SEQ ID NO: 3371671 - DNA, 14 bp, Homo sapiens
gagtggactgcatt

SEQ ID NO: 3371672 - DNA, 15 bp, Homo sapiens
gagtggactgcattt

SEQ ID NO: 3371673 - DNA, 11 bp, Homo sapiens
gagtggcagcc

SEQ ID NO: 3371674 - DNA, 16 bp, Homo sapiens
gagtggcagccatgcc

SEQ ID NO: 3371675 - DNA, 19 bp, Homo sapiens
gagtggcagccatgcctca

SEQ ID NO: 3371676 - DNA, 24 bp, Homo sapiens
gagtggcagccatgcctcatgcca

SEQ ID NO: 3371677 - DNA, 14 bp, Homo sapiens
gagtggcaggggac

SEQ ID NO: 3371678 - DNA, 19 bp, Homo sapiens
gagtggcaggggacaggag

SEQ ID NO: 3371679 - DNA, 23 bp, Homo sapiens
gagtggcaggggacaggagtcca

SEQ ID NO: 3371680 - DNA, 13 bp, Homo sapiens
gagtggcctggcc

SEQ ID NO: 3371681 - DNA, 14 bp, Homo sapiens
gagtggcctggcca

SEQ ID NO: 3371682 - DNA, 19 bp, Homo sapiens
gagtggcctggccaggagc

SEQ ID NO: 3371683 - DNA, 20 bp, Homo sapiens
gagtggcctggccaggagct

SEQ ID NO: 3371684 - DNA, 17 bp, Homo sapiens
gagtgggaaggacttgg

SEQ ID NO: 3371685 - DNA, 19 bp, Homo sapiens
gagtgggccccgggctgga

SEQ ID NO: 3371686 - DNA, 20 bp, Homo sapiens
gagtgggtgacaagagcctg

SEQ ID NO: 3371687 - DNA, 21 bp, Homo sapiens
gagtgggtgacaagagcctga

SEQ ID NO: 3371688 - DNA, 21 bp, Homo sapiens
gagtggtaacagctctcttct

SEQ ID NO: 3371689 - DNA, 14 bp, Homo sapiens
gagtggtctttctg

SEQ ID NO: 3371690 - DNA, 15 bp, Homo sapiens
gagtggtgcagacag

SEQ ID NO: 3371691 - DNA, 11 bp, Homo sapiens
gagtggtggtt

SEQ ID NO: 3371692 - DNA, 21 bp, Homo sapiens
gagtggtttaggctatttgta

SEQ ID NO: 3371693 - DNA, 14 bp, Homo sapiens
gagtgtaagtgtga

SEQ ID NO: 3371694 - DNA, 13 bp, Homo sapiens
gagtgtacaagta

SEQ ID NO: 3371695 - DNA, 19 bp, Homo sapiens
gagtgtagcctaaagggca

SEQ ID NO: 3371696 - DNA, 20 bp, Homo sapiens
gagtgtagcctaaagggcag

SEQ ID NO: 3371697 - DNA, 21 bp, Homo sapiens
gagtgtagcctaaagggcagg

SEQ ID NO: 3371698 - DNA, 22 bp, Homo sapiens
gagtgtagcctaaagggcaggg

SEQ ID NO: 3371699 - DNA, 14 bp, Homo sapiens
gagtgtagctgtaa

SEQ ID NO: 3371700 - DNA, 18 bp, Homo sapiens
gagtgtagctgtaagggc

SEQ ID NO: 3371701 - DNA, 19 bp, Homo sapiens
gagtgtcctcttccctctc

SEQ ID NO: 3371702 - DNA, 18 bp, Homo sapiens
gagtgtcctgcccatgcc

SEQ ID NO: 3371703 - DNA, 17 bp, Homo sapiens
gagtgtctctgataaaa

SEQ ID NO: 3371704 - DNA, 16 bp, Homo sapiens
gagtgtgacagggcca

SEQ ID NO: 3371705 - DNA, 23 bp, Homo sapiens
gagtgtgagccacctaagatctc

SEQ ID NO: 3371706 - DNA, 22 bp, Homo sapiens
gagtgtttctaataaacttgga

SEQ ID NO: 3371707 - DNA, 19 bp, Homo sapiens
gagtgtttgtgtctgactc

SEQ ID NO: 3371708 - DNA, 14 bp, Homo sapiens
gagttaagaagctg

SEQ ID NO: 3371709 - DNA, 14 bp, Homo sapiens
gagttacagttctg

SEQ ID NO: 3371710 - DNA, 18 bp, Homo sapiens
gagttacttgtctgaggc

SEQ ID NO: 3371711 - DNA, 19 bp, Homo sapiens
gagttaggttaataaatca

SEQ ID NO: 3371712 - DNA, 23 bp, Homo sapiens
gagttattttaattatcttttct

SEQ ID NO: 3371713 - DNA, 14 bp, Homo sapiens
gagttcaactacat

SEQ ID NO: 3371714 - DNA, 18 bp, Homo sapiens
gagttcaagcctgtggga

SEQ ID NO: 3371715 - DNA, 12 bp, Homo sapiens
gagttcacagga

SEQ ID NO: 3371716 - DNA, 13 bp, Homo sapiens
gagttcacaggag

SEQ ID NO: 3371717 - DNA, 18 bp, Homo sapiens
gagttcacaggaggccag

SEQ ID NO: 3371718 - DNA, 15 bp, Homo sapiens
gagttcaccatctct

SEQ ID NO: 3371719 - DNA, 15 bp, Homo sapiens
gagttccagttgaag

SEQ ID NO: 3371720 - DNA, 20 bp, Homo sapiens
gagttcccccaaccatcttc

SEQ ID NO: 3371721 - DNA, 21 bp, Homo sapiens
gagttccgggaaacatagcct

SEQ ID NO: 3371722 - DNA, 19 bp, Homo sapiens
gagttcgagaccagcctgg

SEQ ID NO: 3371723 - DNA, 19 bp, Homo sapiens
gagttctcagggctcctgc

SEQ ID NO: 3371724 - DNA, 20 bp, Homo sapiens
gagttctcagggctcctgcc

SEQ ID NO: 3371725 - DNA, 21 bp, Homo sapiens
gagttcttaaggattgtgata

SEQ ID NO: 3371726 - DNA, 20 bp, Homo sapiens
gagttgccaagacaaatcaa

SEQ ID NO: 3371727 - DNA, 17 bp, Homo sapiens
gagttggagtactatat

SEQ ID NO: 3371728 - DNA, 17 bp, Homo sapiens
gagttgggcaaaaccca

SEQ ID NO: 3371729 - DNA, 20 bp, Homo sapiens
gagttgggcaaaacccagga

SEQ ID NO: 3371730 - DNA, 21 bp, Homo sapiens
gagttgggcaaaacccaggac

SEQ ID NO: 3371731 - DNA, 19 bp, Homo sapiens
gagtttaagaccagcctgg

SEQ ID NO: 3371732 - DNA, 20 bp, Homo sapiens
gagtttaccatttgtaataa

SEQ ID NO: 3371733 - DNA, 21 bp, Homo sapiens
gagtttatattctgaaaggaa

SEQ ID NO: 3371734 - DNA, 15 bp, Homo sapiens
gagtttcatgtacaa

SEQ ID NO: 3371735 - DNA, 18 bp, Homo sapiens
gagtttcatgtacaagat

SEQ ID NO: 3371736 - DNA, 13 bp, Homo sapiens
gagtttgccctgg

SEQ ID NO: 3371737 - DNA, 16 bp, Homo sapiens
gagtttgttctgttct

SEQ ID NO: 3371738 - DNA, 16 bp, Homo sapiens
gagttttcattaaatc

SEQ ID NO: 3371739 - DNA, 21 bp, Homo sapiens
gagttttctctttgtggggct

SEQ ID NO: 3371740 - DNA, 14 bp, Homo sapiens
gagttttcttcctt

SEQ ID NO: 3371741 - DNA, 14 bp, Homo sapiens
gataaaaagatggc

SEQ ID NO: 3371742 - DNA, 23 bp, Homo sapiens
gataaaagaatggccaaaccctc

SEQ ID NO: 3371743 - DNA, 18 bp, Homo sapiens
gataaaatgaggttcaac

SEQ ID NO: 3371744 - DNA, 15 bp, Homo sapiens
gataaaatgttcagt

SEQ ID NO: 3371745 - DNA, 18 bp, Homo sapiens
gataaagaccagaaattc

SEQ ID NO: 3371746 - DNA, 14 bp, Homo sapiens
gataaagagacagt

SEQ ID NO: 3371747 - DNA, 15 bp, Homo sapiens
gataaagatatcaat

SEQ ID NO: 3371748 - DNA, 15 bp, Homo sapiens
gataaatcatttcag

SEQ ID NO: 3371749 - DNA, 20 bp, Homo sapiens
gataacaatgcagcaaggcc

SEQ ID NO: 3371750 - DNA, 15 bp, Homo sapiens
gataaccagctgtaa

SEQ ID NO: 3371751 - DNA, 22 bp, Homo sapiens
gataacctgtacttcaagttaa

SEQ ID NO: 3371752 - DNA, 11 bp, Homo sapiens
gataactctgt

SEQ ID NO: 3371753 - DNA, 16 bp, Homo sapiens
gataactgatttctat

SEQ ID NO: 3371754 - DNA, 14 bp, Homo sapiens
gataacttactgta

SEQ ID NO: 3371755 - DNA, 21 bp, Homo sapiens
gataacttaggtggcaagctg

SEQ ID NO: 3371756 - DNA, 16 bp, Homo sapiens
gataactttacagaaa

SEQ ID NO: 3371757 - DNA, 22 bp, Homo sapiens
gataacttttttgagtcattga

SEQ ID NO: 3371758 - DNA, 16 bp, Homo sapiens
gataagggaaaagata

SEQ ID NO: 3371759 - DNA, 14 bp, Homo sapiens
gataagtggaaaaa

SEQ ID NO: 3371760 - DNA, 22 bp, Homo sapiens
gataagtggaaaaaagagaaaa

SEQ ID NO: 3371761 - DNA, 16 bp, Homo sapiens
gataagtgtatttttc

SEQ ID NO: 3371762 - DNA, 15 bp, Homo sapiens
gataatattagtgat

SEQ ID NO: 3371763 - DNA, 15 bp, Homo sapiens
gataatattgtttgg

SEQ ID NO: 3371764 - DNA, 21 bp, Homo sapiens
gataatcagtgtgtctaaatt

SEQ ID NO: 3371765 - DNA, 19 bp, Homo sapiens
gataatctcagtgctttcc

SEQ ID NO: 3371766 - DNA, 11 bp, Homo sapiens
gataatgttaa

SEQ ID NO: 3371767 - DNA, 22 bp, Homo sapiens
gataatgttctttaatgttgtc

SEQ ID NO: 3371768 - DNA, 14 bp, Homo sapiens
gataattataatat

SEQ ID NO: 3371769 - DNA, 18 bp, Homo sapiens
gataattcatttgtattg

SEQ ID NO: 3371770 - DNA, 14 bp, Homo sapiens
gataattgctattt

SEQ ID NO: 3371771 - DNA, 12 bp, Homo sapiens
gataatttaaga

SEQ ID NO: 3371772 - DNA, 21 bp, Homo sapiens
gataatttgcatattctattg

SEQ ID NO: 3371773 - DNA, 22 bp, Homo sapiens
gataattttatttataaactag

SEQ ID NO: 3371774 - DNA, 14 bp, Homo sapiens
gatacaacctccct

SEQ ID NO: 3371775 - DNA, 16 bp, Homo sapiens
gatacaacctccctct

SEQ ID NO: 3371776 - DNA, 19 bp, Homo sapiens
gatacaacctccctcttgt

SEQ ID NO: 3371777 - DNA, 19 bp, Homo sapiens
gatacaccgggcctggaga

SEQ ID NO: 3371778 - DNA, 22 bp, Homo sapiens
gatacactgaagttaacagaga

SEQ ID NO: 3371779 - DNA, 16 bp, Homo sapiens
gatacagaaatgcaaa

SEQ ID NO: 3371780 - DNA, 18 bp, Homo sapiens
gatacaggaaaagctgct

SEQ ID NO: 3371781 - DNA, 18 bp, Homo sapiens
gatacagtccctaaagaa

SEQ ID NO: 3371782 - DNA, 17 bp, Homo sapiens
gatacatcactgcttga

SEQ ID NO: 3371783 - DNA, 18 bp, Homo sapiens
gataccacctttactgtg

SEQ ID NO: 3371784 - DNA, 17 bp, Homo sapiens
gataccagacctcttct

SEQ ID NO: 3371785 - DNA, 17 bp, Homo sapiens
gataccaggttgaaaga

SEQ ID NO: 3371786 - DNA, 20 bp, Homo sapiens
gatacccatagcttccatga

SEQ ID NO: 3371787 - DNA, 20 bp, Homo sapiens
gataccttcttatttaatct

SEQ ID NO: 3371788 - DNA, 13 bp, Homo sapiens
gatacgactttat

SEQ ID NO: 3371789 - DNA, 22 bp, Homo sapiens
gatactaaaagttcttctccaa

SEQ ID NO: 3371790 - DNA, 14 bp, Homo sapiens
gatactactttctc

SEQ ID NO: 3371791 - DNA, 20 bp, Homo sapiens
gatactgaatgcataaataa

SEQ ID NO: 3371792 - DNA, 21 bp, Homo sapiens
gatactgcagggccaggactg

SEQ ID NO: 3371793 - DNA, 18 bp, Homo sapiens
gatactgcgactttctgc

SEQ ID NO: 3371794 - DNA, 19 bp, Homo sapiens
gatactgcgactttctgcc

SEQ ID NO: 3371795 - DNA, 20 bp, Homo sapiens
gatactgcgactttctgcct

SEQ ID NO: 3371796 - DNA, 14 bp, Homo sapiens
gatactggaagttt

SEQ ID NO: 3371797 - DNA, 19 bp, Homo sapiens
gatacttagtggtatgtct

SEQ ID NO: 3371798 - DNA, 20 bp, Homo sapiens
gatacttagtggtatgtctc

SEQ ID NO: 3371799 - DNA, 22 bp, Homo sapiens
gatacttagtggtatgtctctt

SEQ ID NO: 3371800 - DNA, 22 bp, Homo sapiens
gatacttatattttcgtatgaa

SEQ ID NO: 3371801 - DNA, 18 bp, Homo sapiens
gatacttcatttaaaaaa

SEQ ID NO: 3371802 - DNA, 13 bp, Homo sapiens
gatacttggattt

SEQ ID NO: 3371803 - DNA, 14 bp, Homo sapiens
gatagaaataaata

SEQ ID NO: 3371804 - DNA, 16 bp, Homo sapiens
gatagaaataaatagc

SEQ ID NO: 3371805 - DNA, 20 bp, Homo sapiens
gatagaaataaatagctata

SEQ ID NO: 3371806 - DNA, 11 bp, Homo sapiens
gatagagaaat

SEQ ID NO: 3371807 - DNA, 22 bp, Homo sapiens
gatagaggaaagggatggtaag

SEQ ID NO: 3371808 - DNA, 13 bp, Homo sapiens
gatagagttccat

SEQ ID NO: 3371809 - DNA, 13 bp, Homo sapiens
gatagataagtat

SEQ ID NO: 3371810 - DNA, 20 bp, Homo sapiens
gatagattgtatctcttaaa

SEQ ID NO: 3371811 - DNA, 15 bp, Homo sapiens
gatagatttggaata

SEQ ID NO: 3371812 - DNA, 16 bp, Homo sapiens
gatagatttggaatag

SEQ ID NO: 3371813 - DNA, 20 bp, Homo sapiens
gatagcactttctacaatgt

SEQ ID NO: 3371814 - DNA, 14 bp, Homo sapiens
gatagcccagaaca

SEQ ID NO: 3371815 - DNA, 20 bp, Homo sapiens
gatagcccagaacaaaaaga

SEQ ID NO: 3371816 - DNA, 16 bp, Homo sapiens
gatagctaactgtaaa

SEQ ID NO: 3371817 - DNA, 20 bp, Homo sapiens
gatagctaactgtaaatcat

SEQ ID NO: 3371818 - DNA, 14 bp, Homo sapiens
gatagctggggctt

SEQ ID NO: 3371819 - DNA, 20 bp, Homo sapiens
gatagctttattttttaagt

SEQ ID NO: 3371820 - DNA, 22 bp, Homo sapiens
gataggaactgtctcaaaagga

SEQ ID NO: 3371821 - DNA, 18 bp, Homo sapiens
gatagtctctgttcttca

SEQ ID NO: 3371822 - DNA, 22 bp, Homo sapiens
gatagtctttcagttaaggaga

SEQ ID NO: 3371823 - DNA, 15 bp, Homo sapiens
gatagttcaccccct

SEQ ID NO: 3371824 - DNA, 18 bp, Homo sapiens
gatagttgatgcatgtta

SEQ ID NO: 3371825 - DNA, 14 bp, Homo sapiens
gatataaaatgtgc

SEQ ID NO: 3371826 - DNA, 15 bp, Homo sapiens
gatataaatggctgg

SEQ ID NO: 3371827 - DNA, 14 bp, Homo sapiens
gatataaattctgt

SEQ ID NO: 3371828 - DNA, 16 bp, Homo sapiens
gatataagagaagtct

SEQ ID NO: 3371829 - DNA, 14 bp, Homo sapiens
gatataagctttta

SEQ ID NO: 3371830 - DNA, 18 bp, Homo sapiens
gatataatgaacaaaatt

SEQ ID NO: 3371831 - DNA, 18 bp, Homo sapiens
gatatacacggatgactt

SEQ ID NO: 3371832 - DNA, 19 bp, Homo sapiens
gatatacagatgaaaattt

SEQ ID NO: 3371833 - DNA, 14 bp, Homo sapiens
gatatacatgaaaa

SEQ ID NO: 3371834 - DNA, 15 bp, Homo sapiens
gatatactgtgtgct

SEQ ID NO: 3371835 - DNA, 18 bp, Homo sapiens
gatatacttttttcttat

SEQ ID NO: 3371836 - DNA, 13 bp, Homo sapiens
gatatatatcata

SEQ ID NO: 3371837 - DNA, 20 bp, Homo sapiens
gatatatcatgagtgaataa

SEQ ID NO: 3371838 - DNA, 21 bp, Homo sapiens
gatatatcatgagtgaataaa

SEQ ID NO: 3371839 - DNA, 22 bp, Homo sapiens
gatatattattgtaagttgtac

SEQ ID NO: 3371840 - DNA, 22 bp, Homo sapiens
gatatatttcacttttgttctg

SEQ ID NO: 3371841 - DNA, 17 bp, Homo sapiens
gatatatttttcacagt

SEQ ID NO: 3371842 - DNA, 17 bp, Homo sapiens
gatatcaaaattctagc

SEQ ID NO: 3371843 - DNA, 18 bp, Homo sapiens
gatatcagagctcttaat

SEQ ID NO: 3371844 - DNA, 20 bp, Homo sapiens
gatatctgagggaggaggcc

SEQ ID NO: 3371845 - DNA, 21 bp, Homo sapiens
gatatctggcctaaaatcttg

SEQ ID NO: 3371846 - DNA, 22 bp, Homo sapiens
gatatgagtatacaatatataa

SEQ ID NO: 3371847 - DNA, 15 bp, Homo sapiens
gatatgctagaaaag

SEQ ID NO: 3371848 - DNA, 13 bp, Homo sapiens
gatatggagaatt

SEQ ID NO: 3371849 - DNA, 12 bp, Homo sapiens
gatatggctgcc

SEQ ID NO: 3371850 - DNA, 16 bp, Homo sapiens
gatatggtgcagagaa

SEQ ID NO: 3371851 - DNA, 24 bp, Homo sapiens
gatatggtgcagagaagctggact

SEQ ID NO: 3371852 - DNA, 19 bp, Homo sapiens
gatatgtaaacataattct

SEQ ID NO: 3371853 - DNA, 16 bp, Homo sapiens
gatattactttatcac

SEQ ID NO: 3371854 - DNA, 19 bp, Homo sapiens
gatattactttatcacttt

SEQ ID NO: 3371855 - DNA, 16 bp, Homo sapiens
gatattccatgaatgt

SEQ ID NO: 3371856 - DNA, 20 bp, Homo sapiens
gatattctactgtacttttt

SEQ ID NO: 3371857 - DNA, 15 bp, Homo sapiens
gatattggaacttgc

SEQ ID NO: 3371858 - DNA, 13 bp, Homo sapiens
gatattgttcaaa

SEQ ID NO: 3371859 - DNA, 17 bp, Homo sapiens
gatattgtttaaaattc

SEQ ID NO: 3371860 - DNA, 19 bp, Homo sapiens
gatattgtttaaaattcag

SEQ ID NO: 3371861 - DNA, 16 bp, Homo sapiens
gatatttaagaaaata

SEQ ID NO: 3371862 - DNA, 13 bp, Homo sapiens
gatatttatatat

SEQ ID NO: 3371863 - DNA, 16 bp, Homo sapiens
gatatttatatatatt

SEQ ID NO: 3371864 - DNA, 16 bp, Homo sapiens
gatatttcttgctttc

SEQ ID NO: 3371865 - DNA, 17 bp, Homo sapiens
gatatttcttgctttca

SEQ ID NO: 3371866 - DNA, 14 bp, Homo sapiens
gatatttgcattga

SEQ ID NO: 3371867 - DNA, 22 bp, Homo sapiens
gatatttgcattgaggaaatat

SEQ ID NO: 3371868 - DNA, 12 bp, Homo sapiens
gatattttcaaa

SEQ ID NO: 3371869 - DNA, 15 bp, Homo sapiens
gatattttctgtgcc

SEQ ID NO: 3371870 - DNA, 22 bp, Homo sapiens
gatatttttaaagatctgtaag

SEQ ID NO: 3371871 - DNA, 11 bp, Homo sapiens
gatatttttgt

SEQ ID NO: 3371872 - DNA, 16 bp, Homo sapiens
gatcaaaaactatttg

SEQ ID NO: 3371873 - DNA, 20 bp, Homo sapiens
gatcaaaaggttaataaagt

SEQ ID NO: 3371874 - DNA, 20 bp, Homo sapiens
gatcaaaataaaaagtgaca

SEQ ID NO: 3371875 - DNA, 15 bp, Homo sapiens
gatcaaagatgaaaa

SEQ ID NO: 3371876 - DNA, 14 bp, Homo sapiens
gatcaaataactta

SEQ ID NO: 3371877 - DNA, 17 bp, Homo sapiens
gatcaaatatagaaagt

SEQ ID NO: 3371878 - DNA, 16 bp, Homo sapiens
gatcaaattctacaac

SEQ ID NO: 3371879 - DNA, 23 bp, Homo sapiens
gatcaaccccttcgctcctgtgt

SEQ ID NO: 3371880 - DNA, 21 bp, Homo sapiens
gatcaataaaatgtgattttt

SEQ ID NO: 3371881 - DNA, 18 bp, Homo sapiens
gatcaattatagtttctg

SEQ ID NO: 3371882 - DNA, 21 bp, Homo sapiens
gatcaattatagtttctgagg

SEQ ID NO: 3371883 - DNA, 17 bp, Homo sapiens
gatcacaagatggaatt

SEQ ID NO: 3371884 - DNA, 14 bp, Homo sapiens
gatcacagcctcca

SEQ ID NO: 3371885 - DNA, 20 bp, Homo sapiens
gatcacagcctccagggccc

SEQ ID NO: 3371886 - DNA, 20 bp, Homo sapiens
gatcacagggccccagaagg

SEQ ID NO: 3371887 - DNA, 14 bp, Homo sapiens
gatcaccagcccgg

SEQ ID NO: 3371888 - DNA, 14 bp, Homo sapiens
gatcacctgaggtt

SEQ ID NO: 3371889 - DNA, 14 bp, Homo sapiens
gatcacgccactgc

SEQ ID NO: 3371890 - DNA, 14 bp, Homo sapiens
gatcacgcctggct

SEQ ID NO: 3371891 - DNA, 13 bp, Homo sapiens
gatcacgctcccc

SEQ ID NO: 3371892 - DNA, 12 bp, Homo sapiens
gatcacggctca

SEQ ID NO: 3371893 - DNA, 16 bp, Homo sapiens
gatcacggctcactgc

SEQ ID NO: 3371894 - DNA, 18 bp, Homo sapiens
gatcactagcctgtcatc

SEQ ID NO: 3371895 - DNA, 22 bp, Homo sapiens
gatcactcccagcactcccctt

SEQ ID NO: 3371896 - DNA, 16 bp, Homo sapiens
gatcactgaatttata

SEQ ID NO: 3371897 - DNA, 16 bp, Homo sapiens
gatcactgccacactc

SEQ ID NO: 3371898 - DNA, 13 bp, Homo sapiens
gatcactggagcc

SEQ ID NO: 3371899 - DNA, 14 bp, Homo sapiens
gatcactggagccc

SEQ ID NO: 3371900 - DNA, 18 bp, Homo sapiens
gatcactggagcccagga

SEQ ID NO: 3371901 - DNA, 13 bp, Homo sapiens
gatcactgtgctt

SEQ ID NO: 3371902 - DNA, 22 bp, Homo sapiens
gatcagaacattcagctctgga

SEQ ID NO: 3371903 - DNA, 16 bp, Homo sapiens
gatcagagcaggacct

SEQ ID NO: 3371904 - DNA, 17 bp, Homo sapiens
gatcagagcaggacctc

SEQ ID NO: 3371905 - DNA, 18 bp, Homo sapiens
gatcagaggtgtacacta

SEQ ID NO: 3371906 - DNA, 19 bp, Homo sapiens
gatcagaggtgtacactaa

SEQ ID NO: 3371907 - DNA, 22 bp, Homo sapiens
gatcagaggtgtacactaacat

SEQ ID NO: 3371908 - DNA, 19 bp, Homo sapiens
gatcagcaaaccggggcct

SEQ ID NO: 3371909 - DNA, 18 bp, Homo sapiens
gatcagctgtttgtcata

SEQ ID NO: 3371910 - DNA, 17 bp, Homo sapiens
gatcaggcagtgtttaa

SEQ ID NO: 3371911 - DNA, 18 bp, Homo sapiens
gatcagggaatccagctc

SEQ ID NO: 3371912 - DNA, 20 bp, Homo sapiens
gatcagggaatccagctccc

SEQ ID NO: 3371913 - DNA, 23 bp, Homo sapiens
gatcagtcctttgatcagtataa

SEQ ID NO: 3371914 - DNA, 19 bp, Homo sapiens
gatcataagtgaatttata

SEQ ID NO: 3371915 - DNA, 17 bp, Homo sapiens
gatcataggtatttcaa

SEQ ID NO: 3371916 - DNA, 15 bp, Homo sapiens
gatcatcatgtagaa

SEQ ID NO: 3371917 - DNA, 21 bp, Homo sapiens
gatcatccactgtgccatgtg

SEQ ID NO: 3371918 - DNA, 13 bp, Homo sapiens
gatcatccctttc

SEQ ID NO: 3371919 - DNA, 16 bp, Homo sapiens
gatcatccctttctcc

SEQ ID NO: 3371920 - DNA, 23 bp, Homo sapiens
gatcatggtgtaataagacataa

SEQ ID NO: 3371921 - DNA, 20 bp, Homo sapiens
gatcatgtactttttagtaa

SEQ ID NO: 3371922 - DNA, 15 bp, Homo sapiens
gatcatgttgttaaa

SEQ ID NO: 3371923 - DNA, 14 bp, Homo sapiens
gatcattgaaatac

SEQ ID NO: 3371924 - DNA, 17 bp, Homo sapiens
gatcatttaaaaagctc

SEQ ID NO: 3371925 - DNA, 22 bp, Homo sapiens
gatcatttattttaagcactct

SEQ ID NO: 3371926 - DNA, 14 bp, Homo sapiens
gatcattttccccc

SEQ ID NO: 3371927 - DNA, 15 bp, Homo sapiens
gatcattttcccccc

SEQ ID NO: 3371928 - DNA, 20 bp, Homo sapiens
gatccaaattgtgcttctcc

SEQ ID NO: 3371929 - DNA, 22 bp, Homo sapiens
gatccaagctaagcactgccac

SEQ ID NO: 3371930 - DNA, 19 bp, Homo sapiens
gatccaagctggtcccact

SEQ ID NO: 3371931 - DNA, 15 bp, Homo sapiens
gatccacacacagag

SEQ ID NO: 3371932 - DNA, 17 bp, Homo sapiens
gatccacccaaccctat

SEQ ID NO: 3371933 - DNA, 19 bp, Homo sapiens
gatccacccacctcagcct

SEQ ID NO: 3371934 - DNA, 21 bp, Homo sapiens
gatccacccacctcagcctcc

SEQ ID NO: 3371935 - DNA, 21 bp, Homo sapiens
gatccagactgtaagatgttg

SEQ ID NO: 3371936 - DNA, 13 bp, Homo sapiens
gatccagcactgg

SEQ ID NO: 3371937 - DNA, 16 bp, Homo sapiens
gatccatccatctcca

SEQ ID NO: 3371938 - DNA, 22 bp, Homo sapiens
gatccatgagtttgccctggtt

SEQ ID NO: 3371939 - DNA, 17 bp, Homo sapiens
gatccatttccattgct

SEQ ID NO: 3371940 - DNA, 16 bp, Homo sapiens
gatccatttgcctttc

SEQ ID NO: 3371941 - DNA, 16 bp, Homo sapiens
gatcccaggccaggga

SEQ ID NO: 3371942 - DNA, 14 bp, Homo sapiens
gatccccaagtgtg

SEQ ID NO: 3371943 - DNA, 20 bp, Homo sapiens
gatccccaagtgtgaacaaa

SEQ ID NO: 3371944 - DNA, 19 bp, Homo sapiens
gatccccgcctggccagga

SEQ ID NO: 3371945 - DNA, 20 bp, Homo sapiens
gatccccgcctggccaggag

SEQ ID NO: 3371946 - DNA, 17 bp, Homo sapiens
gatccccgttcctgaca

SEQ ID NO: 3371947 - DNA, 14 bp, Homo sapiens
gatcccctccccca

SEQ ID NO: 3371948 - DNA, 14 bp, Homo sapiens
gatcccctgagccc

SEQ ID NO: 3371949 - DNA, 21 bp, Homo sapiens
gatcccgcctcttcttcttca

SEQ ID NO: 3371950 - DNA, 14 bp, Homo sapiens
gatccctgtgttgt

SEQ ID NO: 3371951 - DNA, 14 bp, Homo sapiens
gatccgctgccacc

SEQ ID NO: 3371952 - DNA, 15 bp, Homo sapiens
gatccgctgccacca

SEQ ID NO: 3371953 - DNA, 16 bp, Homo sapiens
gatccgctgccaccac

SEQ ID NO: 3371954 - DNA, 16 bp, Homo sapiens
gatccgtgaattctcg

SEQ ID NO: 3371955 - DNA, 16 bp, Homo sapiens
gatcctcccacctcag

SEQ ID NO: 3371956 - DNA, 21 bp, Homo sapiens
gatcctcctgcagaccacgcc

SEQ ID NO: 3371957 - DNA, 13 bp, Homo sapiens
gatcctctactgt

SEQ ID NO: 3371958 - DNA, 13 bp, Homo sapiens
gatcctctatttt

SEQ ID NO: 3371959 - DNA, 16 bp, Homo sapiens
gatcctctcacctcag

SEQ ID NO: 3371960 - DNA, 19 bp, Homo sapiens
gatcctctcacctcagcct

SEQ ID NO: 3371961 - DNA, 21 bp, Homo sapiens
gatcctctcctttgaaacctg

SEQ ID NO: 3371962 - DNA, 12 bp, Homo sapiens
gatcctgcagga

SEQ ID NO: 3371963 - DNA, 20 bp, Homo sapiens
gatcctgcaggaacgagcac

SEQ ID NO: 3371964 - DNA, 23 bp, Homo sapiens
gatcctgcaggaacgagcactgg

SEQ ID NO: 3371965 - DNA, 16 bp, Homo sapiens
gatcctgccaccctgt

SEQ ID NO: 3371966 - DNA, 17 bp, Homo sapiens
gatcctgcgggtggggc

SEQ ID NO: 3371967 - DNA, 18 bp, Homo sapiens
gatcctgcgggtggggct

SEQ ID NO: 3371968 - DNA, 17 bp, Homo sapiens
gatcctggggccctcag

SEQ ID NO: 3371969 - DNA, 22 bp, Homo sapiens
gatcctgggtactgaaagcctt

SEQ ID NO: 3371970 - DNA, 21 bp, Homo sapiens
gatccttagaggtcctctgga

SEQ ID NO: 3371971 - DNA, 22 bp, Homo sapiens
gatccttagaggtcctctggag

SEQ ID NO: 3371972 - DNA, 20 bp, Homo sapiens
gatcctttttccatcatttt

SEQ ID NO: 3371973 - DNA, 19 bp, Homo sapiens
gatccttttttgtcatttt

SEQ ID NO: 3371974 - DNA, 20 bp, Homo sapiens
gatccttttttgtcatttta

SEQ ID NO: 3371975 - DNA, 16 bp, Homo sapiens
gatcgagaccatcctg

SEQ ID NO: 3371976 - DNA, 18 bp, Homo sapiens
gatcgcagtttgcctggt

SEQ ID NO: 3371977 - DNA, 15 bp, Homo sapiens
gatcgcttgagccca

SEQ ID NO: 3371978 - DNA, 14 bp, Homo sapiens
gatcgtagaaaatt

SEQ ID NO: 3371979 - DNA, 16 bp, Homo sapiens
gatcgtagaaaatttg

SEQ ID NO: 3371980 - DNA, 22 bp, Homo sapiens
gatcgtgctactgcactccagc

SEQ ID NO: 3371981 - DNA, 17 bp, Homo sapiens
gatctaagcctttccat

SEQ ID NO: 3371982 - DNA, 23 bp, Homo sapiens
gatctaaggatgtcacagggcca

SEQ ID NO: 3371983 - DNA, 13 bp, Homo sapiens
gatctaatgtgaa

SEQ ID NO: 3371984 - DNA, 20 bp, Homo sapiens
gatctacttcatagctcctt

SEQ ID NO: 3371985 - DNA, 21 bp, Homo sapiens
gatctatccctgcggcctcca

SEQ ID NO: 3371986 - DNA, 19 bp, Homo sapiens
gatctatgtttgtgtgatt

SEQ ID NO: 3371987 - DNA, 20 bp, Homo sapiens
gatctatgtttgtgtgattt

SEQ ID NO: 3371988 - DNA, 21 bp, Homo sapiens
gatctcagctttgagaagcct

SEQ ID NO: 3371989 - DNA, 18 bp, Homo sapiens
gatctcaggggctgtttg

SEQ ID NO: 3371990 - DNA, 15 bp, Homo sapiens
gatctcattcagtat

SEQ ID NO: 3371991 - DNA, 17 bp, Homo sapiens
gatctccatatgttaca

SEQ ID NO: 3371992 - DNA, 13 bp, Homo sapiens
gatctcctgacct

SEQ ID NO: 3371993 - DNA, 14 bp, Homo sapiens
gatctcggtttgcc

SEQ ID NO: 3371994 - DNA, 18 bp, Homo sapiens
gatctctcaggagcacag

SEQ ID NO: 3371995 - DNA, 22 bp, Homo sapiens
gatctctcaggagcacaggcag

SEQ ID NO: 3371996 - DNA, 12 bp, Homo sapiens
gatctcttcctg

SEQ ID NO: 3371997 - DNA, 16 bp, Homo sapiens
gatctgaattaaataa

SEQ ID NO: 3371998 - DNA, 20 bp, Homo sapiens
gatctgatggtgagctggga

SEQ ID NO: 3371999 - DNA, 12 bp, Homo sapiens
gatctgcctggg

SEQ ID NO: 3372000 - DNA, 13 bp, Homo sapiens
gatctgcctgggc

SEQ ID NO: 3372001 - DNA, 14 bp, Homo sapiens
gatctgcctgggcc

SEQ ID NO: 3372002 - DNA, 15 bp, Homo sapiens
gatctgcctgggcct

SEQ ID NO: 3372003 - DNA, 18 bp, Homo sapiens
gatctgcctgggcctgtg

SEQ ID NO: 3372004 - DNA, 22 bp, Homo sapiens
gatctgcctgggcctgtgcagc

SEQ ID NO: 3372005 - DNA, 16 bp, Homo sapiens
gatctggttttgctat

SEQ ID NO: 3372006 - DNA, 21 bp, Homo sapiens
gatctgtagacttctggttgt

SEQ ID NO: 3372007 - DNA, 20 bp, Homo sapiens
gatctgtatttaatggtttt

SEQ ID NO: 3372008 - DNA, 19 bp, Homo sapiens
gatctgttttgaaggcaaa

SEQ ID NO: 3372009 - DNA, 22 bp, Homo sapiens
gatctgttttgtggtttggaat

SEQ ID NO: 3372010 - DNA, 15 bp, Homo sapiens
gatcttcaatggctt

SEQ ID NO: 3372011 - DNA, 16 bp, Homo sapiens
gatcttcaatggcttt

SEQ ID NO: 3372012 - DNA, 14 bp, Homo sapiens
gatcttgaatgtgg

SEQ ID NO: 3372013 - DNA, 17 bp, Homo sapiens
gatcttgtgctcagcat

SEQ ID NO: 3372014 - DNA, 15 bp, Homo sapiens
gatctttactcttga

SEQ ID NO: 3372015 - DNA, 15 bp, Homo sapiens
gatctttcagaaata

SEQ ID NO: 3372016 - DNA, 19 bp, Homo sapiens
gatctttctttccaaaaca

SEQ ID NO: 3372017 - DNA, 16 bp, Homo sapiens
gatctttgactgaaaa

SEQ ID NO: 3372018 - DNA, 16 bp, Homo sapiens
gatctttgcagacagg

SEQ ID NO: 3372019 - DNA, 18 bp, Homo sapiens
gatctttgcagacaggca

SEQ ID NO: 3372020 - DNA, 16 bp, Homo sapiens
gatcttttgaagggag

SEQ ID NO: 3372021 - DNA, 18 bp, Homo sapiens
gatgaaaactaaggattt

SEQ ID NO: 3372022 - DNA, 23 bp, Homo sapiens
gatgaaaagtatattgataacct

SEQ ID NO: 3372023 - DNA, 15 bp, Homo sapiens
gatgaaatgaggtca

SEQ ID NO: 3372024 - DNA, 22 bp, Homo sapiens
gatgaacccaggacgcttctga

SEQ ID NO: 3372025 - DNA, 23 bp, Homo sapiens
gatgaacccaggacgcttctgaa

SEQ ID NO: 3372026 - DNA, 17 bp, Homo sapiens
gatgaacttattctgta

SEQ ID NO: 3372027 - DNA, 19 bp, Homo sapiens
gatgaacttattctgtaga

SEQ ID NO: 3372028 - DNA, 17 bp, Homo sapiens
gatgaagaacacagcat

SEQ ID NO: 3372029 - DNA, 19 bp, Homo sapiens
gatgaagaacacagcatgt

SEQ ID NO: 3372030 - DNA, 21 bp, Homo sapiens
gatgaagagtgagagggcatg

SEQ ID NO: 3372031 - DNA, 16 bp, Homo sapiens
gatgaagttttacatt

SEQ ID NO: 3372032 - DNA, 17 bp, Homo sapiens
gatgaagttttacattg

SEQ ID NO: 3372033 - DNA, 13 bp, Homo sapiens
gatgaataaaata

SEQ ID NO: 3372034 - DNA, 20 bp, Homo sapiens
gatgaatcactgtttttaga

SEQ ID NO: 3372035 - DNA, 16 bp, Homo sapiens
gatgaatgccgtggat

SEQ ID NO: 3372036 - DNA, 13 bp, Homo sapiens
gatgaatgtatgt

SEQ ID NO: 3372037 - DNA, 23 bp, Homo sapiens
gatgacaacctgtgtgagagaat

SEQ ID NO: 3372038 - DNA, 20 bp, Homo sapiens
gatgacacccaccctgtgcc

SEQ ID NO: 3372039 - DNA, 23 bp, Homo sapiens
gatgacacccaccctgtgccatc

SEQ ID NO: 3372040 - DNA, 15 bp, Homo sapiens
gatgacaccctggcc

SEQ ID NO: 3372041 - DNA, 18 bp, Homo sapiens
gatgacaccctggcctga

SEQ ID NO: 3372042 - DNA, 20 bp, Homo sapiens
gatgacacctccatttctct

SEQ ID NO: 3372043 - DNA, 19 bp, Homo sapiens
gatgacaggcgcctgccat

SEQ ID NO: 3372044 - DNA, 18 bp, Homo sapiens
gatgaccaaaccagcctt

SEQ ID NO: 3372045 - DNA, 21 bp, Homo sapiens
gatgacgacgacaacgatgat

SEQ ID NO: 3372046 - DNA, 18 bp, Homo sapiens
gatgactaaaatatttat

SEQ ID NO: 3372047 - DNA, 18 bp, Homo sapiens
gatgactaacaagatttg

SEQ ID NO: 3372048 - DNA, 22 bp, Homo sapiens
gatgactaacaagatttgtaat

SEQ ID NO: 3372049 - DNA, 15 bp, Homo sapiens
gatgactagaggcag

SEQ ID NO: 3372050 - DNA, 22 bp, Homo sapiens
gatgactttgcagatggaaaga

SEQ ID NO: 3372051 - DNA, 18 bp, Homo sapiens
gatgagaaacagctcagc

SEQ ID NO: 3372052 - DNA, 11 bp, Homo sapiens
gatgagaaagg

SEQ ID NO: 3372053 - DNA, 22 bp, Homo sapiens
gatgagaaaggttgaagcacca

SEQ ID NO: 3372054 - DNA, 22 bp, Homo sapiens
gatgagaacaaagctgttaaac

SEQ ID NO: 3372055 - DNA, 15 bp, Homo sapiens
gatgagagcccagag

SEQ ID NO: 3372056 - DNA, 21 bp, Homo sapiens
gatgagagcccagaggtaaca

SEQ ID NO: 3372057 - DNA, 17 bp, Homo sapiens
gatgagatttgccagca

SEQ ID NO: 3372058 - DNA, 13 bp, Homo sapiens
gatgagccgctgt

SEQ ID NO: 3372059 - DNA, 23 bp, Homo sapiens
gatgaggggcttcctgggtcctg

SEQ ID NO: 3372060 - DNA, 16 bp, Homo sapiens
gatgaggtattttttc

SEQ ID NO: 3372061 - DNA, 20 bp, Homo sapiens
gatgaggtcaccaggggagg

SEQ ID NO: 3372062 - DNA, 16 bp, Homo sapiens
gatgataaacgacttt

SEQ ID NO: 3372063 - DNA, 18 bp, Homo sapiens
gatgatacaagattagaa

SEQ ID NO: 3372064 - DNA, 20 bp, Homo sapiens
gatgatcaattatagtttct

SEQ ID NO: 3372065 - DNA, 22 bp, Homo sapiens
gatgatcaattatagtttctga

SEQ ID NO: 3372066 - DNA, 22 bp, Homo sapiens
gatgatccatgagtttgccctg

SEQ ID NO: 3372067 - DNA, 15 bp, Homo sapiens
gatgatctactcaga

SEQ ID NO: 3372068 - DNA, 22 bp, Homo sapiens
gatgatctctccacggtagcac

SEQ ID NO: 3372069 - DNA, 22 bp, Homo sapiens
gatgatggttgcaaaagactaa

SEQ ID NO: 3372070 - DNA, 14 bp, Homo sapiens
gatgatgtctcttg

SEQ ID NO: 3372071 - DNA, 11 bp, Homo sapiens
gatgattaaat

SEQ ID NO: 3372072 - DNA, 13 bp, Homo sapiens
gatgattaaattt

SEQ ID NO: 3372073 - DNA, 14 bp, Homo sapiens
gatgattaaatttt

SEQ ID NO: 3372074 - DNA, 19 bp, Homo sapiens
gatgatttcatcttctgga

SEQ ID NO: 3372075 - DNA, 22 bp, Homo sapiens
gatgatttcatcttctggaata

SEQ ID NO: 3372076 - DNA, 18 bp, Homo sapiens
gatgatttggtcagattg

SEQ ID NO: 3372077 - DNA, 23 bp, Homo sapiens
gatgcaaagtacaatgtgttttt

SEQ ID NO: 3372078 - DNA, 18 bp, Homo sapiens
gatgcaacctcactatgg

SEQ ID NO: 3372079 - DNA, 14 bp, Homo sapiens
gatgcaaggaccag

SEQ ID NO: 3372080 - DNA, 17 bp, Homo sapiens
gatgcaaggaccaggac

SEQ ID NO: 3372081 - DNA, 20 bp, Homo sapiens
gatgcaaggattacagaaac

SEQ ID NO: 3372082 - DNA, 23 bp, Homo sapiens
gatgcaaggattacagaaactga

SEQ ID NO: 3372083 - DNA, 15 bp, Homo sapiens
gatgcaaggtagcat

SEQ ID NO: 3372084 - DNA, 18 bp, Homo sapiens
gatgcaatatatccccac

SEQ ID NO: 3372085 - DNA, 18 bp, Homo sapiens
gatgcacagtatcttttc

SEQ ID NO: 3372086 - DNA, 13 bp, Homo sapiens
gatgcacatttct

SEQ ID NO: 3372087 - DNA, 16 bp, Homo sapiens
gatgcacatttctgga

SEQ ID NO: 3372088 - DNA, 19 bp, Homo sapiens
gatgcacatttctggattg

SEQ ID NO: 3372089 - DNA, 16 bp, Homo sapiens
gatgcaccaccaagcc

SEQ ID NO: 3372090 - DNA, 13 bp, Homo sapiens
gatgcaccagccc

SEQ ID NO: 3372091 - DNA, 15 bp, Homo sapiens
gatgcaccagccctt

SEQ ID NO: 3372092 - DNA, 20 bp, Homo sapiens
gatgcactatatgtttacac

SEQ ID NO: 3372093 - DNA, 22 bp, Homo sapiens
gatgcactatatgtttacacaa

SEQ ID NO: 3372094 - DNA, 20 bp, Homo sapiens
gatgcatacagttttctagc

SEQ ID NO: 3372095 - DNA, 13 bp, Homo sapiens
gatgcatcactgg

SEQ ID NO: 3372096 - DNA, 18 bp, Homo sapiens
gatgcatcgggaaagaag

SEQ ID NO: 3372097 - DNA, 19 bp, Homo sapiens
gatgcatcgggaaagaaga

SEQ ID NO: 3372098 - DNA, 14 bp, Homo sapiens
gatgcatgtctttt

SEQ ID NO: 3372099 - DNA, 23 bp, Homo sapiens
gatgcatgtggtttggttcctct

SEQ ID NO: 3372100 - DNA, 14 bp, Homo sapiens
gatgcatttaataa

SEQ ID NO: 3372101 - DNA, 15 bp, Homo sapiens
gatgcatttaataaa

SEQ ID NO: 3372102 - DNA, 17 bp, Homo sapiens
gatgcatttaataaaga

SEQ ID NO: 3372103 - DNA, 18 bp, Homo sapiens
gatgcatttaataaagat

SEQ ID NO: 3372104 - DNA, 21 bp, Homo sapiens
gatgcatttaataaagatgag

SEQ ID NO: 3372105 - DNA, 14 bp, Homo sapiens
gatgcatttcaaat

SEQ ID NO: 3372106 - DNA, 18 bp, Homo sapiens
gatgcatttcaaatgtta

SEQ ID NO: 3372107 - DNA, 22 bp, Homo sapiens
gatgccaacctctggagcaatg

SEQ ID NO: 3372108 - DNA, 12 bp, Homo sapiens
gatgccacccta

SEQ ID NO: 3372109 - DNA, 15 bp, Homo sapiens
gatgccactcctccc

SEQ ID NO: 3372110 - DNA, 14 bp, Homo sapiens
gatgccagcccctg

SEQ ID NO: 3372111 - DNA, 16 bp, Homo sapiens
gatgccagcccctgcc

SEQ ID NO: 3372112 - DNA, 21 bp, Homo sapiens
gatgccagcccctgcctgggt

SEQ ID NO: 3372113 - DNA, 14 bp, Homo sapiens
gatgccagcccttc

SEQ ID NO: 3372114 - DNA, 11 bp, Homo sapiens
gatgccaggac

SEQ ID NO: 3372115 - DNA, 21 bp, Homo sapiens
gatgccatctgtgtcctggtt

SEQ ID NO: 3372116 - DNA, 18 bp, Homo sapiens
gatgcccagagggcccag

SEQ ID NO: 3372117 - DNA, 16 bp, Homo sapiens
gatgccccctccagga

SEQ ID NO: 3372118 - DNA, 20 bp, Homo sapiens
gatgccccctccaggagaga

SEQ ID NO: 3372119 - DNA, 24 bp, Homo sapiens
gatgccccctccaggagagagcca

SEQ ID NO: 3372120 - DNA, 21 bp, Homo sapiens
gatgccctttggaaagccatt

SEQ ID NO: 3372121 - DNA, 18 bp, Homo sapiens
gatgccgaggtaaaagtt

SEQ ID NO: 3372122 - DNA, 21 bp, Homo sapiens
gatgcctacaaccatccctgc

SEQ ID NO: 3372123 - DNA, 16 bp, Homo sapiens
gatgcctcctgtcaga

SEQ ID NO: 3372124 - DNA, 12 bp, Homo sapiens
gatgccttcatg

SEQ ID NO: 3372125 - DNA, 18 bp, Homo sapiens
gatgccttttttgtagtt

SEQ ID NO: 3372126 - DNA, 14 bp, Homo sapiens
gatgcgaggaccac

SEQ ID NO: 3372127 - DNA, 16 bp, Homo sapiens
gatgcggatcctgctg

SEQ ID NO: 3372128 - DNA, 17 bp, Homo sapiens
gatgcggatcctgctgg

SEQ ID NO: 3372129 - DNA, 20 bp, Homo sapiens
gatgcggatcctgctggggc

SEQ ID NO: 3372130 - DNA, 22 bp, Homo sapiens
gatgctagaactccctttcaac

SEQ ID NO: 3372131 - DNA, 14 bp, Homo sapiens
gatgctagccccag

SEQ ID NO: 3372132 - DNA, 17 bp, Homo sapiens
gatgctagccccagaga

SEQ ID NO: 3372133 - DNA, 14 bp, Homo sapiens
gatgctcaggcttg

SEQ ID NO: 3372134 - DNA, 21 bp, Homo sapiens
gatgctcaggcttgaaatgca

SEQ ID NO: 3372135 - DNA, 16 bp, Homo sapiens
gatgctccaagattct

SEQ ID NO: 3372136 - DNA, 17 bp, Homo sapiens
gatgctccaagattcta

SEQ ID NO: 3372137 - DNA, 19 bp, Homo sapiens
gatgctccaagattctaga

SEQ ID NO: 3372138 - DNA, 20 bp, Homo sapiens
gatgctccctcagcctcaga

SEQ ID NO: 3372139 - DNA, 16 bp, Homo sapiens
gatgctctttcccttt

SEQ ID NO: 3372140 - DNA, 18 bp, Homo sapiens
gatgctctttcccttttc

SEQ ID NO: 3372141 - DNA, 14 bp, Homo sapiens
gatgctgcagcaga

SEQ ID NO: 3372142 - DNA, 11 bp, Homo sapiens
gatgctgctcc

SEQ ID NO: 3372143 - DNA, 19 bp, Homo sapiens
gatgctgctccgcccgctc

SEQ ID NO: 3372144 - DNA, 14 bp, Homo sapiens
gatgctggagaaga

SEQ ID NO: 3372145 - DNA, 20 bp, Homo sapiens
gatgctggagaagagaggag

SEQ ID NO: 3372146 - DNA, 15 bp, Homo sapiens
gatgctggagaggtt

SEQ ID NO: 3372147 - DNA, 14 bp, Homo sapiens
gatgctgggctggg

SEQ ID NO: 3372148 - DNA, 15 bp, Homo sapiens
gatgctgggctgggc

SEQ ID NO: 3372149 - DNA, 12 bp, Homo sapiens
gatgctgggtgg

SEQ ID NO: 3372150 - DNA, 17 bp, Homo sapiens
gatgctgggtggccctg

SEQ ID NO: 3372151 - DNA, 16 bp, Homo sapiens
gatgctgtgctatgaa

SEQ ID NO: 3372152 - DNA, 18 bp, Homo sapiens
gatgcttgtaacaagaaa

SEQ ID NO: 3372153 - DNA, 15 bp, Homo sapiens
gatggaaaaggaaga

SEQ ID NO: 3372154 - DNA, 12 bp, Homo sapiens
gatggaaaataa

SEQ ID NO: 3372155 - DNA, 13 bp, Homo sapiens
gatggaaaataaa

SEQ ID NO: 3372156 - DNA, 17 bp, Homo sapiens
gatggaaaattcatttt

SEQ ID NO: 3372157 - DNA, 17 bp, Homo sapiens
gatggaagtaaagcctc

SEQ ID NO: 3372158 - DNA, 15 bp, Homo sapiens
gatggaattcttcct

SEQ ID NO: 3372159 - DNA, 20 bp, Homo sapiens
gatggacagttcacaccctg

SEQ ID NO: 3372160 - DNA, 23 bp, Homo sapiens
gatggacagttcacaccctgcaa

SEQ ID NO: 3372161 - DNA, 20 bp, Homo sapiens
gatggaccgggtgggcctgg

SEQ ID NO: 3372162 - DNA, 19 bp, Homo sapiens
gatggagaaagaagtggag

SEQ ID NO: 3372163 - DNA, 15 bp, Homo sapiens
gatggagagagggga

SEQ ID NO: 3372164 - DNA, 20 bp, Homo sapiens
gatggagccagctctgcatt

SEQ ID NO: 3372165 - DNA, 22 bp, Homo sapiens
gatggagcccaggcgggagcgg

SEQ ID NO: 3372166 - DNA, 18 bp, Homo sapiens
gatggagcccccagatag

SEQ ID NO: 3372167 - DNA, 15 bp, Homo sapiens
gatggaggaaaaagg

SEQ ID NO: 3372168 - DNA, 23 bp, Homo sapiens
gatggaggaaaaccaagccgtgg

SEQ ID NO: 3372169 - DNA, 16 bp, Homo sapiens
gatggaggtatttgaa

SEQ ID NO: 3372170 - DNA, 23 bp, Homo sapiens
gatggaggttctcagagccaagt

SEQ ID NO: 3372171 - DNA, 18 bp, Homo sapiens
gatggagtccagggaaga

SEQ ID NO: 3372172 - DNA, 18 bp, Homo sapiens
gatggagttcttgtgcca

SEQ ID NO: 3372173 - DNA, 18 bp, Homo sapiens
gatggataaactgagcct

SEQ ID NO: 3372174 - DNA, 14 bp, Homo sapiens
gatggatggcagac

SEQ ID NO: 3372175 - DNA, 15 bp, Homo sapiens
gatggatggcagact

SEQ ID NO: 3372176 - DNA, 14 bp, Homo sapiens
gatggattctcaga

SEQ ID NO: 3372177 - DNA, 14 bp, Homo sapiens
gatggatttgcctg

SEQ ID NO: 3372178 - DNA, 17 bp, Homo sapiens
gatggcacaatgaatgt

SEQ ID NO: 3372179 - DNA, 18 bp, Homo sapiens
gatggcaccaacgggacc

SEQ ID NO: 3372180 - DNA, 18 bp, Homo sapiens
gatggcagactctttaat

SEQ ID NO: 3372181 - DNA, 19 bp, Homo sapiens
gatggcagactctttaata

SEQ ID NO: 3372182 - DNA, 22 bp, Homo sapiens
gatggccaagggggtggacgca

SEQ ID NO: 3372183 - DNA, 14 bp, Homo sapiens
gatggcccctccac

SEQ ID NO: 3372184 - DNA, 17 bp, Homo sapiens
gatggcgcgggaggcac

SEQ ID NO: 3372185 - DNA, 20 bp, Homo sapiens
gatggcgcgggaggcaccag

SEQ ID NO: 3372186 - DNA, 12 bp, Homo sapiens
gatgggaaaata

SEQ ID NO: 3372187 - DNA, 14 bp, Homo sapiens
gatgggaaaatatt

SEQ ID NO: 3372188 - DNA, 23 bp, Homo sapiens
gatgggaatgaggtgggaggtgg

SEQ ID NO: 3372189 - DNA, 20 bp, Homo sapiens
gatgggaccagggatggggg

SEQ ID NO: 3372190 - DNA, 20 bp, Homo sapiens
gatgggaggaaagagagcag

SEQ ID NO: 3372191 - DNA, 15 bp, Homo sapiens
gatgggagtgggcac

SEQ ID NO: 3372192 - DNA, 20 bp, Homo sapiens
gatgggcaacccccagcctg

SEQ ID NO: 3372193 - DNA, 22 bp, Homo sapiens
gatgggcattgggctgacacct

SEQ ID NO: 3372194 - DNA, 14 bp, Homo sapiens
gatgggccaccgcc

SEQ ID NO: 3372195 - DNA, 15 bp, Homo sapiens
gatgggccaccgccg

SEQ ID NO: 3372196 - DNA, 12 bp, Homo sapiens
gatgggccaggg

SEQ ID NO: 3372197 - DNA, 17 bp, Homo sapiens
gatgggggatgggccag

SEQ ID NO: 3372198 - DNA, 15 bp, Homo sapiens
gatggggggctgatg

SEQ ID NO: 3372199 - DNA, 14 bp, Homo sapiens
gatgggggtggctg

SEQ ID NO: 3372200 - DNA, 14 bp, Homo sapiens
gatgggtctgatat

SEQ ID NO: 3372201 - DNA, 21 bp, Homo sapiens
gatgggtctgatattaatcaa

SEQ ID NO: 3372202 - DNA, 16 bp, Homo sapiens
gatgggtgggggctcc

SEQ ID NO: 3372203 - DNA, 16 bp, Homo sapiens
gatgggtgtggatgta

SEQ ID NO: 3372204 - DNA, 22 bp, Homo sapiens
gatgggttctaattttggatgg

SEQ ID NO: 3372205 - DNA, 23 bp, Homo sapiens
gatggtatctgggtaagaagaaa

SEQ ID NO: 3372206 - DNA, 13 bp, Homo sapiens
gatggtatttctt

SEQ ID NO: 3372207 - DNA, 14 bp, Homo sapiens
gatggtcagctccc

SEQ ID NO: 3372208 - DNA, 13 bp, Homo sapiens
gatggtctcgatc

SEQ ID NO: 3372209 - DNA, 18 bp, Homo sapiens
gatggtgccagagagggg

SEQ ID NO: 3372210 - DNA, 15 bp, Homo sapiens
gatggttacactgtt

SEQ ID NO: 3372211 - DNA, 17 bp, Homo sapiens
gatggttacactgttag

SEQ ID NO: 3372212 - DNA, 23 bp, Homo sapiens
gatggttattttcttttctttca

SEQ ID NO: 3372213 - DNA, 14 bp, Homo sapiens
gatggttctgtgac

SEQ ID NO: 3372214 - DNA, 18 bp, Homo sapiens
gatgtaattagctctggg

SEQ ID NO: 3372215 - DNA, 22 bp, Homo sapiens
gatgtaatttagggtactaaat

SEQ ID NO: 3372216 - DNA, 17 bp, Homo sapiens
gatgtacagattttatt

SEQ ID NO: 3372217 - DNA, 15 bp, Homo sapiens
gatgtacttaagagt

SEQ ID NO: 3372218 - DNA, 15 bp, Homo sapiens
gatgtagcattatgc

SEQ ID NO: 3372219 - DNA, 14 bp, Homo sapiens
gatgtatgtgtgaa

SEQ ID NO: 3372220 - DNA, 21 bp, Homo sapiens
gatgtcaaagtgtaacagata

SEQ ID NO: 3372221 - DNA, 15 bp, Homo sapiens
gatgtcaatttctgt

SEQ ID NO: 3372222 - DNA, 13 bp, Homo sapiens
gatgtcacagggc

SEQ ID NO: 3372223 - DNA, 22 bp, Homo sapiens
gatgtcagccgagccgggcctg

SEQ ID NO: 3372224 - DNA, 18 bp, Homo sapiens
gatgtcagcttcccagcc

SEQ ID NO: 3372225 - DNA, 19 bp, Homo sapiens
gatgtcagtatttcaactg

SEQ ID NO: 3372226 - DNA, 22 bp, Homo sapiens
gatgtcagtatttcaactgctg

SEQ ID NO: 3372227 - DNA, 20 bp, Homo sapiens
gatgtcatcagagctcctct

SEQ ID NO: 3372228 - DNA, 17 bp, Homo sapiens
gatgtcccaacttgtaa

SEQ ID NO: 3372229 - DNA, 15 bp, Homo sapiens
gatgtcccctgcggg

SEQ ID NO: 3372230 - DNA, 16 bp, Homo sapiens
gatgtccctgggccag

SEQ ID NO: 3372231 - DNA, 21 bp, Homo sapiens
gatgtccctttcttggccagt

SEQ ID NO: 3372232 - DNA, 14 bp, Homo sapiens
gatgtctaatagtt

SEQ ID NO: 3372233 - DNA, 13 bp, Homo sapiens
gatgtctctgggg

SEQ ID NO: 3372234 - DNA, 16 bp, Homo sapiens
gatgtcttctgcctgt

SEQ ID NO: 3372235 - DNA, 18 bp, Homo sapiens
gatgtcttctgcctgtta

SEQ ID NO: 3372236 - DNA, 22 bp, Homo sapiens
gatgtgaaaataaagcagaagc

SEQ ID NO: 3372237 - DNA, 19 bp, Homo sapiens
gatgtgaaacactttgcct

SEQ ID NO: 3372238 - DNA, 20 bp, Homo sapiens
gatgtgaagataatttgcat

SEQ ID NO: 3372239 - DNA, 21 bp, Homo sapiens
gatgtgacccaccagtgcctt

SEQ ID NO: 3372240 - DNA, 16 bp, Homo sapiens
gatgtgagccccaggg

SEQ ID NO: 3372241 - DNA, 17 bp, Homo sapiens
gatgtgagccccagggg

SEQ ID NO: 3372242 - DNA, 20 bp, Homo sapiens
gatgtgattcaaaagatgcc

SEQ ID NO: 3372243 - DNA, 16 bp, Homo sapiens
gatgtgattgtggaat

SEQ ID NO: 3372244 - DNA, 16 bp, Homo sapiens
gatgtgcaattgattt

SEQ ID NO: 3372245 - DNA, 19 bp, Homo sapiens
gatgtgcaattgatttctt

SEQ ID NO: 3372246 - DNA, 19 bp, Homo sapiens
gatgtgctataatctgttt

SEQ ID NO: 3372247 - DNA, 16 bp, Homo sapiens
gatgtgggccaccatg

SEQ ID NO: 3372248 - DNA, 15 bp, Homo sapiens
gatgtgggtgtcctg

SEQ ID NO: 3372249 - DNA, 23 bp, Homo sapiens
gatgtggtccttaggagacgctg

SEQ ID NO: 3372250 - DNA, 20 bp, Homo sapiens
gatgtgtgttgtcagcctgt

SEQ ID NO: 3372251 - DNA, 24 bp, Homo sapiens
gatgtgtgttgtcagcctgtgctg

SEQ ID NO: 3372252 - DNA, 19 bp, Homo sapiens
gatgtgttcattcaagcta

SEQ ID NO: 3372253 - DNA, 19 bp, Homo sapiens
gatgtgttcctcctgctgt

SEQ ID NO: 3372254 - DNA, 12 bp, Homo sapiens
gatgtgttgtga

SEQ ID NO: 3372255 - DNA, 14 bp, Homo sapiens
gatgtgttgtgata

SEQ ID NO: 3372256 - DNA, 14 bp, Homo sapiens
gatgttctaaggct

SEQ ID NO: 3372257 - DNA, 20 bp, Homo sapiens
gatgttctaaggctctgaga

SEQ ID NO: 3372258 - DNA, 23 bp, Homo sapiens
gatgttctaggatagttgatgca

SEQ ID NO: 3372259 - DNA, 14 bp, Homo sapiens
gatgttctgggaca

SEQ ID NO: 3372260 - DNA, 14 bp, Homo sapiens
gatgtttaacaaat

SEQ ID NO: 3372261 - DNA, 20 bp, Homo sapiens
gatgtttaacaaatctaatc

SEQ ID NO: 3372262 - DNA, 14 bp, Homo sapiens
gatgtttattcttc

SEQ ID NO: 3372263 - DNA, 21 bp, Homo sapiens
gatgtttattcttctagagtt

SEQ ID NO: 3372264 - DNA, 23 bp, Homo sapiens
gatgtttattcttctagagttca

SEQ ID NO: 3372265 - DNA, 17 bp, Homo sapiens
gatgtttcaactgtgct

SEQ ID NO: 3372266 - DNA, 12 bp, Homo sapiens
gatgtttccaga

SEQ ID NO: 3372267 - DNA, 15 bp, Homo sapiens
gatgtttgtggcctc

SEQ ID NO: 3372268 - DNA, 16 bp, Homo sapiens
gatgtttgtggcctca

SEQ ID NO: 3372269 - DNA, 16 bp, Homo sapiens
gatgttttagcatttt

SEQ ID NO: 3372270 - DNA, 14 bp, Homo sapiens
gatgttttattatt

SEQ ID NO: 3372271 - DNA, 18 bp, Homo sapiens
gatgtttttaaaagtttc

SEQ ID NO: 3372272 - DNA, 21 bp, Homo sapiens
gatgtttttaaaagtttcaat

SEQ ID NO: 3372273 - DNA, 15 bp, Homo sapiens
gattaaaagcacaag

SEQ ID NO: 3372274 - DNA, 22 bp, Homo sapiens
gattaaaaggtatactttagta

SEQ ID NO: 3372275 - DNA, 13 bp, Homo sapiens
gattaaagactgt

SEQ ID NO: 3372276 - DNA, 15 bp, Homo sapiens
gattaaaggaaggaa

SEQ ID NO: 3372277 - DNA, 16 bp, Homo sapiens
gattaaaggaaggaaa

SEQ ID NO: 3372278 - DNA, 16 bp, Homo sapiens
gattaaataagattct

SEQ ID NO: 3372279 - DNA, 14 bp, Homo sapiens
gattaaattacagc

SEQ ID NO: 3372280 - DNA, 20 bp, Homo sapiens
gattaaattttagtacattt

SEQ ID NO: 3372281 - DNA, 21 bp, Homo sapiens
gattaaattttagtacatttt

SEQ ID NO: 3372282 - DNA, 17 bp, Homo sapiens
gattaacctctgcacta

SEQ ID NO: 3372283 - DNA, 17 bp, Homo sapiens
gattaacttatttagag

SEQ ID NO: 3372284 - DNA, 10 bp, Homo sapiens
gattaatcaa

SEQ ID NO: 3372285 - DNA, 23 bp, Homo sapiens
gattaatgtgtatttactgtact

SEQ ID NO: 3372286 - DNA, 15 bp, Homo sapiens
gattaatgttttgta

SEQ ID NO: 3372287 - DNA, 16 bp, Homo sapiens
gattaatgttttgtac

SEQ ID NO: 3372288 - DNA, 22 bp, Homo sapiens
gattaattagttgattgctgtt

SEQ ID NO: 3372289 - DNA, 16 bp, Homo sapiens
gattacaaatcagaag

SEQ ID NO: 3372290 - DNA, 20 bp, Homo sapiens
gattacaaatcagaagtcat

SEQ ID NO: 3372291 - DNA, 21 bp, Homo sapiens
gattacaaatcagaagtcatc

SEQ ID NO: 3372292 - DNA, 23 bp, Homo sapiens
gattacaagcgtgagccactgca

SEQ ID NO: 3372293 - DNA, 15 bp, Homo sapiens
gattacagaaactga

SEQ ID NO: 3372294 - DNA, 17 bp, Homo sapiens
gattacaggaatgaaga

SEQ ID NO: 3372295 - DNA, 20 bp, Homo sapiens
gattacaggcatgagccact

SEQ ID NO: 3372296 - DNA, 19 bp, Homo sapiens
gattagaaaaattcctaag

SEQ ID NO: 3372297 - DNA, 15 bp, Homo sapiens
gattagaaattacct

SEQ ID NO: 3372298 - DNA, 22 bp, Homo sapiens
gattagaaattacctgtggata

SEQ ID NO: 3372299 - DNA, 14 bp, Homo sapiens
gattagaacattta

SEQ ID NO: 3372300 - DNA, 14 bp, Homo sapiens
gattagaaggcaag

SEQ ID NO: 3372301 - DNA, 14 bp, Homo sapiens
gattagagggaggt

SEQ ID NO: 3372302 - DNA, 21 bp, Homo sapiens
gattataaaaaatgtaacatc

SEQ ID NO: 3372303 - DNA, 13 bp, Homo sapiens
gattatagattct

SEQ ID NO: 3372304 - DNA, 17 bp, Homo sapiens
gattatagattctaaag

SEQ ID NO: 3372305 - DNA, 21 bp, Homo sapiens
gattatataaagacctataaa

SEQ ID NO: 3372306 - DNA, 14 bp, Homo sapiens
gattatgatgcata

SEQ ID NO: 3372307 - DNA, 18 bp, Homo sapiens
gattatggaaaaataaaa

SEQ ID NO: 3372308 - DNA, 20 bp, Homo sapiens
gattatggaaaaataaaact

SEQ ID NO: 3372309 - DNA, 18 bp, Homo sapiens
gattatgtcttttatatt

SEQ ID NO: 3372310 - DNA, 20 bp, Homo sapiens
gattatgtcttttatatttg

SEQ ID NO: 3372311 - DNA, 21 bp, Homo sapiens
gattatgtcttttatatttgt

SEQ ID NO: 3372312 - DNA, 22 bp, Homo sapiens
gattattatgtttattacaatt

SEQ ID NO: 3372313 - DNA, 16 bp, Homo sapiens
gattattcatttaaaa

SEQ ID NO: 3372314 - DNA, 20 bp, Homo sapiens
gattattcatttaaaatgat

SEQ ID NO: 3372315 - DNA, 19 bp, Homo sapiens
gattattctgattccactt

SEQ ID NO: 3372316 - DNA, 14 bp, Homo sapiens
gattattgtattta

SEQ ID NO: 3372317 - DNA, 13 bp, Homo sapiens
gattatttaataa

SEQ ID NO: 3372318 - DNA, 15 bp, Homo sapiens
gattatttaataaca

SEQ ID NO: 3372319 - DNA, 16 bp, Homo sapiens
gattatttaataacat

SEQ ID NO: 3372320 - DNA, 23 bp, Homo sapiens
gattatttaataacattacctta

SEQ ID NO: 3372321 - DNA, 14 bp, Homo sapiens
gattattttcatta

SEQ ID NO: 3372322 - DNA, 18 bp, Homo sapiens
gattcaaaggttctaggt

SEQ ID NO: 3372323 - DNA, 19 bp, Homo sapiens
gattcaaaggttctaggtt

SEQ ID NO: 3372324 - DNA, 22 bp, Homo sapiens
gattcaatctgtaaactgtgta

SEQ ID NO: 3372325 - DNA, 15 bp, Homo sapiens
gattcactatttaaa

SEQ ID NO: 3372326 - DNA, 13 bp, Homo sapiens
gattcactgtgct

SEQ ID NO: 3372327 - DNA, 15 bp, Homo sapiens
gattcactgtgcttc

SEQ ID NO: 3372328 - DNA, 23 bp, Homo sapiens
gattcagcgaagtctcatgggaa

SEQ ID NO: 3372329 - DNA, 17 bp, Homo sapiens
gattcaggccagcccag

SEQ ID NO: 3372330 - DNA, 20 bp, Homo sapiens
gattcaggccagcccagcca

SEQ ID NO: 3372331 - DNA, 21 bp, Homo sapiens
gattcaggccagcccagccag

SEQ ID NO: 3372332 - DNA, 12 bp, Homo sapiens
gattcaggctgc

SEQ ID NO: 3372333 - DNA, 16 bp, Homo sapiens
gattcaggctgcttgg

SEQ ID NO: 3372334 - DNA, 15 bp, Homo sapiens
gattcagttttcatt

SEQ ID NO: 3372335 - DNA, 18 bp, Homo sapiens
gattccaaagagtagaat

SEQ ID NO: 3372336 - DNA, 19 bp, Homo sapiens
gattccaaagagtagaatt

SEQ ID NO: 3372337 - DNA, 19 bp, Homo sapiens
gattccagagagtggctcc

SEQ ID NO: 3372338 - DNA, 15 bp, Homo sapiens
gattccagcccacat

SEQ ID NO: 3372339 - DNA, 16 bp, Homo sapiens
gattcccaagctctgc

SEQ ID NO: 3372340 - DNA, 18 bp, Homo sapiens
gattcccaagctctgctc

SEQ ID NO: 3372341 - DNA, 21 bp, Homo sapiens
gattcccaagctctgctcctc

SEQ ID NO: 3372342 - DNA, 22 bp, Homo sapiens
gattcccaagctctgctcctct

SEQ ID NO: 3372343 - DNA, 21 bp, Homo sapiens
gattcccccccctttcctaaa

SEQ ID NO: 3372344 - DNA, 15 bp, Homo sapiens
gattccggatcctaa

SEQ ID NO: 3372345 - DNA, 18 bp, Homo sapiens
gattccggatcctaagca

SEQ ID NO: 3372346 - DNA, 20 bp, Homo sapiens
gattcctcacagccttggct

SEQ ID NO: 3372347 - DNA, 23 bp, Homo sapiens
gattcctctgtattgtgctgatt

SEQ ID NO: 3372348 - DNA, 17 bp, Homo sapiens
gattcctgacccaggcc

SEQ ID NO: 3372349 - DNA, 15 bp, Homo sapiens
gattcctgggcctgt

SEQ ID NO: 3372350 - DNA, 22 bp, Homo sapiens
gattccttctctgaacacaggc

SEQ ID NO: 3372351 - DNA, 20 bp, Homo sapiens
gattcctttccctttagcac

SEQ ID NO: 3372352 - DNA, 16 bp, Homo sapiens
gattcggtatcccccc

SEQ ID NO: 3372353 - DNA, 11 bp, Homo sapiens
gattctaaaat

SEQ ID NO: 3372354 - DNA, 11 bp, Homo sapiens
gattctaaaga

SEQ ID NO: 3372355 - DNA, 14 bp, Homo sapiens
gattctaaagattc

SEQ ID NO: 3372356 - DNA, 15 bp, Homo sapiens
gattctaatgtcttc

SEQ ID NO: 3372357 - DNA, 18 bp, Homo sapiens
gattctactcttgtcatt

SEQ ID NO: 3372358 - DNA, 22 bp, Homo sapiens
gattctactttaagcactacat

SEQ ID NO: 3372359 - DNA, 19 bp, Homo sapiens
gattctcctgcctcagcct

SEQ ID NO: 3372360 - DNA, 14 bp, Homo sapiens
gattctcctgtgct

SEQ ID NO: 3372361 - DNA, 16 bp, Homo sapiens
gattctcctgtgctag

SEQ ID NO: 3372362 - DNA, 12 bp, Homo sapiens
gattctctgagt

SEQ ID NO: 3372363 - DNA, 18 bp, Homo sapiens
gattctctgtgtctaaga

SEQ ID NO: 3372364 - DNA, 23 bp, Homo sapiens
gattctctgtgtctaagattcta

SEQ ID NO: 3372365 - DNA, 16 bp, Homo sapiens
gattctgaaaccacag

SEQ ID NO: 3372366 - DNA, 19 bp, Homo sapiens
gattctgacatttatattt

SEQ ID NO: 3372367 - DNA, 15 bp, Homo sapiens
gattctgatttcagt

SEQ ID NO: 3372368 - DNA, 15 bp, Homo sapiens
gattctgcagtaaat

SEQ ID NO: 3372369 - DNA, 21 bp, Homo sapiens
gattctgggaatcatgtccat

SEQ ID NO: 3372370 - DNA, 19 bp, Homo sapiens
gattctgtgtgttttcata

SEQ ID NO: 3372371 - DNA, 22 bp, Homo sapiens
gattctgtgtgttttcataata

SEQ ID NO: 3372372 - DNA, 13 bp, Homo sapiens
gattcttctgctt

SEQ ID NO: 3372373 - DNA, 20 bp, Homo sapiens
gattcttctgcttcagcctc

SEQ ID NO: 3372374 - DNA, 15 bp, Homo sapiens
gattcttgtatttat

SEQ ID NO: 3372375 - DNA, 19 bp, Homo sapiens
gattctttccattatgatt

SEQ ID NO: 3372376 - DNA, 20 bp, Homo sapiens
gattcttttaaattagaaaa

SEQ ID NO: 3372377 - DNA, 14 bp, Homo sapiens
gattctttttctga

SEQ ID NO: 3372378 - DNA, 15 bp, Homo sapiens
gattgaaaattcgcc

SEQ ID NO: 3372379 - DNA, 21 bp, Homo sapiens
gattgaagtattttgctggaa

SEQ ID NO: 3372380 - DNA, 20 bp, Homo sapiens
gattgacctgaggagacatc

SEQ ID NO: 3372381 - DNA, 12 bp, Homo sapiens
gattgacctgct

SEQ ID NO: 3372382 - DNA, 14 bp, Homo sapiens
gattgacctgctcc

SEQ ID NO: 3372383 - DNA, 15 bp, Homo sapiens
gattgacctgctccg

SEQ ID NO: 3372384 - DNA, 18 bp, Homo sapiens
gattgacctgctccgctg

SEQ ID NO: 3372385 - DNA, 23 bp, Homo sapiens
gattgacctgctccgctgctcct

SEQ ID NO: 3372386 - DNA, 23 bp, Homo sapiens
gattgactaactcaaatacacat

SEQ ID NO: 3372387 - DNA, 16 bp, Homo sapiens
gattgagaaggagaga

SEQ ID NO: 3372388 - DNA, 18 bp, Homo sapiens
gattgagaaggagagaaa

SEQ ID NO: 3372389 - DNA, 19 bp, Homo sapiens
gattgagaaggagagaaag

SEQ ID NO: 3372390 - DNA, 20 bp, Homo sapiens
gattgaggggccctggccag

SEQ ID NO: 3372391 - DNA, 19 bp, Homo sapiens
gattgatagagtgttatca

SEQ ID NO: 3372392 - DNA, 15 bp, Homo sapiens
gattgcaacaggctg

SEQ ID NO: 3372393 - DNA, 17 bp, Homo sapiens
gattgcaacaggctggg

SEQ ID NO: 3372394 - DNA, 16 bp, Homo sapiens
gattgcacagagctgg

SEQ ID NO: 3372395 - DNA, 15 bp, Homo sapiens
gattgcacgtggcct

SEQ ID NO: 3372396 - DNA, 16 bp, Homo sapiens
gattgcacgtggcctc

SEQ ID NO: 3372397 - DNA, 17 bp, Homo sapiens
gattgcacgtggcctct

SEQ ID NO: 3372398 - DNA, 20 bp, Homo sapiens
gattgcacgtggcctcttga

SEQ ID NO: 3372399 - DNA, 23 bp, Homo sapiens
gattgcacgtggcctcttgagca

SEQ ID NO: 3372400 - DNA, 18 bp, Homo sapiens
gattgcagaaaggagaga

SEQ ID NO: 3372401 - DNA, 19 bp, Homo sapiens
gattgcggtttacagctat

SEQ ID NO: 3372402 - DNA, 15 bp, Homo sapiens
gattgctgcaaagat

SEQ ID NO: 3372403 - DNA, 11 bp, Homo sapiens
gattgctgcca

SEQ ID NO: 3372404 - DNA, 14 bp, Homo sapiens
gattgcttctgtag

SEQ ID NO: 3372405 - DNA, 15 bp, Homo sapiens
gattggaccaggcca

SEQ ID NO: 3372406 - DNA, 14 bp, Homo sapiens
gattggattattca

SEQ ID NO: 3372407 - DNA, 15 bp, Homo sapiens
gattggattattcat

SEQ ID NO: 3372408 - DNA, 17 bp, Homo sapiens
gattggattattcattt

SEQ ID NO: 3372409 - DNA, 20 bp, Homo sapiens
gattggattattcatttaaa

SEQ ID NO: 3372410 - DNA, 16 bp, Homo sapiens
gattggcctgtagagt

SEQ ID NO: 3372411 - DNA, 16 bp, Homo sapiens
gattggcttgtagaat

SEQ ID NO: 3372412 - DNA, 20 bp, Homo sapiens
gattggcttgtagaattgtt

SEQ ID NO: 3372413 - DNA, 19 bp, Homo sapiens
gattggcttgtgtgtttca

SEQ ID NO: 3372414 - DNA, 16 bp, Homo sapiens
gattggctttaaacac

SEQ ID NO: 3372415 - DNA, 18 bp, Homo sapiens
gattgtaaaaaaaaatgc

SEQ ID NO: 3372416 - DNA, 12 bp, Homo sapiens
gattgtaaaata

SEQ ID NO: 3372417 - DNA, 23 bp, Homo sapiens
gattgtaaaatagcttgtatagt

SEQ ID NO: 3372418 - DNA, 20 bp, Homo sapiens
gattgtcctttaaaaaagaa

SEQ ID NO: 3372419 - DNA, 21 bp, Homo sapiens
gattgtctttcccccctccct

SEQ ID NO: 3372420 - DNA, 21 bp, Homo sapiens
gattgttaagtctaaatattt

SEQ ID NO: 3372421 - DNA, 15 bp, Homo sapiens
gatttaaacacacag

SEQ ID NO: 3372422 - DNA, 15 bp, Homo sapiens
gatttaaattttcac

SEQ ID NO: 3372423 - DNA, 15 bp, Homo sapiens
gatttacatgtatgg

SEQ ID NO: 3372424 - DNA, 20 bp, Homo sapiens
gatttacatgtatggttact

SEQ ID NO: 3372425 - DNA, 12 bp, Homo sapiens
gatttagaaaaa

SEQ ID NO: 3372426 - DNA, 15 bp, Homo sapiens
gatttagaactgtat

SEQ ID NO: 3372427 - DNA, 15 bp, Homo sapiens
gatttagagtttttt

SEQ ID NO: 3372428 - DNA, 13 bp, Homo sapiens
gatttagtttcag

SEQ ID NO: 3372429 - DNA, 15 bp, Homo sapiens
gatttagtttcagta

SEQ ID NO: 3372430 - DNA, 14 bp, Homo sapiens
gatttataaacaga

SEQ ID NO: 3372431 - DNA, 19 bp, Homo sapiens
gatttatagtatgtgactt

SEQ ID NO: 3372432 - DNA, 21 bp, Homo sapiens
gatttatagtatgtgactttt

SEQ ID NO: 3372433 - DNA, 21 bp, Homo sapiens
gatttatagtttgtacatgca

SEQ ID NO: 3372434 - DNA, 11 bp, Homo sapiens
gatttatcttt

SEQ ID NO: 3372435 - DNA, 12 bp, Homo sapiens
gatttatcttta

SEQ ID NO: 3372436 - DNA, 18 bp, Homo sapiens
gatttatctttatacaga

SEQ ID NO: 3372437 - DNA, 12 bp, Homo sapiens
gatttcaagaaa

SEQ ID NO: 3372438 - DNA, 20 bp, Homo sapiens
gatttcaggatactctgtca

SEQ ID NO: 3372439 - DNA, 15 bp, Homo sapiens
gatttcatactgtaa

SEQ ID NO: 3372440 - DNA, 15 bp, Homo sapiens
gatttcatagttcag

SEQ ID NO: 3372441 - DNA, 13 bp, Homo sapiens
gatttcatgattt

SEQ ID NO: 3372442 - DNA, 19 bp, Homo sapiens
gatttcatggtgattccag

SEQ ID NO: 3372443 - DNA, 13 bp, Homo sapiens
gatttccaggccc

SEQ ID NO: 3372444 - DNA, 14 bp, Homo sapiens
gatttccaggcccc

SEQ ID NO: 3372445 - DNA, 19 bp, Homo sapiens
gatttccagtgagtgtaaa

SEQ ID NO: 3372446 - DNA, 13 bp, Homo sapiens
gatttccatctta

SEQ ID NO: 3372447 - DNA, 12 bp, Homo sapiens
gatttcccctct

SEQ ID NO: 3372448 - DNA, 15 bp, Homo sapiens
gatttcctaaacata

SEQ ID NO: 3372449 - DNA, 13 bp, Homo sapiens
gatttcctaatac

SEQ ID NO: 3372450 - DNA, 14 bp, Homo sapiens
gatttctacctcag

SEQ ID NO: 3372451 - DNA, 18 bp, Homo sapiens
gatttctatggctttcaa

SEQ ID NO: 3372452 - DNA, 23 bp, Homo sapiens
gatttctatggctttcaaagcta

SEQ ID NO: 3372453 - DNA, 15 bp, Homo sapiens
gatttctcattgact

SEQ ID NO: 3372454 - DNA, 19 bp, Homo sapiens
gatttcttaaatctttctt

SEQ ID NO: 3372455 - DNA, 15 bp, Homo sapiens
gatttgaaaaatata

SEQ ID NO: 3372456 - DNA, 21 bp, Homo sapiens
gatttgaaaaatataaaatta

SEQ ID NO: 3372457 - DNA, 18 bp, Homo sapiens
gatttgaagaacatgtga

SEQ ID NO: 3372458 - DNA, 13 bp, Homo sapiens
gatttgacattgc

SEQ ID NO: 3372459 - DNA, 17 bp, Homo sapiens
gatttgatatttgcatt

SEQ ID NO: 3372460 - DNA, 23 bp, Homo sapiens
gatttgatgagttaactgtgaaa

SEQ ID NO: 3372461 - DNA, 15 bp, Homo sapiens
gatttgatgctggag

SEQ ID NO: 3372462 - DNA, 21 bp, Homo sapiens
gatttgatgctggagaggtta

SEQ ID NO: 3372463 - DNA, 22 bp, Homo sapiens
gatttgatgtgactttttttgg

SEQ ID NO: 3372464 - DNA, 17 bp, Homo sapiens
gatttgccagcacaggg

SEQ ID NO: 3372465 - DNA, 19 bp, Homo sapiens
gatttgcccatttacactt

SEQ ID NO: 3372466 - DNA, 16 bp, Homo sapiens
gatttgggggaggctt

SEQ ID NO: 3372467 - DNA, 16 bp, Homo sapiens
gatttgtagcactgag

SEQ ID NO: 3372468 - DNA, 21 bp, Homo sapiens
gatttgtaggaaggtctcatt

SEQ ID NO: 3372469 - DNA, 21 bp, Homo sapiens
gatttgtcccagcctggggct

SEQ ID NO: 3372470 - DNA, 18 bp, Homo sapiens
gatttgtccttttatttc

SEQ ID NO: 3372471 - DNA, 22 bp, Homo sapiens
gatttgtgaactggaagaaagc

SEQ ID NO: 3372472 - DNA, 12 bp, Homo sapiens
gattttaacaat

SEQ ID NO: 3372473 - DNA, 23 bp, Homo sapiens
gattttaatagggaatatatctc

SEQ ID NO: 3372474 - DNA, 16 bp, Homo sapiens
gattttaattgtcatg

SEQ ID NO: 3372475 - DNA, 22 bp, Homo sapiens
gattttatctttcgcacagcag

SEQ ID NO: 3372476 - DNA, 19 bp, Homo sapiens
gattttatttatatcttta

SEQ ID NO: 3372477 - DNA, 19 bp, Homo sapiens
gattttcaaagctttttcc

SEQ ID NO: 3372478 - DNA, 17 bp, Homo sapiens
gattttctagaaatgtt

SEQ ID NO: 3372479 - DNA, 12 bp, Homo sapiens
gattttctattg

SEQ ID NO: 3372480 - DNA, 22 bp, Homo sapiens
gattttctattgttactctggt

SEQ ID NO: 3372481 - DNA, 21 bp, Homo sapiens
gattttctgggcctaaaggat

SEQ ID NO: 3372482 - DNA, 17 bp, Homo sapiens
gattttgaggtaaagat

SEQ ID NO: 3372483 - DNA, 19 bp, Homo sapiens
gattttgatccaagctggt

SEQ ID NO: 3372484 - DNA, 13 bp, Homo sapiens
gattttgcctgtg

SEQ ID NO: 3372485 - DNA, 18 bp, Homo sapiens
gattttggataaatcatt

SEQ ID NO: 3372486 - DNA, 21 bp, Homo sapiens
gattttggtattacactgtat

SEQ ID NO: 3372487 - DNA, 16 bp, Homo sapiens
gattttgtaacccaga

SEQ ID NO: 3372488 - DNA, 21 bp, Homo sapiens
gattttgttgatacctctgct

SEQ ID NO: 3372489 - DNA, 17 bp, Homo sapiens
gatttttaaaaaatatt

SEQ ID NO: 3372490 - DNA, 23 bp, Homo sapiens
gatttttcggaggccccactgat

SEQ ID NO: 3372491 - DNA, 14 bp, Homo sapiens
gatttttctcttca

SEQ ID NO: 3372492 - DNA, 13 bp, Homo sapiens
gatttttgttaat

SEQ ID NO: 3372493 - DNA, 14 bp, Homo sapiens
gatttttttctgag

SEQ ID NO: 3372494 - DNA, 20 bp, Homo sapiens
gatttttttttttttttcct

SEQ ID NO: 3372495 - DNA, 13 bp, Homo sapiens
gcaaaaaactctt

SEQ ID NO: 3372496 - DNA, 22 bp, Homo sapiens
gcaaaaaactcttaatctgtgt

SEQ ID NO: 3372497 - DNA, 14 bp, Homo sapiens
gcaaaaatagttaa

SEQ ID NO: 3372498 - DNA, 16 bp, Homo sapiens
gcaaaaatataaaata

SEQ ID NO: 3372499 - DNA, 23 bp, Homo sapiens
gcaaaaatatttataaaacttct

SEQ ID NO: 3372500 - DNA, 18 bp, Homo sapiens
gcaaaacacgcaagggca

SEQ ID NO: 3372501 - DNA, 12 bp, Homo sapiens
gcaaaagaaaaa

SEQ ID NO: 3372502 - DNA, 16 bp, Homo sapiens
gcaaaagactaattta

SEQ ID NO: 3372503 - DNA, 14 bp, Homo sapiens
gcaaaagccttgtg

SEQ ID NO: 3372504 - DNA, 23 bp, Homo sapiens
gcaaaagccttgtgtatatttgt

SEQ ID NO: 3372505 - DNA, 16 bp, Homo sapiens
gcaaaaggcctcttgt

SEQ ID NO: 3372506 - DNA, 13 bp, Homo sapiens
gcaaaatatgttt

SEQ ID NO: 3372507 - DNA, 17 bp, Homo sapiens
gcaaaattgttttcact

SEQ ID NO: 3372508 - DNA, 10 bp, Homo sapiens
gcaaaatttc

SEQ ID NO: 3372509 - DNA, 22 bp, Homo sapiens
gcaaacaatcccaatctttcta

SEQ ID NO: 3372510 - DNA, 24 bp, Homo sapiens
gcaaacaatgaagaattatgtaat

SEQ ID NO: 3372511 - DNA, 14 bp, Homo sapiens
gcaaacagaacagg

SEQ ID NO: 3372512 - DNA, 16 bp, Homo sapiens
gcaaacagaacagggt

SEQ ID NO: 3372513 - DNA, 13 bp, Homo sapiens
gcaaacatcaaat

SEQ ID NO: 3372514 - DNA, 22 bp, Homo sapiens
gcaaaccagcttgttctgggct

SEQ ID NO: 3372515 - DNA, 23 bp, Homo sapiens
gcaaaccagcttgttctgggctc

SEQ ID NO: 3372516 - DNA, 17 bp, Homo sapiens
gcaaaccattatacctt

SEQ ID NO: 3372517 - DNA, 16 bp, Homo sapiens
gcaaacccattaaggg

SEQ ID NO: 3372518 - DNA, 18 bp, Homo sapiens
gcaaaccccctttgtgct

SEQ ID NO: 3372519 - DNA, 14 bp, Homo sapiens
gcaaaccttcctgg

SEQ ID NO: 3372520 - DNA, 20 bp, Homo sapiens
gcaaacttaagaaacactga

SEQ ID NO: 3372521 - DNA, 22 bp, Homo sapiens
gcaaagaaagtgggaggtcagg

SEQ ID NO: 3372522 - DNA, 18 bp, Homo sapiens
gcaaagaagtaagtttat

SEQ ID NO: 3372523 - DNA, 17 bp, Homo sapiens
gcaaagacgtaataaaa

SEQ ID NO: 3372524 - DNA, 16 bp, Homo sapiens
gcaaagaggactcgct

SEQ ID NO: 3372525 - DNA, 14 bp, Homo sapiens
gcaaagatcaaaat

SEQ ID NO: 3372526 - DNA, 18 bp, Homo sapiens
gcaaagatcaaaataaaa

SEQ ID NO: 3372527 - DNA, 14 bp, Homo sapiens
gcaaaggaccagcg

SEQ ID NO: 3372528 - DNA, 15 bp, Homo sapiens
gcaaaggcctgggct

SEQ ID NO: 3372529 - DNA, 20 bp, Homo sapiens
gcaaaggggctgaaagaaca

SEQ ID NO: 3372530 - DNA, 18 bp, Homo sapiens
gcaaagggtcttttgcag

SEQ ID NO: 3372531 - DNA, 21 bp, Homo sapiens
gcaaaggtggcaatgcttaaa

SEQ ID NO: 3372532 - DNA, 19 bp, Homo sapiens
gcaaaggttccaactgtat

SEQ ID NO: 3372533 - DNA, 12 bp, Homo sapiens
gcaaagtacaat

SEQ ID NO: 3372534 - DNA, 19 bp, Homo sapiens
gcaaagtacaatgtgtttt

SEQ ID NO: 3372535 - DNA, 23 bp, Homo sapiens
gcaaagtgctgtacccttccacc

SEQ ID NO: 3372536 - DNA, 14 bp, Homo sapiens
gcaaatataaaact

SEQ ID NO: 3372537 - DNA, 17 bp, Homo sapiens
gcaaatataaacatctc

SEQ ID NO: 3372538 - DNA, 19 bp, Homo sapiens
gcaaatataagctgggaaa

SEQ ID NO: 3372539 - DNA, 22 bp, Homo sapiens
gcaaatcagaaacttgtgaagt

SEQ ID NO: 3372540 - DNA, 16 bp, Homo sapiens
gcaaatgacatgcact

SEQ ID NO: 3372541 - DNA, 20 bp, Homo sapiens
gcaaatggaggcttttcact

SEQ ID NO: 3372542 - DNA, 23 bp, Homo sapiens
gcaaatgttaaaagttttatatg

SEQ ID NO: 3372543 - DNA, 14 bp, Homo sapiens
gcaaattaaacaat

SEQ ID NO: 3372544 - DNA, 14 bp, Homo sapiens
gcaaattgattgtc

SEQ ID NO: 3372545 - DNA, 14 bp, Homo sapiens
gcaaattgtatctt

SEQ ID NO: 3372546 - DNA, 17 bp, Homo sapiens
gcaaattgtatcttatt

SEQ ID NO: 3372547 - DNA, 16 bp, Homo sapiens
gcaaatttcaaaagac

SEQ ID NO: 3372548 - DNA, 14 bp, Homo sapiens
gcaaatttgtggtt

SEQ ID NO: 3372549 - DNA, 19 bp, Homo sapiens
gcaacagagtgagaccctg

SEQ ID NO: 3372550 - DNA, 18 bp, Homo sapiens
gcaacagcactggctctc

SEQ ID NO: 3372551 - DNA, 13 bp, Homo sapiens
gcaacaggacaga

SEQ ID NO: 3372552 - DNA, 20 bp, Homo sapiens
gcaacaggattgatcattct

SEQ ID NO: 3372553 - DNA, 19 bp, Homo sapiens
gcaacaggctgggcttcag

SEQ ID NO: 3372554 - DNA, 23 bp, Homo sapiens
gcaacaggggaggaaaaaagaac

SEQ ID NO: 3372555 - DNA, 23 bp, Homo sapiens
gcaacatttacagtccttcaaaa

SEQ ID NO: 3372556 - DNA, 22 bp, Homo sapiens
gcaaccccagttctgctcctct

SEQ ID NO: 3372557 - DNA, 13 bp, Homo sapiens
gcaacccctgtac

SEQ ID NO: 3372558 - DNA, 21 bp, Homo sapiens
gcaacccttaccccttagcct

SEQ ID NO: 3372559 - DNA, 14 bp, Homo sapiens
gcaaccgcttccct

SEQ ID NO: 3372560 - DNA, 18 bp, Homo sapiens
gcaacctacccagcgtgg

SEQ ID NO: 3372561 - DNA, 20 bp, Homo sapiens
gcaacctccgcctcttgggt

SEQ ID NO: 3372562 - DNA, 23 bp, Homo sapiens
gcaacctctgcctcccaggttcc

SEQ ID NO: 3372563 - DNA, 18 bp, Homo sapiens
gcaacctgattgtaaact

SEQ ID NO: 3372564 - DNA, 19 bp, Homo sapiens
gcaacctgggtccaaataa

SEQ ID NO: 3372565 - DNA, 22 bp, Homo sapiens
gcaacgggattgaagggtcctg

SEQ ID NO: 3372566 - DNA, 22 bp, Homo sapiens
gcaacgtttacaccgactagcc

SEQ ID NO: 3372567 - DNA, 22 bp, Homo sapiens
gcaactcaaggactttgcagcc

SEQ ID NO: 3372568 - DNA, 14 bp, Homo sapiens
gcaactctccagcc

SEQ ID NO: 3372569 - DNA, 20 bp, Homo sapiens
gcaactgttatgaaataaag

SEQ ID NO: 3372570 - DNA, 21 bp, Homo sapiens
gcaactgttatgaaataaaga

SEQ ID NO: 3372571 - DNA, 16 bp, Homo sapiens
gcaacttcagtcctgg

SEQ ID NO: 3372572 - DNA, 15 bp, Homo sapiens
gcaacttccgctgag

SEQ ID NO: 3372573 - DNA, 14 bp, Homo sapiens
gcaacttcttctcc

SEQ ID NO: 3372574 - DNA, 20 bp, Homo sapiens
gcaacttcttctccatccct

SEQ ID NO: 3372575 - DNA, 17 bp, Homo sapiens
gcaactttaagcagctc

SEQ ID NO: 3372576 - DNA, 13 bp, Homo sapiens
gcaacttttaaag

SEQ ID NO: 3372577 - DNA, 18 bp, Homo sapiens
gcaagaaaaaaacttact

SEQ ID NO: 3372578 - DNA, 18 bp, Homo sapiens
gcaagaacttgtttacaa

SEQ ID NO: 3372579 - DNA, 20 bp, Homo sapiens
gcaagaacttgtttacaaca

SEQ ID NO: 3372580 - DNA, 13 bp, Homo sapiens
gcaagaagtagca

SEQ ID NO: 3372581 - DNA, 16 bp, Homo sapiens
gcaagaataaaaaaga

SEQ ID NO: 3372582 - DNA, 15 bp, Homo sapiens
gcaagaccagtcact

SEQ ID NO: 3372583 - DNA, 15 bp, Homo sapiens
gcaagaccagttgaa

SEQ ID NO: 3372584 - DNA, 14 bp, Homo sapiens
gcaagacctcatct

SEQ ID NO: 3372585 - DNA, 19 bp, Homo sapiens
gcaagagactgggagccac

SEQ ID NO: 3372586 - DNA, 14 bp, Homo sapiens
gcaagagagatgtt

SEQ ID NO: 3372587 - DNA, 19 bp, Homo sapiens
gcaagaggcaagctgaaat

SEQ ID NO: 3372588 - DNA, 19 bp, Homo sapiens
gcaagatagatttggaata

SEQ ID NO: 3372589 - DNA, 16 bp, Homo sapiens
gcaagatttaacacta

SEQ ID NO: 3372590 - DNA, 12 bp, Homo sapiens
gcaagcagcttt

SEQ ID NO: 3372591 - DNA, 16 bp, Homo sapiens
gcaagcaggacctggc

SEQ ID NO: 3372592 - DNA, 17 bp, Homo sapiens
gcaagcaggacctggca

SEQ ID NO: 3372593 - DNA, 13 bp, Homo sapiens
gcaagccccaggg

SEQ ID NO: 3372594 - DNA, 15 bp, Homo sapiens
gcaagccccagggcc

SEQ ID NO: 3372595 - DNA, 16 bp, Homo sapiens
gcaagccccagggcct

SEQ ID NO: 3372596 - DNA, 18 bp, Homo sapiens
gcaagccccagggcctgg

SEQ ID NO: 3372597 - DNA, 21 bp, Homo sapiens
gcaagccccagggcctggggg

SEQ ID NO: 3372598 - DNA, 14 bp, Homo sapiens
gcaagcccctcagc

SEQ ID NO: 3372599 - DNA, 16 bp, Homo sapiens
gcaagcgacgacagat

SEQ ID NO: 3372600 - DNA, 17 bp, Homo sapiens
gcaagctaggccccaga

SEQ ID NO: 3372601 - DNA, 18 bp, Homo sapiens
gcaagctaggccccagag

SEQ ID NO: 3372602 - DNA, 23 bp, Homo sapiens
gcaagctaggccccagaggccct

SEQ ID NO: 3372603 - DNA, 14 bp, Homo sapiens
gcaagctctcttgc

SEQ ID NO: 3372604 - DNA, 14 bp, Homo sapiens
gcaagctgaaattt

SEQ ID NO: 3372605 - DNA, 12 bp, Homo sapiens
gcaagctggcct

SEQ ID NO: 3372606 - DNA, 9 bp, Homo sapiens
gcaaggaaa

SEQ ID NO: 3372607 - DNA, 10 bp, Homo sapiens
gcaaggaaag

SEQ ID NO: 3372608 - DNA, 14 bp, Homo sapiens
gcaaggaccaggac

SEQ ID NO: 3372609 - DNA, 15 bp, Homo sapiens
gcaaggaccaggact

SEQ ID NO: 3372610 - DNA, 20 bp, Homo sapiens
gcaaggattacagaaactga

SEQ ID NO: 3372611 - DNA, 21 bp, Homo sapiens
gcaaggattacagaaactgat

SEQ ID NO: 3372612 - DNA, 23 bp, Homo sapiens
gcaaggattacagaaactgatgc

SEQ ID NO: 3372613 - DNA, 11 bp, Homo sapiens
gcaaggcaggt

SEQ ID NO: 3372614 - DNA, 19 bp, Homo sapiens
gcaaggcaggtgcctccag

SEQ ID NO: 3372615 - DNA, 21 bp, Homo sapiens
gcaaggcaggtgcctccaggt

SEQ ID NO: 3372616 - DNA, 14 bp, Homo sapiens
gcaaggcccacagg

SEQ ID NO: 3372617 - DNA, 15 bp, Homo sapiens
gcaaggccctgctgc

SEQ ID NO: 3372618 - DNA, 20 bp, Homo sapiens
gcaagggagaaaagagaaac

SEQ ID NO: 3372619 - DNA, 15 bp, Homo sapiens
gcaagggcatcaggc

SEQ ID NO: 3372620 - DNA, 19 bp, Homo sapiens
gcaagggcatcaggcactg

SEQ ID NO: 3372621 - DNA, 20 bp, Homo sapiens
gcaagggcatcaggcactgg

SEQ ID NO: 3372622 - DNA, 21 bp, Homo sapiens
gcaagggctccagcatccagc

SEQ ID NO: 3372623 - DNA, 21 bp, Homo sapiens
gcaaggggctgcatgacctac

SEQ ID NO: 3372624 - DNA, 23 bp, Homo sapiens
gcaagggggtgtcatctgaggag

SEQ ID NO: 3372625 - DNA, 22 bp, Homo sapiens
gcaaggtctccttactctgagc

SEQ ID NO: 3372626 - DNA, 19 bp, Homo sapiens
gcaagtagataaatatttg

SEQ ID NO: 3372627 - DNA, 15 bp, Homo sapiens
gcaagtcagaggatg

SEQ ID NO: 3372628 - DNA, 23 bp, Homo sapiens
gcaagtcagaggatggccagtgt

SEQ ID NO: 3372629 - DNA, 20 bp, Homo sapiens
gcaagtccctgactctctgt

SEQ ID NO: 3372630 - DNA, 13 bp, Homo sapiens
gcaagtctgtgag

SEQ ID NO: 3372631 - DNA, 18 bp, Homo sapiens
gcaagtgagagctgggtg

SEQ ID NO: 3372632 - DNA, 16 bp, Homo sapiens
gcaagtggatgggaat

SEQ ID NO: 3372633 - DNA, 15 bp, Homo sapiens
gcaagtgtctggagc

SEQ ID NO: 3372634 - DNA, 22 bp, Homo sapiens
gcaagtgtctggagcggctgct

SEQ ID NO: 3372635 - DNA, 16 bp, Homo sapiens
gcaagttcaatttgtt

SEQ ID NO: 3372636 - DNA, 22 bp, Homo sapiens
gcaagtttctagctagaaatat

SEQ ID NO: 3372637 - DNA, 12 bp, Homo sapiens
gcaataaaattt

SEQ ID NO: 3372638 - DNA, 21 bp, Homo sapiens
gcaataaaatttaaaaaataa

SEQ ID NO: 3372639 - DNA, 19 bp, Homo sapiens
gcaataaacgcattatcag

SEQ ID NO: 3372640 - DNA, 13 bp, Homo sapiens
gcaataaagtata

SEQ ID NO: 3372641 - DNA, 12 bp, Homo sapiens
gcaataaatgaa

SEQ ID NO: 3372642 - DNA, 20 bp, Homo sapiens
gcaataacctcaaagtgact

SEQ ID NO: 3372643 - DNA, 12 bp, Homo sapiens
gcaataacttct

SEQ ID NO: 3372644 - DNA, 20 bp, Homo sapiens
gcaataacttctatatttta

SEQ ID NO: 3372645 - DNA, 18 bp, Homo sapiens
gcaataatggtcccatcc

SEQ ID NO: 3372646 - DNA, 19 bp, Homo sapiens
gcaataatggtcccatcca

SEQ ID NO: 3372647 - DNA, 22 bp, Homo sapiens
gcaataatggtcccatccaggc

SEQ ID NO: 3372648 - DNA, 23 bp, Homo sapiens
gcaataatggtcccatccaggca

SEQ ID NO: 3372649 - DNA, 17 bp, Homo sapiens
gcaatactcatcagagc

SEQ ID NO: 3372650 - DNA, 22 bp, Homo sapiens
gcaatactcatcagagcagcta

SEQ ID NO: 3372651 - DNA, 14 bp, Homo sapiens
gcaatagagactgt

SEQ ID NO: 3372652 - DNA, 23 bp, Homo sapiens
gcaatagcagttataacagatgt

SEQ ID NO: 3372653 - DNA, 21 bp, Homo sapiens
gcaatatattaccagcaagaa

SEQ ID NO: 3372654 - DNA, 21 bp, Homo sapiens
gcaatatttatggatgcaaca

SEQ ID NO: 3372655 - DNA, 13 bp, Homo sapiens
gcaatcaaaaata

SEQ ID NO: 3372656 - DNA, 22 bp, Homo sapiens
gcaatcaaaaatatgtgttttt

SEQ ID NO: 3372657 - DNA, 15 bp, Homo sapiens
gcaatcaaatctgct

SEQ ID NO: 3372658 - DNA, 14 bp, Homo sapiens
gcaatcaatacagc

SEQ ID NO: 3372659 - DNA, 12 bp, Homo sapiens
gcaatcccagca

SEQ ID NO: 3372660 - DNA, 22 bp, Homo sapiens
gcaatctccttactgtgtttca

SEQ ID NO: 3372661 - DNA, 12 bp, Homo sapiens
gcaatctctctc

SEQ ID NO: 3372662 - DNA, 17 bp, Homo sapiens
gcaatctctctctgtgt

SEQ ID NO: 3372663 - DNA, 21 bp, Homo sapiens
gcaatctctctctgtgtcttt

SEQ ID NO: 3372664 - DNA, 15 bp, Homo sapiens
gcaatgaaaaattct

SEQ ID NO: 3372665 - DNA, 16 bp, Homo sapiens
gcaatgaaaaattctc

SEQ ID NO: 3372666 - DNA, 21 bp, Homo sapiens
gcaatgacatctcaggggcca

SEQ ID NO: 3372667 - DNA, 15 bp, Homo sapiens
gcaatgatgtccaga

SEQ ID NO: 3372668 - DNA, 13 bp, Homo sapiens
gcaatgctggctg

SEQ ID NO: 3372669 - DNA, 16 bp, Homo sapiens
gcaatgctgtactttt

SEQ ID NO: 3372670 - DNA, 16 bp, Homo sapiens
gcaattagcattctgt

SEQ ID NO: 3372671 - DNA, 16 bp, Homo sapiens
gcaattaggattttga

SEQ ID NO: 3372672 - DNA, 21 bp, Homo sapiens
gcaattcagtcctgggcaaag

SEQ ID NO: 3372673 - DNA, 14 bp, Homo sapiens
gcaattcatcccag

SEQ ID NO: 3372674 - DNA, 18 bp, Homo sapiens
gcaattgaattaaattag

SEQ ID NO: 3372675 - DNA, 21 bp, Homo sapiens
gcaattgctcatgttggccaa

SEQ ID NO: 3372676 - DNA, 18 bp, Homo sapiens
gcaatttcctggccctcc

SEQ ID NO: 3372677 - DNA, 20 bp, Homo sapiens
gcaatttcctggccctccac

SEQ ID NO: 3372678 - DNA, 19 bp, Homo sapiens
gcaatttctaatttttaag

SEQ ID NO: 3372679 - DNA, 19 bp, Homo sapiens
gcaattttaattgattatt

SEQ ID NO: 3372680 - DNA, 22 bp, Homo sapiens
gcaattttctaagcaatttctt

SEQ ID NO: 3372681 - DNA, 14 bp, Homo sapiens
gcaattttgtaacg

SEQ ID NO: 3372682 - DNA, 14 bp, Homo sapiens
gcacaaacattttt

SEQ ID NO: 3372683 - DNA, 16 bp, Homo sapiens
gcacaaacatttttca

SEQ ID NO: 3372684 - DNA, 14 bp, Homo sapiens
gcacaaacttcaga

SEQ ID NO: 3372685 - DNA, 13 bp, Homo sapiens
gcacaaatattta

SEQ ID NO: 3372686 - DNA, 15 bp, Homo sapiens
gcacaaggattgaaa

SEQ ID NO: 3372687 - DNA, 19 bp, Homo sapiens
gcacaaggctgaccaagag

SEQ ID NO: 3372688 - DNA, 19 bp, Homo sapiens
gcacaaggttggttgctaa

SEQ ID NO: 3372689 - DNA, 19 bp, Homo sapiens
gcacaatcactaaacttta

SEQ ID NO: 3372690 - DNA, 21 bp, Homo sapiens
gcacaatcactaaactttatt

SEQ ID NO: 3372691 - DNA, 22 bp, Homo sapiens
gcacaatcactaaactttattt

SEQ ID NO: 3372692 - DNA, 10 bp, Homo sapiens
gcacaatgaa

SEQ ID NO: 3372693 - DNA, 14 bp, Homo sapiens
gcacaatgaatgta

SEQ ID NO: 3372694 - DNA, 10 bp, Homo sapiens
gcacacacac

SEQ ID NO: 3372695 - DNA, 12 bp, Homo sapiens
gcacacacacaa

SEQ ID NO: 3372696 - DNA, 16 bp, Homo sapiens
gcacacaccagagccc

SEQ ID NO: 3372697 - DNA, 20 bp, Homo sapiens
gcacacaccagagcccacct

SEQ ID NO: 3372698 - DNA, 13 bp, Homo sapiens
gcacacagaaata

SEQ ID NO: 3372699 - DNA, 15 bp, Homo sapiens
gcacacagaaatata

SEQ ID NO: 3372700 - DNA, 18 bp, Homo sapiens
gcacacagaaatatatat

SEQ ID NO: 3372701 - DNA, 16 bp, Homo sapiens
gcacaccaccctcccg

SEQ ID NO: 3372702 - DNA, 12 bp, Homo sapiens
gcacaccactgc

SEQ ID NO: 3372703 - DNA, 14 bp, Homo sapiens
gcacaccactgccc

SEQ ID NO: 3372704 - DNA, 18 bp, Homo sapiens
gcacaccactgccctgcc

SEQ ID NO: 3372705 - DNA, 13 bp, Homo sapiens
gcacaccagccgc

SEQ ID NO: 3372706 - DNA, 15 bp, Homo sapiens
gcacaccagccgctg

SEQ ID NO: 3372707 - DNA, 15 bp, Homo sapiens
gcacacccaggtttg

SEQ ID NO: 3372708 - DNA, 14 bp, Homo sapiens
gcacaccgggcact

SEQ ID NO: 3372709 - DNA, 20 bp, Homo sapiens
gcacaccgggcactcagaag

SEQ ID NO: 3372710 - DNA, 13 bp, Homo sapiens
gcacactgaggcc

SEQ ID NO: 3372711 - DNA, 11 bp, Homo sapiens
gcacactgcca

SEQ ID NO: 3372712 - DNA, 20 bp, Homo sapiens
gcacactgccaaataaacag

SEQ ID NO: 3372713 - DNA, 16 bp, Homo sapiens
gcacagaagggctctt

SEQ ID NO: 3372714 - DNA, 22 bp, Homo sapiens
gcacagacaagcagcccttgct

SEQ ID NO: 3372715 - DNA, 23 bp, Homo sapiens
gcacagacttctggaaggctggc

SEQ ID NO: 3372716 - DNA, 12 bp, Homo sapiens
gcacagagccca

SEQ ID NO: 3372717 - DNA, 17 bp, Homo sapiens
gcacagagctctccagc

SEQ ID NO: 3372718 - DNA, 19 bp, Homo sapiens
gcacagagctctccagctc

SEQ ID NO: 3372719 - DNA, 17 bp, Homo sapiens
gcacagagggctaggga

SEQ ID NO: 3372720 - DNA, 13 bp, Homo sapiens
gcacagattttaa

SEQ ID NO: 3372721 - DNA, 17 bp, Homo sapiens
gcacagcagcctgcttc

SEQ ID NO: 3372722 - DNA, 13 bp, Homo sapiens
gcacagcagttcc

SEQ ID NO: 3372723 - DNA, 16 bp, Homo sapiens
gcacagccacccgtgg

SEQ ID NO: 3372724 - DNA, 11 bp, Homo sapiens
gcacagcccag

SEQ ID NO: 3372725 - DNA, 12 bp, Homo sapiens
gcacagcccagg

SEQ ID NO: 3372726 - DNA, 11 bp, Homo sapiens
gcacagccctg

SEQ ID NO: 3372727 - DNA, 13 bp, Homo sapiens
gcacagccctggg

SEQ ID NO: 3372728 - DNA, 21 bp, Homo sapiens
gcacagcggggccccagggct

SEQ ID NO: 3372729 - DNA, 14 bp, Homo sapiens
gcacagctccctgc

SEQ ID NO: 3372730 - DNA, 15 bp, Homo sapiens
gcacagcttagattt

SEQ ID NO: 3372731 - DNA, 16 bp, Homo sapiens
gcacagcttagatttc

SEQ ID NO: 3372732 - DNA, 16 bp, Homo sapiens
gcacagcttcatttcc

SEQ ID NO: 3372733 - DNA, 21 bp, Homo sapiens
gcacagcttcatttcctgtgt

SEQ ID NO: 3372734 - DNA, 19 bp, Homo sapiens
gcacagcttgacctgaggc

SEQ ID NO: 3372735 - DNA, 22 bp, Homo sapiens
gcacagcttgacctgaggctgt

SEQ ID NO: 3372736 - DNA, 18 bp, Homo sapiens
gcacaggaaaaggtagct

SEQ ID NO: 3372737 - DNA, 16 bp, Homo sapiens
gcacaggactgattct

SEQ ID NO: 3372738 - DNA, 16 bp, Homo sapiens
gcacaggatgctggcc

SEQ ID NO: 3372739 - DNA, 18 bp, Homo sapiens
gcacaggccccgaggagc

SEQ ID NO: 3372740 - DNA, 22 bp, Homo sapiens
gcacagggagtgcacatatcca

SEQ ID NO: 3372741 - DNA, 13 bp, Homo sapiens
gcacagggcacca

SEQ ID NO: 3372742 - DNA, 14 bp, Homo sapiens
gcacagggcaccag

SEQ ID NO: 3372743 - DNA, 17 bp, Homo sapiens
gcacagggcaccagagg

SEQ ID NO: 3372744 - DNA, 18 bp, Homo sapiens
gcacagggcaccagaggc

SEQ ID NO: 3372745 - DNA, 19 bp, Homo sapiens
gcacagggcaccagaggcc

SEQ ID NO: 3372746 - DNA, 23 bp, Homo sapiens
gcacagggcccgcagtgctggga

SEQ ID NO: 3372747 - DNA, 15 bp, Homo sapiens
gcacaggggccccag

SEQ ID NO: 3372748 - DNA, 18 bp, Homo sapiens
gcacagggtctgctcttt

SEQ ID NO: 3372749 - DNA, 15 bp, Homo sapiens
gcacaggtcccacct

SEQ ID NO: 3372750 - DNA, 19 bp, Homo sapiens
gcacaggtcgggcgcagga

SEQ ID NO: 3372751 - DNA, 12 bp, Homo sapiens
gcacagtgattt

SEQ ID NO: 3372752 - DNA, 21 bp, Homo sapiens
gcacagtgcatctcagcccac

SEQ ID NO: 3372753 - DNA, 13 bp, Homo sapiens
gcacagtggcaca

SEQ ID NO: 3372754 - DNA, 21 bp, Homo sapiens
gcacagtgggagctgagctgg

SEQ ID NO: 3372755 - DNA, 18 bp, Homo sapiens
gcacagtgtaatccaggg

SEQ ID NO: 3372756 - DNA, 13 bp, Homo sapiens
gcacagtgtgtga

SEQ ID NO: 3372757 - DNA, 21 bp, Homo sapiens
gcacagttgtctattctgagc

SEQ ID NO: 3372758 - DNA, 22 bp, Homo sapiens
gcacagttgtctattctgagcc

SEQ ID NO: 3372759 - DNA, 23 bp, Homo sapiens
gcacagttgtctattctgagcct

SEQ ID NO: 3372760 - DNA, 14 bp, Homo sapiens
gcacagtttgaaca

SEQ ID NO: 3372761 - DNA, 21 bp, Homo sapiens
gcacatagctatcaagtgtgc

SEQ ID NO: 3372762 - DNA, 21 bp, Homo sapiens
gcacatccattcccaagaaat

SEQ ID NO: 3372763 - DNA, 23 bp, Homo sapiens
gcacatccattcccaagaaatgc

SEQ ID NO: 3372764 - DNA, 21 bp, Homo sapiens
gcacatctgcattttcacccc

SEQ ID NO: 3372765 - DNA, 13 bp, Homo sapiens
gcacatgactcgg

SEQ ID NO: 3372766 - DNA, 19 bp, Homo sapiens
gcacatgctgagtctccca

SEQ ID NO: 3372767 - DNA, 22 bp, Homo sapiens
gcacatgctgagtctcccaagg

SEQ ID NO: 3372768 - DNA, 13 bp, Homo sapiens
gcacatgctggcc

SEQ ID NO: 3372769 - DNA, 18 bp, Homo sapiens
gcacatgctggccagcct

SEQ ID NO: 3372770 - DNA, 21 bp, Homo sapiens
gcacatgcttagcttatcttt

SEQ ID NO: 3372771 - DNA, 20 bp, Homo sapiens
gcacatgtaataaattcaaa

SEQ ID NO: 3372772 - DNA, 15 bp, Homo sapiens
gcacatgtgccacac

SEQ ID NO: 3372773 - DNA, 15 bp, Homo sapiens
gcacatgttcatata

SEQ ID NO: 3372774 - DNA, 16 bp, Homo sapiens
gcacatttctggattg

SEQ ID NO: 3372775 - DNA, 13 bp, Homo sapiens
gcaccaaagacat

SEQ ID NO: 3372776 - DNA, 15 bp, Homo sapiens
gcaccaaccacagca

SEQ ID NO: 3372777 - DNA, 13 bp, Homo sapiens
gcaccaccaagcc

SEQ ID NO: 3372778 - DNA, 14 bp, Homo sapiens
gcaccaccaagcca

SEQ ID NO: 3372779 - DNA, 12 bp, Homo sapiens
gcaccactgcac

SEQ ID NO: 3372780 - DNA, 16 bp, Homo sapiens
gcaccactgcactcca

SEQ ID NO: 3372781 - DNA, 19 bp, Homo sapiens
gcaccagagcaacctctca

SEQ ID NO: 3372782 - DNA, 13 bp, Homo sapiens
gcaccagaggccg

SEQ ID NO: 3372783 - DNA, 12 bp, Homo sapiens
gcaccagcatcc

SEQ ID NO: 3372784 - DNA, 12 bp, Homo sapiens
gcaccagccagc

SEQ ID NO: 3372785 - DNA, 13 bp, Homo sapiens
gcaccagccagcg

SEQ ID NO: 3372786 - DNA, 16 bp, Homo sapiens
gcaccagccccctgga

SEQ ID NO: 3372787 - DNA, 19 bp, Homo sapiens
gcaccagccccctggatgg

SEQ ID NO: 3372788 - DNA, 16 bp, Homo sapiens
gcaccagctctgtggc

SEQ ID NO: 3372789 - DNA, 23 bp, Homo sapiens
gcaccagctctgtggcctgtgtc

SEQ ID NO: 3372790 - DNA, 12 bp, Homo sapiens
gcaccagctgct

SEQ ID NO: 3372791 - DNA, 15 bp, Homo sapiens
gcaccagctgctctg

SEQ ID NO: 3372792 - DNA, 17 bp, Homo sapiens
gcaccagctgctctgcc

SEQ ID NO: 3372793 - DNA, 20 bp, Homo sapiens
gcaccagggcattcgggcca

SEQ ID NO: 3372794 - DNA, 16 bp, Homo sapiens
gcaccaggggtttctc

SEQ ID NO: 3372795 - DNA, 19 bp, Homo sapiens
gcaccaggggtttctcgca

SEQ ID NO: 3372796 - DNA, 19 bp, Homo sapiens
gcaccatgtgggcacggag

SEQ ID NO: 3372797 - DNA, 16 bp, Homo sapiens
gcaccattctcctgcc

SEQ ID NO: 3372798 - DNA, 15 bp, Homo sapiens
gcaccattctgactc

SEQ ID NO: 3372799 - DNA, 22 bp, Homo sapiens
gcacccacaaataaatgacaag

SEQ ID NO: 3372800 - DNA, 17 bp, Homo sapiens
gcacccactcaccaggg

SEQ ID NO: 3372801 - DNA, 18 bp, Homo sapiens
gcacccactcaccagggt

SEQ ID NO: 3372802 - DNA, 19 bp, Homo sapiens
gcacccactcaccagggtc

SEQ ID NO: 3372803 - DNA, 15 bp, Homo sapiens
gcacccagagcaccc

SEQ ID NO: 3372804 - DNA, 22 bp, Homo sapiens
gcacccagagcaccccctgctc

SEQ ID NO: 3372805 - DNA, 20 bp, Homo sapiens
gcacccatgacaatcacctt

SEQ ID NO: 3372806 - DNA, 14 bp, Homo sapiens
gcaccccagctacc

SEQ ID NO: 3372807 - DNA, 21 bp, Homo sapiens
gcacccccacaagctgtccct

SEQ ID NO: 3372808 - DNA, 16 bp, Homo sapiens
gcacccccacccacct

SEQ ID NO: 3372809 - DNA, 21 bp, Homo sapiens
gcacccccacccacctccacc

SEQ ID NO: 3372810 - DNA, 17 bp, Homo sapiens
gcacccccctgttctaa

SEQ ID NO: 3372811 - DNA, 18 bp, Homo sapiens
gcacccccctgttctaag

SEQ ID NO: 3372812 - DNA, 19 bp, Homo sapiens
gcaccccctgctccaccag

SEQ ID NO: 3372813 - DNA, 17 bp, Homo sapiens
gcaccccggcctcaggg

SEQ ID NO: 3372814 - DNA, 18 bp, Homo sapiens
gcaccccggcctcagggc

SEQ ID NO: 3372815 - DNA, 13 bp, Homo sapiens
gcacccctcccat

SEQ ID NO: 3372816 - DNA, 13 bp, Homo sapiens
gcaccccttccat

SEQ ID NO: 3372817 - DNA, 18 bp, Homo sapiens
gcaccccttctctcctcc

SEQ ID NO: 3372818 - DNA, 21 bp, Homo sapiens
gcaccccttctctcctcccca

SEQ ID NO: 3372819 - DNA, 15 bp, Homo sapiens
gcacccggcccctgc

SEQ ID NO: 3372820 - DNA, 17 bp, Homo sapiens
gcacccggcccctgctg

SEQ ID NO: 3372821 - DNA, 21 bp, Homo sapiens
gcaccctagttctacctcagg

SEQ ID NO: 3372822 - DNA, 17 bp, Homo sapiens
gcaccctcatacacaga

SEQ ID NO: 3372823 - DNA, 20 bp, Homo sapiens
gcaccctcatacacagaaac

SEQ ID NO: 3372824 - DNA, 16 bp, Homo sapiens
gcaccctccaccctgt

SEQ ID NO: 3372825 - DNA, 16 bp, Homo sapiens
gcaccctcccccgcag

SEQ ID NO: 3372826 - DNA, 18 bp, Homo sapiens
gcaccctggaaaggggag

SEQ ID NO: 3372827 - DNA, 23 bp, Homo sapiens
gcaccctggaaaggggagttgag

SEQ ID NO: 3372828 - DNA, 15 bp, Homo sapiens
gcaccctgggtgcca

SEQ ID NO: 3372829 - DNA, 19 bp, Homo sapiens
gcaccctgtagatgttcta

SEQ ID NO: 3372830 - DNA, 16 bp, Homo sapiens
gcacccttctttcctc

SEQ ID NO: 3372831 - DNA, 17 bp, Homo sapiens
gcacccttctttcctct

SEQ ID NO: 3372832 - DNA, 19 bp, Homo sapiens
gcacccttctttcctcttc

SEQ ID NO: 3372833 - DNA, 18 bp, Homo sapiens
gcaccgagtgatttccat

SEQ ID NO: 3372834 - DNA, 12 bp, Homo sapiens
gcaccgccgcca

SEQ ID NO: 3372835 - DNA, 16 bp, Homo sapiens
gcaccgccgccaccag

SEQ ID NO: 3372836 - DNA, 20 bp, Homo sapiens
gcaccgcttttgttctcgca

SEQ ID NO: 3372837 - DNA, 12 bp, Homo sapiens
gcaccggcgctg

SEQ ID NO: 3372838 - DNA, 17 bp, Homo sapiens
gcaccggcgctgcaggt

SEQ ID NO: 3372839 - DNA, 18 bp, Homo sapiens
gcaccggcgctgcaggta

SEQ ID NO: 3372840 - DNA, 16 bp, Homo sapiens
gcaccgggctccatgc

SEQ ID NO: 3372841 - DNA, 22 bp, Homo sapiens
gcaccgggctccatgcctctgg

SEQ ID NO: 3372842 - DNA, 23 bp, Homo sapiens
gcaccgggctccatgcctctgga

SEQ ID NO: 3372843 - DNA, 15 bp, Homo sapiens
gcaccgtcctcagca

SEQ ID NO: 3372844 - DNA, 18 bp, Homo sapiens
gcacctatagtcccagct

SEQ ID NO: 3372845 - DNA, 21 bp, Homo sapiens
gcacctatagtcccagctact

SEQ ID NO: 3372846 - DNA, 24 bp, Homo sapiens
gcacctcagaaagtcaccaggact

SEQ ID NO: 3372847 - DNA, 15 bp, Homo sapiens
gcacctccaggcctg

SEQ ID NO: 3372848 - DNA, 13 bp, Homo sapiens
gcacctcctgaga

SEQ ID NO: 3372849 - DNA, 15 bp, Homo sapiens
gcacctcctgagaag

SEQ ID NO: 3372850 - DNA, 17 bp, Homo sapiens
gcacctccttgtcactt

SEQ ID NO: 3372851 - DNA, 21 bp, Homo sapiens
gcacctcggggacaccagagc

SEQ ID NO: 3372852 - DNA, 16 bp, Homo sapiens
gcacctgaaccccatg

SEQ ID NO: 3372853 - DNA, 19 bp, Homo sapiens
gcacctgaaccccatgggc

SEQ ID NO: 3372854 - DNA, 22 bp, Homo sapiens
gcacctgccccctggtggacag

SEQ ID NO: 3372855 - DNA, 12 bp, Homo sapiens
gcacctgctgcg

SEQ ID NO: 3372856 - DNA, 18 bp, Homo sapiens
gcacctggcatcgcacca

SEQ ID NO: 3372857 - DNA, 14 bp, Homo sapiens
gcacctggcctgct

SEQ ID NO: 3372858 - DNA, 15 bp, Homo sapiens
gcacctgtagtccca

SEQ ID NO: 3372859 - DNA, 17 bp, Homo sapiens
gcacctgtagtcccagc

SEQ ID NO: 3372860 - DNA, 15 bp, Homo sapiens
gcacctgtccccacc

SEQ ID NO: 3372861 - DNA, 18 bp, Homo sapiens
gcacctgtccccaccctc

SEQ ID NO: 3372862 - DNA, 22 bp, Homo sapiens
gcacctgtgcccatggcttctg

SEQ ID NO: 3372863 - DNA, 21 bp, Homo sapiens
gcaccttaccaactttctgta

SEQ ID NO: 3372864 - DNA, 22 bp, Homo sapiens
gcacctttccttcaagccagca

SEQ ID NO: 3372865 - DNA, 11 bp, Homo sapiens
gcacgcacaca

SEQ ID NO: 3372866 - DNA, 14 bp, Homo sapiens
gcacgcacacacac

SEQ ID NO: 3372867 - DNA, 15 bp, Homo sapiens
gcacgcacacacaca

SEQ ID NO: 3372868 - DNA, 15 bp, Homo sapiens
gcacgctcgctgcca

SEQ ID NO: 3372869 - DNA, 16 bp, Homo sapiens
gcacgctcgctgccat

SEQ ID NO: 3372870 - DNA, 17 bp, Homo sapiens
gcacgtatacacccaga

SEQ ID NO: 3372871 - DNA, 17 bp, Homo sapiens
gcacgtggcctcttgag

SEQ ID NO: 3372872 - DNA, 15 bp, Homo sapiens
gcactaaagccagcc

SEQ ID NO: 3372873 - DNA, 23 bp, Homo sapiens
gcactaaagccagcctgaccttc

SEQ ID NO: 3372874 - DNA, 22 bp, Homo sapiens
gcactaaagtatgtaaagtatg

SEQ ID NO: 3372875 - DNA, 22 bp, Homo sapiens
gcactaagagaaaattgcacta

SEQ ID NO: 3372876 - DNA, 20 bp, Homo sapiens
gcactaaggccgtgtctctg

SEQ ID NO: 3372877 - DNA, 20 bp, Homo sapiens
gcactacctgaacattgtaa

SEQ ID NO: 3372878 - DNA, 17 bp, Homo sapiens
gcactactcagttatta

SEQ ID NO: 3372879 - DNA, 16 bp, Homo sapiens
gcactactcctctgca

SEQ ID NO: 3372880 - DNA, 19 bp, Homo sapiens
gcactactcctctgcagtg

SEQ ID NO: 3372881 - DNA, 15 bp, Homo sapiens
gcactactctgtgcc

SEQ ID NO: 3372882 - DNA, 18 bp, Homo sapiens
gcactactgacatgtggg

SEQ ID NO: 3372883 - DNA, 20 bp, Homo sapiens
gcactagagaatgcacagat

SEQ ID NO: 3372884 - DNA, 19 bp, Homo sapiens
gcactaggttcaattccct

SEQ ID NO: 3372885 - DNA, 21 bp, Homo sapiens
gcactagtttgattattatgt

SEQ ID NO: 3372886 - DNA, 22 bp, Homo sapiens
gcactagtttgattattatgtt

SEQ ID NO: 3372887 - DNA, 14 bp, Homo sapiens
gcactataatgtaa

SEQ ID NO: 3372888 - DNA, 22 bp, Homo sapiens
gcactatagcctaggtgacaga

SEQ ID NO: 3372889 - DNA, 19 bp, Homo sapiens
gcactatatgtttacacaa

SEQ ID NO: 3372890 - DNA, 16 bp, Homo sapiens
gcactattttatattt

SEQ ID NO: 3372891 - DNA, 17 bp, Homo sapiens
gcactattttatattta

SEQ ID NO: 3372892 - DNA, 17 bp, Homo sapiens
gcactcagaagacactg

SEQ ID NO: 3372893 - DNA, 13 bp, Homo sapiens
gcactcagccacg

SEQ ID NO: 3372894 - DNA, 23 bp, Homo sapiens
gcactcagccacgaccagcccct

SEQ ID NO: 3372895 - DNA, 20 bp, Homo sapiens
gcactcattttctataacag

SEQ ID NO: 3372896 - DNA, 16 bp, Homo sapiens
gcactccagcctgggc

SEQ ID NO: 3372897 - DNA, 17 bp, Homo sapiens
gcactccagcctggggg

SEQ ID NO: 3372898 - DNA, 17 bp, Homo sapiens
gcactcccacctgacac

SEQ ID NO: 3372899 - DNA, 22 bp, Homo sapiens
gcactcccacctgacacaccag

SEQ ID NO: 3372900 - DNA, 22 bp, Homo sapiens
gcactccccagagctgtgccag

SEQ ID NO: 3372901 - DNA, 15 bp, Homo sapiens
gcactccccttgcct

SEQ ID NO: 3372902 - DNA, 23 bp, Homo sapiens
gcactcccttggtggcaagagcc

SEQ ID NO: 3372903 - DNA, 12 bp, Homo sapiens
gcactctagatt

SEQ ID NO: 3372904 - DNA, 13 bp, Homo sapiens
gcactctagattc

SEQ ID NO: 3372905 - DNA, 15 bp, Homo sapiens
gcactctagattcca

SEQ ID NO: 3372906 - DNA, 23 bp, Homo sapiens
gcactctgagtttaccatttgta

SEQ ID NO: 3372907 - DNA, 20 bp, Homo sapiens
gcactgaaaacttagccaga

SEQ ID NO: 3372908 - DNA, 21 bp, Homo sapiens
gcactgaaaacttagccagag

SEQ ID NO: 3372909 - DNA, 16 bp, Homo sapiens
gcactgaagtttttga

SEQ ID NO: 3372910 - DNA, 17 bp, Homo sapiens
gcactgaagtttttgaa

SEQ ID NO: 3372911 - DNA, 14 bp, Homo sapiens
gcactgacccttcc

SEQ ID NO: 3372912 - DNA, 16 bp, Homo sapiens
gcactgactgggcata

SEQ ID NO: 3372913 - DNA, 13 bp, Homo sapiens
gcactgagccccc

SEQ ID NO: 3372914 - DNA, 11 bp, Homo sapiens
gcactgagggc

SEQ ID NO: 3372915 - DNA, 16 bp, Homo sapiens
gcactgagggccacac

SEQ ID NO: 3372916 - DNA, 13 bp, Homo sapiens
gcactgcatgcaa

SEQ ID NO: 3372917 - DNA, 18 bp, Homo sapiens
gcactgccttctcctctc

SEQ ID NO: 3372918 - DNA, 12 bp, Homo sapiens
gcactgctgttc

SEQ ID NO: 3372919 - DNA, 22 bp, Homo sapiens
gcactgctgttcctgctccatg

SEQ ID NO: 3372920 - DNA, 19 bp, Homo sapiens
gcactggcattgtccctgt

SEQ ID NO: 3372921 - DNA, 14 bp, Homo sapiens
gcactggccagaga

SEQ ID NO: 3372922 - DNA, 16 bp, Homo sapiens
gcactggccagagagg

SEQ ID NO: 3372923 - DNA, 20 bp, Homo sapiens
gcactggccagagagggccc

SEQ ID NO: 3372924 - DNA, 12 bp, Homo sapiens
gcactggcccag

SEQ ID NO: 3372925 - DNA, 17 bp, Homo sapiens
gcactggctctctccag

SEQ ID NO: 3372926 - DNA, 12 bp, Homo sapiens
gcactgggctgt

SEQ ID NO: 3372927 - DNA, 18 bp, Homo sapiens
gcactggggagcccgtct

SEQ ID NO: 3372928 - DNA, 18 bp, Homo sapiens
gcactgggttgcagggga

SEQ ID NO: 3372929 - DNA, 21 bp, Homo sapiens
gcactgggttgcaggggattg

SEQ ID NO: 3372930 - DNA, 23 bp, Homo sapiens
gcactggtgaactgagctgggca

SEQ ID NO: 3372931 - DNA, 17 bp, Homo sapiens
gcactggtttgttccct

SEQ ID NO: 3372932 - DNA, 14 bp, Homo sapiens
gcactgtgctaata

SEQ ID NO: 3372933 - DNA, 17 bp, Homo sapiens
gcactgttaatacacag

SEQ ID NO: 3372934 - DNA, 18 bp, Homo sapiens
gcactgttgatgtatctg

SEQ ID NO: 3372935 - DNA, 19 bp, Homo sapiens
gcactgttgatgtatctga

SEQ ID NO: 3372936 - DNA, 20 bp, Homo sapiens
gcactgttgcaaactcagtg

SEQ ID NO: 3372937 - DNA, 22 bp, Homo sapiens
gcacttaagcacaagcagagtg

SEQ ID NO: 3372938 - DNA, 16 bp, Homo sapiens
gcacttaatttgtaaa

SEQ ID NO: 3372939 - DNA, 22 bp, Homo sapiens
gcacttaatttgtaaacttctg

SEQ ID NO: 3372940 - DNA, 17 bp, Homo sapiens
gcacttacaccagtttg

SEQ ID NO: 3372941 - DNA, 21 bp, Homo sapiens
gcacttagcccaagaggtctg

SEQ ID NO: 3372942 - DNA, 17 bp, Homo sapiens
gcacttagctatcagaa

SEQ ID NO: 3372943 - DNA, 14 bp, Homo sapiens
gcacttatatagca

SEQ ID NO: 3372944 - DNA, 14 bp, Homo sapiens
gcacttatgtactt

SEQ ID NO: 3372945 - DNA, 15 bp, Homo sapiens
gcacttatgtacttg

SEQ ID NO: 3372946 - DNA, 17 bp, Homo sapiens
gcacttatgtacttgat

SEQ ID NO: 3372947 - DNA, 18 bp, Homo sapiens
gcacttattgaccatttt

SEQ ID NO: 3372948 - DNA, 19 bp, Homo sapiens
gcacttattgaccattttt

SEQ ID NO: 3372949 - DNA, 23 bp, Homo sapiens
gcacttattgaccattttttaat

SEQ ID NO: 3372950 - DNA, 11 bp, Homo sapiens
gcacttccaaa

SEQ ID NO: 3372951 - DNA, 22 bp, Homo sapiens
gcacttgagaaccagtctcctc

SEQ ID NO: 3372952 - DNA, 16 bp, Homo sapiens
gcacttgcagactcta

SEQ ID NO: 3372953 - DNA, 18 bp, Homo sapiens
gcacttgcgtcctgcaga

SEQ ID NO: 3372954 - DNA, 20 bp, Homo sapiens
gcacttgcgtcctgcagagg

SEQ ID NO: 3372955 - DNA, 15 bp, Homo sapiens
gcacttggcctcagc

SEQ ID NO: 3372956 - DNA, 17 bp, Homo sapiens
gcacttggcctcagctg

SEQ ID NO: 3372957 - DNA, 10 bp, Homo sapiens
gcacttgtat

SEQ ID NO: 3372958 - DNA, 14 bp, Homo sapiens
gcacttgtatttaa

SEQ ID NO: 3372959 - DNA, 17 bp, Homo sapiens
gcacttgtgattattta

SEQ ID NO: 3372960 - DNA, 23 bp, Homo sapiens
gcacttgtgattatttattattt

SEQ ID NO: 3372961 - DNA, 14 bp, Homo sapiens
gcactttagcagat

SEQ ID NO: 3372962 - DNA, 19 bp, Homo sapiens
gcactttccacttcttcct

SEQ ID NO: 3372963 - DNA, 16 bp, Homo sapiens
gcactttctaatgttt

SEQ ID NO: 3372964 - DNA, 17 bp, Homo sapiens
gcactttctaatgtttc

SEQ ID NO: 3372965 - DNA, 21 bp, Homo sapiens
gcactttctacaatgtgaact

SEQ ID NO: 3372966 - DNA, 17 bp, Homo sapiens
gcactttgaaatacctc

SEQ ID NO: 3372967 - DNA, 14 bp, Homo sapiens
gcactttgcactta

SEQ ID NO: 3372968 - DNA, 22 bp, Homo sapiens
gcactttgggaggccgaggcgg

SEQ ID NO: 3372969 - DNA, 20 bp, Homo sapiens
gcactttgggaggctgaggc

SEQ ID NO: 3372970 - DNA, 11 bp, Homo sapiens
gcactttgggg

SEQ ID NO: 3372971 - DNA, 15 bp, Homo sapiens
gcacttttgttattc

SEQ ID NO: 3372972 - DNA, 17 bp, Homo sapiens
gcacttttgttattcca

SEQ ID NO: 3372973 - DNA, 20 bp, Homo sapiens
gcacttttgttattccatca

SEQ ID NO: 3372974 - DNA, 20 bp, Homo sapiens
gcactttttaattcaccaaa

SEQ ID NO: 3372975 - DNA, 20 bp, Homo sapiens
gcactttttcgtgtggatct

SEQ ID NO: 3372976 - DNA, 18 bp, Homo sapiens
gcagaaaaatgtcattga

SEQ ID NO: 3372977 - DNA, 16 bp, Homo sapiens
gcagaaaacagagcct

SEQ ID NO: 3372978 - DNA, 21 bp, Homo sapiens
gcagaaaacagagcctgccta

SEQ ID NO: 3372979 - DNA, 22 bp, Homo sapiens
gcagaaaacagagcctgcctaa

SEQ ID NO: 3372980 - DNA, 16 bp, Homo sapiens
gcagaaaagaggagac

SEQ ID NO: 3372981 - DNA, 18 bp, Homo sapiens
gcagaaaataaaggaagc

SEQ ID NO: 3372982 - DNA, 19 bp, Homo sapiens
gcagaaacacacagtcaca

SEQ ID NO: 3372983 - DNA, 21 bp, Homo sapiens
gcagaaagctgtgaacaggct

SEQ ID NO: 3372984 - DNA, 23 bp, Homo sapiens
gcagaaaggaaaacctgaagact

SEQ ID NO: 3372985 - DNA, 12 bp, Homo sapiens
gcagaactgcca

SEQ ID NO: 3372986 - DNA, 17 bp, Homo sapiens
gcagaagaaagggtgga

SEQ ID NO: 3372987 - DNA, 16 bp, Homo sapiens
gcagaagacaccagag

SEQ ID NO: 3372988 - DNA, 16 bp, Homo sapiens
gcagaagcagggtacc

SEQ ID NO: 3372989 - DNA, 15 bp, Homo sapiens
gcagaagccctgatg

SEQ ID NO: 3372990 - DNA, 22 bp, Homo sapiens
gcagaaggaaagaagggggccc

SEQ ID NO: 3372991 - DNA, 23 bp, Homo sapiens
gcagaaggaaagaagggggccct

SEQ ID NO: 3372992 - DNA, 17 bp, Homo sapiens
gcagaatagcaaggtgc

SEQ ID NO: 3372993 - DNA, 16 bp, Homo sapiens
gcagaatgactccacc

SEQ ID NO: 3372994 - DNA, 13 bp, Homo sapiens
gcagaatgttttt

SEQ ID NO: 3372995 - DNA, 18 bp, Homo sapiens
gcagacaacaccttcctc

SEQ ID NO: 3372996 - DNA, 21 bp, Homo sapiens
gcagacaacaccttcctcctg

SEQ ID NO: 3372997 - DNA, 22 bp, Homo sapiens
gcagacaacaccttcctcctgc

SEQ ID NO: 3372998 - DNA, 23 bp, Homo sapiens
gcagacaacaccttcctcctgca

SEQ ID NO: 3372999 - DNA, 24 bp, Homo sapiens
gcagacaacaccttcctcctgcag

SEQ ID NO: 3373000 - DNA, 21 bp, Homo sapiens
gcagacacctggactgagcca

SEQ ID NO: 3373001 - DNA, 15 bp, Homo sapiens
gcagacagaggggat

SEQ ID NO: 3373002 - DNA, 17 bp, Homo sapiens
gcagacaggaggaatca

SEQ ID NO: 3373003 - DNA, 23 bp, Homo sapiens
gccatataagtttgaaggaaaca

SEQ ID NO: 3373004 - DNA, 19 bp, Homo sapiens
gccatatataacagataca

SEQ ID NO: 3373005 - DNA, 20 bp, Homo sapiens
gccatattctgttggccagt

SEQ ID NO: 3373006 - DNA, 15 bp, Homo sapiens
gccatcaaaatgctt

SEQ ID NO: 3373007 - DNA, 16 bp, Homo sapiens
gccatcaaaatgcttt

SEQ ID NO: 3373008 - DNA, 19 bp, Homo sapiens
gccatcacaggatgccagc

SEQ ID NO: 3373009 - DNA, 20 bp, Homo sapiens
gccatcacaggatgccagcc

SEQ ID NO: 3373010 - DNA, 21 bp, Homo sapiens
gccatcacaggatgccagccc

SEQ ID NO: 3373011 - DNA, 15 bp, Homo sapiens
gccatcaccgctggg

SEQ ID NO: 3373012 - DNA, 16 bp, Homo sapiens
gccatcaccgctgggt

SEQ ID NO: 3373013 - DNA, 18 bp, Homo sapiens
gccatcactagaagaaaa

SEQ ID NO: 3373014 - DNA, 20 bp, Homo sapiens
gccatcactagaagaaaagc

SEQ ID NO: 3373015 - DNA, 17 bp, Homo sapiens
gccatcatatcccctgt

SEQ ID NO: 3373016 - DNA, 20 bp, Homo sapiens
gccatcatatcccctgtgcc

SEQ ID NO: 3373017 - DNA, 20 bp, Homo sapiens
gccatccaaataagaaacct

SEQ ID NO: 3373018 - DNA, 14 bp, Homo sapiens
gccatccctcgtgg

SEQ ID NO: 3373019 - DNA, 13 bp, Homo sapiens
gccatccctgggc

SEQ ID NO: 3373020 - DNA, 14 bp, Homo sapiens
gccatccctgggcc

SEQ ID NO: 3373021 - DNA, 16 bp, Homo sapiens
gccatccctgggcccc

SEQ ID NO: 3373022 - DNA, 18 bp, Homo sapiens
gccatccctgggcccctc

SEQ ID NO: 3373023 - DNA, 21 bp, Homo sapiens
gccatccctgggcccctccac

SEQ ID NO: 3373024 - DNA, 15 bp, Homo sapiens
gccatcgtcctggga

SEQ ID NO: 3373025 - DNA, 16 bp, Homo sapiens
gccatcgtcctgggac

SEQ ID NO: 3373026 - DNA, 15 bp, Homo sapiens
gccatctagccagcc

SEQ ID NO: 3373027 - DNA, 16 bp, Homo sapiens
gccatctagccagccc

SEQ ID NO: 3373028 - DNA, 16 bp, Homo sapiens
gccatctccctcccca

SEQ ID NO: 3373029 - DNA, 22 bp, Homo sapiens
gccatctccctccccagaaaca

SEQ ID NO: 3373030 - DNA, 17 bp, Homo sapiens
gccatctgactgccaag

SEQ ID NO: 3373031 - DNA, 19 bp, Homo sapiens
gccatgagggacagggtct

SEQ ID NO: 3373032 - DNA, 15 bp, Homo sapiens
gccatgatagctggg

SEQ ID NO: 3373033 - DNA, 14 bp, Homo sapiens
gccatgatttgtcc

SEQ ID NO: 3373034 - DNA, 19 bp, Homo sapiens
gccatgatttgtcccagcc

SEQ ID NO: 3373035 - DNA, 14 bp, Homo sapiens
gccatgcaattcat

SEQ ID NO: 3373036 - DNA, 17 bp, Homo sapiens
gccatgccactgccagg

SEQ ID NO: 3373037 - DNA, 13 bp, Homo sapiens
gccatgcctcatg

SEQ ID NO: 3373038 - DNA, 13 bp, Homo sapiens
gccatgctgaggc

SEQ ID NO: 3373039 - DNA, 18 bp, Homo sapiens
gccatgctgaggcctggg

SEQ ID NO: 3373040 - DNA, 19 bp, Homo sapiens
gccatgctgaggcctgggc

SEQ ID NO: 3373041 - DNA, 16 bp, Homo sapiens
gccatgctgggaagac

SEQ ID NO: 3373042 - DNA, 13 bp, Homo sapiens
gccatgctgggcc

SEQ ID NO: 3373043 - DNA, 15 bp, Homo sapiens
gccatgctgggccac

SEQ ID NO: 3373044 - DNA, 16 bp, Homo sapiens
gccatggcgtgtccct

SEQ ID NO: 3373045 - DNA, 22 bp, Homo sapiens
gccatggcgtgtccctctcgga

SEQ ID NO: 3373046 - DNA, 13 bp, Homo sapiens
gccatggctcagg

SEQ ID NO: 3373047 - DNA, 17 bp, Homo sapiens
gccatggctcaggcaag

SEQ ID NO: 3373048 - DNA, 20 bp, Homo sapiens
gccatggctcaggcaagccc

SEQ ID NO: 3373049 - DNA, 14 bp, Homo sapiens
gccatgggacaggg

SEQ ID NO: 3373050 - DNA, 15 bp, Homo sapiens
gccatgggccagcct

SEQ ID NO: 3373051 - DNA, 16 bp, Homo sapiens
gccatgggcctcctgt

SEQ ID NO: 3373052 - DNA, 13 bp, Homo sapiens
gccatgggcctgg

SEQ ID NO: 3373053 - DNA, 19 bp, Homo sapiens
gccatgggcctgggcctgc

SEQ ID NO: 3373054 - DNA, 21 bp, Homo sapiens
gccatgtaaatccccactggg

SEQ ID NO: 3373055 - DNA, 22 bp, Homo sapiens
gccatgtaaatccccactggga

SEQ ID NO: 3373056 - DNA, 18 bp, Homo sapiens
gccatgtccaaagaggct

SEQ ID NO: 3373057 - DNA, 23 bp, Homo sapiens
gccatgtctgcagtgtgcccccc

SEQ ID NO: 3373058 - DNA, 15 bp, Homo sapiens
gccatgtgaagaggg

SEQ ID NO: 3373059 - DNA, 17 bp, Homo sapiens
gccatgtgcaccttggg

SEQ ID NO: 3373060 - DNA, 15 bp, Homo sapiens
gccatgttggccagg

SEQ ID NO: 3373061 - DNA, 17 bp, Homo sapiens
gccatgttggccaggct

SEQ ID NO: 3373062 - DNA, 18 bp, Homo sapiens
gccatgttggccaggctg

SEQ ID NO: 3373063 - DNA, 19 bp, Homo sapiens
gccatgttggccaggctgg

SEQ ID NO: 3373064 - DNA, 20 bp, Homo sapiens
gccatgttggccaggctggt

SEQ ID NO: 3373065 - DNA, 22 bp, Homo sapiens
gccatgttggccaggctggtct

SEQ ID NO: 3373066 - DNA, 14 bp, Homo sapiens
gccatgtttagtga

SEQ ID NO: 3373067 - DNA, 15 bp, Homo sapiens
gccattaaatgaata

SEQ ID NO: 3373068 - DNA, 20 bp, Homo sapiens
gccattagccagatttgtct

SEQ ID NO: 3373069 - DNA, 22 bp, Homo sapiens
gccattattttctgtcagatga

SEQ ID NO: 3373070 - DNA, 19 bp, Homo sapiens
gccattgccaccaggagaa

SEQ ID NO: 3373071 - DNA, 22 bp, Homo sapiens
gccattgggaccctccagtgct

SEQ ID NO: 3373072 - DNA, 14 bp, Homo sapiens
gccattgtctttat

SEQ ID NO: 3373073 - DNA, 18 bp, Homo sapiens
gccatttagcaataaata

SEQ ID NO: 3373074 - DNA, 18 bp, Homo sapiens
gccatttccccctcctca

SEQ ID NO: 3373075 - DNA, 15 bp, Homo sapiens
gccatttgctttttc

SEQ ID NO: 3373076 - DNA, 21 bp, Homo sapiens
gccattttattaaacattttc

SEQ ID NO: 3373077 - DNA, 23 bp, Homo sapiens
gccattttattaaacattttcat

SEQ ID NO: 3373078 - DNA, 13 bp, Homo sapiens
gccattttgtgaa

SEQ ID NO: 3373079 - DNA, 14 bp, Homo sapiens
gccattttgtgaat

SEQ ID NO: 3373080 - DNA, 18 bp, Homo sapiens
gccattttgtgaatggat

SEQ ID NO: 3373081 - DNA, 17 bp, Homo sapiens
gccatttttctataaat

SEQ ID NO: 3373082 - DNA, 18 bp, Homo sapiens
gcccaaaaatatggttga

SEQ ID NO: 3373083 - DNA, 17 bp, Homo sapiens
gcccaaaacccagggca

SEQ ID NO: 3373084 - DNA, 18 bp, Homo sapiens
gcccaaaacccagggcaa

SEQ ID NO: 3373085 - DNA, 14 bp, Homo sapiens
gcccaaacccttaa

SEQ ID NO: 3373086 - DNA, 21 bp, Homo sapiens
gcccaaagagaaatcacaggg

SEQ ID NO: 3373087 - DNA, 21 bp, Homo sapiens
gcccaaagagcacaaacattt

SEQ ID NO: 3373088 - DNA, 20 bp, Homo sapiens
gcccaaaggggacaggcctc

SEQ ID NO: 3373089 - DNA, 15 bp, Homo sapiens
gcccaaagtggggag

SEQ ID NO: 3373090 - DNA, 14 bp, Homo sapiens
gcccaacaccagcc

SEQ ID NO: 3373091 - DNA, 23 bp, Homo sapiens
gcccaagacagatgccccagagc

SEQ ID NO: 3373092 - DNA, 20 bp, Homo sapiens
gcccaagagcagagtctggg

SEQ ID NO: 3373093 - DNA, 22 bp, Homo sapiens
gcccaagagcagagtctgggcc

SEQ ID NO: 3373094 - DNA, 20 bp, Homo sapiens
gcccaagaggactgagactg

SEQ ID NO: 3373095 - DNA, 18 bp, Homo sapiens
gcccaagaggtctgagcc

SEQ ID NO: 3373096 - DNA, 18 bp, Homo sapiens
gcccaagccagaggctgg

SEQ ID NO: 3373097 - DNA, 15 bp, Homo sapiens
gcccaagcccaggcc

SEQ ID NO: 3373098 - DNA, 15 bp, Homo sapiens
gcccaaggtcccctc

SEQ ID NO: 3373099 - DNA, 17 bp, Homo sapiens
gcccaaggtgctgatgt

SEQ ID NO: 3373100 - DNA, 16 bp, Homo sapiens
gcccaagtcattgttt

SEQ ID NO: 3373101 - DNA, 19 bp, Homo sapiens
gcccaagtccaaatgttta

SEQ ID NO: 3373102 - DNA, 14 bp, Homo sapiens
gcccaagtccctgt

SEQ ID NO: 3373103 - DNA, 15 bp, Homo sapiens
gcccaagtccctgtt

SEQ ID NO: 3373104 - DNA, 20 bp, Homo sapiens
gcccaagttcatgcagctgt

SEQ ID NO: 3373105 - DNA, 18 bp, Homo sapiens
gcccaatgcatagagccc

SEQ ID NO: 3373106 - DNA, 19 bp, Homo sapiens
gcccaatgcatagagccct

SEQ ID NO: 3373107 - DNA, 14 bp, Homo sapiens
gcccacaccgcagg

SEQ ID NO: 3373108 - DNA, 20 bp, Homo sapiens
gcccacactatgcacagagc

SEQ ID NO: 3373109 - DNA, 22 bp, Homo sapiens
gcccacactatgcacagagccc

SEQ ID NO: 3373110 - DNA, 20 bp, Homo sapiens
gcccacagccgccggaagtg

SEQ ID NO: 3373111 - DNA, 24 bp, Homo sapiens
gcccacaggaggcaagcaagctct

SEQ ID NO: 3373112 - DNA, 18 bp, Homo sapiens
gcccacaggatcagtctg

SEQ ID NO: 3373113 - DNA, 14 bp, Homo sapiens
gcccacatcccagg

SEQ ID NO: 3373114 - DNA, 20 bp, Homo sapiens
gcccaccaccccctcaagcc

SEQ ID NO: 3373115 - DNA, 19 bp, Homo sapiens
gcccaccatcaccaccgcc

SEQ ID NO: 3373116 - DNA, 15 bp, Homo sapiens
gcccaccccctcaag

SEQ ID NO: 3373117 - DNA, 15 bp, Homo sapiens
gcccaccccctgccc

SEQ ID NO: 3373118 - DNA, 23 bp, Homo sapiens
gcccaccgtgggcagtgccaccc

SEQ ID NO: 3373119 - DNA, 10 bp, Homo sapiens
gcccacctcc

SEQ ID NO: 3373120 - DNA, 15 bp, Homo sapiens
gcccacctgcccatc

SEQ ID NO: 3373121 - DNA, 16 bp, Homo sapiens
gcccacctggccacct

SEQ ID NO: 3373122 - DNA, 17 bp, Homo sapiens
gcccacctggccacctg

SEQ ID NO: 3373123 - DNA, 20 bp, Homo sapiens
gcccacctggccacctgagg

SEQ ID NO: 3373124 - DNA, 13 bp, Homo sapiens
gcccaccttggct

SEQ ID NO: 3373125 - DNA, 16 bp, Homo sapiens
gcccaccttggctcaa

SEQ ID NO: 3373126 - DNA, 17 bp, Homo sapiens
gcccaccttggctcaag

SEQ ID NO: 3373127 - DNA, 16 bp, Homo sapiens
gcccacgatcccctcc

SEQ ID NO: 3373128 - DNA, 21 bp, Homo sapiens
gcccacgatcccctcccccaa

SEQ ID NO: 3373129 - DNA, 18 bp, Homo sapiens
gcccacgcagaggacgca

SEQ ID NO: 3373130 - DNA, 21 bp, Homo sapiens
gcccacgctggagtgcagtga

SEQ ID NO: 3373131 - DNA, 15 bp, Homo sapiens
gcccacggctaagag

SEQ ID NO: 3373132 - DNA, 16 bp, Homo sapiens
gcccactgcccacccc

SEQ ID NO: 3373133 - DNA, 19 bp, Homo sapiens
gcccactgcccaccccctc

SEQ ID NO: 3373134 - DNA, 23 bp, Homo sapiens
gcccactgcccaccccctcaagc

SEQ ID NO: 3373135 - DNA, 21 bp, Homo sapiens
gcccacttagccgtccatggc

SEQ ID NO: 3373136 - DNA, 23 bp, Homo sapiens
gcccacttagccgtccatggcac

SEQ ID NO: 3373137 - DNA, 13 bp, Homo sapiens
gcccacttctgcc

SEQ ID NO: 3373138 - DNA, 23 bp, Homo sapiens
gcccacttgtatcctctggttct

SEQ ID NO: 3373139 - DNA, 18 bp, Homo sapiens
gcccagaagaaaattctc

SEQ ID NO: 3373140 - DNA, 18 bp, Homo sapiens
gcccagacacagactggc

SEQ ID NO: 3373141 - DNA, 20 bp, Homo sapiens
gcccagacccctctggccag

SEQ ID NO: 3373142 - DNA, 21 bp, Homo sapiens
gcccagacccctctggccagg

SEQ ID NO: 3373143 - DNA, 14 bp, Homo sapiens
gcccagactacagg

SEQ ID NO: 3373144 - DNA, 15 bp, Homo sapiens
gcccagactctgagc

SEQ ID NO: 3373145 - DNA, 14 bp, Homo sapiens
gcccagagaacagc

SEQ ID NO: 3373146 - DNA, 12 bp, Homo sapiens
gcccagagactt

SEQ ID NO: 3373147 - DNA, 21 bp, Homo sapiens
gcccagagagggtggtgacct

SEQ ID NO: 3373148 - DNA, 18 bp, Homo sapiens
gcccagagcactttagca

SEQ ID NO: 3373149 - DNA, 15 bp, Homo sapiens
gcccagagcaggaag

SEQ ID NO: 3373150 - DNA, 18 bp, Homo sapiens
gcccagagcaggaagcat

SEQ ID NO: 3373151 - DNA, 16 bp, Homo sapiens
gcccagagccacctgg

SEQ ID NO: 3373152 - DNA, 20 bp, Homo sapiens
gcccagagggcccaggcagg

SEQ ID NO: 3373153 - DNA, 12 bp, Homo sapiens
gcccagaggtaa

SEQ ID NO: 3373154 - DNA, 16 bp, Homo sapiens
gcccagaggtaacaga

SEQ ID NO: 3373155 - DNA, 18 bp, Homo sapiens
gcccagatgaactgactg

SEQ ID NO: 3373156 - DNA, 14 bp, Homo sapiens
gcccagcaggagag

SEQ ID NO: 3373157 - DNA, 23 bp, Homo sapiens
gcccagcaggagagactgagcag

SEQ ID NO: 3373158 - DNA, 16 bp, Homo sapiens
gcccagcattgctggt

SEQ ID NO: 3373159 - DNA, 17 bp, Homo sapiens
gcccagccaaaccctgt

SEQ ID NO: 3373160 - DNA, 13 bp, Homo sapiens
gcccagccaggag

SEQ ID NO: 3373161 - DNA, 13 bp, Homo sapiens
gcccagccaggcc

SEQ ID NO: 3373162 - DNA, 17 bp, Homo sapiens
gcccagccaggccaaca

SEQ ID NO: 3373163 - DNA, 14 bp, Homo sapiens
gcccagcccagagc

SEQ ID NO: 3373164 - DNA, 18 bp, Homo sapiens
gcccagcccagagccacc

SEQ ID NO: 3373165 - DNA, 15 bp, Homo sapiens
gcccagccggcctct

SEQ ID NO: 3373166 - DNA, 18 bp, Homo sapiens
gcccagccggcctctctg

SEQ ID NO: 3373167 - DNA, 19 bp, Homo sapiens
gcccagccggcctctctgg

SEQ ID NO: 3373168 - DNA, 21 bp, Homo sapiens
gcccagccggcctctctggcc

SEQ ID NO: 3373169 - DNA, 24 bp, Homo sapiens
gcccagccggcctctctggcctcc

SEQ ID NO: 3373170 - DNA, 21 bp, Homo sapiens
gcccagcctgggagcccagag

SEQ ID NO: 3373171 - DNA, 14 bp, Homo sapiens
gcccagcgccaagt

SEQ ID NO: 3373172 - DNA, 15 bp, Homo sapiens
gcccagcgcggccag

SEQ ID NO: 3373173 - DNA, 16 bp, Homo sapiens
gcccagcgctctgcct

SEQ ID NO: 3373174 - DNA, 13 bp, Homo sapiens
gcccagctgcacc

SEQ ID NO: 3373175 - DNA, 13 bp, Homo sapiens
gcccagctgcctg

SEQ ID NO: 3373176 - DNA, 14 bp, Homo sapiens
gcccagctgcctgg

SEQ ID NO: 3373177 - DNA, 15 bp, Homo sapiens
gcccagctgcctgga

SEQ ID NO: 3373178 - DNA, 16 bp, Homo sapiens
gcccagctgcctggag

SEQ ID NO: 3373179 - DNA, 12 bp, Homo sapiens
gcccaggaagcc

SEQ ID NO: 3373180 - DNA, 13 bp, Homo sapiens
gcccaggaagccc

SEQ ID NO: 3373181 - DNA, 17 bp, Homo sapiens
gcccaggaagcccacac

SEQ ID NO: 3373182 - DNA, 19 bp, Homo sapiens
gcccaggaattagagaagc

SEQ ID NO: 3373183 - DNA, 16 bp, Homo sapiens
gcccaggaccagctgg

SEQ ID NO: 3373184 - DNA, 18 bp, Homo sapiens
gcccaggaccagctgggg

SEQ ID NO: 3373185 - DNA, 22 bp, Homo sapiens
gcccaggagacagaccacttgc

SEQ ID NO: 3373186 - DNA, 15 bp, Homo sapiens
gcccaggagagagaa

SEQ ID NO: 3373187 - DNA, 16 bp, Homo sapiens
gcccaggagagagaaa

SEQ ID NO: 3373188 - DNA, 16 bp, Homo sapiens
gcccaggagagagcta

SEQ ID NO: 3373189 - DNA, 22 bp, Homo sapiens
gcccaggagtttgaggctgcag

SEQ ID NO: 3373190 - DNA, 23 bp, Homo sapiens
gcccaggatactggcacagaggt

SEQ ID NO: 3373191 - DNA, 24 bp, Homo sapiens
gcccaggatatttctgagagtgaa

SEQ ID NO: 3373192 - DNA, 15 bp, Homo sapiens
gcccaggcagagctg

SEQ ID NO: 3373193 - DNA, 12 bp, Homo sapiens
gcccaggcaggt

SEQ ID NO: 3373194 - DNA, 13 bp, Homo sapiens
gcccaggcaggtc

SEQ ID NO: 3373195 - DNA, 14 bp, Homo sapiens
gcccaggcaggtct

SEQ ID NO: 3373196 - DNA, 20 bp, Homo sapiens
gcccaggcatctccttgggc

SEQ ID NO: 3373197 - DNA, 17 bp, Homo sapiens
gcccaggccacagccgc

SEQ ID NO: 3373198 - DNA, 14 bp, Homo sapiens
gcccaggccggcca

SEQ ID NO: 3373199 - DNA, 17 bp, Homo sapiens
gcccaggccggccagcc

SEQ ID NO: 3373200 - DNA, 21 bp, Homo sapiens
gcccaggccgttccccttggc

SEQ ID NO: 3373201 - DNA, 22 bp, Homo sapiens
gcccaggccgttccccttggct

SEQ ID NO: 3373202 - DNA, 21 bp, Homo sapiens
gcccaggcctacctcactctc

SEQ ID NO: 3373203 - DNA, 15 bp, Homo sapiens
gcccaggcctgggtt

SEQ ID NO: 3373204 - DNA, 19 bp, Homo sapiens
gcccaggctggagtgcagt

SEQ ID NO: 3373205 - DNA, 14 bp, Homo sapiens
gcccaggctggcgt

SEQ ID NO: 3373206 - DNA, 15 bp, Homo sapiens
gcccaggctggcgtg

SEQ ID NO: 3373207 - DNA, 17 bp, Homo sapiens
gcccaggggtgccccct

SEQ ID NO: 3373208 - DNA, 20 bp, Homo sapiens
gcccaggggtgccccctcct

SEQ ID NO: 3373209 - DNA, 14 bp, Homo sapiens
gcccagggtggact

SEQ ID NO: 3373210 - DNA, 17 bp, Homo sapiens
gcccaggtaccaccctt

SEQ ID NO: 3373211 - DNA, 14 bp, Homo sapiens
gcccaggtccctcc

SEQ ID NO: 3373212 - DNA, 13 bp, Homo sapiens
gcccagtccccca

SEQ ID NO: 3373213 - DNA, 21 bp, Homo sapiens
gcccagtgacaaagactcctc

SEQ ID NO: 3373214 - DNA, 17 bp, Homo sapiens
gcccagtgccactgccc

SEQ ID NO: 3373215 - DNA, 18 bp, Homo sapiens
gcccagtgttgtttgtaa

SEQ ID NO: 3373216 - DNA, 19 bp, Homo sapiens
gcccagtgttgtttgtaaa

SEQ ID NO: 3373217 - DNA, 15 bp, Homo sapiens
gcccagttgggtgga

SEQ ID NO: 3373218 - DNA, 15 bp, Homo sapiens
gcccatactcagcct

SEQ ID NO: 3373219 - DNA, 19 bp, Homo sapiens
gcccatactcagcctgctg

SEQ ID NO: 3373220 - DNA, 16 bp, Homo sapiens
gcccatactggttggc

SEQ ID NO: 3373221 - DNA, 19 bp, Homo sapiens
gcccatacttttggctcct

SEQ ID NO: 3373222 - DNA, 20 bp, Homo sapiens
gcccatccatagtaactgac

SEQ ID NO: 3373223 - DNA, 19 bp, Homo sapiens
gcccatccattaggccagc

SEQ ID NO: 3373224 - DNA, 20 bp, Homo sapiens
gcccatccattaggccagca

SEQ ID NO: 3373225 - DNA, 18 bp, Homo sapiens
gcccatccccaggcacct

SEQ ID NO: 3373226 - DNA, 12 bp, Homo sapiens
gcccatccctgc

SEQ ID NO: 3373227 - DNA, 12 bp, Homo sapiens
gcccatccttcc

SEQ ID NO: 3373228 - DNA, 21 bp, Homo sapiens
gcccatctcagcctcctgagc

SEQ ID NO: 3373229 - DNA, 18 bp, Homo sapiens
gcccatctcggagcatcc

SEQ ID NO: 3373230 - DNA, 20 bp, Homo sapiens
gcccatctcggagcatcccg

SEQ ID NO: 3373231 - DNA, 22 bp, Homo sapiens
gcccatctgcctgttctgagga

SEQ ID NO: 3373232 - DNA, 13 bp, Homo sapiens
gcccatgcccacc

SEQ ID NO: 3373233 - DNA, 19 bp, Homo sapiens
gcccatgcccacctgccca

SEQ ID NO: 3373234 - DNA, 15 bp, Homo sapiens
gcccatggcccccaa

SEQ ID NO: 3373235 - DNA, 19 bp, Homo sapiens
gcccatggcccccaataaa

SEQ ID NO: 3373236 - DNA, 18 bp, Homo sapiens
gcccatgtgtacattctg

SEQ ID NO: 3373237 - DNA, 21 bp, Homo sapiens
gcccatgtgtacattctgcct

SEQ ID NO: 3373238 - DNA, 16 bp, Homo sapiens
gcccatgtgtcccctc

SEQ ID NO: 3373239 - DNA, 18 bp, Homo sapiens
gcccatgtgtcccctcac

SEQ ID NO: 3373240 - DNA, 19 bp, Homo sapiens
gcccatgtgtcccctcact

SEQ ID NO: 3373241 - DNA, 22 bp, Homo sapiens
gcccatgtgtcccctcactctg

SEQ ID NO: 3373242 - DNA, 14 bp, Homo sapiens
gcccatgttctgcc

SEQ ID NO: 3373243 - DNA, 19 bp, Homo sapiens
gcccatgttctgcccccag

SEQ ID NO: 3373244 - DNA, 22 bp, Homo sapiens
gcccatgttctgcccccagccc

SEQ ID NO: 3373245 - DNA, 23 bp, Homo sapiens
gcccatgttctgcccccagccca

SEQ ID NO: 3373246 - DNA, 21 bp, Homo sapiens
gcccatttacacttttgagac

SEQ ID NO: 3373247 - DNA, 17 bp, Homo sapiens
gccccaaacaaatatgc

SEQ ID NO: 3373248 - DNA, 19 bp, Homo sapiens
gccccaaacaaatatgcaa

SEQ ID NO: 3373249 - DNA, 16 bp, Homo sapiens
gccccaagcagccagc

SEQ ID NO: 3373250 - DNA, 18 bp, Homo sapiens
gccccaagcagccagcca

SEQ ID NO: 3373251 - DNA, 23 bp, Homo sapiens
gccccaagcagccagccagtctt

SEQ ID NO: 3373252 - DNA, 16 bp, Homo sapiens
gccccaagtcctgaag

SEQ ID NO: 3373253 - DNA, 20 bp, Homo sapiens
gccccacagctacctgagac

SEQ ID NO: 3373254 - DNA, 18 bp, Homo sapiens
gccccacagttgtgttca

SEQ ID NO: 3373255 - DNA, 15 bp, Homo sapiens
gccccacccacccca

SEQ ID NO: 3373256 - DNA, 12 bp, Homo sapiens
gccccacccagg

SEQ ID NO: 3373257 - DNA, 19 bp, Homo sapiens
gccccacccccagccaggc

SEQ ID NO: 3373258 - DNA, 16 bp, Homo sapiens
gccccaccctgggccc

SEQ ID NO: 3373259 - DNA, 20 bp, Homo sapiens
gccccaccctgggccctggg

SEQ ID NO: 3373260 - DNA, 23 bp, Homo sapiens
gccccaccctgggccctgggctg

SEQ ID NO: 3373261 - DNA, 17 bp, Homo sapiens
gccccaccgccgtggag

SEQ ID NO: 3373262 - DNA, 21 bp, Homo sapiens
gccccaccggcgcgctcttcg

SEQ ID NO: 3373263 - DNA, 20 bp, Homo sapiens
gccccacctacttgtgactg

SEQ ID NO: 3373264 - DNA, 11 bp, Homo sapiens
gccccacctcc

SEQ ID NO: 3373265 - DNA, 13 bp, Homo sapiens
gccccactgatgc

SEQ ID NO: 3373266 - DNA, 14 bp, Homo sapiens
gccccactgccagc

SEQ ID NO: 3373267 - DNA, 23 bp, Homo sapiens
gccccactgccagcagcagcagg

SEQ ID NO: 3373268 - DNA, 15 bp, Homo sapiens
gccccagaaggcagg

SEQ ID NO: 3373269 - DNA, 20 bp, Homo sapiens
gccccagacaacagcccagg

SEQ ID NO: 3373270 - DNA, 18 bp, Homo sapiens
gccccagagatgccagcc

SEQ ID NO: 3373271 - DNA, 19 bp, Homo sapiens
gccccagagatgccagccc

SEQ ID NO: 3373272 - DNA, 14 bp, Homo sapiens
gccccagagctgtt

SEQ ID NO: 3373273 - DNA, 16 bp, Homo sapiens
gccccagaggccctgg

SEQ ID NO: 3373274 - DNA, 17 bp, Homo sapiens
gccccagaggccctgga

SEQ ID NO: 3373275 - DNA, 19 bp, Homo sapiens
gccccagaggccctggagg

SEQ ID NO: 3373276 - DNA, 20 bp, Homo sapiens
gccccagaggccctggaggt

SEQ ID NO: 3373277 - DNA, 22 bp, Homo sapiens
gccccagaggccctggaggtct

SEQ ID NO: 3373278 - DNA, 18 bp, Homo sapiens
gccccagatcaccagccc

SEQ ID NO: 3373279 - DNA, 15 bp, Homo sapiens
gccccagatctgcct

SEQ ID NO: 3373280 - DNA, 18 bp, Homo sapiens
gccccagatctgcctggg

SEQ ID NO: 3373281 - DNA, 23 bp, Homo sapiens
gccccagatctgcctgggcctgt

SEQ ID NO: 3373282 - DNA, 14 bp, Homo sapiens
gccccagcagccct

SEQ ID NO: 3373283 - DNA, 11 bp, Homo sapiens
gccccagccag

SEQ ID NO: 3373284 - DNA, 19 bp, Homo sapiens
gccccagccagagttcctg

SEQ ID NO: 3373285 - DNA, 23 bp, Homo sapiens
gccccagccccttctcccagcac

SEQ ID NO: 3373286 - DNA, 18 bp, Homo sapiens
gccccagccctgctgggg

SEQ ID NO: 3373287 - DNA, 13 bp, Homo sapiens
gccccagctctgg

SEQ ID NO: 3373288 - DNA, 19 bp, Homo sapiens
gccccagctgactgtggcc

SEQ ID NO: 3373289 - DNA, 22 bp, Homo sapiens
gccccaggaaaggcccagccac

SEQ ID NO: 3373290 - DNA, 16 bp, Homo sapiens
gccccaggccctccct

SEQ ID NO: 3373291 - DNA, 14 bp, Homo sapiens
gccccaggcctctg

SEQ ID NO: 3373292 - DNA, 12 bp, Homo sapiens
gccccaggcctg

SEQ ID NO: 3373293 - DNA, 12 bp, Homo sapiens
gccccagggcac

SEQ ID NO: 3373294 - DNA, 14 bp, Homo sapiens
gccccagggcctgg

SEQ ID NO: 3373295 - DNA, 15 bp, Homo sapiens
gccccagggcctggg

SEQ ID NO: 3373296 - DNA, 12 bp, Homo sapiens
gccccagggggg

SEQ ID NO: 3373297 - DNA, 15 bp, Homo sapiens
gccccaggggggcct

SEQ ID NO: 3373298 - DNA, 16 bp, Homo sapiens
gccccagggtcttccc

SEQ ID NO: 3373299 - DNA, 20 bp, Homo sapiens
gccccagggtcttccctacc

SEQ ID NO: 3373300 - DNA, 23 bp, Homo sapiens
gccccagggtcttccctacctca

SEQ ID NO: 3373301 - DNA, 17 bp, Homo sapiens
gccccagtcggccccat

SEQ ID NO: 3373302 - DNA, 14 bp, Homo sapiens
gccccagtcttcct

SEQ ID NO: 3373303 - DNA, 18 bp, Homo sapiens
gccccatcctcatccctg

SEQ ID NO: 3373304 - DNA, 16 bp, Homo sapiens
gccccatcggccaaga

SEQ ID NO: 3373305 - DNA, 16 bp, Homo sapiens
gccccatgcctgtcca

SEQ ID NO: 3373306 - DNA, 13 bp, Homo sapiens
gccccatgctctg

SEQ ID NO: 3373307 - DNA, 21 bp, Homo sapiens
gccccatgctctgccccaagc

SEQ ID NO: 3373308 - DNA, 22 bp, Homo sapiens
gccccatgctctgccccaagcc

SEQ ID NO: 3373309 - DNA, 15 bp, Homo sapiens
gccccattctgcctg

SEQ ID NO: 3373310 - DNA, 20 bp, Homo sapiens
gccccattctgcctgcccag

SEQ ID NO: 3373311 - DNA, 23 bp, Homo sapiens
gccccattctgcctgcccaggcc

SEQ ID NO: 3373312 - DNA, 17 bp, Homo sapiens
gcccccaacactccagg

SEQ ID NO: 3373313 - DNA, 23 bp, Homo sapiens
gcccccaaccccgcggtgctctg

SEQ ID NO: 3373314 - DNA, 16 bp, Homo sapiens
gcccccaacctcaggg

SEQ ID NO: 3373315 - DNA, 19 bp, Homo sapiens
gcccccaacctcagggctc

SEQ ID NO: 3373316 - DNA, 23 bp, Homo sapiens
gcccccaacctcagggctcccag

SEQ ID NO: 3373317 - DNA, 21 bp, Homo sapiens
gcccccaccactaggactctg

SEQ ID NO: 3373318 - DNA, 21 bp, Homo sapiens
gcccccaccccggggaccctg

SEQ ID NO: 3373319 - DNA, 16 bp, Homo sapiens
gcccccaccccttccc

SEQ ID NO: 3373320 - DNA, 21 bp, Homo sapiens
gcccccaccccttccccaggc

SEQ ID NO: 3373321 - DNA, 22 bp, Homo sapiens
gcccccaccccttccccaggcc

SEQ ID NO: 3373322 - DNA, 16 bp, Homo sapiens
gcccccacctctggtc

SEQ ID NO: 3373323 - DNA, 22 bp, Homo sapiens
gcccccacctctggtccacact

SEQ ID NO: 3373324 - DNA, 21 bp, Homo sapiens
gcccccacttgcctcttcctt

SEQ ID NO: 3373325 - DNA, 22 bp, Homo sapiens
gcccccagatagagctgggtgg

SEQ ID NO: 3373326 - DNA, 17 bp, Homo sapiens
gcccccagcccagggct

SEQ ID NO: 3373327 - DNA, 21 bp, Homo sapiens
gcccccagcccagggctcctg

SEQ ID NO: 3373328 - DNA, 21 bp, Homo sapiens
gcccccagccccggggtgagt

SEQ ID NO: 3373329 - DNA, 12 bp, Homo sapiens
gcccccagccta

SEQ ID NO: 3373330 - DNA, 13 bp, Homo sapiens
gcccccaggaaga

SEQ ID NO: 3373331 - DNA, 22 bp, Homo sapiens
gcccccaggattcccccagcca

SEQ ID NO: 3373332 - DNA, 14 bp, Homo sapiens
gcccccaggggcag

SEQ ID NO: 3373333 - DNA, 17 bp, Homo sapiens
gcccccagtccccaccc

SEQ ID NO: 3373334 - DNA, 20 bp, Homo sapiens
gcccccagtccccacccctg

SEQ ID NO: 3373335 - DNA, 22 bp, Homo sapiens
gcccccagtccccacccctgcc

SEQ ID NO: 3373336 - DNA, 15 bp, Homo sapiens
gcccccatctcccca

SEQ ID NO: 3373337 - DNA, 17 bp, Homo sapiens
gcccccatctccccagg

SEQ ID NO: 3373338 - DNA, 20 bp, Homo sapiens
gcccccatctccccaggcct

SEQ ID NO: 3373339 - DNA, 21 bp, Homo sapiens
gccccccaaggttctggttcc

SEQ ID NO: 3373340 - DNA, 12 bp, Homo sapiens
gccccccagcac

SEQ ID NO: 3373341 - DNA, 16 bp, Homo sapiens
gccccccagctcaggg

SEQ ID NO: 3373342 - DNA, 23 bp, Homo sapiens
gcccccccaacactgtgccctgg

SEQ ID NO: 3373343 - DNA, 16 bp, Homo sapiens
gccccccgaggctgct

SEQ ID NO: 3373344 - DNA, 18 bp, Homo sapiens
gccccccgcacagccacc

SEQ ID NO: 3373345 - DNA, 15 bp, Homo sapiens
gcccccgcctgccac

SEQ ID NO: 3373346 - DNA, 16 bp, Homo sapiens
gcccccgcctgccacc

SEQ ID NO: 3373347 - DNA, 15 bp, Homo sapiens
gccccctccaggaga

SEQ ID NO: 3373348 - DNA, 18 bp, Homo sapiens
gccccctcccactcttga

SEQ ID NO: 3373349 - DNA, 23 bp, Homo sapiens
gccccctccccggcaccctctgg

SEQ ID NO: 3373350 - DNA, 15 bp, Homo sapiens
gccccctccctggat

SEQ ID NO: 3373351 - DNA, 20 bp, Homo sapiens
gccccctccgccctgccact

SEQ ID NO: 3373352 - DNA, 19 bp, Homo sapiens
gccccctcctctagctgtg

SEQ ID NO: 3373353 - DNA, 12 bp, Homo sapiens
gccccctcctga

SEQ ID NO: 3373354 - DNA, 13 bp, Homo sapiens
gccccctggcctc

SEQ ID NO: 3373355 - DNA, 14 bp, Homo sapiens
gccccctggcctct

SEQ ID NO: 3373356 - DNA, 21 bp, Homo sapiens
gccccctggtggacagtcctg

SEQ ID NO: 3373357 - DNA, 22 bp, Homo sapiens
gccccctggtggacagtcctgg

SEQ ID NO: 3373358 - DNA, 21 bp, Homo sapiens
gccccctgtacatttgtgctc

SEQ ID NO: 3373359 - DNA, 13 bp, Homo sapiens
gcccccttgccct

SEQ ID NO: 3373360 - DNA, 16 bp, Homo sapiens
gcccccttgccctccg

SEQ ID NO: 3373361 - DNA, 23 bp, Homo sapiens
gccccgaggccttctctgaagga

SEQ ID NO: 3373362 - DNA, 14 bp, Homo sapiens
gccccgccagggct

SEQ ID NO: 3373363 - DNA, 15 bp, Homo sapiens
gccccgccagggctg

SEQ ID NO: 3373364 - DNA, 19 bp, Homo sapiens
gccccgccagggctgggga

SEQ ID NO: 3373365 - DNA, 13 bp, Homo sapiens
gccccgcccacac

SEQ ID NO: 3373366 - DNA, 21 bp, Homo sapiens
gccccgcccccagtccccacc

SEQ ID NO: 3373367 - DNA, 14 bp, Homo sapiens
gccccgccctcagg

SEQ ID NO: 3373368 - DNA, 13 bp, Homo sapiens
gccccgctgggat

SEQ ID NO: 3373369 - DNA, 23 bp, Homo sapiens
gccccgctgggatttcttcgctg

SEQ ID NO: 3373370 - DNA, 16 bp, Homo sapiens
gccccggccacctctg

SEQ ID NO: 3373371 - DNA, 18 bp, Homo sapiens
gccccggccacctctgcg

SEQ ID NO: 3373372 - DNA, 22 bp, Homo sapiens
gccccgggacccacggagccct

SEQ ID NO: 3373373 - DNA, 15 bp, Homo sapiens
gccccgggcaaaggg

SEQ ID NO: 3373374 - DNA, 16 bp, Homo sapiens
gccccgggcaaagggt

SEQ ID NO: 3373375 - DNA, 13 bp, Homo sapiens
gccccggggctgg

SEQ ID NO: 3373376 - DNA, 14 bp, Homo sapiens
gccccggggctggc

SEQ ID NO: 3373377 - DNA, 19 bp, Homo sapiens
gccccggggtgagtccatt

SEQ ID NO: 3373378 - DNA, 20 bp, Homo sapiens
gccccgtggtgacatttccc

SEQ ID NO: 3373379 - DNA, 16 bp, Homo sapiens
gccccgtgtgcacacc

SEQ ID NO: 3373380 - DNA, 15 bp, Homo sapiens
gccccgttccctgtc

SEQ ID NO: 3373381 - DNA, 18 bp, Homo sapiens
gccccgttccctgtcaga

SEQ ID NO: 3373382 - DNA, 21 bp, Homo sapiens
gcccctagaaacccaagctcc

SEQ ID NO: 3373383 - DNA, 22 bp, Homo sapiens
gcccctaggatgctgcagcaga

SEQ ID NO: 3373384 - DNA, 15 bp, Homo sapiens
gcccctaggctgctg

SEQ ID NO: 3373385 - DNA, 20 bp, Homo sapiens
gcccctcagagccctgccct

SEQ ID NO: 3373386 - DNA, 13 bp, Homo sapiens
gcccctcagccct

SEQ ID NO: 3373387 - DNA, 18 bp, Homo sapiens
gcccctcagcccttgccc

SEQ ID NO: 3373388 - DNA, 14 bp, Homo sapiens
gcccctcccccatc

SEQ ID NO: 3373389 - DNA, 16 bp, Homo sapiens
gcccctcccccatctc

SEQ ID NO: 3373390 - DNA, 14 bp, Homo sapiens
gcccctccctctgc

SEQ ID NO: 3373391 - DNA, 16 bp, Homo sapiens
gcccctccctctgccc

SEQ ID NO: 3373392 - DNA, 12 bp, Homo sapiens
gcccctcccttc

SEQ ID NO: 3373393 - DNA, 17 bp, Homo sapiens
gcccctcctagacccag

SEQ ID NO: 3373394 - DNA, 18 bp, Homo sapiens
gcccctcgccagcttctc

SEQ ID NO: 3373395 - DNA, 22 bp, Homo sapiens
gcccctcgccagcttctcctgc

SEQ ID NO: 3373396 - DNA, 15 bp, Homo sapiens
gcccctctcaccaaa

SEQ ID NO: 3373397 - DNA, 17 bp, Homo sapiens
gcccctctccttcttag

SEQ ID NO: 3373398 - DNA, 19 bp, Homo sapiens
gcccctctggtcgctcctg

SEQ ID NO: 3373399 - DNA, 21 bp, Homo sapiens
gcccctcttattcctctaggc

SEQ ID NO: 3373400 - DNA, 18 bp, Homo sapiens
gcccctgaggactggaga

SEQ ID NO: 3373401 - DNA, 18 bp, Homo sapiens
gcccctgatcactcccag

SEQ ID NO: 3373402 - DNA, 15 bp, Homo sapiens
gcccctgcacaggca

SEQ ID NO: 3373403 - DNA, 16 bp, Homo sapiens
gcccctgcacaggcac

SEQ ID NO: 3373404 - DNA, 23 bp, Homo sapiens
gcccctgcagcacggacaataaa

SEQ ID NO: 3373405 - DNA, 23 bp, Homo sapiens
gcccctgcatccccttggctgtg

SEQ ID NO: 3373406 - DNA, 13 bp, Homo sapiens
gcccctgccaccc

SEQ ID NO: 3373407 - DNA, 15 bp, Homo sapiens
gcccctgccaccctg

SEQ ID NO: 3373408 - DNA, 21 bp, Homo sapiens
gcccctgccccagcccaagtc

SEQ ID NO: 3373409 - DNA, 13 bp, Homo sapiens
gcccctgcccggc

SEQ ID NO: 3373410 - DNA, 15 bp, Homo sapiens
gcccctgctggttca

SEQ ID NO: 3373411 - DNA, 16 bp, Homo sapiens
gcccctgctggttcag

SEQ ID NO: 3373412 - DNA, 13 bp, Homo sapiens
gcccctgctgtct

SEQ ID NO: 3373413 - DNA, 14 bp, Homo sapiens
gcccctgcttctcc

SEQ ID NO: 3373414 - DNA, 16 bp, Homo sapiens
gcccctgcttctccag

SEQ ID NO: 3373415 - DNA, 15 bp, Homo sapiens
gcccctggagccaga

SEQ ID NO: 3373416 - DNA, 17 bp, Homo sapiens
gcccctggcccatctca

SEQ ID NO: 3373417 - DNA, 20 bp, Homo sapiens
gcccctgggatgggaccagg

SEQ ID NO: 3373418 - DNA, 22 bp, Homo sapiens
gcccctgggatgggaccaggga

SEQ ID NO: 3373419 - DNA, 11 bp, Homo sapiens
gcccctgggct

SEQ ID NO: 3373420 - DNA, 18 bp, Homo sapiens
gcccctgggcttggcctg

SEQ ID NO: 3373421 - DNA, 21 bp, Homo sapiens
gcccctgggcttggcctgctg

SEQ ID NO: 3373422 - DNA, 12 bp, Homo sapiens
gcccctggggcc

SEQ ID NO: 3373423 - DNA, 21 bp, Homo sapiens
gcccctgggtgggtggtgggg

SEQ ID NO: 3373424 - DNA, 22 bp, Homo sapiens
gcccctgggtgggtggtgggga

SEQ ID NO: 3373425 - DNA, 18 bp, Homo sapiens
gcccctggtgccctgaga

SEQ ID NO: 3373426 - DNA, 19 bp, Homo sapiens
gcccctggtgccctgagac

SEQ ID NO: 3373427 - DNA, 15 bp, Homo sapiens
gcccctgtcccaccc

SEQ ID NO: 3373428 - DNA, 16 bp, Homo sapiens
gccccttaagggttga

SEQ ID NO: 3373429 - DNA, 14 bp, Homo sapiens
gccccttcctgggt

SEQ ID NO: 3373430 - DNA, 13 bp, Homo sapiens
gccccttggctgg

SEQ ID NO: 3373431 - DNA, 22 bp, Homo sapiens
gccccttgggcatccacccagt

SEQ ID NO: 3373432 - DNA, 19 bp, Homo sapiens
gccccttttacttttttat

SEQ ID NO: 3373433 - DNA, 15 bp, Homo sapiens
gcccgacagtgccat

SEQ ID NO: 3373434 - DNA, 18 bp, Homo sapiens
gcccgagctgtttatgtt

SEQ ID NO: 3373435 - DNA, 22 bp, Homo sapiens
gcccgagctgtttatgttttta

SEQ ID NO: 3373436 - DNA, 18 bp, Homo sapiens
gcccgagtgcggcgtgga

SEQ ID NO: 3373437 - DNA, 20 bp, Homo sapiens
gcccgagtgcggcgtggaga

SEQ ID NO: 3373438 - DNA, 21 bp, Homo sapiens
gcccgagtgcggcgtggagac

SEQ ID NO: 3373439 - DNA, 24 bp, Homo sapiens
gcccgagtgcggcgtggagactgg

SEQ ID NO: 3373440 - DNA, 17 bp, Homo sapiens
gcccgcacagcagcctg

SEQ ID NO: 3373441 - DNA, 21 bp, Homo sapiens
gcccgcaccccggcctcaggg

SEQ ID NO: 3373442 - DNA, 22 bp, Homo sapiens
gcccgcaccccggcctcagggc

SEQ ID NO: 3373443 - DNA, 20 bp, Homo sapiens
gcccgcaggaactgggctgg

SEQ ID NO: 3373444 - DNA, 14 bp, Homo sapiens
gcccgcagtgctgg

SEQ ID NO: 3373445 - DNA, 15 bp, Homo sapiens
gcccgcagtgctggg

SEQ ID NO: 3373446 - DNA, 20 bp, Homo sapiens
gcccgcagtgctgggaccag

SEQ ID NO: 3373447 - DNA, 14 bp, Homo sapiens
gcccgcccctgcag

SEQ ID NO: 3373448 - DNA, 15 bp, Homo sapiens
gcccgcccctgcagc

SEQ ID NO: 3373449 - DNA, 23 bp, Homo sapiens
gcccgcgggagacagcttctctg

SEQ ID NO: 3373450 - DNA, 16 bp, Homo sapiens
gcccgctcccaacccc

SEQ ID NO: 3373451 - DNA, 19 bp, Homo sapiens
gcccgctcccaacccccct

SEQ ID NO: 3373452 - DNA, 22 bp, Homo sapiens
gcccgctcccaacccccctcct

SEQ ID NO: 3373453 - DNA, 14 bp, Homo sapiens
gcccgctgcaatgc

SEQ ID NO: 3373454 - DNA, 23 bp, Homo sapiens
gcccgcttttgttcttccccaca

SEQ ID NO: 3373455 - DNA, 16 bp, Homo sapiens
gcccggattctgggag

SEQ ID NO: 3373456 - DNA, 14 bp, Homo sapiens
gcccggccacaccc

SEQ ID NO: 3373457 - DNA, 17 bp, Homo sapiens
gcccggccagcgggcac

SEQ ID NO: 3373458 - DNA, 12 bp, Homo sapiens
gcccggccggcc

SEQ ID NO: 3373459 - DNA, 15 bp, Homo sapiens
gcccggccggcctgg

SEQ ID NO: 3373460 - DNA, 13 bp, Homo sapiens
gcccggctccagg

SEQ ID NO: 3373461 - DNA, 17 bp, Homo sapiens
gcccgggaactcctgcc

SEQ ID NO: 3373462 - DNA, 13 bp, Homo sapiens
gcccgggagccta

SEQ ID NO: 3373463 - DNA, 18 bp, Homo sapiens
gcccgggctgcctgggct

SEQ ID NO: 3373464 - DNA, 15 bp, Homo sapiens
gcccggtggcggcag

SEQ ID NO: 3373465 - DNA, 17 bp, Homo sapiens
gcccggtggcggcaggg

SEQ ID NO: 3373466 - DNA, 18 bp, Homo sapiens
gcccgtcatgttcctcaa

SEQ ID NO: 3373467 - DNA, 16 bp, Homo sapiens
gcccgtcctgcctgtg

SEQ ID NO: 3373468 - DNA, 13 bp, Homo sapiens
gcccgtgaagcag

SEQ ID NO: 3373469 - DNA, 22 bp, Homo sapiens
gcccgtgaagcagtgcctcgag

SEQ ID NO: 3373470 - DNA, 21 bp, Homo sapiens
gcccgtgcccccgcctgccac

SEQ ID NO: 3373471 - DNA, 16 bp, Homo sapiens
gcccgtgcccgcagga

SEQ ID NO: 3373472 - DNA, 23 bp, Homo sapiens
gcccgtggtggcggtggctgccc

SEQ ID NO: 3373473 - DNA, 14 bp, Homo sapiens
gccctaagggagtg

SEQ ID NO: 3373474 - DNA, 21 bp, Homo sapiens
gccctacagaggtctctgccg

SEQ ID NO: 3373475 - DNA, 14 bp, Homo sapiens
gccctactccactg

SEQ ID NO: 3373476 - DNA, 23 bp, Homo sapiens
gccctactcggatggggcacgga

SEQ ID NO: 3373477 - DNA, 16 bp, Homo sapiens
gccctagcccagactc

SEQ ID NO: 3373478 - DNA, 17 bp, Homo sapiens
gccctagcccagactct

SEQ ID NO: 3373479 - DNA, 19 bp, Homo sapiens
gccctagcccagcgctctg

SEQ ID NO: 3373480 - DNA, 21 bp, Homo sapiens
gccctagcccagcgctctgcc

SEQ ID NO: 3373481 - DNA, 17 bp, Homo sapiens
gccctaggcccctccta

SEQ ID NO: 3373482 - DNA, 15 bp, Homo sapiens
gccctatttttgcaa

SEQ ID NO: 3373483 - DNA, 19 bp, Homo sapiens
gccctcaacaggcccaggg

SEQ ID NO: 3373484 - DNA, 21 bp, Homo sapiens
gccctcaacaggcccagggag

SEQ ID NO: 3373485 - DNA, 23 bp, Homo sapiens
gccctcaacaggcccagggaggg

SEQ ID NO: 3373486 - DNA, 22 bp, Homo sapiens
gccctcaactattctgttccac

SEQ ID NO: 3373487 - DNA, 18 bp, Homo sapiens
gccctcaagtaaaagaaa

SEQ ID NO: 3373488 - DNA, 19 bp, Homo sapiens
gccctcaggggacttgaat

SEQ ID NO: 3373489 - DNA, 21 bp, Homo sapiens
gccctcatctatgaggaaagg

SEQ ID NO: 3373490 - DNA, 23 bp, Homo sapiens
gccctcatcttgaagggcccagg

SEQ ID NO: 3373491 - DNA, 18 bp, Homo sapiens
gccctcatggcccctctg

SEQ ID NO: 3373492 - DNA, 18 bp, Homo sapiens
gccctccccatggagcca

SEQ ID NO: 3373493 - DNA, 14 bp, Homo sapiens
gccctccccctcaa

SEQ ID NO: 3373494 - DNA, 16 bp, Homo sapiens
gccctccccctcaacc

SEQ ID NO: 3373495 - DNA, 23 bp, Homo sapiens
gccctcccccttccccttctgtg

SEQ ID NO: 3373496 - DNA, 13 bp, Homo sapiens
gccctcccctccc

SEQ ID NO: 3373497 - DNA, 17 bp, Homo sapiens
gccctcccctcccctgc

SEQ ID NO: 3373498 - DNA, 20 bp, Homo sapiens
gccctcccctcccctgctgc

SEQ ID NO: 3373499 - DNA, 22 bp, Homo sapiens
gccctcccctccggactggtgc

SEQ ID NO: 3373500 - DNA, 19 bp, Homo sapiens
gccctccctccccagctcc

SEQ ID NO: 3373501 - DNA, 14 bp, Homo sapiens
gccctccctctccc

SEQ ID NO: 3373502 - DNA, 19 bp, Homo sapiens
gccctccctgactccctgt

SEQ ID NO: 3373503 - DNA, 21 bp, Homo sapiens
gccctccctgactccctgtgg

SEQ ID NO: 3373504 - DNA, 22 bp, Homo sapiens
gccctccctgactccctgtggg

SEQ ID NO: 3373505 - DNA, 15 bp, Homo sapiens
gccctccctgcccct

SEQ ID NO: 3373506 - DNA, 22 bp, Homo sapiens
gccctccgaccacttccagggg

SEQ ID NO: 3373507 - DNA, 18 bp, Homo sapiens
gccctccgcgaaaatagt

SEQ ID NO: 3373508 - DNA, 14 bp, Homo sapiens
gccctcctcgggcc

SEQ ID NO: 3373509 - DNA, 12 bp, Homo sapiens
gccctcctggac

SEQ ID NO: 3373510 - DNA, 18 bp, Homo sapiens
gccctcctgtgctggggg

SEQ ID NO: 3373511 - DNA, 13 bp, Homo sapiens
gccctcctttctg

SEQ ID NO: 3373512 - DNA, 20 bp, Homo sapiens
gccctcctttctgtgcccta

SEQ ID NO: 3373513 - DNA, 23 bp, Homo sapiens
gccctcgacactcaccatgaagc

SEQ ID NO: 3373514 - DNA, 14 bp, Homo sapiens
gccctcggtggctg

SEQ ID NO: 3373515 - DNA, 20 bp, Homo sapiens
gccctcggtggctgcacaga

SEQ ID NO: 3373516 - DNA, 18 bp, Homo sapiens
gccctcgtggccagcccg

SEQ ID NO: 3373517 - DNA, 20 bp, Homo sapiens
gccctcgtggccagcccggc

SEQ ID NO: 3373518 - DNA, 23 bp, Homo sapiens
gccctctatttattagccaactg

SEQ ID NO: 3373519 - DNA, 16 bp, Homo sapiens
gccctctccttcctta

SEQ ID NO: 3373520 - DNA, 15 bp, Homo sapiens
gccctctctctgggc

SEQ ID NO: 3373521 - DNA, 15 bp, Homo sapiens
gccctctctgctcct

SEQ ID NO: 3373522 - DNA, 20 bp, Homo sapiens
gccctctgggtccctcctct

SEQ ID NO: 3373523 - DNA, 14 bp, Homo sapiens
gccctcttcctgac

SEQ ID NO: 3373524 - DNA, 16 bp, Homo sapiens
gccctcttcctgacga

SEQ ID NO: 3373525 - DNA, 12 bp, Homo sapiens
gccctgacctcc

SEQ ID NO: 3373526 - DNA, 16 bp, Homo sapiens
gccctgaccttggctg

SEQ ID NO: 3373527 - DNA, 22 bp, Homo sapiens
gccctgaccttggctgactggg

SEQ ID NO: 3373528 - DNA, 14 bp, Homo sapiens
gccctgaggcctga

SEQ ID NO: 3373529 - DNA, 14 bp, Homo sapiens
gccctgaggggcag

SEQ ID NO: 3373530 - DNA, 13 bp, Homo sapiens
gccctgaggtgtg

SEQ ID NO: 3373531 - DNA, 24 bp, Homo sapiens
gccctgaggtgtgggggctgcagc

SEQ ID NO: 3373532 - DNA, 17 bp, Homo sapiens
gccctgcacctgtgcag

SEQ ID NO: 3373533 - DNA, 21 bp, Homo sapiens
gccctgcacgtatacacccag

SEQ ID NO: 3373534 - DNA, 21 bp, Homo sapiens
gccctgcccccatctccccag

SEQ ID NO: 3373535 - DNA, 23 bp, Homo sapiens
gccctgcccccatctccccaggc

SEQ ID NO: 3373536 - DNA, 14 bp, Homo sapiens
gccctgccccctgg

SEQ ID NO: 3373537 - DNA, 13 bp, Homo sapiens
gccctgcccctag

SEQ ID NO: 3373538 - DNA, 20 bp, Homo sapiens
gccctgccctgaggaaggag

SEQ ID NO: 3373539 - DNA, 18 bp, Homo sapiens
gccctgcctcctgggaag

SEQ ID NO: 3373540 - DNA, 22 bp, Homo sapiens
gccctgcctcctgggaagatga

SEQ ID NO: 3373541 - DNA, 17 bp, Homo sapiens
gccctgcgttggagcca

SEQ ID NO: 3373542 - DNA, 19 bp, Homo sapiens
gccctgcgttggagccact

SEQ ID NO: 3373543 - DNA, 20 bp, Homo sapiens
gccctgcgttggagccactc

SEQ ID NO: 3373544 - DNA, 9 bp, Homo sapiens
gccctgcta

SEQ ID NO: 3373545 - DNA, 19 bp, Homo sapiens
gccctgctcctccctggct

SEQ ID NO: 3373546 - DNA, 21 bp, Homo sapiens
gccctgctcctccctggctgc

SEQ ID NO: 3373547 - DNA, 15 bp, Homo sapiens
gccctgctcctgcag

SEQ ID NO: 3373548 - DNA, 16 bp, Homo sapiens
gccctgctcctgcagc

SEQ ID NO: 3373549 - DNA, 17 bp, Homo sapiens
gccctgctcctgcagca

SEQ ID NO: 3373550 - DNA, 12 bp, Homo sapiens
gccctgctgccc

SEQ ID NO: 3373551 - DNA, 22 bp, Homo sapiens
gccctgctttgggctgccctgg

SEQ ID NO: 3373552 - DNA, 11 bp, Homo sapiens
gccctgctttt

SEQ ID NO: 3373553 - DNA, 16 bp, Homo sapiens
gccctgctttttttct

SEQ ID NO: 3373554 - DNA, 18 bp, Homo sapiens
gccctgctttttttctta

SEQ ID NO: 3373555 - DNA, 21 bp, Homo sapiens
gccctggagccaactgctgct

SEQ ID NO: 3373556 - DNA, 14 bp, Homo sapiens
gccctggaggtctc

SEQ ID NO: 3373557 - DNA, 20 bp, Homo sapiens
gccctggaggtctccagggg

SEQ ID NO: 3373558 - DNA, 14 bp, Homo sapiens
gccctggcagcagc

SEQ ID NO: 3373559 - DNA, 15 bp, Homo sapiens
gccctggcagcagca

SEQ ID NO: 3373560 - DNA, 19 bp, Homo sapiens
gccctggcaggatgaccct

SEQ ID NO: 3373561 - DNA, 15 bp, Homo sapiens
gccctggccagccct

SEQ ID NO: 3373562 - DNA, 18 bp, Homo sapiens
gccctggccagcccttcc

SEQ ID NO: 3373563 - DNA, 19 bp, Homo sapiens
gccctggccagcccttcct

SEQ ID NO: 3373564 - DNA, 14 bp, Homo sapiens
gccctggccaggac

SEQ ID NO: 3373565 - DNA, 20 bp, Homo sapiens
gccctggcctcccctgccac

SEQ ID NO: 3373566 - DNA, 15 bp, Homo sapiens
gccctggctcccaca

SEQ ID NO: 3373567 - DNA, 19 bp, Homo sapiens
gccctggctcccacaggcc

SEQ ID NO: 3373568 - DNA, 15 bp, Homo sapiens
gccctggctgggttc

SEQ ID NO: 3373569 - DNA, 18 bp, Homo sapiens
gccctgggaaccactccc

SEQ ID NO: 3373570 - DNA, 13 bp, Homo sapiens
gccctgggctgga

SEQ ID NO: 3373571 - DNA, 14 bp, Homo sapiens
gccctgggctggaa

SEQ ID NO: 3373572 - DNA, 16 bp, Homo sapiens
gccctgggctggactg

SEQ ID NO: 3373573 - DNA, 21 bp, Homo sapiens
gccctggggtttgaagctgac

SEQ ID NO: 3373574 - DNA, 14 bp, Homo sapiens
gccctggtccaggg

SEQ ID NO: 3373575 - DNA, 16 bp, Homo sapiens
gccctggtccagggaa

SEQ ID NO: 3373576 - DNA, 23 bp, Homo sapiens
gccctggtccagggaagctggcc

SEQ ID NO: 3373577 - DNA, 15 bp, Homo sapiens
gccctggtgctgcca

SEQ ID NO: 3373578 - DNA, 18 bp, Homo sapiens
gccctggtggagaaagca

SEQ ID NO: 3373579 - DNA, 20 bp, Homo sapiens
gccctggtggcagtgggagc

SEQ ID NO: 3373580 - DNA, 22 bp, Homo sapiens
gccctggtggcagtgggagctg

SEQ ID NO: 3373581 - DNA, 18 bp, Homo sapiens
gccctggtttcactggcc

SEQ ID NO: 3373582 - DNA, 13 bp, Homo sapiens
gccctgtccctcc

SEQ ID NO: 3373583 - DNA, 23 bp, Homo sapiens
gccctgtccctcccacctctgtg

SEQ ID NO: 3373584 - DNA, 17 bp, Homo sapiens
gccctgtccctgtcccc

SEQ ID NO: 3373585 - DNA, 20 bp, Homo sapiens
gccctgtccctgtccccctc

SEQ ID NO: 3373586 - DNA, 17 bp, Homo sapiens
gccctgtcgagacactt

SEQ ID NO: 3373587 - DNA, 18 bp, Homo sapiens
gccctgtgtaggggcagg

SEQ ID NO: 3373588 - DNA, 16 bp, Homo sapiens
gccctgttcatgtgcc

SEQ ID NO: 3373589 - DNA, 19 bp, Homo sapiens
gccctgttcatgtgcctct

SEQ ID NO: 3373590 - DNA, 21 bp, Homo sapiens
gccctgttctgggtgcagctg

SEQ ID NO: 3373591 - DNA, 14 bp, Homo sapiens
gcccttcactgcca

SEQ ID NO: 3373592 - DNA, 15 bp, Homo sapiens
gcccttcactgccat

SEQ ID NO: 3373593 - DNA, 18 bp, Homo sapiens
gcccttccctgtccctct

SEQ ID NO: 3373594 - DNA, 21 bp, Homo sapiens
gcccttcctctcactcctgcc

SEQ ID NO: 3373595 - DNA, 16 bp, Homo sapiens
gcccttcctctccact

SEQ ID NO: 3373596 - DNA, 19 bp, Homo sapiens
gcccttcctctccactgcc

SEQ ID NO: 3373597 - DNA, 21 bp, Homo sapiens
gcccttcctctccactgcctt

SEQ ID NO: 3373598 - DNA, 17 bp, Homo sapiens
gcccttcggtcacctgt

SEQ ID NO: 3373599 - DNA, 15 bp, Homo sapiens
gcccttctcttatct

SEQ ID NO: 3373600 - DNA, 21 bp, Homo sapiens
gcccttctgattcccctccac

SEQ ID NO: 3373601 - DNA, 20 bp, Homo sapiens
gcccttgcaatcttctactt

SEQ ID NO: 3373602 - DNA, 20 bp, Homo sapiens
gcccttgcccccatccctcg

SEQ ID NO: 3373603 - DNA, 23 bp, Homo sapiens
gcccttgctttcggagctcctgt

SEQ ID NO: 3373604 - DNA, 13 bp, Homo sapiens
gcccttggaataa

SEQ ID NO: 3373605 - DNA, 18 bp, Homo sapiens
gcccttgggacagccaga

SEQ ID NO: 3373606 - DNA, 17 bp, Homo sapiens
gcccttggggcctggct

SEQ ID NO: 3373607 - DNA, 20 bp, Homo sapiens
gcccttggggcctggcttgc

SEQ ID NO: 3373608 - DNA, 17 bp, Homo sapiens
gcccttgtcctgccagc

SEQ ID NO: 3373609 - DNA, 18 bp, Homo sapiens
gcccttgtcctgccagct

SEQ ID NO: 3373610 - DNA, 12 bp, Homo sapiens
gccctttcccct

SEQ ID NO: 3373611 - DNA, 20 bp, Homo sapiens
gccctttccccttcccctcc

SEQ ID NO: 3373612 - DNA, 15 bp, Homo sapiens
gccctttcctcctca

SEQ ID NO: 3373613 - DNA, 16 bp, Homo sapiens
gccctttcctcctcag

SEQ ID NO: 3373614 - DNA, 17 bp, Homo sapiens
gccgaagctctggctga

SEQ ID NO: 3373615 - DNA, 19 bp, Homo sapiens
gccgaagctctggctgaac

SEQ ID NO: 3373616 - DNA, 15 bp, Homo sapiens
gccgaaggtgcctca

SEQ ID NO: 3373617 - DNA, 16 bp, Homo sapiens
gccgaaggtgcctcag

SEQ ID NO: 3373618 - DNA, 20 bp, Homo sapiens
gccgaaggtgcctcagactc

SEQ ID NO: 3373619 - DNA, 14 bp, Homo sapiens
gccgaatcccccag

SEQ ID NO: 3373620 - DNA, 17 bp, Homo sapiens
gccgaatcccccaggga

SEQ ID NO: 3373621 - DNA, 18 bp, Homo sapiens
gccgacttggagactcct

SEQ ID NO: 3373622 - DNA, 23 bp, Homo sapiens
gccgactttgtaccccccaaccc

SEQ ID NO: 3373623 - DNA, 13 bp, Homo sapiens
gccgagacctcaa

SEQ ID NO: 3373624 - DNA, 16 bp, Homo sapiens
gccgagatcacgccac

SEQ ID NO: 3373625 - DNA, 20 bp, Homo sapiens
gccgagccgggcctggggct

SEQ ID NO: 3373626 - DNA, 17 bp, Homo sapiens
gccgagcgttcccagca

SEQ ID NO: 3373627 - DNA, 12 bp, Homo sapiens
gccgaggaccct

SEQ ID NO: 3373628 - DNA, 16 bp, Homo sapiens
gccgaggagccaggca

SEQ ID NO: 3373629 - DNA, 16 bp, Homo sapiens
gccgaggcccagcggg

SEQ ID NO: 3373630 - DNA, 16 bp, Homo sapiens
gccgagggtcctggct

SEQ ID NO: 3373631 - DNA, 20 bp, Homo sapiens
gccgagggtcctggctcctg

SEQ ID NO: 3373632 - DNA, 16 bp, Homo sapiens
gccgagtcacacccgg

SEQ ID NO: 3373633 - DNA, 17 bp, Homo sapiens
gccgatatactctagat

SEQ ID NO: 3373634 - DNA, 18 bp, Homo sapiens
gccgcaccatttctgtca

SEQ ID NO: 3373635 - DNA, 18 bp, Homo sapiens
gccgcaccctgcacctgc

SEQ ID NO: 3373636 - DNA, 15 bp, Homo sapiens
gccgcagacgggcac

SEQ ID NO: 3373637 - DNA, 18 bp, Homo sapiens
gccgcagacgggcacaga

SEQ ID NO: 3373638 - DNA, 20 bp, Homo sapiens
gccgcagacgggcacagaca

SEQ ID NO: 3373639 - DNA, 13 bp, Homo sapiens
gccgcagctcttg

SEQ ID NO: 3373640 - DNA, 15 bp, Homo sapiens
gccgcagctcttgcc

SEQ ID NO: 3373641 - DNA, 20 bp, Homo sapiens
gccgcagctcttgcccttcc

SEQ ID NO: 3373642 - DNA, 18 bp, Homo sapiens
gccgcattggtgactcac

SEQ ID NO: 3373643 - DNA, 20 bp, Homo sapiens
gccgccacccccatcttcca

SEQ ID NO: 3373644 - DNA, 21 bp, Homo sapiens
gccgccacccccatcttccac

SEQ ID NO: 3373645 - DNA, 22 bp, Homo sapiens
gccgccacctgaggtgggctgg

SEQ ID NO: 3373646 - DNA, 17 bp, Homo sapiens
gccgccacggcctggct

SEQ ID NO: 3373647 - DNA, 18 bp, Homo sapiens
gccgccattgccaccagg

SEQ ID NO: 3373648 - DNA, 21 bp, Homo sapiens
gccgccattgccaccaggaga

SEQ ID NO: 3373649 - DNA, 14 bp, Homo sapiens
gccgccccagcccc

SEQ ID NO: 3373650 - DNA, 22 bp, Homo sapiens
gccgccttccttgaccttcctc

SEQ ID NO: 3373651 - DNA, 13 bp, Homo sapiens
gccgcctttgggt

SEQ ID NO: 3373652 - DNA, 17 bp, Homo sapiens
gccgctaggagagactg

SEQ ID NO: 3373653 - DNA, 18 bp, Homo sapiens
gccgctaggagagactga

SEQ ID NO: 3373654 - DNA, 22 bp, Homo sapiens
gccgctaggagagactgaaagc

SEQ ID NO: 3373655 - DNA, 12 bp, Homo sapiens
gccgctgcaggg

SEQ ID NO: 3373656 - DNA, 18 bp, Homo sapiens
gccgctgcagggctccca

SEQ ID NO: 3373657 - DNA, 16 bp, Homo sapiens
gccgctgccgctgcac

SEQ ID NO: 3373658 - DNA, 16 bp, Homo sapiens
gccgcttttctcctct

SEQ ID NO: 3373659 - DNA, 15 bp, Homo sapiens
gccggaaccacaggg

SEQ ID NO: 3373660 - DNA, 16 bp, Homo sapiens
gccggaaccacagggc

SEQ ID NO: 3373661 - DNA, 11 bp, Homo sapiens
gccggcaaccc

SEQ ID NO: 3373662 - DNA, 13 bp, Homo sapiens
gccggcacagggt

SEQ ID NO: 3373663 - DNA, 21 bp, Homo sapiens
gccggcacagggtctgctctt

SEQ ID NO: 3373664 - DNA, 22 bp, Homo sapiens
gccggcagcgggcggaggggat

SEQ ID NO: 3373665 - DNA, 19 bp, Homo sapiens
gccggccaatggaaacctc

SEQ ID NO: 3373666 - DNA, 19 bp, Homo sapiens
gccggcctctctggcctcc

SEQ ID NO: 3373667 - DNA, 16 bp, Homo sapiens
gccggctgtggagcaa

SEQ ID NO: 3373668 - DNA, 19 bp, Homo sapiens
gccggcttcatgccagcta

SEQ ID NO: 3373669 - DNA, 14 bp, Homo sapiens
gccgggcaggtcct

SEQ ID NO: 3373670 - DNA, 17 bp, Homo sapiens
gccgggcaggtcctgcc

SEQ ID NO: 3373671 - DNA, 12 bp, Homo sapiens
gccgggcctggg

SEQ ID NO: 3373672 - DNA, 22 bp, Homo sapiens
gccgggcgtggtggcgggcacc

SEQ ID NO: 3373673 - DNA, 17 bp, Homo sapiens
gccgggggaggggcgcg

SEQ ID NO: 3373674 - DNA, 23 bp, Homo sapiens
gccgggggaggggcgcgggaggg

SEQ ID NO: 3373675 - DNA, 16 bp, Homo sapiens
gccggtagaggctccc

SEQ ID NO: 3373676 - DNA, 22 bp, Homo sapiens
gccggtagaggctccccagggc

SEQ ID NO: 3373677 - DNA, 23 bp, Homo sapiens
gccggtagaggctccccagggct

SEQ ID NO: 3373678 - DNA, 15 bp, Homo sapiens
gccggtcgggcagcc

SEQ ID NO: 3373679 - DNA, 19 bp, Homo sapiens
gccggtctgcaagtcagag

SEQ ID NO: 3373680 - DNA, 14 bp, Homo sapiens
gccgtaatttaact

SEQ ID NO: 3373681 - DNA, 15 bp, Homo sapiens
gccgtaccccaccct

SEQ ID NO: 3373682 - DNA, 18 bp, Homo sapiens
gccgtaccccaccctcag

SEQ ID NO: 3373683 - DNA, 19 bp, Homo sapiens
gccgtaccccaccctcagc

SEQ ID NO: 3373684 - DNA, 19 bp, Homo sapiens
gccgtccatggcaccagcc

SEQ ID NO: 3373685 - DNA, 23 bp, Homo sapiens
gccgtcctaacctcgggcctgct

SEQ ID NO: 3373686 - DNA, 14 bp, Homo sapiens
gccgtctccagggg

SEQ ID NO: 3373687 - DNA, 23 bp, Homo sapiens
gccgtctccaggggctgcttcct

SEQ ID NO: 3373688 - DNA, 17 bp, Homo sapiens
gccgtctgactccagag

SEQ ID NO: 3373689 - DNA, 18 bp, Homo sapiens
gccgtctgactccagagt

SEQ ID NO: 3373690 - DNA, 21 bp, Homo sapiens
gccgtctgactccagagtctg

SEQ ID NO: 3373691 - DNA, 16 bp, Homo sapiens
gccgtgaactgtgcat

SEQ ID NO: 3373692 - DNA, 23 bp, Homo sapiens
gccgtgaggacacgtggcctgca

SEQ ID NO: 3373693 - DNA, 15 bp, Homo sapiens
gccgtgctgtaaata

SEQ ID NO: 3373694 - DNA, 23 bp, Homo sapiens
gccgtggattgcacgtggcctct

SEQ ID NO: 3373695 - DNA, 12 bp, Homo sapiens
gccgtggcttcc

SEQ ID NO: 3373696 - DNA, 21 bp, Homo sapiens
gccgtggcttcccgctcagcc

SEQ ID NO: 3373697 - DNA, 23 bp, Homo sapiens
gccgtgggcctgtcgtgccagtc

SEQ ID NO: 3373698 - DNA, 22 bp, Homo sapiens
gccgtgtgagtgtgacagggcc

SEQ ID NO: 3373699 - DNA, 21 bp, Homo sapiens
gccgtgtgtctgtcagcccaa

SEQ ID NO: 3373700 - DNA, 15 bp, Homo sapiens
gcctaaaagtaaaca

SEQ ID NO: 3373701 - DNA, 15 bp, Homo sapiens
gcctaaacctcagtt

SEQ ID NO: 3373702 - DNA, 14 bp, Homo sapiens
gcctaaagggcagg

SEQ ID NO: 3373703 - DNA, 18 bp, Homo sapiens
gcctaaatttaatgctgc

SEQ ID NO: 3373704 - DNA, 18 bp, Homo sapiens
gcctaaccaggcccagcc

SEQ ID NO: 3373705 - DNA, 18 bp, Homo sapiens
gcctaactactagttttt

SEQ ID NO: 3373706 - DNA, 15 bp, Homo sapiens
gcctaagacatgtga

SEQ ID NO: 3373707 - DNA, 20 bp, Homo sapiens
gcctaagacatgtgaggagg

SEQ ID NO: 3373708 - DNA, 21 bp, Homo sapiens
gcctaagcattgcctggcctt

SEQ ID NO: 3373709 - DNA, 16 bp, Homo sapiens
gcctaatccctgggca

SEQ ID NO: 3373710 - DNA, 15 bp, Homo sapiens
gcctaatggagaaga

SEQ ID NO: 3373711 - DNA, 20 bp, Homo sapiens
gcctacaaccatccctgcca

SEQ ID NO: 3373712 - DNA, 21 bp, Homo sapiens
gcctacaaccatccctgccac

SEQ ID NO: 3373713 - DNA, 16 bp, Homo sapiens
gcctacaggagtgagc

SEQ ID NO: 3373714 - DNA, 15 bp, Homo sapiens
gcctaccaatctctg

SEQ ID NO: 3373715 - DNA, 20 bp, Homo sapiens
gcctagactgttactttggc

SEQ ID NO: 3373716 - DNA, 18 bp, Homo sapiens
gcctagacttcccaacag

SEQ ID NO: 3373717 - DNA, 21 bp, Homo sapiens
gcctagacttcccaacagcct

SEQ ID NO: 3373718 - DNA, 16 bp, Homo sapiens
gcctagagcgcggctg

SEQ ID NO: 3373719 - DNA, 12 bp, Homo sapiens
gcctagagtgta

SEQ ID NO: 3373720 - DNA, 14 bp, Homo sapiens
gcctagagtgtagc

SEQ ID NO: 3373721 - DNA, 16 bp, Homo sapiens
gcctagcaagctggcc

SEQ ID NO: 3373722 - DNA, 14 bp, Homo sapiens
gcctagcccaccct

SEQ ID NO: 3373723 - DNA, 18 bp, Homo sapiens
gcctagcccaccctgctg

SEQ ID NO: 3373724 - DNA, 17 bp, Homo sapiens
gcctagcgatctctcct

SEQ ID NO: 3373725 - DNA, 22 bp, Homo sapiens
gcctagcgatctctcctggcct

SEQ ID NO: 3373726 - DNA, 18 bp, Homo sapiens
gcctagcggagcccagcc

SEQ ID NO: 3373727 - DNA, 20 bp, Homo sapiens
gcctagctcctgccacatgg

SEQ ID NO: 3373728 - DNA, 15 bp, Homo sapiens
gcctaggaccactca

SEQ ID NO: 3373729 - DNA, 23 bp, Homo sapiens
gcctaggaccactcagcccctag

SEQ ID NO: 3373730 - DNA, 21 bp, Homo sapiens
gcctaggagttgagtacagtg

SEQ ID NO: 3373731 - DNA, 12 bp, Homo sapiens
gcctaggattct

SEQ ID NO: 3373732 - DNA, 14 bp, Homo sapiens
gcctaggattctaa

SEQ ID NO: 3373733 - DNA, 19 bp, Homo sapiens
gcctaggccaaatgcacaa

SEQ ID NO: 3373734 - DNA, 20 bp, Homo sapiens
gcctagggtcttgggggtca

SEQ ID NO: 3373735 - DNA, 20 bp, Homo sapiens
gcctaggtgacagagtgaga

SEQ ID NO: 3373736 - DNA, 21 bp, Homo sapiens
gcctagtttttagtaatctgt

SEQ ID NO: 3373737 - DNA, 19 bp, Homo sapiens
gcctataaaattaaatgcc

SEQ ID NO: 3373738 - DNA, 13 bp, Homo sapiens
gcctatagtccca

SEQ ID NO: 3373739 - DNA, 15 bp, Homo sapiens
gcctatcccaaacct

SEQ ID NO: 3373740 - DNA, 19 bp, Homo sapiens
gcctatgggggctctcgga

SEQ ID NO: 3373741 - DNA, 20 bp, Homo sapiens
gcctattatattaaaatatg

SEQ ID NO: 3373742 - DNA, 17 bp, Homo sapiens
gcctatttacctgcagg

SEQ ID NO: 3373743 - DNA, 23 bp, Homo sapiens
gcctatttttttagattgagaaa

SEQ ID NO: 3373744 - DNA, 16 bp, Homo sapiens
gcctcaaaacagaagc

SEQ ID NO: 3373745 - DNA, 18 bp, Homo sapiens
gcctcaaaacgggtcagt

SEQ ID NO: 3373746 - DNA, 20 bp, Homo sapiens
gcctcaaaacgggtcagtat

SEQ ID NO: 3373747 - DNA, 18 bp, Homo sapiens
gcctcaagagcacacaga

SEQ ID NO: 3373748 - DNA, 22 bp, Homo sapiens
gcctcaaggttttaggttctaa

SEQ ID NO: 3373749 - DNA, 21 bp, Homo sapiens
gcctcaagtgattctcctgcc

SEQ ID NO: 3373750 - DNA, 22 bp, Homo sapiens
gcctcaagtgattctcctgcct

SEQ ID NO: 3373751 - DNA, 19 bp, Homo sapiens
gcctcacatttttttctac

SEQ ID NO: 3373752 - DNA, 20 bp, Homo sapiens
gcctcaccgcttccctcctg

SEQ ID NO: 3373753 - DNA, 17 bp, Homo sapiens
gcctcacctctacccaa

SEQ ID NO: 3373754 - DNA, 22 bp, Homo sapiens
gcctcactggctggggcagagg

SEQ ID NO: 3373755 - DNA, 14 bp, Homo sapiens
gcctcactgggggc

SEQ ID NO: 3373756 - DNA, 20 bp, Homo sapiens
gcctcactgggggctttggg

SEQ ID NO: 3373757 - DNA, 16 bp, Homo sapiens
gcctcacttgaatgtg

SEQ ID NO: 3373758 - DNA, 20 bp, Homo sapiens
gcctcactttccaccaagtg

SEQ ID NO: 3373759 - DNA, 15 bp, Homo sapiens
gcctcagaccccagg

SEQ ID NO: 3373760 - DNA, 15 bp, Homo sapiens
gcctcagactccgcc

SEQ ID NO: 3373761 - DNA, 17 bp, Homo sapiens
gcctcagactccgccct

SEQ ID NO: 3373762 - DNA, 18 bp, Homo sapiens
gcctcagactccgccctc

SEQ ID NO: 3373763 - DNA, 17 bp, Homo sapiens
gcctcagaggagctcta

SEQ ID NO: 3373764 - DNA, 18 bp, Homo sapiens
gcctcagaggagctctac

SEQ ID NO: 3373765 - DNA, 20 bp, Homo sapiens
gcctcagaggagctctaccc

SEQ ID NO: 3373766 - DNA, 22 bp, Homo sapiens
gcctcagaggagctctaccctg

SEQ ID NO: 3373767 - DNA, 18 bp, Homo sapiens
gcctcagcatcctggcac

SEQ ID NO: 3373768 - DNA, 12 bp, Homo sapiens
gcctcagcctcc

SEQ ID NO: 3373769 - DNA, 14 bp, Homo sapiens
gcctcagcctccca

SEQ ID NO: 3373770 - DNA, 12 bp, Homo sapiens
gcctcagctggc

SEQ ID NO: 3373771 - DNA, 16 bp, Homo sapiens
gcctcagggccaggaa

SEQ ID NO: 3373772 - DNA, 18 bp, Homo sapiens
gcctcagggccaggaagg

SEQ ID NO: 3373773 - DNA, 19 bp, Homo sapiens
gcctcagggccaggaagga

SEQ ID NO: 3373774 - DNA, 16 bp, Homo sapiens
gcctcagggcgctcag

SEQ ID NO: 3373775 - DNA, 17 bp, Homo sapiens
gcctcagggcgctcaga

SEQ ID NO: 3373776 - DNA, 21 bp, Homo sapiens
gcctcagggcgctcagacggc

SEQ ID NO: 3373777 - DNA, 13 bp, Homo sapiens
gcctcaggttcct

SEQ ID NO: 3373778 - DNA, 23 bp, Homo sapiens
gcctcagtcctcccctcacagcc

SEQ ID NO: 3373779 - DNA, 15 bp, Homo sapiens
gcctcagtgccacta

SEQ ID NO: 3373780 - DNA, 22 bp, Homo sapiens
gcctcagttcaacctggtggca

SEQ ID NO: 3373781 - DNA, 14 bp, Homo sapiens
gcctcagttcccag

SEQ ID NO: 3373782 - DNA, 16 bp, Homo sapiens
gcctcagttcccagct

SEQ ID NO: 3373783 - DNA, 19 bp, Homo sapiens
gcctcagttcccagctccc

SEQ ID NO: 3373784 - DNA, 13 bp, Homo sapiens
gcctcatatttaa

SEQ ID NO: 3373785 - DNA, 13 bp, Homo sapiens
gcctcatccctcg

SEQ ID NO: 3373786 - DNA, 17 bp, Homo sapiens
gcctcatccctcggaag

SEQ ID NO: 3373787 - DNA, 16 bp, Homo sapiens
gcctcatgccacacct

SEQ ID NO: 3373788 - DNA, 12 bp, Homo sapiens
gcctcatgcctg

SEQ ID NO: 3373789 - DNA, 14 bp, Homo sapiens
gcctcatgcctgct

SEQ ID NO: 3373790 - DNA, 15 bp, Homo sapiens
gcctcatgcctgctg

SEQ ID NO: 3373791 - DNA, 18 bp, Homo sapiens
gcctcatgcctgctgaga

SEQ ID NO: 3373792 - DNA, 18 bp, Homo sapiens
gcctcatgctggagggag

SEQ ID NO: 3373793 - DNA, 13 bp, Homo sapiens
gcctcatgtggct

SEQ ID NO: 3373794 - DNA, 16 bp, Homo sapiens
gcctcatgtggctgga

SEQ ID NO: 3373795 - DNA, 19 bp, Homo sapiens
gcctcatgtggctggaaga

SEQ ID NO: 3373796 - DNA, 21 bp, Homo sapiens
gcctcatttcactagagacaa

SEQ ID NO: 3373797 - DNA, 17 bp, Homo sapiens
gcctccaaatgccaact

SEQ ID NO: 3373798 - DNA, 20 bp, Homo sapiens
gcctccaacgcccctgtggc

SEQ ID NO: 3373799 - DNA, 23 bp, Homo sapiens
gcctccaacgcccctgtggccaa

SEQ ID NO: 3373800 - DNA, 13 bp, Homo sapiens
gcctccaagcctg

SEQ ID NO: 3373801 - DNA, 17 bp, Homo sapiens
gcctccaagctccatct

SEQ ID NO: 3373802 - DNA, 22 bp, Homo sapiens
gcctccaaggaggggctgtaaa

SEQ ID NO: 3373803 - DNA, 19 bp, Homo sapiens
gcctccaagggtttcgact

SEQ ID NO: 3373804 - DNA, 21 bp, Homo sapiens
gcctccacagcgagggcagct

SEQ ID NO: 3373805 - DNA, 14 bp, Homo sapiens
gcctccaccaccac

SEQ ID NO: 3373806 - DNA, 23 bp, Homo sapiens
gcctccaccaccactggccacca

SEQ ID NO: 3373807 - DNA, 22 bp, Homo sapiens
gcctccactcccccacctgaca

SEQ ID NO: 3373808 - DNA, 17 bp, Homo sapiens
gcctccagagccagcct

SEQ ID NO: 3373809 - DNA, 19 bp, Homo sapiens
gcctccagagccagcctgg

SEQ ID NO: 3373810 - DNA, 22 bp, Homo sapiens
gcctccagagccagcctgggac

SEQ ID NO: 3373811 - DNA, 22 bp, Homo sapiens
gcctccagaggggctcaggtca

SEQ ID NO: 3373812 - DNA, 16 bp, Homo sapiens
gcctccagcctctccc

SEQ ID NO: 3373813 - DNA, 12 bp, Homo sapiens
gcctccatcctg

SEQ ID NO: 3373814 - DNA, 20 bp, Homo sapiens
gcctccatcctgaggctcca

SEQ ID NO: 3373815 - DNA, 16 bp, Homo sapiens
gcctccattctgacca

SEQ ID NO: 3373816 - DNA, 17 bp, Homo sapiens
gcctccatttagttctt

SEQ ID NO: 3373817 - DNA, 16 bp, Homo sapiens
gcctcccaaagtgctg

SEQ ID NO: 3373818 - DNA, 17 bp, Homo sapiens
gcctcccaaagtgctgg

SEQ ID NO: 3373819 - DNA, 19 bp, Homo sapiens
gcctcccaaggtcctctca

SEQ ID NO: 3373820 - DNA, 20 bp, Homo sapiens
gcctcccacacttgctgggg

SEQ ID NO: 3373821 - DNA, 17 bp, Homo sapiens
gcctcccacccccatct

SEQ ID NO: 3373822 - DNA, 19 bp, Homo sapiens
gcctcccacccgatgctgc

SEQ ID NO: 3373823 - DNA, 23 bp, Homo sapiens
gcctcccacccgatgctgctttc

SEQ ID NO: 3373824 - DNA, 13 bp, Homo sapiens
gcctcccacggca

SEQ ID NO: 3373825 - DNA, 23 bp, Homo sapiens
gcctcccatgcctggtcccaaga

SEQ ID NO: 3373826 - DNA, 17 bp, Homo sapiens
gcctccccaccctcctc

SEQ ID NO: 3373827 - DNA, 16 bp, Homo sapiens
gcctccccatttccca

SEQ ID NO: 3373828 - DNA, 22 bp, Homo sapiens
gcctccccatttcccatctgca

SEQ ID NO: 3373829 - DNA, 13 bp, Homo sapiens
gcctcccccaaag

SEQ ID NO: 3373830 - DNA, 14 bp, Homo sapiens
gcctcccctgccac

SEQ ID NO: 3373831 - DNA, 15 bp, Homo sapiens
gcctcccctgccacc

SEQ ID NO: 3373832 - DNA, 21 bp, Homo sapiens
gcctcccgaatagctgggact

SEQ ID NO: 3373833 - DNA, 23 bp, Homo sapiens
gcctccctctcagaggcctgctg

SEQ ID NO: 3373834 - DNA, 13 bp, Homo sapiens
gcctccctctcca

SEQ ID NO: 3373835 - DNA, 12 bp, Homo sapiens
gcctccctctga

SEQ ID NO: 3373836 - DNA, 14 bp, Homo sapiens
gcctccctctgacc

SEQ ID NO: 3373837 - DNA, 20 bp, Homo sapiens
gcctccctctgacctgcagg

SEQ ID NO: 3373838 - DNA, 22 bp, Homo sapiens
gcctccctgaaaatgtttttct

SEQ ID NO: 3373839 - DNA, 16 bp, Homo sapiens
gcctccctggtccctt

SEQ ID NO: 3373840 - DNA, 15 bp, Homo sapiens
gcctccgagagggag

SEQ ID NO: 3373841 - DNA, 19 bp, Homo sapiens
gcctccgtttatgggcctt

SEQ ID NO: 3373842 - DNA, 16 bp, Homo sapiens
gcctcctcacccccag

SEQ ID NO: 3373843 - DNA, 18 bp, Homo sapiens
gcctcctcacccccagct

SEQ ID NO: 3373844 - DNA, 13 bp, Homo sapiens
gcctcctcctgac

SEQ ID NO: 3373845 - DNA, 23 bp, Homo sapiens
gcctcctcggagagcagcagcac

SEQ ID NO: 3373846 - DNA, 20 bp, Homo sapiens
gcctcctcggggctccaggc

SEQ ID NO: 3373847 - DNA, 17 bp, Homo sapiens
gcctcctctggacggca

SEQ ID NO: 3373848 - DNA, 20 bp, Homo sapiens
gcctcctcttcaccccggca

SEQ ID NO: 3373849 - DNA, 15 bp, Homo sapiens
gcctcctgcccagtc

SEQ ID NO: 3373850 - DNA, 17 bp, Homo sapiens
gcctcctgcccagtccc

SEQ ID NO: 3373851 - DNA, 19 bp, Homo sapiens
gcctcctggccagacgctg

SEQ ID NO: 3373852 - DNA, 12 bp, Homo sapiens
gcctcctgtggg

SEQ ID NO: 3373853 - DNA, 13 bp, Homo sapiens
gcctcctgtgtgt

SEQ ID NO: 3373854 - DNA, 13 bp, Homo sapiens
gcctcctgttctg

SEQ ID NO: 3373855 - DNA, 17 bp, Homo sapiens
gcctcctgttctgccca

SEQ ID NO: 3373856 - DNA, 18 bp, Homo sapiens
gcctccttccacctccct

SEQ ID NO: 3373857 - DNA, 20 bp, Homo sapiens
gcctccttccacctccctcc

SEQ ID NO: 3373858 - DNA, 20 bp, Homo sapiens
gcctccttcccatgcctgtc

SEQ ID NO: 3373859 - DNA, 13 bp, Homo sapiens
gcctcgaactggc

SEQ ID NO: 3373860 - DNA, 20 bp, Homo sapiens
gcctcgaactggctgcaaag

SEQ ID NO: 3373861 - DNA, 22 bp, Homo sapiens
gcctcgacagggcctggagccc

SEQ ID NO: 3373862 - DNA, 14 bp, Homo sapiens
gcctcgaggcaccg

SEQ ID NO: 3373863 - DNA, 15 bp, Homo sapiens
gcctcgaggcaccgg

SEQ ID NO: 3373864 - DNA, 23 bp, Homo sapiens
gcctcgaggcaccggcgctgcag

SEQ ID NO: 3373865 - DNA, 18 bp, Homo sapiens
gcctcgcccccgccccca

SEQ ID NO: 3373866 - DNA, 13 bp, Homo sapiens
gcctcgctccctt

SEQ ID NO: 3373867 - DNA, 14 bp, Homo sapiens
gcctcggcgggctt

SEQ ID NO: 3373868 - DNA, 21 bp, Homo sapiens
gcctcgggacacctgccctgc

SEQ ID NO: 3373869 - DNA, 16 bp, Homo sapiens
gcctcgtgaggggcaa

SEQ ID NO: 3373870 - DNA, 14 bp, Homo sapiens
gcctcgtgccatga

SEQ ID NO: 3373871 - DNA, 20 bp, Homo sapiens
gcctcgttggaagaggaaca

SEQ ID NO: 3373872 - DNA, 15 bp, Homo sapiens
gcctctcacacacat

SEQ ID NO: 3373873 - DNA, 16 bp, Homo sapiens
gcctctccaggcacca

SEQ ID NO: 3373874 - DNA, 15 bp, Homo sapiens
gcctctcccatcact

SEQ ID NO: 3373875 - DNA, 22 bp, Homo sapiens
gcctctccccaggtccagctct

SEQ ID NO: 3373876 - DNA, 19 bp, Homo sapiens
gcctctcccggctgcctgc

SEQ ID NO: 3373877 - DNA, 14 bp, Homo sapiens
gcctctctcaggag

SEQ ID NO: 3373878 - DNA, 13 bp, Homo sapiens
gcctctctggcct

SEQ ID NO: 3373879 - DNA, 17 bp, Homo sapiens
gcctctctggcctccca

SEQ ID NO: 3373880 - DNA, 20 bp, Homo sapiens
gcctctctggcctcccaccc

SEQ ID NO: 3373881 - DNA, 15 bp, Homo sapiens
gcctctgacacacag

SEQ ID NO: 3373882 - DNA, 18 bp, Homo sapiens
gcctctgacacacagctc

SEQ ID NO: 3373883 - DNA, 20 bp, Homo sapiens
gcctctgacacacagctctg

SEQ ID NO: 3373884 - DNA, 15 bp, Homo sapiens
gcctctgacccctcc

SEQ ID NO: 3373885 - DNA, 19 bp, Homo sapiens
gcctctgagaagctctgaa

SEQ ID NO: 3373886 - DNA, 18 bp, Homo sapiens
gcctctgagcccaagcta

SEQ ID NO: 3373887 - DNA, 22 bp, Homo sapiens
gcctctgagcccaagctaagcc

SEQ ID NO: 3373888 - DNA, 15 bp, Homo sapiens
gcctctgatatggga

SEQ ID NO: 3373889 - DNA, 18 bp, Homo sapiens
gcctctgcctctgacaca

SEQ ID NO: 3373890 - DNA, 18 bp, Homo sapiens
gcctctgccttagaggag

SEQ ID NO: 3373891 - DNA, 19 bp, Homo sapiens
gcctctgccttagaggagc

SEQ ID NO: 3373892 - DNA, 21 bp, Homo sapiens
gcctctgcggggcagggcctt

SEQ ID NO: 3373893 - DNA, 16 bp, Homo sapiens
gcctctgctccctctg

SEQ ID NO: 3373894 - DNA, 15 bp, Homo sapiens
gcctctgctgccatg

SEQ ID NO: 3373895 - DNA, 17 bp, Homo sapiens
gcctctggaggcctctg

SEQ ID NO: 3373896 - DNA, 12 bp, Homo sapiens
gcctctggccct

SEQ ID NO: 3373897 - DNA, 16 bp, Homo sapiens
gcctctggccgccacc

SEQ ID NO: 3373898 - DNA, 12 bp, Homo sapiens
gcctctggctag

SEQ ID NO: 3373899 - DNA, 19 bp, Homo sapiens
gcctctggctagaggccag

SEQ ID NO: 3373900 - DNA, 22 bp, Homo sapiens
gcctctggctagaggccagccc

SEQ ID NO: 3373901 - DNA, 12 bp, Homo sapiens
gcctctggctcc

SEQ ID NO: 3373902 - DNA, 13 bp, Homo sapiens
gcctctggctcca

SEQ ID NO: 3373903 - DNA, 14 bp, Homo sapiens
gcctctgggactgg

SEQ ID NO: 3373904 - DNA, 22 bp, Homo sapiens
gcctctgtcccggaagagtcat

SEQ ID NO: 3373905 - DNA, 12 bp, Homo sapiens
gcctctgtgcct

SEQ ID NO: 3373906 - DNA, 18 bp, Homo sapiens
gcctctgtgctgtgtgtg

SEQ ID NO: 3373907 - DNA, 18 bp, Homo sapiens
gcctctgtgtccttccct

SEQ ID NO: 3373908 - DNA, 21 bp, Homo sapiens
gcctctgtgtccttccctgca

SEQ ID NO: 3373909 - DNA, 23 bp, Homo sapiens
gcctcttaaagctgcctgtagtt

SEQ ID NO: 3373910 - DNA, 15 bp, Homo sapiens
gcctcttacttgcca

SEQ ID NO: 3373911 - DNA, 14 bp, Homo sapiens
gcctcttagtgatt

SEQ ID NO: 3373912 - DNA, 13 bp, Homo sapiens
gcctcttcagccc

SEQ ID NO: 3373913 - DNA, 14 bp, Homo sapiens
gcctcttcagcccc

SEQ ID NO: 3373914 - DNA, 17 bp, Homo sapiens
gcctcttgtaaagactg

SEQ ID NO: 3373915 - DNA, 18 bp, Homo sapiens
gcctcttgtaaagactgg

SEQ ID NO: 3373916 - DNA, 22 bp, Homo sapiens
gcctcttgtgctcacgctcccc

SEQ ID NO: 3373917 - DNA, 18 bp, Homo sapiens
gcctctttgccccgactc

SEQ ID NO: 3373918 - DNA, 16 bp, Homo sapiens
gcctgaaagaggctga

SEQ ID NO: 3373919 - DNA, 16 bp, Homo sapiens
gcctgaaagccacaat

SEQ ID NO: 3373920 - DNA, 15 bp, Homo sapiens
gcctgaactgaggag

SEQ ID NO: 3373921 - DNA, 15 bp, Homo sapiens
gcctgaagtcacaca

SEQ ID NO: 3373922 - DNA, 16 bp, Homo sapiens
gcctgaagtcacacag

SEQ ID NO: 3373923 - DNA, 17 bp, Homo sapiens
gcctgaagtcacacagt

SEQ ID NO: 3373924 - DNA, 17 bp, Homo sapiens
gcctgacaattgcaaat

SEQ ID NO: 3373925 - DNA, 22 bp, Homo sapiens
gcctgacacactaaccaagctg

SEQ ID NO: 3373926 - DNA, 21 bp, Homo sapiens
gcctgacactgagccccacct

SEQ ID NO: 3373927 - DNA, 13 bp, Homo sapiens
gcctgacttgggg

SEQ ID NO: 3373928 - DNA, 13 bp, Homo sapiens
gcctgagaggcag

SEQ ID NO: 3373929 - DNA, 20 bp, Homo sapiens
gcctgagaggcaggcataga

SEQ ID NO: 3373930 - DNA, 16 bp, Homo sapiens
gcctgagaggggaagc

SEQ ID NO: 3373931 - DNA, 13 bp, Homo sapiens
gcctgagcaacat

SEQ ID NO: 3373932 - DNA, 13 bp, Homo sapiens
gcctgagccttag

SEQ ID NO: 3373933 - DNA, 15 bp, Homo sapiens
gcctgagccttagct

SEQ ID NO: 3373934 - DNA, 14 bp, Homo sapiens
gcctgagctcactc

SEQ ID NO: 3373935 - DNA, 23 bp, Homo sapiens
gcctgagctcactcggcaccctg

SEQ ID NO: 3373936 - DNA, 15 bp, Homo sapiens
gcctgagctcctgct

SEQ ID NO: 3373937 - DNA, 16 bp, Homo sapiens
gcctgagctcctgctg

SEQ ID NO: 3373938 - DNA, 14 bp, Homo sapiens
gcctgagggtggag

SEQ ID NO: 3373939 - DNA, 17 bp, Homo sapiens
gcctgagggtggagact

SEQ ID NO: 3373940 - DNA, 18 bp, Homo sapiens
gcctgagtcagggcccag

SEQ ID NO: 3373941 - DNA, 22 bp, Homo sapiens
gcctgagtcagggcccagaggc

SEQ ID NO: 3373942 - DNA, 15 bp, Homo sapiens
gcctgagtcctggtc

SEQ ID NO: 3373943 - DNA, 18 bp, Homo sapiens
gcctgagtcctggtccct

SEQ ID NO: 3373944 - DNA, 16 bp, Homo sapiens
gcctgatctcttcctg

SEQ ID NO: 3373945 - DNA, 17 bp, Homo sapiens
gcctgatgctccctccc

SEQ ID NO: 3373946 - DNA, 20 bp, Homo sapiens
gcctgatgctccctcccctg

SEQ ID NO: 3373947 - DNA, 14 bp, Homo sapiens
gcctgatgctgccc

SEQ ID NO: 3373948 - DNA, 15 bp, Homo sapiens
gcctgatgctgcccc

SEQ ID NO: 3373949 - DNA, 14 bp, Homo sapiens
gcctgatggccaag

SEQ ID NO: 3373950 - DNA, 17 bp, Homo sapiens
gcctgcaaaccttcctg

SEQ ID NO: 3373951 - DNA, 19 bp, Homo sapiens
gcctgcaaaccttcctggg

SEQ ID NO: 3373952 - DNA, 11 bp, Homo sapiens
gcctgcagaag

SEQ ID NO: 3373953 - DNA, 13 bp, Homo sapiens
gcctgccacctcc

SEQ ID NO: 3373954 - DNA, 15 bp, Homo sapiens
gcctgccatgggcca

SEQ ID NO: 3373955 - DNA, 20 bp, Homo sapiens
gcctgccatgggccagccta

SEQ ID NO: 3373956 - DNA, 14 bp, Homo sapiens
gcctgcccaggccc

SEQ ID NO: 3373957 - DNA, 18 bp, Homo sapiens
gcctgcccaggcccctgc

SEQ ID NO: 3373958 - DNA, 22 bp, Homo sapiens
gcctgcccaggcccctgccacc

SEQ ID NO: 3373959 - DNA, 19 bp, Homo sapiens
gcctgcccagttgcactca

SEQ ID NO: 3373960 - DNA, 18 bp, Homo sapiens
gcctgccccacccacccc

SEQ ID NO: 3373961 - DNA, 22 bp, Homo sapiens
gcctgccccacccaccccacag

SEQ ID NO: 3373962 - DNA, 23 bp, Homo sapiens
gcctgccccacccaccccacaga

SEQ ID NO: 3373963 - DNA, 22 bp, Homo sapiens
gcctgcccctaccctggacttg

SEQ ID NO: 3373964 - DNA, 14 bp, Homo sapiens
gcctgcccgcacag

SEQ ID NO: 3373965 - DNA, 20 bp, Homo sapiens
gcctgcccgcacagcagcct

SEQ ID NO: 3373966 - DNA, 20 bp, Homo sapiens
gcctgccctcatggcccctc

SEQ ID NO: 3373967 - DNA, 22 bp, Homo sapiens
gcctgccctcatggcccctctg

SEQ ID NO: 3373968 - DNA, 15 bp, Homo sapiens
gcctgccctccagct

SEQ ID NO: 3373969 - DNA, 15 bp, Homo sapiens
gcctgccctccccag

SEQ ID NO: 3373970 - DNA, 19 bp, Homo sapiens
gcctgccctccccagagca

SEQ ID NO: 3373971 - DNA, 17 bp, Homo sapiens
gcctgccgcccaaagag

SEQ ID NO: 3373972 - DNA, 10 bp, Homo sapiens
gcctgcctaa

SEQ ID NO: 3373973 - DNA, 21 bp, Homo sapiens
gcctgcctaaccaggcccagc

SEQ ID NO: 3373974 - DNA, 16 bp, Homo sapiens
gcctgcctcagtggca

SEQ ID NO: 3373975 - DNA, 17 bp, Homo sapiens
gcctgcctcagtggcag

SEQ ID NO: 3373976 - DNA, 23 bp, Homo sapiens
gcctgcctcagtggcagcatcct

SEQ ID NO: 3373977 - DNA, 13 bp, Homo sapiens
gcctgcctggcag

SEQ ID NO: 3373978 - DNA, 16 bp, Homo sapiens
gcctgcctggcaggct

SEQ ID NO: 3373979 - DNA, 16 bp, Homo sapiens
gcctgcctggcccctc

SEQ ID NO: 3373980 - DNA, 21 bp, Homo sapiens
gcctgcgccaccgcccagaga

SEQ ID NO: 3373981 - DNA, 15 bp, Homo sapiens
gcctgcgctcggcag

SEQ ID NO: 3373982 - DNA, 19 bp, Homo sapiens
gcctgcgctcggcaggaag

SEQ ID NO: 3373983 - DNA, 18 bp, Homo sapiens
gcctgcgttggtccagag

SEQ ID NO: 3373984 - DNA, 19 bp, Homo sapiens
gcctgcgttggtccagagc

SEQ ID NO: 3373985 - DNA, 20 bp, Homo sapiens
gcctgcgttggtccagagcg

SEQ ID NO: 3373986 - DNA, 17 bp, Homo sapiens
gcctgctagagcaaccc

SEQ ID NO: 3373987 - DNA, 15 bp, Homo sapiens
gcctgctcccagcag

SEQ ID NO: 3373988 - DNA, 16 bp, Homo sapiens
gcctgctcccagcagc

SEQ ID NO: 3373989 - DNA, 19 bp, Homo sapiens
gcctgctctagtgggacag

SEQ ID NO: 3373990 - DNA, 11 bp, Homo sapiens
gcctgctgcat

SEQ ID NO: 3373991 - DNA, 14 bp, Homo sapiens
gcctgctgccagtg

SEQ ID NO: 3373992 - DNA, 18 bp, Homo sapiens
gcctgctgccagtgcagc

SEQ ID NO: 3373993 - DNA, 22 bp, Homo sapiens
gcctgctgccagtgcagccact

SEQ ID NO: 3373994 - DNA, 13 bp, Homo sapiens
gcctgctggcacc

SEQ ID NO: 3373995 - DNA, 22 bp, Homo sapiens
gcctgctggcacccaccgtgga

SEQ ID NO: 3373996 - DNA, 13 bp, Homo sapiens
gcctgctggctgc

SEQ ID NO: 3373997 - DNA, 14 bp, Homo sapiens
gcctgctggctgcg

SEQ ID NO: 3373998 - DNA, 18 bp, Homo sapiens
gcctgctggctgcggccc

SEQ ID NO: 3373999 - DNA, 20 bp, Homo sapiens
gcctgctgggaaccccgcag

SEQ ID NO: 3374000 - DNA, 13 bp, Homo sapiens
gcctgcttcccac

SEQ ID NO: 3374001 - DNA, 15 bp, Homo sapiens
gcctgcttttccagg

SEQ ID NO: 3374002 - DNA, 23 bp, Homo sapiens
gcctgcttttccaggatcctgca

SEQ ID NO: 3374003 - DNA, 21 bp, Homo sapiens
gcctgctttttggaaagtcag

SEQ ID NO: 3374004 - DNA, 17 bp, Homo sapiens
gcctggaaccagggagg

SEQ ID NO: 3374005 - DNA, 21 bp, Homo sapiens
gcctggacagtatcccacatc

SEQ ID NO: 3374006 - DNA, 20 bp, Homo sapiens
gcctggactctgccccacgc

SEQ ID NO: 3374007 - DNA, 18 bp, Homo sapiens
gcctggactttcctgcaa

SEQ ID NO: 3374008 - DNA, 16 bp, Homo sapiens
gcctggagacagatac

SEQ ID NO: 3374009 - DNA, 15 bp, Homo sapiens
gcctggagacccacc

SEQ ID NO: 3374010 - DNA, 15 bp, Homo sapiens
gcctggagagggtct

SEQ ID NO: 3374011 - DNA, 19 bp, Homo sapiens
gcctggagagggtctcgct

SEQ ID NO: 3374012 - DNA, 22 bp, Homo sapiens
gcctggagagggtctcgctgtc

SEQ ID NO: 3374013 - DNA, 20 bp, Homo sapiens
gcctggagatcctcctgcag

SEQ ID NO: 3374014 - DNA, 13 bp, Homo sapiens
gcctggagctaat

SEQ ID NO: 3374015 - DNA, 21 bp, Homo sapiens
gcctggatattattcttgtag

SEQ ID NO: 3374016 - DNA, 17 bp, Homo sapiens
gcctggatgagaaacag

SEQ ID NO: 3374017 - DNA, 21 bp, Homo sapiens
gcctggatgccaaggagcccc

SEQ ID NO: 3374018 - DNA, 22 bp, Homo sapiens
gcctggatttctggttctgatg

SEQ ID NO: 3374019 - DNA, 16 bp, Homo sapiens
gcctggcacaggactg

SEQ ID NO: 3374020 - DNA, 13 bp, Homo sapiens
gcctggcacaggg

SEQ ID NO: 3374021 - DNA, 14 bp, Homo sapiens
gcctggcacagggc

SEQ ID NO: 3374022 - DNA, 14 bp, Homo sapiens
gcctggcacatttc

SEQ ID NO: 3374023 - DNA, 22 bp, Homo sapiens
gcctggcacatttcagggagaa

SEQ ID NO: 3374024 - DNA, 12 bp, Homo sapiens
gcctggcagccg

SEQ ID NO: 3374025 - DNA, 15 bp, Homo sapiens
gcctggcaggccagt

SEQ ID NO: 3374026 - DNA, 16 bp, Homo sapiens
gcctggcaggccagtg

SEQ ID NO: 3374027 - DNA, 17 bp, Homo sapiens
gcctggcaggccagtgt

SEQ ID NO: 3374028 - DNA, 23 bp, Homo sapiens
gcctggcagggaggtcaggccct

SEQ ID NO: 3374029 - DNA, 15 bp, Homo sapiens
gcctggccagatgca

SEQ ID NO: 3374030 - DNA, 21 bp, Homo sapiens
gcctggccagatgcaccagcc

SEQ ID NO: 3374031 - DNA, 11 bp, Homo sapiens
gcctggccagg

SEQ ID NO: 3374032 - DNA, 15 bp, Homo sapiens
gcctggccaggagca

SEQ ID NO: 3374033 - DNA, 13 bp, Homo sapiens
gcctggccagggc

SEQ ID NO: 3374034 - DNA, 18 bp, Homo sapiens
gcctggcccacgccctcc

SEQ ID NO: 3374035 - DNA, 14 bp, Homo sapiens
gcctggcccataga

SEQ ID NO: 3374036 - DNA, 20 bp, Homo sapiens
gcctggcccccaacctcagg

SEQ ID NO: 3374037 - DNA, 22 bp, Homo sapiens
gcctggcccccaacctcagggc

SEQ ID NO: 3374038 - DNA, 12 bp, Homo sapiens
gcctggccctgc

SEQ ID NO: 3374039 - DNA, 17 bp, Homo sapiens
gcctggccctgccctga

SEQ ID NO: 3374040 - DNA, 13 bp, Homo sapiens
gcctggcctgagc

SEQ ID NO: 3374041 - DNA, 15 bp, Homo sapiens
gcctggcctgagctg

SEQ ID NO: 3374042 - DNA, 22 bp, Homo sapiens
gcctggcctgagctggggccac

SEQ ID NO: 3374043 - DNA, 12 bp, Homo sapiens
gcctggcctggc

SEQ ID NO: 3374044 - DNA, 13 bp, Homo sapiens
gcctggcctggca

SEQ ID NO: 3374045 - DNA, 14 bp, Homo sapiens
gcctggcctggccc

SEQ ID NO: 3374046 - DNA, 19 bp, Homo sapiens
gcctggcctggccctgccc

SEQ ID NO: 3374047 - DNA, 14 bp, Homo sapiens
gcctggcctggctc

SEQ ID NO: 3374048 - DNA, 20 bp, Homo sapiens
gcctggcgggatgggccacc

SEQ ID NO: 3374049 - DNA, 23 bp, Homo sapiens
gcctggctccccacgagtcacct

SEQ ID NO: 3374050 - DNA, 11 bp, Homo sapiens
gcctggctgga

SEQ ID NO: 3374051 - DNA, 12 bp, Homo sapiens
gcctggctggaa

SEQ ID NO: 3374052 - DNA, 16 bp, Homo sapiens
gcctggctgtggaggc

SEQ ID NO: 3374053 - DNA, 19 bp, Homo sapiens
gcctggctgtggaggcctg

SEQ ID NO: 3374054 - DNA, 20 bp, Homo sapiens
gcctggctgtggaggcctga

SEQ ID NO: 3374055 - DNA, 22 bp, Homo sapiens
gcctggcttctggagcccttgg

SEQ ID NO: 3374056 - DNA, 23 bp, Homo sapiens
gcctggcttctggagcccttggg

SEQ ID NO: 3374057 - DNA, 16 bp, Homo sapiens
gcctggcttgctccag

SEQ ID NO: 3374058 - DNA, 16 bp, Homo sapiens
gcctgggacccagcta

SEQ ID NO: 3374059 - DNA, 18 bp, Homo sapiens
gcctgggacccagctact

SEQ ID NO: 3374060 - DNA, 16 bp, Homo sapiens
gcctgggactcccagt

SEQ ID NO: 3374061 - DNA, 18 bp, Homo sapiens
gcctgggactcccagtga

SEQ ID NO: 3374062 - DNA, 16 bp, Homo sapiens
gcctgggagcccagag

SEQ ID NO: 3374063 - DNA, 12 bp, Homo sapiens
gcctgggagggt

SEQ ID NO: 3374064 - DNA, 20 bp, Homo sapiens
gcctgggagggttcccctgg

SEQ ID NO: 3374065 - DNA, 22 bp, Homo sapiens
gcctgggatgctagccccagag

SEQ ID NO: 3374066 - DNA, 23 bp, Homo sapiens
gcctgggatgctagccccagaga

SEQ ID NO: 3374067 - DNA, 20 bp, Homo sapiens
gcctgggccacagggcgaga

SEQ ID NO: 3374068 - DNA, 14 bp, Homo sapiens
gcctgggccagaga

SEQ ID NO: 3374069 - DNA, 17 bp, Homo sapiens
gcctgggccgctgccac

SEQ ID NO: 3374070 - DNA, 18 bp, Homo sapiens
gcctgggccgctgccacg

SEQ ID NO: 3374071 - DNA, 14 bp, Homo sapiens
gcctgggcctgctt

SEQ ID NO: 3374072 - DNA, 14 bp, Homo sapiens
gcctgggcctgtgc

SEQ ID NO: 3374073 - DNA, 16 bp, Homo sapiens
gcctgggcctgtgcag

SEQ ID NO: 3374074 - DNA, 22 bp, Homo sapiens
gcctgggcctgtgcagcagccc

SEQ ID NO: 3374075 - DNA, 17 bp, Homo sapiens
gcctggggatgagacac

SEQ ID NO: 3374076 - DNA, 18 bp, Homo sapiens
gcctggggcctgagagaa

SEQ ID NO: 3374077 - DNA, 14 bp, Homo sapiens
gcctggggcctggc

SEQ ID NO: 3374078 - DNA, 17 bp, Homo sapiens
gcctggggcctggcagg

SEQ ID NO: 3374079 - DNA, 17 bp, Homo sapiens
gcctggggcgggcccct

SEQ ID NO: 3374080 - DNA, 15 bp, Homo sapiens
gcctggggctccctc

SEQ ID NO: 3374081 - DNA, 18 bp, Homo sapiens
gcctggggctccctctct

SEQ ID NO: 3374082 - DNA, 19 bp, Homo sapiens
gcctgggggagttttcctc

SEQ ID NO: 3374083 - DNA, 14 bp, Homo sapiens
gcctgggggcagtg

SEQ ID NO: 3374084 - DNA, 20 bp, Homo sapiens
gcctgggggcagtgactggc

SEQ ID NO: 3374085 - DNA, 22 bp, Homo sapiens
gcctgggggcttttgccactcc

SEQ ID NO: 3374086 - DNA, 19 bp, Homo sapiens
gcctgggtctgtgtctctt

SEQ ID NO: 3374087 - DNA, 20 bp, Homo sapiens
gcctgggtgctggctgccca

SEQ ID NO: 3374088 - DNA, 14 bp, Homo sapiens
gcctgggtgggaca

SEQ ID NO: 3374089 - DNA, 15 bp, Homo sapiens
gcctgggtgggacag

SEQ ID NO: 3374090 - DNA, 20 bp, Homo sapiens
gcctgggtgggacagcctct

SEQ ID NO: 3374091 - DNA, 17 bp, Homo sapiens
gcctggtcacagggcat

SEQ ID NO: 3374092 - DNA, 19 bp, Homo sapiens
gcctggtcccagagtggct

SEQ ID NO: 3374093 - DNA, 13 bp, Homo sapiens
gcctggtgcagtg

SEQ ID NO: 3374094 - DNA, 13 bp, Homo sapiens
gcctggtgctgct

SEQ ID NO: 3374095 - DNA, 18 bp, Homo sapiens
gcctggtggcagctgcgg

SEQ ID NO: 3374096 - DNA, 21 bp, Homo sapiens
gcctggtggcagctgcggtcc

SEQ ID NO: 3374097 - DNA, 19 bp, Homo sapiens
gcctggtggtcagatgcag

SEQ ID NO: 3374098 - DNA, 21 bp, Homo sapiens
gcctgtaatcagctctcctgg

SEQ ID NO: 3374099 - DNA, 15 bp, Homo sapiens
gcctgtaatcccagc

SEQ ID NO: 3374100 - DNA, 18 bp, Homo sapiens
gcctgtaatcccagcact

SEQ ID NO: 3374101 - DNA, 20 bp, Homo sapiens
gcctgtaccggtttggctgg

SEQ ID NO: 3374102 - DNA, 16 bp, Homo sapiens
gcctgtagagttgctg

SEQ ID NO: 3374103 - DNA, 17 bp, Homo sapiens
gcctgtagagttgctga

SEQ ID NO: 3374104 - DNA, 19 bp, Homo sapiens
gcctgtagagttgctgaga

SEQ ID NO: 3374105 - DNA, 14 bp, Homo sapiens
gcctgtagttagga

SEQ ID NO: 3374106 - DNA, 23 bp, Homo sapiens
gcctgtagttaggaaataaaacc

SEQ ID NO: 3374107 - DNA, 19 bp, Homo sapiens
gcctgtatactttagtatg

SEQ ID NO: 3374108 - DNA, 22 bp, Homo sapiens
gcctgtatcctccctggcagac

SEQ ID NO: 3374109 - DNA, 23 bp, Homo sapiens
gcctgtatcctccctggcagaca

SEQ ID NO: 3374110 - DNA, 20 bp, Homo sapiens
gcctgtcaggctctggccct

SEQ ID NO: 3374111 - DNA, 16 bp, Homo sapiens
gcctgtcctcctggaa

SEQ ID NO: 3374112 - DNA, 19 bp, Homo sapiens
gcctgtctcatccccaggg

SEQ ID NO: 3374113 - DNA, 22 bp, Homo sapiens
gcctgtctcatccccaggggtc

SEQ ID NO: 3374114 - DNA, 15 bp, Homo sapiens
gcctgtctgagactc

SEQ ID NO: 3374115 - DNA, 23 bp, Homo sapiens
gcctgtctgagactcacaggaag

SEQ ID NO: 3374116 - DNA, 15 bp, Homo sapiens
gcctgtgcaatgcat

SEQ ID NO: 3374117 - DNA, 15 bp, Homo sapiens
gcctgtgcacacaca

SEQ ID NO: 3374118 - DNA, 13 bp, Homo sapiens
gcctgtgcagcag

SEQ ID NO: 3374119 - DNA, 15 bp, Homo sapiens
gcctgtgcagcagcc

SEQ ID NO: 3374120 - DNA, 18 bp, Homo sapiens
gcctgtgcagcagcccag

SEQ ID NO: 3374121 - DNA, 19 bp, Homo sapiens
gcctgtgcctctgggactg

SEQ ID NO: 3374122 - DNA, 21 bp, Homo sapiens
gcctgtgcctgtcaggctctg

SEQ ID NO: 3374123 - DNA, 18 bp, Homo sapiens
gcctgtgcgtcccagctg

SEQ ID NO: 3374124 - DNA, 13 bp, Homo sapiens
gcctgtgctgtgg

SEQ ID NO: 3374125 - DNA, 18 bp, Homo sapiens
gcctgtggaatgagtgtg

SEQ ID NO: 3374126 - DNA, 17 bp, Homo sapiens
gcctgtggagctcagcc

SEQ ID NO: 3374127 - DNA, 12 bp, Homo sapiens
gcctgtggcaga

SEQ ID NO: 3374128 - DNA, 22 bp, Homo sapiens
gcctgtggcagaaaagaggaga

SEQ ID NO: 3374129 - DNA, 22 bp, Homo sapiens
gcctgtggcatctttgccttgg

SEQ ID NO: 3374130 - DNA, 14 bp, Homo sapiens
gcctgtggcctgtg

SEQ ID NO: 3374131 - DNA, 21 bp, Homo sapiens
gcctgtggcgccgtctccagg

SEQ ID NO: 3374132 - DNA, 11 bp, Homo sapiens
gcctgtgggag

SEQ ID NO: 3374133 - DNA, 15 bp, Homo sapiens
gcctgtgggagtaga

SEQ ID NO: 3374134 - DNA, 14 bp, Homo sapiens
gcctgtgtccagca

SEQ ID NO: 3374135 - DNA, 15 bp, Homo sapiens
gcctgtgtccagcag

SEQ ID NO: 3374136 - DNA, 18 bp, Homo sapiens
gcctgtgtccagcagctg

SEQ ID NO: 3374137 - DNA, 21 bp, Homo sapiens
gcctgtgtccagcagctgcgg

SEQ ID NO: 3374138 - DNA, 12 bp, Homo sapiens
gcctgtgtccat

SEQ ID NO: 3374139 - DNA, 20 bp, Homo sapiens
gcctgtgtccatgcgctcag

SEQ ID NO: 3374140 - DNA, 21 bp, Homo sapiens
gcctgtgtccatgcgctcagg

SEQ ID NO: 3374141 - DNA, 23 bp, Homo sapiens
gcctgtgtccatgcgctcagggc

SEQ ID NO: 3374142 - DNA, 14 bp, Homo sapiens
gcctgtgtgttctg

SEQ ID NO: 3374143 - DNA, 22 bp, Homo sapiens
gcctgttcccctcactggatga

SEQ ID NO: 3374144 - DNA, 14 bp, Homo sapiens
gcctgttgcccttt

SEQ ID NO: 3374145 - DNA, 19 bp, Homo sapiens
gcctgtttctgcagccctt

SEQ ID NO: 3374146 - DNA, 21 bp, Homo sapiens
gcctgtttctgcagcccttgg

SEQ ID NO: 3374147 - DNA, 22 bp, Homo sapiens
gcctgtttctgcagcccttggg

SEQ ID NO: 3374148 - DNA, 17 bp, Homo sapiens
gcctgtttgatgtatgt

SEQ ID NO: 3374149 - DNA, 22 bp, Homo sapiens
gcctgtttggcgtttcccagag

SEQ ID NO: 3374150 - DNA, 14 bp, Homo sapiens
gccttaaaaccaaa

SEQ ID NO: 3374151 - DNA, 16 bp, Homo sapiens
gccttaaaaggggccc

SEQ ID NO: 3374152 - DNA, 16 bp, Homo sapiens
gccttaaagaaagtcg

SEQ ID NO: 3374153 - DNA, 19 bp, Homo sapiens
gccttaacatccctcctgc

SEQ ID NO: 3374154 - DNA, 17 bp, Homo sapiens
gccttaattttcagtat

SEQ ID NO: 3374155 - DNA, 16 bp, Homo sapiens
gccttagaacctttct

SEQ ID NO: 3374156 - DNA, 19 bp, Homo sapiens
gccttagaagtcacacagt

SEQ ID NO: 3374157 - DNA, 13 bp, Homo sapiens
gccttagaggagc

SEQ ID NO: 3374158 - DNA, 18 bp, Homo sapiens
gccttagctcccagctag

SEQ ID NO: 3374159 - DNA, 12 bp, Homo sapiens
gccttagctgcc

SEQ ID NO: 3374160 - DNA, 15 bp, Homo sapiens
gccttagctgccagt

SEQ ID NO: 3374161 - DNA, 15 bp, Homo sapiens
gccttagggaagctg

SEQ ID NO: 3374162 - DNA, 15 bp, Homo sapiens
gccttagtctcagtt

SEQ ID NO: 3374163 - DNA, 17 bp, Homo sapiens
gccttagtgggccaggg

SEQ ID NO: 3374164 - DNA, 18 bp, Homo sapiens
gccttataaaccaatctt

SEQ ID NO: 3374165 - DNA, 13 bp, Homo sapiens
gccttatttccct

SEQ ID NO: 3374166 - DNA, 15 bp, Homo sapiens
gccttcaagtgccaa

SEQ ID NO: 3374167 - DNA, 17 bp, Homo sapiens
gccttcagaaccatcca

SEQ ID NO: 3374168 - DNA, 13 bp, Homo sapiens
gccttcagctcca

SEQ ID NO: 3374169 - DNA, 14 bp, Homo sapiens
gccttcaggcttct

SEQ ID NO: 3374170 - DNA, 21 bp, Homo sapiens
gccttcatctgggacaaaact

SEQ ID NO: 3374171 - DNA, 18 bp, Homo sapiens
gccttccacagtgaatgt

SEQ ID NO: 3374172 - DNA, 14 bp, Homo sapiens
gccttccaggtcag

SEQ ID NO: 3374173 - DNA, 16 bp, Homo sapiens
gccttccaggtcagga

SEQ ID NO: 3374174 - DNA, 14 bp, Homo sapiens
gccttccataatta

SEQ ID NO: 3374175 - DNA, 15 bp, Homo sapiens
gccttccataattat

SEQ ID NO: 3374176 - DNA, 16 bp, Homo sapiens
gccttccataattatg

SEQ ID NO: 3374177 - DNA, 21 bp, Homo sapiens
gccttccataattatgacagt

SEQ ID NO: 3374178 - DNA, 19 bp, Homo sapiens
gccttcccaagttgtgctt

SEQ ID NO: 3374179 - DNA, 14 bp, Homo sapiens
gccttcccctgtct

SEQ ID NO: 3374180 - DNA, 20 bp, Homo sapiens
gccttcccctgtcttcacct

SEQ ID NO: 3374181 - DNA, 16 bp, Homo sapiens
gccttccccttttgcc

SEQ ID NO: 3374182 - DNA, 19 bp, Homo sapiens
gccttccccttttgcctgg

SEQ ID NO: 3374183 - DNA, 20 bp, Homo sapiens
gccttccgccccttcccttc

SEQ ID NO: 3374184 - DNA, 20 bp, Homo sapiens
gccttcctcctccacagtgc

SEQ ID NO: 3374185 - DNA, 13 bp, Homo sapiens
gccttcctctctc

SEQ ID NO: 3374186 - DNA, 23 bp, Homo sapiens
gccttccttcccgccagagggct

SEQ ID NO: 3374187 - DNA, 18 bp, Homo sapiens
gccttccttgaccttcct

SEQ ID NO: 3374188 - DNA, 19 bp, Homo sapiens
gccttcctttctccaggac

SEQ ID NO: 3374189 - DNA, 19 bp, Homo sapiens
gccttcggcctccatcctg

SEQ ID NO: 3374190 - DNA, 15 bp, Homo sapiens
gccttctcccacatg

SEQ ID NO: 3374191 - DNA, 14 bp, Homo sapiens
gccttctcctctct

SEQ ID NO: 3374192 - DNA, 19 bp, Homo sapiens
gccttctcctctctgggcc

SEQ ID NO: 3374193 - DNA, 20 bp, Homo sapiens
gccttctcctctctgggcct

SEQ ID NO: 3374194 - DNA, 21 bp, Homo sapiens
gccttctcctctctgggcctt

SEQ ID NO: 3374195 - DNA, 19 bp, Homo sapiens
gccttctccttccccagga

SEQ ID NO: 3374196 - DNA, 21 bp, Homo sapiens
gccttctctattgggcacagc

SEQ ID NO: 3374197 - DNA, 15 bp, Homo sapiens
gccttctctgaagga

SEQ ID NO: 3374198 - DNA, 19 bp, Homo sapiens
gccttctgacggccctgca

SEQ ID NO: 3374199 - DNA, 11 bp, Homo sapiens
gccttctgcag

SEQ ID NO: 3374200 - DNA, 13 bp, Homo sapiens
gccttctgcagca

SEQ ID NO: 3374201 - DNA, 17 bp, Homo sapiens
gccttctgctgcccagg

SEQ ID NO: 3374202 - DNA, 20 bp, Homo sapiens
gccttctgctgcccaggcca

SEQ ID NO: 3374203 - DNA, 21 bp, Homo sapiens
gccttctgctgcccaggccac

SEQ ID NO: 3374204 - DNA, 16 bp, Homo sapiens
gccttctgtcctggtg

SEQ ID NO: 3374205 - DNA, 14 bp, Homo sapiens
gccttcttccatcc

SEQ ID NO: 3374206 - DNA, 20 bp, Homo sapiens
gccttcttccatcccaggac

SEQ ID NO: 3374207 - DNA, 20 bp, Homo sapiens
gccttcttctttttgctgtt

SEQ ID NO: 3374208 - DNA, 14 bp, Homo sapiens
gccttgaactgttg

SEQ ID NO: 3374209 - DNA, 16 bp, Homo sapiens
gccttgacatcagttc

SEQ ID NO: 3374210 - DNA, 18 bp, Homo sapiens
gccttgacatcagttcct

SEQ ID NO: 3374211 - DNA, 15 bp, Homo sapiens
gccttgagccctggc

SEQ ID NO: 3374212 - DNA, 18 bp, Homo sapiens
gccttgataaatatatat

SEQ ID NO: 3374213 - DNA, 16 bp, Homo sapiens
gccttgcagccacatg

SEQ ID NO: 3374214 - DNA, 23 bp, Homo sapiens
gccttgcctaaatttaatgctgc

SEQ ID NO: 3374215 - DNA, 15 bp, Homo sapiens
gccttgctgctgctg

SEQ ID NO: 3374216 - DNA, 17 bp, Homo sapiens
gccttgctgctgctgca

SEQ ID NO: 3374217 - DNA, 18 bp, Homo sapiens
gccttgctgctgctgcac

SEQ ID NO: 3374218 - DNA, 22 bp, Homo sapiens
gccttgctgctgctgcacccaa

SEQ ID NO: 3374219 - DNA, 17 bp, Homo sapiens
gccttgctttgggcttt

SEQ ID NO: 3374220 - DNA, 24 bp, Homo sapiens
gccttggcatgggcgcaggcccag

SEQ ID NO: 3374221 - DNA, 15 bp, Homo sapiens
gccttggccggctgt

SEQ ID NO: 3374222 - DNA, 12 bp, Homo sapiens
gccttggcctcg

SEQ ID NO: 3374223 - DNA, 17 bp, Homo sapiens
gccttggggaggacaaa

SEQ ID NO: 3374224 - DNA, 21 bp, Homo sapiens
gccttggggaggacaaaactt

SEQ ID NO: 3374225 - DNA, 22 bp, Homo sapiens
gccttgggttccaaccaggcag

SEQ ID NO: 3374226 - DNA, 23 bp, Homo sapiens
gccttgtaaataaccacaaggtc

SEQ ID NO: 3374227 - DNA, 19 bp, Homo sapiens
gccttgtctcctactcctg

SEQ ID NO: 3374228 - DNA, 12 bp, Homo sapiens
gccttgtgccct

SEQ ID NO: 3374229 - DNA, 17 bp, Homo sapiens
gccttgtgccctgcccc

SEQ ID NO: 3374230 - DNA, 17 bp, Homo sapiens
gcctttaaatctgtgat

SEQ ID NO: 3374231 - DNA, 17 bp, Homo sapiens
gcctttaagaaccttaa

SEQ ID NO: 3374232 - DNA, 12 bp, Homo sapiens
gcctttaagcca

SEQ ID NO: 3374233 - DNA, 10 bp, Homo sapiens
gcctttatat

SEQ ID NO: 3374234 - DNA, 14 bp, Homo sapiens
gcctttatggtttc

SEQ ID NO: 3374235 - DNA, 19 bp, Homo sapiens
gcctttatgttttttgtaa

SEQ ID NO: 3374236 - DNA, 13 bp, Homo sapiens
gcctttcctgttc

SEQ ID NO: 3374237 - DNA, 16 bp, Homo sapiens
gcctttcctgttcagc

SEQ ID NO: 3374238 - DNA, 18 bp, Homo sapiens
gcctttcctgttcagcat

SEQ ID NO: 3374239 - DNA, 20 bp, Homo sapiens
gcctttcctgttcagcattc

SEQ ID NO: 3374240 - DNA, 14 bp, Homo sapiens
gcctttctaagact

SEQ ID NO: 3374241 - DNA, 15 bp, Homo sapiens
gcctttcttctgccc

SEQ ID NO: 3374242 - DNA, 16 bp, Homo sapiens
gcctttcttctgccct

SEQ ID NO: 3374243 - DNA, 17 bp, Homo sapiens
gcctttcttctgccctt

SEQ ID NO: 3374244 - DNA, 17 bp, Homo sapiens
gcctttgatgttacaga

SEQ ID NO: 3374245 - DNA, 18 bp, Homo sapiens
gcctttgcaagatgcttg

SEQ ID NO: 3374246 - DNA, 12 bp, Homo sapiens
gcctttgccctg

SEQ ID NO: 3374247 - DNA, 15 bp, Homo sapiens
gcctttgcctccccg

SEQ ID NO: 3374248 - DNA, 16 bp, Homo sapiens
gcctttggccttggct

SEQ ID NO: 3374249 - DNA, 11 bp, Homo sapiens
gcctttgtaag

SEQ ID NO: 3374250 - DNA, 15 bp, Homo sapiens
gcctttgtaagttat

SEQ ID NO: 3374251 - DNA, 15 bp, Homo sapiens
gcctttgtcttgtac

SEQ ID NO: 3374252 - DNA, 14 bp, Homo sapiens
gccttttaacattt

SEQ ID NO: 3374253 - DNA, 15 bp, Homo sapiens
gccttttaacatttt

SEQ ID NO: 3374254 - DNA, 20 bp, Homo sapiens
gccttttaacattttgttct

SEQ ID NO: 3374255 - DNA, 14 bp, Homo sapiens
gccttttaattttt

SEQ ID NO: 3374256 - DNA, 14 bp, Homo sapiens
gccttttatagcta

SEQ ID NO: 3374257 - DNA, 16 bp, Homo sapiens
gccttttatctgcaga

SEQ ID NO: 3374258 - DNA, 12 bp, Homo sapiens
gccttttcctga

SEQ ID NO: 3374259 - DNA, 14 bp, Homo sapiens
gccttttggatatg

SEQ ID NO: 3374260 - DNA, 13 bp, Homo sapiens
gccttttgtgtga

SEQ ID NO: 3374261 - DNA, 15 bp, Homo sapiens
gcctttttcatttat

SEQ ID NO: 3374262 - DNA, 11 bp, Homo sapiens
gcgaaaatagt

SEQ ID NO: 3374263 - DNA, 18 bp, Homo sapiens
gcgaaaggcgagtccagg

SEQ ID NO: 3374264 - DNA, 18 bp, Homo sapiens
gcgaagccttctgcagca

SEQ ID NO: 3374265 - DNA, 16 bp, Homo sapiens
gcgaaggggccctggt

SEQ ID NO: 3374266 - DNA, 21 bp, Homo sapiens
gcgaatccaagctccctgccc

SEQ ID NO: 3374267 - DNA, 23 bp, Homo sapiens
gcgacagagcgagagtctgtctc

SEQ ID NO: 3374268 - DNA, 18 bp, Homo sapiens
gcgacatagcccatccct

SEQ ID NO: 3374269 - DNA, 14 bp, Homo sapiens
gcgaccgggcctcc

SEQ ID NO: 3374270 - DNA, 15 bp, Homo sapiens
gcgaccgggcctccc

SEQ ID NO: 3374271 - DNA, 17 bp, Homo sapiens
gcgaccgggcctcccct

SEQ ID NO: 3374272 - DNA, 23 bp, Homo sapiens
gcgactaatttcaaaatgctttt

SEQ ID NO: 3374273 - DNA, 18 bp, Homo sapiens
gcgactccgttggccact

SEQ ID NO: 3374274 - DNA, 19 bp, Homo sapiens
gcgactccgttggccactc

SEQ ID NO: 3374275 - DNA, 16 bp, Homo sapiens
gcgagactctgtctca

SEQ ID NO: 3374276 - DNA, 14 bp, Homo sapiens
gcgagagaggagcc

SEQ ID NO: 3374277 - DNA, 16 bp, Homo sapiens
gcgagagtctgtctca

SEQ ID NO: 3374278 - DNA, 21 bp, Homo sapiens
gcgagatcggggtagaaatgc

SEQ ID NO: 3374279 - DNA, 15 bp, Homo sapiens
gcgagcacatgttca

SEQ ID NO: 3374280 - DNA, 14 bp, Homo sapiens
gcgagctgagaagc

SEQ ID NO: 3374281 - DNA, 22 bp, Homo sapiens
gcgaggaccactttggagactg

SEQ ID NO: 3374282 - DNA, 18 bp, Homo sapiens
gcgaggaggcgcggcctc

SEQ ID NO: 3374283 - DNA, 13 bp, Homo sapiens
gcgaggcaggccg

SEQ ID NO: 3374284 - DNA, 14 bp, Homo sapiens
gcgagggcagctgc

SEQ ID NO: 3374285 - DNA, 17 bp, Homo sapiens
gcgagggcagctgctat

SEQ ID NO: 3374286 - DNA, 17 bp, Homo sapiens
gcgagtccaggagctca

SEQ ID NO: 3374287 - DNA, 16 bp, Homo sapiens
gcgatccacctgtctc

SEQ ID NO: 3374288 - DNA, 15 bp, Homo sapiens
gcgatcccacacagg

SEQ ID NO: 3374289 - DNA, 16 bp, Homo sapiens
gcgatctctcctggcc

SEQ ID NO: 3374290 - DNA, 22 bp, Homo sapiens
gcgatctgggttcactgcaacc

SEQ ID NO: 3374291 - DNA, 19 bp, Homo sapiens
gcgatgaatttggagactc

SEQ ID NO: 3374292 - DNA, 23 bp, Homo sapiens
gcgatgtttcaggaggctggagg

SEQ ID NO: 3374293 - DNA, 17 bp, Homo sapiens
gcgattctcctgcctca

SEQ ID NO: 3374294 - DNA, 13 bp, Homo sapiens
gcgattcttctgc

SEQ ID NO: 3374295 - DNA, 17 bp, Homo sapiens
gcgattcttctgcttca

SEQ ID NO: 3374296 - DNA, 22 bp, Homo sapiens
gcgcaaaactgcctgaaagcaa

SEQ ID NO: 3374297 - DNA, 20 bp, Homo sapiens
gcgcaagatagatttggaat

SEQ ID NO: 3374298 - DNA, 21 bp, Homo sapiens
gcgcaatctcggctcactgca

SEQ ID NO: 3374299 - DNA, 17 bp, Homo sapiens
gcgcacaaggctgacca

SEQ ID NO: 3374300 - DNA, 18 bp, Homo sapiens
gcgcacaaggctgaccaa

SEQ ID NO: 3374301 - DNA, 16 bp, Homo sapiens
gcgcaccaatgcccag

SEQ ID NO: 3374302 - DNA, 19 bp, Homo sapiens
gcgcacctgccccctggtg

SEQ ID NO: 3374303 - DNA, 15 bp, Homo sapiens
gcgcaggcccagtga

SEQ ID NO: 3374304 - DNA, 18 bp, Homo sapiens
gcgcaggtgggctggact

SEQ ID NO: 3374305 - DNA, 19 bp, Homo sapiens
gcgcaggtgggctggactt

SEQ ID NO: 3374306 - DNA, 21 bp, Homo sapiens
gcgcatccaatctcaaggaat

SEQ ID NO: 3374307 - DNA, 14 bp, Homo sapiens
gcgccaagcaacct

SEQ ID NO: 3374308 - DNA, 21 bp, Homo sapiens
gcgccactacactccagcctg

SEQ ID NO: 3374309 - DNA, 24 bp, Homo sapiens
gcgccactacactccagcctgagc

SEQ ID NO: 3374310 - DNA, 16 bp, Homo sapiens
gcgccactcgcttccc

SEQ ID NO: 3374311 - DNA, 23 bp, Homo sapiens
gcgccactcgcttcccccatagc

SEQ ID NO: 3374312 - DNA, 16 bp, Homo sapiens
gcgccccgcccacacc

SEQ ID NO: 3374313 - DNA, 11 bp, Homo sapiens
gcgcccctccc

SEQ ID NO: 3374314 - DNA, 13 bp, Homo sapiens
gcgcccctgctgt

SEQ ID NO: 3374315 - DNA, 15 bp, Homo sapiens
gcgcccctgctgtct

SEQ ID NO: 3374316 - DNA, 17 bp, Homo sapiens
gcgcccgcccctgcagc

SEQ ID NO: 3374317 - DNA, 22 bp, Homo sapiens
gcgcccgcccctgcagcacgga

SEQ ID NO: 3374318 - DNA, 14 bp, Homo sapiens
gcgccctctctgct

SEQ ID NO: 3374319 - DNA, 15 bp, Homo sapiens
gcgccctctctgctc

SEQ ID NO: 3374320 - DNA, 16 bp, Homo sapiens
gcgccctctctgctcc

SEQ ID NO: 3374321 - DNA, 17 bp, Homo sapiens
gcgccctctctgctcct

SEQ ID NO: 3374322 - DNA, 15 bp, Homo sapiens
gcgccgtctccaggg

SEQ ID NO: 3374323 - DNA, 16 bp, Homo sapiens
gcgccgtgctgtaaat

SEQ ID NO: 3374324 - DNA, 24 bp, Homo sapiens
gcgcctagagcgcggctggctctg

SEQ ID NO: 3374325 - DNA, 22 bp, Homo sapiens
gcgcctccttccttgctgtcct

SEQ ID NO: 3374326 - DNA, 23 bp, Homo sapiens
gcgcctggagagcgaggaggcgc

SEQ ID NO: 3374327 - DNA, 17 bp, Homo sapiens
gcgcctggcacatttca

SEQ ID NO: 3374328 - DNA, 19 bp, Homo sapiens
gcgcctggcacatttcagg

SEQ ID NO: 3374329 - DNA, 16 bp, Homo sapiens
gcgcctgtgatgctgg

SEQ ID NO: 3374330 - DNA, 15 bp, Homo sapiens
gcgcctgtgcacaca

SEQ ID NO: 3374331 - DNA, 17 bp, Homo sapiens
gcgcctgtgcacacaca

SEQ ID NO: 3374332 - DNA, 21 bp, Homo sapiens
gcgccttgtctcctactcctg

SEQ ID NO: 3374333 - DNA, 23 bp, Homo sapiens
gcgccttgtctcctactcctgac

SEQ ID NO: 3374334 - DNA, 14 bp, Homo sapiens
gcgcgccactcgct

SEQ ID NO: 3374335 - DNA, 17 bp, Homo sapiens
gcgcggcctcccgagga

SEQ ID NO: 3374336 - DNA, 20 bp, Homo sapiens
gcgcggcctcccgaggaggg

SEQ ID NO: 3374337 - DNA, 17 bp, Homo sapiens
gcgcgggaggcaccagc

SEQ ID NO: 3374338 - DNA, 13 bp, Homo sapiens
gcgcggtggctca

SEQ ID NO: 3374339 - DNA, 15 bp, Homo sapiens
gcgcggtggctcacg

SEQ ID NO: 3374340 - DNA, 14 bp, Homo sapiens
gcgctatcttcaca

SEQ ID NO: 3374341 - DNA, 14 bp, Homo sapiens
gcgctattacaaat

SEQ ID NO: 3374342 - DNA, 14 bp, Homo sapiens
gcgctcagacggcg

SEQ ID NO: 3374343 - DNA, 19 bp, Homo sapiens
gcgctcagacggcggccag

SEQ ID NO: 3374344 - DNA, 21 bp, Homo sapiens
gcgctcagacggcggccaggc

SEQ ID NO: 3374345 - DNA, 10 bp, Homo sapiens
gcgctcagga

SEQ ID NO: 3374346 - DNA, 13 bp, Homo sapiens
gcgctcaggaccc

SEQ ID NO: 3374347 - DNA, 14 bp, Homo sapiens
gcgctcaggaccca

SEQ ID NO: 3374348 - DNA, 22 bp, Homo sapiens
gcgctcagggccatgctgaggc

SEQ ID NO: 3374349 - DNA, 14 bp, Homo sapiens
gcgctcccagcctg

SEQ ID NO: 3374350 - DNA, 15 bp, Homo sapiens
gcgctcctcctgtgt

SEQ ID NO: 3374351 - DNA, 14 bp, Homo sapiens
gcgctcgcccagca

SEQ ID NO: 3374352 - DNA, 20 bp, Homo sapiens
gcgctctgcctcaccgcttc

SEQ ID NO: 3374353 - DNA, 20 bp, Homo sapiens
gcgctcttggtccctggtcc

SEQ ID NO: 3374354 - DNA, 22 bp, Homo sapiens
gcgctgcaggtacttcctcctg

SEQ ID NO: 3374355 - DNA, 17 bp, Homo sapiens
gcgctgccccctcccca

SEQ ID NO: 3374356 - DNA, 10 bp, Homo sapiens
gcgctggccc

SEQ ID NO: 3374357 - DNA, 12 bp, Homo sapiens
gcgctggcccag

SEQ ID NO: 3374358 - DNA, 17 bp, Homo sapiens
gcgctggcccagccggc

SEQ ID NO: 3374359 - DNA, 12 bp, Homo sapiens
gcgctgggaagg

SEQ ID NO: 3374360 - DNA, 22 bp, Homo sapiens
gcgctgtttttgttgtgtgtgc

SEQ ID NO: 3374361 - DNA, 14 bp, Homo sapiens
gcgcttcccagcac

SEQ ID NO: 3374362 - DNA, 15 bp, Homo sapiens
gcggacagccacggc

SEQ ID NO: 3374363 - DNA, 19 bp, Homo sapiens
gcggactcctcctttctcc

SEQ ID NO: 3374364 - DNA, 21 bp, Homo sapiens
gcggagcccagcctgggagcc

SEQ ID NO: 3374365 - DNA, 19 bp, Homo sapiens
gcggagcttgcagtgagcc

SEQ ID NO: 3374366 - DNA, 20 bp, Homo sapiens
gcggagcttgcagtgagccg

SEQ ID NO: 3374367 - DNA, 18 bp, Homo sapiens
gcggaggaggagggaggc

SEQ ID NO: 3374368 - DNA, 22 bp, Homo sapiens
gcggaggtgttcccaggctgcc

SEQ ID NO: 3374369 - DNA, 18 bp, Homo sapiens
gcggagtgaagaggggca

SEQ ID NO: 3374370 - DNA, 15 bp, Homo sapiens
gcggatcctgctggg

SEQ ID NO: 3374371 - DNA, 14 bp, Homo sapiens
gcggcaggagggag

SEQ ID NO: 3374372 - DNA, 22 bp, Homo sapiens
gcggcaggagggaggtttgtga

SEQ ID NO: 3374373 - DNA, 17 bp, Homo sapiens
gcggccacgcactgggc

SEQ ID NO: 3374374 - DNA, 18 bp, Homo sapiens
gcggccacgcactgggcc

SEQ ID NO: 3374375 - DNA, 20 bp, Homo sapiens
gcggccacgcactgggccac

SEQ ID NO: 3374376 - DNA, 18 bp, Homo sapiens
gcggccagcgtcccaggg

SEQ ID NO: 3374377 - DNA, 14 bp, Homo sapiens
gcggccaggcacag

SEQ ID NO: 3374378 - DNA, 17 bp, Homo sapiens
gcggccaggcacagggc

SEQ ID NO: 3374379 - DNA, 19 bp, Homo sapiens
gcggccagtattagactgg

SEQ ID NO: 3374380 - DNA, 14 bp, Homo sapiens
gcggccccaggagg

SEQ ID NO: 3374381 - DNA, 18 bp, Homo sapiens
gcggccccccgcacagcc

SEQ ID NO: 3374382 - DNA, 22 bp, Homo sapiens
gcggccccccgcacagccaccc

SEQ ID NO: 3374383 - DNA, 16 bp, Homo sapiens
gcggcccggccagcgg

SEQ ID NO: 3374384 - DNA, 16 bp, Homo sapiens
gcggccgcagagactg

SEQ ID NO: 3374385 - DNA, 22 bp, Homo sapiens
gcggcctcgtgccatgatctgt

SEQ ID NO: 3374386 - DNA, 20 bp, Homo sapiens
gcggcctttgttgctcagca

SEQ ID NO: 3374387 - DNA, 17 bp, Homo sapiens
gcggcgatttttgtatg

SEQ ID NO: 3374388 - DNA, 16 bp, Homo sapiens
gcggcgcgccctgcag

SEQ ID NO: 3374389 - DNA, 22 bp, Homo sapiens
gcggcggtggactgcgctggac

SEQ ID NO: 3374390 - DNA, 21 bp, Homo sapiens
gcggctgctcgcccaggaagg

SEQ ID NO: 3374391 - DNA, 22 bp, Homo sapiens
gcggctgctcgcccaggaaggc

SEQ ID NO: 3374392 - DNA, 20 bp, Homo sapiens
gcggctggctctgtggaggg

SEQ ID NO: 3374393 - DNA, 15 bp, Homo sapiens
gcggcttcctgtcca

SEQ ID NO: 3374394 - DNA, 17 bp, Homo sapiens
gcggcttcctgtccact

SEQ ID NO: 3374395 - DNA, 21 bp, Homo sapiens
gcgggacgtccctgcccatgt

SEQ ID NO: 3374396 - DNA, 17 bp, Homo sapiens
gcgggagacctgtgcta

SEQ ID NO: 3374397 - DNA, 15 bp, Homo sapiens
gcgggagctctgtat

SEQ ID NO: 3374398 - DNA, 20 bp, Homo sapiens
gcgggaggatgttctgggac

SEQ ID NO: 3374399 - DNA, 21 bp, Homo sapiens
gcgggaggatgttctgggaca

SEQ ID NO: 3374400 - DNA, 12 bp, Homo sapiens
gcgggaggcacc

SEQ ID NO: 3374401 - DNA, 15 bp, Homo sapiens
gcgggaggcaccagc

SEQ ID NO: 3374402 - DNA, 23 bp, Homo sapiens
gcgggaggcaccagctctgtggc

SEQ ID NO: 3374403 - DNA, 12 bp, Homo sapiens
gcgggaggccct

SEQ ID NO: 3374404 - DNA, 18 bp, Homo sapiens
gcgggaggccctggccct

SEQ ID NO: 3374405 - DNA, 14 bp, Homo sapiens
gcgggatgggccac

SEQ ID NO: 3374406 - DNA, 15 bp, Homo sapiens
gcgggatgggccacc

SEQ ID NO: 3374407 - DNA, 12 bp, Homo sapiens
gcgggcacaggg

SEQ ID NO: 3374408 - DNA, 15 bp, Homo sapiens
gcgggccagccaggc

SEQ ID NO: 3374409 - DNA, 13 bp, Homo sapiens
gcgggccaggccc

SEQ ID NO: 3374410 - DNA, 18 bp, Homo sapiens
gcgggccaggcccgcacc

SEQ ID NO: 3374411 - DNA, 23 bp, Homo sapiens
gcgggccaggcccgcaccccggc

SEQ ID NO: 3374412 - DNA, 22 bp, Homo sapiens
gcgggccatgagggacagggtc

SEQ ID NO: 3374413 - DNA, 23 bp, Homo sapiens
gcgggctaacgggaggctgggca

SEQ ID NO: 3374414 - DNA, 18 bp, Homo sapiens
gcgggctccctggcagga

SEQ ID NO: 3374415 - DNA, 14 bp, Homo sapiens
gcggggacagctcc

SEQ ID NO: 3374416 - DNA, 15 bp, Homo sapiens
gcggggacagctcct

SEQ ID NO: 3374417 - DNA, 17 bp, Homo sapiens
gcggggaccttggtctg

SEQ ID NO: 3374418 - DNA, 20 bp, Homo sapiens
gcggggctcgaggctggtgc

SEQ ID NO: 3374419 - DNA, 19 bp, Homo sapiens
gcggggggggcgcctggag

SEQ ID NO: 3374420 - DNA, 20 bp, Homo sapiens
gcggggggggcgcctggaga

SEQ ID NO: 3374421 - DNA, 19 bp, Homo sapiens
gcggtcaggctgggcagcc

SEQ ID NO: 3374422 - DNA, 22 bp, Homo sapiens
gcggtcaggctgggcagcccca

SEQ ID NO: 3374423 - DNA, 23 bp, Homo sapiens
gcggtcaggctgggcagccccag

SEQ ID NO: 3374424 - DNA, 16 bp, Homo sapiens
gcggtccacccaggag

SEQ ID NO: 3374425 - DNA, 18 bp, Homo sapiens
gcggtccacccaggagcc

SEQ ID NO: 3374426 - DNA, 12 bp, Homo sapiens
gcggtccccatc

SEQ ID NO: 3374427 - DNA, 20 bp, Homo sapiens
gcggtctcaggctggtggga

SEQ ID NO: 3374428 - DNA, 22 bp, Homo sapiens
gcggtctcaggctggtgggagg

SEQ ID NO: 3374429 - DNA, 19 bp, Homo sapiens
gcggtcttcaacatcctgc

SEQ ID NO: 3374430 - DNA, 19 bp, Homo sapiens
gcggtgagaggggaacaga

SEQ ID NO: 3374431 - DNA, 14 bp, Homo sapiens
gcggtgctctggcg

SEQ ID NO: 3374432 - DNA, 18 bp, Homo sapiens
gcggtggctcacgcctgt

SEQ ID NO: 3374433 - DNA, 17 bp, Homo sapiens
gcggtggctgccccggc

SEQ ID NO: 3374434 - DNA, 23 bp, Homo sapiens
gcggttatgaaattcaccccctt

SEQ ID NO: 3374435 - DNA, 14 bp, Homo sapiens
gcggtttggggagc

SEQ ID NO: 3374436 - DNA, 14 bp, Homo sapiens
gcgtaatgggcctg

SEQ ID NO: 3374437 - DNA, 14 bp, Homo sapiens
gcgtatgagtccca

SEQ ID NO: 3374438 - DNA, 14 bp, Homo sapiens
gcgtcagtcttttt

SEQ ID NO: 3374439 - DNA, 19 bp, Homo sapiens
gcgtcagtctttttctgtt

SEQ ID NO: 3374440 - DNA, 23 bp, Homo sapiens
gcgtcagtctttttctgttgtaa

SEQ ID NO: 3374441 - DNA, 14 bp, Homo sapiens
gcgtcccagctgaa

SEQ ID NO: 3374442 - DNA, 23 bp, Homo sapiens
gcgtcccagctgaaggcagtggc

SEQ ID NO: 3374443 - DNA, 17 bp, Homo sapiens
gcgtccccactcccttg

SEQ ID NO: 3374444 - DNA, 20 bp, Homo sapiens
gcgtcccctgctactcctgt

SEQ ID NO: 3374445 - DNA, 19 bp, Homo sapiens
gcgtccctagcagtgaact

SEQ ID NO: 3374446 - DNA, 11 bp, Homo sapiens
gcgtccctggc

SEQ ID NO: 3374447 - DNA, 19 bp, Homo sapiens
gcgtcctgcagaggaccac

SEQ ID NO: 3374448 - DNA, 24 bp, Homo sapiens
gcgtcctgtccacacccagctcag

SEQ ID NO: 3374449 - DNA, 17 bp, Homo sapiens
gcgtccttccccctgta

SEQ ID NO: 3374450 - DNA, 21 bp, Homo sapiens
gcgtctcctgtttttctgggt

SEQ ID NO: 3374451 - DNA, 14 bp, Homo sapiens
gcgtctgaggggac

SEQ ID NO: 3374452 - DNA, 21 bp, Homo sapiens
gcgtctttaagagactcactg

SEQ ID NO: 3374453 - DNA, 16 bp, Homo sapiens
gcgtgactcagcagcc

SEQ ID NO: 3374454 - DNA, 22 bp, Homo sapiens
gcgtgactcagcagcctgcgct

SEQ ID NO: 3374455 - DNA, 20 bp, Homo sapiens
gcgtgcacacaccagagccc

SEQ ID NO: 3374456 - DNA, 16 bp, Homo sapiens
gcgtgccgcctgctcc

SEQ ID NO: 3374457 - DNA, 17 bp, Homo sapiens
gcgtgccgcctgctcct

SEQ ID NO: 3374458 - DNA, 23 bp, Homo sapiens
gcgtgcgagcacacacacacata

SEQ ID NO: 3374459 - DNA, 16 bp, Homo sapiens
gcgtggagactggcag

SEQ ID NO: 3374460 - DNA, 19 bp, Homo sapiens
gcgtggagactggcaggcg

SEQ ID NO: 3374461 - DNA, 15 bp, Homo sapiens
gcgtggctgtggcac

SEQ ID NO: 3374462 - DNA, 19 bp, Homo sapiens
gcgtggctgtggcacagac

SEQ ID NO: 3374463 - DNA, 17 bp, Homo sapiens
gcgtggtcactgctgtc

SEQ ID NO: 3374464 - DNA, 21 bp, Homo sapiens
gcgtggtgtgtccctggacac

SEQ ID NO: 3374465 - DNA, 22 bp, Homo sapiens
gcgtgtgggtcccgcactctgc

SEQ ID NO: 3374466 - DNA, 21 bp, Homo sapiens
gcgtgtgtagagttaagaagc

SEQ ID NO: 3374467 - DNA, 19 bp, Homo sapiens
gcgttatttatggaccact

SEQ ID NO: 3374468 - DNA, 18 bp, Homo sapiens
gcgttcacctccctgctc

SEQ ID NO: 3374469 - DNA, 23 bp, Homo sapiens
gcgttctaccaggcaaattcact

SEQ ID NO: 3374470 - DNA, 15 bp, Homo sapiens
gcgttgcatgtcgtg

SEQ ID NO: 3374471 - DNA, 17 bp, Homo sapiens
gcgttggagccactcct

SEQ ID NO: 3374472 - DNA, 17 bp, Homo sapiens
gcgttgggagcctagct

SEQ ID NO: 3374473 - DNA, 22 bp, Homo sapiens
gcgttggtccagagcggaggct

SEQ ID NO: 3374474 - DNA, 16 bp, Homo sapiens
gcgttttgttgtagat

SEQ ID NO: 3374475 - DNA, 14 bp, Homo sapiens
gcgtttttttacaa

SEQ ID NO: 3374476 - DNA, 20 bp, Homo sapiens
gcgtttttttacaacattca

SEQ ID NO: 3374477 - DNA, 14 bp, Homo sapiens
gctaaaatatataa

SEQ ID NO: 3374478 - DNA, 14 bp, Homo sapiens
gctaaagcactttg

SEQ ID NO: 3374479 - DNA, 21 bp, Homo sapiens
gctaaagcactttgcacttaa

SEQ ID NO: 3374480 - DNA, 20 bp, Homo sapiens
gctaaaggggagaaactgaa

SEQ ID NO: 3374481 - DNA, 20 bp, Homo sapiens
gctaacatggtgaaaccccg

SEQ ID NO: 3374482 - DNA, 21 bp, Homo sapiens
gctaacattttaaataaaaga

SEQ ID NO: 3374483 - DNA, 22 bp, Homo sapiens
gctaaccccaagctgcctctgg

SEQ ID NO: 3374484 - DNA, 19 bp, Homo sapiens
gctaaccttttcacctcca

SEQ ID NO: 3374485 - DNA, 21 bp, Homo sapiens
gctaacgggaggctgggcaca

SEQ ID NO: 3374486 - DNA, 14 bp, Homo sapiens
gctaagaaaagatt

SEQ ID NO: 3374487 - DNA, 19 bp, Homo sapiens
gctaagaaagtagaggcat

SEQ ID NO: 3374488 - DNA, 15 bp, Homo sapiens
gctaagctaggaatg

SEQ ID NO: 3374489 - DNA, 19 bp, Homo sapiens
gctaagctaggaatgaaat

SEQ ID NO: 3374490 - DNA, 17 bp, Homo sapiens
gctaaggctcctccttg

SEQ ID NO: 3374491 - DNA, 19 bp, Homo sapiens
gctaagggtgggtgctcag

SEQ ID NO: 3374492 - DNA, 20 bp, Homo sapiens
gctaagtatcaggggaaaaa

SEQ ID NO: 3374493 - DNA, 21 bp, Homo sapiens
gctaagtatcaggggaaaaaa

SEQ ID NO: 3374494 - DNA, 13 bp, Homo sapiens
gctaagttctaag

SEQ ID NO: 3374495 - DNA, 22 bp, Homo sapiens
gctaagttctaagttcatgttt

SEQ ID NO: 3374496 - DNA, 19 bp, Homo sapiens
gctaataaacactggctct

SEQ ID NO: 3374497 - DNA, 21 bp, Homo sapiens
gctaataaacactggctctgg

SEQ ID NO: 3374498 - DNA, 22 bp, Homo sapiens
gctaataaactgtattaaatct

SEQ ID NO: 3374499 - DNA, 19 bp, Homo sapiens
gctaatcaaagccagggtc

SEQ ID NO: 3374500 - DNA, 22 bp, Homo sapiens
gctaatcagcattctcactcct

SEQ ID NO: 3374501 - DNA, 16 bp, Homo sapiens
gctaatcagtgtctca

SEQ ID NO: 3374502 - DNA, 17 bp, Homo sapiens
gctaatcagtgtctcac

SEQ ID NO: 3374503 - DNA, 22 bp, Homo sapiens
gctaatcatgtgggtgagccag

SEQ ID NO: 3374504 - DNA, 17 bp, Homo sapiens
gctaatctgtagggctg

SEQ ID NO: 3374505 - DNA, 19 bp, Homo sapiens
gctaatctgtagggctgga

SEQ ID NO: 3374506 - DNA, 18 bp, Homo sapiens
gctaatgtaggactgtat

SEQ ID NO: 3374507 - DNA, 14 bp, Homo sapiens
gctaatttaacacc

SEQ ID NO: 3374508 - DNA, 20 bp, Homo sapiens
gctaatttatcctgaaattt

SEQ ID NO: 3374509 - DNA, 12 bp, Homo sapiens
gctaatttgcat

SEQ ID NO: 3374510 - DNA, 13 bp, Homo sapiens
gctaattttctca

SEQ ID NO: 3374511 - DNA, 19 bp, Homo sapiens
gctacaaatttatgcattt

SEQ ID NO: 3374512 - DNA, 13 bp, Homo sapiens
gctacaattttaa

SEQ ID NO: 3374513 - DNA, 22 bp, Homo sapiens
gctacagagccgagcaatattt

SEQ ID NO: 3374514 - DNA, 19 bp, Homo sapiens
gctacagctttcttgctcc

SEQ ID NO: 3374515 - DNA, 21 bp, Homo sapiens
gctacaggaagcaccccatgc

SEQ ID NO: 3374516 - DNA, 14 bp, Homo sapiens
gctacatcccagcc

SEQ ID NO: 3374517 - DNA, 20 bp, Homo sapiens
gctaccagaagaggggcagc

SEQ ID NO: 3374518 - DNA, 13 bp, Homo sapiens
gctaccagtattt

SEQ ID NO: 3374519 - DNA, 15 bp, Homo sapiens
gctaccagtatttag

SEQ ID NO: 3374520 - DNA, 23 bp, Homo sapiens
gctacccaaaagagaaaaaaaat

SEQ ID NO: 3374521 - DNA, 22 bp, Homo sapiens
gctaccctaaagggagaaggaa

SEQ ID NO: 3374522 - DNA, 14 bp, Homo sapiens
gctacccttttcct

SEQ ID NO: 3374523 - DNA, 15 bp, Homo sapiens
gctaccgccctgggc

SEQ ID NO: 3374524 - DNA, 17 bp, Homo sapiens
gctaccgccctgggctg

SEQ ID NO: 3374525 - DNA, 23 bp, Homo sapiens
gctaccgccctgggctggactgg

SEQ ID NO: 3374526 - DNA, 13 bp, Homo sapiens
gctacctcaaggg

SEQ ID NO: 3374527 - DNA, 13 bp, Homo sapiens
gctacctccctcc

SEQ ID NO: 3374528 - DNA, 16 bp, Homo sapiens
gctacctctctgtccc

SEQ ID NO: 3374529 - DNA, 22 bp, Homo sapiens
gctactaagttcacattagaat

SEQ ID NO: 3374530 - DNA, 13 bp, Homo sapiens
gctactataatca

SEQ ID NO: 3374531 - DNA, 23 bp, Homo sapiens
gctactataatcaaatgatttca

SEQ ID NO: 3374532 - DNA, 14 bp, Homo sapiens
gctactcagaagcc

SEQ ID NO: 3374533 - DNA, 18 bp, Homo sapiens
gctactcagaagcctgag

SEQ ID NO: 3374534 - DNA, 21 bp, Homo sapiens
gctactcagaagcctgaggct

SEQ ID NO: 3374535 - DNA, 13 bp, Homo sapiens
gctactcctgtgc

SEQ ID NO: 3374536 - DNA, 16 bp, Homo sapiens
gctactcctgtgctct

SEQ ID NO: 3374537 - DNA, 12 bp, Homo sapiens
gctactctgtcc

SEQ ID NO: 3374538 - DNA, 18 bp, Homo sapiens
gctactctgtccaggcca

SEQ ID NO: 3374539 - DNA, 19 bp, Homo sapiens
gctactctgtccaggccac

SEQ ID NO: 3374540 - DNA, 21 bp, Homo sapiens
gctactctgtccaggccactg

SEQ ID NO: 3374541 - DNA, 18 bp, Homo sapiens
gctactgcactccagcct

SEQ ID NO: 3374542 - DNA, 20 bp, Homo sapiens
gctactgcactccagcctgg

SEQ ID NO: 3374543 - DNA, 21 bp, Homo sapiens
gctactgcactccagcctggg

SEQ ID NO: 3374544 - DNA, 17 bp, Homo sapiens
gctactggcagctcctc

SEQ ID NO: 3374545 - DNA, 21 bp, Homo sapiens
gctactgtctcactgaaacat

SEQ ID NO: 3374546 - DNA, 18 bp, Homo sapiens
gctactgtgtgtgtgaat

SEQ ID NO: 3374547 - DNA, 21 bp, Homo sapiens
gctacttaagagaaatggcaa

SEQ ID NO: 3374548 - DNA, 16 bp, Homo sapiens
gctacttgggaggctg

SEQ ID NO: 3374549 - DNA, 18 bp, Homo sapiens
gctagaaaaatgttcttt

SEQ ID NO: 3374550 - DNA, 12 bp, Homo sapiens
gctagaactttt

SEQ ID NO: 3374551 - DNA, 17 bp, Homo sapiens
gctagaacttttttaaa

SEQ ID NO: 3374552 - DNA, 15 bp, Homo sapiens
gctagaatacttttt

SEQ ID NO: 3374553 - DNA, 19 bp, Homo sapiens
gctagaggccagccccacc

SEQ ID NO: 3374554 - DNA, 16 bp, Homo sapiens
gctagagtcctcactc

SEQ ID NO: 3374555 - DNA, 15 bp, Homo sapiens
gctagatttctacat

SEQ ID NO: 3374556 - DNA, 18 bp, Homo sapiens
gctagattttaatttatt

SEQ ID NO: 3374557 - DNA, 13 bp, Homo sapiens
gctagccccagag

SEQ ID NO: 3374558 - DNA, 14 bp, Homo sapiens
gctagccccagaga

SEQ ID NO: 3374559 - DNA, 12 bp, Homo sapiens
gctagcctgaag

SEQ ID NO: 3374560 - DNA, 12 bp, Homo sapiens
gctagcttctgc

SEQ ID NO: 3374561 - DNA, 17 bp, Homo sapiens
gctagcttctgcttttc

SEQ ID NO: 3374562 - DNA, 18 bp, Homo sapiens
gctagcttctgcttttct

SEQ ID NO: 3374563 - DNA, 20 bp, Homo sapiens
gctagcttgacacagtcagc

SEQ ID NO: 3374564 - DNA, 13 bp, Homo sapiens
gctaggaatgaaa

SEQ ID NO: 3374565 - DNA, 22 bp, Homo sapiens
gctaggacccctccatgtgggc

SEQ ID NO: 3374566 - DNA, 11 bp, Homo sapiens
gctaggactga

SEQ ID NO: 3374567 - DNA, 14 bp, Homo sapiens
gctaggactgagga

SEQ ID NO: 3374568 - DNA, 19 bp, Homo sapiens
gctaggactgaggagtggg

SEQ ID NO: 3374569 - DNA, 19 bp, Homo sapiens
gctaggagagactgaaagc

SEQ ID NO: 3374570 - DNA, 14 bp, Homo sapiens
gctaggatggttct

SEQ ID NO: 3374571 - DNA, 17 bp, Homo sapiens
gctaggccccagaggcc

SEQ ID NO: 3374572 - DNA, 17 bp, Homo sapiens
gctaggcctggccagat

SEQ ID NO: 3374573 - DNA, 21 bp, Homo sapiens
gctagtaccctatagagaggg

SEQ ID NO: 3374574 - DNA, 22 bp, Homo sapiens
gctagtccggacccacctcacc

SEQ ID NO: 3374575 - DNA, 21 bp, Homo sapiens
gctagtgacttgtgtcccatg

SEQ ID NO: 3374576 - DNA, 15 bp, Homo sapiens
gctagtgagctgggc

SEQ ID NO: 3374577 - DNA, 18 bp, Homo sapiens
gctagtgcatttcaagga

SEQ ID NO: 3374578 - DNA, 22 bp, Homo sapiens
gctagtgggccctctctctggg

SEQ ID NO: 3374579 - DNA, 16 bp, Homo sapiens
gctagtgtgagtggca

SEQ ID NO: 3374580 - DNA, 18 bp, Homo sapiens
gctagtgtgagtggcagc

SEQ ID NO: 3374581 - DNA, 21 bp, Homo sapiens
gctagtgtgagtggcagccat

SEQ ID NO: 3374582 - DNA, 15 bp, Homo sapiens
gctagtgttctgtct

SEQ ID NO: 3374583 - DNA, 15 bp, Homo sapiens
gctagttttacagat

SEQ ID NO: 3374584 - DNA, 22 bp, Homo sapiens
gctagttttacagattgcctcc

SEQ ID NO: 3374585 - DNA, 13 bp, Homo sapiens
gctataaatatat

SEQ ID NO: 3374586 - DNA, 18 bp, Homo sapiens
gctataaattttttgaaa

SEQ ID NO: 3374587 - DNA, 20 bp, Homo sapiens
gctataatcattagttttag

SEQ ID NO: 3374588 - DNA, 22 bp, Homo sapiens
gctataatcattagttttagag

SEQ ID NO: 3374589 - DNA, 11 bp, Homo sapiens
gctatatatat

SEQ ID NO: 3374590 - DNA, 14 bp, Homo sapiens
gctatatccatgta

SEQ ID NO: 3374591 - DNA, 17 bp, Homo sapiens
gctatatccatgtactg

SEQ ID NO: 3374592 - DNA, 21 bp, Homo sapiens
gctatatccatgtactgtagt

SEQ ID NO: 3374593 - DNA, 23 bp, Homo sapiens
gctatatccatgtactgtagttt

SEQ ID NO: 3374594 - DNA, 20 bp, Homo sapiens
gctatcacctagcagcctca

SEQ ID NO: 3374595 - DNA, 22 bp, Homo sapiens
gctatcagcaatactcatcaga

SEQ ID NO: 3374596 - DNA, 18 bp, Homo sapiens
gctatccccatctccctg

SEQ ID NO: 3374597 - DNA, 21 bp, Homo sapiens
gctatccccatctccctgcct

SEQ ID NO: 3374598 - DNA, 21 bp, Homo sapiens
gctatctgtcatctctctggg

SEQ ID NO: 3374599 - DNA, 18 bp, Homo sapiens
gctatgattatgccactg

SEQ ID NO: 3374600 - DNA, 18 bp, Homo sapiens
gctatgggagccccaggg

SEQ ID NO: 3374601 - DNA, 16 bp, Homo sapiens
gctatggttgccaccc

SEQ ID NO: 3374602 - DNA, 18 bp, Homo sapiens
gctatggttgccacccca

SEQ ID NO: 3374603 - DNA, 12 bp, Homo sapiens
gctatgtaaggg

SEQ ID NO: 3374604 - DNA, 15 bp, Homo sapiens
gctatgtcagtacta

SEQ ID NO: 3374605 - DNA, 16 bp, Homo sapiens
gctatgttactatttt

SEQ ID NO: 3374606 - DNA, 15 bp, Homo sapiens
gctattaaaaaagtc

SEQ ID NO: 3374607 - DNA, 17 bp, Homo sapiens
gctattagccaggatca

SEQ ID NO: 3374608 - DNA, 18 bp, Homo sapiens
gctattagccaggatcat

SEQ ID NO: 3374609 - DNA, 17 bp, Homo sapiens
gctattattttcactgt

SEQ ID NO: 3374610 - DNA, 19 bp, Homo sapiens
gctattcagtaataactct

SEQ ID NO: 3374611 - DNA, 20 bp, Homo sapiens
gctattcagtaataactcta

SEQ ID NO: 3374612 - DNA, 16 bp, Homo sapiens
gctattgacaagtcat

SEQ ID NO: 3374613 - DNA, 16 bp, Homo sapiens
gctattggaggatcag

SEQ ID NO: 3374614 - DNA, 19 bp, Homo sapiens
gctattggaggatcagttt

SEQ ID NO: 3374615 - DNA, 18 bp, Homo sapiens
gctattgttgtgggcttt

SEQ ID NO: 3374616 - DNA, 21 bp, Homo sapiens
gctatttaatatctggcactg

SEQ ID NO: 3374617 - DNA, 20 bp, Homo sapiens
gctatttattttcctaaaga

SEQ ID NO: 3374618 - DNA, 14 bp, Homo sapiens
gctatttcatctat

SEQ ID NO: 3374619 - DNA, 17 bp, Homo sapiens
gctatttccattccaga

SEQ ID NO: 3374620 - DNA, 13 bp, Homo sapiens
gctatttctctcc

SEQ ID NO: 3374621 - DNA, 15 bp, Homo sapiens
gctatttctctcccc

SEQ ID NO: 3374622 - DNA, 15 bp, Homo sapiens
gctatttctcttgct

SEQ ID NO: 3374623 - DNA, 11 bp, Homo sapiens
gctatttgaag

SEQ ID NO: 3374624 - DNA, 15 bp, Homo sapiens
gctatttgtaaatct

SEQ ID NO: 3374625 - DNA, 13 bp, Homo sapiens
gctatttgttcag

SEQ ID NO: 3374626 - DNA, 15 bp, Homo sapiens
gctcaaaaaatgagc

SEQ ID NO: 3374627 - DNA, 19 bp, Homo sapiens
gctcaaaaggaaaccaagt

SEQ ID NO: 3374628 - DNA, 22 bp, Homo sapiens
gctcaaagatgtgggttctttt

SEQ ID NO: 3374629 - DNA, 17 bp, Homo sapiens
gctcaaatctattcaga

SEQ ID NO: 3374630 - DNA, 20 bp, Homo sapiens
gctcaactctacccctgctc

SEQ ID NO: 3374631 - DNA, 22 bp, Homo sapiens
gctcaagcagcgaccgccccct

SEQ ID NO: 3374632 - DNA, 19 bp, Homo sapiens
gctcaagcaggaagttcaa

SEQ ID NO: 3374633 - DNA, 13 bp, Homo sapiens
gctcaaggaaagg

SEQ ID NO: 3374634 - DNA, 18 bp, Homo sapiens
gctcaagtcctcttttct

SEQ ID NO: 3374635 - DNA, 19 bp, Homo sapiens
gctcaagtcctcttttctg

SEQ ID NO: 3374636 - DNA, 12 bp, Homo sapiens
gctcaagttcat

SEQ ID NO: 3374637 - DNA, 16 bp, Homo sapiens
gctcaataaacacttg

SEQ ID NO: 3374638 - DNA, 19 bp, Homo sapiens
gctcaatattcctgaatga

SEQ ID NO: 3374639 - DNA, 16 bp, Homo sapiens
gctcaatccctgagga

SEQ ID NO: 3374640 - DNA, 20 bp, Homo sapiens
gctcaatccctgaggactga

SEQ ID NO: 3374641 - DNA, 23 bp, Homo sapiens
gctcaatgcattgtcttgtggag

SEQ ID NO: 3374642 - DNA, 19 bp, Homo sapiens
gctcaattgttaatgtgat

SEQ ID NO: 3374643 - DNA, 15 bp, Homo sapiens
gctcacaccaaattt

SEQ ID NO: 3374644 - DNA, 14 bp, Homo sapiens
gctcacaccccatt

SEQ ID NO: 3374645 - DNA, 13 bp, Homo sapiens
gctcacacctgca

SEQ ID NO: 3374646 - DNA, 12 bp, Homo sapiens
gctcacaggcct

SEQ ID NO: 3374647 - DNA, 20 bp, Homo sapiens
gctcacagtacagcatgtgc

SEQ ID NO: 3374648 - DNA, 16 bp, Homo sapiens
gctcacatatctgtca

SEQ ID NO: 3374649 - DNA, 12 bp, Homo sapiens
gctcaccagccc

SEQ ID NO: 3374650 - DNA, 14 bp, Homo sapiens
gctcaccagcccca

SEQ ID NO: 3374651 - DNA, 19 bp, Homo sapiens
gctcaccagccccagtgcc

SEQ ID NO: 3374652 - DNA, 13 bp, Homo sapiens
gctcacccctggg

SEQ ID NO: 3374653 - DNA, 16 bp, Homo sapiens
gctcacccctgggcag

SEQ ID NO: 3374654 - DNA, 18 bp, Homo sapiens
gctcacctagagccagac

SEQ ID NO: 3374655 - DNA, 22 bp, Homo sapiens
gctcacgcctgtaatcccagca

SEQ ID NO: 3374656 - DNA, 23 bp, Homo sapiens
gctcacgcctgtaatcccagcac

SEQ ID NO: 3374657 - DNA, 18 bp, Homo sapiens
gctcacgctcccccgcag

SEQ ID NO: 3374658 - DNA, 19 bp, Homo sapiens
gctcactgaaacctctgcc

SEQ ID NO: 3374659 - DNA, 19 bp, Homo sapiens
gctcactgcaacctctgcc

SEQ ID NO: 3374660 - DNA, 12 bp, Homo sapiens
gctcactgcagc

SEQ ID NO: 3374661 - DNA, 14 bp, Homo sapiens
gctcactgcagcct

SEQ ID NO: 3374662 - DNA, 15 bp, Homo sapiens
gctcactgccaggcc

SEQ ID NO: 3374663 - DNA, 17 bp, Homo sapiens
gctcactgccaggccag

SEQ ID NO: 3374664 - DNA, 21 bp, Homo sapiens
gctcactgccaggccagcctc

SEQ ID NO: 3374665 - DNA, 23 bp, Homo sapiens
gctcacttctgggcttcatctgg

SEQ ID NO: 3374666 - DNA, 20 bp, Homo sapiens
gctcacttttcatccttccc

SEQ ID NO: 3374667 - DNA, 20 bp, Homo sapiens
gctcagaatagatctgatgg

SEQ ID NO: 3374668 - DNA, 21 bp, Homo sapiens
gctcagaatagatctgatggt

SEQ ID NO: 3374669 - DNA, 12 bp, Homo sapiens
gctcagaattca

SEQ ID NO: 3374670 - DNA, 21 bp, Homo sapiens
gctcagacatgttttccgtga

SEQ ID NO: 3374671 - DNA, 16 bp, Homo sapiens
gctcagacggcggcca

SEQ ID NO: 3374672 - DNA, 23 bp, Homo sapiens
gctcagacggcggccaggcacag

SEQ ID NO: 3374673 - DNA, 20 bp, Homo sapiens
gctcagatcggccacagggc

SEQ ID NO: 3374674 - DNA, 11 bp, Homo sapiens
gctcagccagt

SEQ ID NO: 3374675 - DNA, 14 bp, Homo sapiens
gctcagccagtggg

SEQ ID NO: 3374676 - DNA, 12 bp, Homo sapiens
gctcagcccgct

SEQ ID NO: 3374677 - DNA, 18 bp, Homo sapiens
gctcagcccgctgagtgg

SEQ ID NO: 3374678 - DNA, 19 bp, Homo sapiens
gctcagccctccctgcccc

SEQ ID NO: 3374679 - DNA, 15 bp, Homo sapiens
gctcagcgccagcct

SEQ ID NO: 3374680 - DNA, 16 bp, Homo sapiens
gctcagcggggacagc

SEQ ID NO: 3374681 - DNA, 17 bp, Homo sapiens
gctcagcggggacagct

SEQ ID NO: 3374682 - DNA, 19 bp, Homo sapiens
gctcagcggggacagctcc

SEQ ID NO: 3374683 - DNA, 20 bp, Homo sapiens
gctcagcggggacagctcct

SEQ ID NO: 3374684 - DNA, 13 bp, Homo sapiens
gctcaggacccag

SEQ ID NO: 3374685 - DNA, 16 bp, Homo sapiens
gctcaggaggcttgga

SEQ ID NO: 3374686 - DNA, 12 bp, Homo sapiens
gctcaggcaagc

SEQ ID NO: 3374687 - DNA, 23 bp, Homo sapiens
gctcaggcaagcccctcagccct

SEQ ID NO: 3374688 - DNA, 19 bp, Homo sapiens
gctcagggccatgctgagg

SEQ ID NO: 3374689 - DNA, 20 bp, Homo sapiens
gctcagggccatgctgaggc

SEQ ID NO: 3374690 - DNA, 12 bp, Homo sapiens
gctcagggctgg

SEQ ID NO: 3374691 - DNA, 13 bp, Homo sapiens
gctcagggctgga

SEQ ID NO: 3374692 - DNA, 15 bp, Homo sapiens
gctcagggctggagt

SEQ ID NO: 3374693 - DNA, 16 bp, Homo sapiens
gctcaggggcagctca

SEQ ID NO: 3374694 - DNA, 19 bp, Homo sapiens
gctcaggggcagctcatag

SEQ ID NO: 3374695 - DNA, 17 bp, Homo sapiens
gctcaggtgtccctgca

SEQ ID NO: 3374696 - DNA, 12 bp, Homo sapiens
gctcagtaaacg

SEQ ID NO: 3374697 - DNA, 14 bp, Homo sapiens
gctcagtctcagga

SEQ ID NO: 3374698 - DNA, 17 bp, Homo sapiens
gctcagtctcaggagca

SEQ ID NO: 3374699 - DNA, 20 bp, Homo sapiens
gctcagtctcaggagcatgg

SEQ ID NO: 3374700 - DNA, 17 bp, Homo sapiens
gctcagtgcttgggctc

SEQ ID NO: 3374701 - DNA, 21 bp, Homo sapiens
gctcagtgcttgggctccacg

SEQ ID NO: 3374702 - DNA, 19 bp, Homo sapiens
gctcatatgctgacagctc

SEQ ID NO: 3374703 - DNA, 19 bp, Homo sapiens
gctcatatggggctgggag

SEQ ID NO: 3374704 - DNA, 14 bp, Homo sapiens
gctcatctgctggt

SEQ ID NO: 3374705 - DNA, 16 bp, Homo sapiens
gctcatctgctggtcc

SEQ ID NO: 3374706 - DNA, 17 bp, Homo sapiens
gctcatgtgtgcaacag

SEQ ID NO: 3374707 - DNA, 22 bp, Homo sapiens
gctcatgtgtgcaacagggtat

SEQ ID NO: 3374708 - DNA, 20 bp, Homo sapiens
gctcattctgtctcttttct

SEQ ID NO: 3374709 - DNA, 15 bp, Homo sapiens
gctcattttttctta

SEQ ID NO: 3374710 - DNA, 14 bp, Homo sapiens
gctccaagacctag

SEQ ID NO: 3374711 - DNA, 15 bp, Homo sapiens
gctccaagattctag

SEQ ID NO: 3374712 - DNA, 16 bp, Homo sapiens
gctccaagattctaga

SEQ ID NO: 3374713 - DNA, 18 bp, Homo sapiens
gctccaagattctagatg

SEQ ID NO: 3374714 - DNA, 19 bp, Homo sapiens
gctccaagccccatcttct

SEQ ID NO: 3374715 - DNA, 21 bp, Homo sapiens
gctccaatctctggtgcctaa

SEQ ID NO: 3374716 - DNA, 16 bp, Homo sapiens
gctccacacctccacc

SEQ ID NO: 3374717 - DNA, 19 bp, Homo sapiens
gctccaccaagaaagcagg

SEQ ID NO: 3374718 - DNA, 15 bp, Homo sapiens
gctccaccagcagca

SEQ ID NO: 3374719 - DNA, 20 bp, Homo sapiens
gctccacggtgcgtggctgt

SEQ ID NO: 3374720 - DNA, 15 bp, Homo sapiens
gctccactctgcttc

SEQ ID NO: 3374721 - DNA, 19 bp, Homo sapiens
gctccactctgcttctctg

SEQ ID NO: 3374722 - DNA, 20 bp, Homo sapiens
gctccactctgcttctctga

SEQ ID NO: 3374723 - DNA, 15 bp, Homo sapiens
gctccacttggtctg

SEQ ID NO: 3374724 - DNA, 19 bp, Homo sapiens
gctccagaatttggaaatc

SEQ ID NO: 3374725 - DNA, 21 bp, Homo sapiens
gctccagaatttggaaatcct

SEQ ID NO: 3374726 - DNA, 15 bp, Homo sapiens
gctccagcaccttct

SEQ ID NO: 3374727 - DNA, 17 bp, Homo sapiens
gctccagcatccagcct

SEQ ID NO: 3374728 - DNA, 20 bp, Homo sapiens
gctccagcatccagcctgtg

SEQ ID NO: 3374729 - DNA, 21 bp, Homo sapiens
gctccagcatccagcctgtgt

SEQ ID NO: 3374730 - DNA, 22 bp, Homo sapiens
gctccagcatccagcctgtgtg

SEQ ID NO: 3374731 - DNA, 14 bp, Homo sapiens
gctccagctcacca

SEQ ID NO: 3374732 - DNA, 20 bp, Homo sapiens
gctccagctcaccagcccca

SEQ ID NO: 3374733 - DNA, 21 bp, Homo sapiens
gctccagctcaccagccccag

SEQ ID NO: 3374734 - DNA, 16 bp, Homo sapiens
gctccagctgccccgg

SEQ ID NO: 3374735 - DNA, 15 bp, Homo sapiens
gctccaggactccac

SEQ ID NO: 3374736 - DNA, 16 bp, Homo sapiens
gctccaggactccact

SEQ ID NO: 3374737 - DNA, 21 bp, Homo sapiens
gctccaggactccactggaca

SEQ ID NO: 3374738 - DNA, 22 bp, Homo sapiens
gctccaggactccactggacag

SEQ ID NO: 3374739 - DNA, 16 bp, Homo sapiens
gctccaggcctgcagc

SEQ ID NO: 3374740 - DNA, 22 bp, Homo sapiens
gctccaggcctgcagcaggagt

SEQ ID NO: 3374741 - DNA, 19 bp, Homo sapiens
gctccaggggcccttggga

SEQ ID NO: 3374742 - DNA, 23 bp, Homo sapiens
gctccaggggcccttgggacagc

SEQ ID NO: 3374743 - DNA, 14 bp, Homo sapiens
gctccagggtcttg

SEQ ID NO: 3374744 - DNA, 17 bp, Homo sapiens
gctccagggtcttgggc

SEQ ID NO: 3374745 - DNA, 20 bp, Homo sapiens
gctccagggtcttgggctac

SEQ ID NO: 3374746 - DNA, 23 bp, Homo sapiens
gctccagggtcttgggctactgg

SEQ ID NO: 3374747 - DNA, 24 bp, Homo sapiens
gctccagggtcttgggctactggc

SEQ ID NO: 3374748 - DNA, 22 bp, Homo sapiens
gctccatcccaaccaggcacct

SEQ ID NO: 3374749 - DNA, 17 bp, Homo sapiens
gctccatgactggctgt

SEQ ID NO: 3374750 - DNA, 20 bp, Homo sapiens
gctccatgactggctgtctg

SEQ ID NO: 3374751 - DNA, 17 bp, Homo sapiens
gctccatgattctctga

SEQ ID NO: 3374752 - DNA, 19 bp, Homo sapiens
gctccatgctcctcactgc

SEQ ID NO: 3374753 - DNA, 19 bp, Homo sapiens
gctcccacagaacacagca

SEQ ID NO: 3374754 - DNA, 21 bp, Homo sapiens
gctcccacaggcccttcctct

SEQ ID NO: 3374755 - DNA, 22 bp, Homo sapiens
gctcccacaggcccttcctctc

SEQ ID NO: 3374756 - DNA, 18 bp, Homo sapiens
gctcccaccgcccccacc

SEQ ID NO: 3374757 - DNA, 20 bp, Homo sapiens
gctcccaccgcccccacccc

SEQ ID NO: 3374758 - DNA, 19 bp, Homo sapiens
gctcccagcagccctaagg

SEQ ID NO: 3374759 - DNA, 13 bp, Homo sapiens
gctcccagcctgc

SEQ ID NO: 3374760 - DNA, 15 bp, Homo sapiens
gctcccagcctgctg

SEQ ID NO: 3374761 - DNA, 12 bp, Homo sapiens
gctcccagctcc

SEQ ID NO: 3374762 - DNA, 20 bp, Homo sapiens
gctcccaggttcccccagca

SEQ ID NO: 3374763 - DNA, 17 bp, Homo sapiens
gctcccattcctccctc

SEQ ID NO: 3374764 - DNA, 22 bp, Homo sapiens
gctccccacaccttccagggcc

SEQ ID NO: 3374765 - DNA, 21 bp, Homo sapiens
gctccccacgagtcacctgca

SEQ ID NO: 3374766 - DNA, 23 bp, Homo sapiens
gctccccacgagtcacctgcaag

SEQ ID NO: 3374767 - DNA, 24 bp, Homo sapiens
gctccccacgagtcacctgcaagc

SEQ ID NO: 3374768 - DNA, 15 bp, Homo sapiens
gctccccagggctcc

SEQ ID NO: 3374769 - DNA, 17 bp, Homo sapiens
gctccccagggctccct

SEQ ID NO: 3374770 - DNA, 12 bp, Homo sapiens
gctccccatgtg

SEQ ID NO: 3374771 - DNA, 17 bp, Homo sapiens
gctccccccgcccaccc

SEQ ID NO: 3374772 - DNA, 14 bp, Homo sapiens
gctccccctgtccc

SEQ ID NO: 3374773 - DNA, 16 bp, Homo sapiens
gctccccgcctgttcc

SEQ ID NO: 3374774 - DNA, 22 bp, Homo sapiens
gctccccgcctgttcccccgcc

SEQ ID NO: 3374775 - DNA, 17 bp, Homo sapiens
gctccctcagcctcaga

SEQ ID NO: 3374776 - DNA, 19 bp, Homo sapiens
gctccctcccctgccctgg

SEQ ID NO: 3374777 - DNA, 18 bp, Homo sapiens
gctccctcctccaggcct

SEQ ID NO: 3374778 - DNA, 18 bp, Homo sapiens
gctccctctctggtttcc

SEQ ID NO: 3374779 - DNA, 15 bp, Homo sapiens
gctccctgaagccag

SEQ ID NO: 3374780 - DNA, 16 bp, Homo sapiens
gctccctgaagccagc

SEQ ID NO: 3374781 - DNA, 18 bp, Homo sapiens
gctccctgaagccagcct

SEQ ID NO: 3374782 - DNA, 13 bp, Homo sapiens
gctccctgcccca

SEQ ID NO: 3374783 - DNA, 22 bp, Homo sapiens
gctccctgctttggctgagggg

SEQ ID NO: 3374784 - DNA, 11 bp, Homo sapiens
gctccctggag

SEQ ID NO: 3374785 - DNA, 13 bp, Homo sapiens
gctccctggagcc

SEQ ID NO: 3374786 - DNA, 13 bp, Homo sapiens
gctccctggcagg

SEQ ID NO: 3374787 - DNA, 17 bp, Homo sapiens
gctccctgtagctctgc

SEQ ID NO: 3374788 - DNA, 21 bp, Homo sapiens
gctccctgtgtccacctgtgg

SEQ ID NO: 3374789 - DNA, 23 bp, Homo sapiens
gctcccttcaagacgaggggcag

SEQ ID NO: 3374790 - DNA, 14 bp, Homo sapiens
gctcccttcagccc

SEQ ID NO: 3374791 - DNA, 15 bp, Homo sapiens
gctcccttctctgta

SEQ ID NO: 3374792 - DNA, 16 bp, Homo sapiens
gctccctttgctgctg

SEQ ID NO: 3374793 - DNA, 20 bp, Homo sapiens
gctccgcccttagtccccca

SEQ ID NO: 3374794 - DNA, 14 bp, Homo sapiens
gctccgtgcctcca

SEQ ID NO: 3374795 - DNA, 16 bp, Homo sapiens
gctccgtgcctccacc

SEQ ID NO: 3374796 - DNA, 21 bp, Homo sapiens
gctccgtggccccgccctcag

SEQ ID NO: 3374797 - DNA, 19 bp, Homo sapiens
gctcctaactccaccgcct

SEQ ID NO: 3374798 - DNA, 17 bp, Homo sapiens
gctcctagcagacagaa

SEQ ID NO: 3374799 - DNA, 22 bp, Homo sapiens
gctcctagcagacagaaactgg

SEQ ID NO: 3374800 - DNA, 17 bp, Homo sapiens
gctcctaggggaacaga

SEQ ID NO: 3374801 - DNA, 15 bp, Homo sapiens
gctcctatctgtgtt

SEQ ID NO: 3374802 - DNA, 18 bp, Homo sapiens
gctcctcaactcacctaa

SEQ ID NO: 3374803 - DNA, 16 bp, Homo sapiens
gctcctcacctgtcta

SEQ ID NO: 3374804 - DNA, 23 bp, Homo sapiens
gctcctcactggaggagcagctt

SEQ ID NO: 3374805 - DNA, 15 bp, Homo sapiens
gctcctccccttcct

SEQ ID NO: 3374806 - DNA, 23 bp, Homo sapiens
gctcctccccttcctcttgtctg

SEQ ID NO: 3374807 - DNA, 16 bp, Homo sapiens
gctcctcccggtgccc

SEQ ID NO: 3374808 - DNA, 19 bp, Homo sapiens
gctcctcccggtgcccaag

SEQ ID NO: 3374809 - DNA, 11 bp, Homo sapiens
gctcctccctg

SEQ ID NO: 3374810 - DNA, 12 bp, Homo sapiens
gctcctccctgc

SEQ ID NO: 3374811 - DNA, 13 bp, Homo sapiens
gctcctccctgcc

SEQ ID NO: 3374812 - DNA, 14 bp, Homo sapiens
gctcctccctgccc

SEQ ID NO: 3374813 - DNA, 18 bp, Homo sapiens
gctcctccctgcccccca

SEQ ID NO: 3374814 - DNA, 23 bp, Homo sapiens
gctcctccctggctgccctggcc

SEQ ID NO: 3374815 - DNA, 16 bp, Homo sapiens
gctcctcctgccctgt

SEQ ID NO: 3374816 - DNA, 20 bp, Homo sapiens
gctcctcctgccctgtccct

SEQ ID NO: 3374817 - DNA, 19 bp, Homo sapiens
gctcctccttgcccagact

SEQ ID NO: 3374818 - DNA, 14 bp, Homo sapiens
gctcctctccaggc

SEQ ID NO: 3374819 - DNA, 16 bp, Homo sapiens
gctcctctccaggcac

SEQ ID NO: 3374820 - DNA, 17 bp, Homo sapiens
gctcctctccttgggct

SEQ ID NO: 3374821 - DNA, 22 bp, Homo sapiens
gctcctcttaccgtagcctccg

SEQ ID NO: 3374822 - DNA, 22 bp, Homo sapiens
gctcctgagaaaggtgaggagg

SEQ ID NO: 3374823 - DNA, 23 bp, Homo sapiens
gctcctgaggggcatctgcccct

SEQ ID NO: 3374824 - DNA, 12 bp, Homo sapiens
gctcctgcactt

SEQ ID NO: 3374825 - DNA, 15 bp, Homo sapiens
gctcctgcagcatgg

SEQ ID NO: 3374826 - DNA, 22 bp, Homo sapiens
gctcctgccgcagacgggcaca

SEQ ID NO: 3374827 - DNA, 12 bp, Homo sapiens
gctcctgctgcg

SEQ ID NO: 3374828 - DNA, 14 bp, Homo sapiens
gctcctgctgcgga

SEQ ID NO: 3374829 - DNA, 18 bp, Homo sapiens
gctcctggaaaggctcag

SEQ ID NO: 3374830 - DNA, 18 bp, Homo sapiens
gctcctggagcctttgaa

SEQ ID NO: 3374831 - DNA, 19 bp, Homo sapiens
gctcctggagcctttgaat

SEQ ID NO: 3374832 - DNA, 12 bp, Homo sapiens
gctcctggctgc

SEQ ID NO: 3374833 - DNA, 18 bp, Homo sapiens
gctcctggtggccttctg

SEQ ID NO: 3374834 - DNA, 15 bp, Homo sapiens
gctcctgtggcccca

SEQ ID NO: 3374835 - DNA, 12 bp, Homo sapiens
gctcctgtgtct

SEQ ID NO: 3374836 - DNA, 19 bp, Homo sapiens
gctccttggcttacctgac

SEQ ID NO: 3374837 - DNA, 18 bp, Homo sapiens
gctcctttctccagccag

SEQ ID NO: 3374838 - DNA, 20 bp, Homo sapiens
gctcctttctccagccagca

SEQ ID NO: 3374839 - DNA, 23 bp, Homo sapiens
gctccttttgtatcttcctttct

SEQ ID NO: 3374840 - DNA, 17 bp, Homo sapiens
gctcgagcagtcctgcc

SEQ ID NO: 3374841 - DNA, 20 bp, Homo sapiens
gctcgagcagtcctgcctca

SEQ ID NO: 3374842 - DNA, 21 bp, Homo sapiens
gctcgagcagtcctgcctcag

SEQ ID NO: 3374843 - DNA, 12 bp, Homo sapiens
gctcgaggctgg

SEQ ID NO: 3374844 - DNA, 19 bp, Homo sapiens
gctcgccccacctccacct

SEQ ID NO: 3374845 - DNA, 20 bp, Homo sapiens
gctcgccccacctccacctg

SEQ ID NO: 3374846 - DNA, 12 bp, Homo sapiens
gctcgcgggcag

SEQ ID NO: 3374847 - DNA, 14 bp, Homo sapiens
gctcgcgggcagcg

SEQ ID NO: 3374848 - DNA, 18 bp, Homo sapiens
gctcgcgggcagcgggcc

SEQ ID NO: 3374849 - DNA, 19 bp, Homo sapiens
gctcgcgggcagcgggcca

SEQ ID NO: 3374850 - DNA, 22 bp, Homo sapiens
gctcgcgggcagcgggccaggc

SEQ ID NO: 3374851 - DNA, 23 bp, Homo sapiens
gctcgcgggcagcgggccaggcc

SEQ ID NO: 3374852 - DNA, 12 bp, Homo sapiens
gctcgctgccat

SEQ ID NO: 3374853 - DNA, 19 bp, Homo sapiens
gctcggaggccccaaagga

SEQ ID NO: 3374854 - DNA, 20 bp, Homo sapiens
gctcggcaggaaggagcggc

SEQ ID NO: 3374855 - DNA, 17 bp, Homo sapiens
gctcgtgtatttattac

SEQ ID NO: 3374856 - DNA, 20 bp, Homo sapiens
gctctaaaaggtaatgtgtg

SEQ ID NO: 3374857 - DNA, 18 bp, Homo sapiens
gctctaacacctgcctag

SEQ ID NO: 3374858 - DNA, 15 bp, Homo sapiens
gctctaacagccctc

SEQ ID NO: 3374859 - DNA, 15 bp, Homo sapiens
gctctaattcacagt

SEQ ID NO: 3374860 - DNA, 18 bp, Homo sapiens
gctctaattcacagtgct

SEQ ID NO: 3374861 - DNA, 19 bp, Homo sapiens
gctctacatcttctgcctt

SEQ ID NO: 3374862 - DNA, 15 bp, Homo sapiens
gctctaccctgctcc

SEQ ID NO: 3374863 - DNA, 23 bp, Homo sapiens
gctctagattgagagaagagaca

SEQ ID NO: 3374864 - DNA, 14 bp, Homo sapiens
gctctagccaggag

SEQ ID NO: 3374865 - DNA, 15 bp, Homo sapiens
gctctagctggcagg

SEQ ID NO: 3374866 - DNA, 13 bp, Homo sapiens
gctctaggcttca

SEQ ID NO: 3374867 - DNA, 19 bp, Homo sapiens
gctctagggttgctggagc

SEQ ID NO: 3374868 - DNA, 22 bp, Homo sapiens
gctctagggttgctggagcctg

SEQ ID NO: 3374869 - DNA, 19 bp, Homo sapiens
gctctaggtacgatgacag

SEQ ID NO: 3374870 - DNA, 14 bp, Homo sapiens
gctctagtgggaag

SEQ ID NO: 3374871 - DNA, 20 bp, Homo sapiens
gctctagtgggacagcccag

SEQ ID NO: 3374872 - DNA, 21 bp, Homo sapiens
gctctagtgggacagcccaga

SEQ ID NO: 3374873 - DNA, 14 bp, Homo sapiens
gctctatgtttgta

SEQ ID NO: 3374874 - DNA, 16 bp, Homo sapiens
gctctatgtttgtatt

SEQ ID NO: 3374875 - DNA, 17 bp, Homo sapiens
gctctcacccccatccc

SEQ ID NO: 3374876 - DNA, 17 bp, Homo sapiens
gctctcagcctcccaca

SEQ ID NO: 3374877 - DNA, 16 bp, Homo sapiens
gctctcatccattcct

SEQ ID NO: 3374878 - DNA, 20 bp, Homo sapiens
gctctccaaaggggctgctg

SEQ ID NO: 3374879 - DNA, 22 bp, Homo sapiens
gctctccaaaggggctgctggg

SEQ ID NO: 3374880 - DNA, 23 bp, Homo sapiens
gctctccaaaggggctgctgggg

SEQ ID NO: 3374881 - DNA, 20 bp, Homo sapiens
gctctcccctcccttgtcct

SEQ ID NO: 3374882 - DNA, 19 bp, Homo sapiens
gctctcccctgccctgctg

SEQ ID NO: 3374883 - DNA, 22 bp, Homo sapiens
gctctcctcttgccactgcctc

SEQ ID NO: 3374884 - DNA, 13 bp, Homo sapiens
gctctctccagga

SEQ ID NO: 3374885 - DNA, 11 bp, Homo sapiens
gctctctgctg

SEQ ID NO: 3374886 - DNA, 12 bp, Homo sapiens
gctctctggcct

SEQ ID NO: 3374887 - DNA, 14 bp, Homo sapiens
gctctctggccttc

SEQ ID NO: 3374888 - DNA, 20 bp, Homo sapiens
gctctctggccttcggcctc

SEQ ID NO: 3374889 - DNA, 23 bp, Homo sapiens
gctctctgtataaacattaaatg

SEQ ID NO: 3374890 - DNA, 19 bp, Homo sapiens
gctctctgtgggctggcag

SEQ ID NO: 3374891 - DNA, 22 bp, Homo sapiens
gctctcttcttactcattactg

SEQ ID NO: 3374892 - DNA, 22 bp, Homo sapiens
gctctcttgccgaggagccagg

SEQ ID NO: 3374893 - DNA, 23 bp, Homo sapiens
gctctcttgccgaggagccaggc

SEQ ID NO: 3374894 - DNA, 19 bp, Homo sapiens
gctctcttttctgtacttc

SEQ ID NO: 3374895 - DNA, 17 bp, Homo sapiens
gctctgaaagccagctg

SEQ ID NO: 3374896 - DNA, 22 bp, Homo sapiens
gctctgacatcccttcctggaa

SEQ ID NO: 3374897 - DNA, 17 bp, Homo sapiens
gctctgacccagtgaga

SEQ ID NO: 3374898 - DNA, 9 bp, Homo sapiens
gctctgaga

SEQ ID NO: 3374899 - DNA, 14 bp, Homo sapiens
gctctgagaagagg

SEQ ID NO: 3374900 - DNA, 22 bp, Homo sapiens
gctctgagaagaggagccctca

SEQ ID NO: 3374901 - DNA, 18 bp, Homo sapiens
gctctgagagtctagatt

SEQ ID NO: 3374902 - DNA, 20 bp, Homo sapiens
gctctgagcaaatgtggctc

SEQ ID NO: 3374903 - DNA, 21 bp, Homo sapiens
gctctgagcaaatgtggctcc

SEQ ID NO: 3374904 - DNA, 17 bp, Homo sapiens
gctctgagcgcctccat

SEQ ID NO: 3374905 - DNA, 14 bp, Homo sapiens
gctctgaggggagg

SEQ ID NO: 3374906 - DNA, 21 bp, Homo sapiens
gctctgatattccatgaatgt

SEQ ID NO: 3374907 - DNA, 23 bp, Homo sapiens
gctctgcaattcccctctgctgc

SEQ ID NO: 3374908 - DNA, 13 bp, Homo sapiens
gctctgcacagac

SEQ ID NO: 3374909 - DNA, 22 bp, Homo sapiens
gctctgcacagacaagcagccc

SEQ ID NO: 3374910 - DNA, 13 bp, Homo sapiens
gctctgcacagat

SEQ ID NO: 3374911 - DNA, 18 bp, Homo sapiens
gctctgcacagatggatt

SEQ ID NO: 3374912 - DNA, 13 bp, Homo sapiens
gctctgcactaag

SEQ ID NO: 3374913 - DNA, 19 bp, Homo sapiens
gctctgcactaagagaaaa

SEQ ID NO: 3374914 - DNA, 20 bp, Homo sapiens
gctctgcaggcttaataaaa

SEQ ID NO: 3374915 - DNA, 13 bp, Homo sapiens
gctctgccccagc

SEQ ID NO: 3374916 - DNA, 20 bp, Homo sapiens
gctctgccccagctctggct

SEQ ID NO: 3374917 - DNA, 14 bp, Homo sapiens
gctctgccccttgg

SEQ ID NO: 3374918 - DNA, 13 bp, Homo sapiens
gctctgcctgtgg

SEQ ID NO: 3374919 - DNA, 13 bp, Homo sapiens
gctctgctcctct

SEQ ID NO: 3374920 - DNA, 13 bp, Homo sapiens
gctctgctgacag

SEQ ID NO: 3374921 - DNA, 13 bp, Homo sapiens
gctctgctggcct

SEQ ID NO: 3374922 - DNA, 15 bp, Homo sapiens
gctctggacaggcat

SEQ ID NO: 3374923 - DNA, 21 bp, Homo sapiens
gctctggacaggcatgttctc

SEQ ID NO: 3374924 - DNA, 21 bp, Homo sapiens
gctctggaggagcaagggggc

SEQ ID NO: 3374925 - DNA, 14 bp, Homo sapiens
gctctggcacagtg

SEQ ID NO: 3374926 - DNA, 19 bp, Homo sapiens
gctctggcccttgcctttg

SEQ ID NO: 3374927 - DNA, 20 bp, Homo sapiens
gctctggctgaaccctgtgc

SEQ ID NO: 3374928 - DNA, 12 bp, Homo sapiens
gctctgggctca

SEQ ID NO: 3374929 - DNA, 15 bp, Homo sapiens
gctctgggctcaggg

SEQ ID NO: 3374930 - DNA, 17 bp, Homo sapiens
gctctggggggcagttg

SEQ ID NO: 3374931 - DNA, 15 bp, Homo sapiens
gctctgtcctgggag

SEQ ID NO: 3374932 - DNA, 15 bp, Homo sapiens
gctctgtctacccag

SEQ ID NO: 3374933 - DNA, 22 bp, Homo sapiens
gctctgtgagggtgctgactgg

SEQ ID NO: 3374934 - DNA, 19 bp, Homo sapiens
gctctgtgcagtcactgga

SEQ ID NO: 3374935 - DNA, 15 bp, Homo sapiens
gctctgtggaggggc

SEQ ID NO: 3374936 - DNA, 12 bp, Homo sapiens
gctctgtggcct

SEQ ID NO: 3374937 - DNA, 13 bp, Homo sapiens
gctctgtggcctg

SEQ ID NO: 3374938 - DNA, 16 bp, Homo sapiens
gctctgtggcctgtgt

SEQ ID NO: 3374939 - DNA, 17 bp, Homo sapiens
gctctgtggcctgtgtc

SEQ ID NO: 3374940 - DNA, 16 bp, Homo sapiens
gctctgtgtatatctc

SEQ ID NO: 3374941 - DNA, 23 bp, Homo sapiens
gctctgtgtatatctcttggaaa

SEQ ID NO: 3374942 - DNA, 17 bp, Homo sapiens
gctctgtgttcccagag

SEQ ID NO: 3374943 - DNA, 19 bp, Homo sapiens
gctctgtgttcccagaggc

SEQ ID NO: 3374944 - DNA, 16 bp, Homo sapiens
gctctgtgttgccatg

SEQ ID NO: 3374945 - DNA, 17 bp, Homo sapiens
gctctgttacccaggct

SEQ ID NO: 3374946 - DNA, 23 bp, Homo sapiens
gctctgtttgatgctatttatgc

SEQ ID NO: 3374947 - DNA, 19 bp, Homo sapiens
gctcttatgtgtgcctttg

SEQ ID NO: 3374948 - DNA, 14 bp, Homo sapiens
gctcttatttctga

SEQ ID NO: 3374949 - DNA, 23 bp, Homo sapiens
gctcttcaagctgtcccctctgt

SEQ ID NO: 3374950 - DNA, 24 bp, Homo sapiens
gctcttcaagctgtcccctctgtc

SEQ ID NO: 3374951 - DNA, 14 bp, Homo sapiens
gctcttcattccat

SEQ ID NO: 3374952 - DNA, 20 bp, Homo sapiens
gctcttcctatccctctcct

SEQ ID NO: 3374953 - DNA, 18 bp, Homo sapiens
gctcttcctggacctgag

SEQ ID NO: 3374954 - DNA, 21 bp, Homo sapiens
gctcttcgcgcccgcccctgc

SEQ ID NO: 3374955 - DNA, 17 bp, Homo sapiens
gctcttgatacccccct

SEQ ID NO: 3374956 - DNA, 20 bp, Homo sapiens
gctcttgatacccccctctg

SEQ ID NO: 3374957 - DNA, 23 bp, Homo sapiens
gctcttgatacccccctctgtct

SEQ ID NO: 3374958 - DNA, 16 bp, Homo sapiens
gctcttgcccttccct

SEQ ID NO: 3374959 - DNA, 23 bp, Homo sapiens
gctcttgctaatcagtgtctcac

SEQ ID NO: 3374960 - DNA, 13 bp, Homo sapiens
gctcttggccttt

SEQ ID NO: 3374961 - DNA, 14 bp, Homo sapiens
gctcttggtccctg

SEQ ID NO: 3374962 - DNA, 16 bp, Homo sapiens
gctcttggtccctggt

SEQ ID NO: 3374963 - DNA, 22 bp, Homo sapiens
gctcttgtgctggatggagccc

SEQ ID NO: 3374964 - DNA, 15 bp, Homo sapiens
gctctttcagagagg

SEQ ID NO: 3374965 - DNA, 12 bp, Homo sapiens
gctctttccctt

SEQ ID NO: 3374966 - DNA, 17 bp, Homo sapiens
gctctttcccttttctg

SEQ ID NO: 3374967 - DNA, 16 bp, Homo sapiens
gctctttccttgctca

SEQ ID NO: 3374968 - DNA, 18 bp, Homo sapiens
gctctttccttgctcaac

SEQ ID NO: 3374969 - DNA, 17 bp, Homo sapiens
gctctttcgtcaccctt

SEQ ID NO: 3374970 - DNA, 21 bp, Homo sapiens
gctctttgaaatagtctgtgt

SEQ ID NO: 3374971 - DNA, 13 bp, Homo sapiens
gctctttggtaga

SEQ ID NO: 3374972 - DNA, 24 bp, Homo sapiens
gctcttttggtggggagcacttgc

SEQ ID NO: 3374973 - DNA, 21 bp, Homo sapiens
gctcttttttactcattgaaa

SEQ ID NO: 3374974 - DNA, 20 bp, Homo sapiens
gctgaaaacctaagtccttt

SEQ ID NO: 3374975 - DNA, 15 bp, Homo sapiens
gctgaaaatataaaa

SEQ ID NO: 3374976 - DNA, 14 bp, Homo sapiens
gctgaaaatgcaaa

SEQ ID NO: 3374977 - DNA, 15 bp, Homo sapiens
gctgaaaatgcaaag

SEQ ID NO: 3374978 - DNA, 23 bp, Homo sapiens
gctgaaagaacatggacttgtat

SEQ ID NO: 3374979 - DNA, 14 bp, Homo sapiens
gctgaaattctcct

SEQ ID NO: 3374980 - DNA, 18 bp, Homo sapiens
gctgaaattctcctggag

SEQ ID NO: 3374981 - DNA, 13 bp, Homo sapiens
gctgaacagtgga

SEQ ID NO: 3374982 - DNA, 20 bp, Homo sapiens
gctgaaccaaagcctcttca

SEQ ID NO: 3374983 - DNA, 13 bp, Homo sapiens
gctgaaccctgtg

SEQ ID NO: 3374984 - DNA, 17 bp, Homo sapiens
gctgaaccctgtgctgg

SEQ ID NO: 3374985 - DNA, 16 bp, Homo sapiens
gctgaactcttcagaa

SEQ ID NO: 3374986 - DNA, 15 bp, Homo sapiens
gctgaaggcagtggc

SEQ ID NO: 3374987 - DNA, 18 bp, Homo sapiens
gctgaaggcagtggcagg

SEQ ID NO: 3374988 - DNA, 15 bp, Homo sapiens
gctgaatccacctcg

SEQ ID NO: 3374989 - DNA, 19 bp, Homo sapiens
gctgaatccacctcggagc

SEQ ID NO: 3374990 - DNA, 13 bp, Homo sapiens
gctgaatgcctcc

SEQ ID NO: 3374991 - DNA, 19 bp, Homo sapiens
gctgaatgcctcctgtggg

SEQ ID NO: 3374992 - DNA, 19 bp, Homo sapiens
gctgacaaccattaaagtc

SEQ ID NO: 3374993 - DNA, 14 bp, Homo sapiens
gctgacacctacca

SEQ ID NO: 3374994 - DNA, 19 bp, Homo sapiens
gctgacacctaccatgctg

SEQ ID NO: 3374995 - DNA, 21 bp, Homo sapiens
gctgacacctaccatgctgct

SEQ ID NO: 3374996 - DNA, 14 bp, Homo sapiens
gctgacagacacag

SEQ ID NO: 3374997 - DNA, 21 bp, Homo sapiens
gctgacagacacaggcccggc

SEQ ID NO: 3374998 - DNA, 16 bp, Homo sapiens
gctgacatctgtgttt

SEQ ID NO: 3374999 - DNA, 19 bp, Homo sapiens
gctgacatggctctggact

SEQ ID NO: 3375000 - DNA, 15 bp, Homo sapiens
gctgacccagcatct

SEQ ID NO: 3375001 - DNA, 20 bp, Homo sapiens
gctgacccagcatctcccag

SEQ ID NO: 3375002 - DNA, 16 bp, Homo sapiens
gctgacctgcctctca

SEQ ID NO: 3375003 - DNA, 22 bp, Homo sapiens
gctgacgatggggggctgatgg

SEQ ID NO: 3375004 - DNA, 20 bp, Homo sapiens
gctgacgggaggccccagct

SEQ ID NO: 3375005 - DNA, 15 bp, Homo sapiens
gctgacgtgtgaggg

SEQ ID NO: 3375006 - DNA, 23 bp, Homo sapiens
gctgactagaagggccagtcctg

SEQ ID NO: 3375007 - DNA, 23 bp, Homo sapiens
gctgactctttttggactcagcc

SEQ ID NO: 3375008 - DNA, 13 bp, Homo sapiens
gctgactggggct

SEQ ID NO: 3375009 - DNA, 16 bp, Homo sapiens
gctgactggggctggg

SEQ ID NO: 3375010 - DNA, 17 bp, Homo sapiens
gctgactggggctgggg

SEQ ID NO: 3375011 - DNA, 18 bp, Homo sapiens
gctgactgtactcctccc

SEQ ID NO: 3375012 - DNA, 23 bp, Homo sapiens
gctgactgtggccccctccgtga

SEQ ID NO: 3375013 - DNA, 17 bp, Homo sapiens
gctgactgttcttggta

SEQ ID NO: 3375014 - DNA, 15 bp, Homo sapiens
gctgacttcatctgg

SEQ ID NO: 3375015 - DNA, 15 bp, Homo sapiens
gctgagaactcctga

SEQ ID NO: 3375016 - DNA, 16 bp, Homo sapiens
gctgagaactcctgac

SEQ ID NO: 3375017 - DNA, 16 bp, Homo sapiens
gctgagaaggaacagg

SEQ ID NO: 3375018 - DNA, 17 bp, Homo sapiens
gctgagagcccccacct

SEQ ID NO: 3375019 - DNA, 11 bp, Homo sapiens
gctgagccctg

SEQ ID NO: 3375020 - DNA, 12 bp, Homo sapiens
gctgagccctgg

SEQ ID NO: 3375021 - DNA, 13 bp, Homo sapiens
gctgagccctggg

SEQ ID NO: 3375022 - DNA, 11 bp, Homo sapiens
gctgagctgga

SEQ ID NO: 3375023 - DNA, 14 bp, Homo sapiens
gctgagctgggccc

SEQ ID NO: 3375024 - DNA, 17 bp, Homo sapiens
gctgagctgggcccagc

SEQ ID NO: 3375025 - DNA, 18 bp, Homo sapiens
gctgagctgggcccagcc

SEQ ID NO: 3375026 - DNA, 21 bp, Homo sapiens
gctgagctgggcccagcccct

SEQ ID NO: 3375027 - DNA, 16 bp, Homo sapiens
gctgagcttagccttg

SEQ ID NO: 3375028 - DNA, 21 bp, Homo sapiens
gctgagcttcggttctccaga

SEQ ID NO: 3375029 - DNA, 18 bp, Homo sapiens
gctgaggaggcacctaca

SEQ ID NO: 3375030 - DNA, 20 bp, Homo sapiens
gctgaggatttcaagcctgc

SEQ ID NO: 3375031 - DNA, 13 bp, Homo sapiens
gctgaggcctggg

SEQ ID NO: 3375032 - DNA, 15 bp, Homo sapiens
gctgaggcgggagaa

SEQ ID NO: 3375033 - DNA, 22 bp, Homo sapiens
gctgaggggaggatcactggag

SEQ ID NO: 3375034 - DNA, 23 bp, Homo sapiens
gctgaggggcaacgaagaaaaaa

SEQ ID NO: 3375035 - DNA, 14 bp, Homo sapiens
gctgaggggcttgg

SEQ ID NO: 3375036 - DNA, 21 bp, Homo sapiens
gctgaggggtctcggatgaca

SEQ ID NO: 3375037 - DNA, 13 bp, Homo sapiens
gctgagtctccca

SEQ ID NO: 3375038 - DNA, 23 bp, Homo sapiens
gctgagtggccagccagtgccat

SEQ ID NO: 3375039 - DNA, 16 bp, Homo sapiens
gctgagtggggagcag

SEQ ID NO: 3375040 - DNA, 22 bp, Homo sapiens
gctgagtggggggtcgtgggcc

SEQ ID NO: 3375041 - DNA, 11 bp, Homo sapiens
gctgagtttcc

SEQ ID NO: 3375042 - DNA, 13 bp, Homo sapiens
gctgagtttccta

SEQ ID NO: 3375043 - DNA, 17 bp, Homo sapiens
gctgataagcattgact

SEQ ID NO: 3375044 - DNA, 21 bp, Homo sapiens
gctgatacataactaaatttg

SEQ ID NO: 3375045 - DNA, 13 bp, Homo sapiens
gctgatataaatt

SEQ ID NO: 3375046 - DNA, 15 bp, Homo sapiens
gctgatataaattct

SEQ ID NO: 3375047 - DNA, 17 bp, Homo sapiens
gctgatataaattctgt

SEQ ID NO: 3375048 - DNA, 22 bp, Homo sapiens
gctgatcatcgccagaggtgct

SEQ ID NO: 3375049 - DNA, 19 bp, Homo sapiens
gctgatcgtagaaaatttg

SEQ ID NO: 3375050 - DNA, 22 bp, Homo sapiens
gctgatctgcggatctcagctt

SEQ ID NO: 3375051 - DNA, 23 bp, Homo sapiens
gctgatgaaactcctgattttgt

SEQ ID NO: 3375052 - DNA, 17 bp, Homo sapiens
gctgatgaatcactgtt

SEQ ID NO: 3375053 - DNA, 22 bp, Homo sapiens
gctgatgatgtctcttgtagaa

SEQ ID NO: 3375054 - DNA, 20 bp, Homo sapiens
gctgatgatttgtttttgta

SEQ ID NO: 3375055 - DNA, 16 bp, Homo sapiens
gctgatgcttgaagta

SEQ ID NO: 3375056 - DNA, 15 bp, Homo sapiens
gctgatggaggaaaa

SEQ ID NO: 3375057 - DNA, 16 bp, Homo sapiens
gctgatggaggaaaaa

SEQ ID NO: 3375058 - DNA, 18 bp, Homo sapiens
gctgatggaggaaaaagg

SEQ ID NO: 3375059 - DNA, 15 bp, Homo sapiens
gctgatggctgcccc

SEQ ID NO: 3375060 - DNA, 20 bp, Homo sapiens
gctgatggcttgacatgtgc

SEQ ID NO: 3375061 - DNA, 14 bp, Homo sapiens
gctgatgtcaaagt

SEQ ID NO: 3375062 - DNA, 17 bp, Homo sapiens
gctgatgtcaatttctg

SEQ ID NO: 3375063 - DNA, 16 bp, Homo sapiens
gctgatttacatgtat

SEQ ID NO: 3375064 - DNA, 13 bp, Homo sapiens
gctgatttcactt

SEQ ID NO: 3375065 - DNA, 18 bp, Homo sapiens
gctgatttccaggcccct

SEQ ID NO: 3375066 - DNA, 19 bp, Homo sapiens
gctgatttccaggcccctg

SEQ ID NO: 3375067 - DNA, 22 bp, Homo sapiens
gctgatttccaggcccctgagg

SEQ ID NO: 3375068 - DNA, 17 bp, Homo sapiens
gctgatttggtgaccaa

SEQ ID NO: 3375069 - DNA, 15 bp, Homo sapiens
gctgattttaacaat

SEQ ID NO: 3375070 - DNA, 15 bp, Homo sapiens
gctgcaaaactagaa

SEQ ID NO: 3375071 - DNA, 19 bp, Homo sapiens
gctgcaagtcagattgctg

SEQ ID NO: 3375072 - DNA, 17 bp, Homo sapiens
gctgcaatgcctagact

SEQ ID NO: 3375073 - DNA, 13 bp, Homo sapiens
gctgcacatgtgc

SEQ ID NO: 3375074 - DNA, 12 bp, Homo sapiens
gctgcaccagag

SEQ ID NO: 3375075 - DNA, 16 bp, Homo sapiens
gctgcaccagagtgaa

SEQ ID NO: 3375076 - DNA, 23 bp, Homo sapiens
gctgcacccaactactgagctga

SEQ ID NO: 3375077 - DNA, 18 bp, Homo sapiens
gctgcacctgccagcctg

SEQ ID NO: 3375078 - DNA, 15 bp, Homo sapiens
gctgcacttgacacc

SEQ ID NO: 3375079 - DNA, 19 bp, Homo sapiens
gctgcacttgacaccaacc

SEQ ID NO: 3375080 - DNA, 20 bp, Homo sapiens
gctgcacttgacaccaacca

SEQ ID NO: 3375081 - DNA, 15 bp, Homo sapiens
gctgcacttggcctc

SEQ ID NO: 3375082 - DNA, 17 bp, Homo sapiens
gctgcacttggcctcag

SEQ ID NO: 3375083 - DNA, 18 bp, Homo sapiens
gctgcagagatttctcat

SEQ ID NO: 3375084 - DNA, 22 bp, Homo sapiens
gctgcagcatgttgctgaggag

SEQ ID NO: 3375085 - DNA, 13 bp, Homo sapiens
gctgcagctgggc

SEQ ID NO: 3375086 - DNA, 15 bp, Homo sapiens
gctgcagctgggccc

SEQ ID NO: 3375087 - DNA, 21 bp, Homo sapiens
gctgcagctgggccccatgct

SEQ ID NO: 3375088 - DNA, 12 bp, Homo sapiens
gctgcagcttgg

SEQ ID NO: 3375089 - DNA, 23 bp, Homo sapiens
gctgcagcttgggagagcccctg

SEQ ID NO: 3375090 - DNA, 21 bp, Homo sapiens
gctgcaggagtgtcctgccca

SEQ ID NO: 3375091 - DNA, 16 bp, Homo sapiens
gctgcagggctcccat

SEQ ID NO: 3375092 - DNA, 15 bp, Homo sapiens
gctgcaggggcagga

SEQ ID NO: 3375093 - DNA, 17 bp, Homo sapiens
gctgcaggggcaggaga

SEQ ID NO: 3375094 - DNA, 12 bp, Homo sapiens
gctgcaggggct

SEQ ID NO: 3375095 - DNA, 16 bp, Homo sapiens
gctgcaggggctctgg

SEQ ID NO: 3375096 - DNA, 21 bp, Homo sapiens
gctgcaggggctctggagaga

SEQ ID NO: 3375097 - DNA, 22 bp, Homo sapiens
gctgcaggtacttcctcctgat

SEQ ID NO: 3375098 - DNA, 14 bp, Homo sapiens
gctgcaggtgggac

SEQ ID NO: 3375099 - DNA, 16 bp, Homo sapiens
gctgcagtatggccag

SEQ ID NO: 3375100 - DNA, 14 bp, Homo sapiens
gctgcagtcatcta

SEQ ID NO: 3375101 - DNA, 21 bp, Homo sapiens
gctgcagttttgctatctggg

SEQ ID NO: 3375102 - DNA, 22 bp, Homo sapiens
gctgcatcttatagcactttga

SEQ ID NO: 3375103 - DNA, 13 bp, Homo sapiens
gctgcatgaccta

SEQ ID NO: 3375104 - DNA, 20 bp, Homo sapiens
gctgcatgcctggtctttcc

SEQ ID NO: 3375105 - DNA, 15 bp, Homo sapiens
gctgccaaattttgg

SEQ ID NO: 3375106 - DNA, 17 bp, Homo sapiens
gctgccaaattttggcc

SEQ ID NO: 3375107 - DNA, 16 bp, Homo sapiens
gctgccaaggccagag

SEQ ID NO: 3375108 - DNA, 23 bp, Homo sapiens
gctgccacaccagtcacatgacc

SEQ ID NO: 3375109 - DNA, 20 bp, Homo sapiens
gctgccaccacgtctgccag

SEQ ID NO: 3375110 - DNA, 22 bp, Homo sapiens
gctgccaccacgtctgccaggc

SEQ ID NO: 3375111 - DNA, 15 bp, Homo sapiens
gctgccagcccagaa

SEQ ID NO: 3375112 - DNA, 17 bp, Homo sapiens
gctgccagcccagaaca

SEQ ID NO: 3375113 - DNA, 21 bp, Homo sapiens
gctgccagccttgagccctgg

SEQ ID NO: 3375114 - DNA, 13 bp, Homo sapiens
gctgccagggctt

SEQ ID NO: 3375115 - DNA, 19 bp, Homo sapiens
gctgccagtgcagccactg

SEQ ID NO: 3375116 - DNA, 21 bp, Homo sapiens
gctgccatccaggttcagctt

SEQ ID NO: 3375117 - DNA, 15 bp, Homo sapiens
gctgccatgccactg

SEQ ID NO: 3375118 - DNA, 19 bp, Homo sapiens
gctgccatgccactgccag

SEQ ID NO: 3375119 - DNA, 23 bp, Homo sapiens
gctgccatgccactgccaggcac

SEQ ID NO: 3375120 - DNA, 21 bp, Homo sapiens
gctgccatgtgaagagggaga

SEQ ID NO: 3375121 - DNA, 22 bp, Homo sapiens
gctgcccactgtttctcttgag

SEQ ID NO: 3375122 - DNA, 21 bp, Homo sapiens
gctgcccagccccgctcaggc

SEQ ID NO: 3375123 - DNA, 16 bp, Homo sapiens
gctgcccaggagacag

SEQ ID NO: 3375124 - DNA, 12 bp, Homo sapiens
gctgcccaggcc

SEQ ID NO: 3375125 - DNA, 19 bp, Homo sapiens
gctgcccaggccacagccg

SEQ ID NO: 3375126 - DNA, 22 bp, Homo sapiens
gctgccccagctgactgtggcc

SEQ ID NO: 3375127 - DNA, 18 bp, Homo sapiens
gctgcccccaacactcca

SEQ ID NO: 3375128 - DNA, 13 bp, Homo sapiens
gctgccccggccc

SEQ ID NO: 3375129 - DNA, 22 bp, Homo sapiens
gctgccccgttccctgtcagag

SEQ ID NO: 3375130 - DNA, 12 bp, Homo sapiens
gctgccctgaga

SEQ ID NO: 3375131 - DNA, 13 bp, Homo sapiens
gctgccctggccc

SEQ ID NO: 3375132 - DNA, 16 bp, Homo sapiens
gctgccctggccctga

SEQ ID NO: 3375133 - DNA, 17 bp, Homo sapiens
gctgccctggccctgag

SEQ ID NO: 3375134 - DNA, 17 bp, Homo sapiens
gctgccctggtgctgcc

SEQ ID NO: 3375135 - DNA, 20 bp, Homo sapiens
gctgccctggtgctgccaca

SEQ ID NO: 3375136 - DNA, 22 bp, Homo sapiens
gctgccctggtgctgccacact

SEQ ID NO: 3375137 - DNA, 16 bp, Homo sapiens
gctgccgcctcccagc

SEQ ID NO: 3375138 - DNA, 18 bp, Homo sapiens
gctgccgcctcccagcct

SEQ ID NO: 3375139 - DNA, 15 bp, Homo sapiens
gctgccgctgcacca

SEQ ID NO: 3375140 - DNA, 17 bp, Homo sapiens
gctgccgctgccgctgc

SEQ ID NO: 3375141 - DNA, 22 bp, Homo sapiens
gctgccgtggggccgccgcctc

SEQ ID NO: 3375142 - DNA, 12 bp, Homo sapiens
gctgcctcactt

SEQ ID NO: 3375143 - DNA, 11 bp, Homo sapiens
gctgcctctgc

SEQ ID NO: 3375144 - DNA, 16 bp, Homo sapiens
gctgcctctgctccct

SEQ ID NO: 3375145 - DNA, 13 bp, Homo sapiens
gctgcctctgggc

SEQ ID NO: 3375146 - DNA, 21 bp, Homo sapiens
gctgcctgaaacagccatgtc

SEQ ID NO: 3375147 - DNA, 23 bp, Homo sapiens
gctgcctgcccgcacagcagcct

SEQ ID NO: 3375148 - DNA, 13 bp, Homo sapiens
gctgcctgccgcc

SEQ ID NO: 3375149 - DNA, 19 bp, Homo sapiens
gctgcctgcttggcccggc

SEQ ID NO: 3375150 - DNA, 16 bp, Homo sapiens
gctgcctgggctgttg

SEQ ID NO: 3375151 - DNA, 19 bp, Homo sapiens
gctgcctgggctgttggca

SEQ ID NO: 3375152 - DNA, 22 bp, Homo sapiens
gctgcctgggctgttggcactc

SEQ ID NO: 3375153 - DNA, 13 bp, Homo sapiens
gctgcctgtgcct

SEQ ID NO: 3375154 - DNA, 19 bp, Homo sapiens
gctgcctgtgcctgccatg

SEQ ID NO: 3375155 - DNA, 12 bp, Homo sapiens
gctgcctgttca

SEQ ID NO: 3375156 - DNA, 19 bp, Homo sapiens
gctgcctgttcagctccag

SEQ ID NO: 3375157 - DNA, 22 bp, Homo sapiens
gctgcctgttcagctccagctc

SEQ ID NO: 3375158 - DNA, 13 bp, Homo sapiens
gctgccttcccta

SEQ ID NO: 3375159 - DNA, 16 bp, Homo sapiens
gctgccttccctagct

SEQ ID NO: 3375160 - DNA, 19 bp, Homo sapiens
gctgccttctgacggccct

SEQ ID NO: 3375161 - DNA, 20 bp, Homo sapiens
gctgccttctgacggccctg

SEQ ID NO: 3375162 - DNA, 21 bp, Homo sapiens
gctgccttctgacggccctgc

SEQ ID NO: 3375163 - DNA, 23 bp, Homo sapiens
gctgccttctgacggccctgcaa

SEQ ID NO: 3375164 - DNA, 12 bp, Homo sapiens
gctgccttgagc

SEQ ID NO: 3375165 - DNA, 17 bp, Homo sapiens
gctgccttggctcagac

SEQ ID NO: 3375166 - DNA, 23 bp, Homo sapiens
gctgccttggctcagacatgttt

SEQ ID NO: 3375167 - DNA, 17 bp, Homo sapiens
gctgcgcaccaatgccc

SEQ ID NO: 3375168 - DNA, 23 bp, Homo sapiens
gctgcgcaccaatgcccagcagg

SEQ ID NO: 3375169 - DNA, 14 bp, Homo sapiens
gctgcgggaggccc

SEQ ID NO: 3375170 - DNA, 16 bp, Homo sapiens
gctgcgggaggccctg

SEQ ID NO: 3375171 - DNA, 17 bp, Homo sapiens
gctgcgggaggccctgg

SEQ ID NO: 3375172 - DNA, 19 bp, Homo sapiens
gctgcgggaggccctggcc

SEQ ID NO: 3375173 - DNA, 22 bp, Homo sapiens
gctgcgggaggccctggccctt

SEQ ID NO: 3375174 - DNA, 20 bp, Homo sapiens
gctgcgggctccctggcagg

SEQ ID NO: 3375175 - DNA, 15 bp, Homo sapiens
gctgcgggtctgaag

SEQ ID NO: 3375176 - DNA, 22 bp, Homo sapiens
gctgcggtccacccaggagccc

SEQ ID NO: 3375177 - DNA, 17 bp, Homo sapiens
gctgcgtccccactccc

SEQ ID NO: 3375178 - DNA, 22 bp, Homo sapiens
gctgcgtctggaggggcccctg

SEQ ID NO: 3375179 - DNA, 18 bp, Homo sapiens
gctgctaaatctcctatt

SEQ ID NO: 3375180 - DNA, 16 bp, Homo sapiens
gctgctaccagcgcca

SEQ ID NO: 3375181 - DNA, 15 bp, Homo sapiens
gctgctaccgccctg

SEQ ID NO: 3375182 - DNA, 18 bp, Homo sapiens
gctgctaccgccctgggc

SEQ ID NO: 3375183 - DNA, 19 bp, Homo sapiens
gctgctaccgccctgggct

SEQ ID NO: 3375184 - DNA, 22 bp, Homo sapiens
gctgctaccgccctgggctgga

SEQ ID NO: 3375185 - DNA, 22 bp, Homo sapiens
gctgctaccgttgacttccagg

SEQ ID NO: 3375186 - DNA, 22 bp, Homo sapiens
gctgctatacacaagcaatgca

SEQ ID NO: 3375187 - DNA, 23 bp, Homo sapiens
gctgctatccccatctccctgcc

SEQ ID NO: 3375188 - DNA, 19 bp, Homo sapiens
gctgctatttattttccta

SEQ ID NO: 3375189 - DNA, 16 bp, Homo sapiens
gctgctccaggcctgc

SEQ ID NO: 3375190 - DNA, 13 bp, Homo sapiens
gctgctccctggc

SEQ ID NO: 3375191 - DNA, 12 bp, Homo sapiens
gctgctccgccc

SEQ ID NO: 3375192 - DNA, 15 bp, Homo sapiens
gctgctcgcccagga

SEQ ID NO: 3375193 - DNA, 18 bp, Homo sapiens
gctgctcgcccaggaagg

SEQ ID NO: 3375194 - DNA, 19 bp, Homo sapiens
gctgctcgcccaggaaggc

SEQ ID NO: 3375195 - DNA, 15 bp, Homo sapiens
gctgctctagctggc

SEQ ID NO: 3375196 - DNA, 15 bp, Homo sapiens
gctgctctcccctcc

SEQ ID NO: 3375197 - DNA, 13 bp, Homo sapiens
gctgctctgcccc

SEQ ID NO: 3375198 - DNA, 20 bp, Homo sapiens
gctgctctgccccttgggca

SEQ ID NO: 3375199 - DNA, 18 bp, Homo sapiens
gctgctgccagggcttcc

SEQ ID NO: 3375200 - DNA, 14 bp, Homo sapiens
gctgctgctaccag

SEQ ID NO: 3375201 - DNA, 15 bp, Homo sapiens
gctgctgctgcaccc

SEQ ID NO: 3375202 - DNA, 12 bp, Homo sapiens
gctgctgctgct

SEQ ID NO: 3375203 - DNA, 23 bp, Homo sapiens
gctgctggggcatgtgtgcctgt

SEQ ID NO: 3375204 - DNA, 19 bp, Homo sapiens
gctgctggtaacagtggct

SEQ ID NO: 3375205 - DNA, 17 bp, Homo sapiens
gctgctgtaactgctga

SEQ ID NO: 3375206 - DNA, 21 bp, Homo sapiens
gctgctgtaactgctgagcca

SEQ ID NO: 3375207 - DNA, 16 bp, Homo sapiens
gctgctgtccctcccc

SEQ ID NO: 3375208 - DNA, 22 bp, Homo sapiens
gctgctgtccctcccccttgtc

SEQ ID NO: 3375209 - DNA, 13 bp, Homo sapiens
gctgcttccagga

SEQ ID NO: 3375210 - DNA, 23 bp, Homo sapiens
gctgcttccggtagggaggcagc

SEQ ID NO: 3375211 - DNA, 14 bp, Homo sapiens
gctgcttctcctcc

SEQ ID NO: 3375212 - DNA, 23 bp, Homo sapiens
gctgcttctcctcccagcgtgtg

SEQ ID NO: 3375213 - DNA, 18 bp, Homo sapiens
gctgcttttgagcctcag

SEQ ID NO: 3375214 - DNA, 22 bp, Homo sapiens
gctgcttttgtctatgggactc

SEQ ID NO: 3375215 - DNA, 14 bp, Homo sapiens
gctggaagagggtg

SEQ ID NO: 3375216 - DNA, 23 bp, Homo sapiens
gctggaagagggtgaaaggcagg

SEQ ID NO: 3375217 - DNA, 15 bp, Homo sapiens
gctggaaggcagggc

SEQ ID NO: 3375218 - DNA, 17 bp, Homo sapiens
gctggaaggcagggcag

SEQ ID NO: 3375219 - DNA, 22 bp, Homo sapiens
gctggaaggcagggcagaggga

SEQ ID NO: 3375220 - DNA, 21 bp, Homo sapiens
gctggaagtctacctgctgga

SEQ ID NO: 3375221 - DNA, 24 bp, Homo sapiens
gctggaagtctacctgctggacag

SEQ ID NO: 3375222 - DNA, 12 bp, Homo sapiens
gctggacagcct

SEQ ID NO: 3375223 - DNA, 16 bp, Homo sapiens
gctggacagcctccgc

SEQ ID NO: 3375224 - DNA, 16 bp, Homo sapiens
gctggaccttgaactg

SEQ ID NO: 3375225 - DNA, 21 bp, Homo sapiens
gctggaccttgaactgggtac

SEQ ID NO: 3375226 - DNA, 15 bp, Homo sapiens
gctggacgtctttct

SEQ ID NO: 3375227 - DNA, 20 bp, Homo sapiens
gctggacgtctttctttttt

SEQ ID NO: 3375228 - DNA, 18 bp, Homo sapiens
gctggactgttccaggcc

SEQ ID NO: 3375229 - DNA, 17 bp, Homo sapiens
gctggacttctgtgggc

SEQ ID NO: 3375230 - DNA, 18 bp, Homo sapiens
gctggacttctgtgggcc

SEQ ID NO: 3375231 - DNA, 17 bp, Homo sapiens
gctggagaaagagctgc

SEQ ID NO: 3375232 - DNA, 18 bp, Homo sapiens
gctggagaaagagctgcc

SEQ ID NO: 3375233 - DNA, 19 bp, Homo sapiens
gctggagaaagagctgcct

SEQ ID NO: 3375234 - DNA, 22 bp, Homo sapiens
gctggagaaagagctgcctgga

SEQ ID NO: 3375235 - DNA, 12 bp, Homo sapiens
gctggagaagag

SEQ ID NO: 3375236 - DNA, 20 bp, Homo sapiens
gctggaggcccaggctggga

SEQ ID NO: 3375237 - DNA, 13 bp, Homo sapiens
gctggagggaggc

SEQ ID NO: 3375238 - DNA, 16 bp, Homo sapiens
gctggaggtaaggcct

SEQ ID NO: 3375239 - DNA, 22 bp, Homo sapiens
gctggaggtgggagcaggagat

SEQ ID NO: 3375240 - DNA, 16 bp, Homo sapiens
gctggaggtggggcga

SEQ ID NO: 3375241 - DNA, 15 bp, Homo sapiens
gctggagtctggctt

SEQ ID NO: 3375242 - DNA, 12 bp, Homo sapiens
gctggagtgcag

SEQ ID NO: 3375243 - DNA, 22 bp, Homo sapiens
gctggagtgcagtgagccgaga

SEQ ID NO: 3375244 - DNA, 20 bp, Homo sapiens
gctggagtgcagtggtgtga

SEQ ID NO: 3375245 - DNA, 20 bp, Homo sapiens
gctggatgagacttccaaac

SEQ ID NO: 3375246 - DNA, 14 bp, Homo sapiens
gctggcaacacaga

SEQ ID NO: 3375247 - DNA, 23 bp, Homo sapiens
gctggcagaaagggaacagaaag

SEQ ID NO: 3375248 - DNA, 14 bp, Homo sapiens
gctggcagctctcc

SEQ ID NO: 3375249 - DNA, 18 bp, Homo sapiens
gctggcagctctccagtc

SEQ ID NO: 3375250 - DNA, 16 bp, Homo sapiens
gctggcagctgagagc

SEQ ID NO: 3375251 - DNA, 14 bp, Homo sapiens
gctggcagggctgg

SEQ ID NO: 3375252 - DNA, 17 bp, Homo sapiens
gctggcagtcctggaag

SEQ ID NO: 3375253 - DNA, 13 bp, Homo sapiens
gctggccactgca

SEQ ID NO: 3375254 - DNA, 19 bp, Homo sapiens
gctggccactgcacagagc

SEQ ID NO: 3375255 - DNA, 20 bp, Homo sapiens
gctggccactgcacagagct

SEQ ID NO: 3375256 - DNA, 21 bp, Homo sapiens
gctggccactgcacagagctc

SEQ ID NO: 3375257 - DNA, 15 bp, Homo sapiens
gctggccagcaccct

SEQ ID NO: 3375258 - DNA, 17 bp, Homo sapiens
gctggccagcaccctct

SEQ ID NO: 3375259 - DNA, 18 bp, Homo sapiens
gctggccagcaccctctc

SEQ ID NO: 3375260 - DNA, 19 bp, Homo sapiens
gctggccagcaccctctcc

SEQ ID NO: 3375261 - DNA, 14 bp, Homo sapiens
gctggccagcctgg

SEQ ID NO: 3375262 - DNA, 23 bp, Homo sapiens
gctggccagcctggggcctggca

SEQ ID NO: 3375263 - DNA, 11 bp, Homo sapiens
gctggcccagc

SEQ ID NO: 3375264 - DNA, 12 bp, Homo sapiens
gctggcccagcc

SEQ ID NO: 3375265 - DNA, 14 bp, Homo sapiens
gctggcccagccaa

SEQ ID NO: 3375266 - DNA, 16 bp, Homo sapiens
gctggcccagccggcc

SEQ ID NO: 3375267 - DNA, 19 bp, Homo sapiens
gctggcccagccggcctct

SEQ ID NO: 3375268 - DNA, 16 bp, Homo sapiens
gctggccccagccctg

SEQ ID NO: 3375269 - DNA, 17 bp, Homo sapiens
gctggccccagccctgc

SEQ ID NO: 3375270 - DNA, 21 bp, Homo sapiens
gctggccccagccctgctggg

SEQ ID NO: 3375271 - DNA, 18 bp, Homo sapiens
gctggccccagggcaccc

SEQ ID NO: 3375272 - DNA, 14 bp, Homo sapiens
gctggcccccagga

SEQ ID NO: 3375273 - DNA, 19 bp, Homo sapiens
gctggccctggctcccaca

SEQ ID NO: 3375274 - DNA, 19 bp, Homo sapiens
gctggccgggggaggtggg

SEQ ID NO: 3375275 - DNA, 16 bp, Homo sapiens
gctggcctctaccaca

SEQ ID NO: 3375276 - DNA, 17 bp, Homo sapiens
gctggcctggcagttga

SEQ ID NO: 3375277 - DNA, 14 bp, Homo sapiens
gctggcctggccgg

SEQ ID NO: 3375278 - DNA, 17 bp, Homo sapiens
gctggcctggccggcaa

SEQ ID NO: 3375279 - DNA, 13 bp, Homo sapiens
gctggccttcctg

SEQ ID NO: 3375280 - DNA, 16 bp, Homo sapiens
gctggccttcctgccc

SEQ ID NO: 3375281 - DNA, 23 bp, Homo sapiens
gctggccttcctgccctacagag

SEQ ID NO: 3375282 - DNA, 15 bp, Homo sapiens
gctggcgtgcagtgg

SEQ ID NO: 3375283 - DNA, 18 bp, Homo sapiens
gctggcgtgcagtggtgc

SEQ ID NO: 3375284 - DNA, 17 bp, Homo sapiens
gctggctcacagtacag

SEQ ID NO: 3375285 - DNA, 23 bp, Homo sapiens
gctggctcacagtacagcatgtg

SEQ ID NO: 3375286 - DNA, 16 bp, Homo sapiens
gctggctcctacccca

SEQ ID NO: 3375287 - DNA, 14 bp, Homo sapiens
gctggctcctaggg

SEQ ID NO: 3375288 - DNA, 15 bp, Homo sapiens
gctggctctgagaat

SEQ ID NO: 3375289 - DNA, 18 bp, Homo sapiens
gctggctctgagaatcac

SEQ ID NO: 3375290 - DNA, 13 bp, Homo sapiens
gctggctgagtgg

SEQ ID NO: 3375291 - DNA, 14 bp, Homo sapiens
gctggctgccttag

SEQ ID NO: 3375292 - DNA, 13 bp, Homo sapiens
gctggctgcggcc

SEQ ID NO: 3375293 - DNA, 17 bp, Homo sapiens
gctggctgcggccccct

SEQ ID NO: 3375294 - DNA, 12 bp, Homo sapiens
gctggctgtatg

SEQ ID NO: 3375295 - DNA, 23 bp, Homo sapiens
gctggctgttggctgggggcctc

SEQ ID NO: 3375296 - DNA, 13 bp, Homo sapiens
gctggcttgcccg

SEQ ID NO: 3375297 - DNA, 19 bp, Homo sapiens
gctggcttgtttgatttca

SEQ ID NO: 3375298 - DNA, 20 bp, Homo sapiens
gctgggaaccccgcagcccg

SEQ ID NO: 3375299 - DNA, 22 bp, Homo sapiens
gctgggaagctgtactcagagc

SEQ ID NO: 3375300 - DNA, 18 bp, Homo sapiens
gctgggaccagagccaga

SEQ ID NO: 3375301 - DNA, 21 bp, Homo sapiens
gctgggaccagagccagatgc

SEQ ID NO: 3375302 - DNA, 13 bp, Homo sapiens
gctgggactacag

SEQ ID NO: 3375303 - DNA, 18 bp, Homo sapiens
gctgggactacaggcacc

SEQ ID NO: 3375304 - DNA, 19 bp, Homo sapiens
gctgggactacaggtgtga

SEQ ID NO: 3375305 - DNA, 12 bp, Homo sapiens
gctgggactcag

SEQ ID NO: 3375306 - DNA, 19 bp, Homo sapiens
gctgggactcagccttcag

SEQ ID NO: 3375307 - DNA, 16 bp, Homo sapiens
gctgggactggccagg

SEQ ID NO: 3375308 - DNA, 18 bp, Homo sapiens
gctgggagctccactctg

SEQ ID NO: 3375309 - DNA, 16 bp, Homo sapiens
gctgggagctctgcag

SEQ ID NO: 3375310 - DNA, 16 bp, Homo sapiens
gctgggaggagggaga

SEQ ID NO: 3375311 - DNA, 17 bp, Homo sapiens
gctgggaggagggagag

SEQ ID NO: 3375312 - DNA, 12 bp, Homo sapiens
gctgggaggcaa

SEQ ID NO: 3375313 - DNA, 16 bp, Homo sapiens
gctgggaggcaagagg

SEQ ID NO: 3375314 - DNA, 14 bp, Homo sapiens
gctgggaggcatgg

SEQ ID NO: 3375315 - DNA, 18 bp, Homo sapiens
gctgggagtagttgtctt

SEQ ID NO: 3375316 - DNA, 22 bp, Homo sapiens
gctgggagttctagaaccactt

SEQ ID NO: 3375317 - DNA, 24 bp, Homo sapiens
gctgggatttcttcgctgctctag

SEQ ID NO: 3375318 - DNA, 16 bp, Homo sapiens
gctgggcacagaggtc

SEQ ID NO: 3375319 - DNA, 20 bp, Homo sapiens
gctgggcacagaggtcagga

SEQ ID NO: 3375320 - DNA, 16 bp, Homo sapiens
gctgggcatactttct

SEQ ID NO: 3375321 - DNA, 22 bp, Homo sapiens
gctgggcatggtaccagccctg

SEQ ID NO: 3375322 - DNA, 13 bp, Homo sapiens
gctgggccactgg

SEQ ID NO: 3375323 - DNA, 22 bp, Homo sapiens
gctgggccccatgctctgcccc

SEQ ID NO: 3375324 - DNA, 17 bp, Homo sapiens
gctgggccccccagctc

SEQ ID NO: 3375325 - DNA, 19 bp, Homo sapiens
gctgggccccccagctcag

SEQ ID NO: 3375326 - DNA, 22 bp, Homo sapiens
gctgggccccccagctcagggg

SEQ ID NO: 3375327 - DNA, 17 bp, Homo sapiens
gctgggcccctgcacag

SEQ ID NO: 3375328 - DNA, 13 bp, Homo sapiens
gctgggcccctgg

SEQ ID NO: 3375329 - DNA, 14 bp, Homo sapiens
gctgggcccctggg

SEQ ID NO: 3375330 - DNA, 18 bp, Homo sapiens
gctgggccctctcttctc

SEQ ID NO: 3375331 - DNA, 17 bp, Homo sapiens
gctgggccctctttccc

SEQ ID NO: 3375332 - DNA, 24 bp, Homo sapiens
gctgggccctctttccctgcgaga

SEQ ID NO: 3375333 - DNA, 22 bp, Homo sapiens
gctgggcggggctcgaggctgg

SEQ ID NO: 3375334 - DNA, 15 bp, Homo sapiens
gctgggctcacaggc

SEQ ID NO: 3375335 - DNA, 17 bp, Homo sapiens
gctgggctcacaggcct

SEQ ID NO: 3375336 - DNA, 13 bp, Homo sapiens
gctgggctccctg

SEQ ID NO: 3375337 - DNA, 21 bp, Homo sapiens
gctgggctccctgatgacacc

SEQ ID NO: 3375338 - DNA, 12 bp, Homo sapiens
gctgggctgggc

SEQ ID NO: 3375339 - DNA, 18 bp, Homo sapiens
gctgggctgggccctctt

SEQ ID NO: 3375340 - DNA, 17 bp, Homo sapiens
gctgggcttcagtggca

SEQ ID NO: 3375341 - DNA, 18 bp, Homo sapiens
gctgggcttcagtggcag

SEQ ID NO: 3375342 - DNA, 20 bp, Homo sapiens
gctgggcttcagtggcagct

SEQ ID NO: 3375343 - DNA, 16 bp, Homo sapiens
gctggggacagagggt

SEQ ID NO: 3375344 - DNA, 14 bp, Homo sapiens
gctggggactcagg

SEQ ID NO: 3375345 - DNA, 15 bp, Homo sapiens
gctggggactcaggg

SEQ ID NO: 3375346 - DNA, 22 bp, Homo sapiens
gctggggatccccgcctggcca

SEQ ID NO: 3375347 - DNA, 17 bp, Homo sapiens
gctggggcaagtccctg

SEQ ID NO: 3375348 - DNA, 19 bp, Homo sapiens
gctggggcagaggggcagc

SEQ ID NO: 3375349 - DNA, 20 bp, Homo sapiens
gctggggcagaggggcagcc

SEQ ID NO: 3375350 - DNA, 22 bp, Homo sapiens
gctggggcagaggggcagccgc

SEQ ID NO: 3375351 - DNA, 24 bp, Homo sapiens
gctggggcagaggggcagccgcta

SEQ ID NO: 3375352 - DNA, 14 bp, Homo sapiens
gctggggccgccac

SEQ ID NO: 3375353 - DNA, 14 bp, Homo sapiens
gctggggcctcaga

SEQ ID NO: 3375354 - DNA, 15 bp, Homo sapiens
gctggggcctcagac

SEQ ID NO: 3375355 - DNA, 16 bp, Homo sapiens
gctggggcctcagacg

SEQ ID NO: 3375356 - DNA, 19 bp, Homo sapiens
gctggggcgtggggagggc

SEQ ID NO: 3375357 - DNA, 20 bp, Homo sapiens
gctgggggaatgagcccaga

SEQ ID NO: 3375358 - DNA, 22 bp, Homo sapiens
gctgggggaatgagcccagaga

SEQ ID NO: 3375359 - DNA, 15 bp, Homo sapiens
gctgggggcctcagt

SEQ ID NO: 3375360 - DNA, 15 bp, Homo sapiens
gctggggggcacccc

SEQ ID NO: 3375361 - DNA, 20 bp, Homo sapiens
gctgggtataagcagagagg

SEQ ID NO: 3375362 - DNA, 12 bp, Homo sapiens
gctgggtcaggg

SEQ ID NO: 3375363 - DNA, 16 bp, Homo sapiens
gctgggtcagggccag

SEQ ID NO: 3375364 - DNA, 23 bp, Homo sapiens
gctgggtcagggccagactggaa

SEQ ID NO: 3375365 - DNA, 19 bp, Homo sapiens
gctgggtggcacaccaccc

SEQ ID NO: 3375366 - DNA, 14 bp, Homo sapiens
gctgggtggcctgt

SEQ ID NO: 3375367 - DNA, 17 bp, Homo sapiens
gctgggtggtaccctct

SEQ ID NO: 3375368 - DNA, 13 bp, Homo sapiens
gctgggtggtttt

SEQ ID NO: 3375369 - DNA, 18 bp, Homo sapiens
gctggtaacagtggctgc

SEQ ID NO: 3375370 - DNA, 13 bp, Homo sapiens
gctggtaacagtt

SEQ ID NO: 3375371 - DNA, 15 bp, Homo sapiens
gctggtagagacccc

SEQ ID NO: 3375372 - DNA, 15 bp, Homo sapiens
gctggtatctcagaa

SEQ ID NO: 3375373 - DNA, 14 bp, Homo sapiens
gctggtcagagacg

SEQ ID NO: 3375374 - DNA, 14 bp, Homo sapiens
gctggtcccactca

SEQ ID NO: 3375375 - DNA, 15 bp, Homo sapiens
gctggtcccactcag

SEQ ID NO: 3375376 - DNA, 20 bp, Homo sapiens
gctggtcccactcagtccat

SEQ ID NO: 3375377 - DNA, 18 bp, Homo sapiens
gctggtcccctcctcagt

SEQ ID NO: 3375378 - DNA, 14 bp, Homo sapiens
gctggtgccaggcg

SEQ ID NO: 3375379 - DNA, 15 bp, Homo sapiens
gctggtgccccacag

SEQ ID NO: 3375380 - DNA, 23 bp, Homo sapiens
gctggtggaaagcgattcactgt

SEQ ID NO: 3375381 - DNA, 14 bp, Homo sapiens
gctggtgtcacctg

SEQ ID NO: 3375382 - DNA, 18 bp, Homo sapiens
gctggtgtcacctgaaga

SEQ ID NO: 3375383 - DNA, 15 bp, Homo sapiens
gctggtgtcctgacc

SEQ ID NO: 3375384 - DNA, 16 bp, Homo sapiens
gctggtgtcctgacca

SEQ ID NO: 3375385 - DNA, 22 bp, Homo sapiens
gctggtgtcctgaccaccctcc

SEQ ID NO: 3375386 - DNA, 17 bp, Homo sapiens
gctggttactcagggtt

SEQ ID NO: 3375387 - DNA, 23 bp, Homo sapiens
gctggttcagggttggcccctgc

SEQ ID NO: 3375388 - DNA, 14 bp, Homo sapiens
gctggttgctgtgt

SEQ ID NO: 3375389 - DNA, 16 bp, Homo sapiens
gctggttgctgtgtgg

SEQ ID NO: 3375390 - DNA, 12 bp, Homo sapiens
gctggttttcct

SEQ ID NO: 3375391 - DNA, 14 bp, Homo sapiens
gctggttttcctaa

SEQ ID NO: 3375392 - DNA, 20 bp, Homo sapiens
gctggttttgtaagatgctg

SEQ ID NO: 3375393 - DNA, 15 bp, Homo sapiens
gctgtaaaacgctgt

SEQ ID NO: 3375394 - DNA, 14 bp, Homo sapiens
gctgtaaaatcttg

SEQ ID NO: 3375395 - DNA, 20 bp, Homo sapiens
gctgtaaaatgcatgatttt

SEQ ID NO: 3375396 - DNA, 22 bp, Homo sapiens
gctgtaaatcctagacttgaaa

SEQ ID NO: 3375397 - DNA, 14 bp, Homo sapiens
gctgtaactgctga

SEQ ID NO: 3375398 - DNA, 15 bp, Homo sapiens
gctgtaactgctgag

SEQ ID NO: 3375399 - DNA, 22 bp, Homo sapiens
gctgtaactgctgagccactcg

SEQ ID NO: 3375400 - DNA, 16 bp, Homo sapiens
gctgtaagaagagact

SEQ ID NO: 3375401 - DNA, 24 bp, Homo sapiens
gctgtaagaagagactgggaagat

SEQ ID NO: 3375402 - DNA, 15 bp, Homo sapiens
gctgtaaggctctag

SEQ ID NO: 3375403 - DNA, 23 bp, Homo sapiens
gctgtaaggctctagatcataag

SEQ ID NO: 3375404 - DNA, 13 bp, Homo sapiens
gctgtaagggcag

SEQ ID NO: 3375405 - DNA, 15 bp, Homo sapiens
gctgtaatcatttgt

SEQ ID NO: 3375406 - DNA, 22 bp, Homo sapiens
gctgtaatcatttgtttacatt

SEQ ID NO: 3375407 - DNA, 20 bp, Homo sapiens
gctgtacatctattttggat

SEQ ID NO: 3375408 - DNA, 22 bp, Homo sapiens
gctgtacatctattttggattg

SEQ ID NO: 3375409 - DNA, 15 bp, Homo sapiens
gctgtaccacatctg

SEQ ID NO: 3375410 - DNA, 19 bp, Homo sapiens
gctgtaccacatctgctct

SEQ ID NO: 3375411 - DNA, 20 bp, Homo sapiens
gctgtacccagatgcctaca

SEQ ID NO: 3375412 - DNA, 14 bp, Homo sapiens
gctgtacccttcca

SEQ ID NO: 3375413 - DNA, 17 bp, Homo sapiens
gctgtacgcgtttgtct

SEQ ID NO: 3375414 - DNA, 18 bp, Homo sapiens
gctgtacgcgtttgtctc

SEQ ID NO: 3375415 - DNA, 22 bp, Homo sapiens
gctgtacgcgtttgtctcgtgg

SEQ ID NO: 3375416 - DNA, 13 bp, Homo sapiens
gctgtactcagag

SEQ ID NO: 3375417 - DNA, 14 bp, Homo sapiens
gctgtactcagagc

SEQ ID NO: 3375418 - DNA, 17 bp, Homo sapiens
gctgtactcagagcaga

SEQ ID NO: 3375419 - DNA, 19 bp, Homo sapiens
gctgtactcagagcagagc

SEQ ID NO: 3375420 - DNA, 13 bp, Homo sapiens
gctgtagccatgg

SEQ ID NO: 3375421 - DNA, 20 bp, Homo sapiens
gctgtagccatggctcaggc

SEQ ID NO: 3375422 - DNA, 22 bp, Homo sapiens
gctgtagccatggctcaggcaa

SEQ ID NO: 3375423 - DNA, 21 bp, Homo sapiens
gctgtagtcctttctgccttg

SEQ ID NO: 3375424 - DNA, 15 bp, Homo sapiens
gctgtataagttatt

SEQ ID NO: 3375425 - DNA, 12 bp, Homo sapiens
gctgtatgattt

SEQ ID NO: 3375426 - DNA, 16 bp, Homo sapiens
gctgtatgatttgttt

SEQ ID NO: 3375427 - DNA, 21 bp, Homo sapiens
gctgtatggaaatgcaccctc

SEQ ID NO: 3375428 - DNA, 18 bp, Homo sapiens
gctgtattttaacacttt

SEQ ID NO: 3375429 - DNA, 20 bp, Homo sapiens
gctgtattttaacactttgt

SEQ ID NO: 3375430 - DNA, 23 bp, Homo sapiens
gctgtattttaacactttgtatt

SEQ ID NO: 3375431 - DNA, 20 bp, Homo sapiens
gctgtcaaaacaagtttttc

SEQ ID NO: 3375432 - DNA, 14 bp, Homo sapiens
gctgtcactggctg

SEQ ID NO: 3375433 - DNA, 18 bp, Homo sapiens
gctgtcactggctggctc

SEQ ID NO: 3375434 - DNA, 19 bp, Homo sapiens
gctgtcactggctggctcc

SEQ ID NO: 3375435 - DNA, 23 bp, Homo sapiens
gctgtcatcaattgaatggtcag

SEQ ID NO: 3375436 - DNA, 21 bp, Homo sapiens
gctgtcatggtcctttctgga

SEQ ID NO: 3375437 - DNA, 22 bp, Homo sapiens
gctgtcatggtcctttctggaa

SEQ ID NO: 3375438 - DNA, 15 bp, Homo sapiens
gctgtcccctctgtc

SEQ ID NO: 3375439 - DNA, 16 bp, Homo sapiens
gctgtccctgcagggc

SEQ ID NO: 3375440 - DNA, 14 bp, Homo sapiens
gctgtcctaggcca

SEQ ID NO: 3375441 - DNA, 19 bp, Homo sapiens
gctgtcctctcgagcccag

SEQ ID NO: 3375442 - DNA, 14 bp, Homo sapiens
gctgtcgccccagg

SEQ ID NO: 3375443 - DNA, 16 bp, Homo sapiens
gctgtcgccccaggcc

SEQ ID NO: 3375444 - DNA, 17 bp, Homo sapiens
gctgtcgccccaggccc

SEQ ID NO: 3375445 - DNA, 18 bp, Homo sapiens
gctgtcgccccaggccct

SEQ ID NO: 3375446 - DNA, 15 bp, Homo sapiens
gctgtctgcctgtat

SEQ ID NO: 3375447 - DNA, 17 bp, Homo sapiens
gctgtctggccaggcct

SEQ ID NO: 3375448 - DNA, 12 bp, Homo sapiens
gctgtctggggc

SEQ ID NO: 3375449 - DNA, 12 bp, Homo sapiens
gctgtctgtcac

SEQ ID NO: 3375450 - DNA, 16 bp, Homo sapiens
gctgtctgtcaccagc

SEQ ID NO: 3375451 - DNA, 17 bp, Homo sapiens
gctgtcttctggtctgt

SEQ ID NO: 3375452 - DNA, 20 bp, Homo sapiens
gctgtcttctggtctgtgtg

SEQ ID NO: 3375453 - DNA, 12 bp, Homo sapiens
gctgtgagcccc

SEQ ID NO: 3375454 - DNA, 20 bp, Homo sapiens
gctgtgagcccctggtcctg

SEQ ID NO: 3375455 - DNA, 18 bp, Homo sapiens
gctgtgaggaatgctctg

SEQ ID NO: 3375456 - DNA, 21 bp, Homo sapiens
gctgtgaggaatgctctgtgc

SEQ ID NO: 3375457 - DNA, 22 bp, Homo sapiens
gctgtgagtctttggttctaag

SEQ ID NO: 3375458 - DNA, 18 bp, Homo sapiens
gctgtgagtgtaagtgtg

SEQ ID NO: 3375459 - DNA, 22 bp, Homo sapiens
gctgtgagtgtaagtgtgagta

SEQ ID NO: 3375460 - DNA, 18 bp, Homo sapiens
gctgtgagttctccctgt

SEQ ID NO: 3375461 - DNA, 15 bp, Homo sapiens
gctgtgccatgctgg

SEQ ID NO: 3375462 - DNA, 17 bp, Homo sapiens
gctgtgccatgctgggc

SEQ ID NO: 3375463 - DNA, 14 bp, Homo sapiens
gctgtgcctctgcc

SEQ ID NO: 3375464 - DNA, 16 bp, Homo sapiens
gctgtgcctctgcctg

SEQ ID NO: 3375465 - DNA, 12 bp, Homo sapiens
gctgtgcctgct

SEQ ID NO: 3375466 - DNA, 14 bp, Homo sapiens
gctgtgcctgctag

SEQ ID NO: 3375467 - DNA, 17 bp, Homo sapiens
gctgtgcctgctagagc

SEQ ID NO: 3375468 - DNA, 20 bp, Homo sapiens
gctgtgcctgctagagcaac

SEQ ID NO: 3375469 - DNA, 22 bp, Homo sapiens
gctgtgcctgctagagcaaccc

SEQ ID NO: 3375470 - DNA, 18 bp, Homo sapiens
gctgtgctctggacaggc

SEQ ID NO: 3375471 - DNA, 13 bp, Homo sapiens
gctgtgctgcttt

SEQ ID NO: 3375472 - DNA, 23 bp, Homo sapiens
gctgtgctgcttttgagcctcag

SEQ ID NO: 3375473 - DNA, 12 bp, Homo sapiens
gctgtggaccgt

SEQ ID NO: 3375474 - DNA, 21 bp, Homo sapiens
gctgtggaccgtggacaggcc

SEQ ID NO: 3375475 - DNA, 20 bp, Homo sapiens
gctgtggagcaaaaggcagc

SEQ ID NO: 3375476 - DNA, 13 bp, Homo sapiens
gctgtggaggcct

SEQ ID NO: 3375477 - DNA, 13 bp, Homo sapiens
gctgtggccctgg

SEQ ID NO: 3375478 - DNA, 14 bp, Homo sapiens
gctgtggccctgga

SEQ ID NO: 3375479 - DNA, 15 bp, Homo sapiens
gctgtggccgtctcc

SEQ ID NO: 3375480 - DNA, 20 bp, Homo sapiens
gctgtggccgtctcctccct

SEQ ID NO: 3375481 - DNA, 14 bp, Homo sapiens
gctgtggcctcacc

SEQ ID NO: 3375482 - DNA, 18 bp, Homo sapiens
gctgtggcctcaccctga

SEQ ID NO: 3375483 - DNA, 14 bp, Homo sapiens
gctgtggcctgggc

SEQ ID NO: 3375484 - DNA, 15 bp, Homo sapiens
gctgtggcctgggca

SEQ ID NO: 3375485 - DNA, 20 bp, Homo sapiens
gctgtgggcagcaccctccc

SEQ ID NO: 3375486 - DNA, 22 bp, Homo sapiens
gctgtgggcaggcaagcccttc

SEQ ID NO: 3375487 - DNA, 18 bp, Homo sapiens
gctgtgggcctcaaggac

SEQ ID NO: 3375488 - DNA, 19 bp, Homo sapiens
gctgtgggcctcaaggact

SEQ ID NO: 3375489 - DNA, 21 bp, Homo sapiens
gctgtggggctggtagctcag

SEQ ID NO: 3375490 - DNA, 20 bp, Homo sapiens
gctgtgtgaatacctgctca

SEQ ID NO: 3375491 - DNA, 13 bp, Homo sapiens
gctgtgtggtttg

SEQ ID NO: 3375492 - DNA, 13 bp, Homo sapiens
gctgtgtgtgagc

SEQ ID NO: 3375493 - DNA, 18 bp, Homo sapiens
gctgtgttaaataaacct

SEQ ID NO: 3375494 - DNA, 19 bp, Homo sapiens
gctgtgttgaaacagaaaa

SEQ ID NO: 3375495 - DNA, 22 bp, Homo sapiens
gctgtgtttatatggaagaaag

SEQ ID NO: 3375496 - DNA, 15 bp, Homo sapiens
gctgttaaactgtta

SEQ ID NO: 3375497 - DNA, 23 bp, Homo sapiens
gctgttactttctttcagatgtt

SEQ ID NO: 3375498 - DNA, 22 bp, Homo sapiens
gctgttcccatgtagccccctg

SEQ ID NO: 3375499 - DNA, 19 bp, Homo sapiens
gctgttccttgtactctta

SEQ ID NO: 3375500 - DNA, 15 bp, Homo sapiens
gctgttctgcactga

SEQ ID NO: 3375501 - DNA, 17 bp, Homo sapiens
gctgttctgcactgaaa

SEQ ID NO: 3375502 - DNA, 18 bp, Homo sapiens
gctgttgagctgttttcc

SEQ ID NO: 3375503 - DNA, 18 bp, Homo sapiens
gctgttgagggccacttt

SEQ ID NO: 3375504 - DNA, 15 bp, Homo sapiens
gctgttgccatagcc

SEQ ID NO: 3375505 - DNA, 16 bp, Homo sapiens
gctgttgccatagccc

SEQ ID NO: 3375506 - DNA, 22 bp, Homo sapiens
gctgttggcactcacagacctg

SEQ ID NO: 3375507 - DNA, 23 bp, Homo sapiens
gctgttggcactcacagacctgg

SEQ ID NO: 3375508 - DNA, 12 bp, Homo sapiens
gctgttgtacat

SEQ ID NO: 3375509 - DNA, 13 bp, Homo sapiens
gctgttgtacatt

SEQ ID NO: 3375510 - DNA, 15 bp, Homo sapiens
gctgttgtacattta

SEQ ID NO: 3375511 - DNA, 18 bp, Homo sapiens
gctgttgttccattgaag

SEQ ID NO: 3375512 - DNA, 15 bp, Homo sapiens
gctgtttagcagaac

SEQ ID NO: 3375513 - DNA, 17 bp, Homo sapiens
gctgtttatggcctcag

SEQ ID NO: 3375514 - DNA, 22 bp, Homo sapiens
gctgtttatggcctcagctgcc

SEQ ID NO: 3375515 - DNA, 17 bp, Homo sapiens
gctgtttatgtttttat

SEQ ID NO: 3375516 - DNA, 16 bp, Homo sapiens
gctgtttattttatat

SEQ ID NO: 3375517 - DNA, 13 bp, Homo sapiens
gctgtttgcgtga

SEQ ID NO: 3375518 - DNA, 16 bp, Homo sapiens
gctgtttgcgtgaatg

SEQ ID NO: 3375519 - DNA, 12 bp, Homo sapiens
gctgtttgtcat

SEQ ID NO: 3375520 - DNA, 17 bp, Homo sapiens
gctgttttccctgacct

SEQ ID NO: 3375521 - DNA, 21 bp, Homo sapiens
gctgtttttaggctgttcctt

SEQ ID NO: 3375522 - DNA, 23 bp, Homo sapiens
gctgtttttaggctgttccttgt

SEQ ID NO: 3375523 - DNA, 14 bp, Homo sapiens
gctgtttttgttgt

SEQ ID NO: 3375524 - DNA, 22 bp, Homo sapiens
gcttaaaaaagagttttcttta

SEQ ID NO: 3375525 - DNA, 20 bp, Homo sapiens
gcttaaaaggtataattaaa

SEQ ID NO: 3375526 - DNA, 12 bp, Homo sapiens
gcttaaacaaag

SEQ ID NO: 3375527 - DNA, 12 bp, Homo sapiens
gcttaaactaaa

SEQ ID NO: 3375528 - DNA, 17 bp, Homo sapiens
gcttaaataggaaagtt

SEQ ID NO: 3375529 - DNA, 15 bp, Homo sapiens
gcttaacaatgcaac

SEQ ID NO: 3375530 - DNA, 21 bp, Homo sapiens
gcttaacaatgcaacttttaa

SEQ ID NO: 3375531 - DNA, 22 bp, Homo sapiens
gcttaacctttccgctgtcgcc

SEQ ID NO: 3375532 - DNA, 20 bp, Homo sapiens
gcttaagaaatctagtattt

SEQ ID NO: 3375533 - DNA, 15 bp, Homo sapiens
gcttaagcagaagca

SEQ ID NO: 3375534 - DNA, 21 bp, Homo sapiens
gcttaataaaaatgacagact

SEQ ID NO: 3375535 - DNA, 15 bp, Homo sapiens
gcttacaatctttat

SEQ ID NO: 3375536 - DNA, 11 bp, Homo sapiens
gcttacatttt

SEQ ID NO: 3375537 - DNA, 18 bp, Homo sapiens
gcttacatttttacaata

SEQ ID NO: 3375538 - DNA, 13 bp, Homo sapiens
gcttacctcctca

SEQ ID NO: 3375539 - DNA, 21 bp, Homo sapiens
gcttacctgacctcttgctgt

SEQ ID NO: 3375540 - DNA, 21 bp, Homo sapiens
gcttactgatatattttacaa

SEQ ID NO: 3375541 - DNA, 23 bp, Homo sapiens
gcttagagagaggaggcagcccc

SEQ ID NO: 3375542 - DNA, 13 bp, Homo sapiens
gcttagatttcat

SEQ ID NO: 3375543 - DNA, 23 bp, Homo sapiens
gcttagcagggtgctaacgtatc

SEQ ID NO: 3375544 - DNA, 12 bp, Homo sapiens
gcttagccttgt

SEQ ID NO: 3375545 - DNA, 20 bp, Homo sapiens
gcttagctgccttgagctaa

SEQ ID NO: 3375546 - DNA, 22 bp, Homo sapiens
gcttagcttatctttctttcca

SEQ ID NO: 3375547 - DNA, 12 bp, Homo sapiens
gcttaggagaga

SEQ ID NO: 3375548 - DNA, 22 bp, Homo sapiens
gcttaggatgtgtgcatgtgtg

SEQ ID NO: 3375549 - DNA, 15 bp, Homo sapiens
gcttagtaaaattta

SEQ ID NO: 3375550 - DNA, 14 bp, Homo sapiens
gcttagtttgtgtg

SEQ ID NO: 3375551 - DNA, 21 bp, Homo sapiens
gcttagtttgtgtgttgtctc

SEQ ID NO: 3375552 - DNA, 20 bp, Homo sapiens
gcttagtttttttttaatct

SEQ ID NO: 3375553 - DNA, 14 bp, Homo sapiens
gcttataaacacat

SEQ ID NO: 3375554 - DNA, 21 bp, Homo sapiens
gcttatctcttttatatttgt

SEQ ID NO: 3375555 - DNA, 21 bp, Homo sapiens
gcttatctttgcacatgttaa

SEQ ID NO: 3375556 - DNA, 18 bp, Homo sapiens
gcttatgaaagaggcagc

SEQ ID NO: 3375557 - DNA, 18 bp, Homo sapiens
gcttatgacatcacttgt

SEQ ID NO: 3375558 - DNA, 22 bp, Homo sapiens
gcttatgagatctaatgtgaaa

SEQ ID NO: 3375559 - DNA, 15 bp, Homo sapiens
gcttattacatttta

SEQ ID NO: 3375560 - DNA, 17 bp, Homo sapiens
gcttattgttccaagac

SEQ ID NO: 3375561 - DNA, 16 bp, Homo sapiens
gcttatttattaacag

SEQ ID NO: 3375562 - DNA, 12 bp, Homo sapiens
gcttattttaat

SEQ ID NO: 3375563 - DNA, 13 bp, Homo sapiens
gcttattttaatg

SEQ ID NO: 3375564 - DNA, 21 bp, Homo sapiens
gcttattttaatgtgatgatg

SEQ ID NO: 3375565 - DNA, 14 bp, Homo sapiens
gcttattttattat

SEQ ID NO: 3375566 - DNA, 19 bp, Homo sapiens
gcttcaagtgccttttgct

SEQ ID NO: 3375567 - DNA, 15 bp, Homo sapiens
gcttcaattaataaa

SEQ ID NO: 3375568 - DNA, 15 bp, Homo sapiens
gcttcaccagagcat

SEQ ID NO: 3375569 - DNA, 17 bp, Homo sapiens
gcttcaccagtctgtct

SEQ ID NO: 3375570 - DNA, 18 bp, Homo sapiens
gcttcaccagtctgtcta

SEQ ID NO: 3375571 - DNA, 20 bp, Homo sapiens
gcttcaccatggccttatga

SEQ ID NO: 3375572 - DNA, 16 bp, Homo sapiens
gcttcacccctgcact

SEQ ID NO: 3375573 - DNA, 20 bp, Homo sapiens
gcttcacccctgcacttcag

SEQ ID NO: 3375574 - DNA, 22 bp, Homo sapiens
gcttcaccctgaatggttccat

SEQ ID NO: 3375575 - DNA, 16 bp, Homo sapiens
gcttcactgtataaat

SEQ ID NO: 3375576 - DNA, 17 bp, Homo sapiens
gcttcactgtataaata

SEQ ID NO: 3375577 - DNA, 18 bp, Homo sapiens
gcttcagagtttgtgtgt

SEQ ID NO: 3375578 - DNA, 20 bp, Homo sapiens
gcttcagagtttgtgtgtat

SEQ ID NO: 3375579 - DNA, 19 bp, Homo sapiens
gcttcagcatatttatagc

SEQ ID NO: 3375580 - DNA, 16 bp, Homo sapiens
gcttcaggcaccagca

SEQ ID NO: 3375581 - DNA, 20 bp, Homo sapiens
gcttcaggcaccagcatcca

SEQ ID NO: 3375582 - DNA, 20 bp, Homo sapiens
gcttcagggaggtagtttca

SEQ ID NO: 3375583 - DNA, 20 bp, Homo sapiens
gcttcaggttatcgaaataa

SEQ ID NO: 3375584 - DNA, 23 bp, Homo sapiens
gcttcaggttatcgaaataacaa

SEQ ID NO: 3375585 - DNA, 19 bp, Homo sapiens
gcttcagtcatcagccagc

SEQ ID NO: 3375586 - DNA, 16 bp, Homo sapiens
gcttcagtggcagctg

SEQ ID NO: 3375587 - DNA, 22 bp, Homo sapiens
gcttcataaatgaagcagcttt

SEQ ID NO: 3375588 - DNA, 14 bp, Homo sapiens
gcttcatgccagct

SEQ ID NO: 3375589 - DNA, 16 bp, Homo sapiens
gcttcatgcctttgta

SEQ ID NO: 3375590 - DNA, 15 bp, Homo sapiens
gcttcattctccttg

SEQ ID NO: 3375591 - DNA, 14 bp, Homo sapiens
gcttcatttcaatc

SEQ ID NO: 3375592 - DNA, 17 bp, Homo sapiens
gcttcatttcctgtgtc

SEQ ID NO: 3375593 - DNA, 15 bp, Homo sapiens
gcttccaaatattgt

SEQ ID NO: 3375594 - DNA, 22 bp, Homo sapiens
gcttccagattgacgacaagtg

SEQ ID NO: 3375595 - DNA, 19 bp, Homo sapiens
gcttccaggataaggagac

SEQ ID NO: 3375596 - DNA, 18 bp, Homo sapiens
gcttccaggctcttcctg

SEQ ID NO: 3375597 - DNA, 21 bp, Homo sapiens
gcttccaggctcttcctggac

SEQ ID NO: 3375598 - DNA, 17 bp, Homo sapiens
gcttccatgagaacagc

SEQ ID NO: 3375599 - DNA, 12 bp, Homo sapiens
gcttccatgcct

SEQ ID NO: 3375600 - DNA, 22 bp, Homo sapiens
gcttccatgcctgtagctttcc

SEQ ID NO: 3375601 - DNA, 13 bp, Homo sapiens
gcttcccacctcc

SEQ ID NO: 3375602 - DNA, 23 bp, Homo sapiens
gcttcccacctccctgcccaggc

SEQ ID NO: 3375603 - DNA, 12 bp, Homo sapiens
gcttcccagagg

SEQ ID NO: 3375604 - DNA, 15 bp, Homo sapiens
gcttcccagagggag

SEQ ID NO: 3375605 - DNA, 15 bp, Homo sapiens
gcttcccagccatgc

SEQ ID NO: 3375606 - DNA, 14 bp, Homo sapiens
gcttcccagctctg

SEQ ID NO: 3375607 - DNA, 13 bp, Homo sapiens
gcttcccatccta

SEQ ID NO: 3375608 - DNA, 19 bp, Homo sapiens
gcttcccattgtggctcct

SEQ ID NO: 3375609 - DNA, 14 bp, Homo sapiens
gcttcccccatagc

SEQ ID NO: 3375610 - DNA, 15 bp, Homo sapiens
gcttcccttactttg

SEQ ID NO: 3375611 - DNA, 13 bp, Homo sapiens
gcttccgccactc

SEQ ID NO: 3375612 - DNA, 15 bp, Homo sapiens
gcttccgccactcag

SEQ ID NO: 3375613 - DNA, 17 bp, Homo sapiens
gcttccgccactcagcc

SEQ ID NO: 3375614 - DNA, 22 bp, Homo sapiens
gcttcctcagtaacatttctgt

SEQ ID NO: 3375615 - DNA, 21 bp, Homo sapiens
gcttcctcctccccaactgtg

SEQ ID NO: 3375616 - DNA, 11 bp, Homo sapiens
gcttcctcctg

SEQ ID NO: 3375617 - DNA, 15 bp, Homo sapiens
gcttcctctagaagc

SEQ ID NO: 3375618 - DNA, 16 bp, Homo sapiens
gcttcctgaaataaac

SEQ ID NO: 3375619 - DNA, 17 bp, Homo sapiens
gcttcctgaaataaaca

SEQ ID NO: 3375620 - DNA, 19 bp, Homo sapiens
gcttcctgaaataaacact

SEQ ID NO: 3375621 - DNA, 18 bp, Homo sapiens
gcttcctgacaatcaact

SEQ ID NO: 3375622 - DNA, 12 bp, Homo sapiens
gcttcctggtgt

SEQ ID NO: 3375623 - DNA, 14 bp, Homo sapiens
gcttcctgtccact

SEQ ID NO: 3375624 - DNA, 23 bp, Homo sapiens
gcttcctgtccactctcggggcc

SEQ ID NO: 3375625 - DNA, 15 bp, Homo sapiens
gcttccttctgggac

SEQ ID NO: 3375626 - DNA, 22 bp, Homo sapiens
gcttccttctgtgaaagtacat

SEQ ID NO: 3375627 - DNA, 16 bp, Homo sapiens
gcttcgacttttctta

SEQ ID NO: 3375628 - DNA, 15 bp, Homo sapiens
gcttcgagccaactc

SEQ ID NO: 3375629 - DNA, 23 bp, Homo sapiens
gcttcggttctccagaatgtaag

SEQ ID NO: 3375630 - DNA, 12 bp, Homo sapiens
gcttctatccca

SEQ ID NO: 3375631 - DNA, 20 bp, Homo sapiens
gcttctatcccaggaggtgg

SEQ ID NO: 3375632 - DNA, 20 bp, Homo sapiens
gcttctcaccgtgcagagct

SEQ ID NO: 3375633 - DNA, 13 bp, Homo sapiens
gcttctccagcct

SEQ ID NO: 3375634 - DNA, 14 bp, Homo sapiens
gcttctccccagaa

SEQ ID NO: 3375635 - DNA, 15 bp, Homo sapiens
gcttctccccagaat

SEQ ID NO: 3375636 - DNA, 15 bp, Homo sapiens
gcttctccgccagcc

SEQ ID NO: 3375637 - DNA, 20 bp, Homo sapiens
gcttctccgccagcctcctc

SEQ ID NO: 3375638 - DNA, 24 bp, Homo sapiens
gcttctccgccagcctcctctgga

SEQ ID NO: 3375639 - DNA, 15 bp, Homo sapiens
gcttctcctcccagc

SEQ ID NO: 3375640 - DNA, 12 bp, Homo sapiens
gcttctcctgac

SEQ ID NO: 3375641 - DNA, 14 bp, Homo sapiens
gcttctcctgaccc

SEQ ID NO: 3375642 - DNA, 13 bp, Homo sapiens
gcttctcctgcgc

SEQ ID NO: 3375643 - DNA, 18 bp, Homo sapiens
gcttctcctgttttatat

SEQ ID NO: 3375644 - DNA, 14 bp, Homo sapiens
gcttctctacagac

SEQ ID NO: 3375645 - DNA, 18 bp, Homo sapiens
gcttctctagctctctag

SEQ ID NO: 3375646 - DNA, 22 bp, Homo sapiens
gcttctctagctctctaggcct

SEQ ID NO: 3375647 - DNA, 18 bp, Homo sapiens
gcttctctgacttctgcc

SEQ ID NO: 3375648 - DNA, 11 bp, Homo sapiens
gcttctctgca

SEQ ID NO: 3375649 - DNA, 20 bp, Homo sapiens
gcttctctgctagatttcta

SEQ ID NO: 3375650 - DNA, 19 bp, Homo sapiens
gcttctctgtgaacgattt

SEQ ID NO: 3375651 - DNA, 22 bp, Homo sapiens
gcttctctgtgaacgatttaga

SEQ ID NO: 3375652 - DNA, 19 bp, Homo sapiens
gcttctgaatgctgctact

SEQ ID NO: 3375653 - DNA, 15 bp, Homo sapiens
gcttctgcaccctcc

SEQ ID NO: 3375654 - DNA, 17 bp, Homo sapiens
gcttctgcaccctccac

SEQ ID NO: 3375655 - DNA, 14 bp, Homo sapiens
gcttctgcttttct

SEQ ID NO: 3375656 - DNA, 20 bp, Homo sapiens
gcttctgcttttctgccctg

SEQ ID NO: 3375657 - DNA, 21 bp, Homo sapiens
gcttctgcttttctgccctgg

SEQ ID NO: 3375658 - DNA, 17 bp, Homo sapiens
gcttctggaatttgttc

SEQ ID NO: 3375659 - DNA, 23 bp, Homo sapiens
gcttctggaatttgttcaagttt

SEQ ID NO: 3375660 - DNA, 17 bp, Homo sapiens
gcttctggagcccttgg

SEQ ID NO: 3375661 - DNA, 16 bp, Homo sapiens
gcttctggtactctcc

SEQ ID NO: 3375662 - DNA, 17 bp, Homo sapiens
gcttctggtactctcct

SEQ ID NO: 3375663 - DNA, 14 bp, Homo sapiens
gcttctgtagcttc

SEQ ID NO: 3375664 - DNA, 15 bp, Homo sapiens
gcttctgtagcttct

SEQ ID NO: 3375665 - DNA, 20 bp, Homo sapiens
gcttctgtagtactccttaa

SEQ ID NO: 3375666 - DNA, 16 bp, Homo sapiens
gcttctgtgatgagct

SEQ ID NO: 3375667 - DNA, 14 bp, Homo sapiens
gcttctgtttctag

SEQ ID NO: 3375668 - DNA, 15 bp, Homo sapiens
gcttctgtttctagt

SEQ ID NO: 3375669 - DNA, 17 bp, Homo sapiens
gcttcttaattaatttg

SEQ ID NO: 3375670 - DNA, 18 bp, Homo sapiens
gcttcttactgataattt

SEQ ID NO: 3375671 - DNA, 22 bp, Homo sapiens
gcttcttcctaggtccaagccc

SEQ ID NO: 3375672 - DNA, 21 bp, Homo sapiens
gcttcttgcctctgtgctgtg

SEQ ID NO: 3375673 - DNA, 12 bp, Homo sapiens
gcttctttctag

SEQ ID NO: 3375674 - DNA, 21 bp, Homo sapiens
gcttgaaattactgtgtaaat

SEQ ID NO: 3375675 - DNA, 23 bp, Homo sapiens
gcttgaacacagtattttcccaa

SEQ ID NO: 3375676 - DNA, 13 bp, Homo sapiens
gcttgaacccagg

SEQ ID NO: 3375677 - DNA, 21 bp, Homo sapiens
gcttgaagatcgttagtatct

SEQ ID NO: 3375678 - DNA, 15 bp, Homo sapiens
gcttgaagccaaaga

SEQ ID NO: 3375679 - DNA, 16 bp, Homo sapiens
gcttgaagccaaagaa

SEQ ID NO: 3375680 - DNA, 20 bp, Homo sapiens
gcttgaagccaaagaaaaat

SEQ ID NO: 3375681 - DNA, 11 bp, Homo sapiens
gcttgaatgct

SEQ ID NO: 3375682 - DNA, 20 bp, Homo sapiens
gcttgacaaatattttcatg

SEQ ID NO: 3375683 - DNA, 17 bp, Homo sapiens
gcttgacacagtcagca

SEQ ID NO: 3375684 - DNA, 21 bp, Homo sapiens
gcttgagccgggcccctgggc

SEQ ID NO: 3375685 - DNA, 12 bp, Homo sapiens
gcttgagcctcc

SEQ ID NO: 3375686 - DNA, 13 bp, Homo sapiens
gcttgagcctccc

SEQ ID NO: 3375687 - DNA, 16 bp, Homo sapiens
gcttgagcctccccca

SEQ ID NO: 3375688 - DNA, 20 bp, Homo sapiens
gcttgagcctcccccaaagc

SEQ ID NO: 3375689 - DNA, 14 bp, Homo sapiens
gcttgatgaagcaa

SEQ ID NO: 3375690 - DNA, 14 bp, Homo sapiens
gcttgattctgcag

SEQ ID NO: 3375691 - DNA, 20 bp, Homo sapiens
gcttgccgagcctaatgaaa

SEQ ID NO: 3375692 - DNA, 14 bp, Homo sapiens
gcttgcctggagac

SEQ ID NO: 3375693 - DNA, 21 bp, Homo sapiens
gcttgcgaactagagatgtgc

SEQ ID NO: 3375694 - DNA, 18 bp, Homo sapiens
gcttgcggcaaaaggaaa

SEQ ID NO: 3375695 - DNA, 23 bp, Homo sapiens
gcttggaaattccttgccccaca

SEQ ID NO: 3375696 - DNA, 18 bp, Homo sapiens
gcttggacttcctggggc

SEQ ID NO: 3375697 - DNA, 21 bp, Homo sapiens
gcttggagagtcttgggcctg

SEQ ID NO: 3375698 - DNA, 12 bp, Homo sapiens
gcttggcccagc

SEQ ID NO: 3375699 - DNA, 17 bp, Homo sapiens
gcttggcccggccggcc

SEQ ID NO: 3375700 - DNA, 19 bp, Homo sapiens
gcttggcccggccggcctg

SEQ ID NO: 3375701 - DNA, 23 bp, Homo sapiens
gcttggcccggccggcctggcac

SEQ ID NO: 3375702 - DNA, 15 bp, Homo sapiens
gcttggccctttcct

SEQ ID NO: 3375703 - DNA, 22 bp, Homo sapiens
gcttgggaaaaaaacttggcac

SEQ ID NO: 3375704 - DNA, 22 bp, Homo sapiens
gcttggggccaccaaagctgcc

SEQ ID NO: 3375705 - DNA, 20 bp, Homo sapiens
gcttggggtgtggggtgggg

SEQ ID NO: 3375706 - DNA, 16 bp, Homo sapiens
gcttggtggggctcgt

SEQ ID NO: 3375707 - DNA, 18 bp, Homo sapiens
gcttggtggggctcgtgg

SEQ ID NO: 3375708 - DNA, 19 bp, Homo sapiens
gcttggtggggctcgtggc

SEQ ID NO: 3375709 - DNA, 17 bp, Homo sapiens
gcttgtaaataccagga

SEQ ID NO: 3375710 - DNA, 17 bp, Homo sapiens
gcttgtaaatagctcag

SEQ ID NO: 3375711 - DNA, 15 bp, Homo sapiens
gcttgtaacaagaaa

SEQ ID NO: 3375712 - DNA, 19 bp, Homo sapiens
gcttgtagaactcactctg

SEQ ID NO: 3375713 - DNA, 17 bp, Homo sapiens
gcttgtagaattgttat

SEQ ID NO: 3375714 - DNA, 22 bp, Homo sapiens
gcttgtaggagctgaggtttca

SEQ ID NO: 3375715 - DNA, 17 bp, Homo sapiens
gcttgtatcaacactgt

SEQ ID NO: 3375716 - DNA, 20 bp, Homo sapiens
gcttgtcttcgctggctcct

SEQ ID NO: 3375717 - DNA, 21 bp, Homo sapiens
gcttgtcttcgctggctccta

SEQ ID NO: 3375718 - DNA, 21 bp, Homo sapiens
gcttgtcttttctgctgagga

SEQ ID NO: 3375719 - DNA, 12 bp, Homo sapiens
gcttgtgaacag

SEQ ID NO: 3375720 - DNA, 14 bp, Homo sapiens
gcttgtgaactgct

SEQ ID NO: 3375721 - DNA, 16 bp, Homo sapiens
gcttgtgaactgctgg

SEQ ID NO: 3375722 - DNA, 23 bp, Homo sapiens
gcttgtggattgagggtaggagg

SEQ ID NO: 3375723 - DNA, 16 bp, Homo sapiens
gcttgtgggctggtgc

SEQ ID NO: 3375724 - DNA, 18 bp, Homo sapiens
gcttgtggggacccaggc

SEQ ID NO: 3375725 - DNA, 19 bp, Homo sapiens
gcttgtgtgtttcactttt

SEQ ID NO: 3375726 - DNA, 15 bp, Homo sapiens
gcttgttagagagaa

SEQ ID NO: 3375727 - DNA, 17 bp, Homo sapiens
gcttgttatcagctttc

SEQ ID NO: 3375728 - DNA, 15 bp, Homo sapiens
gcttgttatttataa

SEQ ID NO: 3375729 - DNA, 18 bp, Homo sapiens
gcttgtttacctttctct

SEQ ID NO: 3375730 - DNA, 17 bp, Homo sapiens
gcttgtttgatttcaac

SEQ ID NO: 3375731 - DNA, 19 bp, Homo sapiens
gcttgtttgatttcaacat

SEQ ID NO: 3375732 - DNA, 16 bp, Homo sapiens
gctttaaacacccttc

SEQ ID NO: 3375733 - DNA, 18 bp, Homo sapiens
gctttaaactcagggaca

SEQ ID NO: 3375734 - DNA, 15 bp, Homo sapiens
gctttaaagtgtaat

SEQ ID NO: 3375735 - DNA, 13 bp, Homo sapiens
gctttaagccttc

SEQ ID NO: 3375736 - DNA, 15 bp, Homo sapiens
gctttaatcaatcat

SEQ ID NO: 3375737 - DNA, 15 bp, Homo sapiens
gctttaattgtataa

SEQ ID NO: 3375738 - DNA, 16 bp, Homo sapiens
gctttaattgtataag

SEQ ID NO: 3375739 - DNA, 20 bp, Homo sapiens
gctttaattgtataagtcaa

SEQ ID NO: 3375740 - DNA, 12 bp, Homo sapiens
gctttacacaca

SEQ ID NO: 3375741 - DNA, 22 bp, Homo sapiens
gctttacctttttgtatgtgaa

SEQ ID NO: 3375742 - DNA, 21 bp, Homo sapiens
gctttagaattctaattgtca

SEQ ID NO: 3375743 - DNA, 17 bp, Homo sapiens
gctttagaccctgggtg

SEQ ID NO: 3375744 - DNA, 20 bp, Homo sapiens
gctttatacgtgtagctata

SEQ ID NO: 3375745 - DNA, 16 bp, Homo sapiens
gctttattatggcttg

SEQ ID NO: 3375746 - DNA, 20 bp, Homo sapiens
gctttattatggcttgtgaa

SEQ ID NO: 3375747 - DNA, 21 bp, Homo sapiens
gctttattgcccatgggatat

SEQ ID NO: 3375748 - DNA, 11 bp, Homo sapiens
gctttcaagtg

SEQ ID NO: 3375749 - DNA, 21 bp, Homo sapiens
gctttcaattgacaaatgatg

SEQ ID NO: 3375750 - DNA, 13 bp, Homo sapiens
gctttcagagcca

SEQ ID NO: 3375751 - DNA, 22 bp, Homo sapiens
gctttcccccaggcgcctgcgc

SEQ ID NO: 3375752 - DNA, 22 bp, Homo sapiens
gctttccccgggggaggaaggg

SEQ ID NO: 3375753 - DNA, 15 bp, Homo sapiens
gctttcccctgtggg

SEQ ID NO: 3375754 - DNA, 12 bp, Homo sapiens
gctttcctgaat

SEQ ID NO: 3375755 - DNA, 19 bp, Homo sapiens
gctttcctgggcctttgca

SEQ ID NO: 3375756 - DNA, 17 bp, Homo sapiens
gctttcctgtttccagg

SEQ ID NO: 3375757 - DNA, 22 bp, Homo sapiens
gctttccttgtggcagaggatg

SEQ ID NO: 3375758 - DNA, 17 bp, Homo sapiens
gctttcggagctcctgt

SEQ ID NO: 3375759 - DNA, 19 bp, Homo sapiens
gctttctacccagcgagcc

SEQ ID NO: 3375760 - DNA, 22 bp, Homo sapiens
gctttctacccagcgagccctg

SEQ ID NO: 3375761 - DNA, 12 bp, Homo sapiens
gctttctcaggg

SEQ ID NO: 3375762 - DNA, 15 bp, Homo sapiens
gctttctccggggtc

SEQ ID NO: 3375763 - DNA, 13 bp, Homo sapiens
gctttctctcaga

SEQ ID NO: 3375764 - DNA, 19 bp, Homo sapiens
gctttctcttttctctttt

SEQ ID NO: 3375765 - DNA, 17 bp, Homo sapiens
gctttctggggcctagc

SEQ ID NO: 3375766 - DNA, 13 bp, Homo sapiens
gctttctgttcca

SEQ ID NO: 3375767 - DNA, 15 bp, Homo sapiens
gctttctgtttctta

SEQ ID NO: 3375768 - DNA, 20 bp, Homo sapiens
gctttcttgctcccttcagc

SEQ ID NO: 3375769 - DNA, 17 bp, Homo sapiens
gctttctttgattctcc

SEQ ID NO: 3375770 - DNA, 19 bp, Homo sapiens
gctttctttgattctcctt

SEQ ID NO: 3375771 - DNA, 15 bp, Homo sapiens
gctttgaaagaagca

SEQ ID NO: 3375772 - DNA, 16 bp, Homo sapiens
gctttgaaagaagcaa

SEQ ID NO: 3375773 - DNA, 22 bp, Homo sapiens
gctttgagaagccttcagctcc

SEQ ID NO: 3375774 - DNA, 20 bp, Homo sapiens
gctttgattcatagtaactt

SEQ ID NO: 3375775 - DNA, 21 bp, Homo sapiens
gctttgcaggctctgggctca

SEQ ID NO: 3375776 - DNA, 20 bp, Homo sapiens
gctttgcattcctacaaaga

SEQ ID NO: 3375777 - DNA, 22 bp, Homo sapiens
gctttgcattcctacaaagatg

SEQ ID NO: 3375778 - DNA, 19 bp, Homo sapiens
gctttgccaagttgctgtc

SEQ ID NO: 3375779 - DNA, 20 bp, Homo sapiens
gctttgcctggttttgtctt

SEQ ID NO: 3375780 - DNA, 17 bp, Homo sapiens
gctttgccttgcagcca

SEQ ID NO: 3375781 - DNA, 22 bp, Homo sapiens
gctttgctacaaatttatgcat

SEQ ID NO: 3375782 - DNA, 14 bp, Homo sapiens
gctttgctgctacc

SEQ ID NO: 3375783 - DNA, 14 bp, Homo sapiens
gctttgctgctatg

SEQ ID NO: 3375784 - DNA, 15 bp, Homo sapiens
gctttgctgctatga

SEQ ID NO: 3375785 - DNA, 18 bp, Homo sapiens
gctttggacccaaggaaa

SEQ ID NO: 3375786 - DNA, 22 bp, Homo sapiens
gctttggacctaaatggcctca

SEQ ID NO: 3375787 - DNA, 16 bp, Homo sapiens
gctttggcagtgccat

SEQ ID NO: 3375788 - DNA, 14 bp, Homo sapiens
gctttggctgaggg

SEQ ID NO: 3375789 - DNA, 16 bp, Homo sapiens
gctttgggaaagccca

SEQ ID NO: 3375790 - DNA, 18 bp, Homo sapiens
gctttgggaaagcccaga

SEQ ID NO: 3375791 - DNA, 19 bp, Homo sapiens
gctttgggaaagcccagac

SEQ ID NO: 3375792 - DNA, 22 bp, Homo sapiens
gctttgggaatgtttttagctg

SEQ ID NO: 3375793 - DNA, 17 bp, Homo sapiens
gctttgggaggccaagg

SEQ ID NO: 3375794 - DNA, 19 bp, Homo sapiens
gctttgggaggccaaggca

SEQ ID NO: 3375795 - DNA, 20 bp, Homo sapiens
gctttgggatcccaccctgg

SEQ ID NO: 3375796 - DNA, 21 bp, Homo sapiens
gctttgggccgaatcccccag

SEQ ID NO: 3375797 - DNA, 14 bp, Homo sapiens
gctttgggctgccc

SEQ ID NO: 3375798 - DNA, 18 bp, Homo sapiens
gctttggggtgtcttttt

SEQ ID NO: 3375799 - DNA, 17 bp, Homo sapiens
gctttggttaaaaatgg

SEQ ID NO: 3375800 - DNA, 15 bp, Homo sapiens
gctttgtatgcactt

SEQ ID NO: 3375801 - DNA, 14 bp, Homo sapiens
gctttgtctgtcgt

SEQ ID NO: 3375802 - DNA, 16 bp, Homo sapiens
gctttgtttggatgcc

SEQ ID NO: 3375803 - DNA, 20 bp, Homo sapiens
gcttttacgtagtaaaagtc

SEQ ID NO: 3375804 - DNA, 13 bp, Homo sapiens
gcttttactgttt

SEQ ID NO: 3375805 - DNA, 13 bp, Homo sapiens
gcttttactttat

SEQ ID NO: 3375806 - DNA, 21 bp, Homo sapiens
gcttttaggcttgaaatctcc

SEQ ID NO: 3375807 - DNA, 16 bp, Homo sapiens
gcttttatatggccca

SEQ ID NO: 3375808 - DNA, 22 bp, Homo sapiens
gcttttatatggcccagccttg

SEQ ID NO: 3375809 - DNA, 20 bp, Homo sapiens
gcttttatggatgattaaat

SEQ ID NO: 3375810 - DNA, 15 bp, Homo sapiens
gcttttattaaattt

SEQ ID NO: 3375811 - DNA, 19 bp, Homo sapiens
gcttttattttaatattga

SEQ ID NO: 3375812 - DNA, 13 bp, Homo sapiens
gcttttcactgct

SEQ ID NO: 3375813 - DNA, 18 bp, Homo sapiens
gcttttcactgctggctg

SEQ ID NO: 3375814 - DNA, 14 bp, Homo sapiens
gcttttcatgtaga

SEQ ID NO: 3375815 - DNA, 20 bp, Homo sapiens
gcttttccaggatcctgcag

SEQ ID NO: 3375816 - DNA, 16 bp, Homo sapiens
gcttttcctcaagcaa

SEQ ID NO: 3375817 - DNA, 13 bp, Homo sapiens
gcttttctgccac

SEQ ID NO: 3375818 - DNA, 17 bp, Homo sapiens
gcttttctgccactcca

SEQ ID NO: 3375819 - DNA, 15 bp, Homo sapiens
gcttttctgccctgg

SEQ ID NO: 3375820 - DNA, 16 bp, Homo sapiens
gcttttctgccctggc

SEQ ID NO: 3375821 - DNA, 19 bp, Homo sapiens
gcttttctgccctggctgc

SEQ ID NO: 3375822 - DNA, 23 bp, Homo sapiens
gcttttctgtagatgttgtcttg

SEQ ID NO: 3375823 - DNA, 18 bp, Homo sapiens
gcttttgccactccttgt

SEQ ID NO: 3375824 - DNA, 18 bp, Homo sapiens
gcttttggggagccagaa

SEQ ID NO: 3375825 - DNA, 18 bp, Homo sapiens
gcttttgttccaatgtca

SEQ ID NO: 3375826 - DNA, 20 bp, Homo sapiens
gcttttgttgtgacttttta

SEQ ID NO: 3375827 - DNA, 14 bp, Homo sapiens
gcttttgttgttta

SEQ ID NO: 3375828 - DNA, 14 bp, Homo sapiens
gcttttgttttttt

SEQ ID NO: 3375829 - DNA, 22 bp, Homo sapiens
gcttttgtttttttcctcatgt

SEQ ID NO: 3375830 - DNA, 22 bp, Homo sapiens
gctttttaattgttgtttcttt

SEQ ID NO: 3375831 - DNA, 21 bp, Homo sapiens
gctttttatttctgcatatgt

SEQ ID NO: 3375832 - DNA, 16 bp, Homo sapiens
gctttttcctcctgga

SEQ ID NO: 3375833 - DNA, 16 bp, Homo sapiens
gctttttcctctgagc

SEQ ID NO: 3375834 - DNA, 18 bp, Homo sapiens
gctttttcctctgagccc

SEQ ID NO: 3375835 - DNA, 20 bp, Homo sapiens
gctttttcctctgagcccag

SEQ ID NO: 3375836 - DNA, 12 bp, Homo sapiens
gctttttgaaat

SEQ ID NO: 3375837 - DNA, 13 bp, Homo sapiens
gctttttgaaatg

SEQ ID NO: 3375838 - DNA, 16 bp, Homo sapiens
gctttttgaaatgaaa

SEQ ID NO: 3375839 - DNA, 18 bp, Homo sapiens
gctttttggtgtatagaa

SEQ ID NO: 3375840 - DNA, 22 bp, Homo sapiens
gcttttttatttaccttttaag

SEQ ID NO: 3375841 - DNA, 20 bp, Homo sapiens
gcttttttccaaaacaaaaa

SEQ ID NO: 3375842 - DNA, 17 bp, Homo sapiens
gcttttttgttttggct

SEQ ID NO: 3375843 - DNA, 16 bp, Homo sapiens
gctttttttcttgcta

SEQ ID NO: 3375844 - DNA, 20 bp, Homo sapiens
gctttttttcttgctagtat

SEQ ID NO: 3375845 - DNA, 20 bp, Homo sapiens
gctttttttgcctaccattt

SEQ ID NO: 3375846 - DNA, 15 bp, Homo sapiens
gcttttttttccttc

SEQ ID NO: 3375847 - DNA, 15 bp, Homo sapiens
gcttttttttttcca

SEQ ID NO: 3375848 - DNA, 17 bp, Homo sapiens
gcttttttttttccagc

SEQ ID NO: 3375849 - DNA, 21 bp, Homo sapiens
gcttttttttttccagcaagt

SEQ ID NO: 3375850 - DNA, 15 bp, Homo sapiens
ggaaaaaaaaacagc

SEQ ID NO: 3375851 - DNA, 23 bp, Homo sapiens
ggaaaaagcaagttcgtctgttg

SEQ ID NO: 3375852 - DNA, 18 bp, Homo sapiens
ggaaaaataaaagaaaat

SEQ ID NO: 3375853 - DNA, 14 bp, Homo sapiens
ggaaaaataatcaa

SEQ ID NO: 3375854 - DNA, 23 bp, Homo sapiens
ggaaaaataatcaagattttagg

SEQ ID NO: 3375855 - DNA, 15 bp, Homo sapiens
ggaaaaatggttgat

SEQ ID NO: 3375856 - DNA, 21 bp, Homo sapiens
ggaaaaatggttgatggaaaa

SEQ ID NO: 3375857 - DNA, 14 bp, Homo sapiens
ggaaaaatgtgaaa

SEQ ID NO: 3375858 - DNA, 12 bp, Homo sapiens
ggaaaaatgttt

SEQ ID NO: 3375859 - DNA, 13 bp, Homo sapiens
ggaaaaatgtttg

SEQ ID NO: 3375860 - DNA, 13 bp, Homo sapiens
ggaaaaatttgaa

SEQ ID NO: 3375861 - DNA, 14 bp, Homo sapiens
ggaaaacatttgct

SEQ ID NO: 3375862 - DNA, 22 bp, Homo sapiens
ggaaaaccaagccgtggcttcc

SEQ ID NO: 3375863 - DNA, 14 bp, Homo sapiens
ggaaaactgtgttg

SEQ ID NO: 3375864 - DNA, 14 bp, Homo sapiens
ggaaaagaaacctg

SEQ ID NO: 3375865 - DNA, 22 bp, Homo sapiens
ggaaaagataaagaccagaaat

SEQ ID NO: 3375866 - DNA, 18 bp, Homo sapiens
ggaaaagcgtctttaaga

SEQ ID NO: 3375867 - DNA, 20 bp, Homo sapiens
ggaaaagctgctgacagtgt

SEQ ID NO: 3375868 - DNA, 15 bp, Homo sapiens
ggaaaagtacattta

SEQ ID NO: 3375869 - DNA, 18 bp, Homo sapiens
ggaaaagttaaactaaaa

SEQ ID NO: 3375870 - DNA, 14 bp, Homo sapiens
ggaaaataaattat

SEQ ID NO: 3375871 - DNA, 21 bp, Homo sapiens
ggaaaatacctaattgtggat

SEQ ID NO: 3375872 - DNA, 19 bp, Homo sapiens
ggaaaataggcaggaagcc

SEQ ID NO: 3375873 - DNA, 21 bp, Homo sapiens
ggaaaatgagtatttggtcca

SEQ ID NO: 3375874 - DNA, 19 bp, Homo sapiens
ggaaaatgccatgaattac

SEQ ID NO: 3375875 - DNA, 14 bp, Homo sapiens
ggaaacagcatgaa

SEQ ID NO: 3375876 - DNA, 15 bp, Homo sapiens
ggaaacagcatgaat

SEQ ID NO: 3375877 - DNA, 15 bp, Homo sapiens
ggaaacaggaccaca

SEQ ID NO: 3375878 - DNA, 18 bp, Homo sapiens
ggaaacattacagttcat

SEQ ID NO: 3375879 - DNA, 15 bp, Homo sapiens
ggaaactaagcattg

SEQ ID NO: 3375880 - DNA, 18 bp, Homo sapiens
ggaaactccacatctgcc

SEQ ID NO: 3375881 - DNA, 21 bp, Homo sapiens
ggaaactccacatctgcctta

SEQ ID NO: 3375882 - DNA, 15 bp, Homo sapiens
ggaaagaagggggcc

SEQ ID NO: 3375883 - DNA, 15 bp, Homo sapiens
ggaaagcaataaatg

SEQ ID NO: 3375884 - DNA, 18 bp, Homo sapiens
ggaaagcatcacctcagg

SEQ ID NO: 3375885 - DNA, 11 bp, Homo sapiens
ggaaagcccag

SEQ ID NO: 3375886 - DNA, 12 bp, Homo sapiens
ggaaagccctcc

SEQ ID NO: 3375887 - DNA, 14 bp, Homo sapiens
ggaaagcctctgct

SEQ ID NO: 3375888 - DNA, 16 bp, Homo sapiens
ggaaagcctctgctgc

SEQ ID NO: 3375889 - DNA, 13 bp, Homo sapiens
ggaaaggacccac

SEQ ID NO: 3375890 - DNA, 14 bp, Homo sapiens
ggaaaggggggagc

SEQ ID NO: 3375891 - DNA, 18 bp, Homo sapiens
ggaaaggggggagctggg

SEQ ID NO: 3375892 - DNA, 22 bp, Homo sapiens
ggaaagggggtcccagtgggag

SEQ ID NO: 3375893 - DNA, 17 bp, Homo sapiens
ggaaagtcaagaagaat

SEQ ID NO: 3375894 - DNA, 14 bp, Homo sapiens
ggaaagtgaatttg

SEQ ID NO: 3375895 - DNA, 13 bp, Homo sapiens
ggaaagtgccagc

SEQ ID NO: 3375896 - DNA, 18 bp, Homo sapiens
ggaaatacccttctttta

SEQ ID NO: 3375897 - DNA, 20 bp, Homo sapiens
ggaaatattttgataataaa

SEQ ID NO: 3375898 - DNA, 19 bp, Homo sapiens
ggaaatcatcgaaaattca

SEQ ID NO: 3375899 - DNA, 20 bp, Homo sapiens
ggaaatccattgtttaaaga

SEQ ID NO: 3375900 - DNA, 20 bp, Homo sapiens
ggaaatcctagtttcctctc

SEQ ID NO: 3375901 - DNA, 19 bp, Homo sapiens
ggaaatcctgccctggagg

SEQ ID NO: 3375902 - DNA, 16 bp, Homo sapiens
ggaaatctacttccta

SEQ ID NO: 3375903 - DNA, 13 bp, Homo sapiens
ggaaatcttaaac

SEQ ID NO: 3375904 - DNA, 12 bp, Homo sapiens
ggaaatgtactt

SEQ ID NO: 3375905 - DNA, 17 bp, Homo sapiens
ggaaatgtcaacaagta

SEQ ID NO: 3375906 - DNA, 19 bp, Homo sapiens
ggaaatgtcatctaaccat

SEQ ID NO: 3375907 - DNA, 20 bp, Homo sapiens
ggaaattaaatccaataaaa

SEQ ID NO: 3375908 - DNA, 23 bp, Homo sapiens
ggaaattcaggtgaaaatgttca

SEQ ID NO: 3375909 - DNA, 16 bp, Homo sapiens
ggaaattcctgtactg

SEQ ID NO: 3375910 - DNA, 20 bp, Homo sapiens
ggaaattccttgccccacag

SEQ ID NO: 3375911 - DNA, 21 bp, Homo sapiens
ggaaattccttgccccacagt

SEQ ID NO: 3375912 - DNA, 16 bp, Homo sapiens
ggaacaaaaaaaccac

SEQ ID NO: 3375913 - DNA, 21 bp, Homo sapiens
ggaacaaaaaaaccacaaagg

SEQ ID NO: 3375914 - DNA, 19 bp, Homo sapiens
ggaacaaaaattacaaaga

SEQ ID NO: 3375915 - DNA, 18 bp, Homo sapiens
ggaacaaggagtcagaca

SEQ ID NO: 3375916 - DNA, 19 bp, Homo sapiens
ggaacaattgaagtaaact

SEQ ID NO: 3375917 - DNA, 16 bp, Homo sapiens
ggaacacctgatctta

SEQ ID NO: 3375918 - DNA, 17 bp, Homo sapiens
ggaacagacctgaggct

SEQ ID NO: 3375919 - DNA, 11 bp, Homo sapiens
ggaacagcaga

SEQ ID NO: 3375920 - DNA, 19 bp, Homo sapiens
ggaacagcgggagacctgt

SEQ ID NO: 3375921 - DNA, 20 bp, Homo sapiens
ggaacagcgggagacctgtg

SEQ ID NO: 3375922 - DNA, 19 bp, Homo sapiens
ggaacagctatgggagccc

SEQ ID NO: 3375923 - DNA, 15 bp, Homo sapiens
ggaacagtaagaaca

SEQ ID NO: 3375924 - DNA, 17 bp, Homo sapiens
ggaacagtggctgggtg

SEQ ID NO: 3375925 - DNA, 20 bp, Homo sapiens
ggaacatcctttgcagggca

SEQ ID NO: 3375926 - DNA, 11 bp, Homo sapiens
ggaacatttct

SEQ ID NO: 3375927 - DNA, 22 bp, Homo sapiens
ggaacatttctgtaaataccat

SEQ ID NO: 3375928 - DNA, 19 bp, Homo sapiens
ggaaccacagggccagagg

SEQ ID NO: 3375929 - DNA, 23 bp, Homo sapiens
ggaaccacagggccagagggagc

SEQ ID NO: 3375930 - DNA, 13 bp, Homo sapiens
ggaaccactccca

SEQ ID NO: 3375931 - DNA, 17 bp, Homo sapiens
ggaaccagggaggagag

SEQ ID NO: 3375932 - DNA, 19 bp, Homo sapiens
ggaaccagggaggagagga

SEQ ID NO: 3375933 - DNA, 18 bp, Homo sapiens
ggaaccatgaagacagga

SEQ ID NO: 3375934 - DNA, 18 bp, Homo sapiens
ggaacctagtactctctg

SEQ ID NO: 3375935 - DNA, 14 bp, Homo sapiens
ggaacctcccagag

SEQ ID NO: 3375936 - DNA, 16 bp, Homo sapiens
ggaacctcccagaggt

SEQ ID NO: 3375937 - DNA, 22 bp, Homo sapiens
ggaacctcccagaggtccagcc

SEQ ID NO: 3375938 - DNA, 19 bp, Homo sapiens
ggaacctgaggcctgaagg

SEQ ID NO: 3375939 - DNA, 15 bp, Homo sapiens
ggaaccttccctcca

SEQ ID NO: 3375940 - DNA, 16 bp, Homo sapiens
ggaaccttccttcctg

SEQ ID NO: 3375941 - DNA, 13 bp, Homo sapiens
ggaaccttgctgt

SEQ ID NO: 3375942 - DNA, 14 bp, Homo sapiens
ggaacgagcactgg

SEQ ID NO: 3375943 - DNA, 16 bp, Homo sapiens
ggaacgagcactggcc

SEQ ID NO: 3375944 - DNA, 14 bp, Homo sapiens
ggaacgatgtgtct

SEQ ID NO: 3375945 - DNA, 14 bp, Homo sapiens
ggaactaaagcaaa

SEQ ID NO: 3375946 - DNA, 13 bp, Homo sapiens
ggaactactgtac

SEQ ID NO: 3375947 - DNA, 16 bp, Homo sapiens
ggaactactgtacttt

SEQ ID NO: 3375948 - DNA, 21 bp, Homo sapiens
ggaactagagggatacactga

SEQ ID NO: 3375949 - DNA, 18 bp, Homo sapiens
ggaactatggcaaggaac

SEQ ID NO: 3375950 - DNA, 19 bp, Homo sapiens
ggaactccactctccttcg

SEQ ID NO: 3375951 - DNA, 12 bp, Homo sapiens
ggaactctgaca

SEQ ID NO: 3375952 - DNA, 13 bp, Homo sapiens
ggaactctgacaa

SEQ ID NO: 3375953 - DNA, 14 bp, Homo sapiens
ggaactctgacaag

SEQ ID NO: 3375954 - DNA, 23 bp, Homo sapiens
ggaactgagtcacgctggggctc

SEQ ID NO: 3375955 - DNA, 23 bp, Homo sapiens
ggaactggctgtgaagacccagg

SEQ ID NO: 3375956 - DNA, 16 bp, Homo sapiens
ggaactgggctgggcc

SEQ ID NO: 3375957 - DNA, 20 bp, Homo sapiens
ggaactggggctttgccttg

SEQ ID NO: 3375958 - DNA, 15 bp, Homo sapiens
ggaactgtagggcca

SEQ ID NO: 3375959 - DNA, 14 bp, Homo sapiens
ggaactgtccagag

SEQ ID NO: 3375960 - DNA, 15 bp, Homo sapiens
ggaactgtccagaga

SEQ ID NO: 3375961 - DNA, 16 bp, Homo sapiens
ggaactgtccagagag

SEQ ID NO: 3375962 - DNA, 15 bp, Homo sapiens
ggaacttctaatata

SEQ ID NO: 3375963 - DNA, 14 bp, Homo sapiens
ggaagaaaatggtt

SEQ ID NO: 3375964 - DNA, 20 bp, Homo sapiens
ggaagaaaatggtttatttt

SEQ ID NO: 3375965 - DNA, 16 bp, Homo sapiens
ggaagaacatagaact

SEQ ID NO: 3375966 - DNA, 13 bp, Homo sapiens
ggaagaagggaga

SEQ ID NO: 3375967 - DNA, 13 bp, Homo sapiens
ggaagaaggggcc

SEQ ID NO: 3375968 - DNA, 19 bp, Homo sapiens
ggaagaccaaaggaaggaa

SEQ ID NO: 3375969 - DNA, 19 bp, Homo sapiens
ggaagacttgaagcacaga

SEQ ID NO: 3375970 - DNA, 12 bp, Homo sapiens
ggaagagaaatc

SEQ ID NO: 3375971 - DNA, 23 bp, Homo sapiens
ggaagagaagagggcccagccca

SEQ ID NO: 3375972 - DNA, 13 bp, Homo sapiens
ggaagagaatcac

SEQ ID NO: 3375973 - DNA, 19 bp, Homo sapiens
ggaagagcagcctgatggc

SEQ ID NO: 3375974 - DNA, 14 bp, Homo sapiens
ggaagagcaggcac

SEQ ID NO: 3375975 - DNA, 17 bp, Homo sapiens
ggaagagttggtctctg

SEQ ID NO: 3375976 - DNA, 17 bp, Homo sapiens
ggaagataggctctgca

SEQ ID NO: 3375977 - DNA, 14 bp, Homo sapiens
ggaagatatacatg

SEQ ID NO: 3375978 - DNA, 17 bp, Homo sapiens
ggaagatgaggttctga

SEQ ID NO: 3375979 - DNA, 18 bp, Homo sapiens
ggaagattttaaattcac

SEQ ID NO: 3375980 - DNA, 15 bp, Homo sapiens
ggaagcagccagctc

SEQ ID NO: 3375981 - DNA, 11 bp, Homo sapiens
ggaagcagtgc

SEQ ID NO: 3375982 - DNA, 16 bp, Homo sapiens
ggaagcattcagagag

SEQ ID NO: 3375983 - DNA, 20 bp, Homo sapiens
ggaagcattcagagagcagc

SEQ ID NO: 3375984 - DNA, 15 bp, Homo sapiens
ggaagccaaatttat

SEQ ID NO: 3375985 - DNA, 12 bp, Homo sapiens
ggaagccaggta

SEQ ID NO: 3375986 - DNA, 18 bp, Homo sapiens
ggaagccaggtacaggag

SEQ ID NO: 3375987 - DNA, 23 bp, Homo sapiens
ggaagccatccctttttttacat

SEQ ID NO: 3375988 - DNA, 12 bp, Homo sapiens
ggaagcccacac

SEQ ID NO: 3375989 - DNA, 19 bp, Homo sapiens
ggaagcccacactatgcac

SEQ ID NO: 3375990 - DNA, 15 bp, Homo sapiens
ggaagccccaacggg

SEQ ID NO: 3375991 - DNA, 18 bp, Homo sapiens
ggaagcccctgggcccag

SEQ ID NO: 3375992 - DNA, 17 bp, Homo sapiens
ggaagcctccccttggc

SEQ ID NO: 3375993 - DNA, 11 bp, Homo sapiens
ggaagccttgc

SEQ ID NO: 3375994 - DNA, 23 bp, Homo sapiens
ggaagcgatgaatttggagactc

SEQ ID NO: 3375995 - DNA, 10 bp, Homo sapiens
ggaagctgca

SEQ ID NO: 3375996 - DNA, 17 bp, Homo sapiens
ggaagctgcacatgtgc

SEQ ID NO: 3375997 - DNA, 12 bp, Homo sapiens
ggaagctgcagc

SEQ ID NO: 3375998 - DNA, 16 bp, Homo sapiens
ggaagctgcagcttgg

SEQ ID NO: 3375999 - DNA, 16 bp, Homo sapiens
ggaagctgccagccca

SEQ ID NO: 3376000 - DNA, 18 bp, Homo sapiens
ggaagctggccgagggtc

SEQ ID NO: 3376001 - DNA, 17 bp, Homo sapiens
ggaagctgtactcagag

SEQ ID NO: 3376002 - DNA, 19 bp, Homo sapiens
ggaagctgtactcagagca

SEQ ID NO: 3376003 - DNA, 21 bp, Homo sapiens
ggaagctgtactcagagcaga

SEQ ID NO: 3376004 - DNA, 16 bp, Homo sapiens
ggaagcttgagcctcc

SEQ ID NO: 3376005 - DNA, 15 bp, Homo sapiens
ggaagcttggggaac

SEQ ID NO: 3376006 - DNA, 21 bp, Homo sapiens
ggaaggaaatcccatcagtga

SEQ ID NO: 3376007 - DNA, 16 bp, Homo sapiens
ggaaggacagactggc

SEQ ID NO: 3376008 - DNA, 15 bp, Homo sapiens
ggaaggagacttagg

SEQ ID NO: 3376009 - DNA, 15 bp, Homo sapiens
ggaaggagagcctgc

SEQ ID NO: 3376010 - DNA, 16 bp, Homo sapiens
ggaaggagagcctgct

SEQ ID NO: 3376011 - DNA, 12 bp, Homo sapiens
ggaaggagcagt

SEQ ID NO: 3376012 - DNA, 12 bp, Homo sapiens
ggaaggagcggc

SEQ ID NO: 3376013 - DNA, 15 bp, Homo sapiens
ggaaggagcggcgcc

SEQ ID NO: 3376014 - DNA, 20 bp, Homo sapiens
ggaaggaggggaagctgcag

SEQ ID NO: 3376015 - DNA, 23 bp, Homo sapiens
ggaaggattgtaaaaaaaaatgc

SEQ ID NO: 3376016 - DNA, 17 bp, Homo sapiens
ggaaggcagacagcagg

SEQ ID NO: 3376017 - DNA, 12 bp, Homo sapiens
ggaaggcagctg

SEQ ID NO: 3376018 - DNA, 20 bp, Homo sapiens
ggaaggcagggcagagggaa

SEQ ID NO: 3376019 - DNA, 18 bp, Homo sapiens
ggaaggcctaggctagga

SEQ ID NO: 3376020 - DNA, 14 bp, Homo sapiens
ggaaggctggctga

SEQ ID NO: 3376021 - DNA, 15 bp, Homo sapiens
ggaaggctggctgag

SEQ ID NO: 3376022 - DNA, 13 bp, Homo sapiens
ggaagggacctgg

SEQ ID NO: 3376023 - DNA, 12 bp, Homo sapiens
ggaagggcagga

SEQ ID NO: 3376024 - DNA, 13 bp, Homo sapiens
ggaaggggccacg

SEQ ID NO: 3376025 - DNA, 18 bp, Homo sapiens
ggaaggggccttgctgag

SEQ ID NO: 3376026 - DNA, 18 bp, Homo sapiens
ggaagggtttgtggctgg

SEQ ID NO: 3376027 - DNA, 19 bp, Homo sapiens
ggaaggtcccttgtttcca

SEQ ID NO: 3376028 - DNA, 13 bp, Homo sapiens
ggaaggtctcatt

SEQ ID NO: 3376029 - DNA, 15 bp, Homo sapiens
ggaaggtgaagatga

SEQ ID NO: 3376030 - DNA, 16 bp, Homo sapiens
ggaaggtgctgagctt

SEQ ID NO: 3376031 - DNA, 21 bp, Homo sapiens
ggaagtaagcaaacaaatatt

SEQ ID NO: 3376032 - DNA, 15 bp, Homo sapiens
ggaagtccaatgtgg

SEQ ID NO: 3376033 - DNA, 16 bp, Homo sapiens
ggaagtccaatgtggc

SEQ ID NO: 3376034 - DNA, 15 bp, Homo sapiens
ggaagtctacctgct

SEQ ID NO: 3376035 - DNA, 16 bp, Homo sapiens
ggaagtctacctgctg

SEQ ID NO: 3376036 - DNA, 17 bp, Homo sapiens
ggaagtctacctgctgg

SEQ ID NO: 3376037 - DNA, 18 bp, Homo sapiens
ggaagtctacctgctgga

SEQ ID NO: 3376038 - DNA, 20 bp, Homo sapiens
ggaagtgaagactggaagct

SEQ ID NO: 3376039 - DNA, 17 bp, Homo sapiens
ggaagtgcttgatatgt

SEQ ID NO: 3376040 - DNA, 19 bp, Homo sapiens
ggaagtgtaacagctgagg

SEQ ID NO: 3376041 - DNA, 21 bp, Homo sapiens
ggaagtgtaacagctgaggtc

SEQ ID NO: 3376042 - DNA, 18 bp, Homo sapiens
ggaagtgtgagcgccttg

SEQ ID NO: 3376043 - DNA, 12 bp, Homo sapiens
ggaagtgttcaa

SEQ ID NO: 3376044 - DNA, 18 bp, Homo sapiens
ggaagtgttcaagaaata

SEQ ID NO: 3376045 - DNA, 14 bp, Homo sapiens
ggaagttttctgta

SEQ ID NO: 3376046 - DNA, 18 bp, Homo sapiens
ggaagttttgcatttatg

SEQ ID NO: 3376047 - DNA, 18 bp, Homo sapiens
ggaataaaaggcttgaag

SEQ ID NO: 3376048 - DNA, 21 bp, Homo sapiens
ggaataaaatcctaagacaca

SEQ ID NO: 3376049 - DNA, 20 bp, Homo sapiens
ggaataaacattaattttgt

SEQ ID NO: 3376050 - DNA, 18 bp, Homo sapiens
ggaataaagttgcagatg

SEQ ID NO: 3376051 - DNA, 18 bp, Homo sapiens
ggaataacatgtaattaa

SEQ ID NO: 3376052 - DNA, 17 bp, Homo sapiens
ggaataacctttctgga

SEQ ID NO: 3376053 - DNA, 21 bp, Homo sapiens
ggaataacttttacacgacca

SEQ ID NO: 3376054 - DNA, 15 bp, Homo sapiens
ggaataatagaagaa

SEQ ID NO: 3376055 - DNA, 21 bp, Homo sapiens
ggaataattatttatttaata

SEQ ID NO: 3376056 - DNA, 17 bp, Homo sapiens
ggaatactttttgttat

SEQ ID NO: 3376057 - DNA, 22 bp, Homo sapiens
ggaatcaagatgtcagactggc

SEQ ID NO: 3376058 - DNA, 16 bp, Homo sapiens
ggaatcagggaccagc

SEQ ID NO: 3376059 - DNA, 19 bp, Homo sapiens
ggaatcatgtcaggcctgt

SEQ ID NO: 3376060 - DNA, 23 bp, Homo sapiens
ggaatcatgtccatcccttttcc

SEQ ID NO: 3376061 - DNA, 22 bp, Homo sapiens
ggaatcattccagtgctagaaa

SEQ ID NO: 3376062 - DNA, 21 bp, Homo sapiens
ggaatccaagcctccacagcg

SEQ ID NO: 3376063 - DNA, 16 bp, Homo sapiens
ggaatccagacccggc

SEQ ID NO: 3376064 - DNA, 14 bp, Homo sapiens
ggaatcctcctcca

SEQ ID NO: 3376065 - DNA, 22 bp, Homo sapiens
ggaatctaatatccccaaatta

SEQ ID NO: 3376066 - DNA, 13 bp, Homo sapiens
ggaatctggatta

SEQ ID NO: 3376067 - DNA, 12 bp, Homo sapiens
ggaatgaagaac

SEQ ID NO: 3376068 - DNA, 13 bp, Homo sapiens
ggaatgagcccag

SEQ ID NO: 3376069 - DNA, 21 bp, Homo sapiens
ggaatgagcccagagaacagc

SEQ ID NO: 3376070 - DNA, 18 bp, Homo sapiens
ggaatgatagcccagaac

SEQ ID NO: 3376071 - DNA, 12 bp, Homo sapiens
ggaatgcaggga

SEQ ID NO: 3376072 - DNA, 18 bp, Homo sapiens
ggaatgcagggaagaggg

SEQ ID NO: 3376073 - DNA, 12 bp, Homo sapiens
ggaatgcagtgg

SEQ ID NO: 3376074 - DNA, 21 bp, Homo sapiens
ggaatgcatcccaccttgcca

SEQ ID NO: 3376075 - DNA, 21 bp, Homo sapiens
ggaatgctcccagctgtgctg

SEQ ID NO: 3376076 - DNA, 14 bp, Homo sapiens
ggaatgctgtgtta

SEQ ID NO: 3376077 - DNA, 17 bp, Homo sapiens
ggaatggaactactgta

SEQ ID NO: 3376078 - DNA, 17 bp, Homo sapiens
ggaatgttccctgcacc

SEQ ID NO: 3376079 - DNA, 20 bp, Homo sapiens
ggaatgttccctgcaccctg

SEQ ID NO: 3376080 - DNA, 19 bp, Homo sapiens
ggaatgtttgcctctgcct

SEQ ID NO: 3376081 - DNA, 21 bp, Homo sapiens
ggaattattttgaatgtcaca

SEQ ID NO: 3376082 - DNA, 15 bp, Homo sapiens
ggaattcagcaccct

SEQ ID NO: 3376083 - DNA, 22 bp, Homo sapiens
ggaattcagcaccctgggtgcc

SEQ ID NO: 3376084 - DNA, 14 bp, Homo sapiens
ggaattcagtgcct

SEQ ID NO: 3376085 - DNA, 15 bp, Homo sapiens
ggaattgatttgcat

SEQ ID NO: 3376086 - DNA, 19 bp, Homo sapiens
ggaattgatttgcattgaa

SEQ ID NO: 3376087 - DNA, 20 bp, Homo sapiens
ggaattgcttaccaaaggat

SEQ ID NO: 3376088 - DNA, 17 bp, Homo sapiens
ggaatttataacaaata

SEQ ID NO: 3376089 - DNA, 23 bp, Homo sapiens
ggaatttcttttccttcattcat

SEQ ID NO: 3376090 - DNA, 13 bp, Homo sapiens
ggaatttgtcagc

SEQ ID NO: 3376091 - DNA, 11 bp, Homo sapiens
ggaattttatt

SEQ ID NO: 3376092 - DNA, 22 bp, Homo sapiens
ggacaaaaatgaactgaagttt

SEQ ID NO: 3376093 - DNA, 17 bp, Homo sapiens
ggacaaaacatagctgg

SEQ ID NO: 3376094 - DNA, 21 bp, Homo sapiens
ggacaaaacttcttgtcagac

SEQ ID NO: 3376095 - DNA, 12 bp, Homo sapiens
ggacaacacttc

SEQ ID NO: 3376096 - DNA, 20 bp, Homo sapiens
ggacaacagtgctttgtaaa

SEQ ID NO: 3376097 - DNA, 14 bp, Homo sapiens
ggacaacttattta

SEQ ID NO: 3376098 - DNA, 17 bp, Homo sapiens
ggacaacttatttaaaa

SEQ ID NO: 3376099 - DNA, 22 bp, Homo sapiens
ggacaacttatttaaaaatatt

SEQ ID NO: 3376100 - DNA, 21 bp, Homo sapiens
ggacaagccaacttgtaaata

SEQ ID NO: 3376101 - DNA, 23 bp, Homo sapiens
ggacaagccaacttgtaaataca

SEQ ID NO: 3376102 - DNA, 16 bp, Homo sapiens
ggacaatcagtcccct

SEQ ID NO: 3376103 - DNA, 17 bp, Homo sapiens
ggacaatcagtcccctc

SEQ ID NO: 3376104 - DNA, 17 bp, Homo sapiens
ggacacaaaactccgcc

SEQ ID NO: 3376105 - DNA, 18 bp, Homo sapiens
ggacacagttcctgggaa

SEQ ID NO: 3376106 - DNA, 21 bp, Homo sapiens
ggacacatcccggcctcttcc

SEQ ID NO: 3376107 - DNA, 23 bp, Homo sapiens
ggacacatcccggcctcttccac

SEQ ID NO: 3376108 - DNA, 18 bp, Homo sapiens
ggacaccacacccagcct

SEQ ID NO: 3376109 - DNA, 12 bp, Homo sapiens
ggacaccagagc

SEQ ID NO: 3376110 - DNA, 17 bp, Homo sapiens
ggacactaaccacgctg

SEQ ID NO: 3376111 - DNA, 22 bp, Homo sapiens
ggacactaaccacgctggacct

SEQ ID NO: 3376112 - DNA, 15 bp, Homo sapiens
ggacactccagtgcc

SEQ ID NO: 3376113 - DNA, 21 bp, Homo sapiens
ggacacttggttagacgcctt

SEQ ID NO: 3376114 - DNA, 22 bp, Homo sapiens
ggacagaaaggagagtggccat

SEQ ID NO: 3376115 - DNA, 14 bp, Homo sapiens
ggacagactggccg

SEQ ID NO: 3376116 - DNA, 15 bp, Homo sapiens
ggacagagttcacag

SEQ ID NO: 3376117 - DNA, 17 bp, Homo sapiens
ggacagagttcacagga

SEQ ID NO: 3376118 - DNA, 19 bp, Homo sapiens
ggacagccacggccaggcc

SEQ ID NO: 3376119 - DNA, 20 bp, Homo sapiens
ggacagccacggccaggcca

SEQ ID NO: 3376120 - DNA, 14 bp, Homo sapiens
ggacagcccagagc

SEQ ID NO: 3376121 - DNA, 17 bp, Homo sapiens
ggacagcccagagcctg

SEQ ID NO: 3376122 - DNA, 11 bp, Homo sapiens
ggacagcctct

SEQ ID NO: 3376123 - DNA, 12 bp, Homo sapiens
ggacagcctctt

SEQ ID NO: 3376124 - DNA, 17 bp, Homo sapiens
ggacagcctcttcagcc

SEQ ID NO: 3376125 - DNA, 19 bp, Homo sapiens
ggacagcctcttcagcccc

SEQ ID NO: 3376126 - DNA, 20 bp, Homo sapiens
ggacagcctcttcagcccct

SEQ ID NO: 3376127 - DNA, 17 bp, Homo sapiens
ggacagctccttctgtc

SEQ ID NO: 3376128 - DNA, 15 bp, Homo sapiens
ggacaggaccctcag

SEQ ID NO: 3376129 - DNA, 16 bp, Homo sapiens
ggacaggaccctcagg

SEQ ID NO: 3376130 - DNA, 23 bp, Homo sapiens
ggacaggaccctcaggaattcag

SEQ ID NO: 3376131 - DNA, 21 bp, Homo sapiens
ggacaggcccagcgcggccag

SEQ ID NO: 3376132 - DNA, 23 bp, Homo sapiens
ggacaggcccagcgcggccagcg

SEQ ID NO: 3376133 - DNA, 11 bp, Homo sapiens
ggacaggcctc

SEQ ID NO: 3376134 - DNA, 18 bp, Homo sapiens
ggacaggctgaagagagg

SEQ ID NO: 3376135 - DNA, 23 bp, Homo sapiens
ggacaggctgaagagagggacag

SEQ ID NO: 3376136 - DNA, 15 bp, Homo sapiens
ggacagggcatggcc

SEQ ID NO: 3376137 - DNA, 14 bp, Homo sapiens
ggacagtcctggga

SEQ ID NO: 3376138 - DNA, 19 bp, Homo sapiens
ggacagtcctgggagaacc

SEQ ID NO: 3376139 - DNA, 20 bp, Homo sapiens
ggacagtgcttcagcctgag

SEQ ID NO: 3376140 - DNA, 15 bp, Homo sapiens
ggacagttcacaccc

SEQ ID NO: 3376141 - DNA, 16 bp, Homo sapiens
ggacagttcacaccct

SEQ ID NO: 3376142 - DNA, 17 bp, Homo sapiens
ggacagttcacaccctg

SEQ ID NO: 3376143 - DNA, 14 bp, Homo sapiens
ggacagttggcaga

SEQ ID NO: 3376144 - DNA, 22 bp, Homo sapiens
ggacatactctctgcctggtgg

SEQ ID NO: 3376145 - DNA, 13 bp, Homo sapiens
ggacatcctcctc

SEQ ID NO: 3376146 - DNA, 16 bp, Homo sapiens
ggacatcctcctccca

SEQ ID NO: 3376147 - DNA, 18 bp, Homo sapiens
ggacatcctgtataagca

SEQ ID NO: 3376148 - DNA, 16 bp, Homo sapiens
ggacatgcaataaaat

SEQ ID NO: 3376149 - DNA, 20 bp, Homo sapiens
ggacatgcttttctgccact

SEQ ID NO: 3376150 - DNA, 17 bp, Homo sapiens
ggacattgctctctggg

SEQ ID NO: 3376151 - DNA, 16 bp, Homo sapiens
ggaccaaccctgggga

SEQ ID NO: 3376152 - DNA, 12 bp, Homo sapiens
ggaccacacagt

SEQ ID NO: 3376153 - DNA, 21 bp, Homo sapiens
ggaccacacagtccccagact

SEQ ID NO: 3376154 - DNA, 21 bp, Homo sapiens
ggaccacacctccctgaacca

SEQ ID NO: 3376155 - DNA, 17 bp, Homo sapiens
ggaccacagtgggtggc

SEQ ID NO: 3376156 - DNA, 20 bp, Homo sapiens
ggaccacagtgggtggcacc

SEQ ID NO: 3376157 - DNA, 14 bp, Homo sapiens
ggaccacattttat

SEQ ID NO: 3376158 - DNA, 17 bp, Homo sapiens
ggaccactcagccccta

SEQ ID NO: 3376159 - DNA, 18 bp, Homo sapiens
ggaccactcgaggcctgc

SEQ ID NO: 3376160 - DNA, 21 bp, Homo sapiens
ggaccactttggagactgggg

SEQ ID NO: 3376161 - DNA, 15 bp, Homo sapiens
ggaccaggactccct

SEQ ID NO: 3376162 - DNA, 17 bp, Homo sapiens
ggaccaggactccctcc

SEQ ID NO: 3376163 - DNA, 21 bp, Homo sapiens
ggaccatgtgtcacttgtgct

SEQ ID NO: 3376164 - DNA, 22 bp, Homo sapiens
ggaccatgtgtcacttgtgctt

SEQ ID NO: 3376165 - DNA, 18 bp, Homo sapiens
ggacccaaaacacaggaa

SEQ ID NO: 3376166 - DNA, 19 bp, Homo sapiens
ggacccaaggaaaactgca

SEQ ID NO: 3376167 - DNA, 17 bp, Homo sapiens
ggacccacggagccctc

SEQ ID NO: 3376168 - DNA, 23 bp, Homo sapiens
ggacccagctactctgtccaggc

SEQ ID NO: 3376169 - DNA, 13 bp, Homo sapiens
ggacccaggccct

SEQ ID NO: 3376170 - DNA, 17 bp, Homo sapiens
ggacccaggctccgccc

SEQ ID NO: 3376171 - DNA, 19 bp, Homo sapiens
ggacccatagatcttctga

SEQ ID NO: 3376172 - DNA, 13 bp, Homo sapiens
ggaccccagctgg

SEQ ID NO: 3376173 - DNA, 14 bp, Homo sapiens
ggaccccagctggg

SEQ ID NO: 3376174 - DNA, 18 bp, Homo sapiens
ggaccccctggccctgcc

SEQ ID NO: 3376175 - DNA, 20 bp, Homo sapiens
ggacccctgctcccagcctg

SEQ ID NO: 3376176 - DNA, 21 bp, Homo sapiens
ggacccggaggggcctggcag

SEQ ID NO: 3376177 - DNA, 15 bp, Homo sapiens
ggaccctgcttcacc

SEQ ID NO: 3376178 - DNA, 21 bp, Homo sapiens
ggaccctgtccggcccagtgc

SEQ ID NO: 3376179 - DNA, 23 bp, Homo sapiens
ggaccctgtccggcccagtgcca

SEQ ID NO: 3376180 - DNA, 19 bp, Homo sapiens
ggacccttaggatggggct

SEQ ID NO: 3376181 - DNA, 22 bp, Homo sapiens
ggacccttaggatggggctccc

SEQ ID NO: 3376182 - DNA, 17 bp, Homo sapiens
ggaccggtgctgcagga

SEQ ID NO: 3376183 - DNA, 19 bp, Homo sapiens
ggaccggtgctgcaggagt

SEQ ID NO: 3376184 - DNA, 16 bp, Homo sapiens
ggaccgtggacaggcc

SEQ ID NO: 3376185 - DNA, 19 bp, Homo sapiens
ggaccgtggacaggcccag

SEQ ID NO: 3376186 - DNA, 13 bp, Homo sapiens
ggacctcccttcc

SEQ ID NO: 3376187 - DNA, 20 bp, Homo sapiens
ggacctcccttccgaccctc

SEQ ID NO: 3376188 - DNA, 21 bp, Homo sapiens
ggacctccttagccctgtctg

SEQ ID NO: 3376189 - DNA, 16 bp, Homo sapiens
ggacctgccaggcagg

SEQ ID NO: 3376190 - DNA, 21 bp, Homo sapiens
ggaccttaggccttcctctct

SEQ ID NO: 3376191 - DNA, 18 bp, Homo sapiens
ggaccttcgggctgtgcc

SEQ ID NO: 3376192 - DNA, 19 bp, Homo sapiens
ggaccttcgggctgtgccc

SEQ ID NO: 3376193 - DNA, 19 bp, Homo sapiens
ggacctttccaccacagcc

SEQ ID NO: 3376194 - DNA, 22 bp, Homo sapiens
ggacctttccaccacagccagc

SEQ ID NO: 3376195 - DNA, 21 bp, Homo sapiens
ggacgcacgctcgctgccatc

SEQ ID NO: 3376196 - DNA, 22 bp, Homo sapiens
ggacgcacgctcgctgccatca

SEQ ID NO: 3376197 - DNA, 15 bp, Homo sapiens
ggacgctctctggcc

SEQ ID NO: 3376198 - DNA, 13 bp, Homo sapiens
ggacgcttctgaa

SEQ ID NO: 3376199 - DNA, 18 bp, Homo sapiens
ggacggcattcctgctta

SEQ ID NO: 3376200 - DNA, 12 bp, Homo sapiens
ggacggctgtgg

SEQ ID NO: 3376201 - DNA, 17 bp, Homo sapiens
ggacggggaagccgagc

SEQ ID NO: 3376202 - DNA, 17 bp, Homo sapiens
ggacggtgcccaagcca

SEQ ID NO: 3376203 - DNA, 21 bp, Homo sapiens
ggacggtgcccaagccagagg

SEQ ID NO: 3376204 - DNA, 21 bp, Homo sapiens
ggacgtcatcggaggctgggc

SEQ ID NO: 3376205 - DNA, 19 bp, Homo sapiens
ggacgtcctatctccccca

SEQ ID NO: 3376206 - DNA, 13 bp, Homo sapiens
ggacgtctttctt

SEQ ID NO: 3376207 - DNA, 14 bp, Homo sapiens
ggacgtgtgtaaat

SEQ ID NO: 3376208 - DNA, 19 bp, Homo sapiens
ggacgttggcctcagggcc

SEQ ID NO: 3376209 - DNA, 23 bp, Homo sapiens
ggacgttggcctcagggccagga

SEQ ID NO: 3376210 - DNA, 14 bp, Homo sapiens
ggacgttgttttgg

SEQ ID NO: 3376211 - DNA, 18 bp, Homo sapiens
ggactaacataaaatctg

SEQ ID NO: 3376212 - DNA, 21 bp, Homo sapiens
ggactaacataaaatctgtga

SEQ ID NO: 3376213 - DNA, 20 bp, Homo sapiens
ggactacaggtgtgagtcac

SEQ ID NO: 3376214 - DNA, 14 bp, Homo sapiens
ggactagcccctgt

SEQ ID NO: 3376215 - DNA, 20 bp, Homo sapiens
ggactaggacctgagcctgg

SEQ ID NO: 3376216 - DNA, 20 bp, Homo sapiens
ggactcacaggttggaagag

SEQ ID NO: 3376217 - DNA, 21 bp, Homo sapiens
ggactcacaggttggaagaga

SEQ ID NO: 3376218 - DNA, 14 bp, Homo sapiens
ggactcagcagtga

SEQ ID NO: 3376219 - DNA, 24 bp, Homo sapiens
ggactcatttcattcctaacacag

SEQ ID NO: 3376220 - DNA, 22 bp, Homo sapiens
ggactccaggcccaaggctccc

SEQ ID NO: 3376221 - DNA, 11 bp, Homo sapiens
ggactccatct

SEQ ID NO: 3376222 - DNA, 15 bp, Homo sapiens
ggactcccgggccac

SEQ ID NO: 3376223 - DNA, 20 bp, Homo sapiens
ggactcccgggccacgcccc

SEQ ID NO: 3376224 - DNA, 13 bp, Homo sapiens
ggactctcaggga

SEQ ID NO: 3376225 - DNA, 20 bp, Homo sapiens
ggactctcagggattctggg

SEQ ID NO: 3376226 - DNA, 19 bp, Homo sapiens
ggactctgagcgggaggca

SEQ ID NO: 3376227 - DNA, 18 bp, Homo sapiens
ggactctggtgcctccag

SEQ ID NO: 3376228 - DNA, 19 bp, Homo sapiens
ggactcttctcggctcagg

SEQ ID NO: 3376229 - DNA, 20 bp, Homo sapiens
ggactcttctcggctcaggc

SEQ ID NO: 3376230 - DNA, 21 bp, Homo sapiens
ggactgagccaaggaggcctg

SEQ ID NO: 3376231 - DNA, 15 bp, Homo sapiens
ggactgagccccgca

SEQ ID NO: 3376232 - DNA, 22 bp, Homo sapiens
ggactgagcggccgcagagact

SEQ ID NO: 3376233 - DNA, 23 bp, Homo sapiens
ggactgagcggccgcagagactg

SEQ ID NO: 3376234 - DNA, 14 bp, Homo sapiens
ggactgaggagtgg

SEQ ID NO: 3376235 - DNA, 22 bp, Homo sapiens
ggactgagtcccctccaggaag

SEQ ID NO: 3376236 - DNA, 12 bp, Homo sapiens
ggactgcattta

SEQ ID NO: 3376237 - DNA, 16 bp, Homo sapiens
ggactgcgctggacga

SEQ ID NO: 3376238 - DNA, 17 bp, Homo sapiens
ggactggaggcccctgg

SEQ ID NO: 3376239 - DNA, 23 bp, Homo sapiens
ggactggaggtgggcatgccacc

SEQ ID NO: 3376240 - DNA, 17 bp, Homo sapiens
ggactggagtccctgtg

SEQ ID NO: 3376241 - DNA, 22 bp, Homo sapiens
ggactggctagagtcctcactc

SEQ ID NO: 3376242 - DNA, 11 bp, Homo sapiens
ggactgggagg

SEQ ID NO: 3376243 - DNA, 12 bp, Homo sapiens
ggactgggaggt

SEQ ID NO: 3376244 - DNA, 17 bp, Homo sapiens
ggactgggagtcagagc

SEQ ID NO: 3376245 - DNA, 17 bp, Homo sapiens
ggactggggatgtggga

SEQ ID NO: 3376246 - DNA, 21 bp, Homo sapiens
ggactgggtttggaccccagc

SEQ ID NO: 3376247 - DNA, 11 bp, Homo sapiens
ggactggtgcc

SEQ ID NO: 3376248 - DNA, 14 bp, Homo sapiens
ggactggtgccctc

SEQ ID NO: 3376249 - DNA, 17 bp, Homo sapiens
ggactggtgccctcctc

SEQ ID NO: 3376250 - DNA, 15 bp, Homo sapiens
ggactgtaagggatt

SEQ ID NO: 3376251 - DNA, 13 bp, Homo sapiens
ggactgtacacac

SEQ ID NO: 3376252 - DNA, 22 bp, Homo sapiens
ggactgtacacactttatttac

SEQ ID NO: 3376253 - DNA, 18 bp, Homo sapiens
ggactgtagggagggcgg

SEQ ID NO: 3376254 - DNA, 21 bp, Homo sapiens
ggactgttcacggcagaccag

SEQ ID NO: 3376255 - DNA, 20 bp, Homo sapiens
ggactgttccaggccctcca

SEQ ID NO: 3376256 - DNA, 19 bp, Homo sapiens
ggacttaacggctccagga

SEQ ID NO: 3376257 - DNA, 20 bp, Homo sapiens
ggacttaacggctccaggat

SEQ ID NO: 3376258 - DNA, 14 bp, Homo sapiens
ggacttcctggggc

SEQ ID NO: 3376259 - DNA, 16 bp, Homo sapiens
ggacttctgtgggccc

SEQ ID NO: 3376260 - DNA, 23 bp, Homo sapiens
ggacttgaaagcatccatgtgtg

SEQ ID NO: 3376261 - DNA, 16 bp, Homo sapiens
ggacttgctaaagcac

SEQ ID NO: 3376262 - DNA, 21 bp, Homo sapiens
ggacttgctaaagcactttgc

SEQ ID NO: 3376263 - DNA, 17 bp, Homo sapiens
ggacttggaagctccgc

SEQ ID NO: 3376264 - DNA, 15 bp, Homo sapiens
ggacttgggagctgg

SEQ ID NO: 3376265 - DNA, 14 bp, Homo sapiens
ggacttgtatattt

SEQ ID NO: 3376266 - DNA, 16 bp, Homo sapiens
ggacttgtgtctctgt

SEQ ID NO: 3376267 - DNA, 11 bp, Homo sapiens
ggagaaaaaaa

SEQ ID NO: 3376268 - DNA, 11 bp, Homo sapiens
ggagaaacaca

SEQ ID NO: 3376269 - DNA, 15 bp, Homo sapiens
ggagaaacagagaca

SEQ ID NO: 3376270 - DNA, 12 bp, Homo sapiens
ggagaaagaagt

SEQ ID NO: 3376271 - DNA, 20 bp, Homo sapiens
ggagaaagaagtggagacag

SEQ ID NO: 3376272 - DNA, 12 bp, Homo sapiens
ggagaaagagct

SEQ ID NO: 3376273 - DNA, 16 bp, Homo sapiens
ggagaaagagctgcct

SEQ ID NO: 3376274 - DNA, 17 bp, Homo sapiens
ggagaaagagctgcctg

SEQ ID NO: 3376275 - DNA, 22 bp, Homo sapiens
ggagaaagagctgcctggatga

SEQ ID NO: 3376276 - DNA, 17 bp, Homo sapiens
ggagaaagcactgacct

SEQ ID NO: 3376277 - DNA, 13 bp, Homo sapiens
ggagaactagaga

SEQ ID NO: 3376278 - DNA, 14 bp, Homo sapiens
ggagaagacccacg

SEQ ID NO: 3376279 - DNA, 16 bp, Homo sapiens
ggagaagagaggagag

SEQ ID NO: 3376280 - DNA, 22 bp, Homo sapiens
ggagaagagaggagaggagaga

SEQ ID NO: 3376281 - DNA, 14 bp, Homo sapiens
ggagaagagccctg

SEQ ID NO: 3376282 - DNA, 19 bp, Homo sapiens
ggagaagagttgaggaact

SEQ ID NO: 3376283 - DNA, 18 bp, Homo sapiens
ggagaagctttttttctt

SEQ ID NO: 3376284 - DNA, 13 bp, Homo sapiens
ggagaaggaaggg

SEQ ID NO: 3376285 - DNA, 19 bp, Homo sapiens
ggagaaggaagggcagaga

SEQ ID NO: 3376286 - DNA, 14 bp, Homo sapiens
ggagaatcatgtga

SEQ ID NO: 3376287 - DNA, 15 bp, Homo sapiens
ggagacagccccaga

SEQ ID NO: 3376288 - DNA, 21 bp, Homo sapiens
ggagacagccccagagcaggg

SEQ ID NO: 3376289 - DNA, 17 bp, Homo sapiens
ggagacagcttctctgc

SEQ ID NO: 3376290 - DNA, 18 bp, Homo sapiens
ggagacagcttctctgca

SEQ ID NO: 3376291 - DNA, 19 bp, Homo sapiens
ggagacagcttctctgcag

SEQ ID NO: 3376292 - DNA, 17 bp, Homo sapiens
ggagacaggagcctagc

SEQ ID NO: 3376293 - DNA, 21 bp, Homo sapiens
ggagacatctacacacaccag

SEQ ID NO: 3376294 - DNA, 15 bp, Homo sapiens
ggagacatgtgacat

SEQ ID NO: 3376295 - DNA, 19 bp, Homo sapiens
ggagacatgtgacatttat

SEQ ID NO: 3376296 - DNA, 19 bp, Homo sapiens
ggagaccatgcagagcgcc

SEQ ID NO: 3376297 - DNA, 23 bp, Homo sapiens
ggagaccctgcaaacagaacagg

SEQ ID NO: 3376298 - DNA, 13 bp, Homo sapiens
ggagacctgtgct

SEQ ID NO: 3376299 - DNA, 15 bp, Homo sapiens
ggagacctgtgctag

SEQ ID NO: 3376300 - DNA, 23 bp, Homo sapiens
ggagacgtggaacctctgtctca

SEQ ID NO: 3376301 - DNA, 13 bp, Homo sapiens
ggagactctgtgg

SEQ ID NO: 3376302 - DNA, 15 bp, Homo sapiens
ggagactggggtggc

SEQ ID NO: 3376303 - DNA, 22 bp, Homo sapiens
ggagacttagggcaccaggggt

SEQ ID NO: 3376304 - DNA, 18 bp, Homo sapiens
ggagagaaacaataaaga

SEQ ID NO: 3376305 - DNA, 11 bp, Homo sapiens
ggagagacctc

SEQ ID NO: 3376306 - DNA, 19 bp, Homo sapiens
ggagagactgaaagcagca

SEQ ID NO: 3376307 - DNA, 21 bp, Homo sapiens
ggagagactgaaagcagcagc

SEQ ID NO: 3376308 - DNA, 22 bp, Homo sapiens
ggagagactgaaagcagcagct

SEQ ID NO: 3376309 - DNA, 17 bp, Homo sapiens
ggagagagaaagccagg

SEQ ID NO: 3376310 - DNA, 21 bp, Homo sapiens
ggagagagaaagccaggcagg

SEQ ID NO: 3376311 - DNA, 13 bp, Homo sapiens
ggagagagccagg

SEQ ID NO: 3376312 - DNA, 14 bp, Homo sapiens
ggagagagccagga

SEQ ID NO: 3376313 - DNA, 15 bp, Homo sapiens
ggagagagccaggat

SEQ ID NO: 3376314 - DNA, 13 bp, Homo sapiens
ggagagaggcaga

SEQ ID NO: 3376315 - DNA, 16 bp, Homo sapiens
ggagagaggcagagag

SEQ ID NO: 3376316 - DNA, 12 bp, Homo sapiens
ggagagagggga

SEQ ID NO: 3376317 - DNA, 23 bp, Homo sapiens
ggagagcagcagcaccaaccaca

SEQ ID NO: 3376318 - DNA, 12 bp, Homo sapiens
ggagagcaggct

SEQ ID NO: 3376319 - DNA, 13 bp, Homo sapiens
ggagagcaggctg

SEQ ID NO: 3376320 - DNA, 14 bp, Homo sapiens
ggagagcaggctgg

SEQ ID NO: 3376321 - DNA, 13 bp, Homo sapiens
ggagagccaacct

SEQ ID NO: 3376322 - DNA, 11 bp, Homo sapiens
ggagagcccag

SEQ ID NO: 3376323 - DNA, 11 bp, Homo sapiens
ggagagcctgc

SEQ ID NO: 3376324 - DNA, 15 bp, Homo sapiens
ggagagcgaggaggc

SEQ ID NO: 3376325 - DNA, 22 bp, Homo sapiens
ggagagcgaggaggcgcggcct

SEQ ID NO: 3376326 - DNA, 22 bp, Homo sapiens
ggagaggaacgggcagcctggg

SEQ ID NO: 3376327 - DNA, 16 bp, Homo sapiens
ggagaggaactccttg

SEQ ID NO: 3376328 - DNA, 14 bp, Homo sapiens
ggagaggcagcatg

SEQ ID NO: 3376329 - DNA, 22 bp, Homo sapiens
ggagaggcagcatgcttgggct

SEQ ID NO: 3376330 - DNA, 14 bp, Homo sapiens
ggagaggcgagagg

SEQ ID NO: 3376331 - DNA, 13 bp, Homo sapiens
ggagaggcggcct

SEQ ID NO: 3376332 - DNA, 21 bp, Homo sapiens
ggagaggctgggctgggtggc

SEQ ID NO: 3376333 - DNA, 14 bp, Homo sapiens
ggagaggctgtctg

SEQ ID NO: 3376334 - DNA, 19 bp, Homo sapiens
ggagaggctgtctggggcc

SEQ ID NO: 3376335 - DNA, 18 bp, Homo sapiens
ggagaggggaagggccag

SEQ ID NO: 3376336 - DNA, 22 bp, Homo sapiens
ggagaggggaagggccagtctg

SEQ ID NO: 3376337 - DNA, 12 bp, Homo sapiens
ggagataaattt

SEQ ID NO: 3376338 - DNA, 22 bp, Homo sapiens
ggagatatctgagggaggaggc

SEQ ID NO: 3376339 - DNA, 16 bp, Homo sapiens
ggagatgaccagggat

SEQ ID NO: 3376340 - DNA, 17 bp, Homo sapiens
ggagatgaccagggatg

SEQ ID NO: 3376341 - DNA, 18 bp, Homo sapiens
ggagatgcatcgggaaag

SEQ ID NO: 3376342 - DNA, 22 bp, Homo sapiens
ggagatgcatcgggaaagaaga

SEQ ID NO: 3376343 - DNA, 20 bp, Homo sapiens
ggagatggaagttgcagtga

SEQ ID NO: 3376344 - DNA, 16 bp, Homo sapiens
ggagatggagggcttg

SEQ ID NO: 3376345 - DNA, 13 bp, Homo sapiens
ggagatggagttc

SEQ ID NO: 3376346 - DNA, 15 bp, Homo sapiens
ggagatggtcagtgt

SEQ ID NO: 3376347 - DNA, 16 bp, Homo sapiens
ggagatgtagcaaaac

SEQ ID NO: 3376348 - DNA, 16 bp, Homo sapiens
ggagattccacacagg

SEQ ID NO: 3376349 - DNA, 21 bp, Homo sapiens
ggagattgagaaggagagaaa

SEQ ID NO: 3376350 - DNA, 17 bp, Homo sapiens
ggagattggacggcctg

SEQ ID NO: 3376351 - DNA, 21 bp, Homo sapiens
ggagattttgaggtaaagata

SEQ ID NO: 3376352 - DNA, 16 bp, Homo sapiens
ggagcaaaaggcagct

SEQ ID NO: 3376353 - DNA, 16 bp, Homo sapiens
ggagcacagccctggg

SEQ ID NO: 3376354 - DNA, 17 bp, Homo sapiens
ggagcacagccctggga

SEQ ID NO: 3376355 - DNA, 14 bp, Homo sapiens
ggagcacaggcagc

SEQ ID NO: 3376356 - DNA, 15 bp, Homo sapiens
ggagcacaggtccca

SEQ ID NO: 3376357 - DNA, 17 bp, Homo sapiens
ggagcacaggtcccacc

SEQ ID NO: 3376358 - DNA, 18 bp, Homo sapiens
ggagcacaggtcccacct

SEQ ID NO: 3376359 - DNA, 16 bp, Homo sapiens
ggagcacccagagcac

SEQ ID NO: 3376360 - DNA, 13 bp, Homo sapiens
ggagcacctgaac

SEQ ID NO: 3376361 - DNA, 15 bp, Homo sapiens
ggagcacctgaaccc

SEQ ID NO: 3376362 - DNA, 18 bp, Homo sapiens
ggagcactggagtgcagg

SEQ ID NO: 3376363 - DNA, 18 bp, Homo sapiens
ggagcacttgcgtcctgc

SEQ ID NO: 3376364 - DNA, 19 bp, Homo sapiens
ggagcacttgcgtcctgca

SEQ ID NO: 3376365 - DNA, 20 bp, Homo sapiens
ggagcacttgcgtcctgcag

SEQ ID NO: 3376366 - DNA, 18 bp, Homo sapiens
ggagcagaaacagccatt

SEQ ID NO: 3376367 - DNA, 16 bp, Homo sapiens
ggagcagatggacagc

SEQ ID NO: 3376368 - DNA, 23 bp, Homo sapiens
ggagcagcttccttctgggactg

SEQ ID NO: 3376369 - DNA, 13 bp, Homo sapiens
ggagcaggaacaa

SEQ ID NO: 3376370 - DNA, 22 bp, Homo sapiens
ggagcaggagattgagaaggag

SEQ ID NO: 3376371 - DNA, 21 bp, Homo sapiens
ggagcaggaggccaataaaaa

SEQ ID NO: 3376372 - DNA, 16 bp, Homo sapiens
ggagcaggcacgggtg

SEQ ID NO: 3376373 - DNA, 17 bp, Homo sapiens
ggagcaggccggaacca

SEQ ID NO: 3376374 - DNA, 21 bp, Homo sapiens
ggagcaggccggaaccacagg

SEQ ID NO: 3376375 - DNA, 18 bp, Homo sapiens
ggagcaggcggtggggag

SEQ ID NO: 3376376 - DNA, 23 bp, Homo sapiens
ggagcaggcggtggggagagatg

SEQ ID NO: 3376377 - DNA, 13 bp, Homo sapiens
ggagcagggaagg

SEQ ID NO: 3376378 - DNA, 19 bp, Homo sapiens
ggagcagggaaggcctgac

SEQ ID NO: 3376379 - DNA, 17 bp, Homo sapiens
ggagcaggttccccaag

SEQ ID NO: 3376380 - DNA, 23 bp, Homo sapiens
ggagcaggttccccaagggccct

SEQ ID NO: 3376381 - DNA, 17 bp, Homo sapiens
ggagcagtgtcttccat

SEQ ID NO: 3376382 - DNA, 18 bp, Homo sapiens
ggagcagttttcccctgg

SEQ ID NO: 3376383 - DNA, 14 bp, Homo sapiens
ggagcatcagccag

SEQ ID NO: 3376384 - DNA, 15 bp, Homo sapiens
ggagccaactgctgc

SEQ ID NO: 3376385 - DNA, 15 bp, Homo sapiens
ggagccaccagttct

SEQ ID NO: 3376386 - DNA, 13 bp, Homo sapiens
ggagccagctgct

SEQ ID NO: 3376387 - DNA, 14 bp, Homo sapiens
ggagccagctgctt

SEQ ID NO: 3376388 - DNA, 15 bp, Homo sapiens
ggagcccacaacctt

SEQ ID NO: 3376389 - DNA, 20 bp, Homo sapiens
ggagcccacgctcaccccct

SEQ ID NO: 3376390 - DNA, 13 bp, Homo sapiens
ggagcccagaggg

SEQ ID NO: 3376391 - DNA, 16 bp, Homo sapiens
ggagcccagccctccc

SEQ ID NO: 3376392 - DNA, 19 bp, Homo sapiens
ggagcccagccctccccat

SEQ ID NO: 3376393 - DNA, 20 bp, Homo sapiens
ggagcccagcctgggagccc

SEQ ID NO: 3376394 - DNA, 22 bp, Homo sapiens
ggagcccaggcgggagcggtgg

SEQ ID NO: 3376395 - DNA, 20 bp, Homo sapiens
ggagcccatactcagcctgc

SEQ ID NO: 3376396 - DNA, 13 bp, Homo sapiens
ggagccccagggt

SEQ ID NO: 3376397 - DNA, 13 bp, Homo sapiens
ggagccccctctg

SEQ ID NO: 3376398 - DNA, 15 bp, Homo sapiens
ggagccccctctgcc

SEQ ID NO: 3376399 - DNA, 13 bp, Homo sapiens
ggagcccctgggt

SEQ ID NO: 3376400 - DNA, 16 bp, Homo sapiens
ggagcccctgggtggg

SEQ ID NO: 3376401 - DNA, 22 bp, Homo sapiens
ggagcccgaagtctgctgctgt

SEQ ID NO: 3376402 - DNA, 14 bp, Homo sapiens
ggagcctccccctc

SEQ ID NO: 3376403 - DNA, 16 bp, Homo sapiens
ggagcctccccctcag

SEQ ID NO: 3376404 - DNA, 19 bp, Homo sapiens
ggagcctccccctcagatg

SEQ ID NO: 3376405 - DNA, 13 bp, Homo sapiens
ggagcctcctgcc

SEQ ID NO: 3376406 - DNA, 20 bp, Homo sapiens
ggagcctgagtcagggccca

SEQ ID NO: 3376407 - DNA, 21 bp, Homo sapiens
ggagcctgagtcagggcccag

SEQ ID NO: 3376408 - DNA, 16 bp, Homo sapiens
ggagcctggcacagga

SEQ ID NO: 3376409 - DNA, 21 bp, Homo sapiens
ggagcctgtgcgtcccagctg

SEQ ID NO: 3376410 - DNA, 22 bp, Homo sapiens
ggagccttcccaagttgtgctt

SEQ ID NO: 3376411 - DNA, 16 bp, Homo sapiens
ggagcggcgccctgga

SEQ ID NO: 3376412 - DNA, 13 bp, Homo sapiens
ggagcggctgctc

SEQ ID NO: 3376413 - DNA, 22 bp, Homo sapiens
ggagcggctgctcgcccaggaa

SEQ ID NO: 3376414 - DNA, 15 bp, Homo sapiens
ggagcggtggccctg

SEQ ID NO: 3376415 - DNA, 15 bp, Homo sapiens
ggagctatcaggaac

SEQ ID NO: 3376416 - DNA, 22 bp, Homo sapiens
ggagctatcaggaacagctatg

SEQ ID NO: 3376417 - DNA, 22 bp, Homo sapiens
ggagctatgatttttttttcca

SEQ ID NO: 3376418 - DNA, 16 bp, Homo sapiens
ggagctcaccctgccc

SEQ ID NO: 3376419 - DNA, 17 bp, Homo sapiens
ggagctcaccctgcccg

SEQ ID NO: 3376420 - DNA, 12 bp, Homo sapiens
ggagctcagccc

SEQ ID NO: 3376421 - DNA, 22 bp, Homo sapiens
ggagctcaggaagaagagatgc

SEQ ID NO: 3376422 - DNA, 17 bp, Homo sapiens
ggagctcatctgcaaaa

SEQ ID NO: 3376423 - DNA, 20 bp, Homo sapiens
ggagctccactctgcttctc

SEQ ID NO: 3376424 - DNA, 11 bp, Homo sapiens
ggagctcctgg

SEQ ID NO: 3376425 - DNA, 16 bp, Homo sapiens
ggagctctgtatggtc

SEQ ID NO: 3376426 - DNA, 20 bp, Homo sapiens
ggagctcttcaggcctccct

SEQ ID NO: 3376427 - DNA, 19 bp, Homo sapiens
ggagctgatttccaggccc

SEQ ID NO: 3376428 - DNA, 14 bp, Homo sapiens
ggagctgcactgat

SEQ ID NO: 3376429 - DNA, 15 bp, Homo sapiens
ggagctgccacagag

SEQ ID NO: 3376430 - DNA, 12 bp, Homo sapiens
ggagctgcctgt

SEQ ID NO: 3376431 - DNA, 21 bp, Homo sapiens
ggagctgcctgttcagctcca

SEQ ID NO: 3376432 - DNA, 22 bp, Homo sapiens
ggagctgcctgttcagctccag

SEQ ID NO: 3376433 - DNA, 20 bp, Homo sapiens
ggagctggggagaggaaaga

SEQ ID NO: 3376434 - DNA, 15 bp, Homo sapiens
ggagcttgggaatgg

SEQ ID NO: 3376435 - DNA, 21 bp, Homo sapiens
ggaggaaaaccaagccgtggc

SEQ ID NO: 3376436 - DNA, 15 bp, Homo sapiens
ggaggaaagggagga

SEQ ID NO: 3376437 - DNA, 11 bp, Homo sapiens
ggaggaaggat

SEQ ID NO: 3376438 - DNA, 13 bp, Homo sapiens
ggaggaaggattg

SEQ ID NO: 3376439 - DNA, 13 bp, Homo sapiens
ggaggaaggcaag

SEQ ID NO: 3376440 - DNA, 14 bp, Homo sapiens
ggaggaaggtgctg

SEQ ID NO: 3376441 - DNA, 18 bp, Homo sapiens
ggaggaaggtgctgagct

SEQ ID NO: 3376442 - DNA, 14 bp, Homo sapiens
ggaggaattcagct

SEQ ID NO: 3376443 - DNA, 22 bp, Homo sapiens
ggaggacctgaccctactccct

SEQ ID NO: 3376444 - DNA, 13 bp, Homo sapiens
ggaggagagagac

SEQ ID NO: 3376445 - DNA, 14 bp, Homo sapiens
ggaggagagagacc

SEQ ID NO: 3376446 - DNA, 15 bp, Homo sapiens
ggaggagcacagttt

SEQ ID NO: 3376447 - DNA, 13 bp, Homo sapiens
ggaggagcctgtg

SEQ ID NO: 3376448 - DNA, 18 bp, Homo sapiens
ggaggagcgaaatctaaa

SEQ ID NO: 3376449 - DNA, 12 bp, Homo sapiens
ggaggaggaaga

SEQ ID NO: 3376450 - DNA, 15 bp, Homo sapiens
ggaggaggagatggc

SEQ ID NO: 3376451 - DNA, 14 bp, Homo sapiens
ggaggaggccacct

SEQ ID NO: 3376452 - DNA, 15 bp, Homo sapiens
ggaggaggccacctc

SEQ ID NO: 3376453 - DNA, 14 bp, Homo sapiens
ggaggagggaggcg

SEQ ID NO: 3376454 - DNA, 15 bp, Homo sapiens
ggaggagggatgctg

SEQ ID NO: 3376455 - DNA, 15 bp, Homo sapiens
ggaggagggggccgg

SEQ ID NO: 3376456 - DNA, 14 bp, Homo sapiens
ggaggatggagaga

SEQ ID NO: 3376457 - DNA, 21 bp, Homo sapiens
ggaggatggagagaggggaat

SEQ ID NO: 3376458 - DNA, 18 bp, Homo sapiens
ggaggatgttctgggaca

SEQ ID NO: 3376459 - DNA, 21 bp, Homo sapiens
ggaggatgttctgggacacag

SEQ ID NO: 3376460 - DNA, 23 bp, Homo sapiens
ggaggcaagagactgggagccac

SEQ ID NO: 3376461 - DNA, 14 bp, Homo sapiens
ggaggcaccagctc

SEQ ID NO: 3376462 - DNA, 17 bp, Homo sapiens
ggaggcaccagctctgt

SEQ ID NO: 3376463 - DNA, 11 bp, Homo sapiens
ggaggcagcat

SEQ ID NO: 3376464 - DNA, 23 bp, Homo sapiens
ggaggcagcatggagagaggcct

SEQ ID NO: 3376465 - DNA, 23 bp, Homo sapiens
ggaggcagccccctccacaccag

SEQ ID NO: 3376466 - DNA, 17 bp, Homo sapiens
ggaggcatggccctggg

SEQ ID NO: 3376467 - DNA, 21 bp, Homo sapiens
ggaggccaaccagcccgacag

SEQ ID NO: 3376468 - DNA, 15 bp, Homo sapiens
ggaggccaaggcagg

SEQ ID NO: 3376469 - DNA, 18 bp, Homo sapiens
ggaggccaaggcaggtag

SEQ ID NO: 3376470 - DNA, 22 bp, Homo sapiens
ggaggccaataaaaagttcaga

SEQ ID NO: 3376471 - DNA, 18 bp, Homo sapiens
ggaggccacctctccaag

SEQ ID NO: 3376472 - DNA, 18 bp, Homo sapiens
ggaggccccactgatgct

SEQ ID NO: 3376473 - DNA, 14 bp, Homo sapiens
ggaggccccagctc

SEQ ID NO: 3376474 - DNA, 19 bp, Homo sapiens
ggaggccccagctctgagg

SEQ ID NO: 3376475 - DNA, 18 bp, Homo sapiens
ggaggccccccgtgtgga

SEQ ID NO: 3376476 - DNA, 16 bp, Homo sapiens
ggaggccctcctgtgc

SEQ ID NO: 3376477 - DNA, 16 bp, Homo sapiens
ggaggcctcgagcaga

SEQ ID NO: 3376478 - DNA, 13 bp, Homo sapiens
ggaggcctgggga

SEQ ID NO: 3376479 - DNA, 19 bp, Homo sapiens
ggaggcctggggaggccct

SEQ ID NO: 3376480 - DNA, 20 bp, Homo sapiens
ggaggctcccgaggggaagg

SEQ ID NO: 3376481 - DNA, 16 bp, Homo sapiens
ggaggctgaggcagga

SEQ ID NO: 3376482 - DNA, 13 bp, Homo sapiens
ggaggctgcagag

SEQ ID NO: 3376483 - DNA, 20 bp, Homo sapiens
ggaggctggaggaagggggg

SEQ ID NO: 3376484 - DNA, 12 bp, Homo sapiens
ggaggctgggca

SEQ ID NO: 3376485 - DNA, 13 bp, Homo sapiens
ggaggctgggcac

SEQ ID NO: 3376486 - DNA, 16 bp, Homo sapiens
ggaggctgggcccctg

SEQ ID NO: 3376487 - DNA, 23 bp, Homo sapiens
ggaggctgggcccctgggatggg

SEQ ID NO: 3376488 - DNA, 17 bp, Homo sapiens
ggaggcttttcactgcc

SEQ ID NO: 3376489 - DNA, 14 bp, Homo sapiens
ggagggagaagaga

SEQ ID NO: 3376490 - DNA, 15 bp, Homo sapiens
ggagggagaagagaa

SEQ ID NO: 3376491 - DNA, 16 bp, Homo sapiens
ggagggagcagacagg

SEQ ID NO: 3376492 - DNA, 19 bp, Homo sapiens
ggagggaggctgggcgggt

SEQ ID NO: 3376493 - DNA, 22 bp, Homo sapiens
ggagggagtgttcaaaatacta

SEQ ID NO: 3376494 - DNA, 17 bp, Homo sapiens
ggagggattctggttcc

SEQ ID NO: 3376495 - DNA, 14 bp, Homo sapiens
ggagggcagagcca

SEQ ID NO: 3376496 - DNA, 17 bp, Homo sapiens
ggagggcagagccatgg

SEQ ID NO: 3376497 - DNA, 14 bp, Homo sapiens
ggagggcccctgcg

SEQ ID NO: 3376498 - DNA, 16 bp, Homo sapiens
ggagggccctacctga

SEQ ID NO: 3376499 - DNA, 19 bp, Homo sapiens
ggagggcttggcccagcgc

SEQ ID NO: 3376500 - DNA, 21 bp, Homo sapiens
ggaggggaaaggctgccgagg

SEQ ID NO: 3376501 - DNA, 13 bp, Homo sapiens
ggaggggaagctg

SEQ ID NO: 3376502 - DNA, 21 bp, Homo sapiens
ggaggggcccctgcttctcca

SEQ ID NO: 3376503 - DNA, 21 bp, Homo sapiens
ggaggggcccggtggcggcag

SEQ ID NO: 3376504 - DNA, 13 bp, Homo sapiens
ggaggggcctggc

SEQ ID NO: 3376505 - DNA, 21 bp, Homo sapiens
ggaggggcctggcagccgtgc

SEQ ID NO: 3376506 - DNA, 19 bp, Homo sapiens
ggaggggcgctggcccagc

SEQ ID NO: 3376507 - DNA, 14 bp, Homo sapiens
ggagggggatccga

SEQ ID NO: 3376508 - DNA, 16 bp, Homo sapiens
ggagggggcgctcagg

SEQ ID NO: 3376509 - DNA, 18 bp, Homo sapiens
ggagggggcgctcaggac

SEQ ID NO: 3376510 - DNA, 21 bp, Homo sapiens
ggagggggcgctcaggaccca

SEQ ID NO: 3376511 - DNA, 15 bp, Homo sapiens
ggagggggctgggct

SEQ ID NO: 3376512 - DNA, 15 bp, Homo sapiens
ggaggggggtgctgg

SEQ ID NO: 3376513 - DNA, 15 bp, Homo sapiens
ggaggggtgtggctc

SEQ ID NO: 3376514 - DNA, 19 bp, Homo sapiens
ggaggggttgccacaggcc

SEQ ID NO: 3376515 - DNA, 22 bp, Homo sapiens
ggaggggttgccacaggcctcc

SEQ ID NO: 3376516 - DNA, 13 bp, Homo sapiens
ggaggtcactgga

SEQ ID NO: 3376517 - DNA, 17 bp, Homo sapiens
ggaggtcactggaaagg

SEQ ID NO: 3376518 - DNA, 18 bp, Homo sapiens
ggaggtcggtaggttcag

SEQ ID NO: 3376519 - DNA, 13 bp, Homo sapiens
ggaggtctccagg

SEQ ID NO: 3376520 - DNA, 14 bp, Homo sapiens
ggaggtgaccccag

SEQ ID NO: 3376521 - DNA, 18 bp, Homo sapiens
ggaggtgagagtgggagg

SEQ ID NO: 3376522 - DNA, 21 bp, Homo sapiens
ggaggtgagatcacagcctcc

SEQ ID NO: 3376523 - DNA, 22 bp, Homo sapiens
ggaggtgagatcacagcctcca

SEQ ID NO: 3376524 - DNA, 18 bp, Homo sapiens
ggaggtgaggggggctgg

SEQ ID NO: 3376525 - DNA, 17 bp, Homo sapiens
ggaggtggaagaaggga

SEQ ID NO: 3376526 - DNA, 16 bp, Homo sapiens
ggaggtgggcatgcca

SEQ ID NO: 3376527 - DNA, 20 bp, Homo sapiens
ggaggtgggcatgccaccct

SEQ ID NO: 3376528 - DNA, 22 bp, Homo sapiens
ggaggtgggcatgccaccctca

SEQ ID NO: 3376529 - DNA, 14 bp, Homo sapiens
ggaggtggggaagg

SEQ ID NO: 3376530 - DNA, 23 bp, Homo sapiens
ggaggttctaaggcctaggattc

SEQ ID NO: 3376531 - DNA, 14 bp, Homo sapiens
ggaggttctcagag

SEQ ID NO: 3376532 - DNA, 12 bp, Homo sapiens
ggaggttgcagg

SEQ ID NO: 3376533 - DNA, 13 bp, Homo sapiens
ggagtagccaagc

SEQ ID NO: 3376534 - DNA, 17 bp, Homo sapiens
ggagtatgtctgatgga

SEQ ID NO: 3376535 - DNA, 13 bp, Homo sapiens
ggagtcacacagt

SEQ ID NO: 3376536 - DNA, 15 bp, Homo sapiens
ggagtcagagccctg

SEQ ID NO: 3376537 - DNA, 22 bp, Homo sapiens
ggagtcagagccctggctgggt

SEQ ID NO: 3376538 - DNA, 23 bp, Homo sapiens
ggagtcagtaggtccaagggcca

SEQ ID NO: 3376539 - DNA, 21 bp, Homo sapiens
ggagtcccaccttggctgcag

SEQ ID NO: 3376540 - DNA, 22 bp, Homo sapiens
ggagtcccaccttggctgcagg

SEQ ID NO: 3376541 - DNA, 20 bp, Homo sapiens
ggagtctgaggcctgagtga

SEQ ID NO: 3376542 - DNA, 18 bp, Homo sapiens
ggagtctggagtgggcag

SEQ ID NO: 3376543 - DNA, 22 bp, Homo sapiens
ggagtgaaacctttagggcagc

SEQ ID NO: 3376544 - DNA, 23 bp, Homo sapiens
ggagtgaaacctttagggcagct

SEQ ID NO: 3376545 - DNA, 12 bp, Homo sapiens
ggagtgaagagg

SEQ ID NO: 3376546 - DNA, 15 bp, Homo sapiens
ggagtgaagaggggc

SEQ ID NO: 3376547 - DNA, 11 bp, Homo sapiens
ggagtgacaga

SEQ ID NO: 3376548 - DNA, 18 bp, Homo sapiens
ggagtgacagaggcagcc

SEQ ID NO: 3376549 - DNA, 21 bp, Homo sapiens
ggagtgacagaggcagcccca

SEQ ID NO: 3376550 - DNA, 13 bp, Homo sapiens
ggagtgagactga

SEQ ID NO: 3376551 - DNA, 14 bp, Homo sapiens
ggagtgagactgac

SEQ ID NO: 3376552 - DNA, 12 bp, Homo sapiens
ggagtgagctgg

SEQ ID NO: 3376553 - DNA, 21 bp, Homo sapiens
ggagtgaggaatagttgagcc

SEQ ID NO: 3376554 - DNA, 21 bp, Homo sapiens
ggagtgatatgatccagagca

SEQ ID NO: 3376555 - DNA, 12 bp, Homo sapiens
ggagtgcagtga

SEQ ID NO: 3376556 - DNA, 19 bp, Homo sapiens
ggagtgcccaccctgggag

SEQ ID NO: 3376557 - DNA, 16 bp, Homo sapiens
ggagtgctggctcaca

SEQ ID NO: 3376558 - DNA, 18 bp, Homo sapiens
ggagtgggcacctcagaa

SEQ ID NO: 3376559 - DNA, 20 bp, Homo sapiens
ggagtgtatgactgcacatg

SEQ ID NO: 3376560 - DNA, 13 bp, Homo sapiens
ggagtgtcctctt

SEQ ID NO: 3376561 - DNA, 17 bp, Homo sapiens
ggagtgtcctgcccatg

SEQ ID NO: 3376562 - DNA, 16 bp, Homo sapiens
ggagtgtgtattgttc

SEQ ID NO: 3376563 - DNA, 17 bp, Homo sapiens
ggagtgtgtattgttcc

SEQ ID NO: 3376564 - DNA, 20 bp, Homo sapiens
ggagtttaagaccagcctgg

SEQ ID NO: 3376565 - DNA, 19 bp, Homo sapiens
ggagtttcctaaaagttca

SEQ ID NO: 3376566 - DNA, 20 bp, Homo sapiens
ggagtttgaggctgcagcga

SEQ ID NO: 3376567 - DNA, 15 bp, Homo sapiens
ggataaactgagcct

SEQ ID NO: 3376568 - DNA, 16 bp, Homo sapiens
ggataaactgagcctc

SEQ ID NO: 3376569 - DNA, 14 bp, Homo sapiens
ggataacctatatg

SEQ ID NO: 3376570 - DNA, 23 bp, Homo sapiens
ggataagtttctattctgtcagt

SEQ ID NO: 3376571 - DNA, 20 bp, Homo sapiens
ggataatgtcattaatatat

SEQ ID NO: 3376572 - DNA, 18 bp, Homo sapiens
ggatacaacctccctctt

SEQ ID NO: 3376573 - DNA, 22 bp, Homo sapiens
ggatacaacctccctcttgttt

SEQ ID NO: 3376574 - DNA, 12 bp, Homo sapiens
ggatacacagga

SEQ ID NO: 3376575 - DNA, 15 bp, Homo sapiens
ggatactgcagggcc

SEQ ID NO: 3376576 - DNA, 17 bp, Homo sapiens
ggatactggcacagagg

SEQ ID NO: 3376577 - DNA, 13 bp, Homo sapiens
ggatacttcctgg

SEQ ID NO: 3376578 - DNA, 13 bp, Homo sapiens
ggatagcattttt

SEQ ID NO: 3376579 - DNA, 18 bp, Homo sapiens
ggatagctaactgtaaat

SEQ ID NO: 3376580 - DNA, 19 bp, Homo sapiens
ggatagctaactgtaaatc

SEQ ID NO: 3376581 - DNA, 17 bp, Homo sapiens
ggataggagaagaggca

SEQ ID NO: 3376582 - DNA, 16 bp, Homo sapiens
ggatagtatgagccct

SEQ ID NO: 3376583 - DNA, 18 bp, Homo sapiens
ggatagtatttttatcca

SEQ ID NO: 3376584 - DNA, 19 bp, Homo sapiens
ggatagttgatgcatgtta

SEQ ID NO: 3376585 - DNA, 20 bp, Homo sapiens
ggatatagttttacttttaa

SEQ ID NO: 3376586 - DNA, 16 bp, Homo sapiens
ggatatattattgtaa

SEQ ID NO: 3376587 - DNA, 12 bp, Homo sapiens
ggatatggtctt

SEQ ID NO: 3376588 - DNA, 13 bp, Homo sapiens
ggatatgtggaga

SEQ ID NO: 3376589 - DNA, 11 bp, Homo sapiens
ggatatttaag

SEQ ID NO: 3376590 - DNA, 22 bp, Homo sapiens
ggatatttaagaaaatacaata

SEQ ID NO: 3376591 - DNA, 19 bp, Homo sapiens
ggatatttgatatttggtt

SEQ ID NO: 3376592 - DNA, 13 bp, Homo sapiens
ggatcaattttca

SEQ ID NO: 3376593 - DNA, 19 bp, Homo sapiens
ggatcaattttcattaaac

SEQ ID NO: 3376594 - DNA, 18 bp, Homo sapiens
ggatcacaagatggaatt

SEQ ID NO: 3376595 - DNA, 19 bp, Homo sapiens
ggatcactggagcccagga

SEQ ID NO: 3376596 - DNA, 17 bp, Homo sapiens
ggatcacttgagcccag

SEQ ID NO: 3376597 - DNA, 16 bp, Homo sapiens
ggatcagagcaggacc

SEQ ID NO: 3376598 - DNA, 19 bp, Homo sapiens
ggatcagagcgcacaggga

SEQ ID NO: 3376599 - DNA, 16 bp, Homo sapiens
ggatcatggtgtaata

SEQ ID NO: 3376600 - DNA, 12 bp, Homo sapiens
ggatccagccac

SEQ ID NO: 3376601 - DNA, 21 bp, Homo sapiens
ggatccagccacttccccctc

SEQ ID NO: 3376602 - DNA, 23 bp, Homo sapiens
ggatccagccacttccccctctt

SEQ ID NO: 3376603 - DNA, 16 bp, Homo sapiens
ggatccccgcctggcc

SEQ ID NO: 3376604 - DNA, 22 bp, Homo sapiens
ggatcccctctgtctacaaata

SEQ ID NO: 3376605 - DNA, 21 bp, Homo sapiens
ggatcccctgcggtcaggctg

SEQ ID NO: 3376606 - DNA, 14 bp, Homo sapiens
ggatccgctgccac

SEQ ID NO: 3376607 - DNA, 17 bp, Homo sapiens
ggatccgctgccaccac

SEQ ID NO: 3376608 - DNA, 12 bp, Homo sapiens
ggatcctccctc

SEQ ID NO: 3376609 - DNA, 18 bp, Homo sapiens
ggatctaccagcataaat

SEQ ID NO: 3376610 - DNA, 14 bp, Homo sapiens
ggatctatttcatg

SEQ ID NO: 3376611 - DNA, 21 bp, Homo sapiens
ggatctatttcatgtttttga

SEQ ID NO: 3376612 - DNA, 17 bp, Homo sapiens
ggatctcagctttgaga

SEQ ID NO: 3376613 - DNA, 21 bp, Homo sapiens
ggatctccactgataagactg

SEQ ID NO: 3376614 - DNA, 13 bp, Homo sapiens
ggatctctcagga

SEQ ID NO: 3376615 - DNA, 18 bp, Homo sapiens
ggatctggggctctggga

SEQ ID NO: 3376616 - DNA, 14 bp, Homo sapiens
ggatcttgaatgtg

SEQ ID NO: 3376617 - DNA, 23 bp, Homo sapiens
ggatcttgccacatttctgatca

SEQ ID NO: 3376618 - DNA, 14 bp, Homo sapiens
ggatctttgactga

SEQ ID NO: 3376619 - DNA, 18 bp, Homo sapiens
ggatgaaataactccttc

SEQ ID NO: 3376620 - DNA, 23 bp, Homo sapiens
ggatgaatgtatgtgcactgtca

SEQ ID NO: 3376621 - DNA, 19 bp, Homo sapiens
ggatgacaccctggcctga

SEQ ID NO: 3376622 - DNA, 19 bp, Homo sapiens
ggatgacaggcgcctgcca

SEQ ID NO: 3376623 - DNA, 16 bp, Homo sapiens
ggatgactaacaagat

SEQ ID NO: 3376624 - DNA, 13 bp, Homo sapiens
ggatgagaaacag

SEQ ID NO: 3376625 - DNA, 17 bp, Homo sapiens
ggatgagaaacagctca

SEQ ID NO: 3376626 - DNA, 23 bp, Homo sapiens
ggatgagaaacagctcagccagt

SEQ ID NO: 3376627 - DNA, 15 bp, Homo sapiens
ggatgagagcccaga

SEQ ID NO: 3376628 - DNA, 18 bp, Homo sapiens
ggatgagagcccagaggt

SEQ ID NO: 3376629 - DNA, 20 bp, Homo sapiens
ggatgaggggcttcctgggt

SEQ ID NO: 3376630 - DNA, 21 bp, Homo sapiens
ggatgagggtggcatgaggag

SEQ ID NO: 3376631 - DNA, 14 bp, Homo sapiens
ggatgattaaattt

SEQ ID NO: 3376632 - DNA, 16 bp, Homo sapiens
ggatgattcagaaatt

SEQ ID NO: 3376633 - DNA, 20 bp, Homo sapiens
ggatgattcagaaattggaa

SEQ ID NO: 3376634 - DNA, 17 bp, Homo sapiens
ggatgattggattattc

SEQ ID NO: 3376635 - DNA, 19 bp, Homo sapiens
ggatgatttcatcttctgg

SEQ ID NO: 3376636 - DNA, 11 bp, Homo sapiens
ggatgcacatt

SEQ ID NO: 3376637 - DNA, 20 bp, Homo sapiens
ggatgcacatttctggattg

SEQ ID NO: 3376638 - DNA, 12 bp, Homo sapiens
ggatgcatttca

SEQ ID NO: 3376639 - DNA, 15 bp, Homo sapiens
ggatgcatttcaaat

SEQ ID NO: 3376640 - DNA, 18 bp, Homo sapiens
ggatgccaaggagcccct

SEQ ID NO: 3376641 - DNA, 19 bp, Homo sapiens
ggatgccaaggagcccctg

SEQ ID NO: 3376642 - DNA, 22 bp, Homo sapiens
ggatgccaatattaaatctgct

SEQ ID NO: 3376643 - DNA, 21 bp, Homo sapiens
ggatgccagcccctgcctggg

SEQ ID NO: 3376644 - DNA, 13 bp, Homo sapiens
ggatgcccagaag

SEQ ID NO: 3376645 - DNA, 14 bp, Homo sapiens
ggatgcgaggacca

SEQ ID NO: 3376646 - DNA, 16 bp, Homo sapiens
ggatgctaacatctaa

SEQ ID NO: 3376647 - DNA, 15 bp, Homo sapiens
ggatgctctttccct

SEQ ID NO: 3376648 - DNA, 20 bp, Homo sapiens
ggatgctctttcccttttct

SEQ ID NO: 3376649 - DNA, 12 bp, Homo sapiens
ggatgctgcagc

SEQ ID NO: 3376650 - DNA, 14 bp, Homo sapiens
ggatgctgggctgg

SEQ ID NO: 3376651 - DNA, 15 bp, Homo sapiens
ggatggaaggagact

SEQ ID NO: 3376652 - DNA, 16 bp, Homo sapiens
ggatggagaaagaagt

SEQ ID NO: 3376653 - DNA, 20 bp, Homo sapiens
ggatggagaaagaagtggag

SEQ ID NO: 3376654 - DNA, 17 bp, Homo sapiens
ggatggagaggcggcct

SEQ ID NO: 3376655 - DNA, 18 bp, Homo sapiens
ggatggagaggcggcctc

SEQ ID NO: 3376656 - DNA, 21 bp, Homo sapiens
ggatggagcccaggcgggagc

SEQ ID NO: 3376657 - DNA, 19 bp, Homo sapiens
ggatggaggggtggtcctg

SEQ ID NO: 3376658 - DNA, 14 bp, Homo sapiens
ggatggcttgtcta

SEQ ID NO: 3376659 - DNA, 14 bp, Homo sapiens
ggatgggaacactg

SEQ ID NO: 3376660 - DNA, 15 bp, Homo sapiens
ggatgggagtgagac

SEQ ID NO: 3376661 - DNA, 21 bp, Homo sapiens
ggatgggatcccaggccaggg

SEQ ID NO: 3376662 - DNA, 16 bp, Homo sapiens
ggatgggggtggctgg

SEQ ID NO: 3376663 - DNA, 22 bp, Homo sapiens
ggatgtacttaagagtggcata

SEQ ID NO: 3376664 - DNA, 15 bp, Homo sapiens
ggatgtcaggcccag

SEQ ID NO: 3376665 - DNA, 23 bp, Homo sapiens
ggatgtccctgggccagggtctg

SEQ ID NO: 3376666 - DNA, 16 bp, Homo sapiens
ggatgtgagccccagg

SEQ ID NO: 3376667 - DNA, 22 bp, Homo sapiens
ggatgtggggtccccatcatcc

SEQ ID NO: 3376668 - DNA, 17 bp, Homo sapiens
ggatgtgtggggcatgg

SEQ ID NO: 3376669 - DNA, 13 bp, Homo sapiens
ggatgttctggga

SEQ ID NO: 3376670 - DNA, 16 bp, Homo sapiens
ggatgttctgggacac

SEQ ID NO: 3376671 - DNA, 16 bp, Homo sapiens
ggattaacctctgcac

SEQ ID NO: 3376672 - DNA, 17 bp, Homo sapiens
ggattaacctctgcact

SEQ ID NO: 3376673 - DNA, 18 bp, Homo sapiens
ggattaacctctgcacta

SEQ ID NO: 3376674 - DNA, 13 bp, Homo sapiens
ggattaagggcaa

SEQ ID NO: 3376675 - DNA, 20 bp, Homo sapiens
ggattaatctttaataacaa

SEQ ID NO: 3376676 - DNA, 19 bp, Homo sapiens
ggattacaagcgtgagcca

SEQ ID NO: 3376677 - DNA, 23 bp, Homo sapiens
ggattacaagcgtgagccactgc

SEQ ID NO: 3376678 - DNA, 20 bp, Homo sapiens
ggattacagaaactgatgcc

SEQ ID NO: 3376679 - DNA, 21 bp, Homo sapiens
ggattatgttatacaaggcaa

SEQ ID NO: 3376680 - DNA, 22 bp, Homo sapiens
ggattattcatttaaaatgatt

SEQ ID NO: 3376681 - DNA, 16 bp, Homo sapiens
ggattcagcatgtcca

SEQ ID NO: 3376682 - DNA, 11 bp, Homo sapiens
ggattcctcac

SEQ ID NO: 3376683 - DNA, 22 bp, Homo sapiens
ggattctgggaggcaagaaaag

SEQ ID NO: 3376684 - DNA, 14 bp, Homo sapiens
ggattctggttcca

SEQ ID NO: 3376685 - DNA, 16 bp, Homo sapiens
ggattgaagccctcca

SEQ ID NO: 3376686 - DNA, 16 bp, Homo sapiens
ggattgatcattcttt

SEQ ID NO: 3376687 - DNA, 18 bp, Homo sapiens
ggattgcacgtggcctct

SEQ ID NO: 3376688 - DNA, 15 bp, Homo sapiens
ggattgcctctgaaa

SEQ ID NO: 3376689 - DNA, 22 bp, Homo sapiens
ggattggccaaacatcagacct

SEQ ID NO: 3376690 - DNA, 20 bp, Homo sapiens
ggattggcttgtgtgtttca

SEQ ID NO: 3376691 - DNA, 22 bp, Homo sapiens
ggattggtttggcaagaacttg

SEQ ID NO: 3376692 - DNA, 20 bp, Homo sapiens
ggattgtatcaagtggcatg

SEQ ID NO: 3376693 - DNA, 13 bp, Homo sapiens
ggattgtggaaaa

SEQ ID NO: 3376694 - DNA, 17 bp, Homo sapiens
ggatttaaaagcctgct

SEQ ID NO: 3376695 - DNA, 21 bp, Homo sapiens
ggatttaacagtcatttaaaa

SEQ ID NO: 3376696 - DNA, 14 bp, Homo sapiens
ggatttcgtgggtc

SEQ ID NO: 3376697 - DNA, 13 bp, Homo sapiens
ggatttcttaggg

SEQ ID NO: 3376698 - DNA, 15 bp, Homo sapiens
ggattttaccaaagc

SEQ ID NO: 3376699 - DNA, 21 bp, Homo sapiens
ggattttgatccaagctggtc

SEQ ID NO: 3376700 - DNA, 12 bp, Homo sapiens
ggattttttcca

SEQ ID NO: 3376701 - DNA, 15 bp, Homo sapiens
ggcaaaaaaattaaa

SEQ ID NO: 3376702 - DNA, 11 bp, Homo sapiens
ggcaaaaccca

SEQ ID NO: 3376703 - DNA, 15 bp, Homo sapiens
ggcaaaagccttgtg

SEQ ID NO: 3376704 - DNA, 16 bp, Homo sapiens
ggcaaaagccttgtgt

SEQ ID NO: 3376705 - DNA, 20 bp, Homo sapiens
ggcaaaagccttgtgtatat

SEQ ID NO: 3376706 - DNA, 13 bp, Homo sapiens
ggcaaactctcta

SEQ ID NO: 3376707 - DNA, 20 bp, Homo sapiens
ggcaaagccacaaggctggc

SEQ ID NO: 3376708 - DNA, 21 bp, Homo sapiens
ggcaaagtgctgtacccttcc

SEQ ID NO: 3376709 - DNA, 18 bp, Homo sapiens
ggcaaatgacatgcactg

SEQ ID NO: 3376710 - DNA, 20 bp, Homo sapiens
ggcaaatgacatgcactgac

SEQ ID NO: 3376711 - DNA, 13 bp, Homo sapiens
ggcaaatggctga

SEQ ID NO: 3376712 - DNA, 14 bp, Homo sapiens
ggcaacacagaggc

SEQ ID NO: 3376713 - DNA, 13 bp, Homo sapiens
ggcaacagatgaa

SEQ ID NO: 3376714 - DNA, 19 bp, Homo sapiens
ggcaaccactaagaattca

SEQ ID NO: 3376715 - DNA, 21 bp, Homo sapiens
ggcaaccccagttctgctcct

SEQ ID NO: 3376716 - DNA, 19 bp, Homo sapiens
ggcaacccccagcctgcta

SEQ ID NO: 3376717 - DNA, 16 bp, Homo sapiens
ggcaacgaagaaaaaa

SEQ ID NO: 3376718 - DNA, 20 bp, Homo sapiens
ggcaacgaagaaaaaaaata

SEQ ID NO: 3376719 - DNA, 21 bp, Homo sapiens
ggcaacttcagtcctgggaga

SEQ ID NO: 3376720 - DNA, 14 bp, Homo sapiens
ggcaagaaaaggac

SEQ ID NO: 3376721 - DNA, 13 bp, Homo sapiens
ggcaagaagctgc

SEQ ID NO: 3376722 - DNA, 15 bp, Homo sapiens
ggcaagaagctgctt

SEQ ID NO: 3376723 - DNA, 17 bp, Homo sapiens
ggcaagactgcaaactt

SEQ ID NO: 3376724 - DNA, 19 bp, Homo sapiens
ggcaagagcccccttgaca

SEQ ID NO: 3376725 - DNA, 18 bp, Homo sapiens
ggcaagcacctcctgcct

SEQ ID NO: 3376726 - DNA, 19 bp, Homo sapiens
ggcaagcacctcctgcctc

SEQ ID NO: 3376727 - DNA, 19 bp, Homo sapiens
ggcaagcaggacctggcat

SEQ ID NO: 3376728 - DNA, 13 bp, Homo sapiens
ggcaagcagggaa

SEQ ID NO: 3376729 - DNA, 15 bp, Homo sapiens
ggcaagcccctcagc

SEQ ID NO: 3376730 - DNA, 16 bp, Homo sapiens
ggcaagcccctcagcc

SEQ ID NO: 3376731 - DNA, 17 bp, Homo sapiens
ggcaagcccctcagccc

SEQ ID NO: 3376732 - DNA, 20 bp, Homo sapiens
ggcaagcccctcagcccttg

SEQ ID NO: 3376733 - DNA, 22 bp, Homo sapiens
ggcaagcccctcagcccttgcc

SEQ ID NO: 3376734 - DNA, 22 bp, Homo sapiens
ggcaagctaggccccagaggcc

SEQ ID NO: 3376735 - DNA, 23 bp, Homo sapiens
ggcaagctaggccccagaggccc

SEQ ID NO: 3376736 - DNA, 11 bp, Homo sapiens
ggcaaggaaag

SEQ ID NO: 3376737 - DNA, 13 bp, Homo sapiens
ggcaaggcaggtg

SEQ ID NO: 3376738 - DNA, 16 bp, Homo sapiens
ggcaaggtctccttac

SEQ ID NO: 3376739 - DNA, 23 bp, Homo sapiens
ggcaagtccctgactctctgtga

SEQ ID NO: 3376740 - DNA, 13 bp, Homo sapiens
ggcaagtgtgggc

SEQ ID NO: 3376741 - DNA, 14 bp, Homo sapiens
ggcaattttgtaac

SEQ ID NO: 3376742 - DNA, 13 bp, Homo sapiens
ggcacacagcagc

SEQ ID NO: 3376743 - DNA, 19 bp, Homo sapiens
ggcacacagcagcccccca

SEQ ID NO: 3376744 - DNA, 18 bp, Homo sapiens
ggcacaccactgccctgc

SEQ ID NO: 3376745 - DNA, 21 bp, Homo sapiens
ggcacaccactgccctgcctg

SEQ ID NO: 3376746 - DNA, 11 bp, Homo sapiens
ggcacactgcc

SEQ ID NO: 3376747 - DNA, 14 bp, Homo sapiens
ggcacactgccaaa

SEQ ID NO: 3376748 - DNA, 21 bp, Homo sapiens
ggcacagaaacacaatatttt

SEQ ID NO: 3376749 - DNA, 23 bp, Homo sapiens
ggcacagacacgctcgcgggcag

SEQ ID NO: 3376750 - DNA, 22 bp, Homo sapiens
ggcacagacttctggaaggctg

SEQ ID NO: 3376751 - DNA, 15 bp, Homo sapiens
ggcacagcctagggt

SEQ ID NO: 3376752 - DNA, 20 bp, Homo sapiens
ggcacagcggagtctgtcct

SEQ ID NO: 3376753 - DNA, 22 bp, Homo sapiens
ggcacagcggagtctgtcctgt

SEQ ID NO: 3376754 - DNA, 13 bp, Homo sapiens
ggcacaggactga

SEQ ID NO: 3376755 - DNA, 20 bp, Homo sapiens
ggcacaggagtgtcctcttc

SEQ ID NO: 3376756 - DNA, 14 bp, Homo sapiens
ggcacagggcacca

SEQ ID NO: 3376757 - DNA, 20 bp, Homo sapiens
ggcacagggcaccagaggcc

SEQ ID NO: 3376758 - DNA, 16 bp, Homo sapiens
ggcacagggcagtggg

SEQ ID NO: 3376759 - DNA, 14 bp, Homo sapiens
ggcacagggcccgc

SEQ ID NO: 3376760 - DNA, 23 bp, Homo sapiens
ggcacagggcccgcagtgctggg

SEQ ID NO: 3376761 - DNA, 12 bp, Homo sapiens
ggcacagggtct

SEQ ID NO: 3376762 - DNA, 18 bp, Homo sapiens
ggcacagggtctgctctt

SEQ ID NO: 3376763 - DNA, 13 bp, Homo sapiens
ggcacagtgggag

SEQ ID NO: 3376764 - DNA, 16 bp, Homo sapiens
ggcacatgccccgatg

SEQ ID NO: 3376765 - DNA, 20 bp, Homo sapiens
ggcacatttcagggagaaac

SEQ ID NO: 3376766 - DNA, 16 bp, Homo sapiens
ggcaccaaagatgcag

SEQ ID NO: 3376767 - DNA, 17 bp, Homo sapiens
ggcaccagatgcaacct

SEQ ID NO: 3376768 - DNA, 19 bp, Homo sapiens
ggcaccagcatccaccttg

SEQ ID NO: 3376769 - DNA, 17 bp, Homo sapiens
ggcaccagccccctgga

SEQ ID NO: 3376770 - DNA, 21 bp, Homo sapiens
ggcaccagggcgctgggaagg

SEQ ID NO: 3376771 - DNA, 20 bp, Homo sapiens
ggcacccccacaagctgtcc

SEQ ID NO: 3376772 - DNA, 23 bp, Homo sapiens
ggcacccccacaagctgtccctg

SEQ ID NO: 3376773 - DNA, 24 bp, Homo sapiens
ggcacccccacaagctgtccctgc

SEQ ID NO: 3376774 - DNA, 20 bp, Homo sapiens
ggcacccggcccctgctggt

SEQ ID NO: 3376775 - DNA, 22 bp, Homo sapiens
ggcacccggcccctgctggttc

SEQ ID NO: 3376776 - DNA, 21 bp, Homo sapiens
ggcacccggggccagagacat

SEQ ID NO: 3376777 - DNA, 20 bp, Homo sapiens
ggcacccttctttcctcttc

SEQ ID NO: 3376778 - DNA, 17 bp, Homo sapiens
ggcaccggcgctgcagg

SEQ ID NO: 3376779 - DNA, 23 bp, Homo sapiens
ggcaccgggctccatgcctctgg

SEQ ID NO: 3376780 - DNA, 21 bp, Homo sapiens
ggcacctacactcacctgcac

SEQ ID NO: 3376781 - DNA, 18 bp, Homo sapiens
ggcacctatagtcccagc

SEQ ID NO: 3376782 - DNA, 19 bp, Homo sapiens
ggcacctatagtcccagct

SEQ ID NO: 3376783 - DNA, 19 bp, Homo sapiens
ggcacctcacaggccccag

SEQ ID NO: 3376784 - DNA, 13 bp, Homo sapiens
ggcacctggcctg

SEQ ID NO: 3376785 - DNA, 16 bp, Homo sapiens
ggcacctggcctgctg

SEQ ID NO: 3376786 - DNA, 17 bp, Homo sapiens
ggcacctggcctgctgg

SEQ ID NO: 3376787 - DNA, 18 bp, Homo sapiens
ggcaccttccgacatccc

SEQ ID NO: 3376788 - DNA, 17 bp, Homo sapiens
ggcacggactgtccacc

SEQ ID NO: 3376789 - DNA, 13 bp, Homo sapiens
ggcacgggtccct

SEQ ID NO: 3376790 - DNA, 15 bp, Homo sapiens
ggcacgggtggtccc

SEQ ID NO: 3376791 - DNA, 23 bp, Homo sapiens
ggcactaacgttgagcccctgga

SEQ ID NO: 3376792 - DNA, 20 bp, Homo sapiens
ggcactagcctttggctctg

SEQ ID NO: 3376793 - DNA, 22 bp, Homo sapiens
ggcactcacagacctggagccc

SEQ ID NO: 3376794 - DNA, 19 bp, Homo sapiens
ggcactcagaagacactga

SEQ ID NO: 3376795 - DNA, 22 bp, Homo sapiens
ggcactcagccacgaccagccc

SEQ ID NO: 3376796 - DNA, 22 bp, Homo sapiens
ggcactgattgttttagagact

SEQ ID NO: 3376797 - DNA, 21 bp, Homo sapiens
ggcactgccttctcctctctg

SEQ ID NO: 3376798 - DNA, 23 bp, Homo sapiens
ggcactgccttctcctctctggg

SEQ ID NO: 3376799 - DNA, 20 bp, Homo sapiens
ggcactggcattgtccctgt

SEQ ID NO: 3376800 - DNA, 21 bp, Homo sapiens
ggcactggccacccctcccca

SEQ ID NO: 3376801 - DNA, 22 bp, Homo sapiens
ggcactggccacccctccccag

SEQ ID NO: 3376802 - DNA, 14 bp, Homo sapiens
ggcactggcccagg

SEQ ID NO: 3376803 - DNA, 21 bp, Homo sapiens
ggcactgggatgagccgctgt

SEQ ID NO: 3376804 - DNA, 21 bp, Homo sapiens
ggcactggtaggttgggacac

SEQ ID NO: 3376805 - DNA, 16 bp, Homo sapiens
ggcactggtggcatcg

SEQ ID NO: 3376806 - DNA, 18 bp, Homo sapiens
ggcactgtagttctaaga

SEQ ID NO: 3376807 - DNA, 12 bp, Homo sapiens
ggcactgttaat

SEQ ID NO: 3376808 - DNA, 15 bp, Homo sapiens
ggcacttaagcacaa

SEQ ID NO: 3376809 - DNA, 21 bp, Homo sapiens
ggcacttaagtgcactttttt

SEQ ID NO: 3376810 - DNA, 13 bp, Homo sapiens
ggcacttaatttg

SEQ ID NO: 3376811 - DNA, 19 bp, Homo sapiens
ggcacttaatttgtaaact

SEQ ID NO: 3376812 - DNA, 20 bp, Homo sapiens
ggcacttaatttgtaaactt

SEQ ID NO: 3376813 - DNA, 10 bp, Homo sapiens
ggcacttgta

SEQ ID NO: 3376814 - DNA, 14 bp, Homo sapiens
ggcacttgtattta

SEQ ID NO: 3376815 - DNA, 17 bp, Homo sapiens
ggcacttgtatttaatt

SEQ ID NO: 3376816 - DNA, 14 bp, Homo sapiens
ggcactttttaatt

SEQ ID NO: 3376817 - DNA, 20 bp, Homo sapiens
ggcagaaaacagagcctgcc

SEQ ID NO: 3376818 - DNA, 21 bp, Homo sapiens
ggcagaaaacagagcctgcct

SEQ ID NO: 3376819 - DNA, 17 bp, Homo sapiens
ggcagaaaagaggagac

SEQ ID NO: 3376820 - DNA, 21 bp, Homo sapiens
ggcagaaaagaggagaccctg

SEQ ID NO: 3376821 - DNA, 14 bp, Homo sapiens
ggcagaaaggaaaa

SEQ ID NO: 3376822 - DNA, 16 bp, Homo sapiens
ggcagaagacaccaga

SEQ ID NO: 3376823 - DNA, 17 bp, Homo sapiens
ggcagaagacaccagag

SEQ ID NO: 3376824 - DNA, 11 bp, Homo sapiens
ggcagaaggga

SEQ ID NO: 3376825 - DNA, 17 bp, Homo sapiens
ggcagacagcaggcagc

SEQ ID NO: 3376826 - DNA, 23 bp, Homo sapiens
ggcagacagcaggcagcgccaag

SEQ ID NO: 3376827 - DNA, 11 bp, Homo sapiens
ggcagactctt

SEQ ID NO: 3376828 - DNA, 20 bp, Homo sapiens
ggcagagaatggctgggtca

SEQ ID NO: 3376829 - DNA, 18 bp, Homo sapiens
ggcagagacctccaataa

SEQ ID NO: 3376830 - DNA, 19 bp, Homo sapiens
ggcagagagcggtctcagg

SEQ ID NO: 3376831 - DNA, 14 bp, Homo sapiens
ggcagagccatggg

SEQ ID NO: 3376832 - DNA, 23 bp, Homo sapiens
ggcagagccatgggcctgggcct

SEQ ID NO: 3376833 - DNA, 24 bp, Homo sapiens
ggcagagccatgggcctgggcctg

SEQ ID NO: 3376834 - DNA, 21 bp, Homo sapiens
ggcagagctgacgggaggccc

SEQ ID NO: 3376835 - DNA, 17 bp, Homo sapiens
ggcagagctggctctga

SEQ ID NO: 3376836 - DNA, 20 bp, Homo sapiens
ggcagagggaatgttccctg

SEQ ID NO: 3376837 - DNA, 23 bp, Homo sapiens
ggcagagggaatgttccctgcac

SEQ ID NO: 3376838 - DNA, 13 bp, Homo sapiens
ggcagagggctgg

SEQ ID NO: 3376839 - DNA, 13 bp, Homo sapiens
ggcagaggtggcg

SEQ ID NO: 3376840 - DNA, 21 bp, Homo sapiens
ggcagaggttgcagtgagccg

SEQ ID NO: 3376841 - DNA, 21 bp, Homo sapiens
ggcagagtttgtgtgttgtct

SEQ ID NO: 3376842 - DNA, 19 bp, Homo sapiens
ggcagataatcagcctctt

SEQ ID NO: 3376843 - DNA, 23 bp, Homo sapiens
ggcagatacaggaaaagctgctg

SEQ ID NO: 3376844 - DNA, 15 bp, Homo sapiens
ggcagatctgtgccc

SEQ ID NO: 3376845 - DNA, 18 bp, Homo sapiens
ggcagatctgtgccccat

SEQ ID NO: 3376846 - DNA, 15 bp, Homo sapiens
ggcagcacagcccag

SEQ ID NO: 3376847 - DNA, 20 bp, Homo sapiens
ggcagcacagcccagggcct

SEQ ID NO: 3376848 - DNA, 13 bp, Homo sapiens
ggcagcaccctcc

SEQ ID NO: 3376849 - DNA, 16 bp, Homo sapiens
ggcagcaccctccccc

SEQ ID NO: 3376850 - DNA, 14 bp, Homo sapiens
ggcagcactcccca

SEQ ID NO: 3376851 - DNA, 20 bp, Homo sapiens
ggcagcactccccagagctg

SEQ ID NO: 3376852 - DNA, 13 bp, Homo sapiens
ggcagcagcaggt

SEQ ID NO: 3376853 - DNA, 19 bp, Homo sapiens
ggcagcatgcttgggctga

SEQ ID NO: 3376854 - DNA, 23 bp, Homo sapiens
ggcagcatgcttgggctgaccca

SEQ ID NO: 3376855 - DNA, 17 bp, Homo sapiens
ggcagcatggagagcct

SEQ ID NO: 3376856 - DNA, 11 bp, Homo sapiens
ggcagccatgc

SEQ ID NO: 3376857 - DNA, 16 bp, Homo sapiens
ggcagccatgcctcat

SEQ ID NO: 3376858 - DNA, 21 bp, Homo sapiens
ggcagcccagagactttgtag

SEQ ID NO: 3376859 - DNA, 22 bp, Homo sapiens
ggcagcccagagactttgtaga

SEQ ID NO: 3376860 - DNA, 22 bp, Homo sapiens
ggcagccccattctgcctgccc

SEQ ID NO: 3376861 - DNA, 15 bp, Homo sapiens
ggcagccccctccac

SEQ ID NO: 3376862 - DNA, 15 bp, Homo sapiens
ggcagccctgtaggg

SEQ ID NO: 3376863 - DNA, 21 bp, Homo sapiens
ggcagcccttgcttgttggga

SEQ ID NO: 3376864 - DNA, 13 bp, Homo sapiens
ggcagcctccaga

SEQ ID NO: 3376865 - DNA, 18 bp, Homo sapiens
ggcagcctccagagccag

SEQ ID NO: 3376866 - DNA, 19 bp, Homo sapiens
ggcagcctccagagccagc

SEQ ID NO: 3376867 - DNA, 17 bp, Homo sapiens
ggcagcctgggcctggg

SEQ ID NO: 3376868 - DNA, 18 bp, Homo sapiens
ggcagcgccaagtgcgtg

SEQ ID NO: 3376869 - DNA, 12 bp, Homo sapiens
ggcagcgggcca

SEQ ID NO: 3376870 - DNA, 13 bp, Homo sapiens
ggcagcgggccag

SEQ ID NO: 3376871 - DNA, 16 bp, Homo sapiens
ggcagcgggccaggcc

SEQ ID NO: 3376872 - DNA, 13 bp, Homo sapiens
ggcagctagtgcc

SEQ ID NO: 3376873 - DNA, 16 bp, Homo sapiens
ggcagctagtgccttt

SEQ ID NO: 3376874 - DNA, 20 bp, Homo sapiens
ggcagctcacccctgggcag

SEQ ID NO: 3376875 - DNA, 21 bp, Homo sapiens
ggcagctcacccctgggcagg

SEQ ID NO: 3376876 - DNA, 14 bp, Homo sapiens
ggcagctcctctcc

SEQ ID NO: 3376877 - DNA, 19 bp, Homo sapiens
ggcagctcctctccttggg

SEQ ID NO: 3376878 - DNA, 16 bp, Homo sapiens
ggcagctctccagtca

SEQ ID NO: 3376879 - DNA, 21 bp, Homo sapiens
ggcagctgaactattggaggg

SEQ ID NO: 3376880 - DNA, 13 bp, Homo sapiens
ggcagctgcctct

SEQ ID NO: 3376881 - DNA, 19 bp, Homo sapiens
ggcagctgcctctgctccc

SEQ ID NO: 3376882 - DNA, 19 bp, Homo sapiens
ggcagctgcggtccaccca

SEQ ID NO: 3376883 - DNA, 22 bp, Homo sapiens
ggcagctgctcttagtgcccgc

SEQ ID NO: 3376884 - DNA, 14 bp, Homo sapiens
ggcagctgggcccc

SEQ ID NO: 3376885 - DNA, 16 bp, Homo sapiens
ggcagcttcaagtgcc

SEQ ID NO: 3376886 - DNA, 13 bp, Homo sapiens
ggcagcttgcccc

SEQ ID NO: 3376887 - DNA, 18 bp, Homo sapiens
ggcagcttgccccggccc

SEQ ID NO: 3376888 - DNA, 23 bp, Homo sapiens
ggcaggaaggagagcctgctgca

SEQ ID NO: 3376889 - DNA, 19 bp, Homo sapiens
ggcaggaaggagcggcgcc

SEQ ID NO: 3376890 - DNA, 22 bp, Homo sapiens
ggcaggacacatcccggcctct

SEQ ID NO: 3376891 - DNA, 21 bp, Homo sapiens
ggcaggaccttcgggctgtgc

SEQ ID NO: 3376892 - DNA, 15 bp, Homo sapiens
ggcaggagaggctgg

SEQ ID NO: 3376893 - DNA, 20 bp, Homo sapiens
ggcaggagaggctgggctgg

SEQ ID NO: 3376894 - DNA, 14 bp, Homo sapiens
ggcaggagggaggt

SEQ ID NO: 3376895 - DNA, 14 bp, Homo sapiens
ggcaggagggccct

SEQ ID NO: 3376896 - DNA, 19 bp, Homo sapiens
ggcaggccagatggcccct

SEQ ID NO: 3376897 - DNA, 23 bp, Homo sapiens
ggcaggcgtgactcagcagcctg

SEQ ID NO: 3376898 - DNA, 22 bp, Homo sapiens
ggcaggctcactgccaggccag

SEQ ID NO: 3376899 - DNA, 13 bp, Homo sapiens
ggcaggctggcca

SEQ ID NO: 3376900 - DNA, 15 bp, Homo sapiens
ggcaggctgggccat

SEQ ID NO: 3376901 - DNA, 16 bp, Homo sapiens
ggcaggctgggccatg

SEQ ID NO: 3376902 - DNA, 21 bp, Homo sapiens
ggcagggatgggggtggctgg

SEQ ID NO: 3376903 - DNA, 23 bp, Homo sapiens
ggcagggatgggggtggctggga

SEQ ID NO: 3376904 - DNA, 14 bp, Homo sapiens
ggcagggcagaggg

SEQ ID NO: 3376905 - DNA, 17 bp, Homo sapiens
ggcagggccaccccact

SEQ ID NO: 3376906 - DNA, 13 bp, Homo sapiens
ggcagggccaggc

SEQ ID NO: 3376907 - DNA, 18 bp, Homo sapiens
ggcagggccaggctggtc

SEQ ID NO: 3376908 - DNA, 20 bp, Homo sapiens
ggcagggcccacgtgtatag

SEQ ID NO: 3376909 - DNA, 20 bp, Homo sapiens
ggcagggcccttggggctgg

SEQ ID NO: 3376910 - DNA, 15 bp, Homo sapiens
ggcagggccttcctg

SEQ ID NO: 3376911 - DNA, 11 bp, Homo sapiens
ggcagggctca

SEQ ID NO: 3376912 - DNA, 13 bp, Homo sapiens
ggcaggggtgggg

SEQ ID NO: 3376913 - DNA, 16 bp, Homo sapiens
ggcaggggtgggggtg

SEQ ID NO: 3376914 - DNA, 14 bp, Homo sapiens
ggcaggggtggtgg

SEQ ID NO: 3376915 - DNA, 17 bp, Homo sapiens
ggcagggtctcactctg

SEQ ID NO: 3376916 - DNA, 19 bp, Homo sapiens
ggcagggtctcactctgtc

SEQ ID NO: 3376917 - DNA, 24 bp, Homo sapiens
ggcaggtagatcgcttgagcccag

SEQ ID NO: 3376918 - DNA, 15 bp, Homo sapiens
ggcaggtagccaggg

SEQ ID NO: 3376919 - DNA, 13 bp, Homo sapiens
ggcaggtccaggg

SEQ ID NO: 3376920 - DNA, 12 bp, Homo sapiens
ggcaggtgcaga

SEQ ID NO: 3376921 - DNA, 19 bp, Homo sapiens
ggcaggtgcagatgggctg

SEQ ID NO: 3376922 - DNA, 15 bp, Homo sapiens
ggcaggtgggcagac

SEQ ID NO: 3376923 - DNA, 22 bp, Homo sapiens
ggcaggtggtggcactgagccc

SEQ ID NO: 3376924 - DNA, 16 bp, Homo sapiens
ggcaggttggatggga

SEQ ID NO: 3376925 - DNA, 19 bp, Homo sapiens
ggcagtaaagagaaacttt

SEQ ID NO: 3376926 - DNA, 13 bp, Homo sapiens
ggcagtacctggg

SEQ ID NO: 3376927 - DNA, 11 bp, Homo sapiens
ggcagtccctt

SEQ ID NO: 3376928 - DNA, 18 bp, Homo sapiens
ggcagtcgggggctggcc

SEQ ID NO: 3376929 - DNA, 21 bp, Homo sapiens
ggcagtcgggggctggcctag

SEQ ID NO: 3376930 - DNA, 15 bp, Homo sapiens
ggcagtctgaaccct

SEQ ID NO: 3376931 - DNA, 13 bp, Homo sapiens
ggcagtgactggc

SEQ ID NO: 3376932 - DNA, 16 bp, Homo sapiens
ggcagtgactggcagg

SEQ ID NO: 3376933 - DNA, 18 bp, Homo sapiens
ggcagtgactggcaggtg

SEQ ID NO: 3376934 - DNA, 15 bp, Homo sapiens
ggcagtgccacccgc

SEQ ID NO: 3376935 - DNA, 19 bp, Homo sapiens
ggcagtgccacccgcagat

SEQ ID NO: 3376936 - DNA, 14 bp, Homo sapiens
ggcagtgcccatgt

SEQ ID NO: 3376937 - DNA, 17 bp, Homo sapiens
ggcagtggcaggggagc

SEQ ID NO: 3376938 - DNA, 16 bp, Homo sapiens
ggcagtgggagctgcc

SEQ ID NO: 3376939 - DNA, 13 bp, Homo sapiens
ggcagtgttttgg

SEQ ID NO: 3376940 - DNA, 19 bp, Homo sapiens
ggcagttctcactcctagg

SEQ ID NO: 3376941 - DNA, 21 bp, Homo sapiens
ggcagttctcactcctaggag

SEQ ID NO: 3376942 - DNA, 17 bp, Homo sapiens
ggcagttgaacagaggg

SEQ ID NO: 3376943 - DNA, 14 bp, Homo sapiens
ggcagttgcttgtg

SEQ ID NO: 3376944 - DNA, 20 bp, Homo sapiens
ggcagttgggtagatgggtg

SEQ ID NO: 3376945 - DNA, 22 bp, Homo sapiens
ggcagttgggtagatgggtggg

SEQ ID NO: 3376946 - DNA, 13 bp, Homo sapiens
ggcatcacagggc

SEQ ID NO: 3376947 - DNA, 23 bp, Homo sapiens
ggcatcacagggcagagccggga

SEQ ID NO: 3376948 - DNA, 12 bp, Homo sapiens
ggcatcaggcac

SEQ ID NO: 3376949 - DNA, 14 bp, Homo sapiens
ggcatcaggcactg

SEQ ID NO: 3376950 - DNA, 15 bp, Homo sapiens
ggcatcaggcactgg

SEQ ID NO: 3376951 - DNA, 18 bp, Homo sapiens
ggcatcaggcactggtgg

SEQ ID NO: 3376952 - DNA, 20 bp, Homo sapiens
ggcatcaggcactggtggca

SEQ ID NO: 3376953 - DNA, 18 bp, Homo sapiens
ggcatcagtccctatgta

SEQ ID NO: 3376954 - DNA, 20 bp, Homo sapiens
ggcatccacccagtgctgcc

SEQ ID NO: 3376955 - DNA, 22 bp, Homo sapiens
ggcatccacccagtgctgccat

SEQ ID NO: 3376956 - DNA, 23 bp, Homo sapiens
ggcatccacccagtgctgccatg

SEQ ID NO: 3376957 - DNA, 15 bp, Homo sapiens
ggcatcctgcctggg

SEQ ID NO: 3376958 - DNA, 21 bp, Homo sapiens
ggcatcgcaccattctgactc

SEQ ID NO: 3376959 - DNA, 14 bp, Homo sapiens
ggcatcgcaggagt

SEQ ID NO: 3376960 - DNA, 17 bp, Homo sapiens
ggcatctcctgtgcatg

SEQ ID NO: 3376961 - DNA, 15 bp, Homo sapiens
ggcatctgacacaaa

SEQ ID NO: 3376962 - DNA, 16 bp, Homo sapiens
ggcatctgacacaaaa

SEQ ID NO: 3376963 - DNA, 22 bp, Homo sapiens
ggcatctgcaccctcgatgaag

SEQ ID NO: 3376964 - DNA, 14 bp, Homo sapiens
ggcatctgcccctc

SEQ ID NO: 3376965 - DNA, 18 bp, Homo sapiens
ggcatctgcccctccccc

SEQ ID NO: 3376966 - DNA, 19 bp, Homo sapiens
ggcatctgcccctccccca

SEQ ID NO: 3376967 - DNA, 16 bp, Homo sapiens
ggcatctttgccttgg

SEQ ID NO: 3376968 - DNA, 22 bp, Homo sapiens
ggcatctttgccttgggctgct

SEQ ID NO: 3376969 - DNA, 16 bp, Homo sapiens
ggcatctttggggagg

SEQ ID NO: 3376970 - DNA, 23 bp, Homo sapiens
ggcatgagccactgagcctggcc

SEQ ID NO: 3376971 - DNA, 14 bp, Homo sapiens
ggcatgaggaggtc

SEQ ID NO: 3376972 - DNA, 13 bp, Homo sapiens
ggcatgccaccct

SEQ ID NO: 3376973 - DNA, 20 bp, Homo sapiens
ggcatgccccggccacctct

SEQ ID NO: 3376974 - DNA, 22 bp, Homo sapiens
ggcatgccccggccacctctgc

SEQ ID NO: 3376975 - DNA, 13 bp, Homo sapiens
ggcatgccttgtg

SEQ ID NO: 3376976 - DNA, 13 bp, Homo sapiens
ggcatgctggggc

SEQ ID NO: 3376977 - DNA, 17 bp, Homo sapiens
ggcatggccaggtggcc

SEQ ID NO: 3376978 - DNA, 16 bp, Homo sapiens
ggcatggccctggggt

SEQ ID NO: 3376979 - DNA, 17 bp, Homo sapiens
ggcatggccctggggtc

SEQ ID NO: 3376980 - DNA, 21 bp, Homo sapiens
ggcatgggaaagccacctctc

SEQ ID NO: 3376981 - DNA, 16 bp, Homo sapiens
ggcatggtaccagccc

SEQ ID NO: 3376982 - DNA, 19 bp, Homo sapiens
ggcatggtcccttaaggca

SEQ ID NO: 3376983 - DNA, 21 bp, Homo sapiens
ggcatggttccttccctggga

SEQ ID NO: 3376984 - DNA, 21 bp, Homo sapiens
ggcatgtgcctatagtcccag

SEQ ID NO: 3376985 - DNA, 14 bp, Homo sapiens
ggcatgtggagaca

SEQ ID NO: 3376986 - DNA, 13 bp, Homo sapiens
ggcatgtggcctg

SEQ ID NO: 3376987 - DNA, 14 bp, Homo sapiens
ggcatgtgtgcctg

SEQ ID NO: 3376988 - DNA, 19 bp, Homo sapiens
ggcatgtgtgcctgtggca

SEQ ID NO: 3376989 - DNA, 20 bp, Homo sapiens
ggcatgttctctgaggacac

SEQ ID NO: 3376990 - DNA, 19 bp, Homo sapiens
ggcatgttttgtgcatttg

SEQ ID NO: 3376991 - DNA, 17 bp, Homo sapiens
ggcattaccctctgcag

SEQ ID NO: 3376992 - DNA, 17 bp, Homo sapiens
ggcattagaattattta

SEQ ID NO: 3376993 - DNA, 19 bp, Homo sapiens
ggcattagaattatttaaa

SEQ ID NO: 3376994 - DNA, 20 bp, Homo sapiens
ggcattatgtccactgtgta

SEQ ID NO: 3376995 - DNA, 15 bp, Homo sapiens
ggcattcctgcttat

SEQ ID NO: 3376996 - DNA, 17 bp, Homo sapiens
ggcattcgggccacagg

SEQ ID NO: 3376997 - DNA, 15 bp, Homo sapiens
ggcattcggggaagc

SEQ ID NO: 3376998 - DNA, 23 bp, Homo sapiens
ggcattcggggaagctgcacatg

SEQ ID NO: 3376999 - DNA, 12 bp, Homo sapiens
ggcattgctttc

SEQ ID NO: 3377000 - DNA, 13 bp, Homo sapiens
ggcattgctttcc

SEQ ID NO: 3377001 - DNA, 22 bp, Homo sapiens
ggcatttggtgagagtcaaagc

SEQ ID NO: 3377002 - DNA, 19 bp, Homo sapiens
ggccaaacccttgctttcc

SEQ ID NO: 3377003 - DNA, 20 bp, Homo sapiens
ggccaaacccttgctttcct

SEQ ID NO: 3377004 - DNA, 11 bp, Homo sapiens
ggccaaactgc

SEQ ID NO: 3377005 - DNA, 15 bp, Homo sapiens
ggccaaagccaaagc

SEQ ID NO: 3377006 - DNA, 22 bp, Homo sapiens
ggccaaatgcacaagctcagaa

SEQ ID NO: 3377007 - DNA, 19 bp, Homo sapiens
ggccaacatcgtgaaaccc

SEQ ID NO: 3377008 - DNA, 13 bp, Homo sapiens
ggccaaggcaggt

SEQ ID NO: 3377009 - DNA, 15 bp, Homo sapiens
ggccaaggtcctgct

SEQ ID NO: 3377010 - DNA, 12 bp, Homo sapiens
ggccaataaaaa

SEQ ID NO: 3377011 - DNA, 17 bp, Homo sapiens
ggccaatggaaacctca

SEQ ID NO: 3377012 - DNA, 20 bp, Homo sapiens
ggccacaacctgaaagacaa

SEQ ID NO: 3377013 - DNA, 16 bp, Homo sapiens
ggccacacccagcggc

SEQ ID NO: 3377014 - DNA, 21 bp, Homo sapiens
ggccacactattaccatgaga

SEQ ID NO: 3377015 - DNA, 13 bp, Homo sapiens
ggccacagccccc

SEQ ID NO: 3377016 - DNA, 22 bp, Homo sapiens
ggccacagcccccttgccctcc

SEQ ID NO: 3377017 - DNA, 12 bp, Homo sapiens
ggccacagccgc

SEQ ID NO: 3377018 - DNA, 14 bp, Homo sapiens
ggccacatacctct

SEQ ID NO: 3377019 - DNA, 18 bp, Homo sapiens
ggccacatacctctctga

SEQ ID NO: 3377020 - DNA, 14 bp, Homo sapiens
ggccacatttaata

SEQ ID NO: 3377021 - DNA, 16 bp, Homo sapiens
ggccaccagatgctga

SEQ ID NO: 3377022 - DNA, 12 bp, Homo sapiens
ggccaccaggct

SEQ ID NO: 3377023 - DNA, 13 bp, Homo sapiens
ggccaccaggctg

SEQ ID NO: 3377024 - DNA, 19 bp, Homo sapiens
ggccaccaggctggcgcag

SEQ ID NO: 3377025 - DNA, 13 bp, Homo sapiens
ggccacctcctcc

SEQ ID NO: 3377026 - DNA, 15 bp, Homo sapiens
ggccacctcctcccc

SEQ ID NO: 3377027 - DNA, 15 bp, Homo sapiens
ggccacctctccaag

SEQ ID NO: 3377028 - DNA, 12 bp, Homo sapiens
ggccacctctgc

SEQ ID NO: 3377029 - DNA, 20 bp, Homo sapiens
ggccacctgaggtgggccca

SEQ ID NO: 3377030 - DNA, 23 bp, Homo sapiens
ggccacctgaggtgggcccagga

SEQ ID NO: 3377031 - DNA, 19 bp, Homo sapiens
ggccacctgtagccatctg

SEQ ID NO: 3377032 - DNA, 13 bp, Homo sapiens
ggccactccgaga

SEQ ID NO: 3377033 - DNA, 12 bp, Homo sapiens
ggccactgggga

SEQ ID NO: 3377034 - DNA, 14 bp, Homo sapiens
ggccactggggact

SEQ ID NO: 3377035 - DNA, 21 bp, Homo sapiens
ggccactgtggccagagctgg

SEQ ID NO: 3377036 - DNA, 17 bp, Homo sapiens
ggccactttcagagccc

SEQ ID NO: 3377037 - DNA, 19 bp, Homo sapiens
ggccagaaggagggcagag

SEQ ID NO: 3377038 - DNA, 15 bp, Homo sapiens
ggccagactggaaga

SEQ ID NO: 3377039 - DNA, 18 bp, Homo sapiens
ggccagagagcctggtgc

SEQ ID NO: 3377040 - DNA, 21 bp, Homo sapiens
ggccagagagcctggtgctgc

SEQ ID NO: 3377041 - DNA, 12 bp, Homo sapiens
ggccagagaggg

SEQ ID NO: 3377042 - DNA, 15 bp, Homo sapiens
ggccagagagggccc

SEQ ID NO: 3377043 - DNA, 19 bp, Homo sapiens
ggccagagagggcccagct

SEQ ID NO: 3377044 - DNA, 21 bp, Homo sapiens
ggccagagagggcccagctgt

SEQ ID NO: 3377045 - DNA, 23 bp, Homo sapiens
ggccagagagggcccagctgtag

SEQ ID NO: 3377046 - DNA, 22 bp, Homo sapiens
ggccagagctggaaggcagggc

SEQ ID NO: 3377047 - DNA, 21 bp, Homo sapiens
ggccagaggaactgtccagag

SEQ ID NO: 3377048 - DNA, 18 bp, Homo sapiens
ggccagaggcccccagcc

SEQ ID NO: 3377049 - DNA, 19 bp, Homo sapiens
ggccagaggcccccagccc

SEQ ID NO: 3377050 - DNA, 22 bp, Homo sapiens
ggccagaggcccccagcccagg

SEQ ID NO: 3377051 - DNA, 18 bp, Homo sapiens
ggccagagggagctggaa

SEQ ID NO: 3377052 - DNA, 22 bp, Homo sapiens
ggccagagggagtgacagaggc

SEQ ID NO: 3377053 - DNA, 15 bp, Homo sapiens
ggccagagtggcctg

SEQ ID NO: 3377054 - DNA, 16 bp, Homo sapiens
ggccagagtggcctgg

SEQ ID NO: 3377055 - DNA, 15 bp, Homo sapiens
ggccagatgcaccag

SEQ ID NO: 3377056 - DNA, 15 bp, Homo sapiens
ggccagatggcccct

SEQ ID NO: 3377057 - DNA, 17 bp, Homo sapiens
ggccagcaacgcttgta

SEQ ID NO: 3377058 - DNA, 17 bp, Homo sapiens
ggccagcaaggcaggtt

SEQ ID NO: 3377059 - DNA, 12 bp, Homo sapiens
ggccagcaccct

SEQ ID NO: 3377060 - DNA, 20 bp, Homo sapiens
ggccagcaccctctcctggg

SEQ ID NO: 3377061 - DNA, 11 bp, Homo sapiens
ggccagccagg

SEQ ID NO: 3377062 - DNA, 17 bp, Homo sapiens
ggccagcccagccaggc

SEQ ID NO: 3377063 - DNA, 18 bp, Homo sapiens
ggccagcccagccaggcc

SEQ ID NO: 3377064 - DNA, 14 bp, Homo sapiens
ggccagccccaccc

SEQ ID NO: 3377065 - DNA, 23 bp, Homo sapiens
ggccagccccacccccagccagg

SEQ ID NO: 3377066 - DNA, 15 bp, Homo sapiens
ggccagcccggctgg

SEQ ID NO: 3377067 - DNA, 17 bp, Homo sapiens
ggccagccctgcagccc

SEQ ID NO: 3377068 - DNA, 19 bp, Homo sapiens
ggccagccctgcagcccaa

SEQ ID NO: 3377069 - DNA, 15 bp, Homo sapiens
ggccagcccttcctc

SEQ ID NO: 3377070 - DNA, 18 bp, Homo sapiens
ggccagcccttcctctca

SEQ ID NO: 3377071 - DNA, 21 bp, Homo sapiens
ggccagcctggggcctggcag

SEQ ID NO: 3377072 - DNA, 14 bp, Homo sapiens
ggccagcgggcaca

SEQ ID NO: 3377073 - DNA, 15 bp, Homo sapiens
ggccagcgggcacag

SEQ ID NO: 3377074 - DNA, 13 bp, Homo sapiens
ggccagcgtccca

SEQ ID NO: 3377075 - DNA, 21 bp, Homo sapiens
ggccagctcataaaatggaag

SEQ ID NO: 3377076 - DNA, 18 bp, Homo sapiens
ggccagctgcctgtgcct

SEQ ID NO: 3377077 - DNA, 21 bp, Homo sapiens
ggccagctgcctgtgcctgcc

SEQ ID NO: 3377078 - DNA, 22 bp, Homo sapiens
ggccagctgcctgtgcctgcca

SEQ ID NO: 3377079 - DNA, 21 bp, Homo sapiens
ggccaggaccacacagtcccc

SEQ ID NO: 3377080 - DNA, 13 bp, Homo sapiens
ggccaggactgag

SEQ ID NO: 3377081 - DNA, 15 bp, Homo sapiens
ggccaggactgagcc

SEQ ID NO: 3377082 - DNA, 23 bp, Homo sapiens
ggccaggagtttaagaccagcct

SEQ ID NO: 3377083 - DNA, 16 bp, Homo sapiens
ggccaggatggagggg

SEQ ID NO: 3377084 - DNA, 12 bp, Homo sapiens
ggccaggcacag

SEQ ID NO: 3377085 - DNA, 13 bp, Homo sapiens
ggccaggcacagg

SEQ ID NO: 3377086 - DNA, 18 bp, Homo sapiens
ggccaggcacagggcccg

SEQ ID NO: 3377087 - DNA, 14 bp, Homo sapiens
ggccaggcactgcc

SEQ ID NO: 3377088 - DNA, 22 bp, Homo sapiens
ggccaggcagatctgtgcccca

SEQ ID NO: 3377089 - DNA, 13 bp, Homo sapiens
ggccaggcccagg

SEQ ID NO: 3377090 - DNA, 20 bp, Homo sapiens
ggccaggcccaggcagagct

SEQ ID NO: 3377091 - DNA, 11 bp, Homo sapiens
ggccaggctgg

SEQ ID NO: 3377092 - DNA, 16 bp, Homo sapiens
ggccagggatctctct

SEQ ID NO: 3377093 - DNA, 23 bp, Homo sapiens
ggccagggcccctcaccctgcct

SEQ ID NO: 3377094 - DNA, 18 bp, Homo sapiens
ggccagggctgccctgag

SEQ ID NO: 3377095 - DNA, 14 bp, Homo sapiens
ggccagtccaggct

SEQ ID NO: 3377096 - DNA, 15 bp, Homo sapiens
ggccagtccccgagg

SEQ ID NO: 3377097 - DNA, 18 bp, Homo sapiens
ggccagtcctgcctggcc

SEQ ID NO: 3377098 - DNA, 17 bp, Homo sapiens
ggccagtctgggctgcc

SEQ ID NO: 3377099 - DNA, 18 bp, Homo sapiens
ggccagtctgtggatcag

SEQ ID NO: 3377100 - DNA, 23 bp, Homo sapiens
ggccagtctgtggatcagagatg

SEQ ID NO: 3377101 - DNA, 14 bp, Homo sapiens
ggccagtggggcct

SEQ ID NO: 3377102 - DNA, 15 bp, Homo sapiens
ggccagtggggcctg

SEQ ID NO: 3377103 - DNA, 16 bp, Homo sapiens
ggccagtgtctgggtt

SEQ ID NO: 3377104 - DNA, 20 bp, Homo sapiens
ggccagttgcccagagcact

SEQ ID NO: 3377105 - DNA, 19 bp, Homo sapiens
ggccataaacggttcctgg

SEQ ID NO: 3377106 - DNA, 19 bp, Homo sapiens
ggccatacttttgagaggg

SEQ ID NO: 3377107 - DNA, 16 bp, Homo sapiens
ggccatcacaggatgc

SEQ ID NO: 3377108 - DNA, 16 bp, Homo sapiens
ggccatccctgggccc

SEQ ID NO: 3377109 - DNA, 15 bp, Homo sapiens
ggccatctccctccc

SEQ ID NO: 3377110 - DNA, 17 bp, Homo sapiens
ggccatctccctcccca

SEQ ID NO: 3377111 - DNA, 23 bp, Homo sapiens
ggccatctgactgccaagccaga

SEQ ID NO: 3377112 - DNA, 19 bp, Homo sapiens
ggccatgcaattcatccca

SEQ ID NO: 3377113 - DNA, 13 bp, Homo sapiens
ggccatgctgagg

SEQ ID NO: 3377114 - DNA, 15 bp, Homo sapiens
ggccatgctgaggcc

SEQ ID NO: 3377115 - DNA, 13 bp, Homo sapiens
ggccatgggcctc

SEQ ID NO: 3377116 - DNA, 19 bp, Homo sapiens
ggccatggtacccccttct

SEQ ID NO: 3377117 - DNA, 20 bp, Homo sapiens
ggccatggtacccccttctg

SEQ ID NO: 3377118 - DNA, 13 bp, Homo sapiens
ggccatgtccaaa

SEQ ID NO: 3377119 - DNA, 15 bp, Homo sapiens
ggccatgtccaaaga

SEQ ID NO: 3377120 - DNA, 23 bp, Homo sapiens
ggccatgtccaaagaggctgccc

SEQ ID NO: 3377121 - DNA, 23 bp, Homo sapiens
ggccatgtgagccaccgctgcca

SEQ ID NO: 3377122 - DNA, 20 bp, Homo sapiens
ggcccaagagcagagtctgg

SEQ ID NO: 3377123 - DNA, 22 bp, Homo sapiens
ggcccaagccccatctcatcct

SEQ ID NO: 3377124 - DNA, 19 bp, Homo sapiens
ggcccaaggtcccctccac

SEQ ID NO: 3377125 - DNA, 20 bp, Homo sapiens
ggcccaaggtcccctccaca

SEQ ID NO: 3377126 - DNA, 15 bp, Homo sapiens
ggcccaagtcattgt

SEQ ID NO: 3377127 - DNA, 23 bp, Homo sapiens
ggcccacaggaggcaagcaagct

SEQ ID NO: 3377128 - DNA, 14 bp, Homo sapiens
ggcccaccagggtc

SEQ ID NO: 3377129 - DNA, 20 bp, Homo sapiens
ggcccaccatcaccaccgcc

SEQ ID NO: 3377130 - DNA, 12 bp, Homo sapiens
ggcccacctggc

SEQ ID NO: 3377131 - DNA, 15 bp, Homo sapiens
ggcccacctggccac

SEQ ID NO: 3377132 - DNA, 16 bp, Homo sapiens
ggcccacctggccacc

SEQ ID NO: 3377133 - DNA, 18 bp, Homo sapiens
ggcccagaactgccccca

SEQ ID NO: 3377134 - DNA, 20 bp, Homo sapiens
ggcccagagcgaggaaagga

SEQ ID NO: 3377135 - DNA, 23 bp, Homo sapiens
ggcccagaggctgagttttctct

SEQ ID NO: 3377136 - DNA, 20 bp, Homo sapiens
ggcccagagtttacattcta

SEQ ID NO: 3377137 - DNA, 15 bp, Homo sapiens
ggcccagcattgctg

SEQ ID NO: 3377138 - DNA, 20 bp, Homo sapiens
ggcccagcattgctggttct

SEQ ID NO: 3377139 - DNA, 14 bp, Homo sapiens
ggcccagcccagag

SEQ ID NO: 3377140 - DNA, 15 bp, Homo sapiens
ggcccagcccagagc

SEQ ID NO: 3377141 - DNA, 22 bp, Homo sapiens
ggcccagcccagagccacctgg

SEQ ID NO: 3377142 - DNA, 14 bp, Homo sapiens
ggcccagcccctag

SEQ ID NO: 3377143 - DNA, 12 bp, Homo sapiens
ggcccagccggc

SEQ ID NO: 3377144 - DNA, 16 bp, Homo sapiens
ggcccagccggcctct

SEQ ID NO: 3377145 - DNA, 17 bp, Homo sapiens
ggcccagccggcctctc

SEQ ID NO: 3377146 - DNA, 21 bp, Homo sapiens
ggcccagccggcctctctggc

SEQ ID NO: 3377147 - DNA, 15 bp, Homo sapiens
ggcccagcgcggcca

SEQ ID NO: 3377148 - DNA, 21 bp, Homo sapiens
ggcccagcgcggccagcgtcc

SEQ ID NO: 3377149 - DNA, 14 bp, Homo sapiens
ggcccagcgggcag

SEQ ID NO: 3377150 - DNA, 15 bp, Homo sapiens
ggcccagctgtagcc

SEQ ID NO: 3377151 - DNA, 16 bp, Homo sapiens
ggcccagctgtagcca

SEQ ID NO: 3377152 - DNA, 22 bp, Homo sapiens
ggcccagctgtagccatggctc

SEQ ID NO: 3377153 - DNA, 21 bp, Homo sapiens
ggcccaggatatttctgagag

SEQ ID NO: 3377154 - DNA, 12 bp, Homo sapiens
ggcccaggccta

SEQ ID NO: 3377155 - DNA, 14 bp, Homo sapiens
ggcccaggctggga

SEQ ID NO: 3377156 - DNA, 13 bp, Homo sapiens
ggcccagggaggg

SEQ ID NO: 3377157 - DNA, 21 bp, Homo sapiens
ggcccagggagggaagtgtga

SEQ ID NO: 3377158 - DNA, 22 bp, Homo sapiens
ggcccagtacctagctggctct

SEQ ID NO: 3377159 - DNA, 16 bp, Homo sapiens
ggcccagtgccactgc

SEQ ID NO: 3377160 - DNA, 17 bp, Homo sapiens
ggcccagtgccactgcc

SEQ ID NO: 3377161 - DNA, 22 bp, Homo sapiens
ggcccagtgtcaagttgtgctt

SEQ ID NO: 3377162 - DNA, 23 bp, Homo sapiens
ggcccagtgtcaagttgtgcttg

SEQ ID NO: 3377163 - DNA, 23 bp, Homo sapiens
ggcccataatagttagccctcag

SEQ ID NO: 3377164 - DNA, 22 bp, Homo sapiens
ggcccatagaaacatgacactg

SEQ ID NO: 3377165 - DNA, 18 bp, Homo sapiens
ggcccatagcagccagtt

SEQ ID NO: 3377166 - DNA, 15 bp, Homo sapiens
ggcccatctcagcct

SEQ ID NO: 3377167 - DNA, 15 bp, Homo sapiens
ggccccaccctgggc

SEQ ID NO: 3377168 - DNA, 19 bp, Homo sapiens
ggccccagaaggcagggaa

SEQ ID NO: 3377169 - DNA, 15 bp, Homo sapiens
ggccccagaggccct

SEQ ID NO: 3377170 - DNA, 18 bp, Homo sapiens
ggccccagaggccctgga

SEQ ID NO: 3377171 - DNA, 21 bp, Homo sapiens
ggccccagaggccctggaggt

SEQ ID NO: 3377172 - DNA, 17 bp, Homo sapiens
ggccccagatctgcctg

SEQ ID NO: 3377173 - DNA, 21 bp, Homo sapiens
ggccccagatctgcctgggcc

SEQ ID NO: 3377174 - DNA, 13 bp, Homo sapiens
ggccccagccctg

SEQ ID NO: 3377175 - DNA, 16 bp, Homo sapiens
ggccccagccctgctg

SEQ ID NO: 3377176 - DNA, 14 bp, Homo sapiens
ggccccagctctga

SEQ ID NO: 3377177 - DNA, 16 bp, Homo sapiens
ggccccagctctgagg

SEQ ID NO: 3377178 - DNA, 11 bp, Homo sapiens
ggccccaggag

SEQ ID NO: 3377179 - DNA, 12 bp, Homo sapiens
ggccccaggagg

SEQ ID NO: 3377180 - DNA, 15 bp, Homo sapiens
ggccccatgctctgc

SEQ ID NO: 3377181 - DNA, 20 bp, Homo sapiens
ggcccccaaacatagcccct

SEQ ID NO: 3377182 - DNA, 13 bp, Homo sapiens
ggcccccaataaa

SEQ ID NO: 3377183 - DNA, 15 bp, Homo sapiens
ggcccccaataaagg

SEQ ID NO: 3377184 - DNA, 20 bp, Homo sapiens
ggcccccaataaaggcagct

SEQ ID NO: 3377185 - DNA, 15 bp, Homo sapiens
ggcccccacttgcct

SEQ ID NO: 3377186 - DNA, 14 bp, Homo sapiens
ggcccccagcccag

SEQ ID NO: 3377187 - DNA, 18 bp, Homo sapiens
ggcccccagcccagggct

SEQ ID NO: 3377188 - DNA, 19 bp, Homo sapiens
ggcccccaggattccccca

SEQ ID NO: 3377189 - DNA, 22 bp, Homo sapiens
ggcccccaggattcccccagcc

SEQ ID NO: 3377190 - DNA, 12 bp, Homo sapiens
ggcccccagggg

SEQ ID NO: 3377191 - DNA, 13 bp, Homo sapiens
ggcccccaggggc

SEQ ID NO: 3377192 - DNA, 14 bp, Homo sapiens
ggcccccaggggca

SEQ ID NO: 3377193 - DNA, 18 bp, Homo sapiens
ggcccccaggggcaggac

SEQ ID NO: 3377194 - DNA, 13 bp, Homo sapiens
ggccccctccctg

SEQ ID NO: 3377195 - DNA, 13 bp, Homo sapiens
ggccccctgcatc

SEQ ID NO: 3377196 - DNA, 13 bp, Homo sapiens
ggccccgccaggg

SEQ ID NO: 3377197 - DNA, 15 bp, Homo sapiens
ggccccgccagggct

SEQ ID NO: 3377198 - DNA, 19 bp, Homo sapiens
ggccccgccagggctgggg

SEQ ID NO: 3377199 - DNA, 18 bp, Homo sapiens
ggccccggatcagagcag

SEQ ID NO: 3377200 - DNA, 23 bp, Homo sapiens
ggccccggatcagagcaggacct

SEQ ID NO: 3377201 - DNA, 24 bp, Homo sapiens
ggccccggatcagagcaggacctc

SEQ ID NO: 3377202 - DNA, 14 bp, Homo sapiens
ggccccggccccag

SEQ ID NO: 3377203 - DNA, 21 bp, Homo sapiens
ggccccggccccagccagagt

SEQ ID NO: 3377204 - DNA, 16 bp, Homo sapiens
ggccccgggctggaga

SEQ ID NO: 3377205 - DNA, 13 bp, Homo sapiens
ggccccggggctg

SEQ ID NO: 3377206 - DNA, 16 bp, Homo sapiens
ggccccggggctggca

SEQ ID NO: 3377207 - DNA, 18 bp, Homo sapiens
ggccccggggctggcaag

SEQ ID NO: 3377208 - DNA, 15 bp, Homo sapiens
ggccccgtggtgaca

SEQ ID NO: 3377209 - DNA, 14 bp, Homo sapiens
ggcccctcaacagc

SEQ ID NO: 3377210 - DNA, 14 bp, Homo sapiens
ggcccctcagagcc

SEQ ID NO: 3377211 - DNA, 14 bp, Homo sapiens
ggcccctccctctg

SEQ ID NO: 3377212 - DNA, 16 bp, Homo sapiens
ggcccctccctctgcc

SEQ ID NO: 3377213 - DNA, 21 bp, Homo sapiens
ggcccctcctagacccaggtg

SEQ ID NO: 3377214 - DNA, 21 bp, Homo sapiens
ggcccctcttattcctctagg

SEQ ID NO: 3377215 - DNA, 23 bp, Homo sapiens
ggcccctcttattcctctaggca

SEQ ID NO: 3377216 - DNA, 15 bp, Homo sapiens
ggcccctgaggactg

SEQ ID NO: 3377217 - DNA, 16 bp, Homo sapiens
ggcccctgaggactgg

SEQ ID NO: 3377218 - DNA, 17 bp, Homo sapiens
ggcccctgcatcccctt

SEQ ID NO: 3377219 - DNA, 13 bp, Homo sapiens
ggcccctgccacc

SEQ ID NO: 3377220 - DNA, 17 bp, Homo sapiens
ggcccctgcccggctgc

SEQ ID NO: 3377221 - DNA, 23 bp, Homo sapiens
ggcccctgctggttcagggttgg

SEQ ID NO: 3377222 - DNA, 16 bp, Homo sapiens
ggcccctgcttctcca

SEQ ID NO: 3377223 - DNA, 19 bp, Homo sapiens
ggcccctgcttctccagcc

SEQ ID NO: 3377224 - DNA, 20 bp, Homo sapiens
ggcccctgcttctccagcct

SEQ ID NO: 3377225 - DNA, 13 bp, Homo sapiens
ggcccctgggatg

SEQ ID NO: 3377226 - DNA, 23 bp, Homo sapiens
ggcccctgggcttggcctgctgt

SEQ ID NO: 3377227 - DNA, 23 bp, Homo sapiens
ggccccttctctccctgccagag

SEQ ID NO: 3377228 - DNA, 16 bp, Homo sapiens
ggccccttttcactcc

SEQ ID NO: 3377229 - DNA, 18 bp, Homo sapiens
ggccccttttcactccct

SEQ ID NO: 3377230 - DNA, 15 bp, Homo sapiens
ggcccgacagcctgg

SEQ ID NO: 3377231 - DNA, 17 bp, Homo sapiens
ggcccgacagcctggca

SEQ ID NO: 3377232 - DNA, 21 bp, Homo sapiens
ggcccgagatgtgacccacca

SEQ ID NO: 3377233 - DNA, 20 bp, Homo sapiens
ggcccgcaccccggcctcag

SEQ ID NO: 3377234 - DNA, 23 bp, Homo sapiens
ggcccgcaccccggcctcagggc

SEQ ID NO: 3377235 - DNA, 22 bp, Homo sapiens
ggcccgcagtgctgggaccaga

SEQ ID NO: 3377236 - DNA, 18 bp, Homo sapiens
ggcccggcagggcgggca

SEQ ID NO: 3377237 - DNA, 14 bp, Homo sapiens
ggcccggccacacc

SEQ ID NO: 3377238 - DNA, 15 bp, Homo sapiens
ggcccggccacaccc

SEQ ID NO: 3377239 - DNA, 18 bp, Homo sapiens
ggcccggccacacccagc

SEQ ID NO: 3377240 - DNA, 21 bp, Homo sapiens
ggcccggccacacccagcggc

SEQ ID NO: 3377241 - DNA, 13 bp, Homo sapiens
ggcccggccagcg

SEQ ID NO: 3377242 - DNA, 21 bp, Homo sapiens
ggcccggccagcgggcacagg

SEQ ID NO: 3377243 - DNA, 15 bp, Homo sapiens
ggcccggctccaggc

SEQ ID NO: 3377244 - DNA, 21 bp, Homo sapiens
ggcccggggggaccaggatga

SEQ ID NO: 3377245 - DNA, 20 bp, Homo sapiens
ggcccggtggcggcagggcc

SEQ ID NO: 3377246 - DNA, 13 bp, Homo sapiens
ggccctagcattg

SEQ ID NO: 3377247 - DNA, 15 bp, Homo sapiens
ggccctaggcccctc

SEQ ID NO: 3377248 - DNA, 17 bp, Homo sapiens
ggccctaggcccctcct

SEQ ID NO: 3377249 - DNA, 21 bp, Homo sapiens
ggccctaggggtcactgtact

SEQ ID NO: 3377250 - DNA, 19 bp, Homo sapiens
ggccctccctgactccctg

SEQ ID NO: 3377251 - DNA, 15 bp, Homo sapiens
ggccctcgacactca

SEQ ID NO: 3377252 - DNA, 17 bp, Homo sapiens
ggccctctttccctgcg

SEQ ID NO: 3377253 - DNA, 19 bp, Homo sapiens
ggccctgaggtgtgggggc

SEQ ID NO: 3377254 - DNA, 16 bp, Homo sapiens
ggccctgcagccagct

SEQ ID NO: 3377255 - DNA, 22 bp, Homo sapiens
ggccctgcagtgttcgcttggc

SEQ ID NO: 3377256 - DNA, 11 bp, Homo sapiens
ggccctgccca

SEQ ID NO: 3377257 - DNA, 15 bp, Homo sapiens
ggccctgccctctcc

SEQ ID NO: 3377258 - DNA, 14 bp, Homo sapiens
ggccctgccctgag

SEQ ID NO: 3377259 - DNA, 12 bp, Homo sapiens
ggccctgcctcc

SEQ ID NO: 3377260 - DNA, 9 bp, Homo sapiens
ggccctgct

SEQ ID NO: 3377261 - DNA, 14 bp, Homo sapiens
ggccctgctacctg

SEQ ID NO: 3377262 - DNA, 18 bp, Homo sapiens
ggccctgctcctgcagca

SEQ ID NO: 3377263 - DNA, 13 bp, Homo sapiens
ggccctgctgccc

SEQ ID NO: 3377264 - DNA, 22 bp, Homo sapiens
ggccctggaggaattcagctca

SEQ ID NO: 3377265 - DNA, 12 bp, Homo sapiens
ggccctggaggg

SEQ ID NO: 3377266 - DNA, 14 bp, Homo sapiens
ggccctggccagga

SEQ ID NO: 3377267 - DNA, 15 bp, Homo sapiens
ggccctggccaggac

SEQ ID NO: 3377268 - DNA, 22 bp, Homo sapiens
ggccctggctcccacaggccct

SEQ ID NO: 3377269 - DNA, 13 bp, Homo sapiens
ggccctgggcctc

SEQ ID NO: 3377270 - DNA, 16 bp, Homo sapiens
ggccctgggcctcagt

SEQ ID NO: 3377271 - DNA, 13 bp, Homo sapiens
ggccctgggctgg

SEQ ID NO: 3377272 - DNA, 12 bp, Homo sapiens
ggccctggtcct

SEQ ID NO: 3377273 - DNA, 17 bp, Homo sapiens
ggccctggtccttccag

SEQ ID NO: 3377274 - DNA, 16 bp, Homo sapiens
ggccctgtccctccca

SEQ ID NO: 3377275 - DNA, 17 bp, Homo sapiens
ggccctgtccctcccac

SEQ ID NO: 3377276 - DNA, 11 bp, Homo sapiens
ggccctgtgta

SEQ ID NO: 3377277 - DNA, 20 bp, Homo sapiens
ggccctgtgtaggggcaggg

SEQ ID NO: 3377278 - DNA, 20 bp, Homo sapiens
ggcccttacttgcttctcta

SEQ ID NO: 3377279 - DNA, 13 bp, Homo sapiens
ggcccttcctctc

SEQ ID NO: 3377280 - DNA, 19 bp, Homo sapiens
ggcccttcctctccactgc

SEQ ID NO: 3377281 - DNA, 20 bp, Homo sapiens
ggcccttgcctttgtggcct

SEQ ID NO: 3377282 - DNA, 13 bp, Homo sapiens
ggcccttggaata

SEQ ID NO: 3377283 - DNA, 17 bp, Homo sapiens
ggcccttggaataaagt

SEQ ID NO: 3377284 - DNA, 16 bp, Homo sapiens
ggcccttggggcctgg

SEQ ID NO: 3377285 - DNA, 17 bp, Homo sapiens
ggcccttggggcctggc

SEQ ID NO: 3377286 - DNA, 18 bp, Homo sapiens
ggcccttggggcctggct

SEQ ID NO: 3377287 - DNA, 20 bp, Homo sapiens
ggcccttggggcctggcttg

SEQ ID NO: 3377288 - DNA, 20 bp, Homo sapiens
ggcccttgtcctgccagctg

SEQ ID NO: 3377289 - DNA, 15 bp, Homo sapiens
ggccctttccccttc

SEQ ID NO: 3377290 - DNA, 19 bp, Homo sapiens
ggccctttccttccagatc

SEQ ID NO: 3377291 - DNA, 19 bp, Homo sapiens
ggccctttgaagcctcagc

SEQ ID NO: 3377292 - DNA, 16 bp, Homo sapiens
ggccgaagctctggct

SEQ ID NO: 3377293 - DNA, 17 bp, Homo sapiens
ggccgaaggtgcctcag

SEQ ID NO: 3377294 - DNA, 16 bp, Homo sapiens
ggccgactctgcactc

SEQ ID NO: 3377295 - DNA, 20 bp, Homo sapiens
ggccgactctgcactctcca

SEQ ID NO: 3377296 - DNA, 18 bp, Homo sapiens
ggccgagcgttcccagca

SEQ ID NO: 3377297 - DNA, 12 bp, Homo sapiens
ggccgaggccca

SEQ ID NO: 3377298 - DNA, 13 bp, Homo sapiens
ggccgaggcccag

SEQ ID NO: 3377299 - DNA, 18 bp, Homo sapiens
ggccgaggcccagcgggc

SEQ ID NO: 3377300 - DNA, 12 bp, Homo sapiens
ggccgaggcggg

SEQ ID NO: 3377301 - DNA, 13 bp, Homo sapiens
ggccgcagagact

SEQ ID NO: 3377302 - DNA, 18 bp, Homo sapiens
ggccgccacccccatctt

SEQ ID NO: 3377303 - DNA, 22 bp, Homo sapiens
ggccgccacggcctggctggtg

SEQ ID NO: 3377304 - DNA, 16 bp, Homo sapiens
ggccgccccctgcccc

SEQ ID NO: 3377305 - DNA, 14 bp, Homo sapiens
ggccgccgcctctt

SEQ ID NO: 3377306 - DNA, 17 bp, Homo sapiens
ggccgcctgcgggctgc

SEQ ID NO: 3377307 - DNA, 13 bp, Homo sapiens
ggccgctccaggg

SEQ ID NO: 3377308 - DNA, 19 bp, Homo sapiens
ggccgctccaggggtggct

SEQ ID NO: 3377309 - DNA, 17 bp, Homo sapiens
ggccggaaccacagggc

SEQ ID NO: 3377310 - DNA, 16 bp, Homo sapiens
ggccggacgcatctca

SEQ ID NO: 3377311 - DNA, 16 bp, Homo sapiens
ggccggcctggcaccg

SEQ ID NO: 3377312 - DNA, 19 bp, Homo sapiens
ggccggctgtgctcagaga

SEQ ID NO: 3377313 - DNA, 19 bp, Homo sapiens
ggccgggcaggcgtgactc

SEQ ID NO: 3377314 - DNA, 18 bp, Homo sapiens
ggccggggaagctgccag

SEQ ID NO: 3377315 - DNA, 16 bp, Homo sapiens
ggccgggggaggtggg

SEQ ID NO: 3377316 - DNA, 21 bp, Homo sapiens
ggccggtctgcaagtcagagg

SEQ ID NO: 3377317 - DNA, 14 bp, Homo sapiens
ggccgtaccccacc

SEQ ID NO: 3377318 - DNA, 22 bp, Homo sapiens
ggccgtaccccaccctcagcac

SEQ ID NO: 3377319 - DNA, 15 bp, Homo sapiens
ggccgtctcctccct

SEQ ID NO: 3377320 - DNA, 16 bp, Homo sapiens
ggccgtgggggttgag

SEQ ID NO: 3377321 - DNA, 18 bp, Homo sapiens
ggccgtgtctctgaggac

SEQ ID NO: 3377322 - DNA, 16 bp, Homo sapiens
ggccgttccccttggc

SEQ ID NO: 3377323 - DNA, 17 bp, Homo sapiens
ggccgttccccttggct

SEQ ID NO: 3377324 - DNA, 22 bp, Homo sapiens
ggccgttccccttggcttcctc

SEQ ID NO: 3377325 - DNA, 18 bp, Homo sapiens
ggcctaaaactggcctga

SEQ ID NO: 3377326 - DNA, 20 bp, Homo sapiens
ggcctaaaactggcctgact

SEQ ID NO: 3377327 - DNA, 17 bp, Homo sapiens
ggcctaaaagtaaacat

SEQ ID NO: 3377328 - DNA, 23 bp, Homo sapiens
ggcctaagacatgtgaggaggaa

SEQ ID NO: 3377329 - DNA, 23 bp, Homo sapiens
ggcctaccccgcagacaccttgg

SEQ ID NO: 3377330 - DNA, 17 bp, Homo sapiens
ggcctagatccacacac

SEQ ID NO: 3377331 - DNA, 23 bp, Homo sapiens
ggcctagcgatctctcctggcct

SEQ ID NO: 3377332 - DNA, 13 bp, Homo sapiens
ggcctaggaggcc

SEQ ID NO: 3377333 - DNA, 21 bp, Homo sapiens
ggcctatgcacatatggactc

SEQ ID NO: 3377334 - DNA, 20 bp, Homo sapiens
ggcctcaaaggcccgctcta

SEQ ID NO: 3377335 - DNA, 17 bp, Homo sapiens
ggcctcaagagcacaca

SEQ ID NO: 3377336 - DNA, 13 bp, Homo sapiens
ggcctcacccacc

SEQ ID NO: 3377337 - DNA, 19 bp, Homo sapiens
ggcctcaccgagtgggggc

SEQ ID NO: 3377338 - DNA, 13 bp, Homo sapiens
ggcctcactggct

SEQ ID NO: 3377339 - DNA, 19 bp, Homo sapiens
ggcctcactggctggggca

SEQ ID NO: 3377340 - DNA, 14 bp, Homo sapiens
ggcctcagccctca

SEQ ID NO: 3377341 - DNA, 16 bp, Homo sapiens
ggcctcagctgcctca

SEQ ID NO: 3377342 - DNA, 22 bp, Homo sapiens
ggcctcagctgcctcacttcct

SEQ ID NO: 3377343 - DNA, 15 bp, Homo sapiens
ggcctcaggctctgc

SEQ ID NO: 3377344 - DNA, 17 bp, Homo sapiens
ggcctcaggctctgcac

SEQ ID NO: 3377345 - DNA, 10 bp, Homo sapiens
ggcctcaggg

SEQ ID NO: 3377346 - DNA, 19 bp, Homo sapiens
ggcctcagggccaggaagg

SEQ ID NO: 3377347 - DNA, 16 bp, Homo sapiens
ggcctcagggcgctca

SEQ ID NO: 3377348 - DNA, 19 bp, Homo sapiens
ggcctcagggcgctcagac

SEQ ID NO: 3377349 - DNA, 19 bp, Homo sapiens
ggcctcagtttctccatca

SEQ ID NO: 3377350 - DNA, 18 bp, Homo sapiens
ggcctcatgcctgctgag

SEQ ID NO: 3377351 - DNA, 18 bp, Homo sapiens
ggcctcatgctggaggga

SEQ ID NO: 3377352 - DNA, 16 bp, Homo sapiens
ggcctcatgtggctgg

SEQ ID NO: 3377353 - DNA, 23 bp, Homo sapiens
ggcctccaacgcccctgtggcca

SEQ ID NO: 3377354 - DNA, 15 bp, Homo sapiens
ggcctccagaactca

SEQ ID NO: 3377355 - DNA, 18 bp, Homo sapiens
ggcctccagcctctcccg

SEQ ID NO: 3377356 - DNA, 21 bp, Homo sapiens
ggcctccagcctctcccggct

SEQ ID NO: 3377357 - DNA, 15 bp, Homo sapiens
ggcctccatcctgag

SEQ ID NO: 3377358 - DNA, 16 bp, Homo sapiens
ggcctccatcctgagg

SEQ ID NO: 3377359 - DNA, 11 bp, Homo sapiens
ggcctcccacc

SEQ ID NO: 3377360 - DNA, 20 bp, Homo sapiens
ggcctcccacccgatgctgc

SEQ ID NO: 3377361 - DNA, 21 bp, Homo sapiens
ggcctcccacccgatgctgct

SEQ ID NO: 3377362 - DNA, 23 bp, Homo sapiens
ggcctcccacccgatgctgcttt

SEQ ID NO: 3377363 - DNA, 14 bp, Homo sapiens
ggcctcccgaggag

SEQ ID NO: 3377364 - DNA, 17 bp, Homo sapiens
ggcctccctccttgggt

SEQ ID NO: 3377365 - DNA, 15 bp, Homo sapiens
ggcctccctctctct

SEQ ID NO: 3377366 - DNA, 12 bp, Homo sapiens
ggcctccctgct

SEQ ID NO: 3377367 - DNA, 11 bp, Homo sapiens
ggcctcctccc

SEQ ID NO: 3377368 - DNA, 19 bp, Homo sapiens
ggcctcctcggagagcagc

SEQ ID NO: 3377369 - DNA, 20 bp, Homo sapiens
ggcctcctcggagagcagca

SEQ ID NO: 3377370 - DNA, 21 bp, Homo sapiens
ggcctcctcggagagcagcag

SEQ ID NO: 3377371 - DNA, 21 bp, Homo sapiens
ggcctcctcttcaccccggca

SEQ ID NO: 3377372 - DNA, 23 bp, Homo sapiens
ggcctcgcctccccaccctcctc

SEQ ID NO: 3377373 - DNA, 17 bp, Homo sapiens
ggcctcgtgaggggcaa

SEQ ID NO: 3377374 - DNA, 19 bp, Homo sapiens
ggcctctaccacaagggct

SEQ ID NO: 3377375 - DNA, 15 bp, Homo sapiens
ggcctctctggcctc

SEQ ID NO: 3377376 - DNA, 16 bp, Homo sapiens
ggcctctctggcctcc

SEQ ID NO: 3377377 - DNA, 21 bp, Homo sapiens
ggcctctctggcctcccaccc

SEQ ID NO: 3377378 - DNA, 15 bp, Homo sapiens
ggcctcttccaccca

SEQ ID NO: 3377379 - DNA, 16 bp, Homo sapiens
ggcctcttgagcagtg

SEQ ID NO: 3377380 - DNA, 22 bp, Homo sapiens
ggcctcttgagcagtggctggt

SEQ ID NO: 3377381 - DNA, 19 bp, Homo sapiens
ggcctcttgggtcccccac

SEQ ID NO: 3377382 - DNA, 17 bp, Homo sapiens
ggcctgaaagaggctga

SEQ ID NO: 3377383 - DNA, 20 bp, Homo sapiens
ggcctgaccaaacagccaac

SEQ ID NO: 3377384 - DNA, 13 bp, Homo sapiens
ggcctgagctggg

SEQ ID NO: 3377385 - DNA, 20 bp, Homo sapiens
ggcctgaggcctgtgcctgt

SEQ ID NO: 3377386 - DNA, 20 bp, Homo sapiens
ggcctgatgctccctcccct

SEQ ID NO: 3377387 - DNA, 22 bp, Homo sapiens
ggcctgatgctccctcccctgc

SEQ ID NO: 3377388 - DNA, 13 bp, Homo sapiens
ggcctgatgctgc

SEQ ID NO: 3377389 - DNA, 19 bp, Homo sapiens
ggcctgcaaaccttcctgg

SEQ ID NO: 3377390 - DNA, 20 bp, Homo sapiens
ggcctgcaaaccttcctggg

SEQ ID NO: 3377391 - DNA, 13 bp, Homo sapiens
ggcctgcacacaa

SEQ ID NO: 3377392 - DNA, 14 bp, Homo sapiens
ggcctgcacacaag

SEQ ID NO: 3377393 - DNA, 14 bp, Homo sapiens
ggcctgcacagtga

SEQ ID NO: 3377394 - DNA, 14 bp, Homo sapiens
ggcctgcagaagga

SEQ ID NO: 3377395 - DNA, 19 bp, Homo sapiens
ggcctgcagcaggagtggt

SEQ ID NO: 3377396 - DNA, 20 bp, Homo sapiens
ggcctgcagcaggagtggtg

SEQ ID NO: 3377397 - DNA, 21 bp, Homo sapiens
ggcctgcccaatgctttggga

SEQ ID NO: 3377398 - DNA, 15 bp, Homo sapiens
ggcctgcctcccact

SEQ ID NO: 3377399 - DNA, 18 bp, Homo sapiens
ggcctgccttgaagccac

SEQ ID NO: 3377400 - DNA, 12 bp, Homo sapiens
ggcctgctggga

SEQ ID NO: 3377401 - DNA, 19 bp, Homo sapiens
ggcctgctgtgattccact

SEQ ID NO: 3377402 - DNA, 14 bp, Homo sapiens
ggcctggagatcct

SEQ ID NO: 3377403 - DNA, 15 bp, Homo sapiens
ggcctggagatcctc

SEQ ID NO: 3377404 - DNA, 17 bp, Homo sapiens
ggcctggagatcctcct

SEQ ID NO: 3377405 - DNA, 21 bp, Homo sapiens
ggcctggcagggaggtcaggc

SEQ ID NO: 3377406 - DNA, 12 bp, Homo sapiens
ggcctggccaga

SEQ ID NO: 3377407 - DNA, 16 bp, Homo sapiens
ggcctggccaggagct

SEQ ID NO: 3377408 - DNA, 12 bp, Homo sapiens
ggcctggccctg

SEQ ID NO: 3377409 - DNA, 19 bp, Homo sapiens
ggcctggccctgccctgag

SEQ ID NO: 3377410 - DNA, 11 bp, Homo sapiens
ggcctggcctg

SEQ ID NO: 3377411 - DNA, 14 bp, Homo sapiens
ggcctggctcccca

SEQ ID NO: 3377412 - DNA, 15 bp, Homo sapiens
ggcctggctccccac

SEQ ID NO: 3377413 - DNA, 12 bp, Homo sapiens
ggcctggctgga

SEQ ID NO: 3377414 - DNA, 16 bp, Homo sapiens
ggcctgggacccagct

SEQ ID NO: 3377415 - DNA, 20 bp, Homo sapiens
ggcctgggagggttcccctg

SEQ ID NO: 3377416 - DNA, 20 bp, Homo sapiens
ggcctgggatgctagcccca

SEQ ID NO: 3377417 - DNA, 22 bp, Homo sapiens
ggcctgggatgctagccccaga

SEQ ID NO: 3377418 - DNA, 15 bp, Homo sapiens
ggcctgggccgctgc

SEQ ID NO: 3377419 - DNA, 17 bp, Homo sapiens
ggcctgggcctctgccc

SEQ ID NO: 3377420 - DNA, 13 bp, Homo sapiens
ggcctgggcctgc

SEQ ID NO: 3377421 - DNA, 14 bp, Homo sapiens
ggcctgggcctgct

SEQ ID NO: 3377422 - DNA, 15 bp, Homo sapiens
ggcctgggcctgctt

SEQ ID NO: 3377423 - DNA, 19 bp, Homo sapiens
ggcctgggggcagtgactg

SEQ ID NO: 3377424 - DNA, 14 bp, Homo sapiens
ggcctggggtgcat

SEQ ID NO: 3377425 - DNA, 21 bp, Homo sapiens
ggcctggggtgcatcctcctc

SEQ ID NO: 3377426 - DNA, 24 bp, Homo sapiens
ggcctggggtgcatcctcctcagc

SEQ ID NO: 3377427 - DNA, 14 bp, Homo sapiens
ggcctgggtctgtg

SEQ ID NO: 3377428 - DNA, 23 bp, Homo sapiens
ggcctgggtggatcggcctcctc

SEQ ID NO: 3377429 - DNA, 11 bp, Homo sapiens
ggcctggtccc

SEQ ID NO: 3377430 - DNA, 15 bp, Homo sapiens
ggcctgtcgtgccag

SEQ ID NO: 3377431 - DNA, 19 bp, Homo sapiens
ggcctgtctcatccccagg

SEQ ID NO: 3377432 - DNA, 23 bp, Homo sapiens
ggcctgtctcatccccaggggtc

SEQ ID NO: 3377433 - DNA, 13 bp, Homo sapiens
ggcctgtgcagca

SEQ ID NO: 3377434 - DNA, 21 bp, Homo sapiens
ggcctgtgcagcagcccagct

SEQ ID NO: 3377435 - DNA, 16 bp, Homo sapiens
ggcctgtggaatgagt

SEQ ID NO: 3377436 - DNA, 22 bp, Homo sapiens
ggcctgtggaatgagtgtgcat

SEQ ID NO: 3377437 - DNA, 20 bp, Homo sapiens
ggcctgtgggagcctgcaaa

SEQ ID NO: 3377438 - DNA, 20 bp, Homo sapiens
ggcctgtgtcccatgaccca

SEQ ID NO: 3377439 - DNA, 21 bp, Homo sapiens
ggcctgtgtcccatgacccac

SEQ ID NO: 3377440 - DNA, 22 bp, Homo sapiens
ggcctgtgtgtgaaaggaagct

SEQ ID NO: 3377441 - DNA, 11 bp, Homo sapiens
ggcctgttgcc

SEQ ID NO: 3377442 - DNA, 21 bp, Homo sapiens
ggcctgttgctatagagccta

SEQ ID NO: 3377443 - DNA, 24 bp, Homo sapiens
ggcctgttgctatagagcctacct

SEQ ID NO: 3377444 - DNA, 20 bp, Homo sapiens
ggcctgtttctgcagccctt

SEQ ID NO: 3377445 - DNA, 22 bp, Homo sapiens
ggcctgtttgatgtatgtgtga

SEQ ID NO: 3377446 - DNA, 23 bp, Homo sapiens
ggccttaaaaggggcccaagccc

SEQ ID NO: 3377447 - DNA, 21 bp, Homo sapiens
ggccttccccttttgcctggc

SEQ ID NO: 3377448 - DNA, 22 bp, Homo sapiens
ggccttcggcctccatcctgag

SEQ ID NO: 3377449 - DNA, 23 bp, Homo sapiens
ggccttcggcctccatcctgagg

SEQ ID NO: 3377450 - DNA, 12 bp, Homo sapiens
ggccttctctga

SEQ ID NO: 3377451 - DNA, 18 bp, Homo sapiens
ggccttctgctgcccagg

SEQ ID NO: 3377452 - DNA, 18 bp, Homo sapiens
ggccttgctgctgctgca

SEQ ID NO: 3377453 - DNA, 12 bp, Homo sapiens
ggccttggaaat

SEQ ID NO: 3377454 - DNA, 21 bp, Homo sapiens
ggcctttaagaaccttaatga

SEQ ID NO: 3377455 - DNA, 24 bp, Homo sapiens
ggcctttaagaaccttaatgacaa

SEQ ID NO: 3377456 - DNA, 14 bp, Homo sapiens
ggcctttcctctct

SEQ ID NO: 3377457 - DNA, 17 bp, Homo sapiens
ggccttttaacattttg

SEQ ID NO: 3377458 - DNA, 22 bp, Homo sapiens
ggccttttagaaacctcattgg

SEQ ID NO: 3377459 - DNA, 23 bp, Homo sapiens
ggccttttgttaaacccttctgt

SEQ ID NO: 3377460 - DNA, 16 bp, Homo sapiens
ggcgagagaggagcca

SEQ ID NO: 3377461 - DNA, 18 bp, Homo sapiens
ggcgagtccaggagctca

SEQ ID NO: 3377462 - DNA, 23 bp, Homo sapiens
ggcgagtccaggagctcaggaag

SEQ ID NO: 3377463 - DNA, 22 bp, Homo sapiens
ggcgatccacctgtctcagcct

SEQ ID NO: 3377464 - DNA, 14 bp, Homo sapiens
ggcgatgccacgct

SEQ ID NO: 3377465 - DNA, 22 bp, Homo sapiens
ggcgatgctccctcagcctcag

SEQ ID NO: 3377466 - DNA, 17 bp, Homo sapiens
ggcgcaatctcggctca

SEQ ID NO: 3377467 - DNA, 15 bp, Homo sapiens
ggcgcagccaaggcc

SEQ ID NO: 3377468 - DNA, 11 bp, Homo sapiens
ggcgcaggagg

SEQ ID NO: 3377469 - DNA, 13 bp, Homo sapiens
ggcgcaggcccag

SEQ ID NO: 3377470 - DNA, 23 bp, Homo sapiens
ggcgccaacgttcgatttctacc

SEQ ID NO: 3377471 - DNA, 14 bp, Homo sapiens
ggcgcccccagtgt

SEQ ID NO: 3377472 - DNA, 12 bp, Homo sapiens
ggcgccctggac

SEQ ID NO: 3377473 - DNA, 16 bp, Homo sapiens
ggcgccctggacttgg

SEQ ID NO: 3377474 - DNA, 22 bp, Homo sapiens
ggcgcctagagcgcggctggct

SEQ ID NO: 3377475 - DNA, 12 bp, Homo sapiens
ggcgcctggaga

SEQ ID NO: 3377476 - DNA, 13 bp, Homo sapiens
ggcgcctggagag

SEQ ID NO: 3377477 - DNA, 18 bp, Homo sapiens
ggcgcctggagagcgagg

SEQ ID NO: 3377478 - DNA, 20 bp, Homo sapiens
ggcgcctggagagcgaggag

SEQ ID NO: 3377479 - DNA, 18 bp, Homo sapiens
ggcgcggcctcccgagga

SEQ ID NO: 3377480 - DNA, 18 bp, Homo sapiens
ggcgcgggaggcaccagc

SEQ ID NO: 3377481 - DNA, 16 bp, Homo sapiens
ggcgcgggcagccacc

SEQ ID NO: 3377482 - DNA, 12 bp, Homo sapiens
ggcgctcagacg

SEQ ID NO: 3377483 - DNA, 19 bp, Homo sapiens
ggcgctcagacggcggcca

SEQ ID NO: 3377484 - DNA, 18 bp, Homo sapiens
ggcgctgccacctgcccc

SEQ ID NO: 3377485 - DNA, 11 bp, Homo sapiens
ggcgctggccc

SEQ ID NO: 3377486 - DNA, 12 bp, Homo sapiens
ggcgctggccca

SEQ ID NO: 3377487 - DNA, 14 bp, Homo sapiens
ggcgctggcccagc

SEQ ID NO: 3377488 - DNA, 18 bp, Homo sapiens
ggcgctggcccagccggc

SEQ ID NO: 3377489 - DNA, 19 bp, Homo sapiens
ggcgctggcccagccggcc

SEQ ID NO: 3377490 - DNA, 20 bp, Homo sapiens
ggcggcacaggtcgggcgca

SEQ ID NO: 3377491 - DNA, 12 bp, Homo sapiens
ggcggcagcagc

SEQ ID NO: 3377492 - DNA, 18 bp, Homo sapiens
ggcggcaggggcctggag

SEQ ID NO: 3377493 - DNA, 21 bp, Homo sapiens
ggcggccacgcactgggccac

SEQ ID NO: 3377494 - DNA, 14 bp, Homo sapiens
ggcggccaggcaca

SEQ ID NO: 3377495 - DNA, 16 bp, Homo sapiens
ggcggccaggcacagg

SEQ ID NO: 3377496 - DNA, 22 bp, Homo sapiens
ggcggccaggcacagggcccgc

SEQ ID NO: 3377497 - DNA, 16 bp, Homo sapiens
ggcggcccggccagcg

SEQ ID NO: 3377498 - DNA, 14 bp, Homo sapiens
ggcggcggccacgc

SEQ ID NO: 3377499 - DNA, 16 bp, Homo sapiens
ggcggcgggcggctgg

SEQ ID NO: 3377500 - DNA, 17 bp, Homo sapiens
ggcggcttcctgtccac

SEQ ID NO: 3377501 - DNA, 14 bp, Homo sapiens
ggcgggcggtcagg

SEQ ID NO: 3377502 - DNA, 22 bp, Homo sapiens
ggcgggcttttctggggcccag

SEQ ID NO: 3377503 - DNA, 15 bp, Homo sapiens
ggcggggcccaggag

SEQ ID NO: 3377504 - DNA, 20 bp, Homo sapiens
ggcggtcttcaacatcctgc

SEQ ID NO: 3377505 - DNA, 17 bp, Homo sapiens
ggcggtgcccacaccgg

SEQ ID NO: 3377506 - DNA, 23 bp, Homo sapiens
ggcggtgcccacaccggggacag

SEQ ID NO: 3377507 - DNA, 14 bp, Homo sapiens
ggcggtggctgccc

SEQ ID NO: 3377508 - DNA, 19 bp, Homo sapiens
ggcgtaatgggcctgccca

SEQ ID NO: 3377509 - DNA, 19 bp, Homo sapiens
ggcgtcctttgggtgactc

SEQ ID NO: 3377510 - DNA, 14 bp, Homo sapiens
ggcgtgcagtggtg

SEQ ID NO: 3377511 - DNA, 21 bp, Homo sapiens
ggcgtgctggtcccctcctca

SEQ ID NO: 3377512 - DNA, 20 bp, Homo sapiens
ggcgtggagactggcaggcg

SEQ ID NO: 3377513 - DNA, 14 bp, Homo sapiens
ggcgtggaggagga

SEQ ID NO: 3377514 - DNA, 16 bp, Homo sapiens
ggcgtggcaaatataa

SEQ ID NO: 3377515 - DNA, 16 bp, Homo sapiens
ggcgtggtggcgggca

SEQ ID NO: 3377516 - DNA, 22 bp, Homo sapiens
ggcgtggtgtgtccctggacac

SEQ ID NO: 3377517 - DNA, 20 bp, Homo sapiens
ggcgttatttatggaccact

SEQ ID NO: 3377518 - DNA, 19 bp, Homo sapiens
ggcgttcacctccctgctc

SEQ ID NO: 3377519 - DNA, 18 bp, Homo sapiens
ggcgttgggagcctagct

SEQ ID NO: 3377520 - DNA, 18 bp, Homo sapiens
ggcgttttgtctgtgttg

SEQ ID NO: 3377521 - DNA, 17 bp, Homo sapiens
ggctaacctggacctgg

SEQ ID NO: 3377522 - DNA, 17 bp, Homo sapiens
ggctaactatatttgct

SEQ ID NO: 3377523 - DNA, 14 bp, Homo sapiens
ggctaagaggctgc

SEQ ID NO: 3377524 - DNA, 16 bp, Homo sapiens
ggctaagaggctgctg

SEQ ID NO: 3377525 - DNA, 22 bp, Homo sapiens
ggctaagatgagatttgccagc

SEQ ID NO: 3377526 - DNA, 20 bp, Homo sapiens
ggctaagtgatcctcccacc

SEQ ID NO: 3377527 - DNA, 18 bp, Homo sapiens
ggctaataaactgtatta

SEQ ID NO: 3377528 - DNA, 13 bp, Homo sapiens
ggctaatttaaca

SEQ ID NO: 3377529 - DNA, 19 bp, Homo sapiens
ggctacatcccagcctgtg

SEQ ID NO: 3377530 - DNA, 15 bp, Homo sapiens
ggctactgcagcttt

SEQ ID NO: 3377531 - DNA, 18 bp, Homo sapiens
ggctactgcagctttaca

SEQ ID NO: 3377532 - DNA, 23 bp, Homo sapiens
ggctactggcagctcctctcctt

SEQ ID NO: 3377533 - DNA, 16 bp, Homo sapiens
ggctagaggccagccc

SEQ ID NO: 3377534 - DNA, 20 bp, Homo sapiens
ggctaggacgttggcctcag

SEQ ID NO: 3377535 - DNA, 19 bp, Homo sapiens
ggctatagctacaggaagc

SEQ ID NO: 3377536 - DNA, 21 bp, Homo sapiens
ggctatcaaaagaaatagaaa

SEQ ID NO: 3377537 - DNA, 19 bp, Homo sapiens
ggctatgggggcactgagg

SEQ ID NO: 3377538 - DNA, 13 bp, Homo sapiens
ggctatttgaaat

SEQ ID NO: 3377539 - DNA, 14 bp, Homo sapiens
ggctatttgaaata

SEQ ID NO: 3377540 - DNA, 16 bp, Homo sapiens
ggctatttgtgtgtat

SEQ ID NO: 3377541 - DNA, 15 bp, Homo sapiens
ggctatttgttcaga

SEQ ID NO: 3377542 - DNA, 16 bp, Homo sapiens
ggctcaagtagaaaag

SEQ ID NO: 3377543 - DNA, 15 bp, Homo sapiens
ggctcaagtcctctt

SEQ ID NO: 3377544 - DNA, 21 bp, Homo sapiens
ggctcaagtcctcttttctga

SEQ ID NO: 3377545 - DNA, 15 bp, Homo sapiens
ggctcacacctgcaa

SEQ ID NO: 3377546 - DNA, 22 bp, Homo sapiens
ggctcacacctgcaatcccagc

SEQ ID NO: 3377547 - DNA, 23 bp, Homo sapiens
ggctcacagtacagcatgtgcct

SEQ ID NO: 3377548 - DNA, 19 bp, Homo sapiens
ggctcacggggcctccaac

SEQ ID NO: 3377549 - DNA, 21 bp, Homo sapiens
ggctcactgaaacctctgcct

SEQ ID NO: 3377550 - DNA, 15 bp, Homo sapiens
ggctcactgcagcct

SEQ ID NO: 3377551 - DNA, 14 bp, Homo sapiens
ggctcactgccagg

SEQ ID NO: 3377552 - DNA, 19 bp, Homo sapiens
ggctcactgccaggccagc

SEQ ID NO: 3377553 - DNA, 18 bp, Homo sapiens
ggctcagcggggacagct

SEQ ID NO: 3377554 - DNA, 12 bp, Homo sapiens
ggctcagggctg

SEQ ID NO: 3377555 - DNA, 14 bp, Homo sapiens
ggctcagggctgga

SEQ ID NO: 3377556 - DNA, 21 bp, Homo sapiens
ggctcatgcctgtaatctcag

SEQ ID NO: 3377557 - DNA, 12 bp, Homo sapiens
ggctccaacaga

SEQ ID NO: 3377558 - DNA, 18 bp, Homo sapiens
ggctccaagacctaggct

SEQ ID NO: 3377559 - DNA, 17 bp, Homo sapiens
ggctccacacctccacc

SEQ ID NO: 3377560 - DNA, 18 bp, Homo sapiens
ggctccagcaccttcttt

SEQ ID NO: 3377561 - DNA, 10 bp, Homo sapiens
ggctccaggc

SEQ ID NO: 3377562 - DNA, 22 bp, Homo sapiens
ggctccatgattctctgagtgg

SEQ ID NO: 3377563 - DNA, 16 bp, Homo sapiens
ggctccatgcctctgg

SEQ ID NO: 3377564 - DNA, 21 bp, Homo sapiens
ggctccatgcctctggaggcc

SEQ ID NO: 3377565 - DNA, 11 bp, Homo sapiens
ggctccatgct

SEQ ID NO: 3377566 - DNA, 22 bp, Homo sapiens
ggctcccagctcctttctcctg

SEQ ID NO: 3377567 - DNA, 12 bp, Homo sapiens
ggctcccagggg

SEQ ID NO: 3377568 - DNA, 23 bp, Homo sapiens
ggctcccaggggtctccctggct

SEQ ID NO: 3377569 - DNA, 13 bp, Homo sapiens
ggctccccagggc

SEQ ID NO: 3377570 - DNA, 14 bp, Homo sapiens
ggctccccagggct

SEQ ID NO: 3377571 - DNA, 17 bp, Homo sapiens
ggctccccatgtgtcct

SEQ ID NO: 3377572 - DNA, 21 bp, Homo sapiens
ggctccccatgtgtcctggtt

SEQ ID NO: 3377573 - DNA, 20 bp, Homo sapiens
ggctcccctttttcttcctc

SEQ ID NO: 3377574 - DNA, 15 bp, Homo sapiens
ggctcccggaattcc

SEQ ID NO: 3377575 - DNA, 15 bp, Homo sapiens
ggctccctcctccag

SEQ ID NO: 3377576 - DNA, 15 bp, Homo sapiens
ggctccctggcagga

SEQ ID NO: 3377577 - DNA, 18 bp, Homo sapiens
ggctccctttgctgctga

SEQ ID NO: 3377578 - DNA, 22 bp, Homo sapiens
ggctcctaggggaacagaccag

SEQ ID NO: 3377579 - DNA, 12 bp, Homo sapiens
ggctcctccttg

SEQ ID NO: 3377580 - DNA, 16 bp, Homo sapiens
ggctcctccttgccca

SEQ ID NO: 3377581 - DNA, 13 bp, Homo sapiens
ggctcctgagaaa

SEQ ID NO: 3377582 - DNA, 15 bp, Homo sapiens
ggctcctggctgcca

SEQ ID NO: 3377583 - DNA, 20 bp, Homo sapiens
ggctcctggctgccaggcgt

SEQ ID NO: 3377584 - DNA, 13 bp, Homo sapiens
ggctcctggtggc

SEQ ID NO: 3377585 - DNA, 20 bp, Homo sapiens
ggctccttcccatcgctgtc

SEQ ID NO: 3377586 - DNA, 17 bp, Homo sapiens
ggctcgaatctctgtgc

SEQ ID NO: 3377587 - DNA, 18 bp, Homo sapiens
ggctcgaatctctgtgcc

SEQ ID NO: 3377588 - DNA, 17 bp, Homo sapiens
ggctcgaggctggtgcc

SEQ ID NO: 3377589 - DNA, 18 bp, Homo sapiens
ggctcgaggctggtgcca

SEQ ID NO: 3377590 - DNA, 16 bp, Homo sapiens
ggctcgccatgccggg

SEQ ID NO: 3377591 - DNA, 17 bp, Homo sapiens
ggctcgccatgccgggg

SEQ ID NO: 3377592 - DNA, 23 bp, Homo sapiens
ggctcgctccctgtagctctgcc

SEQ ID NO: 3377593 - DNA, 14 bp, Homo sapiens
ggctcgtggccttc

SEQ ID NO: 3377594 - DNA, 17 bp, Homo sapiens
ggctctaattcacagtg

SEQ ID NO: 3377595 - DNA, 20 bp, Homo sapiens
ggctctccaaaggggctgct

SEQ ID NO: 3377596 - DNA, 23 bp, Homo sapiens
ggctctccaaaggggctgctggg

SEQ ID NO: 3377597 - DNA, 12 bp, Homo sapiens
ggctctccaagt

SEQ ID NO: 3377598 - DNA, 20 bp, Homo sapiens
ggctctccaagtgccagagg

SEQ ID NO: 3377599 - DNA, 23 bp, Homo sapiens
ggctctccaagtgccagaggtgg

SEQ ID NO: 3377600 - DNA, 23 bp, Homo sapiens
ggctctctgagactctttagagc

SEQ ID NO: 3377601 - DNA, 14 bp, Homo sapiens
ggctctgaaagcca

SEQ ID NO: 3377602 - DNA, 18 bp, Homo sapiens
ggctctgagagtctagat

SEQ ID NO: 3377603 - DNA, 20 bp, Homo sapiens
ggctctgcaattcccctctg

SEQ ID NO: 3377604 - DNA, 15 bp, Homo sapiens
ggctctgcactaaga

SEQ ID NO: 3377605 - DNA, 23 bp, Homo sapiens
ggctctgccccagctctggcttc

SEQ ID NO: 3377606 - DNA, 21 bp, Homo sapiens
ggctctgccctccctccttcc

SEQ ID NO: 3377607 - DNA, 15 bp, Homo sapiens
ggctctggagacagc

SEQ ID NO: 3377608 - DNA, 17 bp, Homo sapiens
ggctctggagacagccc

SEQ ID NO: 3377609 - DNA, 17 bp, Homo sapiens
ggctctggcccttgcct

SEQ ID NO: 3377610 - DNA, 14 bp, Homo sapiens
ggctctgggctcag

SEQ ID NO: 3377611 - DNA, 20 bp, Homo sapiens
ggctctgggctcagggctgg

SEQ ID NO: 3377612 - DNA, 19 bp, Homo sapiens
ggctcttagcagcttccag

SEQ ID NO: 3377613 - DNA, 20 bp, Homo sapiens
ggctcttatgtgtgcctttg

SEQ ID NO: 3377614 - DNA, 16 bp, Homo sapiens
ggctcttcctggacct

SEQ ID NO: 3377615 - DNA, 19 bp, Homo sapiens
ggctcttcctggacctgag

SEQ ID NO: 3377616 - DNA, 14 bp, Homo sapiens
ggctcttctccttt

SEQ ID NO: 3377617 - DNA, 15 bp, Homo sapiens
ggctcttctcctttc

SEQ ID NO: 3377618 - DNA, 19 bp, Homo sapiens
ggctcttgatacccccctc

SEQ ID NO: 3377619 - DNA, 23 bp, Homo sapiens
ggctcttgtgctggatggagccc

SEQ ID NO: 3377620 - DNA, 13 bp, Homo sapiens
ggctctttcagag

SEQ ID NO: 3377621 - DNA, 15 bp, Homo sapiens
ggctctttccttgct

SEQ ID NO: 3377622 - DNA, 15 bp, Homo sapiens
ggctgaaccctgtgc

SEQ ID NO: 3377623 - DNA, 16 bp, Homo sapiens
ggctgaaccctgtgct

SEQ ID NO: 3377624 - DNA, 20 bp, Homo sapiens
ggctgaaccctgtgctggtg

SEQ ID NO: 3377625 - DNA, 23 bp, Homo sapiens
ggctgaaccctgtgctggtgtcc

SEQ ID NO: 3377626 - DNA, 21 bp, Homo sapiens
ggctgaatccgtggtggcacc

SEQ ID NO: 3377627 - DNA, 17 bp, Homo sapiens
ggctgacacctaccatg

SEQ ID NO: 3377628 - DNA, 19 bp, Homo sapiens
ggctgacacctaccatgct

SEQ ID NO: 3377629 - DNA, 20 bp, Homo sapiens
ggctgacacctaccatgctg

SEQ ID NO: 3377630 - DNA, 21 bp, Homo sapiens
ggctgacacctaccatgctgc

SEQ ID NO: 3377631 - DNA, 14 bp, Homo sapiens
ggctgacatctgtg

SEQ ID NO: 3377632 - DNA, 18 bp, Homo sapiens
ggctgacatctgtgtttc

SEQ ID NO: 3377633 - DNA, 22 bp, Homo sapiens
ggctgacatgaagctgttgtgt

SEQ ID NO: 3377634 - DNA, 20 bp, Homo sapiens
ggctgacccagcatctccca

SEQ ID NO: 3377635 - DNA, 21 bp, Homo sapiens
ggctgacccagcatctcccag

SEQ ID NO: 3377636 - DNA, 17 bp, Homo sapiens
ggctgacctgcctctca

SEQ ID NO: 3377637 - DNA, 13 bp, Homo sapiens
ggctgactggcca

SEQ ID NO: 3377638 - DNA, 23 bp, Homo sapiens
ggctgactggccagttgcccaga

SEQ ID NO: 3377639 - DNA, 16 bp, Homo sapiens
ggctgactggggctgg

SEQ ID NO: 3377640 - DNA, 18 bp, Homo sapiens
ggctgactggggctgggg

SEQ ID NO: 3377641 - DNA, 15 bp, Homo sapiens
ggctgacttcatctg

SEQ ID NO: 3377642 - DNA, 10 bp, Homo sapiens
ggctgagaag

SEQ ID NO: 3377643 - DNA, 13 bp, Homo sapiens
ggctgagaaggaa

SEQ ID NO: 3377644 - DNA, 14 bp, Homo sapiens
ggctgagaaggaac

SEQ ID NO: 3377645 - DNA, 19 bp, Homo sapiens
ggctgagaaggaacaggga

SEQ ID NO: 3377646 - DNA, 14 bp, Homo sapiens
ggctgagccctggc

SEQ ID NO: 3377647 - DNA, 15 bp, Homo sapiens
ggctgagctgagctt

SEQ ID NO: 3377648 - DNA, 21 bp, Homo sapiens
ggctgaggaagcacagcagca

SEQ ID NO: 3377649 - DNA, 14 bp, Homo sapiens
ggctgaggcagaag

SEQ ID NO: 3377650 - DNA, 15 bp, Homo sapiens
ggctgaggcaggaga

SEQ ID NO: 3377651 - DNA, 16 bp, Homo sapiens
ggctgaggcctggact

SEQ ID NO: 3377652 - DNA, 14 bp, Homo sapiens
ggctgagggcagct

SEQ ID NO: 3377653 - DNA, 17 bp, Homo sapiens
ggctgaggggcttggga

SEQ ID NO: 3377654 - DNA, 14 bp, Homo sapiens
ggctgaggttcctc

SEQ ID NO: 3377655 - DNA, 17 bp, Homo sapiens
ggctgaggttcctctgc

SEQ ID NO: 3377656 - DNA, 21 bp, Homo sapiens
ggctgaggttcctctgcctgc

SEQ ID NO: 3377657 - DNA, 22 bp, Homo sapiens
ggctgaggttcctctgcctgcc

SEQ ID NO: 3377658 - DNA, 17 bp, Homo sapiens
ggctgagtggggagcag

SEQ ID NO: 3377659 - DNA, 16 bp, Homo sapiens
ggctgatttacatgta

SEQ ID NO: 3377660 - DNA, 17 bp, Homo sapiens
ggctgatttacatgtat

SEQ ID NO: 3377661 - DNA, 23 bp, Homo sapiens
ggctgatttacatgtatggttac

SEQ ID NO: 3377662 - DNA, 22 bp, Homo sapiens
ggctgcaaagggtatcaggtgc

SEQ ID NO: 3377663 - DNA, 23 bp, Homo sapiens
ggctgcaaagggtatcaggtgct

SEQ ID NO: 3377664 - DNA, 18 bp, Homo sapiens
ggctgcagagctgaccca

SEQ ID NO: 3377665 - DNA, 13 bp, Homo sapiens
ggctgcagaggcc

SEQ ID NO: 3377666 - DNA, 16 bp, Homo sapiens
ggctgcagaggccaga

SEQ ID NO: 3377667 - DNA, 12 bp, Homo sapiens
ggctgcagggag

SEQ ID NO: 3377668 - DNA, 14 bp, Homo sapiens
ggctgcaggtggga

SEQ ID NO: 3377669 - DNA, 15 bp, Homo sapiens
ggctgcagtgagcca

SEQ ID NO: 3377670 - DNA, 15 bp, Homo sapiens
ggctgccaaggccag

SEQ ID NO: 3377671 - DNA, 11 bp, Homo sapiens
ggctgccaggc

SEQ ID NO: 3377672 - DNA, 12 bp, Homo sapiens
ggctgccaggcg

SEQ ID NO: 3377673 - DNA, 20 bp, Homo sapiens
ggctgcccagccccgctcag

SEQ ID NO: 3377674 - DNA, 19 bp, Homo sapiens
ggctgcccatcatgtggcc

SEQ ID NO: 3377675 - DNA, 20 bp, Homo sapiens
ggctgcccccaacactccag

SEQ ID NO: 3377676 - DNA, 17 bp, Homo sapiens
ggctgccccggcctcct

SEQ ID NO: 3377677 - DNA, 13 bp, Homo sapiens
ggctgcccctctc

SEQ ID NO: 3377678 - DNA, 16 bp, Homo sapiens
ggctgccctggccctg

SEQ ID NO: 3377679 - DNA, 17 bp, Homo sapiens
ggctgccctggccctga

SEQ ID NO: 3377680 - DNA, 20 bp, Homo sapiens
ggctgccctggccctgaggt

SEQ ID NO: 3377681 - DNA, 22 bp, Homo sapiens
ggctgccctggccctgaggtgt

SEQ ID NO: 3377682 - DNA, 21 bp, Homo sapiens
ggctgccgggttctagtctcc

SEQ ID NO: 3377683 - DNA, 18 bp, Homo sapiens
ggctgcgggaggccctgg

SEQ ID NO: 3377684 - DNA, 19 bp, Homo sapiens
ggctgcgggaggccctggc

SEQ ID NO: 3377685 - DNA, 22 bp, Homo sapiens
ggctgcgggaggccctggccct

SEQ ID NO: 3377686 - DNA, 15 bp, Homo sapiens
ggctgctcgcccagg

SEQ ID NO: 3377687 - DNA, 19 bp, Homo sapiens
ggctgctcgcccaggaagg

SEQ ID NO: 3377688 - DNA, 11 bp, Homo sapiens
ggctgctgccc

SEQ ID NO: 3377689 - DNA, 16 bp, Homo sapiens
ggctgctggggcatgt

SEQ ID NO: 3377690 - DNA, 14 bp, Homo sapiens
ggctgcttagaatc

SEQ ID NO: 3377691 - DNA, 16 bp, Homo sapiens
ggctgcttcctcctgg

SEQ ID NO: 3377692 - DNA, 14 bp, Homo sapiens
ggctggactggagg

SEQ ID NO: 3377693 - DNA, 14 bp, Homo sapiens
ggctggagaaagag

SEQ ID NO: 3377694 - DNA, 21 bp, Homo sapiens
ggctggagaaagagctgcctg

SEQ ID NO: 3377695 - DNA, 15 bp, Homo sapiens
ggctggaggcccagg

SEQ ID NO: 3377696 - DNA, 20 bp, Homo sapiens
ggctggagtgcagtggcgca

SEQ ID NO: 3377697 - DNA, 20 bp, Homo sapiens
ggctggagtgcagtggtgtg

SEQ ID NO: 3377698 - DNA, 16 bp, Homo sapiens
ggctggcaagcaggga

SEQ ID NO: 3377699 - DNA, 17 bp, Homo sapiens
ggctggcaagcagggaa

SEQ ID NO: 3377700 - DNA, 18 bp, Homo sapiens
ggctggcagctctccagt

SEQ ID NO: 3377701 - DNA, 20 bp, Homo sapiens
ggctggcagctctccagtca

SEQ ID NO: 3377702 - DNA, 13 bp, Homo sapiens
ggctggccactgc

SEQ ID NO: 3377703 - DNA, 12 bp, Homo sapiens
ggctggccagca

SEQ ID NO: 3377704 - DNA, 18 bp, Homo sapiens
ggctggccagcaaggcag

SEQ ID NO: 3377705 - DNA, 21 bp, Homo sapiens
ggctggccagtccaggctgcc

SEQ ID NO: 3377706 - DNA, 20 bp, Homo sapiens
ggctggccccagggcaccct

SEQ ID NO: 3377707 - DNA, 21 bp, Homo sapiens
ggctggcctaggagatatctg

SEQ ID NO: 3377708 - DNA, 19 bp, Homo sapiens
ggctggcctctggctctca

SEQ ID NO: 3377709 - DNA, 16 bp, Homo sapiens
ggctggcgcagccaag

SEQ ID NO: 3377710 - DNA, 17 bp, Homo sapiens
ggctggcgcagccaagg

SEQ ID NO: 3377711 - DNA, 19 bp, Homo sapiens
ggctggcgcagccaaggcc

SEQ ID NO: 3377712 - DNA, 20 bp, Homo sapiens
ggctggcgtgcagtggtgcg

SEQ ID NO: 3377713 - DNA, 11 bp, Homo sapiens
ggctggctcct

SEQ ID NO: 3377714 - DNA, 17 bp, Homo sapiens
ggctggctcctagggga

SEQ ID NO: 3377715 - DNA, 12 bp, Homo sapiens
ggctggctctgc

SEQ ID NO: 3377716 - DNA, 15 bp, Homo sapiens
ggctggctgcagtga

SEQ ID NO: 3377717 - DNA, 13 bp, Homo sapiens
ggctggctggcct

SEQ ID NO: 3377718 - DNA, 15 bp, Homo sapiens
ggctgggagcatagc

SEQ ID NO: 3377719 - DNA, 15 bp, Homo sapiens
ggctgggaggaaggg

SEQ ID NO: 3377720 - DNA, 15 bp, Homo sapiens
ggctgggaggaggaa

SEQ ID NO: 3377721 - DNA, 17 bp, Homo sapiens
ggctgggaggaggaaga

SEQ ID NO: 3377722 - DNA, 16 bp, Homo sapiens
ggctgggcagccccag

SEQ ID NO: 3377723 - DNA, 13 bp, Homo sapiens
ggctgggcccccc

SEQ ID NO: 3377724 - DNA, 15 bp, Homo sapiens
ggctgggcccctggg

SEQ ID NO: 3377725 - DNA, 16 bp, Homo sapiens
ggctgggctcacaggc

SEQ ID NO: 3377726 - DNA, 20 bp, Homo sapiens
ggctgggctcacaggcctct

SEQ ID NO: 3377727 - DNA, 13 bp, Homo sapiens
ggctgggcttcag

SEQ ID NO: 3377728 - DNA, 18 bp, Homo sapiens
ggctgggcttcagtggca

SEQ ID NO: 3377729 - DNA, 21 bp, Homo sapiens
ggctgggcttcagtggcagct

SEQ ID NO: 3377730 - DNA, 19 bp, Homo sapiens
ggctggggactgctacctc

SEQ ID NO: 3377731 - DNA, 15 bp, Homo sapiens
ggctggggaggacct

SEQ ID NO: 3377732 - DNA, 16 bp, Homo sapiens
ggctggggaggacctg

SEQ ID NO: 3377733 - DNA, 12 bp, Homo sapiens
ggctggggcaga

SEQ ID NO: 3377734 - DNA, 14 bp, Homo sapiens
ggctggggcagagg

SEQ ID NO: 3377735 - DNA, 16 bp, Homo sapiens
ggctggggcagagggg

SEQ ID NO: 3377736 - DNA, 22 bp, Homo sapiens
ggctggggcagaggggcagccg

SEQ ID NO: 3377737 - DNA, 18 bp, Homo sapiens
ggctgggggcaggagggc

SEQ ID NO: 3377738 - DNA, 19 bp, Homo sapiens
ggctgggggcctcagtgcc

SEQ ID NO: 3377739 - DNA, 16 bp, Homo sapiens
ggctgggggtgctgga

SEQ ID NO: 3377740 - DNA, 19 bp, Homo sapiens
ggctgggtcagggccagac

SEQ ID NO: 3377741 - DNA, 22 bp, Homo sapiens
ggctgggtgaccgactacccca

SEQ ID NO: 3377742 - DNA, 20 bp, Homo sapiens
ggctgggtggcacaccaccc

SEQ ID NO: 3377743 - DNA, 19 bp, Homo sapiens
ggctgggtgggcccagaac

SEQ ID NO: 3377744 - DNA, 17 bp, Homo sapiens
ggctggtagctcaggtg

SEQ ID NO: 3377745 - DNA, 23 bp, Homo sapiens
ggctggtccagggctagtgactt

SEQ ID NO: 3377746 - DNA, 16 bp, Homo sapiens
ggctggtccgagctga

SEQ ID NO: 3377747 - DNA, 21 bp, Homo sapiens
ggctggtgccccacagctacc

SEQ ID NO: 3377748 - DNA, 18 bp, Homo sapiens
ggctggtgggaaggccgg

SEQ ID NO: 3377749 - DNA, 13 bp, Homo sapiens
ggctggttttgta

SEQ ID NO: 3377750 - DNA, 23 bp, Homo sapiens
ggctgtatcccatgagcctcagc

SEQ ID NO: 3377751 - DNA, 15 bp, Homo sapiens
ggctgtcaggacacc

SEQ ID NO: 3377752 - DNA, 22 bp, Homo sapiens
ggctgtcctgtacattgtggga

SEQ ID NO: 3377753 - DNA, 15 bp, Homo sapiens
ggctgtctgcctgta

SEQ ID NO: 3377754 - DNA, 13 bp, Homo sapiens
ggctgtgcctctg

SEQ ID NO: 3377755 - DNA, 19 bp, Homo sapiens
ggctgtggaccgtggacag

SEQ ID NO: 3377756 - DNA, 21 bp, Homo sapiens
ggctgtggaccgtggacaggc

SEQ ID NO: 3377757 - DNA, 22 bp, Homo sapiens
ggctgtggaccgtggacaggcc

SEQ ID NO: 3377758 - DNA, 23 bp, Homo sapiens
ggctgtggaccgtggacaggccc

SEQ ID NO: 3377759 - DNA, 21 bp, Homo sapiens
ggctgtggagcaaaaggcagc

SEQ ID NO: 3377760 - DNA, 13 bp, Homo sapiens
ggctgtggaggcc

SEQ ID NO: 3377761 - DNA, 13 bp, Homo sapiens
ggctgtggcacag

SEQ ID NO: 3377762 - DNA, 14 bp, Homo sapiens
ggctgtggcacaga

SEQ ID NO: 3377763 - DNA, 21 bp, Homo sapiens
ggctgtgggcctcaaggactt

SEQ ID NO: 3377764 - DNA, 13 bp, Homo sapiens
ggctgttccttgt

SEQ ID NO: 3377765 - DNA, 15 bp, Homo sapiens
ggctgttctgcactg

SEQ ID NO: 3377766 - DNA, 18 bp, Homo sapiens
ggctgttctgcactgaaa

SEQ ID NO: 3377767 - DNA, 21 bp, Homo sapiens
ggctgttctgtggttcctctg

SEQ ID NO: 3377768 - DNA, 17 bp, Homo sapiens
ggctgttggcactcaca

SEQ ID NO: 3377769 - DNA, 15 bp, Homo sapiens
ggctgttggcagtga

SEQ ID NO: 3377770 - DNA, 16 bp, Homo sapiens
ggctgttggctggggg

SEQ ID NO: 3377771 - DNA, 17 bp, Homo sapiens
ggctgtttagcagaact

SEQ ID NO: 3377772 - DNA, 18 bp, Homo sapiens
ggctgtttcgtgtagtgg

SEQ ID NO: 3377773 - DNA, 15 bp, Homo sapiens
ggcttaagaactgct

SEQ ID NO: 3377774 - DNA, 12 bp, Homo sapiens
ggcttaatgttt

SEQ ID NO: 3377775 - DNA, 14 bp, Homo sapiens
ggcttaatgtttat

SEQ ID NO: 3377776 - DNA, 13 bp, Homo sapiens
ggcttagtgccac

SEQ ID NO: 3377777 - DNA, 15 bp, Homo sapiens
ggcttagtgccaccc

SEQ ID NO: 3377778 - DNA, 22 bp, Homo sapiens
ggcttagtttgtgtgttgtctc

SEQ ID NO: 3377779 - DNA, 18 bp, Homo sapiens
ggcttattttaatgtgat

SEQ ID NO: 3377780 - DNA, 21 bp, Homo sapiens
ggcttattttaatgtgatgat

SEQ ID NO: 3377781 - DNA, 21 bp, Homo sapiens
ggcttcaagttgtaaaaatga

SEQ ID NO: 3377782 - DNA, 15 bp, Homo sapiens
ggcttcatttcaatc

SEQ ID NO: 3377783 - DNA, 21 bp, Homo sapiens
ggcttccagaaaaccccagca

SEQ ID NO: 3377784 - DNA, 17 bp, Homo sapiens
ggcttccaggctcttcc

SEQ ID NO: 3377785 - DNA, 20 bp, Homo sapiens
ggcttcccatagtggggcct

SEQ ID NO: 3377786 - DNA, 18 bp, Homo sapiens
ggcttcccgctcagccct

SEQ ID NO: 3377787 - DNA, 22 bp, Homo sapiens
ggcttcccgctcagccctccct

SEQ ID NO: 3377788 - DNA, 20 bp, Homo sapiens
ggcttcctccgtccacccag

SEQ ID NO: 3377789 - DNA, 23 bp, Homo sapiens
ggcttcctccgtccacccaggct

SEQ ID NO: 3377790 - DNA, 21 bp, Homo sapiens
ggcttcctctagaagccaagg

SEQ ID NO: 3377791 - DNA, 20 bp, Homo sapiens
ggcttcctgcgtcctcctca

SEQ ID NO: 3377792 - DNA, 12 bp, Homo sapiens
ggcttcctgtcc

SEQ ID NO: 3377793 - DNA, 13 bp, Homo sapiens
ggcttcctgtcca

SEQ ID NO: 3377794 - DNA, 14 bp, Homo sapiens
ggcttcctgtccac

SEQ ID NO: 3377795 - DNA, 17 bp, Homo sapiens
ggcttcggacaaaatat

SEQ ID NO: 3377796 - DNA, 21 bp, Homo sapiens
ggcttctccgccagcctcctc

SEQ ID NO: 3377797 - DNA, 14 bp, Homo sapiens
ggcttctcctgttt

SEQ ID NO: 3377798 - DNA, 20 bp, Homo sapiens
ggcttctcctgttttatata

SEQ ID NO: 3377799 - DNA, 14 bp, Homo sapiens
ggcttctgcaccct

SEQ ID NO: 3377800 - DNA, 21 bp, Homo sapiens
ggcttctgcaccctccaccct

SEQ ID NO: 3377801 - DNA, 13 bp, Homo sapiens
ggcttctggagcc

SEQ ID NO: 3377802 - DNA, 18 bp, Homo sapiens
ggcttctggagcccttgg

SEQ ID NO: 3377803 - DNA, 20 bp, Homo sapiens
ggcttctggagcccttgggt

SEQ ID NO: 3377804 - DNA, 18 bp, Homo sapiens
ggcttctgtgatgagctg

SEQ ID NO: 3377805 - DNA, 20 bp, Homo sapiens
ggcttgaagccaaagaaaaa

SEQ ID NO: 3377806 - DNA, 14 bp, Homo sapiens
ggcttgactggatg

SEQ ID NO: 3377807 - DNA, 13 bp, Homo sapiens
ggcttgctccagg

SEQ ID NO: 3377808 - DNA, 15 bp, Homo sapiens
ggcttgctccagggt

SEQ ID NO: 3377809 - DNA, 22 bp, Homo sapiens
ggcttgctccagggtcttgggc

SEQ ID NO: 3377810 - DNA, 18 bp, Homo sapiens
ggcttgcttgccgagcct

SEQ ID NO: 3377811 - DNA, 15 bp, Homo sapiens
ggcttggccttggca

SEQ ID NO: 3377812 - DNA, 22 bp, Homo sapiens
ggcttgggaaaaaaacttggca

SEQ ID NO: 3377813 - DNA, 17 bp, Homo sapiens
ggcttgggatttgctgt

SEQ ID NO: 3377814 - DNA, 12 bp, Homo sapiens
ggcttgtgaact

SEQ ID NO: 3377815 - DNA, 17 bp, Homo sapiens
ggctttaattgtataag

SEQ ID NO: 3377816 - DNA, 23 bp, Homo sapiens
ggctttacctttttgtatgtgaa

SEQ ID NO: 3377817 - DNA, 23 bp, Homo sapiens
ggctttcaaagctaaaatatata

SEQ ID NO: 3377818 - DNA, 24 bp, Homo sapiens
ggctttctccggggtctgtgctgt

SEQ ID NO: 3377819 - DNA, 12 bp, Homo sapiens
ggctttctggag

SEQ ID NO: 3377820 - DNA, 13 bp, Homo sapiens
ggctttctggaga

SEQ ID NO: 3377821 - DNA, 15 bp, Homo sapiens
ggctttgcaggctct

SEQ ID NO: 3377822 - DNA, 13 bp, Homo sapiens
ggctttgccttgc

SEQ ID NO: 3377823 - DNA, 15 bp, Homo sapiens
ggctttgccttgcag

SEQ ID NO: 3377824 - DNA, 15 bp, Homo sapiens
ggctttgtgcttggg

SEQ ID NO: 3377825 - DNA, 18 bp, Homo sapiens
ggcttttaccattagcat

SEQ ID NO: 3377826 - DNA, 23 bp, Homo sapiens
ggcttttaccattagcataattt

SEQ ID NO: 3377827 - DNA, 22 bp, Homo sapiens
ggcttttcactgcctgtagaga

SEQ ID NO: 3377828 - DNA, 22 bp, Homo sapiens
ggcttttcactgctggctgcct

SEQ ID NO: 3377829 - DNA, 16 bp, Homo sapiens
ggctttttcctctgag

SEQ ID NO: 3377830 - DNA, 20 bp, Homo sapiens
ggctttttcctctgagccca

SEQ ID NO: 3377831 - DNA, 21 bp, Homo sapiens
ggctttttcctctgagcccag

SEQ ID NO: 3377832 - DNA, 13 bp, Homo sapiens
gggaaaaaaaaaa

SEQ ID NO: 3377833 - DNA, 16 bp, Homo sapiens
gggaaaaaaaaaaaag

SEQ ID NO: 3377834 - DNA, 21 bp, Homo sapiens
gggaaaaaaaaaaaagaaaag

SEQ ID NO: 3377835 - DNA, 14 bp, Homo sapiens
gggaaacaaagaag

SEQ ID NO: 3377836 - DNA, 18 bp, Homo sapiens
gggaaactaagattcttt

SEQ ID NO: 3377837 - DNA, 12 bp, Homo sapiens
gggaaagaagaa

SEQ ID NO: 3377838 - DNA, 13 bp, Homo sapiens
gggaaagaagaaa

SEQ ID NO: 3377839 - DNA, 11 bp, Homo sapiens
gggaaaggaaa

SEQ ID NO: 3377840 - DNA, 17 bp, Homo sapiens
gggaaaggaaacgcccc

SEQ ID NO: 3377841 - DNA, 16 bp, Homo sapiens
gggaaagggaggaaga

SEQ ID NO: 3377842 - DNA, 20 bp, Homo sapiens
gggaaaggggttggggtgac

SEQ ID NO: 3377843 - DNA, 21 bp, Homo sapiens
gggaacaaaactgttcttttg

SEQ ID NO: 3377844 - DNA, 14 bp, Homo sapiens
gggaacagactgga

SEQ ID NO: 3377845 - DNA, 19 bp, Homo sapiens
gggaaccatgaagacagga

SEQ ID NO: 3377846 - DNA, 14 bp, Homo sapiens
gggaacccccttcc

SEQ ID NO: 3377847 - DNA, 16 bp, Homo sapiens
gggaaccccgcagccc

SEQ ID NO: 3377848 - DNA, 17 bp, Homo sapiens
gggaaccccgcagcccg

SEQ ID NO: 3377849 - DNA, 19 bp, Homo sapiens
gggaacctagtactctctg

SEQ ID NO: 3377850 - DNA, 13 bp, Homo sapiens
gggaacctgtgtc

SEQ ID NO: 3377851 - DNA, 18 bp, Homo sapiens
gggaactccactctcctt

SEQ ID NO: 3377852 - DNA, 19 bp, Homo sapiens
gggaactctgacaagggct

SEQ ID NO: 3377853 - DNA, 15 bp, Homo sapiens
gggaagagggcagta

SEQ ID NO: 3377854 - DNA, 22 bp, Homo sapiens
gggaagataggctctgcacaga

SEQ ID NO: 3377855 - DNA, 17 bp, Homo sapiens
gggaagcagccagctcc

SEQ ID NO: 3377856 - DNA, 13 bp, Homo sapiens
gggaagctgcagc

SEQ ID NO: 3377857 - DNA, 19 bp, Homo sapiens
gggaagctgcagcttggga

SEQ ID NO: 3377858 - DNA, 15 bp, Homo sapiens
gggaagctgccagcc

SEQ ID NO: 3377859 - DNA, 16 bp, Homo sapiens
gggaagctggcctgag

SEQ ID NO: 3377860 - DNA, 22 bp, Homo sapiens
gggaagctgtactcagagcaga

SEQ ID NO: 3377861 - DNA, 13 bp, Homo sapiens
gggaaggacagga

SEQ ID NO: 3377862 - DNA, 13 bp, Homo sapiens
gggaaggagccag

SEQ ID NO: 3377863 - DNA, 15 bp, Homo sapiens
gggaaggcctgactt

SEQ ID NO: 3377864 - DNA, 12 bp, Homo sapiens
gggaagggccag

SEQ ID NO: 3377865 - DNA, 16 bp, Homo sapiens
gggaagggccagtctg

SEQ ID NO: 3377866 - DNA, 16 bp, Homo sapiens
gggaagggtttgaatt

SEQ ID NO: 3377867 - DNA, 21 bp, Homo sapiens
gggaaggtggggccctgcccc

SEQ ID NO: 3377868 - DNA, 12 bp, Homo sapiens
gggaatatttta

SEQ ID NO: 3377869 - DNA, 22 bp, Homo sapiens
gggaatcatttttcactgtaca

SEQ ID NO: 3377870 - DNA, 21 bp, Homo sapiens
gggaatccagctccctagact

SEQ ID NO: 3377871 - DNA, 17 bp, Homo sapiens
gggaatgagcccagaga

SEQ ID NO: 3377872 - DNA, 13 bp, Homo sapiens
gggaatgggagag

SEQ ID NO: 3377873 - DNA, 20 bp, Homo sapiens
gggaatgtattattctgcag

SEQ ID NO: 3377874 - DNA, 21 bp, Homo sapiens
gggaatgtattattctgcagc

SEQ ID NO: 3377875 - DNA, 17 bp, Homo sapiens
gggaatgttccctgcac

SEQ ID NO: 3377876 - DNA, 22 bp, Homo sapiens
gggaatgttccctgcaccctgg

SEQ ID NO: 3377877 - DNA, 23 bp, Homo sapiens
gggaatgttccctgcaccctgga

SEQ ID NO: 3377878 - DNA, 21 bp, Homo sapiens
gggaatgtttgcctctgcctc

SEQ ID NO: 3377879 - DNA, 18 bp, Homo sapiens
gggacaagggattctggg

SEQ ID NO: 3377880 - DNA, 20 bp, Homo sapiens
gggacacaaaactccgcccc

SEQ ID NO: 3377881 - DNA, 17 bp, Homo sapiens
gggacaccagagctgcc

SEQ ID NO: 3377882 - DNA, 16 bp, Homo sapiens
gggacacctgccctgc

SEQ ID NO: 3377883 - DNA, 18 bp, Homo sapiens
gggacagccagagctggg

SEQ ID NO: 3377884 - DNA, 19 bp, Homo sapiens
gggacagcccagagcctgg

SEQ ID NO: 3377885 - DNA, 21 bp, Homo sapiens
gggacagctccttctgtccta

SEQ ID NO: 3377886 - DNA, 13 bp, Homo sapiens
gggacaggcctca

SEQ ID NO: 3377887 - DNA, 17 bp, Homo sapiens
gggacaggcctcacctc

SEQ ID NO: 3377888 - DNA, 12 bp, Homo sapiens
gggacaggctga

SEQ ID NO: 3377889 - DNA, 19 bp, Homo sapiens
gggacaggctgaagagagg

SEQ ID NO: 3377890 - DNA, 15 bp, Homo sapiens
gggacagttggcaga

SEQ ID NO: 3377891 - DNA, 16 bp, Homo sapiens
gggacagttggcagag

SEQ ID NO: 3377892 - DNA, 19 bp, Homo sapiens
gggacagttggcagagaag

SEQ ID NO: 3377893 - DNA, 17 bp, Homo sapiens
gggacatgctcacctct

SEQ ID NO: 3377894 - DNA, 17 bp, Homo sapiens
gggacattgctctctgg

SEQ ID NO: 3377895 - DNA, 16 bp, Homo sapiens
gggaccagagccagat

SEQ ID NO: 3377896 - DNA, 18 bp, Homo sapiens
gggacccacggagccctc

SEQ ID NO: 3377897 - DNA, 21 bp, Homo sapiens
gggacccagctactctgtcca

SEQ ID NO: 3377898 - DNA, 22 bp, Homo sapiens
gggacccaggctccgcccttag

SEQ ID NO: 3377899 - DNA, 20 bp, Homo sapiens
gggacccatagatcttctga

SEQ ID NO: 3377900 - DNA, 22 bp, Homo sapiens
gggaccccaacctcagaggcag

SEQ ID NO: 3377901 - DNA, 20 bp, Homo sapiens
gggaccccactccctgctct

SEQ ID NO: 3377902 - DNA, 20 bp, Homo sapiens
gggaccggtgctgcaggagt

SEQ ID NO: 3377903 - DNA, 17 bp, Homo sapiens
gggactacaggcaccca

SEQ ID NO: 3377904 - DNA, 15 bp, Homo sapiens
gggactagcccctgt

SEQ ID NO: 3377905 - DNA, 16 bp, Homo sapiens
gggactcaatgcactg

SEQ ID NO: 3377906 - DNA, 16 bp, Homo sapiens
gggactcagccctgag

SEQ ID NO: 3377907 - DNA, 15 bp, Homo sapiens
gggactcctggtgcc

SEQ ID NO: 3377908 - DNA, 19 bp, Homo sapiens
gggactctgagcgggaggc

SEQ ID NO: 3377909 - DNA, 23 bp, Homo sapiens
gggactctgagcgggaggcagag

SEQ ID NO: 3377910 - DNA, 20 bp, Homo sapiens
gggactggggatgtgggagg

SEQ ID NO: 3377911 - DNA, 19 bp, Homo sapiens
gggactgttccaaagccag

SEQ ID NO: 3377912 - DNA, 15 bp, Homo sapiens
gggacttggaagctc

SEQ ID NO: 3377913 - DNA, 14 bp, Homo sapiens
gggacttgtgtctg

SEQ ID NO: 3377914 - DNA, 20 bp, Homo sapiens
gggagaaaaagaaacacaag

SEQ ID NO: 3377915 - DNA, 16 bp, Homo sapiens
gggagaagagccctgg

SEQ ID NO: 3377916 - DNA, 18 bp, Homo sapiens
gggagaaggaagggcaga

SEQ ID NO: 3377917 - DNA, 20 bp, Homo sapiens
gggagaaggaagggcagaga

SEQ ID NO: 3377918 - DNA, 14 bp, Homo sapiens
gggagacactggcc

SEQ ID NO: 3377919 - DNA, 21 bp, Homo sapiens
gggagacagcttctctgcagt

SEQ ID NO: 3377920 - DNA, 15 bp, Homo sapiens
gggagacatgtgaca

SEQ ID NO: 3377921 - DNA, 23 bp, Homo sapiens
gggagagagagagagagaggaca

SEQ ID NO: 3377922 - DNA, 16 bp, Homo sapiens
gggagagcaggctggc

SEQ ID NO: 3377923 - DNA, 12 bp, Homo sapiens
gggagagccagc

SEQ ID NO: 3377924 - DNA, 15 bp, Homo sapiens
gggagagccagctcc

SEQ ID NO: 3377925 - DNA, 15 bp, Homo sapiens
gggagagcccctggg

SEQ ID NO: 3377926 - DNA, 13 bp, Homo sapiens
gggagagcctgct

SEQ ID NO: 3377927 - DNA, 22 bp, Homo sapiens
gggagagctgagccagttgtcc

SEQ ID NO: 3377928 - DNA, 18 bp, Homo sapiens
gggagagggtgaaggagg

SEQ ID NO: 3377929 - DNA, 14 bp, Homo sapiens
gggagatggtcagt

SEQ ID NO: 3377930 - DNA, 22 bp, Homo sapiens
gggagatggtcagtgtggagag

SEQ ID NO: 3377931 - DNA, 14 bp, Homo sapiens
gggagcaagacaga

SEQ ID NO: 3377932 - DNA, 12 bp, Homo sapiens
gggagcaagccc

SEQ ID NO: 3377933 - DNA, 12 bp, Homo sapiens
gggagcacccag

SEQ ID NO: 3377934 - DNA, 20 bp, Homo sapiens
gggagcacttgcgtcctgca

SEQ ID NO: 3377935 - DNA, 23 bp, Homo sapiens
gggagcacttgcgtcctgcagag

SEQ ID NO: 3377936 - DNA, 16 bp, Homo sapiens
gggagcagacaggagg

SEQ ID NO: 3377937 - DNA, 12 bp, Homo sapiens
gggagcaggaga

SEQ ID NO: 3377938 - DNA, 18 bp, Homo sapiens
gggagcaggagattgaga

SEQ ID NO: 3377939 - DNA, 15 bp, Homo sapiens
gggagcaggaggcca

SEQ ID NO: 3377940 - DNA, 21 bp, Homo sapiens
gggagcaggttccccaagggc

SEQ ID NO: 3377941 - DNA, 21 bp, Homo sapiens
gggagcatagcagaggggcca

SEQ ID NO: 3377942 - DNA, 22 bp, Homo sapiens
gggagcatagcagaggggccag

SEQ ID NO: 3377943 - DNA, 21 bp, Homo sapiens
gggagcatttaatggcagcta

SEQ ID NO: 3377944 - DNA, 11 bp, Homo sapiens
gggagccagcc

SEQ ID NO: 3377945 - DNA, 13 bp, Homo sapiens
gggagccccaggg

SEQ ID NO: 3377946 - DNA, 16 bp, Homo sapiens
gggagccccagggtct

SEQ ID NO: 3377947 - DNA, 14 bp, Homo sapiens
gggagccctgacct

SEQ ID NO: 3377948 - DNA, 12 bp, Homo sapiens
gggagcctagct

SEQ ID NO: 3377949 - DNA, 21 bp, Homo sapiens
gggagcctagctcctgccaca

SEQ ID NO: 3377950 - DNA, 20 bp, Homo sapiens
gggagcctaggaccactcag

SEQ ID NO: 3377951 - DNA, 20 bp, Homo sapiens
gggagcctccccctcagatg

SEQ ID NO: 3377952 - DNA, 12 bp, Homo sapiens
gggagcctcctg

SEQ ID NO: 3377953 - DNA, 13 bp, Homo sapiens
gggagcctcctgc

SEQ ID NO: 3377954 - DNA, 21 bp, Homo sapiens
gggagcctttggttctggcca

SEQ ID NO: 3377955 - DNA, 16 bp, Homo sapiens
gggagctcctggccag

SEQ ID NO: 3377956 - DNA, 22 bp, Homo sapiens
gggagctgagctggaaggggcc

SEQ ID NO: 3377957 - DNA, 19 bp, Homo sapiens
gggagctggttagaaatgc

SEQ ID NO: 3377958 - DNA, 22 bp, Homo sapiens
gggagcttccgctttgaaagaa

SEQ ID NO: 3377959 - DNA, 12 bp, Homo sapiens
gggaggaaaaaa

SEQ ID NO: 3377960 - DNA, 13 bp, Homo sapiens
gggaggaaaaaag

SEQ ID NO: 3377961 - DNA, 20 bp, Homo sapiens
gggaggacctgaccctactc

SEQ ID NO: 3377962 - DNA, 21 bp, Homo sapiens
gggaggagaggggaagggcca

SEQ ID NO: 3377963 - DNA, 15 bp, Homo sapiens
gggaggagcctgtgc

SEQ ID NO: 3377964 - DNA, 14 bp, Homo sapiens
gggaggagggagag

SEQ ID NO: 3377965 - DNA, 17 bp, Homo sapiens
gggaggagggagaggga

SEQ ID NO: 3377966 - DNA, 18 bp, Homo sapiens
gggaggagggagagggag

SEQ ID NO: 3377967 - DNA, 23 bp, Homo sapiens
gggaggatcactggagcccagga

SEQ ID NO: 3377968 - DNA, 16 bp, Homo sapiens
gggaggcaccagctct

SEQ ID NO: 3377969 - DNA, 13 bp, Homo sapiens
gggaggcagccgg

SEQ ID NO: 3377970 - DNA, 14 bp, Homo sapiens
gggaggccaaggca

SEQ ID NO: 3377971 - DNA, 17 bp, Homo sapiens
gggaggccaaggcaggc

SEQ ID NO: 3377972 - DNA, 19 bp, Homo sapiens
gggaggccaaggcaggtag

SEQ ID NO: 3377973 - DNA, 15 bp, Homo sapiens
gggaggccccagctc

SEQ ID NO: 3377974 - DNA, 15 bp, Homo sapiens
gggaggccccttctc

SEQ ID NO: 3377975 - DNA, 12 bp, Homo sapiens
gggaggccctgg

SEQ ID NO: 3377976 - DNA, 15 bp, Homo sapiens
gggaggccgaggcgg

SEQ ID NO: 3377977 - DNA, 16 bp, Homo sapiens
gggagggaagtgtgag

SEQ ID NO: 3377978 - DNA, 22 bp, Homo sapiens
gggagggaagtgtgagcgcctt

SEQ ID NO: 3377979 - DNA, 17 bp, Homo sapiens
gggagggagggcggtgg

SEQ ID NO: 3377980 - DNA, 12 bp, Homo sapiens
gggaggggaggc

SEQ ID NO: 3377981 - DNA, 17 bp, Homo sapiens
gggaggggcaggctgac

SEQ ID NO: 3377982 - DNA, 20 bp, Homo sapiens
gggaggggcgctggcccagc

SEQ ID NO: 3377983 - DNA, 21 bp, Homo sapiens
gggaggggcgctggcccagcc

SEQ ID NO: 3377984 - DNA, 13 bp, Homo sapiens
gggagggggaggg

SEQ ID NO: 3377985 - DNA, 17 bp, Homo sapiens
gggaggtcaggccctgg

SEQ ID NO: 3377986 - DNA, 22 bp, Homo sapiens
gggaggtcaggccctggaactc

SEQ ID NO: 3377987 - DNA, 16 bp, Homo sapiens
gggaggtgaccccagg

SEQ ID NO: 3377988 - DNA, 23 bp, Homo sapiens
gggaggtggaagaagggagaaga

SEQ ID NO: 3377989 - DNA, 20 bp, Homo sapiens
gggaggtgtttaaagagagg

SEQ ID NO: 3377990 - DNA, 21 bp, Homo sapiens
gggaggttttattctgacttc

SEQ ID NO: 3377991 - DNA, 21 bp, Homo sapiens
gggagtcagagccctggctgg

SEQ ID NO: 3377992 - DNA, 22 bp, Homo sapiens
gggagtcagagccctggctggg

SEQ ID NO: 3377993 - DNA, 11 bp, Homo sapiens
gggagtgagct

SEQ ID NO: 3377994 - DNA, 12 bp, Homo sapiens
gggagtgggcac

SEQ ID NO: 3377995 - DNA, 20 bp, Homo sapiens
gggagtgggcacctcagaaa

SEQ ID NO: 3377996 - DNA, 20 bp, Homo sapiens
gggagttgagtcacaagagg

SEQ ID NO: 3377997 - DNA, 21 bp, Homo sapiens
gggagtttctttcctgccttc

SEQ ID NO: 3377998 - DNA, 16 bp, Homo sapiens
gggataactgatttct

SEQ ID NO: 3377999 - DNA, 13 bp, Homo sapiens
gggatacttagtg

SEQ ID NO: 3378000 - DNA, 20 bp, Homo sapiens
gggataggagaagaggcatc

SEQ ID NO: 3378001 - DNA, 16 bp, Homo sapiens
gggatataggagagga

SEQ ID NO: 3378002 - DNA, 15 bp, Homo sapiens
gggatatttttttct

SEQ ID NO: 3378003 - DNA, 14 bp, Homo sapiens
gggatcagagcagg

SEQ ID NO: 3378004 - DNA, 15 bp, Homo sapiens
gggatccagccactt

SEQ ID NO: 3378005 - DNA, 14 bp, Homo sapiens
gggatcccaccctg

SEQ ID NO: 3378006 - DNA, 19 bp, Homo sapiens
gggatccccgcctggccag

SEQ ID NO: 3378007 - DNA, 22 bp, Homo sapiens
gggatccccgcctggccaggag

SEQ ID NO: 3378008 - DNA, 23 bp, Homo sapiens
gggatccccgcctggccaggagc

SEQ ID NO: 3378009 - DNA, 14 bp, Homo sapiens
gggatcctgcctgc

SEQ ID NO: 3378010 - DNA, 18 bp, Homo sapiens
gggatctctctacaagag

SEQ ID NO: 3378011 - DNA, 19 bp, Homo sapiens
gggatgactaaaatattta

SEQ ID NO: 3378012 - DNA, 22 bp, Homo sapiens
gggatgaggtcaccaggggagg

SEQ ID NO: 3378013 - DNA, 15 bp, Homo sapiens
gggatgcccagaaga

SEQ ID NO: 3378014 - DNA, 12 bp, Homo sapiens
gggatgctgctc

SEQ ID NO: 3378015 - DNA, 15 bp, Homo sapiens
gggatggggcctccc

SEQ ID NO: 3378016 - DNA, 15 bp, Homo sapiens
gggatggtccaggat

SEQ ID NO: 3378017 - DNA, 18 bp, Homo sapiens
gggatgtgagccccaggg

SEQ ID NO: 3378018 - DNA, 22 bp, Homo sapiens
gggatgttcagcactgtccctt

SEQ ID NO: 3378019 - DNA, 16 bp, Homo sapiens
gggattaacctctgca

SEQ ID NO: 3378020 - DNA, 16 bp, Homo sapiens
gggattcaggctgctt

SEQ ID NO: 3378021 - DNA, 13 bp, Homo sapiens
gggattcctgacc

SEQ ID NO: 3378022 - DNA, 20 bp, Homo sapiens
gggatttaatttccagggtt

SEQ ID NO: 3378023 - DNA, 18 bp, Homo sapiens
gggatttcttcgctgctc

SEQ ID NO: 3378024 - DNA, 22 bp, Homo sapiens
gggcaaatgacatgcactgacc

SEQ ID NO: 3378025 - DNA, 16 bp, Homo sapiens
gggcaacccccagcct

SEQ ID NO: 3378026 - DNA, 20 bp, Homo sapiens
gggcaacccccagcctgcta

SEQ ID NO: 3378027 - DNA, 14 bp, Homo sapiens
gggcaacgaagaaa

SEQ ID NO: 3378028 - DNA, 17 bp, Homo sapiens
gggcaacgaagaaaaaa

SEQ ID NO: 3378029 - DNA, 23 bp, Homo sapiens
gggcaagctaggccccagaggcc

SEQ ID NO: 3378030 - DNA, 21 bp, Homo sapiens
gggcacaactgcaataacttc

SEQ ID NO: 3378031 - DNA, 14 bp, Homo sapiens
gggcacaccactgc

SEQ ID NO: 3378032 - DNA, 13 bp, Homo sapiens
gggcacagccctc

SEQ ID NO: 3378033 - DNA, 9 bp, Homo sapiens
gggcacagg

SEQ ID NO: 3378034 - DNA, 13 bp, Homo sapiens
gggcacagggcac

SEQ ID NO: 3378035 - DNA, 22 bp, Homo sapiens
gggcacagggcaccagaggccg

SEQ ID NO: 3378036 - DNA, 23 bp, Homo sapiens
gggcacatgctgagtctcccaag

SEQ ID NO: 3378037 - DNA, 17 bp, Homo sapiens
gggcaccacaaaatata

SEQ ID NO: 3378038 - DNA, 22 bp, Homo sapiens
gggcaccacaaaatatacaaaa

SEQ ID NO: 3378039 - DNA, 15 bp, Homo sapiens
gggcaccagaggccg

SEQ ID NO: 3378040 - DNA, 18 bp, Homo sapiens
gggcaccccagcctgaag

SEQ ID NO: 3378041 - DNA, 20 bp, Homo sapiens
gggcactcagaagacactga

SEQ ID NO: 3378042 - DNA, 12 bp, Homo sapiens
gggcactcagcc

SEQ ID NO: 3378043 - DNA, 14 bp, Homo sapiens
gggcactcagccac

SEQ ID NO: 3378044 - DNA, 13 bp, Homo sapiens
gggcactggccca

SEQ ID NO: 3378045 - DNA, 22 bp, Homo sapiens
gggcacttaatttgtaaacttc

SEQ ID NO: 3378046 - DNA, 22 bp, Homo sapiens
gggcactttttaattcaccaaa

SEQ ID NO: 3378047 - DNA, 18 bp, Homo sapiens
gggcagactgtgaacttg

SEQ ID NO: 3378048 - DNA, 14 bp, Homo sapiens
gggcagagccatgg

SEQ ID NO: 3378049 - DNA, 15 bp, Homo sapiens
gggcagagccatggg

SEQ ID NO: 3378050 - DNA, 17 bp, Homo sapiens
gggcagagccatgggcc

SEQ ID NO: 3378051 - DNA, 18 bp, Homo sapiens
gggcagagccatgggcct

SEQ ID NO: 3378052 - DNA, 11 bp, Homo sapiens
gggcagagctg

SEQ ID NO: 3378053 - DNA, 22 bp, Homo sapiens
gggcagagggaatgttccctgc

SEQ ID NO: 3378054 - DNA, 16 bp, Homo sapiens
gggcagagggctggag

SEQ ID NO: 3378055 - DNA, 23 bp, Homo sapiens
gggcagaggtggcgcccaggggc

SEQ ID NO: 3378056 - DNA, 21 bp, Homo sapiens
gggcagatccccactgtccta

SEQ ID NO: 3378057 - DNA, 15 bp, Homo sapiens
gggcagcaccctccc

SEQ ID NO: 3378058 - DNA, 17 bp, Homo sapiens
gggcagcaccctccccc

SEQ ID NO: 3378059 - DNA, 14 bp, Homo sapiens
gggcagcactcccc

SEQ ID NO: 3378060 - DNA, 16 bp, Homo sapiens
gggcagcactccccag

SEQ ID NO: 3378061 - DNA, 15 bp, Homo sapiens
gggcagccacccaag

SEQ ID NO: 3378062 - DNA, 23 bp, Homo sapiens
gggcagccacccaagcctgctgg

SEQ ID NO: 3378063 - DNA, 11 bp, Homo sapiens
gggcagccagc

SEQ ID NO: 3378064 - DNA, 14 bp, Homo sapiens
gggcagccaggctg

SEQ ID NO: 3378065 - DNA, 13 bp, Homo sapiens
gggcagccccaga

SEQ ID NO: 3378066 - DNA, 19 bp, Homo sapiens
gggcagcccttgcttgttg

SEQ ID NO: 3378067 - DNA, 17 bp, Homo sapiens
gggcagccgctaggaga

SEQ ID NO: 3378068 - DNA, 22 bp, Homo sapiens
gggcagccgctaggagagactg

SEQ ID NO: 3378069 - DNA, 14 bp, Homo sapiens
gggcagcctttcca

SEQ ID NO: 3378070 - DNA, 14 bp, Homo sapiens
gggcagcgggccag

SEQ ID NO: 3378071 - DNA, 16 bp, Homo sapiens
gggcagcgggccaggc

SEQ ID NO: 3378072 - DNA, 13 bp, Homo sapiens
gggcagctgggcc

SEQ ID NO: 3378073 - DNA, 12 bp, Homo sapiens
gggcaggcctgg

SEQ ID NO: 3378074 - DNA, 14 bp, Homo sapiens
gggcaggcctggga

SEQ ID NO: 3378075 - DNA, 21 bp, Homo sapiens
gggcaggcctgggacccagct

SEQ ID NO: 3378076 - DNA, 12 bp, Homo sapiens
gggcaggcggtc

SEQ ID NO: 3378077 - DNA, 22 bp, Homo sapiens
gggcaggcgtgactcagcagcc

SEQ ID NO: 3378078 - DNA, 13 bp, Homo sapiens
gggcaggctgaca

SEQ ID NO: 3378079 - DNA, 14 bp, Homo sapiens
gggcaggctgggcc

SEQ ID NO: 3378080 - DNA, 22 bp, Homo sapiens
gggcagggaaggacaggaccct

SEQ ID NO: 3378081 - DNA, 16 bp, Homo sapiens
gggcagggagtgatga

SEQ ID NO: 3378082 - DNA, 11 bp, Homo sapiens
gggcagggcca

SEQ ID NO: 3378083 - DNA, 21 bp, Homo sapiens
gggcagggccaccccactcta

SEQ ID NO: 3378084 - DNA, 16 bp, Homo sapiens
gggcagggcccacgtg

SEQ ID NO: 3378085 - DNA, 22 bp, Homo sapiens
gggcaggtggtggcactgagcc

SEQ ID NO: 3378086 - DNA, 19 bp, Homo sapiens
gggcagtgctagtgagctg

SEQ ID NO: 3378087 - DNA, 21 bp, Homo sapiens
gggcagttcgggaaccccctt

SEQ ID NO: 3378088 - DNA, 16 bp, Homo sapiens
gggcagttctcactcc

SEQ ID NO: 3378089 - DNA, 17 bp, Homo sapiens
gggcagttgggtagatg

SEQ ID NO: 3378090 - DNA, 17 bp, Homo sapiens
gggcatatccaccacct

SEQ ID NO: 3378091 - DNA, 17 bp, Homo sapiens
gggcatcaggcactggt

SEQ ID NO: 3378092 - DNA, 22 bp, Homo sapiens
gggcatccacccagtgctgcca

SEQ ID NO: 3378093 - DNA, 19 bp, Homo sapiens
gggcatccataccagctcg

SEQ ID NO: 3378094 - DNA, 17 bp, Homo sapiens
gggcatctgcccctccc

SEQ ID NO: 3378095 - DNA, 20 bp, Homo sapiens
gggcatctgcccctccccca

SEQ ID NO: 3378096 - DNA, 22 bp, Homo sapiens
gggcatgccccggccacctctg

SEQ ID NO: 3378097 - DNA, 17 bp, Homo sapiens
gggcatggccaggtggc

SEQ ID NO: 3378098 - DNA, 20 bp, Homo sapiens
gggcatggccaggtggccac

SEQ ID NO: 3378099 - DNA, 16 bp, Homo sapiens
gggcatgtgtgcctgt

SEQ ID NO: 3378100 - DNA, 20 bp, Homo sapiens
gggcatgtgtgcctgtggca

SEQ ID NO: 3378101 - DNA, 23 bp, Homo sapiens
gggcatgtgtgcctgtggcagaa

SEQ ID NO: 3378102 - DNA, 23 bp, Homo sapiens
gggcattgggctgacacctacca

SEQ ID NO: 3378103 - DNA, 17 bp, Homo sapiens
gggccaagacttggcaa

SEQ ID NO: 3378104 - DNA, 16 bp, Homo sapiens
gggccacagagaaagt

SEQ ID NO: 3378105 - DNA, 22 bp, Homo sapiens
gggccacagggcggtgctagct

SEQ ID NO: 3378106 - DNA, 16 bp, Homo sapiens
gggccaccaaagctgc

SEQ ID NO: 3378107 - DNA, 19 bp, Homo sapiens
gggccaccaaagctgccca

SEQ ID NO: 3378108 - DNA, 17 bp, Homo sapiens
gggccaccccactctac

SEQ ID NO: 3378109 - DNA, 16 bp, Homo sapiens
gggccacgccccagcc

SEQ ID NO: 3378110 - DNA, 18 bp, Homo sapiens
gggccacgccccagcccg

SEQ ID NO: 3378111 - DNA, 21 bp, Homo sapiens
gggccacgccccagcccgaca

SEQ ID NO: 3378112 - DNA, 22 bp, Homo sapiens
gggccacgccccagcccgacaa

SEQ ID NO: 3378113 - DNA, 24 bp, Homo sapiens
gggccacggaggagggatgctgct

SEQ ID NO: 3378114 - DNA, 13 bp, Homo sapiens
gggccactgggga

SEQ ID NO: 3378115 - DNA, 20 bp, Homo sapiens
gggccactgtggtggcagtg

SEQ ID NO: 3378116 - DNA, 19 bp, Homo sapiens
gggccagaaggagggcaga

SEQ ID NO: 3378117 - DNA, 22 bp, Homo sapiens
gggccagaggaactgtccagag

SEQ ID NO: 3378118 - DNA, 11 bp, Homo sapiens
gggccagaggg

SEQ ID NO: 3378119 - DNA, 14 bp, Homo sapiens
gggccagagggagc

SEQ ID NO: 3378120 - DNA, 13 bp, Homo sapiens
gggccagccaggc

SEQ ID NO: 3378121 - DNA, 17 bp, Homo sapiens
gggccagccaggcgggc

SEQ ID NO: 3378122 - DNA, 22 bp, Homo sapiens
gggccagccccacccccagcca

SEQ ID NO: 3378123 - DNA, 19 bp, Homo sapiens
gggccagcctagcccttgt

SEQ ID NO: 3378124 - DNA, 12 bp, Homo sapiens
gggccaggcagg

SEQ ID NO: 3378125 - DNA, 23 bp, Homo sapiens
gggccaggcaggtgcctggacat

SEQ ID NO: 3378126 - DNA, 17 bp, Homo sapiens
gggccaggccaggacca

SEQ ID NO: 3378127 - DNA, 18 bp, Homo sapiens
gggccaggccaggaccac

SEQ ID NO: 3378128 - DNA, 12 bp, Homo sapiens
gggccaggccca

SEQ ID NO: 3378129 - DNA, 13 bp, Homo sapiens
gggccaggcccag

SEQ ID NO: 3378130 - DNA, 17 bp, Homo sapiens
gggccaggcccaggcag

SEQ ID NO: 3378131 - DNA, 18 bp, Homo sapiens
gggccaggcccaggcaga

SEQ ID NO: 3378132 - DNA, 13 bp, Homo sapiens
gggccagggccct

SEQ ID NO: 3378133 - DNA, 13 bp, Homo sapiens
gggccagggctgc

SEQ ID NO: 3378134 - DNA, 21 bp, Homo sapiens
gggccagggctgccctgagaa

SEQ ID NO: 3378135 - DNA, 13 bp, Homo sapiens
gggccagtcctcc

SEQ ID NO: 3378136 - DNA, 20 bp, Homo sapiens
gggccagtcctgcctggcca

SEQ ID NO: 3378137 - DNA, 16 bp, Homo sapiens
gggccagtctgggctg

SEQ ID NO: 3378138 - DNA, 20 bp, Homo sapiens
gggccagtctgggctgccgg

SEQ ID NO: 3378139 - DNA, 15 bp, Homo sapiens
gggccagtggggcct

SEQ ID NO: 3378140 - DNA, 20 bp, Homo sapiens
gggccagtggggcctgtgga

SEQ ID NO: 3378141 - DNA, 20 bp, Homo sapiens
gggccataaacggttcctgg

SEQ ID NO: 3378142 - DNA, 22 bp, Homo sapiens
gggccatcacaggatgccagcc

SEQ ID NO: 3378143 - DNA, 23 bp, Homo sapiens
gggccatcacaggatgccagccc

SEQ ID NO: 3378144 - DNA, 17 bp, Homo sapiens
gggccatctgactgcca

SEQ ID NO: 3378145 - DNA, 22 bp, Homo sapiens
gggccatctgactgccaagcca

SEQ ID NO: 3378146 - DNA, 23 bp, Homo sapiens
gggccatgctgaggcctgggccg

SEQ ID NO: 3378147 - DNA, 15 bp, Homo sapiens
gggccatgtccaaag

SEQ ID NO: 3378148 - DNA, 23 bp, Homo sapiens
gggccatgtccaaagaggctgcc

SEQ ID NO: 3378149 - DNA, 16 bp, Homo sapiens
gggcccaagccccatc

SEQ ID NO: 3378150 - DNA, 15 bp, Homo sapiens
gggcccacctggcca

SEQ ID NO: 3378151 - DNA, 18 bp, Homo sapiens
gggcccacctggccacct

SEQ ID NO: 3378152 - DNA, 19 bp, Homo sapiens
gggcccacgtggttggggc

SEQ ID NO: 3378153 - DNA, 22 bp, Homo sapiens
gggcccagaactgcccccactg

SEQ ID NO: 3378154 - DNA, 22 bp, Homo sapiens
gggcccagctgtagccatggct

SEQ ID NO: 3378155 - DNA, 20 bp, Homo sapiens
gggcccaggaagcccacact

SEQ ID NO: 3378156 - DNA, 19 bp, Homo sapiens
gggcccaggaccagctggg

SEQ ID NO: 3378157 - DNA, 13 bp, Homo sapiens
gggcccaggaggg

SEQ ID NO: 3378158 - DNA, 13 bp, Homo sapiens
gggccccacctac

SEQ ID NO: 3378159 - DNA, 18 bp, Homo sapiens
gggccccagaaggcaggg

SEQ ID NO: 3378160 - DNA, 12 bp, Homo sapiens
gggccccagacc

SEQ ID NO: 3378161 - DNA, 21 bp, Homo sapiens
gggccccagaccccagggcag

SEQ ID NO: 3378162 - DNA, 23 bp, Homo sapiens
gggccccagatctgcctgggcct

SEQ ID NO: 3378163 - DNA, 20 bp, Homo sapiens
gggccccatgctctgcccca

SEQ ID NO: 3378164 - DNA, 18 bp, Homo sapiens
gggccccgccagggctgg

SEQ ID NO: 3378165 - DNA, 14 bp, Homo sapiens
gggccccggggctg

SEQ ID NO: 3378166 - DNA, 18 bp, Homo sapiens
gggccccggggctggcaa

SEQ ID NO: 3378167 - DNA, 21 bp, Homo sapiens
gggccccggggctggcaagca

SEQ ID NO: 3378168 - DNA, 17 bp, Homo sapiens
gggcccctcaccctgcc

SEQ ID NO: 3378169 - DNA, 19 bp, Homo sapiens
gggcccctcaccctgcctt

SEQ ID NO: 3378170 - DNA, 12 bp, Homo sapiens
gggcccctccac

SEQ ID NO: 3378171 - DNA, 14 bp, Homo sapiens
gggcccctccatcc

SEQ ID NO: 3378172 - DNA, 19 bp, Homo sapiens
gggcccctccctctgcccc

SEQ ID NO: 3378173 - DNA, 19 bp, Homo sapiens
gggcccgcagtgctgggac

SEQ ID NO: 3378174 - DNA, 22 bp, Homo sapiens
gggcccgcagtgctgggaccag

SEQ ID NO: 3378175 - DNA, 14 bp, Homo sapiens
gggcccgcggggca

SEQ ID NO: 3378176 - DNA, 23 bp, Homo sapiens
gggccctccgacagccccctctg

SEQ ID NO: 3378177 - DNA, 21 bp, Homo sapiens
gggccctctctctgggcccag

SEQ ID NO: 3378178 - DNA, 18 bp, Homo sapiens
gggccctctttccctgcg

SEQ ID NO: 3378179 - DNA, 19 bp, Homo sapiens
gggccctgcacctgtgcag

SEQ ID NO: 3378180 - DNA, 15 bp, Homo sapiens
gggccctgcagaggg

SEQ ID NO: 3378181 - DNA, 19 bp, Homo sapiens
gggccctgccctggcaggg

SEQ ID NO: 3378182 - DNA, 11 bp, Homo sapiens
gggccctgggc

SEQ ID NO: 3378183 - DNA, 14 bp, Homo sapiens
gggccctgggcctc

SEQ ID NO: 3378184 - DNA, 15 bp, Homo sapiens
gggccctgggcctca

SEQ ID NO: 3378185 - DNA, 18 bp, Homo sapiens
gggccctgggcctcagtt

SEQ ID NO: 3378186 - DNA, 13 bp, Homo sapiens
gggccctgggctg

SEQ ID NO: 3378187 - DNA, 14 bp, Homo sapiens
gggccctgggctgg

SEQ ID NO: 3378188 - DNA, 16 bp, Homo sapiens
gggcccttggggcctg

SEQ ID NO: 3378189 - DNA, 18 bp, Homo sapiens
gggcccttggggcctggc

SEQ ID NO: 3378190 - DNA, 17 bp, Homo sapiens
gggcccttggggctggg

SEQ ID NO: 3378191 - DNA, 20 bp, Homo sapiens
gggccgaggaggtgcctgga

SEQ ID NO: 3378192 - DNA, 14 bp, Homo sapiens
gggccgaggcccag

SEQ ID NO: 3378193 - DNA, 21 bp, Homo sapiens
gggccgggcaggtcctgccca

SEQ ID NO: 3378194 - DNA, 19 bp, Homo sapiens
gggccggggaagctgccag

SEQ ID NO: 3378195 - DNA, 23 bp, Homo sapiens
gggccggggaagctgccagccca

SEQ ID NO: 3378196 - DNA, 22 bp, Homo sapiens
gggccggtagaggctccccagg

SEQ ID NO: 3378197 - DNA, 16 bp, Homo sapiens
gggccgtaccccaccc

SEQ ID NO: 3378198 - DNA, 18 bp, Homo sapiens
gggccgtaccccaccctc

SEQ ID NO: 3378199 - DNA, 17 bp, Homo sapiens
gggcctactagagtctg

SEQ ID NO: 3378200 - DNA, 20 bp, Homo sapiens
gggcctagcgatctctcctg

SEQ ID NO: 3378201 - DNA, 23 bp, Homo sapiens
gggcctagcgatctctcctggcc

SEQ ID NO: 3378202 - DNA, 20 bp, Homo sapiens
gggcctcaccgagtgggggc

SEQ ID NO: 3378203 - DNA, 15 bp, Homo sapiens
gggcctcaggctctg

SEQ ID NO: 3378204 - DNA, 14 bp, Homo sapiens
gggcctcagtgcca

SEQ ID NO: 3378205 - DNA, 12 bp, Homo sapiens
gggcctcatcac

SEQ ID NO: 3378206 - DNA, 14 bp, Homo sapiens
gggcctccagaact

SEQ ID NO: 3378207 - DNA, 23 bp, Homo sapiens
gggcctcccataattgctttgcc

SEQ ID NO: 3378208 - DNA, 19 bp, Homo sapiens
gggcctcccctccatgggc

SEQ ID NO: 3378209 - DNA, 18 bp, Homo sapiens
gggcctccctccttgggt

SEQ ID NO: 3378210 - DNA, 13 bp, Homo sapiens
gggcctcctccta

SEQ ID NO: 3378211 - DNA, 22 bp, Homo sapiens
gggcctccttcccatgcctgtc

SEQ ID NO: 3378212 - DNA, 14 bp, Homo sapiens
gggcctgagagaat

SEQ ID NO: 3378213 - DNA, 12 bp, Homo sapiens
gggcctgcccaa

SEQ ID NO: 3378214 - DNA, 21 bp, Homo sapiens
gggcctggagatcctcctgca

SEQ ID NO: 3378215 - DNA, 10 bp, Homo sapiens
gggcctggca

SEQ ID NO: 3378216 - DNA, 18 bp, Homo sapiens
gggcctggcccaaagcag

SEQ ID NO: 3378217 - DNA, 13 bp, Homo sapiens
gggcctggcctga

SEQ ID NO: 3378218 - DNA, 19 bp, Homo sapiens
gggcctggcctgagctggg

SEQ ID NO: 3378219 - DNA, 22 bp, Homo sapiens
gggcctgggagggttcccctgg

SEQ ID NO: 3378220 - DNA, 15 bp, Homo sapiens
gggcctgggcctctg

SEQ ID NO: 3378221 - DNA, 13 bp, Homo sapiens
gggcctggggcct

SEQ ID NO: 3378222 - DNA, 16 bp, Homo sapiens
gggcctggggcctgag

SEQ ID NO: 3378223 - DNA, 17 bp, Homo sapiens
gggcctggggcctgaga

SEQ ID NO: 3378224 - DNA, 19 bp, Homo sapiens
gggcctggggcctgagaga

SEQ ID NO: 3378225 - DNA, 13 bp, Homo sapiens
gggcctggggtgc

SEQ ID NO: 3378226 - DNA, 20 bp, Homo sapiens
gggcctgtcgtgccagtcct

SEQ ID NO: 3378227 - DNA, 12 bp, Homo sapiens
gggcctgtgcag

SEQ ID NO: 3378228 - DNA, 18 bp, Homo sapiens
gggcctgtgcagcagccc

SEQ ID NO: 3378229 - DNA, 17 bp, Homo sapiens
gggccttagggcactgg

SEQ ID NO: 3378230 - DNA, 17 bp, Homo sapiens
gggccttagtgggccag

SEQ ID NO: 3378231 - DNA, 23 bp, Homo sapiens
gggccttgctacctcaaggggga

SEQ ID NO: 3378232 - DNA, 19 bp, Homo sapiens
gggcgaagcccaggcccct

SEQ ID NO: 3378233 - DNA, 15 bp, Homo sapiens
gggcgatgctccctc

SEQ ID NO: 3378234 - DNA, 13 bp, Homo sapiens
gggcgcaggccca

SEQ ID NO: 3378235 - DNA, 14 bp, Homo sapiens
gggcgcaggcccag

SEQ ID NO: 3378236 - DNA, 15 bp, Homo sapiens
gggcgcaggcccagt

SEQ ID NO: 3378237 - DNA, 12 bp, Homo sapiens
gggcgcctggag

SEQ ID NO: 3378238 - DNA, 13 bp, Homo sapiens
gggcgcctggaga

SEQ ID NO: 3378239 - DNA, 13 bp, Homo sapiens
gggcgctcagacg

SEQ ID NO: 3378240 - DNA, 20 bp, Homo sapiens
gggcgctcagacggcggcca

SEQ ID NO: 3378241 - DNA, 12 bp, Homo sapiens
gggcgctggccc

SEQ ID NO: 3378242 - DNA, 16 bp, Homo sapiens
gggcgctggcccagcc

SEQ ID NO: 3378243 - DNA, 17 bp, Homo sapiens
gggcgctggcccagccg

SEQ ID NO: 3378244 - DNA, 15 bp, Homo sapiens
gggcggcaggaggga

SEQ ID NO: 3378245 - DNA, 17 bp, Homo sapiens
gggctaacgggaggctg

SEQ ID NO: 3378246 - DNA, 19 bp, Homo sapiens
gggctaacgggaggctggg

SEQ ID NO: 3378247 - DNA, 13 bp, Homo sapiens
gggctaaggcccc

SEQ ID NO: 3378248 - DNA, 19 bp, Homo sapiens
gggctaccctaaagggaga

SEQ ID NO: 3378249 - DNA, 16 bp, Homo sapiens
gggctactggcagctc

SEQ ID NO: 3378250 - DNA, 21 bp, Homo sapiens
gggctagtgtgagtggcagcc

SEQ ID NO: 3378251 - DNA, 18 bp, Homo sapiens
gggctagttgggcttcct

SEQ ID NO: 3378252 - DNA, 15 bp, Homo sapiens
gggctatggcaaggg

SEQ ID NO: 3378253 - DNA, 16 bp, Homo sapiens
gggctatggcaagggg

SEQ ID NO: 3378254 - DNA, 22 bp, Homo sapiens
gggctatttctctccccactga

SEQ ID NO: 3378255 - DNA, 14 bp, Homo sapiens
gggctcacacacct

SEQ ID NO: 3378256 - DNA, 15 bp, Homo sapiens
gggctcacggggcct

SEQ ID NO: 3378257 - DNA, 17 bp, Homo sapiens
gggctcagcggggacag

SEQ ID NO: 3378258 - DNA, 18 bp, Homo sapiens
gggctccagcaccttctt

SEQ ID NO: 3378259 - DNA, 21 bp, Homo sapiens
gggctccagcatccagcctgt

SEQ ID NO: 3378260 - DNA, 22 bp, Homo sapiens
gggctccagcatccagcctgtg

SEQ ID NO: 3378261 - DNA, 23 bp, Homo sapiens
gggctccagcatccagcctgtgt

SEQ ID NO: 3378262 - DNA, 11 bp, Homo sapiens
gggctccaggc

SEQ ID NO: 3378263 - DNA, 16 bp, Homo sapiens
gggctccaggctggct

SEQ ID NO: 3378264 - DNA, 11 bp, Homo sapiens
gggctcccagg

SEQ ID NO: 3378265 - DNA, 14 bp, Homo sapiens
gggctcccaggggt

SEQ ID NO: 3378266 - DNA, 10 bp, Homo sapiens
gggctccccg

SEQ ID NO: 3378267 - DNA, 13 bp, Homo sapiens
gggctccctctct

SEQ ID NO: 3378268 - DNA, 15 bp, Homo sapiens
gggctccctctctgg

SEQ ID NO: 3378269 - DNA, 14 bp, Homo sapiens
gggctccctggcag

SEQ ID NO: 3378270 - DNA, 14 bp, Homo sapiens
gggctcctcccagc

SEQ ID NO: 3378271 - DNA, 18 bp, Homo sapiens
gggctcctgcacttactt

SEQ ID NO: 3378272 - DNA, 18 bp, Homo sapiens
gggctcctgccttctgtc

SEQ ID NO: 3378273 - DNA, 12 bp, Homo sapiens
gggctcctggaa

SEQ ID NO: 3378274 - DNA, 14 bp, Homo sapiens
gggctcctggctgc

SEQ ID NO: 3378275 - DNA, 15 bp, Homo sapiens
gggctcctggctgcc

SEQ ID NO: 3378276 - DNA, 14 bp, Homo sapiens
gggctcgaggctgg

SEQ ID NO: 3378277 - DNA, 15 bp, Homo sapiens
gggctcgaggctggt

SEQ ID NO: 3378278 - DNA, 20 bp, Homo sapiens
gggctcgaggggtgggctgg

SEQ ID NO: 3378279 - DNA, 17 bp, Homo sapiens
gggctctcaaagtataa

SEQ ID NO: 3378280 - DNA, 13 bp, Homo sapiens
gggctctcagctc

SEQ ID NO: 3378281 - DNA, 19 bp, Homo sapiens
gggctctccaaaggggctg

SEQ ID NO: 3378282 - DNA, 13 bp, Homo sapiens
gggctctctgaga

SEQ ID NO: 3378283 - DNA, 23 bp, Homo sapiens
gggctctgcaattcccctctgct

SEQ ID NO: 3378284 - DNA, 11 bp, Homo sapiens
gggctctgccc

SEQ ID NO: 3378285 - DNA, 14 bp, Homo sapiens
gggctctgccccag

SEQ ID NO: 3378286 - DNA, 21 bp, Homo sapiens
gggctctgccctccctccttc

SEQ ID NO: 3378287 - DNA, 22 bp, Homo sapiens
gggctctttctctctgctgagc

SEQ ID NO: 3378288 - DNA, 21 bp, Homo sapiens
gggctgacacctaccatgctg

SEQ ID NO: 3378289 - DNA, 21 bp, Homo sapiens
gggctgacccagcatctccca

SEQ ID NO: 3378290 - DNA, 20 bp, Homo sapiens
gggctgactagaagggccag

SEQ ID NO: 3378291 - DNA, 22 bp, Homo sapiens
gggctgactctccagggagctg

SEQ ID NO: 3378292 - DNA, 13 bp, Homo sapiens
gggctgagccctg

SEQ ID NO: 3378293 - DNA, 15 bp, Homo sapiens
gggctgagccctggc

SEQ ID NO: 3378294 - DNA, 16 bp, Homo sapiens
gggctgagctgcctgt

SEQ ID NO: 3378295 - DNA, 17 bp, Homo sapiens
gggctgatttacatgta

SEQ ID NO: 3378296 - DNA, 22 bp, Homo sapiens
gggctgcagcatgttgctgagg

SEQ ID NO: 3378297 - DNA, 18 bp, Homo sapiens
gggctgccatgtgaagag

SEQ ID NO: 3378298 - DNA, 14 bp, Homo sapiens
gggctgccctgaga

SEQ ID NO: 3378299 - DNA, 12 bp, Homo sapiens
gggctgccctgc

SEQ ID NO: 3378300 - DNA, 13 bp, Homo sapiens
gggctgccctgcc

SEQ ID NO: 3378301 - DNA, 13 bp, Homo sapiens
gggctgccctggt

SEQ ID NO: 3378302 - DNA, 15 bp, Homo sapiens
gggctgccctggtgc

SEQ ID NO: 3378303 - DNA, 19 bp, Homo sapiens
gggctgcctgggctgttgg

SEQ ID NO: 3378304 - DNA, 22 bp, Homo sapiens
gggctgcgggaggccctggccc

SEQ ID NO: 3378305 - DNA, 12 bp, Homo sapiens
gggctgcttcct

SEQ ID NO: 3378306 - DNA, 18 bp, Homo sapiens
gggctggacttctacctg

SEQ ID NO: 3378307 - DNA, 24 bp, Homo sapiens
gggctggagaaagagctgcctgga

SEQ ID NO: 3378308 - DNA, 19 bp, Homo sapiens
gggctggaggcccaggctg

SEQ ID NO: 3378309 - DNA, 16 bp, Homo sapiens
gggctggcaagcaggg

SEQ ID NO: 3378310 - DNA, 19 bp, Homo sapiens
gggctggcctctggctctc

SEQ ID NO: 3378311 - DNA, 17 bp, Homo sapiens
gggctggctctgcacta

SEQ ID NO: 3378312 - DNA, 16 bp, Homo sapiens
gggctgggagctctgc

SEQ ID NO: 3378313 - DNA, 18 bp, Homo sapiens
gggctgggagctctgcag

SEQ ID NO: 3378314 - DNA, 12 bp, Homo sapiens
gggctggggagg

SEQ ID NO: 3378315 - DNA, 17 bp, Homo sapiens
gggctggggctgctccc

SEQ ID NO: 3378316 - DNA, 18 bp, Homo sapiens
gggctggggtgagagagg

SEQ ID NO: 3378317 - DNA, 18 bp, Homo sapiens
gggctgtaaaatgcatga

SEQ ID NO: 3378318 - DNA, 23 bp, Homo sapiens
gggctgtgctgcttttgagcctc

SEQ ID NO: 3378319 - DNA, 14 bp, Homo sapiens
gggcttccatgcct

SEQ ID NO: 3378320 - DNA, 19 bp, Homo sapiens
gggcttcctctagaagcca

SEQ ID NO: 3378321 - DNA, 18 bp, Homo sapiens
gggcttctgcaccctcca

SEQ ID NO: 3378322 - DNA, 21 bp, Homo sapiens
gggcttctgcaccctccaccc

SEQ ID NO: 3378323 - DNA, 23 bp, Homo sapiens
gggcttctgcaccctccaccctg

SEQ ID NO: 3378324 - DNA, 13 bp, Homo sapiens
gggcttgaagcca

SEQ ID NO: 3378325 - DNA, 17 bp, Homo sapiens
gggcttgagctgcagaa

SEQ ID NO: 3378326 - DNA, 15 bp, Homo sapiens
gggctttctggggcc

SEQ ID NO: 3378327 - DNA, 14 bp, Homo sapiens
gggctttgcaggct

SEQ ID NO: 3378328 - DNA, 18 bp, Homo sapiens
gggctttgcaggctctgg

SEQ ID NO: 3378329 - DNA, 13 bp, Homo sapiens
gggctttgggccg

SEQ ID NO: 3378330 - DNA, 14 bp, Homo sapiens
gggcttttttcttt

SEQ ID NO: 3378331 - DNA, 15 bp, Homo sapiens
ggggaagctgcagct

SEQ ID NO: 3378332 - DNA, 13 bp, Homo sapiens
ggggaaggagcca

SEQ ID NO: 3378333 - DNA, 21 bp, Homo sapiens
ggggaaggagggtacagctgg

SEQ ID NO: 3378334 - DNA, 22 bp, Homo sapiens
ggggaatgtttgcctctgcctc

SEQ ID NO: 3378335 - DNA, 14 bp, Homo sapiens
ggggacaccagagc

SEQ ID NO: 3378336 - DNA, 14 bp, Homo sapiens
ggggacagctcctt

SEQ ID NO: 3378337 - DNA, 17 bp, Homo sapiens
ggggacaggcctcacct

SEQ ID NO: 3378338 - DNA, 18 bp, Homo sapiens
ggggacagttggcagaga

SEQ ID NO: 3378339 - DNA, 19 bp, Homo sapiens
ggggacccaggctccgccc

SEQ ID NO: 3378340 - DNA, 18 bp, Homo sapiens
ggggaccccaacctcaga

SEQ ID NO: 3378341 - DNA, 14 bp, Homo sapiens
ggggactcagccct

SEQ ID NO: 3378342 - DNA, 21 bp, Homo sapiens
ggggactctgagcgggaggca

SEQ ID NO: 3378343 - DNA, 14 bp, Homo sapiens
ggggactgtctttc

SEQ ID NO: 3378344 - DNA, 20 bp, Homo sapiens
ggggactgttccaaagccag

SEQ ID NO: 3378345 - DNA, 23 bp, Homo sapiens
ggggactgttccaaagccagtga

SEQ ID NO: 3378346 - DNA, 11 bp, Homo sapiens
ggggagaaagt

SEQ ID NO: 3378347 - DNA, 13 bp, Homo sapiens
ggggagaagagcc

SEQ ID NO: 3378348 - DNA, 17 bp, Homo sapiens
ggggagaagagccctgg

SEQ ID NO: 3378349 - DNA, 16 bp, Homo sapiens
ggggagagcctgctgg

SEQ ID NO: 3378350 - DNA, 18 bp, Homo sapiens
ggggagagcctgctggca

SEQ ID NO: 3378351 - DNA, 19 bp, Homo sapiens
ggggagcacttgcgtcctg

SEQ ID NO: 3378352 - DNA, 19 bp, Homo sapiens
ggggaggatcactggagcc

SEQ ID NO: 3378353 - DNA, 14 bp, Homo sapiens
ggggagggatgaag

SEQ ID NO: 3378354 - DNA, 21 bp, Homo sapiens
ggggagggccgtaccccaccc

SEQ ID NO: 3378355 - DNA, 16 bp, Homo sapiens
ggggaggggcgctggc

SEQ ID NO: 3378356 - DNA, 15 bp, Homo sapiens
ggggaggtgggtgtg

SEQ ID NO: 3378357 - DNA, 20 bp, Homo sapiens
ggggagtttctttcctgcct

SEQ ID NO: 3378358 - DNA, 17 bp, Homo sapiens
ggggatccagccacttc

SEQ ID NO: 3378359 - DNA, 13 bp, Homo sapiens
ggggatccccgcc

SEQ ID NO: 3378360 - DNA, 21 bp, Homo sapiens
ggggatgactagaggcaggga

SEQ ID NO: 3378361 - DNA, 13 bp, Homo sapiens
ggggatgggtgtg

SEQ ID NO: 3378362 - DNA, 14 bp, Homo sapiens
ggggatgtgggagg

SEQ ID NO: 3378363 - DNA, 15 bp, Homo sapiens
ggggcaactgtatga

SEQ ID NO: 3378364 - DNA, 13 bp, Homo sapiens
ggggcaagctagg

SEQ ID NO: 3378365 - DNA, 14 bp, Homo sapiens
ggggcaaggtctcc

SEQ ID NO: 3378366 - DNA, 15 bp, Homo sapiens
ggggcaaggtctcct

SEQ ID NO: 3378367 - DNA, 21 bp, Homo sapiens
ggggcacaccactgccctgcc

SEQ ID NO: 3378368 - DNA, 19 bp, Homo sapiens
ggggcacggactgtccacc

SEQ ID NO: 3378369 - DNA, 20 bp, Homo sapiens
ggggcagaggggcagccgct

SEQ ID NO: 3378370 - DNA, 13 bp, Homo sapiens
ggggcaggactga

SEQ ID NO: 3378371 - DNA, 16 bp, Homo sapiens
ggggcaggagggccct

SEQ ID NO: 3378372 - DNA, 15 bp, Homo sapiens
ggggcaggctgggcc

SEQ ID NO: 3378373 - DNA, 18 bp, Homo sapiens
ggggcagggaaggacagg

SEQ ID NO: 3378374 - DNA, 19 bp, Homo sapiens
ggggcagggaaggacagga

SEQ ID NO: 3378375 - DNA, 14 bp, Homo sapiens
ggggcagggccttc

SEQ ID NO: 3378376 - DNA, 20 bp, Homo sapiens
ggggcatctgcccctccccc

SEQ ID NO: 3378377 - DNA, 20 bp, Homo sapiens
ggggcatgtgtgcctgtggc

SEQ ID NO: 3378378 - DNA, 18 bp, Homo sapiens
ggggccaccaaagctgcc

SEQ ID NO: 3378379 - DNA, 13 bp, Homo sapiens
ggggccagagaca

SEQ ID NO: 3378380 - DNA, 23 bp, Homo sapiens
ggggccagaggaactgtccagag

SEQ ID NO: 3378381 - DNA, 13 bp, Homo sapiens
ggggccaggccag

SEQ ID NO: 3378382 - DNA, 15 bp, Homo sapiens
ggggccaggccagga

SEQ ID NO: 3378383 - DNA, 17 bp, Homo sapiens
ggggccaggccaggacc

SEQ ID NO: 3378384 - DNA, 16 bp, Homo sapiens
ggggccaggcccaggc

SEQ ID NO: 3378385 - DNA, 10 bp, Homo sapiens
ggggccatca

SEQ ID NO: 3378386 - DNA, 23 bp, Homo sapiens
ggggccatcacaggatgccagcc

SEQ ID NO: 3378387 - DNA, 17 bp, Homo sapiens
ggggccccagatctgcc

SEQ ID NO: 3378388 - DNA, 20 bp, Homo sapiens
ggggccccagatctgcctgg

SEQ ID NO: 3378389 - DNA, 22 bp, Homo sapiens
ggggccccagatctgcctgggc

SEQ ID NO: 3378390 - DNA, 15 bp, Homo sapiens
ggggccccgccaggg

SEQ ID NO: 3378391 - DNA, 19 bp, Homo sapiens
ggggccccgccagggctgg

SEQ ID NO: 3378392 - DNA, 20 bp, Homo sapiens
ggggccccgccagggctggg

SEQ ID NO: 3378393 - DNA, 22 bp, Homo sapiens
ggggccccgccagggctgggga

SEQ ID NO: 3378394 - DNA, 15 bp, Homo sapiens
ggggcccggagatag

SEQ ID NO: 3378395 - DNA, 20 bp, Homo sapiens
ggggcccgggaactcctgcc

SEQ ID NO: 3378396 - DNA, 22 bp, Homo sapiens
ggggcccggtggcggcagggcc

SEQ ID NO: 3378397 - DNA, 14 bp, Homo sapiens
ggggccctgggcct

SEQ ID NO: 3378398 - DNA, 18 bp, Homo sapiens
ggggccctgggcctcagt

SEQ ID NO: 3378399 - DNA, 22 bp, Homo sapiens
ggggcccttgggacagccagag

SEQ ID NO: 3378400 - DNA, 19 bp, Homo sapiens
ggggcccttggggcctggc

SEQ ID NO: 3378401 - DNA, 16 bp, Homo sapiens
ggggccgggcaggtcc

SEQ ID NO: 3378402 - DNA, 21 bp, Homo sapiens
ggggccgggcaggtcctgccc

SEQ ID NO: 3378403 - DNA, 21 bp, Homo sapiens
ggggccgggcgcggtggctca

SEQ ID NO: 3378404 - DNA, 13 bp, Homo sapiens
ggggcctggcagg

SEQ ID NO: 3378405 - DNA, 14 bp, Homo sapiens
ggggcctggcttgc

SEQ ID NO: 3378406 - DNA, 22 bp, Homo sapiens
ggggcctgggagggttcccctg

SEQ ID NO: 3378407 - DNA, 20 bp, Homo sapiens
ggggccttagggcactgggc

SEQ ID NO: 3378408 - DNA, 15 bp, Homo sapiens
ggggcgcctggagag

SEQ ID NO: 3378409 - DNA, 20 bp, Homo sapiens
ggggcgctcaggacccaggc

SEQ ID NO: 3378410 - DNA, 14 bp, Homo sapiens
ggggcgctggccca

SEQ ID NO: 3378411 - DNA, 17 bp, Homo sapiens
ggggcgctggcccagcc

SEQ ID NO: 3378412 - DNA, 14 bp, Homo sapiens
ggggcggggcagga

SEQ ID NO: 3378413 - DNA, 20 bp, Homo sapiens
ggggcgttatttatggacca

SEQ ID NO: 3378414 - DNA, 12 bp, Homo sapiens
ggggctccctct

SEQ ID NO: 3378415 - DNA, 15 bp, Homo sapiens
ggggctcgaggctgg

SEQ ID NO: 3378416 - DNA, 15 bp, Homo sapiens
ggggctcgccatgcc

SEQ ID NO: 3378417 - DNA, 22 bp, Homo sapiens
ggggctctagggttgctggagc

SEQ ID NO: 3378418 - DNA, 16 bp, Homo sapiens
ggggctctcagctcag

SEQ ID NO: 3378419 - DNA, 18 bp, Homo sapiens
ggggctctccaaaggggc

SEQ ID NO: 3378420 - DNA, 13 bp, Homo sapiens
ggggctctggaga

SEQ ID NO: 3378421 - DNA, 16 bp, Homo sapiens
ggggctctggagagaa

SEQ ID NO: 3378422 - DNA, 12 bp, Homo sapiens
ggggctctggga

SEQ ID NO: 3378423 - DNA, 13 bp, Homo sapiens
ggggctgcagcat

SEQ ID NO: 3378424 - DNA, 15 bp, Homo sapiens
ggggctgctggggca

SEQ ID NO: 3378425 - DNA, 16 bp, Homo sapiens
ggggctggccttcctg

SEQ ID NO: 3378426 - DNA, 18 bp, Homo sapiens
ggggctgggctcacaggc

SEQ ID NO: 3378427 - DNA, 12 bp, Homo sapiens
ggggctggggca

SEQ ID NO: 3378428 - DNA, 14 bp, Homo sapiens
ggggctgtgccaac

SEQ ID NO: 3378429 - DNA, 11 bp, Homo sapiens
ggggcttggcg

SEQ ID NO: 3378430 - DNA, 16 bp, Homo sapiens
ggggcttttgccactc

SEQ ID NO: 3378431 - DNA, 19 bp, Homo sapiens
gggggaaaaaaaaaaaaga

SEQ ID NO: 3378432 - DNA, 17 bp, Homo sapiens
gggggaacgatgtgtct

SEQ ID NO: 3378433 - DNA, 20 bp, Homo sapiens
gggggaagtcgaaggatgct

SEQ ID NO: 3378434 - DNA, 12 bp, Homo sapiens
gggggaatgagc

SEQ ID NO: 3378435 - DNA, 15 bp, Homo sapiens
gggggacagagaagg

SEQ ID NO: 3378436 - DNA, 20 bp, Homo sapiens
gggggactctgagcgggagg

SEQ ID NO: 3378437 - DNA, 20 bp, Homo sapiens
gggggactgggagtcagagc

SEQ ID NO: 3378438 - DNA, 11 bp, Homo sapiens
gggggagaggg

SEQ ID NO: 3378439 - DNA, 21 bp, Homo sapiens
gggggagcccagtgaagcctc

SEQ ID NO: 3378440 - DNA, 23 bp, Homo sapiens
gggggcacatgctgagtctccca

SEQ ID NO: 3378441 - DNA, 14 bp, Homo sapiens
gggggccaaggtcc

SEQ ID NO: 3378442 - DNA, 18 bp, Homo sapiens
gggggccccgccagggct

SEQ ID NO: 3378443 - DNA, 12 bp, Homo sapiens
gggggcctcagt

SEQ ID NO: 3378444 - DNA, 14 bp, Homo sapiens
gggggcctcctcct

SEQ ID NO: 3378445 - DNA, 14 bp, Homo sapiens
gggggcgcctggag

SEQ ID NO: 3378446 - DNA, 12 bp, Homo sapiens
gggggctctcca

SEQ ID NO: 3378447 - DNA, 13 bp, Homo sapiens
gggggctggccta

SEQ ID NO: 3378448 - DNA, 12 bp, Homo sapiens
gggggctttctg

SEQ ID NO: 3378449 - DNA, 12 bp, Homo sapiens
gggggtggccat

SEQ ID NO: 3378450 - DNA, 19 bp, Homo sapiens
ggggtaagccagagcctgg

SEQ ID NO: 3378451 - DNA, 20 bp, Homo sapiens
ggggtacatttctctgagca

SEQ ID NO: 3378452 - DNA, 15 bp, Homo sapiens
ggggtataggtctca

SEQ ID NO: 3378453 - DNA, 20 bp, Homo sapiens
ggggtataggtctcatctct

SEQ ID NO: 3378454 - DNA, 14 bp, Homo sapiens
ggggtatgaagagc

SEQ ID NO: 3378455 - DNA, 20 bp, Homo sapiens
ggggtatttcaattaccttc

SEQ ID NO: 3378456 - DNA, 12 bp, Homo sapiens
ggggtcacaggc

SEQ ID NO: 3378457 - DNA, 20 bp, Homo sapiens
ggggtcacaggcccagaagg

SEQ ID NO: 3378458 - DNA, 20 bp, Homo sapiens
ggggtcagagcactccctaa

SEQ ID NO: 3378459 - DNA, 16 bp, Homo sapiens
ggggtcccatcagtga

SEQ ID NO: 3378460 - DNA, 23 bp, Homo sapiens
ggggtccgtggtagaggcctggg

SEQ ID NO: 3378461 - DNA, 22 bp, Homo sapiens
ggggtccttcaagttagctcag

SEQ ID NO: 3378462 - DNA, 21 bp, Homo sapiens
ggggtctccctggctccctcc

SEQ ID NO: 3378463 - DNA, 19 bp, Homo sapiens
ggggtctcttttgtaaatt

SEQ ID NO: 3378464 - DNA, 14 bp, Homo sapiens
ggggtgagtcccct

SEQ ID NO: 3378465 - DNA, 23 bp, Homo sapiens
ggggtgcatcctcctcagccccc

SEQ ID NO: 3378466 - DNA, 14 bp, Homo sapiens
ggggtgctgagtga

SEQ ID NO: 3378467 - DNA, 11 bp, Homo sapiens
ggggtgctgcc

SEQ ID NO: 3378468 - DNA, 20 bp, Homo sapiens
ggggtgcttttatagaggct

SEQ ID NO: 3378469 - DNA, 17 bp, Homo sapiens
ggggtggagtgagactg

SEQ ID NO: 3378470 - DNA, 13 bp, Homo sapiens
ggggtgggctggt

SEQ ID NO: 3378471 - DNA, 18 bp, Homo sapiens
ggggtgggggtggaggct

SEQ ID NO: 3378472 - DNA, 19 bp, Homo sapiens
ggggttaacttggtcagag

SEQ ID NO: 3378473 - DNA, 13 bp, Homo sapiens
ggggttacaaact

SEQ ID NO: 3378474 - DNA, 15 bp, Homo sapiens
ggggttatctctgtg

SEQ ID NO: 3378475 - DNA, 14 bp, Homo sapiens
ggggttcaggcccg

SEQ ID NO: 3378476 - DNA, 21 bp, Homo sapiens
ggggttcgagaccagtctggc

SEQ ID NO: 3378477 - DNA, 20 bp, Homo sapiens
ggggttctttcttcctctgc

SEQ ID NO: 3378478 - DNA, 20 bp, Homo sapiens
ggggttgccacaggcctccc

SEQ ID NO: 3378479 - DNA, 12 bp, Homo sapiens
ggggttgggcgg

SEQ ID NO: 3378480 - DNA, 17 bp, Homo sapiens
ggggttggggtgacagt

SEQ ID NO: 3378481 - DNA, 13 bp, Homo sapiens
gggtaagagagga

SEQ ID NO: 3378482 - DNA, 17 bp, Homo sapiens
gggtaagccagagcctg

SEQ ID NO: 3378483 - DNA, 20 bp, Homo sapiens
gggtaagggatttcttaggg

SEQ ID NO: 3378484 - DNA, 22 bp, Homo sapiens
gggtacttgtggacacagctct

SEQ ID NO: 3378485 - DNA, 23 bp, Homo sapiens
gggtacttgtggacacagctctt

SEQ ID NO: 3378486 - DNA, 24 bp, Homo sapiens
gggtagatgggtgggggctcctgg

SEQ ID NO: 3378487 - DNA, 14 bp, Homo sapiens
gggtagcagctgga

SEQ ID NO: 3378488 - DNA, 13 bp, Homo sapiens
gggtagctgggcg

SEQ ID NO: 3378489 - DNA, 15 bp, Homo sapiens
gggtagggaataaaa

SEQ ID NO: 3378490 - DNA, 22 bp, Homo sapiens
gggtagggtaaatcagtaagag

SEQ ID NO: 3378491 - DNA, 12 bp, Homo sapiens
gggtagtgagca

SEQ ID NO: 3378492 - DNA, 20 bp, Homo sapiens
gggtatcaggtgctgccatc

SEQ ID NO: 3378493 - DNA, 19 bp, Homo sapiens
gggtatccaagttggactg

SEQ ID NO: 3378494 - DNA, 20 bp, Homo sapiens
gggtatccaagttggactgg

SEQ ID NO: 3378495 - DNA, 16 bp, Homo sapiens
gggtatgcgtttcatg

SEQ ID NO: 3378496 - DNA, 15 bp, Homo sapiens
gggtcacaggcccag

SEQ ID NO: 3378497 - DNA, 17 bp, Homo sapiens
gggtcaccctctccagc

SEQ ID NO: 3378498 - DNA, 21 bp, Homo sapiens
gggtcagggccagactggaag

SEQ ID NO: 3378499 - DNA, 12 bp, Homo sapiens
gggtcagggggg

SEQ ID NO: 3378500 - DNA, 20 bp, Homo sapiens
gggtcatgtttgcaggggtg

SEQ ID NO: 3378501 - DNA, 20 bp, Homo sapiens
gggtcattgacctctcaggg

SEQ ID NO: 3378502 - DNA, 12 bp, Homo sapiens
gggtccaaataa

SEQ ID NO: 3378503 - DNA, 11 bp, Homo sapiens
gggtccaggaa

SEQ ID NO: 3378504 - DNA, 16 bp, Homo sapiens
gggtccaggaaggcag

SEQ ID NO: 3378505 - DNA, 19 bp, Homo sapiens
gggtccaggaaggcagctg

SEQ ID NO: 3378506 - DNA, 19 bp, Homo sapiens
gggtccagtggatgccaca

SEQ ID NO: 3378507 - DNA, 14 bp, Homo sapiens
gggtcccagtggga

SEQ ID NO: 3378508 - DNA, 23 bp, Homo sapiens
gggtcccagtgggaggggcaggc

SEQ ID NO: 3378509 - DNA, 19 bp, Homo sapiens
gggtccgcaccagctgctc

SEQ ID NO: 3378510 - DNA, 22 bp, Homo sapiens
gggtccgcaccagctgctctgc

SEQ ID NO: 3378511 - DNA, 13 bp, Homo sapiens
gggtcctcttctg

SEQ ID NO: 3378512 - DNA, 13 bp, Homo sapiens
gggtcctggctcc

SEQ ID NO: 3378513 - DNA, 18 bp, Homo sapiens
gggtcctggctcctgagg

SEQ ID NO: 3378514 - DNA, 15 bp, Homo sapiens
gggtccttctccaca

SEQ ID NO: 3378515 - DNA, 22 bp, Homo sapiens
gggtccttttgacactgctcta

SEQ ID NO: 3378516 - DNA, 16 bp, Homo sapiens
gggtcgaaagctctag

SEQ ID NO: 3378517 - DNA, 15 bp, Homo sapiens
gggtcggccctgccc

SEQ ID NO: 3378518 - DNA, 14 bp, Homo sapiens
gggtcggctgacca

SEQ ID NO: 3378519 - DNA, 15 bp, Homo sapiens
gggtcggctgaccat

SEQ ID NO: 3378520 - DNA, 20 bp, Homo sapiens
gggtcggctgaccatgctca

SEQ ID NO: 3378521 - DNA, 14 bp, Homo sapiens
gggtctccctggct

SEQ ID NO: 3378522 - DNA, 17 bp, Homo sapiens
gggtctccctggctccc

SEQ ID NO: 3378523 - DNA, 18 bp, Homo sapiens
gggtctccctggctccct

SEQ ID NO: 3378524 - DNA, 22 bp, Homo sapiens
gggtctccctggctccctcctc

SEQ ID NO: 3378525 - DNA, 22 bp, Homo sapiens
gggtctcggatgacaccctggc

SEQ ID NO: 3378526 - DNA, 14 bp, Homo sapiens
gggtctcttccttc

SEQ ID NO: 3378527 - DNA, 21 bp, Homo sapiens
gggtctcttttgtaaattaaa

SEQ ID NO: 3378528 - DNA, 21 bp, Homo sapiens
gggtctgctctttctctgcca

SEQ ID NO: 3378529 - DNA, 22 bp, Homo sapiens
gggtctgctctttctctgccag

SEQ ID NO: 3378530 - DNA, 23 bp, Homo sapiens
gggtctgggcggcgggcggctgg

SEQ ID NO: 3378531 - DNA, 15 bp, Homo sapiens
gggtctgtgctgtgc

SEQ ID NO: 3378532 - DNA, 15 bp, Homo sapiens
gggtctgtgtgaatg

SEQ ID NO: 3378533 - DNA, 17 bp, Homo sapiens
gggtctgtgtgaatgtg

SEQ ID NO: 3378534 - DNA, 21 bp, Homo sapiens
gggtcttcagcattccctccc

SEQ ID NO: 3378535 - DNA, 22 bp, Homo sapiens
gggtcttgggctactggcagct

SEQ ID NO: 3378536 - DNA, 14 bp, Homo sapiens
gggtgaaggcctgg

SEQ ID NO: 3378537 - DNA, 18 bp, Homo sapiens
gggtgacggccctcatct

SEQ ID NO: 3378538 - DNA, 11 bp, Homo sapiens
gggtgagccag

SEQ ID NO: 3378539 - DNA, 18 bp, Homo sapiens
gggtgaggaccactcctg

SEQ ID NO: 3378540 - DNA, 19 bp, Homo sapiens
gggtgagtccattctccca

SEQ ID NO: 3378541 - DNA, 21 bp, Homo sapiens
gggtgagtcccctactccctc

SEQ ID NO: 3378542 - DNA, 14 bp, Homo sapiens
gggtgcagcagtga

SEQ ID NO: 3378543 - DNA, 24 bp, Homo sapiens
gggtgcatcctcctcagcccccag

SEQ ID NO: 3378544 - DNA, 15 bp, Homo sapiens
gggtgccccctcctc

SEQ ID NO: 3378545 - DNA, 18 bp, Homo sapiens
gggtgctcagaataaggc

SEQ ID NO: 3378546 - DNA, 18 bp, Homo sapiens
gggtgctgggaggaggga

SEQ ID NO: 3378547 - DNA, 21 bp, Homo sapiens
gggtgcttttatagaggctag

SEQ ID NO: 3378548 - DNA, 14 bp, Homo sapiens
gggtggaagggctg

SEQ ID NO: 3378549 - DNA, 22 bp, Homo sapiens
gggtggagactgcttcccatcc

SEQ ID NO: 3378550 - DNA, 23 bp, Homo sapiens
gggtggagactgcttcccatcct

SEQ ID NO: 3378551 - DNA, 15 bp, Homo sapiens
gggtggatcacctgt

SEQ ID NO: 3378552 - DNA, 17 bp, Homo sapiens
gggtggatcacgaggtc

SEQ ID NO: 3378553 - DNA, 18 bp, Homo sapiens
gggtggcacctcctgaga

SEQ ID NO: 3378554 - DNA, 17 bp, Homo sapiens
gggtggcctcaagagca

SEQ ID NO: 3378555 - DNA, 15 bp, Homo sapiens
gggtgggaagaaaga

SEQ ID NO: 3378556 - DNA, 16 bp, Homo sapiens
gggtgggaagaaagaa

SEQ ID NO: 3378557 - DNA, 14 bp, Homo sapiens
gggtgggagagccc

SEQ ID NO: 3378558 - DNA, 17 bp, Homo sapiens
gggtgggcccagaactg

SEQ ID NO: 3378559 - DNA, 19 bp, Homo sapiens
gggtgggcctggcctgagc

SEQ ID NO: 3378560 - DNA, 17 bp, Homo sapiens
gggtgggggctcctggt

SEQ ID NO: 3378561 - DNA, 13 bp, Homo sapiens
gggtgggtgaagg

SEQ ID NO: 3378562 - DNA, 13 bp, Homo sapiens
gggtgtagccagg

SEQ ID NO: 3378563 - DNA, 21 bp, Homo sapiens
gggtgtaggggccacctcctc

SEQ ID NO: 3378564 - DNA, 17 bp, Homo sapiens
gggtgtcatctgaggag

SEQ ID NO: 3378565 - DNA, 21 bp, Homo sapiens
gggtgtcttgggcagagctgg

SEQ ID NO: 3378566 - DNA, 16 bp, Homo sapiens
gggtgtgcggtctcga

SEQ ID NO: 3378567 - DNA, 16 bp, Homo sapiens
gggtgtggggtggggt

SEQ ID NO: 3378568 - DNA, 12 bp, Homo sapiens
gggttacaaact

SEQ ID NO: 3378569 - DNA, 18 bp, Homo sapiens
gggttatgtatcagaaga

SEQ ID NO: 3378570 - DNA, 19 bp, Homo sapiens
gggttatgtatcagaagag

SEQ ID NO: 3378571 - DNA, 16 bp, Homo sapiens
gggttcaaaatgtctg

SEQ ID NO: 3378572 - DNA, 14 bp, Homo sapiens
gggttcatttgtgt

SEQ ID NO: 3378573 - DNA, 20 bp, Homo sapiens
gggttccatcttgctaataa

SEQ ID NO: 3378574 - DNA, 16 bp, Homo sapiens
gggttccgcactttcc

SEQ ID NO: 3378575 - DNA, 14 bp, Homo sapiens
gggttcctcttccc

SEQ ID NO: 3378576 - DNA, 17 bp, Homo sapiens
gggttctttcttcctct

SEQ ID NO: 3378577 - DNA, 16 bp, Homo sapiens
gggttgaaaatgtgtt

SEQ ID NO: 3378578 - DNA, 13 bp, Homo sapiens
gggttgaaggcag

SEQ ID NO: 3378579 - DNA, 19 bp, Homo sapiens
gggttgaatatagcctgcc

SEQ ID NO: 3378580 - DNA, 18 bp, Homo sapiens
gggttgccacaggcctcc

SEQ ID NO: 3378581 - DNA, 20 bp, Homo sapiens
gggttgccacaggcctccct

SEQ ID NO: 3378582 - DNA, 14 bp, Homo sapiens
gggttgctggagcc

SEQ ID NO: 3378583 - DNA, 19 bp, Homo sapiens
gggttggtgcacagtgatt

SEQ ID NO: 3378584 - DNA, 20 bp, Homo sapiens
gggtttacccagtgggacag

SEQ ID NO: 3378585 - DNA, 20 bp, Homo sapiens
gggtttcacctgggccctgg

SEQ ID NO: 3378586 - DNA, 14 bp, Homo sapiens
gggtttcctgcagg

SEQ ID NO: 3378587 - DNA, 19 bp, Homo sapiens
gggtttcgactggtccagc

SEQ ID NO: 3378588 - DNA, 17 bp, Homo sapiens
gggtttcttaaatatat

SEQ ID NO: 3378589 - DNA, 14 bp, Homo sapiens
gggtttgaattgtt

SEQ ID NO: 3378590 - DNA, 17 bp, Homo sapiens
gggtttgccatttgata

SEQ ID NO: 3378591 - DNA, 21 bp, Homo sapiens
gggtttggaccccagctggga

SEQ ID NO: 3378592 - DNA, 23 bp, Homo sapiens
gggttttattgtccttcagagct

SEQ ID NO: 3378593 - DNA, 13 bp, Homo sapiens
gggttttcatcta

SEQ ID NO: 3378594 - DNA, 16 bp, Homo sapiens
gggttttccaccctgg

SEQ ID NO: 3378595 - DNA, 12 bp, Homo sapiens
gggttttgtatt

SEQ ID NO: 3378596 - DNA, 20 bp, Homo sapiens
ggtaaacccattttgaatat

SEQ ID NO: 3378597 - DNA, 16 bp, Homo sapiens
ggtaaagttacacttt

SEQ ID NO: 3378598 - DNA, 17 bp, Homo sapiens
ggtaaatgcaaagttct

SEQ ID NO: 3378599 - DNA, 12 bp, Homo sapiens
ggtaaatgtttc

SEQ ID NO: 3378600 - DNA, 14 bp, Homo sapiens
ggtaacagaacagc

SEQ ID NO: 3378601 - DNA, 18 bp, Homo sapiens
ggtaacagaacagcttca

SEQ ID NO: 3378602 - DNA, 18 bp, Homo sapiens
ggtaactgctttctgttc

SEQ ID NO: 3378603 - DNA, 13 bp, Homo sapiens
ggtaagaagaaag

SEQ ID NO: 3378604 - DNA, 17 bp, Homo sapiens
ggtaagaagaaagcaaa

SEQ ID NO: 3378605 - DNA, 23 bp, Homo sapiens
ggtaagaagttttaaaaagccag

SEQ ID NO: 3378606 - DNA, 18 bp, Homo sapiens
ggtaatgttttgtatata

SEQ ID NO: 3378607 - DNA, 19 bp, Homo sapiens
ggtaatgttttgtatatac

SEQ ID NO: 3378608 - DNA, 23 bp, Homo sapiens
ggtaattattttggtacttttat

SEQ ID NO: 3378609 - DNA, 17 bp, Homo sapiens
ggtaattcacttcagtt

SEQ ID NO: 3378610 - DNA, 22 bp, Homo sapiens
ggtaattgttgctaatcttctt

SEQ ID NO: 3378611 - DNA, 20 bp, Homo sapiens
ggtaatttttaccctaatgt

SEQ ID NO: 3378612 - DNA, 18 bp, Homo sapiens
ggtacatggtgtttgtgg

SEQ ID NO: 3378613 - DNA, 22 bp, Homo sapiens
ggtaccacccttcagaccccag

SEQ ID NO: 3378614 - DNA, 18 bp, Homo sapiens
ggtaccagccctggggct

SEQ ID NO: 3378615 - DNA, 15 bp, Homo sapiens
ggtaccagctgcgct

SEQ ID NO: 3378616 - DNA, 13 bp, Homo sapiens
ggtacccactgct

SEQ ID NO: 3378617 - DNA, 20 bp, Homo sapiens
ggtacccagccatctgccca

SEQ ID NO: 3378618 - DNA, 21 bp, Homo sapiens
ggtacccagccatctgcccag

SEQ ID NO: 3378619 - DNA, 16 bp, Homo sapiens
ggtacctcaagcccca

SEQ ID NO: 3378620 - DNA, 17 bp, Homo sapiens
ggtacctcaagccccat

SEQ ID NO: 3378621 - DNA, 20 bp, Homo sapiens
ggtactagtgtggtgtgttt

SEQ ID NO: 3378622 - DNA, 12 bp, Homo sapiens
ggtactctccta

SEQ ID NO: 3378623 - DNA, 14 bp, Homo sapiens
ggtactctcctaga

SEQ ID NO: 3378624 - DNA, 19 bp, Homo sapiens
ggtactgcattctctccca

SEQ ID NO: 3378625 - DNA, 17 bp, Homo sapiens
ggtactgctgtcttcca

SEQ ID NO: 3378626 - DNA, 16 bp, Homo sapiens
ggtacttgtcatttcg

SEQ ID NO: 3378627 - DNA, 21 bp, Homo sapiens
ggtacttgtggacacagctct

SEQ ID NO: 3378628 - DNA, 18 bp, Homo sapiens
ggtactttattcttgctg

SEQ ID NO: 3378629 - DNA, 21 bp, Homo sapiens
ggtacttttatgatgtatatt

SEQ ID NO: 3378630 - DNA, 22 bp, Homo sapiens
ggtagaaatatctgaaaatgta

SEQ ID NO: 3378631 - DNA, 15 bp, Homo sapiens
ggtagagacccccag

SEQ ID NO: 3378632 - DNA, 17 bp, Homo sapiens
ggtagagaggggactgg

SEQ ID NO: 3378633 - DNA, 19 bp, Homo sapiens
ggtagagattcattatttt

SEQ ID NO: 3378634 - DNA, 19 bp, Homo sapiens
ggtagaggctccccagggc

SEQ ID NO: 3378635 - DNA, 14 bp, Homo sapiens
ggtagatgggtggg

SEQ ID NO: 3378636 - DNA, 21 bp, Homo sapiens
ggtagatgggtgggggctcct

SEQ ID NO: 3378637 - DNA, 21 bp, Homo sapiens
ggtagccatgatttgtcccag

SEQ ID NO: 3378638 - DNA, 12 bp, Homo sapiens
ggtagctcaggt

SEQ ID NO: 3378639 - DNA, 12 bp, Homo sapiens
ggtagctgggcg

SEQ ID NO: 3378640 - DNA, 14 bp, Homo sapiens
ggtagcttttccct

SEQ ID NO: 3378641 - DNA, 11 bp, Homo sapiens
ggtaggccctt

SEQ ID NO: 3378642 - DNA, 12 bp, Homo sapiens
ggtaggcccttg

SEQ ID NO: 3378643 - DNA, 16 bp, Homo sapiens
ggtaggcccttgtcct

SEQ ID NO: 3378644 - DNA, 19 bp, Homo sapiens
ggtaggcccttgtcctgcc

SEQ ID NO: 3378645 - DNA, 21 bp, Homo sapiens
ggtaggcccttgtcctgccag

SEQ ID NO: 3378646 - DNA, 22 bp, Homo sapiens
ggtaggcccttgtcctgccagc

SEQ ID NO: 3378647 - DNA, 23 bp, Homo sapiens
ggtaggcccttgtcctgccagct

SEQ ID NO: 3378648 - DNA, 15 bp, Homo sapiens
ggtagggtaaatcag

SEQ ID NO: 3378649 - DNA, 16 bp, Homo sapiens
ggtagggtaaatcagt

SEQ ID NO: 3378650 - DNA, 16 bp, Homo sapiens
ggtaggttcagccaag

SEQ ID NO: 3378651 - DNA, 15 bp, Homo sapiens
ggtaggttgggacac

SEQ ID NO: 3378652 - DNA, 18 bp, Homo sapiens
ggtaggttgggacaccag

SEQ ID NO: 3378653 - DNA, 22 bp, Homo sapiens
ggtagtactcctgcaaaatttt

SEQ ID NO: 3378654 - DNA, 23 bp, Homo sapiens
ggtagtactcctgcaaaatttta

SEQ ID NO: 3378655 - DNA, 15 bp, Homo sapiens
ggtagtctcactgct

SEQ ID NO: 3378656 - DNA, 21 bp, Homo sapiens
ggtataaaactttcctcgcct

SEQ ID NO: 3378657 - DNA, 21 bp, Homo sapiens
ggtataggtctcatctcttca

SEQ ID NO: 3378658 - DNA, 14 bp, Homo sapiens
ggtatcaggtgctg

SEQ ID NO: 3378659 - DNA, 23 bp, Homo sapiens
ggtatcctactgagcatttgcac

SEQ ID NO: 3378660 - DNA, 12 bp, Homo sapiens
ggtatcctgccc

SEQ ID NO: 3378661 - DNA, 15 bp, Homo sapiens
ggtatcctgcccagt

SEQ ID NO: 3378662 - DNA, 15 bp, Homo sapiens
ggtatctcagaaagt

SEQ ID NO: 3378663 - DNA, 22 bp, Homo sapiens
ggtatgatcacggctcactgca

SEQ ID NO: 3378664 - DNA, 17 bp, Homo sapiens
ggtatgctggccagcac

SEQ ID NO: 3378665 - DNA, 20 bp, Homo sapiens
ggtatgctggccagcaccct

SEQ ID NO: 3378666 - DNA, 21 bp, Homo sapiens
ggtatggaagggtttgtggct

SEQ ID NO: 3378667 - DNA, 12 bp, Homo sapiens
ggtatgtttaat

SEQ ID NO: 3378668 - DNA, 18 bp, Homo sapiens
ggtatgtttaatctgtta

SEQ ID NO: 3378669 - DNA, 22 bp, Homo sapiens
ggtattaatatatagtccagac

SEQ ID NO: 3378670 - DNA, 19 bp, Homo sapiens
ggtatttttcagagattta

SEQ ID NO: 3378671 - DNA, 23 bp, Homo sapiens
ggtcaacatcttttacattctgc

SEQ ID NO: 3378672 - DNA, 18 bp, Homo sapiens
ggtcaagaaacagccagc

SEQ ID NO: 3378673 - DNA, 21 bp, Homo sapiens
ggtcaagggcttactatttct

SEQ ID NO: 3378674 - DNA, 20 bp, Homo sapiens
ggtcaagtaagaagacatga

SEQ ID NO: 3378675 - DNA, 11 bp, Homo sapiens
ggtcaataaac

SEQ ID NO: 3378676 - DNA, 13 bp, Homo sapiens
ggtcaatcccaaa

SEQ ID NO: 3378677 - DNA, 22 bp, Homo sapiens
ggtcacaaatcctaaaagaagc

SEQ ID NO: 3378678 - DNA, 18 bp, Homo sapiens
ggtcacaggactctgcct

SEQ ID NO: 3378679 - DNA, 22 bp, Homo sapiens
ggtcaccaggggaggagcctgt

SEQ ID NO: 3378680 - DNA, 17 bp, Homo sapiens
ggtcactaaccaacaag

SEQ ID NO: 3378681 - DNA, 20 bp, Homo sapiens
ggtcactaaccaacaaggtt

SEQ ID NO: 3378682 - DNA, 17 bp, Homo sapiens
ggtcactccaccatccc

SEQ ID NO: 3378683 - DNA, 13 bp, Homo sapiens
ggtcactggctct

SEQ ID NO: 3378684 - DNA, 16 bp, Homo sapiens
ggtcactggctctcca

SEQ ID NO: 3378685 - DNA, 21 bp, Homo sapiens
ggtcagagacggcagaaaaca

SEQ ID NO: 3378686 - DNA, 13 bp, Homo sapiens
ggtcagagccact

SEQ ID NO: 3378687 - DNA, 15 bp, Homo sapiens
ggtcagagccactct

SEQ ID NO: 3378688 - DNA, 12 bp, Homo sapiens
ggtcagagcctg

SEQ ID NO: 3378689 - DNA, 16 bp, Homo sapiens
ggtcagagtgccactg

SEQ ID NO: 3378690 - DNA, 11 bp, Homo sapiens
ggtcagccatt

SEQ ID NO: 3378691 - DNA, 14 bp, Homo sapiens
ggtcagccattttt

SEQ ID NO: 3378692 - DNA, 18 bp, Homo sapiens
ggtcagccatttttaatg

SEQ ID NO: 3378693 - DNA, 18 bp, Homo sapiens
ggtcagctgttactttct

SEQ ID NO: 3378694 - DNA, 13 bp, Homo sapiens
ggtcaggccctgg

SEQ ID NO: 3378695 - DNA, 14 bp, Homo sapiens
ggtcaggccctgga

SEQ ID NO: 3378696 - DNA, 14 bp, Homo sapiens
ggtcaggctgggca

SEQ ID NO: 3378697 - DNA, 21 bp, Homo sapiens
ggtcaggctgggcagccccag

SEQ ID NO: 3378698 - DNA, 20 bp, Homo sapiens
ggtcaggttatactcctcct

SEQ ID NO: 3378699 - DNA, 17 bp, Homo sapiens
ggtcagtggaagcccca

SEQ ID NO: 3378700 - DNA, 15 bp, Homo sapiens
ggtcagtgtggagag

SEQ ID NO: 3378701 - DNA, 19 bp, Homo sapiens
ggtcagtgtggagaggggt

SEQ ID NO: 3378702 - DNA, 14 bp, Homo sapiens
ggtcatcctgcccc

SEQ ID NO: 3378703 - DNA, 14 bp, Homo sapiens
ggtcatgtttgcag

SEQ ID NO: 3378704 - DNA, 19 bp, Homo sapiens
ggtcatgtttgcaggggtg

SEQ ID NO: 3378705 - DNA, 18 bp, Homo sapiens
ggtcattgacctctcagg

SEQ ID NO: 3378706 - DNA, 22 bp, Homo sapiens
ggtcattgacctctcagggcct

SEQ ID NO: 3378707 - DNA, 23 bp, Homo sapiens
ggtcattgacctctcagggcctg

SEQ ID NO: 3378708 - DNA, 20 bp, Homo sapiens
ggtcatttcttcagtcagaa

SEQ ID NO: 3378709 - DNA, 18 bp, Homo sapiens
ggtccaaaaaaaggaaaa

SEQ ID NO: 3378710 - DNA, 20 bp, Homo sapiens
ggtccaaaaaaaggaaaaat

SEQ ID NO: 3378711 - DNA, 15 bp, Homo sapiens
ggtccaaataaaaac

SEQ ID NO: 3378712 - DNA, 18 bp, Homo sapiens
ggtccacaggtctagact

SEQ ID NO: 3378713 - DNA, 20 bp, Homo sapiens
ggtccacccaggagccccga

SEQ ID NO: 3378714 - DNA, 16 bp, Homo sapiens
ggtccaccggcccctg

SEQ ID NO: 3378715 - DNA, 17 bp, Homo sapiens
ggtccactccctgctcc

SEQ ID NO: 3378716 - DNA, 22 bp, Homo sapiens
ggtccagcctcgttggaagagg

SEQ ID NO: 3378717 - DNA, 12 bp, Homo sapiens
ggtccagctctg

SEQ ID NO: 3378718 - DNA, 13 bp, Homo sapiens
ggtccagctctga

SEQ ID NO: 3378719 - DNA, 14 bp, Homo sapiens
ggtccagctctgac

SEQ ID NO: 3378720 - DNA, 14 bp, Homo sapiens
ggtccagctctgga

SEQ ID NO: 3378721 - DNA, 11 bp, Homo sapiens
ggtccagggaa

SEQ ID NO: 3378722 - DNA, 18 bp, Homo sapiens
ggtccagtggatgccaca

SEQ ID NO: 3378723 - DNA, 16 bp, Homo sapiens
ggtccatcagcccctc

SEQ ID NO: 3378724 - DNA, 16 bp, Homo sapiens
ggtcccacctccagcc

SEQ ID NO: 3378725 - DNA, 22 bp, Homo sapiens
ggtcccacgaatttgctgggga

SEQ ID NO: 3378726 - DNA, 12 bp, Homo sapiens
ggtcccactcag

SEQ ID NO: 3378727 - DNA, 15 bp, Homo sapiens
ggtcccagccacccc

SEQ ID NO: 3378728 - DNA, 20 bp, Homo sapiens
ggtcccagtgggaggggcag

SEQ ID NO: 3378729 - DNA, 17 bp, Homo sapiens
ggtcccatccaggcagt

SEQ ID NO: 3378730 - DNA, 16 bp, Homo sapiens
ggtccccacctgggac

SEQ ID NO: 3378731 - DNA, 21 bp, Homo sapiens
ggtccccactcaccccctttg

SEQ ID NO: 3378732 - DNA, 18 bp, Homo sapiens
ggtccccatcatcccagc

SEQ ID NO: 3378733 - DNA, 22 bp, Homo sapiens
ggtccccatccccaccagctcg

SEQ ID NO: 3378734 - DNA, 23 bp, Homo sapiens
ggtccccatccccaccagctcgt

SEQ ID NO: 3378735 - DNA, 12 bp, Homo sapiens
ggtcccctccac

SEQ ID NO: 3378736 - DNA, 18 bp, Homo sapiens
ggtcccctcctcagtgac

SEQ ID NO: 3378737 - DNA, 16 bp, Homo sapiens
ggtcccctgcctggaa

SEQ ID NO: 3378738 - DNA, 21 bp, Homo sapiens
ggtccctccgcggctggagcg

SEQ ID NO: 3378739 - DNA, 13 bp, Homo sapiens
ggtccctctgagg

SEQ ID NO: 3378740 - DNA, 14 bp, Homo sapiens
ggtccctctgtgta

SEQ ID NO: 3378741 - DNA, 13 bp, Homo sapiens
ggtccctgcctta

SEQ ID NO: 3378742 - DNA, 14 bp, Homo sapiens
ggtccctgccttag

SEQ ID NO: 3378743 - DNA, 13 bp, Homo sapiens
ggtccctgggagg

SEQ ID NO: 3378744 - DNA, 23 bp, Homo sapiens
ggtccctgggaggaaatttgaat

SEQ ID NO: 3378745 - DNA, 22 bp, Homo sapiens
ggtccctgtgtgtaggctgggg

SEQ ID NO: 3378746 - DNA, 19 bp, Homo sapiens
ggtcccttgaaggaagagg

SEQ ID NO: 3378747 - DNA, 15 bp, Homo sapiens
ggtccgcaccagctg

SEQ ID NO: 3378748 - DNA, 17 bp, Homo sapiens
ggtccgcaccagctgct

SEQ ID NO: 3378749 - DNA, 13 bp, Homo sapiens
ggtccgtgggacg

SEQ ID NO: 3378750 - DNA, 22 bp, Homo sapiens
ggtcctaattaccagtctttaa

SEQ ID NO: 3378751 - DNA, 23 bp, Homo sapiens
ggtcctcacccctcgccaccttt

SEQ ID NO: 3378752 - DNA, 14 bp, Homo sapiens
ggtcctcagagaat

SEQ ID NO: 3378753 - DNA, 21 bp, Homo sapiens
ggtcctcagagaatttctacc

SEQ ID NO: 3378754 - DNA, 23 bp, Homo sapiens
ggtcctccatcccaacagccatg

SEQ ID NO: 3378755 - DNA, 15 bp, Homo sapiens
ggtcctctggagccc

SEQ ID NO: 3378756 - DNA, 22 bp, Homo sapiens
ggtcctggccagatggcccgga

SEQ ID NO: 3378757 - DNA, 12 bp, Homo sapiens
ggtcctgtggca

SEQ ID NO: 3378758 - DNA, 14 bp, Homo sapiens
ggtcctgtggcagg

SEQ ID NO: 3378759 - DNA, 21 bp, Homo sapiens
ggtcctgtggcaggcagcgcc

SEQ ID NO: 3378760 - DNA, 16 bp, Homo sapiens
ggtccttccaggcccc

SEQ ID NO: 3378761 - DNA, 23 bp, Homo sapiens
ggtcctttctggaagtttctggt

SEQ ID NO: 3378762 - DNA, 22 bp, Homo sapiens
ggtcgcttactttgagtgatcc

SEQ ID NO: 3378763 - DNA, 20 bp, Homo sapiens
ggtcggtaggttcagccaag

SEQ ID NO: 3378764 - DNA, 14 bp, Homo sapiens
ggtcgtgggccagt

SEQ ID NO: 3378765 - DNA, 13 bp, Homo sapiens
ggtctaccaggaa

SEQ ID NO: 3378766 - DNA, 14 bp, Homo sapiens
ggtctatggggaga

SEQ ID NO: 3378767 - DNA, 16 bp, Homo sapiens
ggtctatgttccccag

SEQ ID NO: 3378768 - DNA, 21 bp, Homo sapiens
ggtctcaaactcctgggctca

SEQ ID NO: 3378769 - DNA, 23 bp, Homo sapiens
ggtctcaaactcctgggctcagg

SEQ ID NO: 3378770 - DNA, 18 bp, Homo sapiens
ggtctcacagtgttgccc

SEQ ID NO: 3378771 - DNA, 22 bp, Homo sapiens
ggtctcactatgttgcccaggc

SEQ ID NO: 3378772 - DNA, 16 bp, Homo sapiens
ggtctcactctgtcgc

SEQ ID NO: 3378773 - DNA, 14 bp, Homo sapiens
ggtctcaggcctcc

SEQ ID NO: 3378774 - DNA, 15 bp, Homo sapiens
ggtctcaggttcttt

SEQ ID NO: 3378775 - DNA, 19 bp, Homo sapiens
ggtctcatgtcctgctggc

SEQ ID NO: 3378776 - DNA, 23 bp, Homo sapiens
ggtctcatgtcctgctggcttcc

SEQ ID NO: 3378777 - DNA, 19 bp, Homo sapiens
ggtctcattgcttctgact

SEQ ID NO: 3378778 - DNA, 13 bp, Homo sapiens
ggtctccaggggc

SEQ ID NO: 3378779 - DNA, 21 bp, Homo sapiens
ggtctccaggggcctgcagaa

SEQ ID NO: 3378780 - DNA, 16 bp, Homo sapiens
ggtctcccacgtggga

SEQ ID NO: 3378781 - DNA, 15 bp, Homo sapiens
ggtctccctggctcc

SEQ ID NO: 3378782 - DNA, 21 bp, Homo sapiens
ggtctcctcagggtggggggt

SEQ ID NO: 3378783 - DNA, 23 bp, Homo sapiens
ggtctccttactctgagcccagg

SEQ ID NO: 3378784 - DNA, 15 bp, Homo sapiens
ggtctcgattcgctg

SEQ ID NO: 3378785 - DNA, 14 bp, Homo sapiens
ggtctctatttcat

SEQ ID NO: 3378786 - DNA, 17 bp, Homo sapiens
ggtctcttctcccagaa

SEQ ID NO: 3378787 - DNA, 21 bp, Homo sapiens
ggtctcttgagggagcttagc

SEQ ID NO: 3378788 - DNA, 10 bp, Homo sapiens
ggtctctttt

SEQ ID NO: 3378789 - DNA, 11 bp, Homo sapiens
ggtctgaatgt

SEQ ID NO: 3378790 - DNA, 17 bp, Homo sapiens
ggtctgaatgttctgac

SEQ ID NO: 3378791 - DNA, 14 bp, Homo sapiens
ggtctgacccactg

SEQ ID NO: 3378792 - DNA, 15 bp, Homo sapiens
ggtctgacccactgc

SEQ ID NO: 3378793 - DNA, 16 bp, Homo sapiens
ggtctgacccactgct

SEQ ID NO: 3378794 - DNA, 13 bp, Homo sapiens
ggtctgagcatga

SEQ ID NO: 3378795 - DNA, 19 bp, Homo sapiens
ggtctgagtgcaagttcat

SEQ ID NO: 3378796 - DNA, 19 bp, Homo sapiens
ggtctgcaagtcagaggat

SEQ ID NO: 3378797 - DNA, 20 bp, Homo sapiens
ggtctgcaagtcagaggatg

SEQ ID NO: 3378798 - DNA, 18 bp, Homo sapiens
ggtctgctctttctctgc

SEQ ID NO: 3378799 - DNA, 16 bp, Homo sapiens
ggtctgggatatggct

SEQ ID NO: 3378800 - DNA, 20 bp, Homo sapiens
ggtctgggatatggctgccc

SEQ ID NO: 3378801 - DNA, 22 bp, Homo sapiens
ggtctgggcggcgggcggctgg

SEQ ID NO: 3378802 - DNA, 15 bp, Homo sapiens
ggtctggttgggcag

SEQ ID NO: 3378803 - DNA, 24 bp, Homo sapiens
ggtctggttgttgcaccatctgct

SEQ ID NO: 3378804 - DNA, 14 bp, Homo sapiens
ggtctgtagggatt

SEQ ID NO: 3378805 - DNA, 15 bp, Homo sapiens
ggtctgtcccaccag

SEQ ID NO: 3378806 - DNA, 24 bp, Homo sapiens
ggtctgtgagatgctagaactccc

SEQ ID NO: 3378807 - DNA, 16 bp, Homo sapiens
ggtctgtgcatttctg

SEQ ID NO: 3378808 - DNA, 21 bp, Homo sapiens
ggtctgtgctgtgcctgctag

SEQ ID NO: 3378809 - DNA, 13 bp, Homo sapiens
ggtctgtgtctct

SEQ ID NO: 3378810 - DNA, 19 bp, Homo sapiens
ggtctgtgtctcttttctc

SEQ ID NO: 3378811 - DNA, 17 bp, Homo sapiens
ggtctgtgtgaatgtgg

SEQ ID NO: 3378812 - DNA, 16 bp, Homo sapiens
ggtctgtgtgtgttct

SEQ ID NO: 3378813 - DNA, 17 bp, Homo sapiens
ggtctgttctgtttcaa

SEQ ID NO: 3378814 - DNA, 20 bp, Homo sapiens
ggtctgttggcaggctggcc

SEQ ID NO: 3378815 - DNA, 17 bp, Homo sapiens
ggtctgttttcctttct

SEQ ID NO: 3378816 - DNA, 20 bp, Homo sapiens
ggtcttaggatgtctgtaat

SEQ ID NO: 3378817 - DNA, 17 bp, Homo sapiens
ggtcttccctacctcag

SEQ ID NO: 3378818 - DNA, 20 bp, Homo sapiens
ggtcttccctacctcaggca

SEQ ID NO: 3378819 - DNA, 21 bp, Homo sapiens
ggtcttgaactcctggactca

SEQ ID NO: 3378820 - DNA, 22 bp, Homo sapiens
ggtcttgaactcctggcctcaa

SEQ ID NO: 3378821 - DNA, 23 bp, Homo sapiens
ggtcttgagccagtaatctttat

SEQ ID NO: 3378822 - DNA, 20 bp, Homo sapiens
ggtcttgggctactggcagc

SEQ ID NO: 3378823 - DNA, 21 bp, Homo sapiens
ggtcttgggctactggcagct

SEQ ID NO: 3378824 - DNA, 18 bp, Homo sapiens
ggtctttctaatgtagct

SEQ ID NO: 3378825 - DNA, 14 bp, Homo sapiens
ggtctttctctcag

SEQ ID NO: 3378826 - DNA, 12 bp, Homo sapiens
ggtctttgtaag

SEQ ID NO: 3378827 - DNA, 20 bp, Homo sapiens
ggtctttgtaagagtgtaga

SEQ ID NO: 3378828 - DNA, 15 bp, Homo sapiens
ggtcttttttcattt

SEQ ID NO: 3378829 - DNA, 17 bp, Homo sapiens
ggtcttttttcatttct

SEQ ID NO: 3378830 - DNA, 18 bp, Homo sapiens
ggtgaaccacttcattct

SEQ ID NO: 3378831 - DNA, 17 bp, Homo sapiens
ggtgaagctatttatct

SEQ ID NO: 3378832 - DNA, 15 bp, Homo sapiens
ggtgaaggatccagg

SEQ ID NO: 3378833 - DNA, 16 bp, Homo sapiens
ggtgaagggagagcca

SEQ ID NO: 3378834 - DNA, 14 bp, Homo sapiens
ggtgacaagagcct

SEQ ID NO: 3378835 - DNA, 13 bp, Homo sapiens
ggtgactgtccca

SEQ ID NO: 3378836 - DNA, 12 bp, Homo sapiens
ggtgagaaaaaa

SEQ ID NO: 3378837 - DNA, 12 bp, Homo sapiens
ggtgagagagac

SEQ ID NO: 3378838 - DNA, 16 bp, Homo sapiens
ggtgagagaggaaaga

SEQ ID NO: 3378839 - DNA, 15 bp, Homo sapiens
ggtgataagtggaaa

SEQ ID NO: 3378840 - DNA, 18 bp, Homo sapiens
ggtgataagtggaaaaaa

SEQ ID NO: 3378841 - DNA, 16 bp, Homo sapiens
ggtgatcctctatttt

SEQ ID NO: 3378842 - DNA, 19 bp, Homo sapiens
ggtgatctgtagacttctg

SEQ ID NO: 3378843 - DNA, 16 bp, Homo sapiens
ggtgcaacccttaccc

SEQ ID NO: 3378844 - DNA, 15 bp, Homo sapiens
ggtgcacagtgattt

SEQ ID NO: 3378845 - DNA, 15 bp, Homo sapiens
ggtgcagacagaagt

SEQ ID NO: 3378846 - DNA, 20 bp, Homo sapiens
ggtgcagagaagctggactt

SEQ ID NO: 3378847 - DNA, 16 bp, Homo sapiens
ggtgcagatgggctgt

SEQ ID NO: 3378848 - DNA, 15 bp, Homo sapiens
ggtgcagctcctcag

SEQ ID NO: 3378849 - DNA, 16 bp, Homo sapiens
ggtgcaggtgggcact

SEQ ID NO: 3378850 - DNA, 19 bp, Homo sapiens
ggtgcaggtgggcactgga

SEQ ID NO: 3378851 - DNA, 20 bp, Homo sapiens
ggtgcatcctcctcagcccc

SEQ ID NO: 3378852 - DNA, 19 bp, Homo sapiens
ggtgcattacagagaggag

SEQ ID NO: 3378853 - DNA, 18 bp, Homo sapiens
ggtgccactccctgagct

SEQ ID NO: 3378854 - DNA, 22 bp, Homo sapiens
ggtgccacttcttaaaggcctg

SEQ ID NO: 3378855 - DNA, 13 bp, Homo sapiens
ggtgccagcctga

SEQ ID NO: 3378856 - DNA, 17 bp, Homo sapiens
ggtgccaggttttctgg

SEQ ID NO: 3378857 - DNA, 21 bp, Homo sapiens
ggtgccaggttttctgggtgt

SEQ ID NO: 3378858 - DNA, 22 bp, Homo sapiens
ggtgcccaagccagaggctggg

SEQ ID NO: 3378859 - DNA, 19 bp, Homo sapiens
ggtgcccagaacttccctg

SEQ ID NO: 3378860 - DNA, 20 bp, Homo sapiens
ggtgccccctcctctcccat

SEQ ID NO: 3378861 - DNA, 21 bp, Homo sapiens
ggtgcccgagtgcggcgtgga

SEQ ID NO: 3378862 - DNA, 14 bp, Homo sapiens
ggtgcctccaggtg

SEQ ID NO: 3378863 - DNA, 17 bp, Homo sapiens
ggtgcctgagaggcagg

SEQ ID NO: 3378864 - DNA, 10 bp, Homo sapiens
ggtgcctggc

SEQ ID NO: 3378865 - DNA, 16 bp, Homo sapiens
ggtgcctttgagttct

SEQ ID NO: 3378866 - DNA, 17 bp, Homo sapiens
ggtgcgtggctgtggca

SEQ ID NO: 3378867 - DNA, 21 bp, Homo sapiens
ggtgcgtggctgtggcacaga

SEQ ID NO: 3378868 - DNA, 13 bp, Homo sapiens
ggtgcgtttttac

SEQ ID NO: 3378869 - DNA, 16 bp, Homo sapiens
ggtgcgtttttacagt

SEQ ID NO: 3378870 - DNA, 22 bp, Homo sapiens
ggtgctagcttgacacagtcag

SEQ ID NO: 3378871 - DNA, 14 bp, Homo sapiens
ggtgctatttgaag

SEQ ID NO: 3378872 - DNA, 10 bp, Homo sapiens
ggtgctctgg

SEQ ID NO: 3378873 - DNA, 12 bp, Homo sapiens
ggtgctctggcg

SEQ ID NO: 3378874 - DNA, 22 bp, Homo sapiens
ggtgctgatggagggaggggga

SEQ ID NO: 3378875 - DNA, 12 bp, Homo sapiens
ggtgctgcagga

SEQ ID NO: 3378876 - DNA, 14 bp, Homo sapiens
ggtgctgcaggagt

SEQ ID NO: 3378877 - DNA, 12 bp, Homo sapiens
ggtgctgccctg
